United States Patent 11,332,783 (SAMPLE ANALYSIS, PRESENCE DETERMINATION OF A TARGET SEQUENCE) - sequence listing, part 19

SEQ ID NO: 378266 - DNA, 140 bp, Artificial Sequence
  Synthetic
caccgctgtcccaaaaggtcagacccagttgggatttagaaaatttccttgttaatacggcacaaagggttaaaagagctctaagtttagagtcctcaatttgccttaggtctctggttgcatatcagcagccagggcct

SEQ ID NO: 378267 - DNA, 140 bp, Artificial Sequence
  Synthetic
atacgccatgctgggtctccgttagtaagttcttttatagaagtcattagcttctaaggtgattatattttagtattaaattttgttaattgcttgctataaagttgaaatgtctaatgccgtacttgggagtcggccat

SEQ ID NO: 378268 - DNA, 140 bp, Artificial Sequence
  Synthetic
atggccgactcccaagtacggcattagacatttcaactttatagcaagcaattaacaaaatttaatactaaaatataatcaccttagaagctaatgacttctataaaagaacttactaacggagacccagcatggcgtat

SEQ ID NO: 378269 - DNA, 140 bp, Artificial Sequence
  Synthetic
atacgccatgctgggtctccctacacacacaatcattataactcgtacaaatatgggttttctcgtggaagttcaggagcctgacaaatcagctatgaattctaagcgcccaggaccagtcgtacttgggagtcggccat

SEQ ID NO: 378270 - DNA, 140 bp, Artificial Sequence
  Synthetic
atggccgactcccaagtacgactggtcctgggcgcttagaattcatagctgatttgtcaggctcctgaacttccacgagaaaacccatatttgtacgagttataatgattgtgtgtgtagggagacccagcatggcgtat

SEQ ID NO: 378271 - DNA, 140 bp, Artificial Sequence
  Synthetic
atacgccatgctgggtctcccacaatctgggatgcaatcattaataatggagttcaacagtttgttggcaatttaacaaggtgatcttaaaataagtacatgaatgagaattagttgtggcgtacttgggagtcggccat

SEQ ID NO: 378272 - DNA, 140 bp, Artificial Sequence
  Synthetic
atggccgactcccaagtacgccacaactaattctcattcatgtacttattttaagatcaccttgttaaattgccaacaaactgttgaactccattattaatgattgcatcccagattgtgggagacccagcatggcgtat

SEQ ID NO: 378273 - DNA, 140 bp, Artificial Sequence
  Synthetic
atacgccatgctgggtctccgggccacagctgttgaacagacatgttgggatgcagtctttgaacccaatgtgctaggttacaatcctccaaacaaattctccactaaaagggtgccggacgtacttgggagtcggccat

SEQ ID NO: 378274 - DNA, 140 bp, Artificial Sequence
  Synthetic
atggccgactcccaagtacgtccggcacccttttagtggagaatttgtttggaggattgtaacctagcacattgggttcaaagactgcatcccaacatgtctgttcaacagctgtggcccggagacccagcatggcgtat

SEQ ID NO: 378275 - DNA, 140 bp, Artificial Sequence
  Synthetic
aggccctggctgctgatatggaagtcctgcaaatgacaccatcacattattcaggaaatattgtccatcgatataacgaccaatatagcccgcactcatttatggcgaatcgcatgagcagaccttttgggacagcggtg

SEQ ID NO: 378276 - DNA, 140 bp, Artificial Sequence
  Synthetic
caccgctgtcccaaaaggtctgctcatgcgattcgccataaatgagtgcgggctatattggtcgttatatcgatggacaatatttcctgaataatgtgatggtgtcatttgcaggacttccatatcagcagccagggcct

SEQ ID NO: 378277 - DNA, 140 bp, Artificial Sequence
  Synthetic
atacgccatgctgggtctccgtcccgattaatggaaattgattccaacttctcaatttatattggcgggacatctggagatcgagggctgtctgatgctgctcgactgtttcttcggacacgtacttgggagtcggccat

SEQ ID NO: 378278 - DNA, 140 bp, Artificial Sequence
  Synthetic
atggccgactcccaagtacgtgtccgaagaaacagtcgagcagcatcagacagccctcgatctccagatgtcccgccaatataaattgagaagttggaatcaatttccattaatcgggacggagacccagcatggcgtat

SEQ ID NO: 378279 - DNA, 140 bp, Artificial Sequence
  Synthetic
atacgccatgctgggtctcctttttgaacacattggcaacagaacacagtatagagtcagaagttgtatcaggtttttctactccgagaatgttgttaccaataatgcaaaaggttcatgcgtacttgggagtcggccat

SEQ ID NO: 378280 - DNA, 140 bp, Artificial Sequence
  Synthetic
atggccgactcccaagtacgcatgaaccttttgcattattggtaacaacattctcggagtagaaaaacctgatacaacttctgactctatactgtgttctgttgccaatgtgttcaaaaaggagacccagcatggcgtat

SEQ ID NO: 378281 - DNA, 140 bp, Artificial Sequence
  Synthetic
atacgccatgctgggtctccataactagctcaatgtggttaagtaatcaaaaatataatctaccttgtcaagttgaaatcattacgatggatgctgaaacaacagagaacttaaacaggtcgtacttgggagtcggccat

SEQ ID NO: 378282 - DNA, 140 bp, Artificial Sequence
  Synthetic
atggccgactcccaagtacgacctgtttaagttctctgttgtttcagcatccatcgtaatgatttcaacttgacaaggtagattatatttttgattacttaaccacattgagctagttatggagacccagcatggcgtat

SEQ ID NO: 378283 - DNA, 140 bp, Artificial Sequence
  Synthetic
atacgccatgctgggtctcctatccagaagggttaatatattccaatcacacataggtactaaatcatcatagtatgaggaataaaataatgataattcctgacgacagttttagttccgcgtacttgggagtcggccat

SEQ ID NO: 378284 - DNA, 140 bp, Artificial Sequence
  Synthetic
atggccgactcccaagtacgcggaactaaaactgtcgtcaggaattatcattattttattcctcatactatgatgatttagtacctatgtgtgattggaatatattaacccttctggataggagacccagcatggcgtat

SEQ ID NO: 378285 - DNA, 140 bp, Artificial Sequence
  Synthetic
aggccctggctgctgatatgtggaagatcattccaaacgtacaaacatgcacaagatgttatggtttagcaaagaattgataggagtactggtatataatgtaaatataacaagtgatgagaccttttgggacagcggtg

SEQ ID NO: 378286 - DNA, 140 bp, Artificial Sequence
  Synthetic
caccgctgtcccaaaaggtctcatcacttgttatatttacattatataccagtactcctatcaattctttgctaaaccataacatcttgtgcatgtttgtacgtttggaatgatcttccacatatcagcagccagggcct

SEQ ID NO: 378287 - DNA, 140 bp, Artificial Sequence
  Synthetic
atacgccatgctgggtctcccctgatgagagagagtcgcactcaaacgtaccattttattaagactgcaaaaggcagaatcacaaagttagtcaatgactttctgaagttttctttaattcgtacttgggagtcggccat

SEQ ID NO: 378288 - DNA, 140 bp, Artificial Sequence
  Synthetic
atggccgactcccaagtacgaattaaagaaaacttcagaaagtcattgactaactttgtgattctgccttttgcagtcttaataaaatggtacgtttgagtgcgactctctctcatcaggggagacccagcatggcgtat

SEQ ID NO: 378289 - DNA, 140 bp, Artificial Sequence
  Synthetic
aggccctggctgctgatatgaaggcagaatcacaaagttagtcaatgactttctgaagttttctttaattgtccaggcactcaaaaataattcttcctggtatactgagcttaaaaaattgaccttttgggacagcggtg

SEQ ID NO: 378290 - DNA, 140 bp, Artificial Sequence
  Synthetic
caccgctgtcccaaaaggtcaattttttaagctcagtataccaggaagaattatttttgagtgcctggacaattaaagaaaacttcagaaagtcattgactaactttgtgattctgccttcatatcagcagccagggcct

SEQ ID NO: 378291 - DNA, 140 bp, Artificial Sequence
  Synthetic
atacgccatgctgggtctcccggacacacaaaaagaaaaaaggttttttaagattttttgtgtgcgagtaactatgaggaagattaacagttctcctcagtttaagatatacactgaaatcgtacttgggagtcggccat

SEQ ID NO: 378292 - DNA, 140 bp, Artificial Sequence
  Synthetic
atggccgactcccaagtacgatttcagtgtatatcttaaactgaggagaactgttaatcttcctcatagttactcgcacacaaaaaatcttaaaaaaccttttttctttttgtgtgtccgggagacccagcatggcgtat

SEQ ID NO: 378293 - DNA, 140 bp, Artificial Sequence
  Synthetic
aggccctggctgctgatatgactatgaggaagattaacagttctcctcagtttaagatatacactgaaattgagattgagattctcctctttgctattctgtcactttccctggttgtgagaccttttgggacagcggtg

SEQ ID NO: 378294 - DNA, 140 bp, Artificial Sequence
  Synthetic
caccgctgtcccaaaaggtctcacaaccagggaaagtgacagaatagcaaagaggagaatctcaatctcaatttcagtgtatatcttaaactgaggagaactgttaatcttcctcatagtcatatcagcagccagggcct

SEQ ID NO: 378295 - DNA, 140 bp, Artificial Sequence
  Synthetic
atacgccatgctgggtctcccgattgagccagttttatctattaccaattaccgtcaacatggtatgtctagtggtcttgggactcttcttcatctggtgtttcctagagctctgaatcgcgtacttgggagtcggccat

SEQ ID NO: 378296 - DNA, 140 bp, Artificial Sequence
  Synthetic
atggccgactcccaagtacgcgattcagagctctaggaaacaccagatgaagaagagtcccaagaccactagacataccatgttgacggtaattggtaatagataaaactggctcaatcgggagacccagcatggcgtat

SEQ ID NO: 378297 - DNA, 140 bp, Artificial Sequence
  Synthetic
atacgccatgctgggtctccaaggaaacaatttgttccaataatatcatacatcttgactaagtcgaacaaggggaattcgatatggatcgtgggaccagaagaatctgggtgtcgcagacgtacttgggagtcggccat

SEQ ID NO: 378298 - DNA, 140 bp, Artificial Sequence
  Synthetic
atggccgactcccaagtacgtctgcgacacccagattcttctggtcccacgatccatatcgaattccccttgttcgacttagtcaagatgtatgatattattggaacaaattgtttccttggagacccagcatggcgtat

SEQ ID NO: 378299 - DNA, 140 bp, Artificial Sequence
  Synthetic
atacgccatgctgggtctcctgtcaagaccgttcttgatcatattctgcaaaaaaccgaccaaggagtaagacttcaccctttggcccgaacagccaaagtacgcaatgaggttaatgcacgtacttgggagtcggccat

SEQ ID NO: 378300 - DNA, 140 bp, Artificial Sequence
  Synthetic
atggccgactcccaagtacgtgcattaacctcattgcgtactttggctgttcgggccaaagggtgaagtcttactccttggtcggttttttgcagaatatgatcaagaacggtcttgacaggagacccagcatggcgtat

SEQ ID NO: 378301 - DNA, 140 bp, Artificial Sequence
  Synthetic
atacgccatgctgggtctcccaagacctaacctcgggtctagacaagatgacgacaatgaaataccgttccttgggcctataaacaacaacccagaccgagatcatctggaggatgatcccgtacttgggagtcggccat

SEQ ID NO: 378302 - DNA, 140 bp, Artificial Sequence
  Synthetic
atggccgactcccaagtacgggatcatcctccagatgatctcggtctgggttgttgtttataggcccaaggaacggtatttcattgtcgtcatcttgtctagacccgaggttaggtcttgggagacccagcatggcgtat

SEQ ID NO: 378303 - DNA, 140 bp, Artificial Sequence
  Synthetic
atacgccatgctgggtctccgagaaagattaattcatccacccccgagcaacaacaaggacgacaatcgggtctcagccaacaatcaacaatcagcaagttttgaggaacaagaagatcacgtacttgggagtcggccat

SEQ ID NO: 378304 - DNA, 140 bp, Artificial Sequence
  Synthetic
atggccgactcccaagtacgtgatcttcttgttcctcaaaacttgctgattgttgattgttggctgagacccgattgtcgtccttgttgttgctcgggggtggatgaattaatctttctcggagacccagcatggcgtat

SEQ ID NO: 378305 - DNA, 140 bp, Artificial Sequence
  Synthetic
aggccctggctgctgatatggtctcagccaacaatcaacaatcagcaagttttgaggaacaagaagatcaatacaacaggcaccgaggcccagaacgtacgaccgcccatcgaagactctgaccttttgggacagcggtg

SEQ ID NO: 378306 - DNA, 140 bp, Artificial Sequence
  Synthetic
caccgctgtcccaaaaggtcagagtcttcgatgggcggtcgtacgttctgggcctcggtgcctgttgtattgatcttcttgttcctcaaaacttgctgattgttgattgttggctgagaccatatcagcagccagggcct

SEQ ID NO: 378307 - DNA, 140 bp, Artificial Sequence
  Synthetic
aggccctggctgctgatatgacaagatcccgattatacagctgttgcccctcctgctcctgtataccgcagtgcagaagcccacgagcctcctcataactcctcgaacgagccagctgaagaccttttgggacagcggtg

SEQ ID NO: 378308 - DNA, 140 bp, Artificial Sequence
  Synthetic
caccgctgtcccaaaaggtcttcagctggctcgttcgaggagttatgaggaggctcgtgggcttctgcactgcggtatacaggagcaggaggggcaacagctgtataatcgggatcttgtcatatcagcagccagggcct

SEQ ID NO: 378309 - DNA, 140 bp, Artificial Sequence
  Synthetic
atacgccatgctgggtctccaaaattagaagagacatatcaccatctgctgaggactcaaggtccatttgaggccatcagttattatcacatgatgaaggatgagccggtaatatttagccgtacttgggagtcggccat

SEQ ID NO: 378310 - DNA, 140 bp, Artificial Sequence
  Synthetic
atggccgactcccaagtacggctaaatattaccggctcatccttcatcatgtgataataactgatggcctcaaatggaccttgagtcctcagcagatggtgatatgtctcttctaattttggagacccagcatggcgtat

SEQ ID NO: 378311 - DNA, 140 bp, Artificial Sequence
  Synthetic
aggccctggctgctgatatgaggccatcagttattatcacatgatgaaggatgagccggtaatatttagcactaatgatgggaaggaatacacctacccggattcacttgaggaagcctagaccttttgggacagcggtg

SEQ ID NO: 378312 - DNA, 140 bp, Artificial Sequence
  Synthetic
caccgctgtcccaaaaggtctaggcttcctcaagtgaatccgggtaggtgtattccttcccatcattagtgctaaatattaccggctcatccttcatcatgtgataataactgatggcctcatatcagcagccagggcct

SEQ ID NO: 378313 - DNA, 140 bp, Artificial Sequence
  Synthetic
atacgccatgctgggtctcctttacataaataatcaacagttcttctggcctgtaatgagcttcagagacaaatttcttgcaatcttgcagcaccatcagtgaccacagcacaaagcgcgcgtacttgggagtcggccat

SEQ ID NO: 378314 - DNA, 140 bp, Artificial Sequence
  Synthetic
atggccgactcccaagtacgcgcgctttgtgctgtggtcactgatggtgctgcaagattgcaagaaatttgtctctgaagctcattacaggccagaagaactgttgattatttatgtaaaggagacccagcatggcgtat

SEQ ID NO: 378315 - DNA, 140 bp, Artificial Sequence
  Synthetic
aggccctggctgctgatatgaaatttcttgcaatcttgcagcaccatcagtgaccacagcacaaagcgcggtccacttcgtaaagctaaatacactcaagacttgaccgactcatctacagaccttttgggacagcggtg

SEQ ID NO: 378316 - DNA, 140 bp, Artificial Sequence
  Synthetic
caccgctgtcccaaaaggtctgtagatgagtcggtcaagtcttgagtgtatttagctttacgaagtggaccgcgctttgtgctgtggtcactgatggtgctgcaagattgcaagaaatttcatatcagcagccagggcct

SEQ ID NO: 378317 - DNA, 140 bp, Artificial Sequence
  Synthetic
atacgccatgctgggtctcctgatttaaggccattaagagtttaaataatatacatatacacttacaccggtctatccaagatgtggctcaatgttcttaatttgaacatagtcataaggcgtacttgggagtcggccat

SEQ ID NO: 378318 - DNA, 140 bp, Artificial Sequence
  Synthetic
atggccgactcccaagtacgccttatgactatgttcaaattaagaacattgagccacatcttggatagaccggtgtaagtgtatatgtatattatttaaactcttaatggccttaaatcaggagacccagcatggcgtat

SEQ ID NO: 378319 - DNA, 140 bp, Artificial Sequence
  Synthetic
aggccctggctgctgatatggtctatccaagatgtggctcaatgttcttaatttgaacatagtcataaggaaataaatgatactttctgtttctgattgtagattgactcattctgcttagaccttttgggacagcggtg

SEQ ID NO: 378320 - DNA, 140 bp, Artificial Sequence
  Synthetic
caccgctgtcccaaaaggtctaagcagaatgagtcaatctacaatcagaaacagaaagtatcatttatttccttatgactatgttcaaattaagaacattgagccacatcttggatagaccatatcagcagccagggcct

SEQ ID NO: 378321 - DNA, 140 bp, Artificial Sequence
  Synthetic
  misc_feature (55)..(55): n is a, c, g, or t
atacgccatgctgggtctccatcagcaaggagctcaacaagaacttgtacaagtngcagtcagacggaggtcaactatgtacctctccttaaaaaggttgaggatacattaactatgctacgtacttgggagtcggccat

SEQ ID NO: 378322 - DNA, 140 bp, Artificial Sequence
  Synthetic
  misc_feature (86)..(86): n is a, c, g, or t
atggccgactcccaagtacgtagcatagttaatgtatcctcaacctttttaaggagaggtacatagttgacctccgtctgactgcnacttgtacaagttcttgttgagctccttgctgatggagacccagcatggcgtat

SEQ ID NO: 378323 - DNA, 140 bp, Artificial Sequence
  Synthetic
atacgccatgctgggtctcctgcgtattggaaagagcacaaacagccaccaccagggccagcactgtacgaagagaatgcgcttaaaggaaaaattgatgatccaaacagctatgtaccacgtacttgggagtcggccat

SEQ ID NO: 378324 - DNA, 140 bp, Artificial Sequence
  Synthetic
atggccgactcccaagtacgtggtacatagctgtttggatcatcaatttttcctttaagcgcattctcttcgtacagtgctggccctggtggtggctgtttgtgctctttccaatacgcaggagacccagcatggcgtat

SEQ ID NO: 378325 - DNA, 140 bp, Artificial Sequence
  Synthetic
aggccctggctgctgatatgaagagaatgcgcttaaaggaaaaattgatgatccaaacagctatgtaccagatgctgtgcaggaggcttacaagaatcttgacagtacatcgaccctgacgaccttttgggacagcggtg

SEQ ID NO: 378326 - DNA, 140 bp, Artificial Sequence
  Synthetic
caccgctgtcccaaaaggtcgtcagggtcgatgtactgtcaagattcttgtaagcctcctgcacagcatctggtacatagctgtttggatcatcaatttttcctttaagcgcattctcttcatatcagcagccagggcct

SEQ ID NO: 378327 - DNA, 140 bp, Artificial Sequence
  Synthetic
atacgccatgctgggtctcccctccgaccagcaccaccatcacccaaaattgatcgtggttgggtttgtttgtttaagatgcaagatggtaaaacgctaggacttaagatctaagaatcgcgtacttgggagtcggccat

SEQ ID NO: 378328 - DNA, 140 bp, Artificial Sequence
  Synthetic
atggccgactcccaagtacgcgattcttagatcttaagtcctagcgttttaccatcttgcatcttaaacaaacaaacccaaccacgatcaattttgggtgatggtggtgctggtcggaggggagacccagcatggcgtat

SEQ ID NO: 378329 - DNA, 140 bp, Artificial Sequence
  Synthetic
aggccctggctgctgatatgtgtttaagatgcaagatggtaaaacgctaggacttaagatctaagaatcgagatttatttaacaagacaagccacaaccttagatgaagccccagccagagaccttttgggacagcggtg

SEQ ID NO: 378330 - DNA, 140 bp, Artificial Sequence
  Synthetic
caccgctgtcccaaaaggtctctggctggggcttcatctaaggttgtggcttgtcttgttaaataaatctcgattcttagatcttaagtcctagcgttttaccatcttgcatcttaaacacatatcagcagccagggcct

SEQ ID NO: 378331 - DNA, 140 bp, Artificial Sequence
  Synthetic
atacgccatgctgggtctccagattaagaaaaaccagtctgtattttccagacttggcatttcttatcttcatcttcgaaagtgagatattttatcatcaaaaaatgaagcgcggagtgtcgtacttgggagtcggccat

SEQ ID NO: 378332 - DNA, 140 bp, Artificial Sequence
  Synthetic
atggccgactcccaagtacgacactccgcgcttcattttttgatgataaaatatctcactttcgaagatgaagataagaaatgccaagtctggaaaatacagactggtttttcttaatctggagacccagcatggcgtat

SEQ ID NO: 378333 - DNA, 140 bp, Artificial Sequence
  Synthetic
atacgccatgctgggtctccacagctttaattcaacaacagccgcaattatgttagcttcctacacagtgacacacttcgggaagatatctaacccgctggtacgtgtcaacaggctaggcgtacttgggagtcggccat

SEQ ID NO: 378334 - DNA, 140 bp, Artificial Sequence
  Synthetic
atggccgactcccaagtacgcctagcctgttgacacgtaccagcgggttagatatcttcccgaagtgtgtcactgtgtaggaagctaacataattgcggctgttgttgaattaaagctgtggagacccagcatggcgtat

SEQ ID NO: 378335 - DNA, 140 bp, Artificial Sequence
  Synthetic
aggccctggctgctgatatgacacacttcgggaagatatctaacccgctggtacgtgtcaacaggctaggtccaggaatacccgatcatccgctgcgactcctaaagttgggcaatcagggaccttttgggacagcggtg

SEQ ID NO: 378336 - DNA, 140 bp, Artificial Sequence
  Synthetic
caccgctgtcccaaaaggtccctgattgcccaactttaggagtcgcagcggatgatcgggtattcctggacctagcctgttgacacgtaccagcgggttagatatcttcccgaagtgtgtcatatcagcagccagggcct

SEQ ID NO: 378337 - DNA, 140 bp, Artificial Sequence
  Synthetic
atacgccatgctgggtctccacatttgatctaacagctctaaagctcatcactcaaccattgccagctgcaacctggacagacgaaactcctgcaggagcagtcaatgttcttcgtcctgcgtacttgggagtcggccat

SEQ ID NO: 378338 - DNA, 140 bp, Artificial Sequence
  Synthetic
atggccgactcccaagtacgcaggacgaagaacattgactgctcctgcaggagtttcgtctgtccaggttgcagctggcaatggttgagtgatgagctttagagctgttagatcaaatgtggagacccagcatggcgtat

SEQ ID NO: 378339 - DNA, 140 bp, Artificial Sequence
  Synthetic
aggccctggctgctgatatgaacctggacagacgaaactcctgcaggagcagtcaatgttcttcgtcctggactctcactccatcccaagcttcgtccaattcttctgccggggaagatagaccttttgggacagcggtg

SEQ ID NO: 378340 - DNA, 140 bp, Artificial Sequence
  Synthetic
caccgctgtcccaaaaggtctatcttccccggcagaagaattggacgaagcttgggatggagtgagagtccaggacgaagaacattgactgctcctgcaggagtttcgtctgtccaggttcatatcagcagccagggcct

SEQ ID NO: 378341 - DNA, 140 bp, Artificial Sequence
  Synthetic
atacgccatgctgggtctccaatcatgaatgccataccggacctcaaaattgtcccgattgatcctaccaagaacatagttggaattgaggttccagaattactggttcaaaggttgacccgtacttgggagtcggccat

SEQ ID NO: 378342 - DNA, 140 bp, Artificial Sequence
  Synthetic
atggccgactcccaagtacgggtcaacctttgaaccagtaattctggaacctcaattccaactatgttcttggtaggatcaatcgggacaattttgaggtccggtatggcattcatgattggagacccagcatggcgtat

SEQ ID NO: 378343 - DNA, 140 bp, Artificial Sequence
  Synthetic
aggccctggctgctgatatgagaacatagttggaattgaggttccagaattactggttcaaaggttgaccggcaaaaaaccacaaccccaaaatggccaaccaattattccagttcttctgaccttttgggacagcggtg

SEQ ID NO: 378344 - DNA, 140 bp, Artificial Sequence
  Synthetic
caccgctgtcccaaaaggtcagaagaactggaataattggttggccattttggggttgtggttttttgccggtcaacctttgaaccagtaattctggaacctcaattccaactatgttctcatatcagcagccagggcct

SEQ ID NO: 378345 - DNA, 140 bp, Artificial Sequence
  Synthetic
atacgccatgctgggtctccttatcacccaggattgtgattcatgccactctccagccagttatccgtatcacatggacaagcagaatagttactaataatttaaattccattcgagctacgtacttgggagtcggccat

SEQ ID NO: 378346 - DNA, 140 bp, Artificial Sequence
  Synthetic
atggccgactcccaagtacgtagctcgaatggaatttaaattattagtaactattctgcttgtccatgtgatacggataactggctggagagtggcatgaatcacaatcctgggtgataaggagacccagcatggcgtat

SEQ ID NO: 378347 - DNA, 140 bp, Artificial Sequence
  Synthetic
aggccctggctgctgatatgcacatggacaagcagaatagttactaataatttaaattccattcgagctattattctgctagtaatcccaacgggctcaatagactaaaaatctgattgtgaccttttgggacagcggtg

SEQ ID NO: 378348 - DNA, 140 bp, Artificial Sequence
  Synthetic
caccgctgtcccaaaaggtcacaatcagatttttagtctattgagcccgttgggattactagcagaataatagctcgaatggaatttaaattattagtaactattctgcttgtccatgtgcatatcagcagccagggcct

SEQ ID NO: 378349 - DNA, 140 bp, Artificial Sequence
  Synthetic
atacgccatgctgggtctcctagataactaatattaaggagttttttaatctaattttccagtcttaagtaataatcatttcttttgtaattaattatgcatttgttaacttatcgatgtcgtacttgggagtcggccat

SEQ ID NO: 378350 - DNA, 140 bp, Artificial Sequence
  Synthetic
atggccgactcccaagtacgacatcgataagttaacaaatgcataattaattacaaaagaaatgattattacttaagactggaaaattagattaaaaaactccttaatattagttatctaggagacccagcatggcgtat

SEQ ID NO: 378351 - DNA, 140 bp, Artificial Sequence
  Synthetic
aggccctggctgctgatatgaataatcatttcttttgtaattaattatgcatttgttaacttatcgatgtgagatttccttgggaacccggcggggcccctactatccgcagtaaccagagaccttttgggacagcggtg

SEQ ID NO: 378352 - DNA, 140 bp, Artificial Sequence
  Synthetic
caccgctgtcccaaaaggtctctggttactgcggatagtaggggccccgccgggttcccaaggaaatctcacatcgataagttaacaaatgcataattaattacaaaagaaatgattattcatatcagcagccagggcct

SEQ ID NO: 378353 - DNA, 140 bp, Artificial Sequence
  Synthetic
atacgccatgctgggtctcctataatctattctaaccagaggcataacaatggctaatatttcaatgactcgttaacaatcgttagcaattttaatctccagattaagaaaaagatataccgtacttgggagtcggccat

SEQ ID NO: 378354 - DNA, 140 bp, Artificial Sequence
  Synthetic
atggccgactcccaagtacggtatatctttttcttaatctggagattaaaattgctaacgattgttaacgagtcattgaaatattagccattgttatgcctctggttagaatagattataggagacccagcatggcgtat

SEQ ID NO: 378355 - DNA, 140 bp, Artificial Sequence
  Synthetic
aggccctggctgctgatatgcgttaacaatcgttagcaattttaatctccagattaagaaaaagatatacgatgaagattaaggcaataacgagccgaaacttcatctttcttaaagatcgaccttttgggacagcggtg

SEQ ID NO: 378356 - DNA, 140 bp, Artificial Sequence
  Synthetic
caccgctgtcccaaaaggtcgatctttaagaaagatgaagtttcggctcgttattgccttaatcttcatcgtatatctttttcttaatctggagattaaaattgctaacgattgttaacgcatatcagcagccagggcct

SEQ ID NO: 378357 - DNA, 140 bp, Artificial Sequence
  Synthetic
atacgccatgctgggtctccgtaagctgctatttcttaccttcccgaattacctatacaacatggggtcaggatatcaacttctccaattgcctcagggatgttttcgtaaaacttcgttcgtacttgggagtcggccat

SEQ ID NO: 378358 - DNA, 140 bp, Artificial Sequence
  Synthetic
atggccgactcccaagtacgaacgaagttttacgaaaacatccctgaggcaattggagaagttgatatcctgaccccatgttgtataggtaattcgggaaggtaagaaatagcagcttacggagacccagcatggcgtat

SEQ ID NO: 378359 - DNA, 140 bp, Artificial Sequence
  Synthetic
aggccctggctgctgatatgggatatcaacttctccaattgcctcagggatgttttcgtaaaacttcgttctttgtatgggtaatcatcctcttccagcgagcaatctctatgccgcttggaccttttgggacagcggtg

SEQ ID NO: 378360 - DNA, 140 bp, Artificial Sequence
  Synthetic
caccgctgtcccaaaaggtccaagcggcatagagattgctcgctggaagaggatgattacccatacaaagaacgaagttttacgaaaacatccctgaggcaattggagaagttgatatcccatatcagcagccagggcct

SEQ ID NO: 378361 - DNA, 140 bp, Artificial Sequence
  Synthetic
atacgccatgctgggtctcctgtcgggacaaactgtcatcaactagtcagctcaagtctgtggggctgaatttggaaggaaatggaattgcaaccgatgttctatcagcaacaaaacgctcgtacttgggagtcggccat

SEQ ID NO: 378362 - DNA, 140 bp, Artificial Sequence
  Synthetic
atggccgactcccaagtacgagcgttttgttgctgatagaacatcggttgcaattccatttccttccaaattcagccccacagacttgagctgactagttgatgacagtttgtcccgacaggagacccagcatggcgtat

SEQ ID NO: 378363 - DNA, 140 bp, Artificial Sequence
  Synthetic
atacgccatgctgggtctccggggatttcgttcaggtgtgccccccaaggtggtcagctatgaagccggagaatgggcagaaaattgctacaatctggagatcaaaaagttggacggaagcgtacttgggagtcggccat

SEQ ID NO: 378364 - DNA, 140 bp, Artificial Sequence
  Synthetic
atggccgactcccaagtacgcttccgtccaactttttgatctccagattgtagcaattttctgcccattctccggcttcatagctgaccaccttggggggcacacctgaacgaaatccccggagacccagcatggcgtat

SEQ ID NO: 378365 - DNA, 140 bp, Artificial Sequence
  Synthetic
atacgccatgctgggtctccatgaacacaacagatgattccacaggccactatatgaccctgacactcagctacgaggtgtcaaattttgggggcaatgaaagtaacacccttttaaaggcgtacttgggagtcggccat

SEQ ID NO: 378366 - DNA, 140 bp, Artificial Sequence
  Synthetic
atggccgactcccaagtacgcctttaaaagggtgttactttcattgcccccaaaatttgacacctcgtagctgagtgtcagggtcatatagtggcctgtggaatcatctgttgtgttcatggagacccagcatggcgtat

SEQ ID NO: 378367 - DNA, 140 bp, Artificial Sequence
  Synthetic
aggccctggctgctgatatgctacgaggtgtcaaattttgggggcaatgaaagtaacacccttttaaaggtagacaaccacacatatgtgcaactagatcgtccacacactccgcagttcgaccttttgggacagcggtg

SEQ ID NO: 378368 - DNA, 140 bp, Artificial Sequence
  Synthetic
caccgctgtcccaaaaggtcgaactgcggagtgtgtggacgatctagttgcacatatgtgtggttgtctacctttaaaagggtgttactttcattgcccccaaaatttgacacctcgtagcatatcagcagccagggcct

SEQ ID NO: 378369 - DNA, 140 bp, Artificial Sequence
  Synthetic
atacgccatgctgggtctcctacagggagattgatttggatattggatcctgagattgaacccgatgttgatgagtgggccttctgggaaactaaaaaaacttttcccaacaacttcatgcgtacttgggagtcggccat

SEQ ID NO: 378370 - DNA, 140 bp, Artificial Sequence
  Synthetic
atggccgactcccaagtacgcatgaagttgttgggaaaagtttttttagtttcccagaaggcccactcatcaacatcgggttcaatctcaggatccaatatccaaatcaatctccctgtaggagacccagcatggcgtat

SEQ ID NO: 378371 - DNA, 140 bp, Artificial Sequence
  Synthetic
aggccctggctgctgatatgatgagtgggccttctgggaaactaaaaaaacttttcccaacaacttcatggagaaaacttgcatttacaaattctatcaacccacaacaacaactcctcagaccttttgggacagcggtg

SEQ ID NO: 378372 - DNA, 140 bp, Artificial Sequence
  Synthetic
caccgctgtcccaaaaggtctgaggagttgttgttgtgggttgatagaatttgtaaatgcaagttttctccatgaagttgttgggaaaagtttttttagtttcccagaaggcccactcatcatatcagcagccagggcct

SEQ ID NO: 378373 - DNA, 140 bp, Artificial Sequence
  Synthetic
atacgccatgctgggtctcccaccaacaactccgagctggttccaacggatccccctccagtggtttcagtgctcactgcaggacggacagaggaaatgtcgacccaaggtctaaccaaccgtacttgggagtcggccat

SEQ ID NO: 378374 - DNA, 140 bp, Artificial Sequence
  Synthetic
atggccgactcccaagtacggttggttagaccttgggtcgacatttcctctgtccgtcctgcagtgagcactgaaaccactggagggggatccgttggaaccagctcggagttgttggtgggagacccagcatggcgtat

SEQ ID NO: 378375 - DNA, 140 bp, Artificial Sequence
  Synthetic
aggccctggctgctgatatgtgctcactgcaggacggacagaggaaatgtcgacccaaggtctaaccaacggagagacactcacaggtttcaccgcgaccccagtgacaaccaccattgcgaccttttgggacagcggtg

SEQ ID NO: 378376 - DNA, 140 bp, Artificial Sequence
  Synthetic
caccgctgtcccaaaaggtcgcaatggtggttgtcactggggtcgcggtgaaacctgtgagtgtctctccgttggttagaccttgggtcgacatttcctctgtccgtcctgcagtgagcacatatcagcagccagggcct

SEQ ID NO: 378377 - DNA, 140 bp, Artificial Sequence
  Synthetic
atacgccatgctgggtctccagccgaacaacacagaatccattgaatactcccccccatcggtgagcaacgagacaactgaccaccccgagatgaacttgatccaaggcccgaacaactccgtacttgggagtcggccat

SEQ ID NO: 378378 - DNA, 140 bp, Artificial Sequence
  Synthetic
atggccgactcccaagtacggagttgttcgggccttggatcaagttcatctcggggtggtcagttgtctcgttgctcaccgatgggggggagtattcaatggattctgtgttgttcggctggagacccagcatggcgtat

SEQ ID NO: 378379 - DNA, 140 bp, Artificial Sequence
  Synthetic
atacgccatgctgggtctcctgacccaggacccgcaagcgacggtcaacagcagcaaatcaggaaccagcccaggaagtgcagccgaaccaagtcagcccggactcatcataaatacagtcgtacttgggagtcggccat

SEQ ID NO: 378380 - DNA, 140 bp, Artificial Sequence
  Synthetic
atggccgactcccaagtacgactgtatttatgatgagtccgggctgacttggttcggctgcacttcctgggctggttcctgatttgctgctgttgaccgtcgcttgcgggtcctgggtcaggagacccagcatggcgtat

SEQ ID NO: 378381 - DNA, 140 bp, Artificial Sequence
  Synthetic
aggccctggctgctgatatgccaggaagtgcagccgaaccaagtcagcccggactcatcataaatacagtaagtgaggtagctggttcactgagccccaccaggaaacaaaagcaatcaggaccttttgggacagcggtg

SEQ ID NO: 378382 - DNA, 140 bp, Artificial Sequence
  Synthetic
caccgctgtcccaaaaggtcctgattgcttttgtttcctggtggggctcagtgaaccagctacctcacttactgtatttatgatgagtccgggctgacttggttcggctgcacttcctggcatatcagcagccagggcct

SEQ ID NO: 378383 - DNA, 140 bp, Artificial Sequence
  Synthetic
atacgccatgctgggtctccactgatgaaattaaccaaattagacatgactttattgataatcccctaccaaaccacggagatgatctcattctatggacaggttggagacaatggatcccgtacttgggagtcggccat

SEQ ID NO: 378384 - DNA, 140 bp, Artificial Sequence
  Synthetic
atggccgactcccaagtacgggatccattgtctccaacctgtccatagaatgagatcatctccgtggtttggtaggggattatcaataaagtcatgtctaatttggttaatttcatcagtggagacccagcatggcgtat

SEQ ID NO: 378385 - DNA, 140 bp, Artificial Sequence
  Synthetic
aggccctggctgctgatatgatctcagggttactctaaggagaaatattatttttaagatttacttgaatgttgaccacttatcttgaatgagcaattaacaatatgtttttctgcttctgaccttttgggacagcggtg

SEQ ID NO: 378386 - DNA, 140 bp, Artificial Sequence
  Synthetic
caccgctgtcccaaaaggtcagaagcagaaaaacatattgttaattgctcattcaagataagtggtcaacattcaagtaaatcttaaaaataatatttctccttagagtaaccctgagatcatatcagcagccagggcct

SEQ ID NO: 378387 - DNA, 140 bp, Artificial Sequence
  Synthetic
atacgccatgctgggtctccgaaaaacgtatgacgaagattaaaggggaggatcgttaacggaaaaacttcccatctcgttcgtcgaagtcacgttggtggtgcttgcagctgagaacaacgtacttgggagtcggccat

SEQ ID NO: 378388 - DNA, 140 bp, Artificial Sequence
  Synthetic
atggccgactcccaagtacgttgttctcagctgcaagcaccaccaacgtgacttcgacgaacgagatgggaagtttttccgttaacgatcctcccctttaatcttcgtcatacgtttttcggagacccagcatggcgtat

SEQ ID NO: 378389 - DNA, 140 bp, Artificial Sequence
  Synthetic
aggccctggctgctgatatgcccatctcgttcgtcgaagtcacgttggtggtgcttgcagctgagaacaaccccagagattgtaggtagataagaccaacacttataggtaggggtcagagaccttttgggacagcggtg

SEQ ID NO: 378390 - DNA, 140 bp, Artificial Sequence
  Synthetic
caccgctgtcccaaaaggtctctgacccctacctataagtgttggtcttatctacctacaatctctggggttgttctcagctgcaagcaccaccaacgtgacttcgacgaacgagatgggcatatcagcagccagggcct

SEQ ID NO: 378391 - DNA, 140 bp, Artificial Sequence
  Synthetic
atacgccatgctgggtctccagcacctgatttctaggttctagttgtacaatccgaatgatggagcattcaagagaacggggtagatctcgcaacatacgacataatagccgggaaccatcgtacttgggagtcggccat

SEQ ID NO: 378392 - DNA, 140 bp, Artificial Sequence
  Synthetic
atggccgactcccaagtacgatggttcccggctattatgtcgtatgttgcgagatctaccccgttctcttgaatgctccatcattcggattgtacaactagaacctagaaatcaggtgctggagacccagcatggcgtat

SEQ ID NO: 378393 - DNA, 140 bp, Artificial Sequence
  Synthetic
atacgccatgctgggtctccatgaaaatccatcaaggtctcgctcattatctcgggaccccaatcagatcgatcgtagacagcctcgaagtgcatcccaaattcgtgttccgaatctgttcgtacttgggagtcggccat

SEQ ID NO: 378394 - DNA, 140 bp, Artificial Sequence
  Synthetic
atggccgactcccaagtacgaacagattcggaacacgaatttgggatgcacttcgaggctgtctacgatcgatctgattggggtcccgagataatgagcgagaccttgatggattttcatggagacccagcatggcgtat

SEQ ID NO: 378395 - DNA, 140 bp, Artificial Sequence
  Synthetic
atacgccatgctgggtctcccttctatgtgagacccacctacggcatgagggcctcgggcaggaccaagctgattctgtattagaggtctaccaaagactccacagtgataagggagggacgtacttgggagtcggccat

SEQ ID NO: 378396 - DNA, 140 bp, Artificial Sequence
  Synthetic
atggccgactcccaagtacgtccctcccttatcactgtggagtctttggtagacctctaatacagaatcagcttggtcctgcccgaggccctcatgccgtaggtgggtctcacatagaagggagacccagcatggcgtat

SEQ ID NO: 378397 - DNA, 140 bp, Artificial Sequence
  Synthetic
aggccctggctgctgatatgtagaaaaccactggagctatttttccacgattgctctcagtcaataaattaatatagatataacccgacttcggtgtgcaattgtcaagagttccatttagaccttttgggacagcggtg

SEQ ID NO: 378398 - DNA, 140 bp, Artificial Sequence
  Synthetic
caccgctgtcccaaaaggtctaaatggaactcttgacaattgcacaccgaagtcgggttatatctatattaatttattgactgagagcaatcgtggaaaaatagctccagtggttttctacatatcagcagccagggcct

SEQ ID NO: 378399 - DNA, 140 bp, Artificial Sequence
  Synthetic
atacgccatgctgggtctcctcctatttgacggtacatgacttgaatgtaataaggtgagttggtatctgaggtattttgtctagagtatactcaaaattgtgtgtcgagcaaattatcacgtacttgggagtcggccat

SEQ ID NO: 378400 - DNA, 140 bp, Artificial Sequence
  Synthetic
atggccgactcccaagtacgtgataatttgctcgacacacaattttgagtatactctagacaaaatacctcagataccaactcaccttattacattcaagtcatgtaccgtcaaataggaggagacccagcatggcgtat

SEQ ID NO: 378401 - DNA, 140 bp, Artificial Sequence
  Synthetic
aggccctggctgctgatatgaggtattttgtctagagtatactcaaaattgtgtgtcgagcaaattatcaataacaaagttaaattctcctaacctcacattttgatcaagtaatcatgagaccttttgggacagcggtg

SEQ ID NO: 378402 - DNA, 140 bp, Artificial Sequence
  Synthetic
caccgctgtcccaaaaggtctcatgattacttgatcaaaatgtgaggttaggagaatttaactttgttattgataatttgctcgacacacaattttgagtatactctagacaaaatacctcatatcagcagccagggcct

SEQ ID NO: 378403 - DNA, 140 bp, Artificial Sequence
  Synthetic
atacgccatgctgggtctccatcatgattgtagacaatttactggtagtccttgggtatccaagtttatgaacagagctagagagaatttgctacttccgatgtataattttattatttgcgtacttgggagtcggccat

SEQ ID NO: 378404 - DNA, 140 bp, Artificial Sequence
  Synthetic
atggccgactcccaagtacgcaaataataaaattatacatcggaagtagcaaattctctctagctctgttcataaacttggatacccaaggactaccagtaaattgtctacaatcatgatggagacccagcatggcgtat

SEQ ID NO: 378405 - DNA, 140 bp, Artificial Sequence
  Synthetic
aggccctggctgctgatatgaacagagctagagagaatttgctacttccgatgtataattttattatttgctacttcaagtgcctaaaaccagtaacgcaggatgaagattaattgcggagaccttttgggacagcggtg

SEQ ID NO: 378406 - DNA, 140 bp, Artificial Sequence
  Synthetic
caccgctgtcccaaaaggtctccgcaattaatcttcatcctgcgttactggttttaggcacttgaagtagcaaataataaaattatacatcggaagtagcaaattctctctagctctgttcatatcagcagccagggcct

SEQ ID NO: 378407 - DNA, 140 bp, Artificial Sequence
  Synthetic
atacgccatgctgggtctcccagttagcacgttcttttatagaagccattagcttctagagtgattatattttagtattaaattttgctaattgcttgctataaagttgaaatgtctaatcgtacttgggagtcggccat

SEQ ID NO: 378408 - DNA, 140 bp, Artificial Sequence
  Synthetic
atggccgactcccaagtacgattagacatttcaactttatagcaagcaattagcaaaatttaatactaaaatataatcactctagaagctaatggcttctataaaagaacgtgctaactgggagacccagcatggcgtat

SEQ ID NO: 378409 - DNA, 140 bp, Artificial Sequence
  Synthetic
aggccctggctgctgatatgtttagtattaaattttgctaattgcttgctataaagttgaaatgtctaatgtttaaatgaacatttttttgaagctgacatacgaatacatcatatcatagaccttttgggacagcggtg

SEQ ID NO: 378410 - DNA, 140 bp, Artificial Sequence
  Synthetic
caccgctgtcccaaaaggtctatgatatgatgtattcgtatgtcagcttcaaaaaaatgttcatttaaacattagacatttcaactttatagcaagcaattagcaaaatttaatactaaacatatcagcagccagggcct

SEQ ID NO: 378411 - DNA, 140 bp, Artificial Sequence
  Synthetic
atacgccatgctgggtctccaggctgttctcagtagtctgtccttagaagctcttggggagacaaaaaggagtcccagagagtcctaacaggttggcataaggtcattaacaccagcatacgtacttgggagtcggccat

SEQ ID NO: 378412 - DNA, 140 bp, Artificial Sequence
  Synthetic
atggccgactcccaagtacgtatgctggtgttaatgaccttatgccaacctgttaggactctctgggactcctttttgtctccccaagagcttctaaggacagactactgagaacagcctggagacccagcatggcgtat

SEQ ID NO: 378413 - DNA, 140 bp, Artificial Sequence
  Synthetic
aggccctggctgctgatatgagtcccagagagtcctaacaggttggcataaggtcattaacaccagcatagtcggctcgatcaaggctgcaagcgagtcgatctcaactaaaaagattatgaccttttgggacagcggtg

SEQ ID NO: 378414 - DNA, 140 bp, Artificial Sequence
  Synthetic
caccgctgtcccaaaaggtcataatctttttagttgagatcgactcgcttgcagccttgatcgagccgactatgctggtgttaatgaccttatgccaacctgttaggactctctgggactcatatcagcagccagggcct

SEQ ID NO: 378415 - DNA, 140 bp, Artificial Sequence
  Synthetic
atacgccatgctgggtctccaaatggctaaagccacaggccgatacaatctcgtgtctccaaagaaagatatggaaaagggagtgattttgagtgatctttgtaatttcttgattactcacgtacttgggagtcggccat

SEQ ID NO: 378416 - DNA, 140 bp, Artificial Sequence
  Synthetic
atggccgactcccaagtacgtgagtaatcaagaaattacaaagatcactcaaaatcactcccttttccatatctttctttggagacacgagattgtatcggcctgtggctttagccatttggagacccagcatggcgtat

SEQ ID NO: 378417 - DNA, 140 bp, Artificial Sequence
  Synthetic
atacgccatgctgggtctccgtcaaaaaggcatggcccttctgacaagactcaaaacaaatgacttcgctcctgcctgggcgatgacaagaaatcttttcccacatctgttccaaaaccccgtacttgggagtcggccat

SEQ ID NO: 378418 - DNA, 140 bp, Artificial Sequence
  Synthetic
atggccgactcccaagtacggggttttggaacagatgtgggaaaagatttcttgtcatcgcccaggcaggagcgaagtcatttgttttgagtcttgtcagaagggccatgcctttttgacggagacccagcatggcgtat

SEQ ID NO: 378419 - DNA, 140 bp, Artificial Sequence
  Synthetic
aggccctggctgctgatatgaagttcaggagcctgacaaatcagctatgaattctaagcacccaggaccagtcaaattctcattacttcatgagtctgccttcaaacctttcactcgtgtgaccttttgggacagcggtg

SEQ ID NO: 378420 - DNA, 140 bp, Artificial Sequence
  Synthetic
caccgctgtcccaaaaggtcacacgagtgaaaggtttgaaggcagactcatgaagtaatgagaatttgactggtcctgggtgcttagaattcatagctgatttgtcaggctcctgaacttcatatcagcagccagggcct

SEQ ID NO: 378421 - DNA, 140 bp, Artificial Sequence
  Synthetic
atacgccatgctgggtctcccaatttaacaagatgatcttaaaataagtacatgaatgagaattagttgtgggtcttatctagcattgctgagttagctatctaatctattttcactaatcgtacttgggagtcggccat

SEQ ID NO: 378422 - DNA, 140 bp, Artificial Sequence
  Synthetic
atggccgactcccaagtacgattagtgaaaatagattagatagctaactcagcaatgctagataagacccacaactaattctcattcatgtacttattttaagatcatcttgttaaattgggagacccagcatggcgtat

SEQ ID NO: 378423 - DNA, 140 bp, Artificial Sequence
  Synthetic
aggccctggctgctgatatggggtcttatctagcattgctgagttagctatctaatctattttcactaattgctttaagcactgctaataggtttgtatcacgttaaggatttagagtgtgaccttttgggacagcggtg

SEQ ID NO: 378424 - DNA, 140 bp, Artificial Sequence
  Synthetic
caccgctgtcccaaaaggtcacactctaaatccttaacgtgatacaaacctattagcagtgcttaaagcaattagtgaaaatagattagatagctaactcagcaatgctagataagaccccatatcagcagccagggcct

SEQ ID NO: 378425 - DNA, 140 bp, Artificial Sequence
  Synthetic
atacgccatgctgggtctcctctttttgaaatggagattatcagcatttctttaatgggaggagttagcaatcagaaattgaagatagatgggcatcgggatagaacaatgcctaactatcgtacttgggagtcggccat

SEQ ID NO: 378426 - DNA, 140 bp, Artificial Sequence
  Synthetic
atggccgactcccaagtacgatagttaggcattgttctatcccgatgcccatctatcttcaatttctgattgctaactcctcccattaaagaaatgctgataatctccatttcaaaaagaggagacccagcatggcgtat

SEQ ID NO: 378427 - DNA, 140 bp, Artificial Sequence
  Synthetic
aggccctggctgctgatatgatcagaaattgaagatagatgggcatcgggatagaacaatgcctaactattgggtggcttccatttttacatgtgtatatcaccaattttttcctatcttgaccttttgggacagcggtg

SEQ ID NO: 378428 - DNA, 140 bp, Artificial Sequence
  Synthetic
caccgctgtcccaaaaggtcaagataggaaaaaattggtgatatacacatgtaaaaatggaagccacccaatagttaggcattgttctatcccgatgcccatctatcttcaatttctgatcatatcagcagccagggcct

SEQ ID NO: 378429 - DNA, 140 bp, Artificial Sequence
  Synthetic
atacgccatgctgggtctcctaagggaaggtctgaggaagattaagaaaaaggccttgtgttcacttggttgccgtcaagtatcctgtggtctttttctacctagcttcctcatgccatacgtacttgggagtcggccat

SEQ ID NO: 378430 - DNA, 140 bp, Artificial Sequence
  Synthetic
atggccgactcccaagtacgtatggcatgaggaagctaggtagaaaaagaccacaggatacttgacggcaaccaagtgaacacaaggcctttttcttaatcttcctcagaccttcccttaggagacccagcatggcgtat

SEQ ID NO: 378431 - DNA, 140 bp, Artificial Sequence
  Synthetic
atacgccatgctgggtctccgtcctggatcaatgtgatttggtaactcgggcatgtgggttatattcatcttattctctaaatcctcaactaaggcgatgtaaattaccaaaacatatatcgtacttgggagtcggccat

SEQ ID NO: 378432 - DNA, 140 bp, Artificial Sequence
  Synthetic
atggccgactcccaagtacgatatatgttttggtaatttacatcgccttagttgaggatttagagaataagatgaatataacccacatgcccgagttaccaaatcacattgatccaggacggagacccagcatggcgtat

SEQ ID NO: 378433 - DNA, 140 bp, Artificial Sequence
  Synthetic
atacgccatgctgggtctccctatagacggagttccacacgcagcaacagactggtatcaaccgactctttttaaagaatccatcctagggcacagccaaatcctatctgtgtcaacagccgtacttgggagtcggccat

SEQ ID NO: 378434 - DNA, 140 bp, Artificial Sequence
  Synthetic
atggccgactcccaagtacggctgttgacacagataggatttggctgtgccctaggatggattctttaaaaagagtcggttgataccagtctgttgctgcgtgtggaactccgtctatagggagacccagcatggcgtat

SEQ ID NO: 378435 - DNA, 140 bp, Artificial Sequence
  Synthetic
aggccctggctgctgatatgatgtgctaggttacaatcccccaaacaaattctccactaaaagggtgccggaacaatttttagaacaagaggatttttcaatcgaaagtgtcctgaattagaccttttgggacagcggtg

SEQ ID NO: 378436 - DNA, 140 bp, Artificial Sequence
  Synthetic
caccgctgtcccaaaaggtctaattcaggacactttcgattgaaaaatcctcttgttctaaaaattgttccggcacccttttagtggagaatttgtttgggggattgtaacctagcacatcatatcagcagccagggcct

SEQ ID NO: 378437 - DNA, 140 bp, Artificial Sequence
  Synthetic
atacgccatgctgggtctcctaacattggcggttccacaagtccttgggggattgtcttttctaaatccagaaaagtgtttttatcgaaatttcggagatcctgtgacgtctggacttttcgtacttgggagtcggccat

SEQ ID NO: 378438 - DNA, 140 bp, Artificial Sequence
  Synthetic
atggccgactcccaagtacgaaaagtccagacgtcacaggatctccgaaatttcgataaaaacacttttctggatttagaaaagacaatcccccaaggacttgtggaaccgccaatgttaggagacccagcatggcgtat

SEQ ID NO: 378439 - DNA, 140 bp, Artificial Sequence
  Synthetic
atacgccatgctgggtctccgacagcctgctatcaagccgcggtgcccttcatctgccctcaaggaggctatagaattagcctcaaggctcacttgggttacacaaggaggttctaatagcgtacttgggagtcggccat

SEQ ID NO: 378440 - DNA, 140 bp, Artificial Sequence
  Synthetic
atggccgactcccaagtacgctattagaacctccttgtgtaacccaagtgagccttgaggctaattctatagcctccttgagggcagatgaagggcaccgcggcttgatagcaggctgtcggagacccagcatggcgtat

SEQ ID NO: 378441 - DNA, 140 bp, Artificial Sequence
  Synthetic
aggccctggctgctgatatggacatctggagatagagggctgtctgatgctgctcgactgtttcttcggacagcaatcgcgagctttttacaatttcttaaaagctggatcatcgaccgcgaccttttgggacagcggtg

SEQ ID NO: 378442 - DNA, 140 bp, Artificial Sequence
  Synthetic
caccgctgtcccaaaaggtcgcggtcgatgatccagcttttaagaaattgtaaaaagctcgcgattgctgtccgaagaaacagtcgagcagcatcagacagccctctatctccagatgtccatatcagcagccagggcct

SEQ ID NO: 378443 - DNA, 140 bp, Artificial Sequence
  Synthetic
atacgccatgctgggtctccggaatccatcaatgaattcctacataaaattttgggtctgctcaagcaaggccccaaaagtattccaaaggaggtcagcattcaaaataatgggcatttgcgtacttgggagtcggccat

SEQ ID NO: 378444 - DNA, 140 bp, Artificial Sequence
  Synthetic
atggccgactcccaagtacgcaaatgcccattattttgaatgctgacctcctttggaatacttttggggccttgcttgagcagacccaaaattttatgtaggaattcattgatggattccggagacccagcatggcgtat

SEQ ID NO: 378445 - DNA, 140 bp, Artificial Sequence
  Synthetic
atacgccatgctgggtctcctttctttcatgcatccttagcttactggagaggtaggaaatctcggaagactcaagaccataatgatttctcaagtggggatggaacattcacagaaccccgtacttgggagtcggccat

SEQ ID NO: 378446 - DNA, 140 bp, Artificial Sequence
  Synthetic
atggccgactcccaagtacggggttctgtgaatgttccatccccacttgagaaatcattatggtcttgagtcttccgagatttcctacctctccagtaagctaaggatgcatgaaagaaaggagacccagcatggcgtat

SEQ ID NO: 378447 - DNA, 140 bp, Artificial Sequence
  Synthetic
aggccctggctgctgatatgctcaagaccataatgatttctcaagtggggatggaacattcacagaacccgtgcgtaagttctcaagcaatcatcagtcagatgagaagtactacaaagtgaccttttgggacagcggtg

SEQ ID NO: 378448 - DNA, 140 bp, Artificial Sequence
  Synthetic
caccgctgtcccaaaaggtcactttgtagtacttctcatctgactgatgattgcttgagaacttacgcacgggttctgtgaatgttccatccccacttgagaaatcattatggtcttgagcatatcagcagccagggcct

SEQ ID NO: 378449 - DNA, 140 bp, Artificial Sequence
  Synthetic
aggccctggctgctgatatgaagttccacaagtggaatccctgcaaagtgttaatggagagtcaaaggggagctgttctaacagagggtgactaccttcaaaacaatactccaccaacaggaccttttgggacagcggtg

SEQ ID NO: 378450 - DNA, 140 bp, Artificial Sequence
  Synthetic
caccgctgtcccaaaaggtcctgttggtggagtattgttttgaaggtagtcaccctctgttagaacagctcccctttgactctccattaacactttgcagggattccacttgtggaacttcatatcagcagccagggcct

SEQ ID NO: 378451 - DNA, 140 bp, Artificial Sequence
  Synthetic
atacgccatgctgggtctccaatcacaatcatgcacatggtcaagatgaccaagaattgatgaatcaaaatattaaacagtacctacatcagctaaagtctatgttggacaccactatatcgtacttgggagtcggccat

SEQ ID NO: 378452 - DNA, 140 bp, Artificial Sequence
  Synthetic
atggccgactcccaagtacgatatagtggtgtccaacatagactttagctgatgtaggtactgtttaatattttgattcatcaattcttggtcatcttgaccatgtgcatgattgtgattggagacccagcatggcgtat

SEQ ID NO: 378453 - DNA, 140 bp, Artificial Sequence
  Synthetic
atacgccatgctgggtctccattgtagattcacagggattgtctcatccatgcattacaaattagacgaagttcttatggaatacaatagtttcgattcagctatcacattagctgaaggcgtacttgggagtcggccat

SEQ ID NO: 378454 - DNA, 140 bp, Artificial Sequence
  Synthetic
atggccgactcccaagtacgccttcagctaatgtgatagctgaatcgaaactattgtattccataagaacttcgtctaatttgtaatgcatggatgagacaatccctgtgaatctacaatggagacccagcatggcgtat

SEQ ID NO: 378455 - DNA, 140 bp, Artificial Sequence
  Synthetic
aggccctggctgctgatatggtcccaactctaccgagcagtgtataatttaatacttgatcacattgatccgcagtatctcaaggtggtggtactcaaagtatttctgagtgatatagaagaccttttgggacagcggtg

SEQ ID NO: 378456 - DNA, 140 bp, Artificial Sequence
  Synthetic
caccgctgtcccaaaaggtcttctatatcactcagaaatactttgagtaccaccaccttgagatactgcggatcaatgtgatcaagtattaaattatacactgctcggtagagttgggaccatatcagcagccagggcct

SEQ ID NO: 378457 - DNA, 140 bp, Artificial Sequence
  Synthetic
atacgccatgctgggtctccaggcgtgtactggttgagtcacatcgcacagtatgctacaaagaatctccattgtgaatacatatgccttggttttccatctctagaaaaggtcctatatcgtacttgggagtcggccat

SEQ ID NO: 378458 - DNA, 140 bp, Artificial Sequence
  Synthetic
atggccgactcccaagtacgatataggaccttttctagagatggaaaaccaaggcatatgtattcacaatggagattctttgtagcatactgtgcgatgtgactcaaccagtacacgcctggagacccagcatggcgtat

SEQ ID NO: 378459 - DNA, 140 bp, Artificial Sequence
  Synthetic
aggccctggctgctgatatgtgcgaatgtcaggaaaaattctttgtccagacgctttatttacaacgcctacgtgatgcagaaatcaagctaattgaacgccttaccggattaatgcgatgaccttttgggacagcggtg

SEQ ID NO: 378460 - DNA, 140 bp, Artificial Sequence
  Synthetic
caccgctgtcccaaaaggtcatcgcattaatccggtaaggcgttcaattagcttgatttctgcatcacgtaggcgttgtaaataaagcgtctggacaaagaatttttcctgacattcgcacatatcagcagccagggcct

SEQ ID NO: 378461 - DNA, 140 bp, Artificial Sequence
  Synthetic
atacgccatgctgggtctcccatagtatgaggaataagataatgacaattcctgacgacagttttagttcctattctaagtatatcgaaagagagtatgccaatcttaattattaaaggtcgtacttgggagtcggccat

SEQ ID NO: 378462 - DNA, 140 bp, Artificial Sequence
  Synthetic
atggccgactcccaagtacgacctttaataattaagattggcatactctctttcgatatacttagaataggaactaaaactgtcgtcaggaattgtcattatcttattcctcatactatgggagacccagcatggcgtat

SEQ ID NO: 378463 - DNA, 140 bp, Artificial Sequence
  Synthetic
aggccctggctgctgatatgctattctaagtatatcgaaagagagtatgccaatcttaattattaaaggtaacaagctattatttactacttattaataagaataaactttatcatagcggaccttttgggacagcggtg

SEQ ID NO: 378464 - DNA, 140 bp, Artificial Sequence
  Synthetic
caccgctgtcccaaaaggtccgctatgataaagtttattcttattaataagtagtaaataatagcttgttacctttaataattaagattggcatactctctttcgatatacttagaatagcatatcagcagccagggcct

SEQ ID NO: 378465 - DNA, 140 bp, Artificial Sequence
  Synthetic
atacgccatgctgggtctccttagaatgtactatcagagaaatggccccagttcctatctttaaataatgattgtgtgttttaaattattattttattaggtttatgagttggtcacacacgtacttgggagtcggccat

SEQ ID NO: 378466 - DNA, 140 bp, Artificial Sequence
  Synthetic
atggccgactcccaagtacgtgtgtgaccaactcataaacctaataaaataataatttaaaacacacaatcattatttaaagataggaactggggccatttctctgatagtacattctaaggagacccagcatggcgtat

SEQ ID NO: 378467 - DNA, 140 bp, Artificial Sequence
  Synthetic
aggccctggctgctgatatgattgtgtgttttaaattattattttattaggtttatgagttggtcacacagtgagtatcagtgattgaggattatgtagataggtaatctaacactgaatgaccttttgggacagcggtg

SEQ ID NO: 378468 - DNA, 140 bp, Artificial Sequence
  Synthetic
caccgctgtcccaaaaggtcattcagtgttagattacctatctacataatcctcaatcactgatactcactgtgtgaccaactcataaacctaataaaataataatttaaaacacacaatcatatcagcagccagggcct

SEQ ID NO: 378469 - DNA, 140 bp, Artificial Sequence
  Synthetic
atacgccatgctgggtctccatgctatcctcagttaagtaacatagactgaaaatgctaagaagagattggagtaaaagtataaaataaagttaattgaacttcaaaatgattaaatgatcgtacttgggagtcggccat

SEQ ID NO: 378470 - DNA, 140 bp, Artificial Sequence
  Synthetic
atggccgactcccaagtacgatcatttaatcattttgaagttcaattaactttattttatacttttactccaatctcttcttagcattttcagtctatgttacttaactgaggatagcatggagacccagcatggcgtat

SEQ ID NO: 378471 - DNA, 140 bp, Artificial Sequence
  Synthetic
atacgccatgctgggtctccaataatgtcaatataattatttagtaatatgagtgataatgtaaattttgataattaactaactgtagtaattaaggtcaaatgcaaacattataagaatcgtacttgggagtcggccat

SEQ ID NO: 378472 - DNA, 140 bp, Artificial Sequence
  Synthetic
atggccgactcccaagtacgattcttataatgtttgcatttgaccttaattactacagttagttaattatcaaaatttacattatcactcatattactaaataattatattgacattattggagacccagcatggcgtat

SEQ ID NO: 378473 - DNA, 140 bp, Artificial Sequence
  Synthetic
atacgccatgctgggtctccgtgtgcgagtaactatgaggaagattaacagttttcctcagtttaaggtatacactgaaattgaaattgagattctcctctttgatattctgtaactttccgtacttgggagtcggccat

SEQ ID NO: 378474 - DNA, 140 bp, Artificial Sequence
  Synthetic
atggccgactcccaagtacggaaagttacagaatatcaaagaggagaatctcaatttcaatttcagtgtataccttaaactgaggaaaactgttaatcttcctcatagttactcgcacacggagacccagcatggcgtat

SEQ ID NO: 378475 - DNA, 140 bp, Artificial Sequence
  Synthetic
atacgccatgctgggtctccaatacaagaggttcccctttccgtcaagtttaaggggttgttttgattgtgtgtagattttataatcctagagtgccagggagttgcgtgtcatcattaacgtacttgggagtcggccat

SEQ ID NO: 378476 - DNA, 140 bp, Artificial Sequence
  Synthetic
atggccgactcccaagtacgttaatgatgacacgcaactccctggcactctaggattataaaatctacacacaatcaaaacaaccccttaaacttgacggaaaggggaacctcttgtattggagacccagcatggcgtat

SEQ ID NO: 378477 - DNA, 140 bp, Artificial Sequence
  Synthetic
aggccctggctgctgatatggtgtagattttataatcctagagtgccagggagttgcgtgtcatcattaattaggaagatcaaggaaacagtttgttccaataatatcgtatatcttgacgaccttttgggacagcggtg

SEQ ID NO: 378478 - DNA, 140 bp, Artificial Sequence
  Synthetic
caccgctgtcccaaaaggtcgtcaagatatacgatattattggaacaaactgtttccttgatcttcctaattaatgatgacacgcaactccctggcactctaggattataaaatctacaccatatcagcagccagggcct

SEQ ID NO: 378479 - DNA, 140 bp, Artificial Sequence
  Synthetic
aggccctggctgctgatatgcacatggtagcacccttgcaggagttaatgttggtgagcagtatcagcaacttagagaggctgcaactgaagctgagaagcaactccaacaatatgctgagaccttttgggacagcggtg

SEQ ID NO: 378480 - DNA, 140 bp, Artificial Sequence
  Synthetic
caccgctgtcccaaaaggtctcagcatattgttggagttgcttctcagcttcagttgcagcctctctaagttgctgatactgctcaccaacattaactcctgcaagggtgctaccatgtgcatatcagcagccagggcct

SEQ ID NO: 378481 - DNA, 140 bp, Artificial Sequence
  Synthetic
atacgccatgctgggtctcctaatgaacttccatcagaagaaaaatgaaattagtttccagcagaccaatgcaatggtaacccttaggaaagagcgactggctaaattaacagaagctatcgtacttgggagtcggccat

SEQ ID NO: 378482 - DNA, 140 bp, Artificial Sequence
  Synthetic
atggccgactcccaagtacgatagcttctgttaatttagccagtcgctctttcctaagggttaccattgcattggtctgctggaaactaatttcatttttcttctgatggaagttcattaggagacccagcatggcgtat

SEQ ID NO: 378483 - DNA, 140 bp, Artificial Sequence
  Synthetic
atacgccatgctgggtctccaagttgggacggcaggtgacttggtcttgttcgaccttgacgatcatgaggatgacaataaagcttttgagccacagaacagctcaccacaatcccaaagcgtacttgggagtcggccat

SEQ ID NO: 378484 - DNA, 140 bp, Artificial Sequence
  Synthetic
atggccgactcccaagtacgctttgggattgtggtgagctgttctgtggctcaaaagctttattgtcatcctcatgatcgtcaaggtcgaacaagaccaagtcacctgccgtcccaacttggagacccagcatggcgtat

SEQ ID NO: 378485 - DNA, 140 bp, Artificial Sequence
  Synthetic
aggccctggctgctgatatggatgacaataaagcttttgagccacagaacagctcaccacaatcccaaagggaaatagagagagaaagattaattcacccacccccaggcaacaataagggaccttttgggacagcggtg

SEQ ID NO: 378486 - DNA, 140 bp, Artificial Sequence
  Synthetic
caccgctgtcccaaaaggtcccttattgttgcctgggggtgggtgaattaatctttctctctctatttccctttgggattgtggtgagctgttctgtggctcaaaagctttattgtcatccatatcagcagccagggcct

SEQ ID NO: 378487 - DNA, 140 bp, Artificial Sequence
  Synthetic
atacgccatgctgggtctccagccagctgaaacatcacaattggatgaagaccctgatatcggtcaatcaaaatctatgcaaaaattagaagagacatatcaccatctgctgagaactcacgtacttgggagtcggccat

SEQ ID NO: 378488 - DNA, 140 bp, Artificial Sequence
  Synthetic
atggccgactcccaagtacgtgagttctcagcagatggtgatatgtctcttctaatttttgcatagattttgattgaccgatatcagggtcttcatccaattgtgatgtttcagctggctggagacccagcatggcgtat

SEQ ID NO: 378489 - DNA, 140 bp, Artificial Sequence
  Synthetic
aggccctggctgctgatatgcacttacaccggtctatccaagatgtggctcaatgttcttaatttgaacatagtcacaaggggataaataatactttatatttctgattgtagattgaccgaccttttgggacagcggtg

SEQ ID NO: 378490 - DNA, 140 bp, Artificial Sequence
  Synthetic
caccgctgtcccaaaaggtcggtcaatctacaatcagaaatataaagtattatttatccccttgtgactatgttcaaattaagaacattgagccacatcttggatagaccggtgtaagtgcatatcagcagccagggcct

SEQ ID NO: 378491 - DNA, 140 bp, Artificial Sequence
  Synthetic
atacgccatgctgggtctcccctgactagacaaattaagaaaaacatttgatgaagattaaaaccttcatcgccagtaaatgattatattgtctgtaggcaggtgtttactccaccttaacgtacttgggagtcggccat

SEQ ID NO: 378492 - DNA, 140 bp, Artificial Sequence
  Synthetic
atggccgactcccaagtacgttaaggtggagtaaacacctgcctacagacaatataatcatttactggcgatgaaggttttaatcttcatcaaatgtttttcttaatttgtctagtcaggggagacccagcatggcgtat

SEQ ID NO: 378493 - DNA, 140 bp, Artificial Sequence
  Synthetic
aggccctggctgctgatatgtaactgatatattcattgatattgataacaagccagatcaaatggaagtccggctcaaaccatcatcaaggagctcaacaagaacttgtacaagtagcaggaccttttgggacagcggtg

SEQ ID NO: 378494 - DNA, 140 bp, Artificial Sequence
  Synthetic
caccgctgtcccaaaaggtcctgctacttgtacaagttcttgttgagctccttgatgatggtttgagccggacttccatttgatctggcttgttatcaatatcaatgaatatatcagttacatatcagcagccagggcct

SEQ ID NO: 378495 - DNA, 140 bp, Artificial Sequence
  Synthetic
atacgccatgctgggtctcctaactatgctagtgagtgccaccagtcgtcagaatgctgcaatcgaggcccttgaaaaccgcctcagcacacttgagagtagcttaaagccaatccaagacgtacttgggagtcggccat

SEQ ID NO: 378496 - DNA, 140 bp, Artificial Sequence
  Synthetic
atggccgactcccaagtacgtcttggattggctttaagctactctcaagtgtgctgaggcggttttcaagggcctcgattgcagcattctgacgactggtggcactcactagcatagttaggagacccagcatggcgtat

SEQ ID NO: 378497 - DNA, 140 bp, Artificial Sequence
  Synthetic
atacgccatgctgggtctcccaaaatatgatcttctagttatgacaactggacgggctacttcaactgcagctgcagtagatgcgtactggaaagagcacaaacagccaccaccagggcccgtacttgggagtcggccat

SEQ ID NO: 378498 - DNA, 140 bp, Artificial Sequence
  Synthetic
atggccgactcccaagtacgggccctggtggtggctgtttgtgctctttccagtacgcatctactgcagctgcagttgaagtagcccgtccagttgtcataactagaagatcatattttgggagacccagcatggcgtat

SEQ ID NO: 378499 - DNA, 140 bp, Artificial Sequence
  Synthetic
atacgccatgctgggtctccgctatgtaccagatgctgtgcaggaggcttacaagaaccttgacagtacatcgaccctgaccgaggaaaattttgggaaaccttatatatctgctaaagacgtacttgggagtcggccat

SEQ ID NO: 378500 - DNA, 140 bp, Artificial Sequence
  Synthetic
atggccgactcccaagtacgtctttagcagatatataaggtttcccaaaattttcctcggtcagggtcgatgtactgtcaaggttcttgtaagcctcctgcacagcatctggtacatagcggagacccagcatggcgtat

SEQ ID NO: 378501 - DNA, 140 bp, Artificial Sequence
  Synthetic
aggccctggctgctgatatgttgggtttgtttgtttaagatgcaagatggtaaaacgcttggacttaagatctaagaatcaagatttatttaacaagacaagccacaaccttagatagaagaccttttgggacagcggtg

SEQ ID NO: 378502 - DNA, 140 bp, Artificial Sequence
  Synthetic
caccgctgtcccaaaaggtcttctatctaaggttgtggcttgtcttgttaaataaatcttgattcttagatcttaagtccaagcgttttaccatcttgcatcttaaacaaacaaacccaacatatcagcagccagggcct

SEQ ID NO: 378503 - DNA, 140 bp, Artificial Sequence
  Synthetic
atacgccatgctgggtctccaatggtcatacttgaatatgacaacatcttgcttcttgttttgccttgtgtttctttgaattgaaagatcattccaaacttacaaacatgcacaagatgtcgtacttgggagtcggccat

SEQ ID NO: 378504 - DNA, 140 bp, Artificial Sequence
  Synthetic
atggccgactcccaagtacgacatcttgtgcatgtttgtaagtttggaatgatctttcaattcaaagaaacacaaggcaaaacaagaagcaagatgttgtcatattcaagtatgaccattggagacccagcatggcgtat

SEQ ID NO: 378505 - DNA, 140 bp, Artificial Sequence
  Synthetic
aggccctggctgctgatatgtttctttgaattgaaagatcattccaaacttacaaacatgcacaagatgttatggtttagcaaagaattgataggagtactggtatataatgtaaatatagaccttttgggacagcggtg

SEQ ID NO: 378506 - DNA, 140 bp, Artificial Sequence
  Synthetic
caccgctgtcccaaaaggtctatatttacattatataccagtactcctatcaattctttgctaaaccataacatcttgtgcatgtttgtaagtttggaatgatctttcaattcaaagaaacatatcagcagccagggcct

SEQ ID NO: 378507 - DNA, 140 bp, Artificial Sequence
  Synthetic
atacgccatgctgggtctcctttcttatcttcatcttctaaagtgagatattttatcatcaaaaaatgaggcgcggagtgttaccaacggctcctccagcatataatgatattgcatactcgtacttgggagtcggccat

SEQ ID NO: 378508 - DNA, 140 bp, Artificial Sequence
  Synthetic
atggccgactcccaagtacgagtatgcaatatcattatatgctggaggagccgttggtaacactccgcgcctcattttttgatgataaaatatctcactttagaagatgaagataagaaaggagacccagcatggcgtat

SEQ ID NO: 378509 - DNA, 140 bp, Artificial Sequence
  Synthetic
atacgccatgctgggtctccaacaggctaggcccaggaatacccgatcatccgctacgactcctaaggttgggcaatcaggcattccttcaagagtttgttcttccaccggttcagcttccgtacttgggagtcggccat

SEQ ID NO: 378510 - DNA, 140 bp, Artificial Sequence
  Synthetic
atggccgactcccaagtacggaagctgaaccggtggaagaacaaactcttgaaggaatgcctgattgcccaaccttaggagtcgtagcggatgatcgggtattcctgggcctagcctgttggagacccagcatggcgtat

SEQ ID NO: 378511 - DNA, 140 bp, Artificial Sequence
  Synthetic
atacgccatgctgggtctcccttaactatggttatcacccaggactgcgattcatgccactctccagccagccatccgtatcacatggacaagcaggatagttaccaataattttaattccgtacttgggagtcggccat

SEQ ID NO: 378512 - DNA, 140 bp, Artificial Sequence
  Synthetic
atggccgactcccaagtacggaattaaaattattggtaactatcctgcttgtccatgtgatacggatggctggctggagagtggcatgaatcgcagtcctgggtgataaccatagttaagggagacccagcatggcgtat

SEQ ID NO: 378513 - DNA, 140 bp, Artificial Sequence
  Synthetic
aggccctggctgctgatatgaatctgattgtatagaattataaaagaatcaagcagaggcaacagactcacagcttacgcctagataactaatattaaggagttttttaatctaattttcgaccttttgggacagcggtg

SEQ ID NO: 378514 - DNA, 140 bp, Artificial Sequence
  Synthetic
caccgctgtcccaaaaggtcgaaaattagattaaaaaactccttaatattagttatctaggcgtaagctgtgagtctgttgcctctgcttgattcttttataattctatacaatcagattcatatcagcagccagggcct

SEQ ID NO: 378515 - DNA, 140 bp, Artificial Sequence
  Synthetic
atacgccatgctgggtctcccttatcggtgcgagatttccttgagagcccggcggggcttctactatctgtagtaaccagaagagaagttcaactcagtcaaaactaaaccaagtaatatcgtacttgggagtcggccat

SEQ ID NO: 378516 - DNA, 140 bp, Artificial Sequence
  Synthetic
atggccgactcccaagtacgatattacttggtttagttttgactgagttgaacttctcttctggttactacagatagtagaagccccgccgggctctcaaggaaatctcgcaccgataagggagacccagcatggcgtat

SEQ ID NO: 378517 - DNA, 140 bp, Artificial Sequence
  Synthetic
aggccctggctgctgatatgtagtaaccagaagagaagttcaactcagtcaaaactaaaccaagtaatattctgaatgctctatagtctattctaatcagaggtataacaatggctaggagaccttttgggacagcggtg

SEQ ID NO: 378518 - DNA, 140 bp, Artificial Sequence
  Synthetic
caccgctgtcccaaaaggtctcctagccattgttatacctctgattagaatagactatagagcattcagaatattacttggtttagttttgactgagttgaacttctcttctggttactacatatcagcagccagggcct

SEQ ID NO: 378519 - DNA, 140 bp, Artificial Sequence
  Synthetic
atacgccatgctgggtctccacatggggtcaggatatcaacttcttcaattgcctcgggaacgttttcgtaaaacttcattcctagtatgggcaatcatcctcttccagcgagcaatctccgtacttgggagtcggccat

SEQ ID NO: 378520 - DNA, 140 bp, Artificial Sequence
  Synthetic
atggccgactcccaagtacggagattgctcgctggaagaggatgattgcccatactaggaatgaagttttacgaaaacgttcccgaggcaattgaagaagttgatatcctgaccccatgtggagacccagcatggcgtat

SEQ ID NO: 378521 - DNA, 140 bp, Artificial Sequence
  Synthetic
atacgccatgctgggtctccttttttaattctgtcagagcccaggaagcatttttggaaggctacaccagctcatgaaccggtgaacacaacagatgattccacaagctactacataacccgtacttgggagtcggccat

SEQ ID NO: 378522 - DNA, 140 bp, Artificial Sequence
  Synthetic
atggccgactcccaagtacgggttatgtagtagcttgtggaatcatctgttgtgttcaccggttcatgagctggtgtagccttccaaaaatgcttcctgggctctgacagaattaaaaaaggagacccagcatggcgtat

SEQ ID NO: 378523 - DNA, 140 bp, Artificial Sequence
  Synthetic
aggccctggctgctgatatgcttagcaacagtacagggagattaacttggacattggatcccaaaattgaaccaaatgttggtgagtgggccttttgggaaactaaaaaaacttttccaagaccttttgggacagcggtg

SEQ ID NO: 378524 - DNA, 140 bp, Artificial Sequence
  Synthetic
caccgctgtcccaaaaggtcttggaaaagtttttttagtttcccaaaaggcccactcaccaacatttggttcaattttgggatccaatgtccaagttaatctccctgtactgttgctaagcatatcagcagccagggcct

SEQ ID NO: 378525 - DNA, 140 bp, Artificial Sequence
  Synthetic
aggccctggctgctgatatggtctaactaacggagagacaatcacaggtttcaccgcgaacccaatgacaaccaccattgccctaagtccaaccatgacaagcaaggttgacaacaatgtgaccttttgggacagcggtg

SEQ ID NO: 378526 - DNA, 140 bp, Artificial Sequence
  Synthetic
caccgctgtcccaaaaggtcacattgttgtcaaccttgcttgtcatggttggacttagggcaatggtggttgtcattgggttcgcggtgaaacctgtgattgtctctccgttagttagaccatatcagcagccagggcct

SEQ ID NO: 378527 - DNA, 140 bp, Artificial Sequence
  Synthetic
atacgccatgctgggtctcccggcaagcaacgagacaattgaccactccgaaatgaattcgatccagggctcgaacaactccacccagagcccacagaccaagaccaagccagcgcccaccgtacttgggagtcggccat

SEQ ID NO: 378528 - DNA, 140 bp, Artificial Sequence
  Synthetic
atggccgactcccaagtacggtgggcgctggcttggtcttggtctgtgggctctgggtggagttgttcgagccctggatcgaattcatttcggagtggtcaattgtctcgttgcttgccgggagacccagcatggcgtat

SEQ ID NO: 378529 - DNA, 140 bp, Artificial Sequence
  Synthetic
atacgccatgctgggtctcccaggaaccagcccaggaagcgcagccgaaccaagtcagcctggactcactataaatacagtaagtaaggtagctgattcactgagtcccaccaggaaacacgtacttgggagtcggccat

SEQ ID NO: 378530 - DNA, 140 bp, Artificial Sequence
  Synthetic
atggccgactcccaagtacgtgtttcctggtgggactcagtgaatcagctaccttacttactgtatttatagtgagtccaggctgacttggttcggctgcgcttcctgggctggttcctgggagacccagcatggcgtat

SEQ ID NO: 378531 - DNA, 140 bp, Artificial Sequence
  Synthetic
atacgccatgctgggtctccactattggacagctgttgatgagggggcagcagtaggattggcatggattccatattttggacctgcagcagaaggcatctacattgagggtgtaatgcacgtacttgggagtcggccat

SEQ ID NO: 378532 - DNA, 140 bp, Artificial Sequence
  Synthetic
atggccgactcccaagtacgtgcattacaccctcaatgtagatgccttctgctgcaggtccaaaatatggaatccatgccaatcctactgctgccccctcatcaacagctgtccaatagtggagacccagcatggcgtat

SEQ ID NO: 378533 - DNA, 140 bp, Artificial Sequence
  Synthetic
atacgccatgctgggtctcccagccctactttgtatatgtaagattttgtgttgatttattctgagatctgagagaaagaaatctcagggttactctaaggagaagtattatttttaaaacgtacttgggagtcggccat

SEQ ID NO: 378534 - DNA, 140 bp, Artificial Sequence
  Synthetic
atggccgactcccaagtacgttttaaaaataatacttctccttagagtaaccctgagatttctttctctcagatctcagaataaatcaacacaaaatcttacatatacaaagtagggctgggagacccagcatggcgtat

SEQ ID NO: 378535 - DNA, 140 bp, Artificial Sequence
  Synthetic
atacgccatgctgggtctcctttctgcttctttgcttgatttacaatatgatatttctcttaataatgattaatatattaagaaaaacttatgacgaagattaaaggggaggatcgttaacgtacttgggagtcggccat

SEQ ID NO: 378536 - DNA, 140 bp, Artificial Sequence
  Synthetic
atggccgactcccaagtacgttaacgatcctcccctttaatcttcgtcataagtttttcttaatatattaatcattattaagagaaatatcatattgtaaatcaagcaaagaagcagaaaggagacccagcatggcgtat

SEQ ID NO: 378537 - DNA, 140 bp, Artificial Sequence
  Synthetic
atacgccatgctgggtctcccgggaaaatctcccatctcgttcgtcgaggccacgttggtggtgcttgcagctgagaaccactccagagattgtaggtagaaaggaccagcatttataggcgtacttgggagtcggccat

SEQ ID NO: 378538 - DNA, 140 bp, Artificial Sequence
  Synthetic
atggccgactcccaagtacgcctataaatgctggtcctttctacctacaatctctggagtggttctcagctgcaagcaccaccaacgtggcctcgacgaacgagatgggagattttcccgggagacccagcatggcgtat

SEQ ID NO: 378539 - DNA, 140 bp, Artificial Sequence
  Synthetic
atacgccatgctgggtctcctttaatatcctagaacctgatttctaggttctagttgtacaatccggatgatggagcattcaagagaacggggtagatctagcaacatgcgacataatagcgtacttgggagtcggccat

SEQ ID NO: 378540 - DNA, 140 bp, Artificial Sequence
  Synthetic
atggccgactcccaagtacgctattatgtcgcatgttgctagatctaccccgttctcttgaatgctccatcatccggattgtacaactagaacctagaaatcaggttctaggatattaaaggagacccagcatggcgtat

SEQ ID NO: 378541 - DNA, 140 bp, Artificial Sequence
  Synthetic
aggccctggctgctgatatgaattttgcaaaaaagatcaccaattggatagcttaaatgatcatgaattactactgctaattgcaagaagaacatgtggaattatcgagagcaattcgcagaccttttgggacagcggtg

SEQ ID NO: 378542 - DNA, 140 bp, Artificial Sequence
  Synthetic
caccgctgtcccaaaaggtctgcgaattgctctcgataattccacatgttcttcttgcaattagcagtagtaattcatgatcatttaagctatccaattggtgatcttttttgcaaaattcatatcagcagccagggcct

SEQ ID NO: 378543 - DNA, 140 bp, Artificial Sequence
  Synthetic
atacgccatgctgggtctcctgaatcttcatcagttagcaagttcctttatagaagtcattagcctctaaggtgattatattttagtattaaattctgttaattgcttgctataaagttgcgtacttgggagtcggccat

SEQ ID NO: 378544 - DNA, 140 bp, Artificial Sequence
  Synthetic
atggccgactcccaagtacgcaactttatagcaagcaattaacagaatttaatactaaaatataatcaccttagaggctaatgacttctataaaggaacttgctaactgatgaagattcaggagacccagcatggcgtat

SEQ ID NO: 378545 - DNA, 140 bp, Artificial Sequence
  Synthetic
atacgccatgctgggtctccacaccagcatagtcagttcgatcaagactgtaagcgagtcgattgcaactaaaaagattatttcttgttgtttaaacaaattccttttgtgtgagacatccgtacttgggagtcggccat

SEQ ID NO: 378546 - DNA, 140 bp, Artificial Sequence
  Synthetic
atggccgactcccaagtacggatgtctcacacaaaaggaatttgtttaaacaacaagaaataatctttttagttgcaatcgactcgcttacagtcttgatcgaactgactatgctggtgtggagacccagcatggcgtat

SEQ ID NO: 378547 - DNA, 140 bp, Artificial Sequence
  Synthetic
atacgccatgctgggtctccttttcactaactgcattgagcactgctagtaggtttgcattacgttaaagattcagagtgtatgaattgtgaagatttaaacttgggttttgccttatgccgtacttgggagtcggccat

SEQ ID NO: 378548 - DNA, 140 bp, Artificial Sequence
  Synthetic
atggccgactcccaagtacggcataaggcaaaacccaagtttaaatcttcacaattcatacactctgaatctttaacgtaatgcaaacctactagcagtgctcaatgcagttagtgaaaaggagacccagcatggcgtat

SEQ ID NO: 378549 - DNA, 140 bp, Artificial Sequence
  Synthetic
aggccctggctgctgatatgattcagagtgtatgaattgtgaagatttaaacttgggttttgccttatgcttcataggtggtctttttaagatggagattatcagcatttcttcaatggggaccttttgggacagcggtg

SEQ ID NO: 378550 - DNA, 140 bp, Artificial Sequence
  Synthetic
caccgctgtcccaaaaggtccccattgaagaaatgctgataatctccatcttaaaaagaccacctatgaagcataaggcaaaacccaagtttaaatcttcacaattcatacactctgaatcatatcagcagccagggcct

SEQ ID NO: 378551 - DNA, 140 bp, Artificial Sequence
  Synthetic
aggccctggctgctgatatggtgatacacctgtagcaacactgccgatagactatttagtaccaattctcctgcgttccctaacggggcacggtgataggccgttgaccccgacttgcaagaccttttgggacagcggtg

SEQ ID NO: 378552 - DNA, 140 bp, Artificial Sequence
  Synthetic
caccgctgtcccaaaaggtcttgcaagtcggggtcaacggcctatcaccgtgccccgttagggaacgcaggagaattggtactaaatagtctatcggcagtgttgctacaggtgtatcaccatatcagcagccagggcct

SEQ ID NO: 378553 - DNA, 140 bp, Artificial Sequence
  Synthetic
atacgccatgctgggtctccaaccgactctttttaaagaatccatcctaggacacagccaaatcctatctgtgtcgacagctgaaatactaattatgtgtaaagatattatcacctgtagcgtacttgggagtcggccat

SEQ ID NO: 378554 - DNA, 140 bp, Artificial Sequence
  Synthetic
atggccgactcccaagtacgctacaggtgataatatctttacacataattagtatttcagctgtcgacacagataggatttggctgtgtcctaggatggattctttaaaaagagtcggttggagacccagcatggcgtat

SEQ ID NO: 378555 - DNA, 140 bp, Artificial Sequence
  Synthetic
aggccctggctgctgatatgctttgaacccaatgtgctaggttacaatcctccgaacaaattctccactaaaagggtgccggaacaatttctagaacaggaggatttttcaatcgaaagtgaccttttgggacagcggtg

SEQ ID NO: 378556 - DNA, 140 bp, Artificial Sequence
  Synthetic
caccgctgtcccaaaaggtcactttcgattgaaaaatcctcctgttctagaaattgttccggcacccttttagtggagaatttgttcggaggattgtaacctagcacattgggttcaaagcatatcagcagccagggcct

SEQ ID NO: 378557 - DNA, 140 bp, Artificial Sequence
  Synthetic
atacgccatgctgggtctcctttttccttttctcttaaagaaaaggaattaaatattggacgaacatttgggaagctaccatatctcacacggaatgtccaaactttatgtgaggctctgcgtacttgggagtcggccat

SEQ ID NO: 378558 - DNA, 140 bp, Artificial Sequence
  Synthetic
atggccgactcccaagtacgcagagcctcacataaagtttggacattccgtgtgagatatggtagcttcccaaatgttcgtccaatatttaattccttttctttaagagaaaaggaaaaaggagacccagcatggcgtat

SEQ ID NO: 378559 - DNA, 140 bp, Artificial Sequence
  Synthetic
atacgccatgctgggtctccggatgcattatttaatcccgcagtgttacatgcatgtaagtgattattataatccgcctcacaatgttaatcttagcaatcgagaatatcctcctgaaggcgtacttgggagtcggccat

SEQ ID NO: 378560 - DNA, 140 bp, Artificial Sequence
  Synthetic
atggccgactcccaagtacgccttcaggaggatattctcgattgctaagattaacattgtgaggcggattataataatcacttacatgcatgtaacactgcgggattaaataatgcatccggagacccagcatggcgtat

SEQ ID NO: 378561 - DNA, 140 bp, Artificial Sequence
  Synthetic
atacgccatgctgggtctccaactgtggacgagtatatcctgtgcacaaatctccttagtggaaattaaaactggttttaagttacgatcagcggtcatgggagacaatcagtgtataaccgtacttgggagtcggccat

SEQ ID NO: 378562 - DNA, 140 bp, Artificial Sequence
  Synthetic
atggccgactcccaagtacggttatacactgattgtctcccatgaccgctgatcgtaacttaaaaccagttttaatttccactaaggagatttgtgcacaggatatactcgtccacagttggagacccagcatggcgtat

SEQ ID NO: 378563 - DNA, 140 bp, Artificial Sequence
  Synthetic
atacgccatgctgggtctccgtgagtatacatggtcacacatcttagaaggtagaccattgatcggagcaacattaccatgtatggtggagcaattcaaagttaagtggctaggacagtacgtacttgggagtcggccat

SEQ ID NO: 378564 - DNA, 140 bp, Artificial Sequence
  Synthetic
atggccgactcccaagtacgtactgtcctagccacttaactttgaattgctccaccatacatggtaatgttgctccgatcaatggtctaccttctaagatgtgtgaccatgtatactcacggagacccagcatggcgtat

SEQ ID NO: 378565 - DNA, 140 bp, Artificial Sequence
  Synthetic
atacgccatgctgggtctccggataaaatcggacagcctgcaatcaagccgcgatgcccttcatctgccctcaaggaggctatagaattagcatcaaggctcacttgggttacacaaggacgtacttgggagtcggccat

SEQ ID NO: 378566 - DNA, 140 bp, Artificial Sequence
  Synthetic
atggccgactcccaagtacgtccttgtgtaacccaagtgagccttgatgctaattctatagcctccttgagggcagatgaagggcatcgcggcttgattgcaggctgtccgattttatccggagacccagcatggcgtat

SEQ ID NO: 378567 - DNA, 140 bp, Artificial Sequence
  Synthetic
atacgccatgctgggtctccccttagtgtcagtgaagtcctgcaaatgacaccatcacattattcaggaaatattgtccatcgatataacgaccaatatagcccgcactcatttatggcgcgtacttgggagtcggccat

SEQ ID NO: 378568 - DNA, 140 bp, Artificial Sequence
  Synthetic
atggccgactcccaagtacgcgccataaatgagtgcgggctatattggtcgttatatcgatggacaatatttcctgaataatgtgatggtgtcatttgcaggacttcactgacactaaggggagacccagcatggcgtat

SEQ ID NO: 378569 - DNA, 140 bp, Artificial Sequence
  Synthetic
atacgccatgctgggtctccatggacatttggatttaacagaaaataattatgtttacaatagtaagagcactgctagtaatttcttccatgcatccttagcttactggagaagtaggaacgtacttgggagtcggccat

SEQ ID NO: 378570 - DNA, 140 bp, Artificial Sequence
  Synthetic
atggccgactcccaagtacgttcctacttctccagtaagctaaggatgcatggaagaaattactagcagtgctcttactattgtaaacataattattttctgttaaatccaaatgtccatggagacccagcatggcgtat

SEQ ID NO: 378571 - DNA, 140 bp, Artificial Sequence
  Synthetic
atacgccatgctgggtctcccttctcgcaatacagactcagcaataacagacgaacaatgagtaatcatcgtaagaaagggaagttccacaagtggaatccttgcaaagtgttgatggagcgtacttgggagtcggccat

SEQ ID NO: 378572 - DNA, 140 bp, Artificial Sequence
  Synthetic
atggccgactcccaagtacgctccatcaacactttgcaaggattccacttgtggaacttccctttcttacgatgattactcattgttcgtctgttattgctgagtctgtattgcgagaagggagacccagcatggcgtat

SEQ ID NO: 378573 - DNA, 140 bp, Artificial Sequence
  Synthetic
atacgccatgctgggtctcctccaccaacagatgatgtatcaagtcctcaccgactcattctaccattttttaaattgggaaatcacaaccatgcacatgatcaggatgcccaagaattgcgtacttgggagtcggccat

SEQ ID NO: 378574 - DNA, 140 bp, Artificial Sequence
  Synthetic
atggccgactcccaagtacgcaattcttgggcatcctgatcatgtgcatggttgtgatttcccaatttaaaaaatggtagaatgagtcggtgaggacttgatacatcatctgttggtggaggagacccagcatggcgtat

SEQ ID NO: 378575 - DNA, 140 bp, Artificial Sequence
  Synthetic
aggccctggctgctgatatgaaggaatctccattgtgaatacatatgccttggtttcccacctctagaaaaggtcctatatcacaggtataatctagttgatactggactcggtccattggaccttttgggacagcggtg

SEQ ID NO: 378576 - DNA, 140 bp, Artificial Sequence
  Synthetic
caccgctgtcccaaaaggtccaatggaccgagtccagtatcaactagattatacctgtgatataggaccttttctagaggtgggaaaccaaggcatatgtattcacaatggagattccttcatatcagcagccagggcct

SEQ ID NO: 378577 - DNA, 140 bp, Artificial Sequence
  Synthetic
atacgccatgctgggtctccaggtcctatatcacaggtataatctagttgatactggactcggtccattgtcgtcagttattagacatttaactaacctccaggcagagatacgagacttcgtacttgggagtcggccat

SEQ ID NO: 378578 - DNA, 140 bp, Artificial Sequence
  Synthetic
atggccgactcccaagtacgaagtctcgtatctctgcctggaggttagttaaatgtctaataactgacgacaatggaccgagtccagtatcaactagattatacctgtgatataggacctggagacccagcatggcgtat

SEQ ID NO: 378579 - DNA, 140 bp, Artificial Sequence
  Synthetic
aggccctggctgctgatatgtttaaataatgattgtgtgtattaaattattagtttattaggtttatgagttggttacacagtgagtattagtaattgaggattatgtagataggcaatcgaccttttgggacagcggtg

SEQ ID NO: 378580 - DNA, 140 bp, Artificial Sequence
  Synthetic
caccgctgtcccaaaaggtcgattgcctatctacataatcctcaattactaatactcactgtgtaaccaactcataaacctaataaactaataatttaatacacacaatcattatttaaacatatcagcagccagggcct

SEQ ID NO: 378581 - DNA, 140 bp, Artificial Sequence
  Synthetic
aggccctggctgctgatatgttggttacacagtgagtattagtaattgaggattatgtagataggcaatctaatactgaatcacccatctgatgtcaccatatccaaatattgtgctagtgaccttttgggacagcggtg

SEQ ID NO: 378582 - DNA, 140 bp, Artificial Sequence
  Synthetic
caccgctgtcccaaaaggtcactagcacaatatttggatatggtgacatcagatgggtgattcagtattagattgcctatctacataatcctcaattactaatactcactgtgtaaccaacatatcagcagccagggcct

SEQ ID NO: 378583 - DNA, 140 bp, Artificial Sequence
  Synthetic
atacgccatgctgggtctccagaagagattggagtaaaagtataaagtaaatttaatcaaacttcaaagtgattaaatgataatgatcttgggtactcgatatgacctcaagtcaaaaatcgtacttgggagtcggccat

SEQ ID NO: 378584 - DNA, 140 bp, Artificial Sequence
  Synthetic
atggccgactcccaagtacgatttttgacttgaggtcatatcgagtacccaagatcattatcatttaatcactttgaagtttgattaaatttactttatacttttactccaatctcttctggagacccagcatggcgtat

SEQ ID NO: 378585 - DNA, 140 bp, Artificial Sequence
  Synthetic
atacgccatgctgggtctccaaataatgtcaatataattgtttagtaatatgagttataatgtgaattttgataactaactaactttagtagttaagatcaaatgcaaacattctaagaacgtacttgggagtcggccat

SEQ ID NO: 378586 - DNA, 140 bp, Artificial Sequence
  Synthetic
atggccgactcccaagtacgttcttagaatgtttgcatttgatcttaactactaaagttagttagttatcaaaattcacattataactcatattactaaacaattatattgacattatttggagacccagcatggcgtat

SEQ ID NO: 378587 - DNA, 140 bp, Artificial Sequence
  Synthetic
atacgccatgctgggtctcccggacacacaaaaagaaagaaaagtttttaagattttttgtgtgcgaataactatgaggaagattaatcattttcctcaaactcaaactaatattgacatcgtacttgggagtcggccat

SEQ ID NO: 378588 - DNA, 140 bp, Artificial Sequence
  Synthetic
atggccgactcccaagtacgatgtcaatattagtttgagtttgaggaaaatgattaatcttcctcatagttattcgcacacaaaaaatcttaaaaacttttctttctttttgtgtgtccgggagacccagcatggcgtat

SEQ ID NO: 378589 - DNA, 140 bp, Artificial Sequence
  Synthetic
aggccctggctgctgatatgactatgaggaagattaatcattttcctcaaactcaaactaatattgacattgagattgatctcatcatttaccaattggagacaatttaactagttaatcgaccttttgggacagcggtg

SEQ ID NO: 378590 - DNA, 140 bp, Artificial Sequence
  Synthetic
caccgctgtcccaaaaggtcgattaactagttaaattgtctccaattggtaaatgatgagatcaatctcaatgtcaatattagtttgagtttgaggaaaatgattaatcttcctcatagtcatatcagcagccagggcct

SEQ ID NO: 378591 - DNA, 140 bp, Artificial Sequence
  Synthetic
atacgccatgctgggtctcctgagattgatctcatcatttaccaattggagacaatttaactagttaatcccccatttgggggcattcctaaagtgttgcgaaggtatgtgggtcgtattcgtacttgggagtcggccat

SEQ ID NO: 378592 - DNA, 140 bp, Artificial Sequence
  Synthetic
atggccgactcccaagtacgaatacgacccacataccttcgcaacactttaggaatgcccccaaatgggggattaactagttaaattgtctccaattggtaaatgatgagatcaatctcaggagacccagcatggcgtat

SEQ ID NO: 378593 - DNA, 140 bp, Artificial Sequence
  Synthetic
atacgccatgctgggtctccaagtgtggttaccagagtaatagactaaatttgtcctggtagttagcattttctagtaagaccgatactatcccaagtctcaagagagggtgagaggaggcgtacttgggagtcggccat

SEQ ID NO: 378594 - DNA, 140 bp, Artificial Sequence
  Synthetic
atggccgactcccaagtacgcctcctctcaccctctcttgagacttgggatagtatcggtcttactagaaaatgctaactaccaggacaaatttagtctattactctggtaaccacacttggagacccagcatggcgtat

SEQ ID NO: 378595 - DNA, 140 bp, Artificial Sequence
  Synthetic
aggccctggctgctgatatgttctagtaagaccgatactatcccaagtctcaagagagggtgagaggagggccccgaggtatccctttagtccacaaaatctagccaattttagctaagtgaccttttgggacagcggtg

SEQ ID NO: 378596 - DNA, 140 bp, Artificial Sequence
  Synthetic
caccgctgtcccaaaaggtcacttagctaaaattggctagattttgtggactaaagggatacctcggggccctcctctcaccctctcttgagacttgggatagtatcggtcttactagaacatatcagcagccagggcct

SEQ ID NO: 378597 - DNA, 140 bp, Artificial Sequence
  Synthetic
atacgccatgctgggtctccctacaacatggataaacgggtgagaggttcatgggccctgggaggacaatctgaggttgatcttgactaccacaagatattaacagccgggctttcagtccgtacttgggagtcggccat

SEQ ID NO: 378598 - DNA, 140 bp, Artificial Sequence
  Synthetic
atggccgactcccaagtacggactgaaagcccggctgttaatatcttgtggtagtcaagatcaacctcagattgtcctcccagggcccatgaacctctcacccgtttatccatgttgtagggagacccagcatggcgtat

SEQ ID NO: 378599 - DNA, 140 bp, Artificial Sequence
  Synthetic
aggccctggctgctgatatgctgaggttgatcttgactaccacaagatattaacagccgggctttcagtccaacaggggattgtgcgacagagagtcatcccggtatatgtcgtgaatgagaccttttgggacagcggtg

SEQ ID NO: 378600 - DNA, 140 bp, Artificial Sequence
  Synthetic
caccgctgtcccaaaaggtctcattcacgacatataccgggatgactctctgtcgcacaatcccctgttggactgaaagcccggctgttaatatcttgtggtagtcaagatcaacctcagcatatcagcagccagggcct

SEQ ID NO: 378601 - DNA, 140 bp, Artificial Sequence
  Synthetic
atacgccatgctgggtctccatttccaggataatgctgatagcttccttttacttttatgtttacatcatgcctaccaaggagatcataggctcttcctcaaaagtgatgcagttcaatacgtacttgggagtcggccat

SEQ ID NO: 378602 - DNA, 140 bp, Artificial Sequence
  Synthetic
atggccgactcccaagtacgtattgaactgcatcacttttgaggaagagcctatgatctccttggtaggcatgatgtaaacataaaagtaaaaggaagctatcagcattatcctggaaatggagacccagcatggcgtat

SEQ ID NO: 378603 - DNA, 140 bp, Artificial Sequence
  Synthetic
aggccctggctgctgatatggcctaccaaggagatcataggctcttcctcaaaagtgatgcagttcaatatttagagggccatggcttcaggtttgaggtccgagaaaaggagaatgtgcgaccttttgggacagcggtg

SEQ ID NO: 378604 - DNA, 140 bp, Artificial Sequence
  Synthetic
caccgctgtcccaaaaggtcgcacattctccttttctcggacctcaaacctgaagccatggccctctaaatattgaactgcatcacttttgaggaagagcctatgatctccttggtaggccatatcagcagccagggcct

SEQ ID NO: 378605 - DNA, 140 bp, Artificial Sequence
  Synthetic
atacgccatgctgggtctccagaacattggctgctatgcccgaagaggagacaacggaagctaatgctggtcagtttctatcctttgccagtttgtttctacccaaacttgtcgttggggcgtacttgggagtcggccat

SEQ ID NO: 378606 - DNA, 140 bp, Artificial Sequence
  Synthetic
atggccgactcccaagtacgccccaacgacaagtttgggtagaaacaaactggcaaaggatagaaactgaccagcattagcttccgttgtctcctcttcgggcatagcagccaatgttctggagacccagcatggcgtat

SEQ ID NO: 378607 - DNA, 140 bp, Artificial Sequence
  Synthetic
aggccctggctgctgatatgtcagtttctatcctttgccagtttgtttctacccaaacttgtcgttggggagaaagcgtgcctggaaaaagtacaaaggcaaattcaggtccatgcagaagaccttttgggacagcggtg

SEQ ID NO: 378608 - DNA, 140 bp, Artificial Sequence
  Synthetic
caccgctgtcccaaaaggtcttctgcatggacctgaatttgcctttgtactttttccaggcacgctttctccccaacgacaagtttgggtagaaacaaactggcaaaggatagaaactgacatatcagcagccagggcct

SEQ ID NO: 378609 - DNA, 140 bp, Artificial Sequence
  Synthetic
atacgccatgctgggtctccggtgatcttccgtttgatgaggacaaactttttaatcaagtttctactaatacatcaagggatgcacatggttgcaggtcatgatgcgaatgacacagtacgtacttgggagtcggccat

SEQ ID NO: 378610 - DNA, 140 bp, Artificial Sequence
  Synthetic
atggccgactcccaagtacgtactgtgtcattcgcatcatgacctgcaaccatgtgcatcccttgatgtattagtagaaacttgattaaaaagtttgtcctcatcaaacggaagatcaccggagacccagcatggcgtat

SEQ ID NO: 378611 - DNA, 140 bp, Artificial Sequence
  Synthetic
aggccctggctgctgatatgtacatcaagggatgcacatggttgcaggtcatgatgcgaatgacacagtaatatctaattctgttgcccaggcaaggttctctggtcttctgattgtaaagaccttttgggacagcggtg

SEQ ID NO: 378612 - DNA, 140 bp, Artificial Sequence
  Synthetic
caccgctgtcccaaaaggtctttacaatcagaagaccagagaaccttgcctgggcaacagaattagatattactgtgtcattcgcatcatgacctgcaaccatgtgcatcccttgatgtacatatcagcagccagggcct

SEQ ID NO: 378613 - DNA, 140 bp, Artificial Sequence
  Synthetic
atacgccatgctgggtctccatccactggccaggacagcaaaagtgaagaatgaggtcagttcattcaaggcggctcttggttcacttgccaagcatggagaatatgctccgtttgcacgcgtacttgggagtcggccat

SEQ ID NO: 378614 - DNA, 140 bp, Artificial Sequence
  Synthetic
atggccgactcccaagtacgcgtgcaaacggagcatattctccatgcttggcaagtgaaccaagagccgccttgaatgaactgacctcattcttcacttttgctgtcctggccagtggatggagacccagcatggcgtat

SEQ ID NO: 378615 - DNA, 140 bp, Artificial Sequence
  Synthetic
aggccctggctgctgatatggcggctcttggttcacttgccaagcatggagaatatgctccgtttgcacgtctccttaatctttctggagtcaacaacttggaacatgggctttatccacgaccttttgggacagcggtg

SEQ ID NO: 378616 - DNA, 140 bp, Artificial Sequence
  Synthetic
caccgctgtcccaaaaggtcgtggataaagcccatgttccaagttgttgactccagaaagattaaggagacgtgcaaacggagcatattctccatgcttggcaagtgaaccaagagccgccatatcagcagccagggcct

SEQ ID NO: 378617 - DNA, 140 bp, Artificial Sequence
  Synthetic
atacgccatgctgggtctccgctggtgtgaatgtaggggagcaatatcagcaactgcgtgaggctgctactgaggctgaaaagcaactccaacaatatgctgaaacacgtgagttggatacgtacttgggagtcggccat

SEQ ID NO: 378618 - DNA, 140 bp, Artificial Sequence
  Synthetic
atggccgactcccaagtacgtatccaactcacgtgtttcagcatattgttggagttgcttttcagcctcagtagcagcctcacgcagttgctgatattgctcccctacattcacaccagcggagacccagcatggcgtat

SEQ ID NO: 378619 - DNA, 140 bp, Artificial Sequence
  Synthetic
aggccctggctgctgatatgtgaggctgaaaagcaactccaacaatatgctgaaacacgtgagttggataaccttgggcttgatgaacaggagaagaagattctcatgagcttccaccaggaccttttgggacagcggtg

SEQ ID NO: 378620 - DNA, 140 bp, Artificial Sequence
  Synthetic
caccgctgtcccaaaaggtcctggtggaagctcatgagaatcttcttctcctgttcatcaagcccaaggttatccaactcacgtgtttcagcatattgttggagttgcttttcagcctcacatatcagcagccagggcct

SEQ ID NO: 378621 - DNA, 140 bp, Artificial Sequence
  Synthetic
atacgccatgctgggtctccgaaagaacggctggctaaattgaccgaagccatcacgactgcatcgaagatcaaggttggagaccgttatcctgatgacaatgatattccatttcccgggcgtacttgggagtcggccat

SEQ ID NO: 378622 - DNA, 140 bp, Artificial Sequence
  Synthetic
atggccgactcccaagtacgcccgggaaatggaatatcattgtcatcaggataacggtctccaaccttgatcttcgatgcagtcgtgatggcttcggtcaatttagccagccgttctttcggagacccagcatggcgtat

SEQ ID NO: 378623 - DNA, 140 bp, Artificial Sequence
  Synthetic
atacgccatgctgggtctccttcacgtgatacaactattccaggtggtgttgttgacccgtatgatgatgagagtaataattatcctgactacgaggattcggctgaaggcaccacaggacgtacttgggagtcggccat

SEQ ID NO: 378624 - DNA, 140 bp, Artificial Sequence
  Synthetic
atggccgactcccaagtacgtcctgtggtgccttcagccgaatcctcgtagtcaggataattattactctcatcatcatacgggtcaacaacaccacctggaatagttgtatcacgtgaaggagacccagcatggcgtat

SEQ ID NO: 378625 - DNA, 140 bp, Artificial Sequence
  Synthetic
aggccctggctgctgatatgagagtaataattatcctgactacgaggattcggctgaaggcaccacaggagatcttgatctcttcaatttggacgacgacgatgatgacagccgaccagggaccttttgggacagcggtg

SEQ ID NO: 378626 - DNA, 140 bp, Artificial Sequence
  Synthetic
caccgctgtcccaaaaggtccctggtcggctgtcatcatcgtcgtcgtccaaattgaagagatcaagatctcctgtggtgccttcagccgaatcctcgtagtcaggataattattactctcatatcagcagccagggcct

SEQ ID NO: 378627 - DNA, 140 bp, Artificial Sequence
  Synthetic
atacgccatgctgggtctcctccaagatccgaccttggacggagcgaaaaaggtgccggagttgaccccaggttcccatcaaccaggcaacctccacatcaccaagtcgggttcaaacaccgtacttgggagtcggccat

SEQ ID NO: 378628 - DNA, 140 bp, Artificial Sequence
  Synthetic
atggccgactcccaagtacggtgtttgaacccgacttggtgatgtggaggttgcctggttgatgggaacctggggtcaactccggcacctttttcgctccgtccaaggtcggatcttggaggagacccagcatggcgtat

SEQ ID NO: 378629 - DNA, 140 bp, Artificial Sequence
  Synthetic
aggccctggctgctgatatgggttcccatcaaccaggcaacctccacatcaccaagtcgggttcaaacaccaaccaaccacaaggcaatatgtcatctactctccatagtatgacccctagaccttttgggacagcggtg

SEQ ID NO: 378630 - DNA, 140 bp, Artificial Sequence
  Synthetic
caccgctgtcccaaaaggtctaggggtcatactatggagagtagatgacatattgccttgtggttggttggtgtttgaacccgacttggtgatgtggaggttgcctggttgatgggaacccatatcagcagccagggcct

SEQ ID NO: 378631 - DNA, 140 bp, Artificial Sequence
  Synthetic
atacgccatgctgggtctccctcacatcccttgactctgaaggtgacgaagatggtgagagcatctctgaggagaacaccccaactgtagctccaccagcaccagtctacaaagacactgcgtacttgggagtcggccat

SEQ ID NO: 378632 - DNA, 140 bp, Artificial Sequence
  Synthetic
atggccgactcccaagtacgcagtgtctttgtagactggtgctggtggagctacagttggggtgttctcctcagagatgctctcaccatcttcgtcaccttcagagtcaagggatgtgagggagacccagcatggcgtat

SEQ ID NO: 378633 - DNA, 140 bp, Artificial Sequence
  Synthetic
aggccctggctgctgatatgggagaacaccccaactgtagctccaccagcaccagtctacaaagacactggagtagacactaatcagcagaatggaccaagcagtactgtagatagtcaagaccttttgggacagcggtg

SEQ ID NO: 378634 - DNA, 140 bp, Artificial Sequence
  Synthetic
caccgctgtcccaaaaggtcttgactatctacagtactgcttggtccattctgctgattagtgtctactccagtgtctttgtagactggtgctggtggagctacagttggggtgttctcccatatcagcagccagggcct

SEQ ID NO: 378635 - DNA, 140 bp, Artificial Sequence
  Synthetic
atacgccatgctgggtctccagaagaaacatattatcatctcctaaaaacacagggtccatttgaggcaatcaattattatcacctaatgagtgatgaacccattgcttttagcactgaacgtacttgggagtcggccat

SEQ ID NO: 378636 - DNA, 140 bp, Artificial Sequence
  Synthetic
atggccgactcccaagtacgttcagtgctaaaagcaatgggttcatcactcattaggtgataataattgattgcctcaaatggaccctgtgtttttaggagatgataatatgtttcttctggagacccagcatggcgtat

SEQ ID NO: 378637 - DNA, 140 bp, Artificial Sequence
  Synthetic
aggccctggctgctgatatgtcaattattatcacctaatgagtgatgaacccattgcttttagcactgaaagtggcaaggaatatatctttccagactcccttgaagaagcctacccgccgaccttttgggacagcggtg

SEQ ID NO: 378638 - DNA, 140 bp, Artificial Sequence
  Synthetic
caccgctgtcccaaaaggtcggcgggtaggcttcttcaagggagtctggaaagatatattccttgccactttcagtgctaaaagcaatgggttcatcactcattaggtgataataattgacatatcagcagccagggcct

SEQ ID NO: 378639 - DNA, 140 bp, Artificial Sequence
  Synthetic
atacgccatgctgggtctccttgatggccagcaattcctctggccggtaatgagcctacaggacaagttccttgccgttcttcaacatgactgaggacctatgattggtggatcttgtttcgtacttgggagtcggccat

SEQ ID NO: 378640 - DNA, 140 bp, Artificial Sequence
  Synthetic
atggccgactcccaagtacgaaacaagatccaccaatcataggtcctcagtcatgttgaagaacggcaaggaacttgtcctgtaggctcattaccggccagaggaattgctggccatcaaggagacccagcatggcgtat

SEQ ID NO: 378641 - DNA, 140 bp, Artificial Sequence
  Synthetic
aggccctggctgctgatatgcttgccgttcttcaacatgactgaggacctatgattggtggatcttgtttattccgagcctgattataattgttctgataattcaagtataagcacctacgaccttttgggacagcggtg

SEQ ID NO: 378642 - DNA, 140 bp, Artificial Sequence
  Synthetic
caccgctgtcccaaaaggtcgtaggtgcttatacttgaattatcagaacaattataatcaggctcggaataaacaagatccaccaatcataggtcctcagtcatgttgaagaacggcaagcatatcagcagccagggcct

SEQ ID NO: 378643 - DNA, 140 bp, Artificial Sequence
  Synthetic
atacgccatgctgggtctccgtaagttataggactacgaagagctgcttgtgtcaatttatcatgggttgatacccgtaccgcaagaatcattatttagtagttttggtcagcttctgatcgtacttgggagtcggccat

SEQ ID NO: 378644 - DNA, 140 bp, Artificial Sequence
  Synthetic
atggccgactcccaagtacgatcagaagctgaccaaaactactaaataatgattcttgcggtacgggtatcaacccatgataaattgacacaagcagctcttcgtagtcctataacttacggagacccagcatggcgtat

SEQ ID NO: 378645 - DNA, 140 bp, Artificial Sequence
  Synthetic
aggccctggctgctgatatgatacccgtaccgcaagaatcattatttagtagttttggtcagcttctgatatgtaccaataagaaaacattatagcattaaaacataaggtatctttcaagaccttttgggacagcggtg

SEQ ID NO: 378646 - DNA, 140 bp, Artificial Sequence
  Synthetic
caccgctgtcccaaaaggtcttgaaagataccttatgttttaatgctataatgttttcttattggtacatatcagaagctgaccaaaactactaaataatgattcttgcggtacgggtatcatatcagcagccagggcct

SEQ ID NO: 378647 - DNA, 140 bp, Artificial Sequence
  Synthetic
atacgccatgctgggtctccgaaaaaatccatgatgaagattaaaaccttcatcatcttttaaaaagagagctatttctgatctaaatgttcttattaatgtcaaagagctattagtttgcgtacttgggagtcggccat

SEQ ID NO: 378648 - DNA, 140 bp, Artificial Sequence
  Synthetic
atggccgactcccaagtacgcaaactaatagctctttgacattaataagaacatttagatcagaaatagctctctttttaaaagatgatgaaggttttaatcttcatcatggattttttcggagacccagcatggcgtat

SEQ ID NO: 378649 - DNA, 140 bp, Artificial Sequence
  Synthetic
aggccctggctgctgatatggctatttctgatctaaatgttcttattaatgtcaaagagctattagtttgtatcctcttagcctagacgctgcctaacatataagccatgcagcaggatagaccttttgggacagcggtg

SEQ ID NO: 378650 - DNA, 140 bp, Artificial Sequence
  Synthetic
caccgctgtcccaaaaggtctatcctgctgcatggcttatatgttaggcagcgtctaggctaagaggatacaaactaatagctctttgacattaataagaacatttagatcagaaatagccatatcagcagccagggcct

SEQ ID NO: 378651 - DNA, 140 bp, Artificial Sequence
  Synthetic
atacgccatgctgggtctccttaatgaccggcaaaataccgctaacagaggtgtttgttgacgttgaaaccaagccaagtcctaccccgataaccattattagtaagaatcctaaaacaacgtacttgggagtcggccat

SEQ ID NO: 378652 - DNA, 140 bp, Artificial Sequence
  Synthetic
atggccgactcccaagtacgttgttttaggattcttactaataatggttatcggggtaggacttggcttggtttcaacgtcaacaaacacctctgttagcggtattttgccggtcattaaggagacccagcatggcgtat

SEQ ID NO: 378653 - DNA, 140 bp, Artificial Sequence
  Synthetic
aggccctggctgctgatatgcaagccaagtcctaccccgataaccattattagtaagaatcctaaaacaacgcgtaaaagtgataagcaagtccaaacagatgatgctagtagcttattggaccttttgggacagcggtg

SEQ ID NO: 378654 - DNA, 140 bp, Artificial Sequence
  Synthetic
caccgctgtcccaaaaggtccaataagctactagcatcatctgtttggacttgcttatcacttttacgcgttgttttaggattcttactaataatggttatcggggtaggacttggcttgcatatcagcagccagggcct

SEQ ID NO: 378655 - DNA, 140 bp, Artificial Sequence
  Synthetic
atacgccatgctgggtctccgcaaaccaatgctattgaatcactagaaagtcgaatagcaaaccttgaggccagcttaaaaccagttcaagatatggcaaagaccatttcatccctgaatcgtacttgggagtcggccat

SEQ ID NO: 378656 - DNA, 140 bp, Artificial Sequence
  Synthetic
atggccgactcccaagtacgattcagggatgaaatggtctttgccatatcttgaactggttttaagctggcctcaaggtttgctattcgactttctagtgattcaatagcattggtttgcggagacccagcatggcgtat

SEQ ID NO: 378657 - DNA, 140 bp, Artificial Sequence
  Synthetic
aggccctggctgctgatatgccagcttaaaaccagttcaagatatggcaaagaccatttcatccctgaatcgcagttgtgctgaaatggttgcaaaatacgacctactggtgatgaccacgaccttttgggacagcggtg

SEQ ID NO: 378658 - DNA, 140 bp, Artificial Sequence
  Synthetic
caccgctgtcccaaaaggtcgtggtcatcaccagtaggtcgtattttgcaaccatttcagcacaactgcgattcagggatgaaatggtctttgccatatcttgaactggttttaagctggcatatcagcagccagggcct

SEQ ID NO: 378659 - DNA, 140 bp, Artificial Sequence
  Synthetic
atacgccatgctgggtctccatggacaagcacctccaggcccatcattgtacgaagatgatgctatcaaggctaaattgaaagatccgaacgggaaggttccagagagtgtcaaacaggccgtacttgggagtcggccat

SEQ ID NO: 378660 - DNA, 140 bp, Artificial Sequence
  Synthetic
atggccgactcccaagtacggcctgtttgacactctctggaaccttcccgttcggatctttcaatttagccttgatagcatcatcttcgtacaatgatgggcctggaggtgcttgtccatggagacccagcatggcgtat

SEQ ID NO: 378661 - DNA, 140 bp, Artificial Sequence
  Synthetic
atacgccatgctgggtctccgaccttacatctcagcaaaagatctcaaggaaatcatctatgatcatctcccaggatttgggacagcctttcatcagctggtgcaggttatctgcaaaatcgtacttgggagtcggccat

SEQ ID NO: 378662 - DNA, 140 bp, Artificial Sequence
  Synthetic
atggccgactcccaagtacgattttgcagataacctgcaccagctgatgaaaggctgtcccaaatcctgggagatgatcatagatgatttccttgagatcttttgctgagatgtaaggtcggagacccagcatggcgtat

SEQ ID NO: 378663 - DNA, 140 bp, Artificial Sequence
  Synthetic
aggccctggctgctgatatgcgtcaccaaagatcgatagaggttgggtctgtatttttcaatttcaagacgggaagacccttgggctaaaaatatgatacagaagcaaggtaagctcattgaccttttgggacagcggtg

SEQ ID NO: 378664 - DNA, 140 bp, Artificial Sequence
  Synthetic
caccgctgtcccaaaaggtcaatgagcttaccttgcttctgtatcatatttttagcccaagggtcttcccgtcttgaaattgaaaaatacagacccaacctctatcgatctttggtgacgcatatcagcagccagggcct

SEQ ID NO: 378665 - DNA, 140 bp, Artificial Sequence
  Synthetic
atacgccatgctgggtctcctagtctatcacgtcataagcttataagtcagttaaaaatttatcctctatcctaatcaattgatgatgctgtcaatagggagattcccctgtattgtaatcgtacttgggagtcggccat

SEQ ID NO: 378666 - DNA, 140 bp, Artificial Sequence
  Synthetic
atggccgactcccaagtacgattacaatacaggggaatctccctattgacagcatcatcaattgattaggatagaggataaatttttaactgacttataagcttatgacgtgatagactaggagacccagcatggcgtat

SEQ ID NO: 378667 - DNA, 140 bp, Artificial Sequence
  Synthetic
aggccctggctgctgatatgcctaatcaattgatgatgctgtcaatagggagattcccctgtattgtaataaaacctcattaacatatctcccctgcttggtactatgtagaaacccttggaccttttgggacagcggtg

SEQ ID NO: 378668 - DNA, 140 bp, Artificial Sequence
  Synthetic
caccgctgtcccaaaaggtccaagggtttctacatagtaccaagcaggggagatatgttaatgaggttttattacaatacaggggaatctccctattgacagcatcatcaattgattaggcatatcagcagccagggcct

SEQ ID NO: 378669 - DNA, 140 bp, Artificial Sequence
  Synthetic
atacgccatgctgggtctccaaatcttctttcttaccttcatcttatttagataaatctaggatttagggaaaatgagaagggttactgtgccgactgcaccacctgcatatgctgacatcgtacttgggagtcggccat

SEQ ID NO: 378670 - DNA, 140 bp, Artificial Sequence
  Synthetic
atggccgactcccaagtacgatgtcagcatatgcaggtggtgcagtcggcacagtaacccttctcattttccctaaatcctagatttatctaaataagatgaaggtaagaaagaagatttggagacccagcatggcgtat

SEQ ID NO: 378671 - DNA, 140 bp, Artificial Sequence
  Synthetic
atacgccatgctgggtctcctggctatcctatgagcatgcttccaatcaagtcaagcagggctgtaagtggaattcaacagaaacaagaggtccttcctggaatggatacaccatcgaaccgtacttgggagtcggccat

SEQ ID NO: 378672 - DNA, 140 bp, Artificial Sequence
  Synthetic
atggccgactcccaagtacggttcgatggtgtatccattccaggaaggacctcttgtttctgttgaattccacttacagccctgcttgacttgattggaagcatgctcataggatagccaggagacccagcatggcgtat

SEQ ID NO: 378673 - DNA, 140 bp, Artificial Sequence
  Synthetic
atacgccatgctgggtctccattgctgaccaaaaaacatacagctttgactcaacaacagcagcaattatgctcgcatcctacacgatcactcattttggaaaggccaacaaccccctcgcgtacttgggagtcggccat

SEQ ID NO: 378674 - DNA, 140 bp, Artificial Sequence
  Synthetic
atggccgactcccaagtacgcgagggggttgttggcctttccaaaatgagtgatcgtgtaggatgcgagcataattgctgctgttgttgagtcaaagctgtatgttttttggtcagcaatggagacccagcatggcgtat

SEQ ID NO: 378675 - DNA, 140 bp, Artificial Sequence
  Synthetic
atacgccatgctgggtctccctcaggatggggaaccaggctttccttcaagagtttgtgctaccaccagttcaactgccgcaatatttcacttttgatctgactgcactcaaattagtgacgtacttgggagtcggccat

SEQ ID NO: 378676 - DNA, 140 bp, Artificial Sequence
  Synthetic
atggccgactcccaagtacgtcactaatttgagtgcagtcagatcaaaagtgaaatattgcggcagttgaactggtggtagcacaaactcttgaaggaaagcctggttccccatcctgagggagacccagcatggcgtat

SEQ ID NO: 378677 - DNA, 140 bp, Artificial Sequence
  Synthetic
aggccctggctgctgatatgtcaactgccgcaatatttcacttttgatctgactgcactcaaattagtgacacagcctctccctgctgcaacatggacagatgagactccgagcaaccttgaccttttgggacagcggtg

SEQ ID NO: 378678 - DNA, 140 bp, Artificial Sequence
  Synthetic
caccgctgtcccaaaaggtcaaggttgctcggagtctcatctgtccatgttgcagcagggagaggctgtgtcactaatttgagtgcagtcagatcaaaagtgaaatattgcggcagttgacatatcagcagccagggcct

SEQ ID NO: 378679 - DNA, 140 bp, Artificial Sequence
  Synthetic
atacgccatgctgggtctcctctacttccaggcaagacgggaaagaaagggcatgtttctgatctgaccgccccagacaaaatccagacaattgtgaacctgatgcaagatttcaagattcgtacttgggagtcggccat

SEQ ID NO: 378680 - DNA, 140 bp, Artificial Sequence
  Synthetic
atggccgactcccaagtacgaatcttgaaatcttgcatcaggttcacaattgtctggattttgtctggggcggtcagatcagaaacatgccctttctttcccgtcttgcctggaagtagaggagacccagcatggcgtat

SEQ ID NO: 378681 - DNA, 140 bp, Artificial Sequence
  Synthetic
aggccctggctgctgatatgccccagacaaaatccagacaattgtgaacctgatgcaagatttcaagattgtgccaatcgacccagccaagagcatcattgggatcgaggttccagaattgaccttttgggacagcggtg

SEQ ID NO: 378682 - DNA, 140 bp, Artificial Sequence
  Synthetic
caccgctgtcccaaaaggtcaattctggaacctcgatcccaatgatgctcttggctgggtcgattggcacaatcttgaaatcttgcatcaggttcacaattgtctggattttgtctggggcatatcagcagccagggcct

SEQ ID NO: 378683 - DNA, 140 bp, Artificial Sequence
  Synthetic
atacgccatgctgggtctccctataattcctgtcttactcccaaaatacattgggctagatccaatctcgcccggagacctaactatggtcataacaccagattatgatgattgtcattccgtacttgggagtcggccat

SEQ ID NO: 378684 - DNA, 140 bp, Artificial Sequence
  Synthetic
atggccgactcccaagtacggaatgacaatcatcataatctggtgttatgaccatagttaggtctccgggcgagattggatctagcccaatgtattttgggagtaagacaggaattatagggagacccagcatggcgtat

SEQ ID NO: 378685 - DNA, 140 bp, Artificial Sequence
  Synthetic
atacgccatgctgggtctccgagacacctccagtaaagaaatcaaatcttatctatagcaactcaatcgacttttggaaggctagcagtacatatactatgggacaactcaaccctcctgcgtacttgggagtcggccat

SEQ ID NO: 378686 - DNA, 140 bp, Artificial Sequence
  Synthetic
atggccgactcccaagtacgcaggagggttgagttgtcccatagtatatgtactgctagccttccaaaagtcgattgagttgctatagataagatttgatttctttactggaggtgtctcggagacccagcatggcgtat

SEQ ID NO: 378687 - DNA, 140 bp, Artificial Sequence
  Synthetic
atacgccatgctgggtctcccaggatagaaccagcccaaagggtctcctccaagtctcccacaagcttagccaatcaatttacatgcgtaagcgatccatacttaatccaattagtgttccgtacttgggagtcggccat

SEQ ID NO: 378688 - DNA, 140 bp, Artificial Sequence
  Synthetic
atggccgactcccaagtacggaacactaattggattaagtatggatcgcttacgcatgtaaattgattggctaagcttgtgggagacttggaggagaccctttgggctggttctatcctgggagacccagcatggcgtat

SEQ ID NO: 378689 - DNA, 140 bp, Artificial Sequence
  Synthetic
aggccctggctgctgatatgccaatcaatttacatgcgtaagcgatccatacttaatccaattagtgttcgatgctcacccctccaagcctccctcctggcaaatcaacctagctgtaccgaccttttgggacagcggtg

SEQ ID NO: 378690 - DNA, 140 bp, Artificial Sequence
  Synthetic
caccgctgtcccaaaaggtcggtacagctaggttgatttgccaggagggaggcttggaggggtgagcatcgaacactaattggattaagtatggatcgcttacgcatgtaaattgattggcatatcagcagccagggcct

SEQ ID NO: 378691 - DNA, 140 bp, Artificial Sequence
  Synthetic
atacgccatgctgggtctccatcctcaccaatctatgcttatttaacccaaacataaaaagcaatgcctttacatgattgcactattaagaaaaacaaatttgatgaagattaagcctgacgtacttgggagtcggccat

SEQ ID NO: 378692 - DNA, 140 bp, Artificial Sequence
  Synthetic
atggccgactcccaagtacgtcaggcttaatcttcatcaaatttgtttttcttaatagtgcaatcatgtaaaggcattgctttttatgtttgggttaaataagcatagattggtgaggatggagacccagcatggcgtat

SEQ ID NO: 378693 - DNA, 140 bp, Artificial Sequence
  Synthetic
aggccctggctgctgatatgtacatgattgcactattaagaaaaacaaatttgatgaagattaagcctgattaaggcccaaccttcatctttttaccataatcttgttctcaataccattgaccttttgggacagcggtg

SEQ ID NO: 378694 - DNA, 140 bp, Artificial Sequence
  Synthetic
caccgctgtcccaaaaggtcaatggtattgagaacaagattatggtaaaaagatgaaggttgggccttaatcaggcttaatcttcatcaaatttgtttttcttaatagtgcaatcatgtacatatcagcagccagggcct

SEQ ID NO: 378695 - DNA, 140 bp, Artificial Sequence
  Synthetic
atacgccatgctgggtctccgagggtcttagcctactccaattgcccagagataaatttcgaaaaagctctttctttgtttgggtcatcatcttatttcaaaaggccttttccatgccttcgtacttgggagtcggccat

SEQ ID NO: 378696 - DNA, 140 bp, Artificial Sequence
  Synthetic
atggccgactcccaagtacgaaggcatggaaaaggccttttgaaataagatgatgacccaaacaaagaaagagctttttcgaaatttatctctgggcaattggagtaggctaagaccctcggagacccagcatggcgtat

SEQ ID NO: 378697 - DNA, 140 bp, Artificial Sequence
  Synthetic
atacgccatgctgggtctccgtctgcaaggatcatcttgcatccactgaccagctgaaatcagttggtctcaacctcgaggggagcggagtatctactgatatcccatctgcgacaaagccgtacttgggagtcggccat

SEQ ID NO: 378698 - DNA, 140 bp, Artificial Sequence
  Synthetic
atggccgactcccaagtacggctttgtcgcagatgggatatcagtagatactccgctcccctcgaggttgagaccaactgatttcagctggtcagtggatgcaagatgatccttgcagacggagacccagcatggcgtat

SEQ ID NO: 378699 - DNA, 140 bp, Artificial Sequence
  Synthetic
atacgccatgctgggtctccggagaatgggctgaaaattgctacaatcttgaaataaagaagccggacgggagcgaatgcttacccccaccgccggatggtgtcagaggctttccaaggtcgtacttgggagtcggccat

SEQ ID NO: 378700 - DNA, 140 bp, Artificial Sequence
  Synthetic
atggccgactcccaagtacgaccttggaaagcctctgacaccatccggcggtgggggtaagcattcgctcccgtccggcttctttatttcaagattgtagcaattttcagcccattctccggagacccagcatggcgtat

SEQ ID NO: 378701 - DNA, 140 bp, Artificial Sequence
  Synthetic
atacgccatgctgggtctccgcctttcacaaggatggagctttcttcctctatgacaggctggcttcaactgtaatttacagaggagtcaattttgctgagggggtaattgcattcttgacgtacttgggagtcggccat

SEQ ID NO: 378702 - DNA, 140 bp, Artificial Sequence
  Synthetic
atggccgactcccaagtacgtcaagaatgcaattaccccctcagcaaaattgactcctctgtaaattacagttgaagccagcctgtcatagaggaagaaagctccatccttgtgaaaggcggagacccagcatggcgtat

SEQ ID NO: 378703 - DNA, 140 bp, Artificial Sequence
  Synthetic
aggccctggctgctgatatgtgtaatttacagaggagtcaattttgctgagggggtaattgcattcttgatattggctaaaccaaaggaaacgttccttcaatcaccccccattcgagaggaccttttgggacagcggtg

SEQ ID NO: 378704 - DNA, 140 bp, Artificial Sequence
  Synthetic
caccgctgtcccaaaaggtcctctcgaatggggggtgattgaaggaacgtttcctttggtttagccaatatcaagaatgcaattaccccctcagcaaaattgactcctctgtaaattacacatatcagcagccagggcct

SEQ ID NO: 378705 - DNA, 140 bp, Artificial Sequence
  Synthetic
atacgccatgctgggtctccggagtacgaaatcgaaaattttggtgctcaacactccacgacccttttcaaaattaacaataatacttttgttcttctggacaggccccacacgcctcagcgtacttgggagtcggccat

SEQ ID NO: 378706 - DNA, 140 bp, Artificial Sequence
  Synthetic
atggccgactcccaagtacgctgaggcgtgtggggcctgtccagaagaacaaaagtattattgttaattttgaaaagggtcgtggagtgttgagcaccaaaattttcgatttcgtactccggagacccagcatggcgtat

SEQ ID NO: 378707 - DNA, 140 bp, Artificial Sequence
  Synthetic
aggccctggctgctgatatgaaattaacaataatacttttgttcttctggacaggccccacacgcctcagttccttttccagctgaatgataccattcaccttcaccaacagttgagcaagaccttttgggacagcggtg

SEQ ID NO: 378708 - DNA, 140 bp, Artificial Sequence
  Synthetic
caccgctgtcccaaaaggtcttgctcaactgttggtgaaggtgaatggtatcattcagctggaaaaggaactgaggcgtgtggggcctgtccagaagaacaaaagtattattgttaatttcatatcagcagccagggcct

SEQ ID NO: 378709 - DNA, 140 bp, Artificial Sequence
  Synthetic
aggccctggctgctgatatgttggtgaatgggctttttgggaaaataaaaaaatctctccgaacaactacgtggagaagagctgtctttcgaaactttatcgctcaacgagacagaagacgaccttttgggacagcggtg

SEQ ID NO: 378710 - DNA, 140 bp, Artificial Sequence
  Synthetic
caccgctgtcccaaaaggtcgtcttctgtctcgttgagcgataaagtttcgaaagacagctcttctccacgtagttgttcggagagatttttttattttcccaaaaagcccattcaccaacatatcagcagccagggcct

SEQ ID NO: 378711 - DNA, 140 bp, Artificial Sequence
  Synthetic
aggccctggctgctgatatggtggagaagagctgtctttcgaaactttatcgctcaacgagacagaagacgatgatgcgacatcgtcgagaactacaaagggaagaatctccgaccgggcgaccttttgggacagcggtg

SEQ ID NO: 378712 - DNA, 140 bp, Artificial Sequence
  Synthetic
caccgctgtcccaaaaggtcgcccggtcggagattcttccctttgtagttctcgacgatgtcgcatcatcgtcttctgtctcgttgagcgataaagtttcgaaagacagctcttctccaccatatcagcagccagggcct

SEQ ID NO: 378713 - DNA, 140 bp, Artificial Sequence
  Synthetic
atacgccatgctgggtctcccattgcacgtaccagaaggggaaacaacattgccgtctcagaattcgacagaaggtcgaagagtagatgtgaatactcaggaaactatcacagagacaaccgtacttgggagtcggccat

SEQ ID NO: 378714 - DNA, 140 bp, Artificial Sequence
  Synthetic
atggccgactcccaagtacggttgtctctgtgatagtttcctgagtattcacatctactcttcgaccttctgtcgaattctgagacggcaatgttgtttccccttctggtacgtgcaatgggagacccagcatggcgtat

SEQ ID NO: 378715 - DNA, 140 bp, Artificial Sequence
  Synthetic
atacgccatgctgggtctcctgcaacaatcataggcactaacggtaacaacatgcagatctccaccatcgggacaggactgagctccagccaaatcctgagttcctcaccgaccatggcacgtacttgggagtcggccat

SEQ ID NO: 378716 - DNA, 140 bp, Artificial Sequence
  Synthetic
atggccgactcccaagtacgtgccatggtcggtgaggaactcaggatttggctggagctcagtcctgtcccgatggtggagatctgcatgttgttaccgttagtgcctatgattgttgcaggagacccagcatggcgtat

SEQ ID NO: 378717 - DNA, 140 bp, Artificial Sequence
  Synthetic
atacgccatgctgggtctccgatgaccaccgaggaatcaacaacaccaccgagaaactctcctggctcaacaacagaagcacccactctcaccaccccagagaatataacaacagcggttcgtacttgggagtcggccat

SEQ ID NO: 378718 - DNA, 140 bp, Artificial Sequence
  Synthetic
atggccgactcccaagtacgaaccgctgttgttatattctctggggtggtgagagtgggtgcttctgttgttgagccaggagagtttctcggtggtgttgttgattcctcggtggtcatcggagacccagcatggcgtat

SEQ ID NO: 378719 - DNA, 140 bp, Artificial Sequence
  Synthetic
aggccctggctgctgatatgcaacagaagcacccactctcaccaccccagagaatataacaacagcggttaaaactgttttgccacaagagtccacaagcaacggtctaataacttcaacgaccttttgggacagcggtg

SEQ ID NO: 378720 - DNA, 140 bp, Artificial Sequence
  Synthetic
caccgctgtcccaaaaggtcgttgaagttattagaccgttgcttgtggactcttgtggcaaaacagttttaaccgctgttgttatattctctggggtggtgagagtgggtgcttctgttgcatatcagcagccagggcct

SEQ ID NO: 378721 - DNA, 140 bp, Artificial Sequence
  Synthetic
atacgccatgctgggtctccaagttaacaccagggccacgggtaaatgcaatcccaacttacactactggactgcacaagaacaacataatgctgctgggattgcctggatcccgtacttcgtacttgggagtcggccat

SEQ ID NO: 378722 - DNA, 140 bp, Artificial Sequence
  Synthetic
atggccgactcccaagtacgaagtacgggatccaggcaatcccagcagcattatgttgttcttgtgcagtccagtagtgtaagttgggattgcatttacccgtggccctggtgttaacttggagacccagcatggcgtat

SEQ ID NO: 378723 - DNA, 140 bp, Artificial Sequence
  Synthetic
aggccctggctgctgatatgactgcacaagaacaacataatgctgctgggattgcctggatcccgtactttggaccgggtgcagaaggcatatacactgaaggccttatgcacaaccaaagaccttttgggacagcggtg

SEQ ID NO: 378724 - DNA, 140 bp, Artificial Sequence
  Synthetic
caccgctgtcccaaaaggtctttggttgtgcataaggccttcagtgtatatgccttctgcacccggtccaaagtacgggatccaggcaatcccagcagcattatgttgttcttgtgcagtcatatcagcagccagggcct

SEQ ID NO: 378725 - DNA, 140 bp, Artificial Sequence
  Synthetic
atacgccatgctgggtctccctgcagcttttcttaagggccacgacggagctgcggacatataccatactcaataggaaggccatagatttccttctgcgacgatggggcgggacatgtacgtacttgggagtcggccat

SEQ ID NO: 378726 - DNA, 140 bp, Artificial Sequence
  Synthetic
atggccgactcccaagtacgtacatgtcccgccccatcgtcgcagaaggaaatctatggccttcctattgagtatggtatatgtccgcagctccgtcgtggcccttaagaaaagctgcagggagacccagcatggcgtat

SEQ ID NO: 378727 - DNA, 140 bp, Artificial Sequence
  Synthetic
aggccctggctgctgatatgcaataggaaggccatagatttccttctgcgacgatggggcgggacatgtaggatcctgggaccagattgttgcattgagccacatgattggaccaaaaacgaccttttgggacagcggtg

SEQ ID NO: 378728 - DNA, 140 bp, Artificial Sequence
  Synthetic
caccgctgtcccaaaaggtcgtttttggtccaatcatgtggctcaatgcaacaatctggtcccaggatcctacatgtcccgccccatcgtcgcagaaggaaatctatggccttcctattgcatatcagcagccagggcct

SEQ ID NO: 378729 - DNA, 140 bp, Artificial Sequence
  Synthetic
atacgccatgctgggtctccacccaatcaggataatgatgataattggtggacgggctggagacagtggatccctgcaggaataggcattactggaattattattgcaatcattgctcttcgtacttgggagtcggccat

SEQ ID NO: 378730 - DNA, 140 bp, Artificial Sequence
  Synthetic
atggccgactcccaagtacgaagagcaatgattgcaataataattccagtaatgcctattcctgcagggatccactgtctccagcccgtccaccaattatcatcattatcctgattgggtggagacccagcatggcgtat

SEQ ID NO: 378731 - DNA, 140 bp, Artificial Sequence
  Synthetic
aggccctggctgctgatatgtccctgcaggaataggcattactggaattattattgcaatcattgctcttctttgcgtctgcaagctgctttgttgaatatcaacttgaatcattaatttgaccttttgggacagcggtg

SEQ ID NO: 378732 - DNA, 140 bp, Artificial Sequence
  Synthetic
caccgctgtcccaaaaggtcaaattaatgattcaagttgatattcaacaaagcagcttgcagacgcaaagaagagcaatgattgcaataataattccagtaatgcctattcctgcagggacatatcagcagccagggcct

SEQ ID NO: 378733 - DNA, 140 bp, Artificial Sequence
  Synthetic
atacgccatgctgggtctccgaaaataaggctaatgccaaattctgtgcaaaacttgaaagtaggtttacaaaaatcctttgaactggaatgctttaatgctctttctcaatactatatacgtacttgggagtcggccat

SEQ ID NO: 378734 - DNA, 140 bp, Artificial Sequence
  Synthetic
atggccgactcccaagtacgtatatagtattgagaaagagcattaaagcattccagttcaaaggatttttgtaaacctactttcaagttttgcacagaatttggcattagccttattttcggagacccagcatggcgtat

SEQ ID NO: 378735 - DNA, 140 bp, Artificial Sequence
  Synthetic
aggccctggctgctgatatgaaaaatcctttgaactggaatgctttaatgctctttctcaatactatataagttccttcccaaaaataatattgatgaagattaagaaaaagtgacattggaccttttgggacagcggtg

SEQ ID NO: 378736 - DNA, 140 bp, Artificial Sequence
  Synthetic
caccgctgtcccaaaaggtccaatgtcactttttcttaatcttcatcaatattatttttgggaaggaacttatatagtattgagaaagagcattaaagcattccagttcaaaggatttttcatatcagcagccagggcct

SEQ ID NO: 378737 - DNA, 140 bp, Artificial Sequence
  Synthetic
atacgccatgctgggtctccttgaatcaacccttacacttgcttaggaaagagcctgtcctcgacaagaattccgaggcggcaattcagttaatttaatatcaagataacatccatttcccgtacttgggagtcggccat

SEQ ID NO: 378738 - DNA, 140 bp, Artificial Sequence
  Synthetic
atggccgactcccaagtacgggaaatggatgttatcttgatattaaattaactgaattgccgcctcggaattcttgtcgaggacaggctctttcctaagcaagtgtaagggttgattcaaggagacccagcatggcgtat

SEQ ID NO: 378739 - DNA, 140 bp, Artificial Sequence
  Synthetic
aggccctggctgctgatatgttccgaggcggcaattcagttaatttaatatcaagataacatccatttccaaggccacagctagttatattattaacttttatcacaaatatggagaggggaccttttgggacagcggtg

SEQ ID NO: 378740 - DNA, 140 bp, Artificial Sequence
  Synthetic
caccgctgtcccaaaaggtcccctctccatatttgtgataaaagttaataatataactagctgtggccttggaaatggatgttatcttgatattaaattaactgaattgccgcctcggaacatatcagcagccagggcct

SEQ ID NO: 378741 - DNA, 140 bp, Artificial Sequence
  Synthetic
atacgccatgctgggtctccacaggtccgcaatttaggacaagatccatttcccgggataagacaacaacagactaccgtagtagtcgaagcacttcgcaagttagagtccctacagtctcgtacttgggagtcggccat

SEQ ID NO: 378742 - DNA, 140 bp, Artificial Sequence
  Synthetic
atggccgactcccaagtacgagactgtagggactctaacttgcgaagtgcttcgactactacggtagtctgttgttgtcttatcccgggaaatggatcttgtcctaaattgcggacctgtggagacccagcatggcgtat

SEQ ID NO: 378743 - DNA, 140 bp, Artificial Sequence
  Synthetic
aggccctggctgctgatatgagactaccgtagtagtcgaagcacttcgcaagttagagtccctacagtcttccataagaaaggtaccgggacccttactgtccctccagcacctaaggatgaccttttgggacagcggtg

SEQ ID NO: 378744 - DNA, 140 bp, Artificial Sequence
  Synthetic
caccgctgtcccaaaaggtcatccttaggtgctggagggacagtaagggtcccggtacctttcttatggaagactgtagggactctaacttgcgaagtgcttcgactactacggtagtctcatatcagcagccagggcct

SEQ ID NO: 378745 - DNA, 140 bp, Artificial Sequence
  Synthetic
atacgccatgctgggtctccaaaggaccaccaacttgaaagcctaaccgaccgggagctcctgcttcttatagcacggaagacctgtggatcaactgattcatcacttaatatagctgctcgtacttgggagtcggccat

SEQ ID NO: 378746 - DNA, 140 bp, Artificial Sequence
  Synthetic
atggccgactcccaagtacgagcagctatattaagtgatgaatcagttgatccacaggtcttccgtgctataagaagcaggagctcccggtcggttaggctttcaagttggtggtcctttggagacccagcatggcgtat

SEQ ID NO: 378747 - DNA, 140 bp, Artificial Sequence
  Synthetic
aggccctggctgctgatatgtagcacggaagacctgtggatcaactgattcatcacttaatatagctgctcctaaagacttaagactggcaaatcctacggctgatgacttcaagcaggagaccttttgggacagcggtg

SEQ ID NO: 378748 - DNA, 140 bp, Artificial Sequence
  Synthetic
caccgctgtcccaaaaggtctcctgcttgaagtcatcagccgtaggatttgccagtcttaagtctttaggagcagctatattaagtgatgaatcagttgatccacaggtcttccgtgctacatatcagcagccagggcct

SEQ ID NO: 378749 - DNA, 140 bp, Artificial Sequence
  Synthetic
atacgccatgctgggtctccgggctaatcagaatattaatgaggtagatgatgcaaaactccgtgctcttttgacgttgagtgctgttctagtgcggaaattctctaagtcacaacttagcgtacttgggagtcggccat

SEQ ID NO: 378750 - DNA, 140 bp, Artificial Sequence
  Synthetic
atggccgactcccaagtacgctaagttgtgacttagagaatttccgcactagaacagcactcaacgtcaaaagagcacggagttttgcatcatctacctcattaatattctgattagcccggagacccagcatggcgtat

SEQ ID NO: 378751 - DNA, 140 bp, Artificial Sequence
  Synthetic
aggccctggctgctgatatgttgacgttgagtgctgttctagtgcggaaattctctaagtcacaacttagtcaattatgtgagagtcatcttaggagggaaaacttggggcaagaccaaggaccttttgggacagcggtg

SEQ ID NO: 378752 - DNA, 140 bp, Artificial Sequence
  Synthetic
caccgctgtcccaaaaggtccttggtcttgccccaagttttccctcctaagatgactctcacataattgactaagttgtgacttagagaatttccgcactagaacagcactcaacgtcaacatatcagcagccagggcct

SEQ ID NO: 378753 - DNA, 140 bp, Artificial Sequence
  Synthetic
atacgccatgctgggtctccgctttcgaggcagcactatggcaacagtgggatagacaatcattgactatgtttatatctgcttttctccatgtagcattgcaactttcctgtgagagctcgtacttgggagtcggccat

SEQ ID NO: 378754 - DNA, 140 bp, Artificial Sequence
  Synthetic
atggccgactcccaagtacgagctctcacaggaaagttgcaatgctacatggagaaaagcagatataaacatagtcaatgattgtctatcccactgttgccatagtgctgcctcgaaagcggagacccagcatggcgtat

SEQ ID NO: 378755 - DNA, 140 bp, Artificial Sequence
  Synthetic
aggccctggctgctgatatggtttatatctgcttttctccatgtagcattgcaactttcctgtgagagctccaccgtagtgatatcaggcctacgcttacttgccccgccaagcgtgaatgaccttttgggacagcggtg

SEQ ID NO: 378756 - DNA, 140 bp, Artificial Sequence
  Synthetic
caccgctgtcccaaaaggtcattcacgcttggcggggcaagtaagcgtaggcctgatatcactacggtggagctctcacaggaaagttgcaatgctacatggagaaaagcagatataaaccatatcagcagccagggcct

SEQ ID NO: 378757 - DNA, 140 bp, Artificial Sequence
  Synthetic
atacgccatgctgggtctccaacttagtccgtagggaggacaagtcaaataagatatcctcatcctctataggaggtattttttaagagggggacaggatatgaataaggataacgactacgtacttgggagtcggccat

SEQ ID NO: 378758 - DNA, 140 bp, Artificial Sequence
  Synthetic
atggccgactcccaagtacgtagtcgttatccttattcatatcctgtccccctcttaaaaaatacctcctatagaggatgaggatatcttatttgacttgtcctccctacggactaagttggagacccagcatggcgtat

SEQ ID NO: 378759 - DNA, 140 bp, Artificial Sequence
  Synthetic
aggccctggctgctgatatgaggaggtattttttaagagggggacaggatatgaataaggataacgactaaagccaatataaagataagaacacaaataggaattaaaatagaaatcaaagaccttttgggacagcggtg

SEQ ID NO: 378760 - DNA, 140 bp, Artificial Sequence
  Synthetic
caccgctgtcccaaaaggtctttgatttctattttaattcctatttgtgttcttatctttatattggctttagtcgttatccttattcatatcctgtccccctcttaaaaaatacctcctcatatcagcagccagggcct

SEQ ID NO: 378761 - DNA, 140 bp, Artificial Sequence
  Synthetic
atacgccatgctgggtctccgatattaatcatttattgttaaaaataaacaaagtcagtaagagtgttaggatcattatattgtaaggatcttcccttgaagcgttgaatcatctcaagtcgtacttgggagtcggccat

SEQ ID NO: 378762 - DNA, 140 bp, Artificial Sequence
  Synthetic
atggccgactcccaagtacgacttgagatgattcaacgcttcaagggaagatccttacaatataatgatcctaacactcttactgactttgtttatttttaacaataaatgattaatatcggagacccagcatggcgtat

SEQ ID NO: 378763 - DNA, 140 bp, Artificial Sequence
  Synthetic
aggccctggctgctgatatggatcattatattgtaaggatcttcccttgaagcgttgaatcatctcaagtagcctagaaccaaaacagtagagcattaaattgtaatagataatagggacgaccttttgggacagcggtg

SEQ ID NO: 378764 - DNA, 140 bp, Artificial Sequence
  Synthetic
caccgctgtcccaaaaggtcgtccctattatctattacaatttaatgctctactgttttggttctaggctacttgagatgattcaacgcttcaagggaagatccttacaatataatgatccatatcagcagccagggcct

SEQ ID NO: 378765 - DNA, 140 bp, Artificial Sequence
  Synthetic
atacgccatgctgggtctcccccatggacacactctaacattgaggatagggtttccttgatgatagtctagtcttaggtacagggtagtcctacacgccctatattatacaatctaaaccgtacttgggagtcggccat

SEQ ID NO: 378766 - DNA, 140 bp, Artificial Sequence
  Synthetic
atggccgactcccaagtacggtttagattgtataatatagggcgtgtaggactaccctgtacctaagactagactatcatcaaggaaaccctatcctcaatgttagagtgtgtccatgggggagacccagcatggcgtat

SEQ ID NO: 378767 - DNA, 140 bp, Artificial Sequence
  Synthetic
atacgccatgctgggtctccttgtaaaattgaactacaaaaacatgatgaaaattaatgagaaggttccaagattgacttcaatccaaacaccttgctctgccaattttcatctccttaacgtacttgggagtcggccat

SEQ ID NO: 378768 - DNA, 140 bp, Artificial Sequence
  Synthetic
atggccgactcccaagtacgttaaggagatgaaaattggcagagcaaggtgtttggattgaagtcaatcttggaaccttctcattaattttcatcatgtttttgtagttcaattttacaaggagacccagcatggcgtat

SEQ ID NO: 378769 - DNA, 140 bp, Artificial Sequence
  Synthetic
atacgccatgctgggtctccctctttcacatatttgggctcctactgggctagggtttatagttaaggaagactcatctcatttctcattgaactattctactcgtaggatcctactgggcgtacttgggagtcggccat

SEQ ID NO: 378770 - DNA, 140 bp, Artificial Sequence
  Synthetic
atggccgactcccaagtacgcccagtaggatcctacgagtagaatagttcaatgagaaatgagatgagtcttccttaactataaaccctagcccagtaggagcccaaatatgtgaaagagggagacccagcatggcgtat

SEQ ID NO: 378771 - DNA, 140 bp, Artificial Sequence
  Synthetic
atacgccatgctgggtctccaaactacctgagatcgggtcatttctccaactcattctgcaagtaattgtttagcatcataacaacagcgttataatttaaaaatcaagtcttgtaacaacgtacttgggagtcggccat

SEQ ID NO: 378772 - DNA, 140 bp, Artificial Sequence
  Synthetic
atggccgactcccaagtacgttgttacaagacttgatttttaaattataacgctgttgttatgatgctaaacaattacttgcagaatgagttggagaaatgacccgatctcaggtagtttggagacccagcatggcgtat

SEQ ID NO: 378773 - DNA, 140 bp, Artificial Sequence
  Synthetic
atacgccatgctgggtctccaggagaagctccttttgcaagcctaagattccattagagataaccagaatggctaaagccacaggccggtacaacttggtaacaccaaaacgggagctagcgtacttgggagtcggccat

SEQ ID NO: 378774 - DNA, 140 bp, Artificial Sequence
  Synthetic
atggccgactcccaagtacgctagctcccgttttggtgttaccaagttgtaccggcctgtggctttagccattctggttatctctaatggaatcttaggcttgcaaaaggagcttctcctggagacccagcatggcgtat

SEQ ID NO: 378775 - DNA, 140 bp, Artificial Sequence
  Synthetic
aggccctggctgctgatatgtctgaagtccaaactcccatttgggccttgagggtaattcttgccgccgggattcttgaccaattaatggatcattccctcatcgagccactatcagggggaccttttgggacagcggtg

SEQ ID NO: 378776 - DNA, 140 bp, Artificial Sequence
  Synthetic
caccgctgtcccaaaaggtccccctgatagtggctcgatgagggaatgatccattaattggtcaagaatcccggcggcaagaattaccctcaaggcccaaatgggagtttggacttcagacatatcagcagccagggcct

SEQ ID NO: 378777 - DNA, 140 bp, Artificial Sequence
  Synthetic
atacgccatgctgggtctccaacatgagaacgcaacgagtgaaggaccaactgagcatgaggatgttatctcttataaggtcaaatattattaactttataaataagctcgaaactcttccgtacttgggagtcggccat

SEQ ID NO: 378778 - DNA, 140 bp, Artificial Sequence
  Synthetic
atggccgactcccaagtacggaagagtttcgagcttatttataaagttaataatatttgaccttataagagataacatcctcatgctcagttggtccttcactcgttgcgttctcatgttggagacccagcatggcgtat

SEQ ID NO: 378779 - DNA, 140 bp, Artificial Sequence
  Synthetic
aggccctggctgctgatatgtcttataaggtcaaatattattaactttataaataagctcgaaactcttcatgttgttaattacaagggacttctaagcagtgttgagataggaacaccagaccttttgggacagcggtg

SEQ ID NO: 378780 - DNA, 140 bp, Artificial Sequence
  Synthetic
caccgctgtcccaaaaggtctggtgttcctatctcaacactgcttagaagtcccttgtaattaacaacatgaagagtttcgagcttatttataaagttaataatatttgaccttataagacatatcagcagccagggcct

SEQ ID NO: 378781 - DNA, 140 bp, Artificial Sequence
  Synthetic
atacgccatgctgggtctcctcaggaaccagataaatctgcgatggatatacgacaccctggtcctgtcaagttctctctactgcatgaatcgaccctcaaacctgttgccacttctaaacgtacttgggagtcggccat

SEQ ID NO: 378782 - DNA, 140 bp, Artificial Sequence
  Synthetic
atggccgactcccaagtacgtttagaagtggcaacaggtttgagggtcgattcatgcagtagagagaacttgacaggaccagggtgtcgtatatccatcgcagatttatctggttcctgaggagacccagcatggcgtat

SEQ ID NO: 378783 - DNA, 140 bp, Artificial Sequence
  Synthetic
atacgccatgctgggtctccttaattgccataacaaagattgtatgatagggctaatattgattcaataatctatcgtaggacagaatcattttcctgtatgatctcagtttaatctctccgtacttgggagtcggccat

SEQ ID NO: 378784 - DNA, 140 bp, Artificial Sequence
  Synthetic
atggccgactcccaagtacggagagattaaactgagatcatacaggaaaatgattctgtcctacgatagattattgaatcaatattagccctatcatacaatctttgttatggcaattaaggagacccagcatggcgtat

SEQ ID NO: 378785 - DNA, 140 bp, Artificial Sequence
  Synthetic
atacgccatgctgggtctcctgtttgaacctctagtatccctgtaaatattttcattcaattgtcagcccttacatgtgtagtcacttgtgtagcatgacactagttttgccttcaattacgtacttgggagtcggccat

SEQ ID NO: 378786 - DNA, 140 bp, Artificial Sequence
  Synthetic
atggccgactcccaagtacgtaattgaaggcaaaactagtgtcatgctacacaagtgactacacatgtaagggctgacaattgaatgaaaatatttacagggatactagaggttcaaacaggagacccagcatggcgtat

SEQ ID NO: 378787 - DNA, 140 bp, Artificial Sequence
  Synthetic
atacgccatgctgggtctcctagtcaaaacaatgtgagatccagtttcactcacagcatctattcaatatttacagtatgatgagtccgaattaacacagtagaggtctaggtgtgttaacgtacttgggagtcggccat

SEQ ID NO: 378788 - DNA, 140 bp, Artificial Sequence
  Synthetic
atggccgactcccaagtacgttaacacacctagacctctactgtgttaattcggactcatcatactgtaaatattgaatagatgctgtgagtgaaactggatctcacattgttttgactaggagacccagcatggcgtat

SEQ ID NO: 378789 - DNA, 140 bp, Artificial Sequence
  Synthetic
atacgccatgctgggtctcccagaacgaggaagattaagaaaaagtccataatgctgggtggacaatccttgccaccataggactttttcaattcctctactttatgatggctacccaaccgtacttgggagtcggccat

SEQ ID NO: 378790 - DNA, 140 bp, Artificial Sequence
  Synthetic
atggccgactcccaagtacggttgggtagccatcataaagtagaggaattgaaaaagtcctatggtggcaaggattgtccacccagcattatggactttttcttaatcttcctcgttctgggagacccagcatggcgtat

SEQ ID NO: 378791 - DNA, 140 bp, Artificial Sequence
  Synthetic
aggccctggctgctgatatgtgccaccataggactttttcaattcctctactttatgatggctacccaacatacacaatatcctgatgcaagattgtcttccccaatcgttttagaccaagaccttttgggacagcggtg

SEQ ID NO: 378792 - DNA, 140 bp, Artificial Sequence
  Synthetic
caccgctgtcccaaaaggtcttggtctaaaacgattggggaagacaatcttgcatcaggatattgtgtatgttgggtagccatcataaagtagaggaattgaaaaagtcctatggtggcacatatcagcagccagggcct

SEQ ID NO: 378793 - DNA, 140 bp, Artificial Sequence
  Synthetic
atacgccatgctgggtctccccctaaactaagaacatgccgcttgccgaaacatatctatagattaaaatatgacgccattgttttacgatttatcagtgatgtccctgtagctacaatccgtacttgggagtcggccat

SEQ ID NO: 378794 - DNA, 140 bp, Artificial Sequence
  Synthetic
atggccgactcccaagtacggattgtagctacagggacatcactgataaatcgtaaaacaatggcgtcatattttaatctatagatatgtttcggcaagcggcatgttcttagtttagggggagacccagcatggcgtat

SEQ ID NO: 378795 - DNA, 140 bp, Artificial Sequence
  Synthetic
aggccctggctgctgatatgatgacgccattgttttacgatttatcagtgatgtccctgtagctacaatcccaatagattacattgctccaatgttaataaatgttctggcagatagtaagaccttttgggacagcggtg

SEQ ID NO: 378796 - DNA, 140 bp, Artificial Sequence
  Synthetic
caccgctgtcccaaaaggtcttactatctgccagaacatttattaacattggagcaatgtaatctattgggattgtagctacagggacatcactgataaatcgtaaaacaatggcgtcatcatatcagcagccagggcct

SEQ ID NO: 378797 - DNA, 140 bp, Artificial Sequence
  Synthetic
atacgccatgctgggtctccattatactgtgcaggatgcggcattccttaattattacatgaatcagattaaaacacaggaaggagtaattacagatcaattaaaacagaacattcgtagcgtacttgggagtcggccat

SEQ ID NO: 378798 - DNA, 140 bp, Artificial Sequence
  Synthetic
atggccgactcccaagtacgctacgaatgttctgttttaattgatctgtaattactccttcctgtgttttaatctgattcatgtaataattaaggaatgccgcatcctgcacagtataatggagacccagcatggcgtat

SEQ ID NO: 378799 - DNA, 140 bp, Artificial Sequence
  Synthetic
aggccctggctgctgatatgaaaacacaggaaggagtaattacagatcaattaaaacagaacattcgtagggtcattcacaaaaacagatatttatctgctctatttttctggcatgatcgaccttttgggacagcggtg

SEQ ID NO: 378800 - DNA, 140 bp, Artificial Sequence
  Synthetic
caccgctgtcccaaaaggtcgatcatgccagaaaaatagagcagataaatatctgtttttgtgaatgaccctacgaatgttctgttttaattgatctgtaattactccttcctgtgttttcatatcagcagccagggcct

SEQ ID NO: 378801 - DNA, 140 bp, Artificial Sequence
  Synthetic
atacgccatgctgggtctccacttggtttgtaacgaatgaggttgttgatatcctaggatatggtgattatattttctggaagatccctattgctctattaccaatgaacacagctaatgcgtacttgggagtcggccat

SEQ ID NO: 378802 - DNA, 140 bp, Artificial Sequence
  Synthetic
atggccgactcccaagtacgcattagctgtgttcattggtaatagagcaatagggatcttccagaaaatataatcaccatatcctaggatatcaacaacctcattcgttacaaaccaagtggagacccagcatggcgtat

SEQ ID NO: 378803 - DNA, 140 bp, Artificial Sequence
  Synthetic
aggccctggctgctgatatgtattttctggaagatccctattgctctattaccaatgaacacagctaatgttcctcatgcatcgactgactggtaccaacctaatatcttcaaggaggctgaccttttgggacagcggtg

SEQ ID NO: 378804 - DNA, 140 bp, Artificial Sequence
  Synthetic
caccgctgtcccaaaaggtcagcctccttgaagatattaggttggtaccagtcagtcgatgcatgaggaacattagctgtgttcattggtaatagagcaatagggatcttccagaaaatacatatcagcagccagggcct

SEQ ID NO: 378805 - DNA, 140 bp, Artificial Sequence
  Synthetic
atacgccatgctgggtctcctatgtgtaaggatcttgtcacaagtcgttttaacacccttctgattgctgagttagccaggttggaagatccagtgtccgctgattatccactggtagatcgtacttgggagtcggccat

SEQ ID NO: 378806 - DNA, 140 bp, Artificial Sequence
  Synthetic
atggccgactcccaagtacgatctaccagtggataatcagcggacactggatcttccaacctggctaactcagcaatcagaagggtgttaaaacgacttgtgacaagatccttacacataggagacccagcatggcgtat

SEQ ID NO: 378807 - DNA, 140 bp, Artificial Sequence
  Synthetic
aggccctggctgctgatatgagttagccaggttggaagatccagtgtccgctgattatccactggtagatgatattcaatctctgtataatgcaggagactacttgttgtccatattggggaccttttgggacagcggtg

SEQ ID NO: 378808 - DNA, 140 bp, Artificial Sequence
  Synthetic
caccgctgtcccaaaaggtccccaatatggacaacaagtagtctcctgcattatacagagattgaatatcatctaccagtggataatcagcggacactggatcttccaacctggctaactcatatcagcagccagggcct

SEQ ID NO: 378809 - DNA, 140 bp, Artificial Sequence
  Synthetic
atacgccatgctgggtctccagattcaactatgttcccaatatacagaacgaaaagggcggtttttaacccagatgcatcttgcagttattcaaacattgcgtgaacttctccttaatagcgtacttgggagtcggccat

SEQ ID NO: 378810 - DNA, 140 bp, Artificial Sequence
  Synthetic
atggccgactcccaagtacgctattaaggagaagttcacgcaatgtttgaataactgcaagatgcatctgggttaaaaaccgcccttttcgttctgtatattgggaacatagttgaatctggagacccagcatggcgtat

SEQ ID NO: 378811 - DNA, 140 bp, Artificial Sequence
  Synthetic
aggccctggctgctgatatgcagatgcatcttgcagttattcaaacattgcgtgaacttctccttaatagagggttgaaaaaatcacagctttctaaaatccgtgagttccaccaactgtgaccttttgggacagcggtg

SEQ ID NO: 378812 - DNA, 140 bp, Artificial Sequence
  Synthetic
caccgctgtcccaaaaggtcacagttggtggaactcacggattttagaaagctgtgattttttcaaccctctattaaggagaagttcacgcaatgtttgaataactgcaagatgcatctgcatatcagcagccagggcct

SEQ ID NO: 378813 - DNA, 140 bp, Artificial Sequence
  Synthetic
atacgccatgctgggtctcccaaaagcactggggccatccagttctgcatagtgaaaaggccatacaaaaggttaaaaatcatgcaacagttctaaaggcattgcgtccgattatcatctcgtacttgggagtcggccat

SEQ ID NO: 378814 - DNA, 140 bp, Artificial Sequence
  Synthetic
atggccgactcccaagtacgagatgataatcggacgcaatgcctttagaactgttgcatgatttttaaccttttgtatggccttttcactatgcagaactggatggccccagtgcttttgggagacccagcatggcgtat

SEQ ID NO: 378815 - DNA, 140 bp, Artificial Sequence
  Synthetic
aggccctggctgctgatatgggttaaaaatcatgcaacagttctaaaggcattgcgtccgattatcatctctgaaacgtactgtgtattcaagtacagtgttgcaaaacatttctttgatgaccttttgggacagcggtg

SEQ ID NO: 378816 - DNA, 140 bp, Artificial Sequence
  Synthetic
caccgctgtcccaaaaggtcatcaaagaaatgttttgcaacactgtacttgaatacacagtacgtttcagagatgataatcggacgcaatgcctttagaactgttgcatgatttttaacccatatcagcagccagggcct

SEQ ID NO: 378817 - DNA, 140 bp, Artificial Sequence
  Synthetic
atacgccatgctgggtctccattgaattcctacattaggcgaaatcaattcccaccacttccaatgatcaaagatcttctatgggaattttaccatttggatcatcctccattattctcccgtacttgggagtcggccat

SEQ ID NO: 378818 - DNA, 140 bp, Artificial Sequence
  Synthetic
atggccgactcccaagtacgggagaataatggaggatgatccaaatggtaaaattcccatagaagatctttgatcattggaagtggtgggaattgatttcgcctaatgtaggaattcaatggagacccagcatggcgtat

SEQ ID NO: 378819 - DNA, 140 bp, Artificial Sequence
  Synthetic
atacgccatgctgggtctccagttgaacaaacctgttgggatgcagttttcgagcctaacgttttgggctacagtccaccttatcgattcaacaccaaacgtgtacccgaacaattcctgcgtacttgggagtcggccat

SEQ ID NO: 378820 - DNA, 140 bp, Artificial Sequence
  Synthetic
atggccgactcccaagtacgcaggaattgttcgggtacacgtttggtgttgaatcgataaggtggactgtagcccaaaacgttaggctcgaaaactgcatcccaacaggtttgttcaactggagacccagcatggcgtat

SEQ ID NO: 378821 - DNA, 140 bp, Artificial Sequence
  Synthetic
aggccctggctgctgatatgacagtccaccttatcgattcaacaccaaacgtgtacccgaacaattcctggagcaagaggatttttctattgagagtgtcttacaatacgcccaagaactgaccttttgggacagcggtg

SEQ ID NO: 378822 - DNA, 140 bp, Artificial Sequence
  Synthetic
caccgctgtcccaaaaggtcagttcttgggcgtattgtaagacactctcaatagaaaaatcctcttgctccaggaattgttcgggtacacgtttggtgttgaatcgataaggtggactgtcatatcagcagccagggcct

SEQ ID NO: 378823 - DNA, 140 bp, Artificial Sequence
  Synthetic
atacgccatgctgggtctccaagaattaaatgttggtaggacatttggaaaattgccttatttaactaggaatgtccaaaccctctgcgaagcattacttgcagatggtttggctaaagccgtacttgggagtcggccat

SEQ ID NO: 378824 - DNA, 140 bp, Artificial Sequence
  Synthetic
atggccgactcccaagtacggctttagccaaaccatctgcaagtaatgcttcgcagagggtttggacattcctagttaaataaggcaattttccaaatgtcctaccaacatttaattcttggagacccagcatggcgtat

SEQ ID NO: 378825 - DNA, 140 bp, Artificial Sequence
  Synthetic
atacgccatgctgggtctcctccttcaccaagcatcttggcatcatacgagtgatgatttcggagagcatgccacagttcgcgggagtagttttgtcacagacctagagaaatataatctcgtacttgggagtcggccat

SEQ ID NO: 378826 - DNA, 140 bp, Artificial Sequence
  Synthetic
atggccgactcccaagtacgagattatatttctctaggtctgtgacaaaactactcccgcgaactgtggcatgctctccgaaatcatcactcgtatgatgccaagatgcttggtgaaggaggagacccagcatggcgtat

SEQ ID NO: 378827 - DNA, 140 bp, Artificial Sequence
  Synthetic
atacgccatgctgggtctccgctatggggttcgcaatgtctttgattggatgcacttcctaattccgcaatgttacatgcatgttagtgattattataacccaccacataatgtaactttcgtacttgggagtcggccat

SEQ ID NO: 378828 - DNA, 140 bp, Artificial Sequence
  Synthetic
atggccgactcccaagtacgaaagttacattatgtggtgggttataataatcactaacatgcatgtaacattgcggaattaggaagtgcatccaatcaaagacattgcgaaccccatagcggagacccagcatggcgtat

SEQ ID NO: 378829 - DNA, 140 bp, Artificial Sequence
  Synthetic
atacgccatgctgggtctccttggtggtattgaggggcttcaacagaagttatggactagcatctcatgtgctcaaatttcattggtagagatcaagaccggattcaaattgcgatcagccgtacttgggagtcggccat

SEQ ID NO: 378830 - DNA, 140 bp, Artificial Sequence
  Synthetic
atggccgactcccaagtacggctgatcgcaatttgaatccggtcttgatctctaccaatgaaatttgagcacatgagatgctagtccataacttctgttgaagcccctcaataccaccaaggagacccagcatggcgtat

SEQ ID NO: 378831 - DNA, 140 bp, Artificial Sequence
  Synthetic
aggccctggctgctgatatggctcaaatttcattggtagagatcaagaccggattcaaattgcgatcagcagtcatgggggataatcaatgtatcacagtattatcagtctttccactaggaccttttgggacagcggtg

SEQ ID NO: 378832 - DNA, 140 bp, Artificial Sequence
  Synthetic
caccgctgtcccaaaaggtcctagtggaaagactgataatactgtgatacattgattatcccccatgactgctgatcgcaatttgaatccggtcttgatctctaccaatgaaatttgagccatatcagcagccagggcct

SEQ ID NO: 378833 - DNA, 140 bp, Artificial Sequence
  Synthetic
aggccctggctgctgatatgcagtataggaactgcctttgagcgatcaatctccgaaactagacatattttaccatgtcgtgttgcagctgcctttcatacatatttctctgttcggatcgaccttttgggacagcggtg

SEQ ID NO: 378834 - DNA, 140 bp, Artificial Sequence
  Synthetic
caccgctgtcccaaaaggtcgatccgaacagagaaatatgtatgaaaggcagctgcaacacgacatggtaaaatatgtctagtttcggagattgatcgctcaaaggcagttcctatactgcatatcagcagccagggcct

SEQ ID NO: 378835 - DNA, 140 bp, Artificial Sequence
  Synthetic
atacgccatgctgggtctcctaccatgtcgtgttgcagctgcctttcatacatatttctctgttcggatcttacaacatcatcaccttggcttccataaaggttcagaccttggacaattcgtacttgggagtcggccat

SEQ ID NO: 378836 - DNA, 140 bp, Artificial Sequence
  Synthetic
atggccgactcccaagtacgaattgtccaaggtctgaacctttatggaagccaaggtgatgatgttgtaagatccgaacagagaaatatgtatgaaaggcagctgcaacacgacatggtaggagacccagcatggcgtat

SEQ ID NO: 378837 - DNA, 140 bp, Artificial Sequence
  Synthetic
atacgccatgctgggtctccttccccaggtactgggtggattatccttcctaaatccagaaaaatgtctttatcgcaacctgggtgaccctgtgacttcaggcctattccagttgaagcacgtacttgggagtcggccat

SEQ ID NO: 378838 - DNA, 140 bp, Artificial Sequence
  Synthetic
atggccgactcccaagtacgtgcttcaactggaataggcctgaagtcacagggtcacccaggttgcgataaagacatttttctggatttaggaaggataatccacccagtacctggggaaggagacccagcatggcgtat

SEQ ID NO: 378839 - DNA, 140 bp, Artificial Sequence
  Synthetic
aggccctggctgctgatatgtatcgcaacctgggtgaccctgtgacttcaggcctattccagttgaagcattatctatcaatggtaggtatgagtgatatctttcacgcacttgttgcaagaccttttgggacagcggtg

SEQ ID NO: 378840 - DNA, 140 bp, Artificial Sequence
  Synthetic
caccgctgtcccaaaaggtcttgcaacaagtgcgtgaaagatatcactcatacctaccattgatagataatgcttcaactggaataggcctgaagtcacagggtcacccaggttgcgatacatatcagcagccagggcct

SEQ ID NO: 378841 - DNA, 140 bp, Artificial Sequence
  Synthetic
atacgccatgctgggtctccttaaatgtccctggatcacaggatctaacatctttccttcgtcagattgtcagaaggagtatcacactttcggcaaggaataagttaatcaacacgctgtcgtacttgggagtcggccat

SEQ ID NO: 378842 - DNA, 140 bp, Artificial Sequence
  Synthetic
atggccgactcccaagtacgacagcgtgttgattaacttattccttgccgaaagtgtgatactccttctgacaatctgacgaaggaaagatgttagatcctgtgatccagggacatttaaggagacccagcatggcgtat

SEQ ID NO: 378843 - DNA, 140 bp, Artificial Sequence
  Synthetic
aggccctggctgctgatatgcagaaggagtatcacactttcggcaaggaataagttaatcaacacgctgtttcatgcctctgcagatcttgaagatgaattagtttgtaaatggttacttgaccttttgggacagcggtg

SEQ ID NO: 378844 - DNA, 140 bp, Artificial Sequence
  Synthetic
caccgctgtcccaaaaggtcaagtaaccatttacaaactaattcatcttcaagatctgcagaggcatgaaacagcgtgttgattaacttattccttgccgaaagtgtgatactccttctgcatatcagcagccagggcct

SEQ ID NO: 378845 - DNA, 140 bp, Artificial Sequence
  Synthetic
atacgccatgctgggtctccaccaagcgggaaaagattacaaatcttgggatatctcgagggaaccagaactttattagcatctagaatgataagcaataatgcagagacaccaatcttacgtacttgggagtcggccat

SEQ ID NO: 378846 - DNA, 140 bp, Artificial Sequence
  Synthetic
atggccgactcccaagtacgtaagattggtgtctctgcattattgcttatcattctagatgctaataaagttctggttccctcgagatatcccaagatttgtaatcttttcccgcttggtggagacccagcatggcgtat

SEQ ID NO: 378847 - DNA, 140 bp, Artificial Sequence
  Synthetic
atacgccatgctgggtctcccctagatcattgtgactcagctttaatggaagcaattcaaccaattaggtgtactgttgatattgctcaaattcttagagaatactcctgggctcatattcgtacttgggagtcggccat

SEQ ID NO: 378848 - DNA, 140 bp, Artificial Sequence
  Synthetic
atggccgactcccaagtacgaatatgagcccaggagtattctctaagaatttgagcaatatcaacagtacacctaattggttgaattgcttccattaaagctgagtcacaatgatctaggggagacccagcatggcgtat

SEQ ID NO: 378849 - DNA, 140 bp, Artificial Sequence
  Synthetic
atacgccatgctgggtctccgttccaaaccacatggttaaaaccttacgagcaatgtgtggaatgttcatccacaaacaattctagtccatatgtatcagttgcattaaaaaggaacgtgcgtacttgggagtcggccat

SEQ ID NO: 378850 - DNA, 140 bp, Artificial Sequence
  Synthetic
atggccgactcccaagtacgcacgttcctttttaatgcaactgatacatatggactagaattgtttgtggatgaacattccacacattgctcgtaaggttttaaccatgtggtttggaacggagacccagcatggcgtat

SEQ ID NO: 378851 - DNA, 140 bp, Artificial Sequence
  Synthetic
aggccctggctgctgatatgccacaaacaattctagtccatatgtatcagttgcattaaaaaggaacgtggtcagcgcttggcctgacgcatctagattggggtggacgattggtgatgggaccttttgggacagcggtg

SEQ ID NO: 378852 - DNA, 140 bp, Artificial Sequence
  Synthetic
caccgctgtcccaaaaggtcccatcaccaatcgtccaccccaatctagatgcgtcaggccaagcgctgaccacgttcctttttaatgcaactgatacatatggactagaattgtttgtggcatatcagcagccagggcct

SEQ ID NO: 378853 - DNA, 140 bp, Artificial Sequence
  Synthetic
atacgccatgctgggtctccttaagccgaggtgcccatcagctgcattgagggaagctattgaattgacctctaggttaacctgggtcactcaaggtagtgcaaatagcgatcagttaatcgtacttgggagtcggccat

SEQ ID NO: 378854 - DNA, 140 bp, Artificial Sequence
  Synthetic
atggccgactcccaagtacgattaactgatcgctatttgcactaccttgagtgacccaggttaacctagaggtcaattcaatagcttccctcaatgcagctgatgggcacctcggcttaaggagacccagcatggcgtat

SEQ ID NO: 378855 - DNA, 140 bp, Artificial Sequence
  Synthetic
aggccctggctgctgatatgtctaggttaacctgggtcactcaaggtagtgcaaatagcgatcagttaattcgtccttttcttgaggcaagagtgaacttgagtgtacaagaaattcttcgaccttttgggacagcggtg

SEQ ID NO: 378856 - DNA, 140 bp, Artificial Sequence
  Synthetic
caccgctgtcccaaaaggtcgaagaatttcttgtacactcaagttcactcttgcctcaagaaaaggacgaattaactgatcgctatttgcactaccttgagtgacccaggttaacctagacatatcagcagccagggcct

SEQ ID NO: 378857 - DNA, 140 bp, Artificial Sequence
  Synthetic
atacgccatgctgggtctcccagtatagccctcactcctttatggccaaccgcatgagtaacacagcaacgcgcttgatggtatctacaaacacactaggagagttctccggagggggcccgtacttgggagtcggccat

SEQ ID NO: 378858 - DNA, 140 bp, Artificial Sequence
  Synthetic
atggccgactcccaagtacgggccccctccggagaactctcctagtgtgtttgtagataccatcaagcgcgttgctgtgttactcatgcggttggccataaaggagtgagggctatactgggagacccagcatggcgtat

SEQ ID NO: 378859 - DNA, 140 bp, Artificial Sequence
  Synthetic
aggccctggctgctgatatggcgcttgatggtatctacaaacacactaggagagttctccggagggggccaagctgcacgtgatagcaacattatattccaaaatgtgattaattttgcagaccttttgggacagcggtg

SEQ ID NO: 378860 - DNA, 140 bp, Artificial Sequence
  Synthetic
caccgctgtcccaaaaggtctgcaaaattaatcacattttggaatataatgttgctatcacgtgcagcttggccccctccggagaactctcctagtgtgtttgtagataccatcaagcgccatatcagcagccagggcct

SEQ ID NO: 378861 - DNA, 140 bp, Artificial Sequence
  Synthetic
atacgccatgctgggtctccatatcacagggctcatattcacctgacagattgttgtacgagggaagtaccagcccaatacttaacatacacaaccacgctaaatctagatttgagtaagcgtacttgggagtcggccat

SEQ ID NO: 378862 - DNA, 140 bp, Artificial Sequence
  Synthetic
atggccgactcccaagtacgcttactcaaatctagatttagcgtggttgtgtatgttaagtattgggctggtacttccctcgtacaacaatctgtcaggtgaatatgagccctgtgatatggagacccagcatggcgtat

SEQ ID NO: 378863 - DNA, 140 bp, Artificial Sequence
  Synthetic
atacgccatgctgggtctccaaactgcaacttatcgattgacagtcctttgatgaagggcccacgtttaaatattattgaggatgacttaatacggttgccacatttatccggttgggaacgtacttgggagtcggccat

SEQ ID NO: 378864 - DNA, 140 bp, Artificial Sequence
  Synthetic
atggccgactcccaagtacgttcccaaccggataaatgtggcaaccgtattaagtcatcctcaataatatttaaacgtgggcccttcatcaaaggactgtcaatcgataagttgcagtttggagacccagcatggcgtat

SEQ ID NO: 378865 - DNA, 140 bp, Artificial Sequence
  Synthetic
atacgccatgctgggtctccaacagatcccattagcagcggtgaaacaagatcctttacaacccacttcttaacgtatcctaaaatagggctcttatacagttttggagccctcataagtcgtacttgggagtcggccat

SEQ ID NO: 378866 - DNA, 140 bp, Artificial Sequence
  Synthetic
atggccgactcccaagtacgacttatgagggctccaaaactgtataagagccctattttaggatacgttaagaagtgggttgtaaaggatcttgtttcaccgctgctaatgggatctgttggagacccagcatggcgtat

SEQ ID NO: 378867 - DNA, 140 bp, Artificial Sequence
  Synthetic
aggccctggctgctgatatgtaacgtatcctaaaatagggctcttatacagttttggagccctcataagtttttatttgggtaatactatcttgtgcacgaaaaagatcggacttacagagaccttttgggacagcggtg

SEQ ID NO: 378868 - DNA, 140 bp, Artificial Sequence
  Synthetic
caccgctgtcccaaaaggtctctgtaagtccgatctttttcgtgcacaagatagtattacccaaataaaaacttatgagggctccaaaactgtataagagccctattttaggatacgttacatatcagcagccagggcct

SEQ ID NO: 378869 - DNA, 140 bp, Artificial Sequence
  Synthetic
atacgccatgctgggtctccttcgaatcttcaaaccgacattcagacactcaagtgtcatgtctaggttgatggatatagaccccaacttctcaatatatattggtgggactgcaggtgacgtacttgggagtcggccat

SEQ ID NO: 378870 - DNA, 140 bp, Artificial Sequence
  Synthetic
atggccgactcccaagtacgtcacctgcagtcccaccaatatatattgagaagttggggtctatatccatcaacctagacatgacacttgagtgtctgaatgtcggtttgaagattcgaaggagacccagcatggcgtat

SEQ ID NO: 378871 - DNA, 140 bp, Artificial Sequence
  Synthetic
aggccctggctgctgatatgatggatatagaccccaacttctcaatatatattggtgggactgcaggtgatcgtggattatcggatgctgcaagattatttctccgaatcgcaatttcaagaccttttgggacagcggtg

SEQ ID NO: 378872 - DNA, 140 bp, Artificial Sequence
  Synthetic
caccgctgtcccaaaaggtcttgaaattgcgattcggagaaataatcttgcagcatccgataatccacgatcacctgcagtcccaccaatatatattgagaagttggggtctatatccatcatatcagcagccagggcct

SEQ ID NO: 378873 - DNA, 140 bp, Artificial Sequence
  Synthetic
atacgccatgctgggtctccccactatgggttgtctatcctctcgaaggccaacgccctgatcctcctggtgaatttttaaaccgagtaaaatctttaattgttgggattgaggatgatacgtacttgggagtcggccat

SEQ ID NO: 378874 - DNA, 140 bp, Artificial Sequence
  Synthetic
atggccgactcccaagtacgtatcatcctcaatcccaacaattaaagattttactcggtttaaaaattcaccaggaggatcagggcgttggccttcgagaggatagacaacccatagtggggagacccagcatggcgtat

SEQ ID NO: 378875 - DNA, 140 bp, Artificial Sequence
  Synthetic
aggccctggctgctgatatgtgaatttttaaaccgagtaaaatctttaattgttgggattgaggatgataaaaataaaggctctatactttcaagatctgaagagaagggctcttcaaatgaccttttgggacagcggtg

SEQ ID NO: 378876 - DNA, 140 bp, Artificial Sequence
  Synthetic
caccgctgtcccaaaaggtcatttgaagagcccttctcttcagatcttgaaagtatagagcctttatttttatcatcctcaatcccaacaattaaagattttactcggtttaaaaattcacatatcagcagccagggcct

SEQ ID NO: 378877 - DNA, 140 bp, Artificial Sequence
  Synthetic
atacgccatgctgggtctccggcttattggagaggtcgacatagacctaagaagactataggtgcaactaaagcgacaacagctccacacatcattttgccgctaggaaattctgatcgacgtacttgggagtcggccat

SEQ ID NO: 378878 - DNA, 140 bp, Artificial Sequence
  Synthetic
atggccgactcccaagtacgtcgatcagaatttcctagcggcaaaatgatgtgtggagctgttgtcgctttagttgcacctatagtcttcttaggtctatgtcgacctctccaataagccggagacccagcatggcgtat

SEQ ID NO: 378879 - DNA, 140 bp, Artificial Sequence
  Synthetic
aggccctggctgctgatatgaagcgacaacagctccacacatcattttgccgctaggaaattctgatcgaccgcctggcctagatcttaatcagagcaatgatacttttattcctaccaggaccttttgggacagcggtg

SEQ ID NO: 378880 - DNA, 140 bp, Artificial Sequence
  Synthetic
caccgctgtcccaaaaggtcctggtaggaataaaagtatcattgctctgattaagatctaggccaggcggtcgatcagaatttcctagcggcaaaatgatgtgtggagctgttgtcgcttcatatcagcagccagggcct

SEQ ID NO: 378881 - DNA, 140 bp, Artificial Sequence
  Synthetic
atacgccatgctgggtctcccgagacttccacccaaaagtaggtccaccccaacatcagcaaccgagcctcctacaaaaatatatgagggttcgacaacctatcgaggaaaatcaacagacgtacttgggagtcggccat

SEQ ID NO: 378882 - DNA, 140 bp, Artificial Sequence
  Synthetic
atggccgactcccaagtacgtctgttgattttcctcgataggttgtcgaaccctcatatatttttgtaggaggctcggttgctgatgttggggtggacctacttttgggtggaagtctcgggagacccagcatggcgtat

SEQ ID NO: 378883 - DNA, 140 bp, Artificial Sequence
  Synthetic
aggccctggctgctgatatgcctacaaaaatatatgagggttcgacaacctatcgaggaaaatcaacagatacacatttggatgagggtcataatgccaaagagttcccattcaatccacgaccttttgggacagcggtg

SEQ ID NO: 378884 - DNA, 140 bp, Artificial Sequence
  Synthetic
caccgctgtcccaaaaggtcgtggattgaatgggaactctttggcattatgaccctcatccaaatgtgtatctgttgattttcctcgataggttgtcgaaccctcatatatttttgtaggcatatcagcagccagggcct

SEQ ID NO: 378885 - DNA, 140 bp, Artificial Sequence
  Synthetic
atacgccatgctgggtctccatcgaaccttcccctgaagaaagccgcagtaatataaaagggttacttcaacatttaagaaccatggttgatactaccatatattgtcgcttcactgggacgtacttgggagtcggccat

SEQ ID NO: 378886 - DNA, 140 bp, Artificial Sequence
  Synthetic
atggccgactcccaagtacgtcccagtgaagcgacaatatatggtagtatcaaccatggttcttaaatgttgaagtaacccttttatattactgcggctttcttcaggggaaggttcgatggagacccagcatggcgtat

SEQ ID NO: 378887 - DNA, 140 bp, Artificial Sequence
  Synthetic
aggccctggctgctgatatgacatttaagaaccatggttgatactaccatatattgtcgcttcactgggattgtttcatcaatgcattataaattagatgaagtactatgggaatataatgaccttttgggacagcggtg

SEQ ID NO: 378888 - DNA, 140 bp, Artificial Sequence
  Synthetic
caccgctgtcccaaaaggtcattatattcccatagtacttcatctaatttataatgcattgatgaaacaatcccagtgaagcgacaatatatggtagtatcaaccatggttcttaaatgtcatatcagcagccagggcct

SEQ ID NO: 378889 - DNA, 140 bp, Artificial Sequence
  Synthetic
aggccctggctgctgatatgtcatcttaaaagtcttcctcagcgatttggatgggatgtgctggattaacaattatcttgctcctatgtttggatcaggatacttaatcaaacctataacgaccttttgggacagcggtg

SEQ ID NO: 378890 - DNA, 140 bp, Artificial Sequence
  Synthetic
caccgctgtcccaaaaggtcgttataggtttgattaagtatcctgatccaaacataggagcaagataattgttaatccagcacatcccatccaaatcgctgaggaagacttttaagatgacatatcagcagccagggcct

SEQ ID NO: 378891 - DNA, 140 bp, Artificial Sequence
  Synthetic
atacgccatgctgggtctccaattatcttgctcctatgtttggatcaggatacttaatcaaacctataacatcaagtgcaaggtcaagtgagtggtatttatgcttatctaatctactttcgtacttgggagtcggccat

SEQ ID NO: 378892 - DNA, 140 bp, Artificial Sequence
  Synthetic
atggccgactcccaagtacgaaagtagattagataagcataaataccactcacttgaccttgcacttgatgttataggtttgattaagtatcctgatccaaacataggagcaagataattggagacccagcatggcgtat

SEQ ID NO: 378893 - DNA, 140 bp, Artificial Sequence
  Synthetic
atacgccatgctgggtctccgtacaatgtgctcttcaacagcaagttcaaagagggtcatattggctaagtcatctcaccaaatacaccacaagtagattgcacaatagttatattgcatcgtacttgggagtcggccat

SEQ ID NO: 378894 - DNA, 140 bp, Artificial Sequence
  Synthetic
atggccgactcccaagtacgatgcaatataactattgtgcaatctacttgtggtgtatttggtgagatgacttagccaatatgaccctctttgaacttgctgttgaagagcacattgtacggagacccagcatggcgtat

SEQ ID NO: 378895 - DNA, 140 bp, Artificial Sequence
  Synthetic
aggccctggctgctgatatgtcatctcaccaaatacaccacaagtagattgcacaatagttatattgcatttggttttccttcgttagagaaggtcctatatcatagatataatcttgttgaccttttgggacagcggtg

SEQ ID NO: 378896 - DNA, 140 bp, Artificial Sequence
  Synthetic
caccgctgtcccaaaaggtcaacaagattatatctatgatataggaccttctctaacgaaggaaaaccaaatgcaatataactattgtgcaatctacttgtggtgtatttggtgagatgacatatcagcagccagggcct

SEQ ID NO: 378897 - DNA, 140 bp, Artificial Sequence
  Synthetic
atacgccatgctgggtctccccaaactgagatccgggagttggtaactgattataatcagctgcgacaaagtcgaacccagacttatcatttcataaaaacatccaagggacggataactcgtacttgggagtcggccat

SEQ ID NO: 378898 - DNA, 140 bp, Artificial Sequence
  Synthetic
atggccgactcccaagtacgagttatccgtcccttggatgtttttatgaaatgataagtctgggttcgactttgtcgcagctgattataatcagttaccaactcccggatctcagtttggggagacccagcatggcgtat

SEQ ID NO: 378899 - DNA, 140 bp, Artificial Sequence
  Synthetic
aggccctggctgctgatatggtcgaacccagacttatcatttcataaaaacatccaagggacggataactaaactagtgaatgattatctaagatttgagttggttatacgggctcttaagaccttttgggacagcggtg

SEQ ID NO: 378900 - DNA, 140 bp, Artificial Sequence
  Synthetic
caccgctgtcccaaaaggtcttaagagcccgtataaccaactcaaatcttagataatcattcactagtttagttatccgtcccttggatgtttttatgaaatgataagtctgggttcgaccatatcagcagccagggcct

SEQ ID NO: 378901 - DNA, 140 bp, Artificial Sequence
  Synthetic
atacgccatgctgggtctccaaactagtgaatgattatctaagatttgagttggttatacgggctcttaaaaataattctacatggcaccatgagttgtacttactaccagaacttatagcgtacttgggagtcggccat

SEQ ID NO: 378902 - DNA, 140 bp, Artificial Sequence
  Synthetic
atggccgactcccaagtacgctataagttctggtagtaagtacaactcatggtgccatgtagaattatttttaagagcccgtataaccaactcaaatcttagataatcattcactagtttggagacccagcatggcgtat

SEQ ID NO: 378903 - DNA, 140 bp, Artificial Sequence
  Synthetic
atacgccatgctgggtctccttcctggttcaaaccttatatctacaccggatgagtgatgctgagataaaacttatggaccggctcaccagcctagtcaatatgtttcccgaaggtttcacgtacttgggagtcggccat

SEQ ID NO: 378904 - DNA, 140 bp, Artificial Sequence
  Synthetic
atggccgactcccaagtacgtgaaaccttcgggaaacatattgactaggctggtgagccggtccataagttttatctcagcatcactcatccggtgtagatataaggtttgaaccaggaaggagacccagcatggcgtat

SEQ ID NO: 378905 - DNA, 140 bp, Artificial Sequence
  Synthetic
aggccctggctgctgatatgacttatggaccggctcaccagcctagtcaatatgtttcccgaaggtttcaggtctagttcagtctaattctaactgcatctcaggttctagaagtattttgaccttttgggacagcggtg

SEQ ID NO: 378906 - DNA, 140 bp, Artificial Sequence
  Synthetic
caccgctgtcccaaaaggtcaaaatacttctagaacctgagatgcagttagaattagactgaactagacctgaaaccttcgggaaacatattgactaggctggtgagccggtccataagtcatatcagcagccagggcct

SEQ ID NO: 378907 - DNA, 140 bp, Artificial Sequence
  Synthetic
atacgccatgctgggtctccagggaccacatttggcattagtttattgactcttccaatatacagcgttggaagcatcgattcaaggtttcgaagacactctattgattatgttgataatcgtacttgggagtcggccat

SEQ ID NO: 378908 - DNA, 140 bp, Artificial Sequence
  Synthetic
atggccgactcccaagtacgattatcaacataatcaatagagtgtcttcgaaaccttgaatcgatgcttccaacgctgtatattggaagagtcaataaactaatgccaaatgtggtccctggagacccagcatggcgtat

SEQ ID NO: 378909 - DNA, 140 bp, Artificial Sequence
  Synthetic
aggccctggctgctgatatggaagcatcgattcaaggtttcgaagacactctattgattatgttgataatgtaaataataatttttcctagctattatgactaaaataaacaaatctatagaccttttgggacagcggtg

SEQ ID NO: 378910 - DNA, 140 bp, Artificial Sequence
  Synthetic
caccgctgtcccaaaaggtctatagatttgtttattttagtcataatagctaggaaaaattattatttacattatcaacataatcaatagagtgtcttcgaaaccttgaatcgatgcttccatatcagcagccagggcct

SEQ ID NO: 378911 - DNA, 140 bp, Artificial Sequence
  Synthetic
atacgccatgctgggtctccttagaagctaggttgactccagttacataagtattaagaaaaaattactaagactaatactcttatgctaagaactagtaatatgtttcacatgacaggtcgtacttgggagtcggccat

SEQ ID NO: 378912 - DNA, 140 bp, Artificial Sequence
  Synthetic
atggccgactcccaagtacgacctgtcatgtgaaacatattactagttcttagcataagagtattagtcttagtaattttttcttaatacttatgtaactggagtcaacctagcttctaaggagacccagcatggcgtat

SEQ ID NO: 378913 - DNA, 140 bp, Artificial Sequence
  Synthetic
aggccctggctgctgatatgagactaatactcttatgctaagaactagtaatatgtttcacatgacaggttatttctgatactaaattgcaatttcacttttaaagctaagtttaatactgaccttttgggacagcggtg

SEQ ID NO: 378914 - DNA, 140 bp, Artificial Sequence
  Synthetic
caccgctgtcccaaaaggtcagtattaaacttagctttaaaagtgaaattgcaatttagtatcagaaataacctgtcatgtgaaacatattactagttcttagcataagagtattagtctcatatcagcagccagggcct

SEQ ID NO: 378915 - DNA, 140 bp, Artificial Sequence
  Synthetic
atacgccatgctgggtctccacggtcaatgaaccttttattccaaccaggtagttgattgataatctacaaattccataagatgttcttacgacatttttttgtttttaatctcaatgtccgtacttgggagtcggccat

SEQ ID NO: 378916 - DNA, 140 bp, Artificial Sequence
  Synthetic
atggccgactcccaagtacggacattgagattaaaaacaaaaaaatgtcgtaagaacatcttatggaatttgtagattatcaatcaactacctggttggaataaaaggttcattgaccgtggagacccagcatggcgtat

SEQ ID NO: 378917 - DNA, 140 bp, Artificial Sequence
  Synthetic
atacgccatgctgggtctccaatgatttaattagtagtaagaaaaaagttacattagaggtgcaggaagatcttaacctcaccaggaaaattaagcgcacacaaataaattaaaaaatctcgtacttgggagtcggccat

SEQ ID NO: 378918 - DNA, 140 bp, Artificial Sequence
  Synthetic
atggccgactcccaagtacgagattttttaatttatttgtgtgcgcttaattttcctggtgaggttaagatcttcctgcacctctaatgtaacttttttcttactactaattaaatcattggagacccagcatggcgtat

SEQ ID NO: 378919 - DNA, 140 bp, Artificial Sequence
  Synthetic
atacgccatgctgggtctcccggacacacaaaaagaaagaaaagttttttagactttttgtgtgcgaataactatgaggaagattaatcattttcctcaaactcaaactaatattaacatcgtacttgggagtcggccat

SEQ ID NO: 378920 - DNA, 140 bp, Artificial Sequence
  Synthetic
atggccgactcccaagtacgatgttaatattagtttgagtttgaggaaaatgattaatcttcctcatagttattcgcacacaaaaagtctaaaaaacttttctttctttttgtgtgtccgggagacccagcatggcgtat

SEQ ID NO: 378921 - DNA, 140 bp, Artificial Sequence
  Synthetic
atacgccatgctgggtctccgtcccgaggtatccctccagtccacaaaatctagctaattttagctgagtggactgattactctcatcacacgctaactactaagggtttacctgagagccgtacttgggagtcggccat

SEQ ID NO: 378922 - DNA, 140 bp, Artificial Sequence
  Synthetic
atggccgactcccaagtacggctctcaggtaaacccttagtagttagcgtgtgatgagagtaatcagtccactcagctaaaattagctagattttgtggactggagggatacctcgggacggagacccagcatggcgtat

SEQ ID NO: 378923 - DNA, 140 bp, Artificial Sequence
  Synthetic
aggccctggctgctgatatgggactgattactctcatcacacgctaactactaagggtttacctgagagcctacaacatggataaacgggtgagaggttcatgggccctgggaggacaatgaccttttgggacagcggtg

SEQ ID NO: 378924 - DNA, 140 bp, Artificial Sequence
  Synthetic
caccgctgtcccaaaaggtcattgtcctcccagggcccatgaacctctcacccgtttatccatgttgtaggctctcaggtaaacccttagtagttagcgtgtgatgagagtaatcagtcccatatcagcagccagggcct

SEQ ID NO: 378925 - DNA, 140 bp, Artificial Sequence
  Synthetic
atacgccatgctgggtctcccaacaagggattgtgcgacaaagagtcatcccggtatatgttgtgagtgatcttgagggtatttgtcaacatatcattcaggcctttgaagcaggcgtagcgtacttgggagtcggccat

SEQ ID NO: 378926 - DNA, 140 bp, Artificial Sequence
  Synthetic
atggccgactcccaagtacgctacgcctgcttcaaaggcctgaatgatatgttgacaaataccctcaagatcactcacaacatataccgggatgactctttgtcgcacaatcccttgttgggagacccagcatggcgtat

SEQ ID NO: 378927 - DNA, 140 bp, Artificial Sequence
  Synthetic
aggccctggctgctgatatgtcttgagggtatttgtcaacatatcattcaggcctttgaagcaggcgtagatttccaagataatgctgacagcttccttttacttttatgtttacatcatgaccttttgggacagcggtg

SEQ ID NO: 378928 - DNA, 140 bp, Artificial Sequence
  Synthetic
caccgctgtcccaaaaggtcatgatgtaaacataaaagtaaaaggaagctgtcagcattatcttggaaatctacgcctgcttcaaaggcctgaatgatatgttgacaaataccctcaagacatatcagcagccagggcct

SEQ ID NO: 378929 - DNA, 140 bp, Artificial Sequence
  Synthetic
atacgccatgctgggtctcccttagagggccatggtttcaggtttgaggtccgagaaaaggagaatgtgcaccgtctggatgaattgttgcccaatgtcaccggtggaaaaaatcttaggcgtacttgggagtcggccat

SEQ ID NO: 378930 - DNA, 140 bp, Artificial Sequence
  Synthetic
atggccgactcccaagtacgcctaagattttttccaccggtgacattgggcaacaattcatccagacggtgcacattctccttttctcggacctcaaacctgaaaccatggccctctaagggagacccagcatggcgtat

SEQ ID NO: 378931 - DNA, 140 bp, Artificial Sequence
  Synthetic
aggccctggctgctgatatgaccgtctggatgaattgttgcccaatgtcaccggtggaaaaaatcttaggagaacattggctgcaatgcctgaagaggagacaacagaagctaatgctgggaccttttgggacagcggtg

SEQ ID NO: 378932 - DNA, 140 bp, Artificial Sequence
  Synthetic
caccgctgtcccaaaaggtcccagcattagcttctgttgtctcctcttcaggcattgcagccaatgttctcctaagattttttccaccggtgacattgggcaacaattcatccagacggtcatatcagcagccagggcct

SEQ ID NO: 378933 - DNA, 140 bp, Artificial Sequence
  Synthetic
atacgccatgctgggtctccagaaagcgtgtctggaaaaagtacaaaggcagattcaggtccatgcagaacaagggctcattcaatatccaacttcctggcaatcagttggacacatgatcgtacttgggagtcggccat

SEQ ID NO: 378934 - DNA, 140 bp, Artificial Sequence
  Synthetic
atggccgactcccaagtacgatcatgtgtccaactgattgccaggaagttggatattgaatgagcccttgttctgcatggacctgaatctgcctttgtactttttccagacacgctttctggagacccagcatggcgtat

SEQ ID NO: 378935 - DNA, 140 bp, Artificial Sequence
  Synthetic
aggccctggctgctgatatgcaagggctcattcaatatccaacttcctggcaatcagttggacacatgatggtgatcttccgtttgatgagaacaaactttttaatcaagttcctactaagaccttttgggacagcggtg

SEQ ID NO: 378936 - DNA, 140 bp, Artificial Sequence
  Synthetic
caccgctgtcccaaaaggtcttagtaggaacttgattaaaaagtttgttctcatcaaacggaagatcaccatcatgtgtccaactgattgccaggaagttggatattgaatgagcccttgcatatcagcagccagggcct

SEQ ID NO: 378937 - DNA, 140 bp, Artificial Sequence
  Synthetic
atacgccatgctgggtctccatatctaattctgttgcccaagcaaggttctctggtcttctgattgtaaagactgttctggaccacatcctacaaaaaaccgatcttggagtacgacttccgtacttgggagtcggccat

SEQ ID NO: 378938 - DNA, 140 bp, Artificial Sequence
  Synthetic
atggccgactcccaagtacggaagtcgtactccaagatcggttttttgtaggatgtggtccagaacagtctttacaatcagaagaccagagaaccttgcttgggcaacagaattagatatggagacccagcatggcgtat

SEQ ID NO: 378939 - DNA, 140 bp, Artificial Sequence
  Synthetic
aggccctggctgctgatatggactgttctggaccacatcctacaaaaaaccgatcttggagtacgacttcatccactggccaggacagcaaaagtcaagaatgaggtcagttcattcaaggaccttttgggacagcggtg

SEQ ID NO: 378940 - DNA, 140 bp, Artificial Sequence
  Synthetic
caccgctgtcccaaaaggtccttgaatgaactgacctcattcttgacttttgctgtcctggccagtggatgaagtcgtactccaagatcggttttttgtaggatgtggtccagaacagtccatatcagcagccagggcct

SEQ ID NO: 378941 - DNA, 140 bp, Artificial Sequence
  Synthetic
atacgccatgctgggtctcctctcctcaatctttctggagtcaacaacttggaacatgggctttatccacaactctcagccattgctttgggtgttgcaactgcccacgggagcacgctgcgtacttgggagtcggccat

SEQ ID NO: 378942 - DNA, 140 bp, Artificial Sequence
  Synthetic
atggccgactcccaagtacgcagcgtgctcccgtgggcagttgcaacacccaaagcaatggctgagagttgtggataaagcccatgttccaagttgttgactccagaaagattgaggagaggagacccagcatggcgtat

SEQ ID NO: 378943 - DNA, 140 bp, Artificial Sequence
  Synthetic
atacgccatgctgggtctccaagaagaatgagatcagcttccagcaaactaacgcaatggtaaccttgaggaaagagcggctggccaaactgaccgaagccatcacgactgcatcaaagacgtacttgggagtcggccat

SEQ ID NO: 378944 - DNA, 140 bp, Artificial Sequence
  Synthetic
atggccgactcccaagtacgtctttgatgcagtcgtgatggcttcggtcagtttggccagccgctctttcctcaaggttaccattgcgttagtttgctggaagctgatctcattcttcttggagacccagcatggcgtat

SEQ ID NO: 378945 - DNA, 140 bp, Artificial Sequence
  Synthetic
aggccctggctgctgatatggaaagagcggctggccaaactgaccgaagccatcacgactgcatcaaagatcaaggttggagatcgttatcctgatgacaatgatattccatttcccggggaccttttgggacagcggtg

SEQ ID NO: 378946 - DNA, 140 bp, Artificial Sequence
  Synthetic
caccgctgtcccaaaaggtccccgggaaatggaatatcattgtcatcaggataacgatctccaaccttgatctttgatgcagtcgtgatggcttcggtcagtttggccagccgctctttccatatcagcagccagggcct

SEQ ID NO: 378947 - DNA, 140 bp, Artificial Sequence
  Synthetic
atacgccatgctgggtctcccaaccaaccacaaggcaatatgtcatctactctccagagtatgacccctatacaggaagaatcagagcccgatgatcagaaagatgatgatgacgagagtcgtacttgggagtcggccat

SEQ ID NO: 378948 - DNA, 140 bp, Artificial Sequence
  Synthetic
atggccgactcccaagtacgactctcgtcatcatcatctttctgatcatcgggctctgattcttcctgtataggggtcatactctggagagtagatgacatattgccttgtggttggttgggagacccagcatggcgtat

SEQ ID NO: 378949 - DNA, 140 bp, Artificial Sequence
  Synthetic
aggccctggctgctgatatgtacaggaagaatcagagcccgatgatcagaaagatgatgatgacgagagtctcacatcccttgactctgaaggtgacgaagatgttgagagcgtatcagggaccttttgggacagcggtg

SEQ ID NO: 378950 - DNA, 140 bp, Artificial Sequence
  Synthetic
caccgctgtcccaaaaggtccctgatacgctctcaacatcttcgtcaccttcagagtcaagggatgtgagactctcgtcatcatcatctttctgatcatcgggctctgattcttcctgtacatatcagcagccagggcct

SEQ ID NO: 378951 - DNA, 140 bp, Artificial Sequence
  Synthetic
atacgccatgctgggtctccgagtagacactaatcagcaaaatggaccaagcaatgctgtagatggtcaaggttctgaaagtgaagctctcccaatcaaccccgaaaagagatctgcactcgtacttgggagtcggccat

SEQ ID NO: 378952 - DNA, 140 bp, Artificial Sequence
  Synthetic
atggccgactcccaagtacgagtgcagatctcttttcggggttgattgggagagcttcactttcagaaccttgaccatctacagcattgcttggtccattttgctgattagtgtctactcggagacccagcatggcgtat

SEQ ID NO: 378953 - DNA, 140 bp, Artificial Sequence
  Synthetic
aggccctggctgctgatatgggttctgaaagtgaagctctcccaatcaaccccgaaaagagatctgcactggaagaaacatattatcatctcctaaaaacacagggtccatttgaggcaagaccttttgggacagcggtg

SEQ ID NO: 378954 - DNA, 140 bp, Artificial Sequence
  Synthetic
caccgctgtcccaaaaggtcttgcctcaaatggaccctgtgtttttaggagatgataatatgtttcttccagtgcagatctcttttcggggttgattgggagagcttcactttcagaacccatatcagcagccagggcct

SEQ ID NO: 378955 - DNA, 140 bp, Artificial Sequence
  Synthetic
atacgccatgctgggtctccagtggcaaggaatatctcttcccagattctcttgaagaagcctacccgccttggttgagtgagaaggaggccttagagaaagaaaatcgttatctggtcacgtacttgggagtcggccat

SEQ ID NO: 378956 - DNA, 140 bp, Artificial Sequence
  Synthetic
atggccgactcccaagtacgtgaccagataacgattttctttctctaaggcctccttctcactcaaccaaggcgggtaggcttcttcaagagaatctgggaagagatattccttgccactggagacccagcatggcgtat

SEQ ID NO: 378957 - DNA, 140 bp, Artificial Sequence
  Synthetic
atacgccatgctgggtctcccttgctgttcttcaacatgactgaggacccatgattagtagattttgtttattctgagcttgattataattgttttgataattcaagtatgagcacccaacgtacttgggagtcggccat

SEQ ID NO: 378958 - DNA, 140 bp, Artificial Sequence
  Synthetic
atggccgactcccaagtacgttgggtgctcatacttgaattatcaaaacaattataatcaagctcagaataaacaaaatctactaatcatgggtcctcagtcatgttgaagaacagcaagggagacccagcatggcgtat

SEQ ID NO: 378959 - DNA, 140 bp, Artificial Sequence
  Synthetic
atacgccatgctgggtctccgtaagttgtaggactatgaagagctgcttgtgtcaatttatcacgggttaatacccataccgcaagaataattatttagtaattttgatcagcttatgatcgtacttgggagtcggccat

SEQ ID NO: 378960 - DNA, 140 bp, Artificial Sequence
  Synthetic
atggccgactcccaagtacgatcataagctgatcaaaattactaaataattattcttgcggtatgggtattaacccgtgataaattgacacaagcagctcttcatagtcctacaacttacggagacccagcatggcgtat

SEQ ID NO: 378961 - DNA, 140 bp, Artificial Sequence
  Synthetic
atacgccatgctgggtctcctgagcttaggaggataatatcctgatgaattctatagaacttaggattaagaaaaaattcatgatgaagattaaaaccttcatcatcctttaaaaagagacgtacttgggagtcggccat

SEQ ID NO: 378962 - DNA, 140 bp, Artificial Sequence
  Synthetic
atggccgactcccaagtacgtctctttttaaaggatgatgaaggttttaatcttcatcatgaattttttcttaatcctaagttctatagaattcatcaggatattatcctcctaagctcaggagacccagcatggcgtat

SEQ ID NO: 378963 - DNA, 140 bp, Artificial Sequence
  Synthetic
atacgccatgctgggtctccggacttatagacatcatggacccgaagtgtctggctggttttctgagcaattaatgaccggcaaaataccgctaacagaggtgtttgttgatgttgaaaacgtacttgggagtcggccat

SEQ ID NO: 378964 - DNA, 140 bp, Artificial Sequence
  Synthetic
atggccgactcccaagtacgttttcaacatcaacaaacacctctgttagcggtattttgccggtcattaattgctcagaaaaccagccagacacttcgggtccatgatgtctataagtccggagacccagcatggcgtat

SEQ ID NO: 378965 - DNA, 140 bp, Artificial Sequence
  Synthetic
atacgccatgctgggtctcccacgtaaaagtgataagcaagtccaaacagatgatgccagtagcttattgacagaagaagtcaaggctgccataaattcggtgatatcagctgtgcgtcgcgtacttgggagtcggccat

SEQ ID NO: 378966 - DNA, 140 bp, Artificial Sequence
  Synthetic
atggccgactcccaagtacgcgacgcacagctgatatcaccgaatttatggcagccttgacttcttctgtcaataagctactggcatcatctgtttggacttgcttatcacttttacgtgggagacccagcatggcgtat

SEQ ID NO: 378967 - DNA, 140 bp, Artificial Sequence
  Synthetic
aggccctggctgctgatatgacagaagaagtcaaggctgccataaattcggtgatatcagctgtgcgtcggcaaaccaatgctattgaatcactagaaggtcgagtaacaactcttgagggaccttttgggacagcggtg

SEQ ID NO: 378968 - DNA, 140 bp, Artificial Sequence
  Synthetic
caccgctgtcccaaaaggtccctcaagagttgttactcgaccttctagtgattcaatagcattggtttgccgacgcacagctgatatcaccgaatttatggcagccttgacttcttctgtcatatcagcagccagggcct

SEQ ID NO: 378969 - DNA, 140 bp, Artificial Sequence
  Synthetic
atacgccatgctgggtctccgcaaaccaatgctattgaatcactagaaggtcgagtaacaactcttgaggccagcttaaaaccagttcaagacatggcaaagaccatatcatccctgaatcgtacttgggagtcggccat

SEQ ID NO: 378970 - DNA, 140 bp, Artificial Sequence
  Synthetic
atggccgactcccaagtacgattcagggatgatatggtctttgccatgtcttgaactggttttaagctggcctcaagagttgttactcgaccttctagtgattcaatagcattggtttgcggagacccagcatggcgtat

SEQ ID NO: 378971 - DNA, 140 bp, Artificial Sequence
  Synthetic
atacgccatgctgggtctcctgggcgagcaactgccactgctgcagcaacagaagcatattggaatgaacatggacaagcacctccaggcccatcattgtacgaggatgatgctattaagcgtacttgggagtcggccat

SEQ ID NO: 378972 - DNA, 140 bp, Artificial Sequence
  Synthetic
atggccgactcccaagtacgcttaatagcatcatcctcgtacaatgatgggcctggaggtgcttgtccatgttcattccaatatgcttctgttgctgcagcagtggcagttgctcgcccaggagacccagcatggcgtat

SEQ ID NO: 378973 - DNA, 140 bp, Artificial Sequence
  Synthetic
atacgccatgctgggtctccctacacaaatctagatagcacaagtgccctcaatgaggaaaatttcgggcgaccttacatttcagcaaaagatctcaaggaaatcatctatgaccatctccgtacttgggagtcggccat

SEQ ID NO: 378974 - DNA, 140 bp, Artificial Sequence
  Synthetic
atggccgactcccaagtacggagatggtcatagatgatttccttgagatcttttgctgaaatgtaaggtcgcccgaaattttcctcattgagggcacttgtgctatctagatttgtgtagggagacccagcatggcgtat

SEQ ID NO: 378975 - DNA, 140 bp, Artificial Sequence
  Synthetic
atacgccatgctgggtctcctggtaaggataataatatcctagacataattcatgcagaattccaagcaagcttggctgagggagactccccccagtgtgcattaatccagataacaaaacgtacttgggagtcggccat

SEQ ID NO: 378976 - DNA, 140 bp, Artificial Sequence
  Synthetic
atggccgactcccaagtacgttttgttatctggattaatgcacactggggggagtctccctcagccaagcttgcttggaattctgcatgaattatgtctaggatattattatccttaccaggagacccagcatggcgtat

SEQ ID NO: 378977 - DNA, 140 bp, Artificial Sequence
  Synthetic
atacgccatgctgggtctccgggaaggcccttgggctaaaaatatgatacagaagcaaggtaagctcattttgcgatggccaaatgatacttatgactgtttaaaatcaagttagactaacgtacttgggagtcggccat

SEQ ID NO: 378978 - DNA, 140 bp, Artificial Sequence
  Synthetic
atggccgactcccaagtacgttagtctaacttgattttaaacagtcataagtatcatttggccatcgcaaaatgagcttaccttgcttctgtatcatatttttagcccaagggccttcccggagacccagcatggcgtat

SEQ ID NO: 378979 - DNA, 140 bp, Artificial Sequence
  Synthetic
atacgccatgctgggtctcctagtctatcatgtcataagcttataagtcagttttaaatttcccctctatcctaatcaattgataatgctgtcaataggaaaattcccctgtattgtaatcgtacttgggagtcggccat

SEQ ID NO: 378980 - DNA, 140 bp, Artificial Sequence
  Synthetic
atggccgactcccaagtacgattacaatacaggggaattttcctattgacagcattatcaattgattaggatagaggggaaatttaaaactgacttataagcttatgacatgatagactaggagacccagcatggcgtat

SEQ ID NO: 378981 - DNA, 140 bp, Artificial Sequence
  Synthetic
atacgccatgctgggtctccagcaaattaaaattgatgaagattaagaaaaagagggattttctcaggaaaaatcttttttcttaccttcatctcatttaaacaaatttaggactcaggacgtacttgggagtcggccat

SEQ ID NO: 378982 - DNA, 140 bp, Artificial Sequence
  Synthetic
atggccgactcccaagtacgtcctgagtcctaaatttgtttaaatgagatgaaggtaagaaaaaagatttttcctgagaaaatccctctttttcttaatcttcatcaattttaatttgctggagacccagcatggcgtat

SEQ ID NO: 378983 - DNA, 140 bp, Artificial Sequence
  Synthetic
atacgccatgctgggtctcctggctatcctatgagcatgcttcccatcaagtcaagcagggctgtgagtggaattcaacagaaacaagaggtccttcctggaatggatacaccatcaaatcgtacttgggagtcggccat

SEQ ID NO: 378984 - DNA, 140 bp, Artificial Sequence
  Synthetic
atggccgactcccaagtacgatttgatggtgtatccattccaggaaggacctcttgtttctgttgaattccactcacagccctgcttgacttgatgggaagcatgctcataggatagccaggagacccagcatggcgtat

SEQ ID NO: 378985 - DNA, 140 bp, Artificial Sequence
  Synthetic
atacgccatgctgggtctccgaacggagtggcctcagcattcatcttggaggcaactgtcaatgtgatctcggggcccaaagtcctcatgaaacaaatccctatttggttgccactcggacgtacttgggagtcggccat

SEQ ID NO: 378986 - DNA, 140 bp, Artificial Sequence
  Synthetic
atggccgactcccaagtacgtccgagtggcaaccaaatagggatttgtttcatgaggactttgggccccgagatcacattgacagttgcctccaagatgaatgctgaggccactccgttcggagacccagcatggcgtat

SEQ ID NO: 378987 - DNA, 140 bp, Artificial Sequence
  Synthetic
atacgccatgctgggtctccattgctgaccaaaaaacgtacagttttgactcaacaacagcagcaattatgctcgcatcttatacgatcacccattttggaaaggccaacaaccccctcgcgtacttgggagtcggccat

SEQ ID NO: 378988 - DNA, 140 bp, Artificial Sequence
  Synthetic
atggccgactcccaagtacgcgagggggttgttggcctttccaaaatgggtgatcgtataagatgcgagcataattgctgctgttgttgagtcaaaactgtacgttttttggtcagcaatggagacccagcatggcgtat

SEQ ID NO: 378989 - DNA, 140 bp, Artificial Sequence
  Synthetic
atacgccatgctgggtctccctccagacaaaattcagacaattgtgaacctgatgcaagatttcaaaatcgtgccaattgatccagctaagagtatcattgggatcgaggttccagaattcgtacttgggagtcggccat

SEQ ID NO: 378990 - DNA, 140 bp, Artificial Sequence
  Synthetic
atggccgactcccaagtacgaattctggaacctcgatcccaatgatactcttagctggatcaattggcacgattttgaaatcttgcatcaggttcacaattgtctgaattttgtctggagggagacccagcatggcgtat

SEQ ID NO: 378991 - DNA, 140 bp, Artificial Sequence
  Synthetic
aggccctggctgctgatatggtgccaattgatccagctaagagtatcattgggatcgaggttccagaattgctggtccacaagctcactgggaagaaaatgagtcagaagaatggacagcgaccttttgggacagcggtg

SEQ ID NO: 378992 - DNA, 140 bp, Artificial Sequence
  Synthetic
caccgctgtcccaaaaggtcgctgtccattcttctgactcattttcttcccagtgagcttgtggaccagcaattctggaacctcgatcccaatgatactcttagctggatcaattggcaccatatcagcagccagggcct

SEQ ID NO: 378993 - DNA, 140 bp, Artificial Sequence
  Synthetic
atacgccatgctgggtctcccctggagacctgactatggtcataacaccagattatgatgattgtcattcacctgccagttgctcttatctcagtgaaaagtgattctcacaaagtgagacgtacttgggagtcggccat

SEQ ID NO: 378994 - DNA, 140 bp, Artificial Sequence
  Synthetic
atggccgactcccaagtacgtctcactttgtgagaatcacttttcactgagataagagcaactggcaggtgaatgacaatcatcataatctggtgttatgaccatagtcaggtctccaggggagacccagcatggcgtat

SEQ ID NO: 378995 - DNA, 140 bp, Artificial Sequence
  Synthetic
aggccctggctgctgatatgacctgccagttgctcttatctcagtgaaaagtgattctcacaaagtgagagaaacacctccagtaaagaaatcaaatcttatctatagcaactcaatcgagaccttttgggacagcggtg

SEQ ID NO: 378996 - DNA, 140 bp, Artificial Sequence
  Synthetic
caccgctgtcccaaaaggtctcgattgagttgctatagataagatttgatttctttactggaggtgtttctctcactttgtgagaatcacttttcactgagataagagcaactggcaggtcatatcagcagccagggcct

SEQ ID NO: 378997 - DNA, 140 bp, Artificial Sequence
  Synthetic
atacgccatgctgggtctccgaaacacctccagtaaagaaatcaaatcttatctatagcaactcaatcgacttttaggaagctagcagtacatatactatgggacaactcaaccctcttgcgtacttgggagtcggccat

SEQ ID NO: 378998 - DNA, 140 bp, Artificial Sequence
  Synthetic
atggccgactcccaagtacgcaagagggttgagttgtcccatagtatatgtactgctagcttcctaaaagtcgattgagttgctatagataagatttgatttctttactggaggtgtttcggagacccagcatggcgtat

SEQ ID NO: 378999 - DNA, 140 bp, Artificial Sequence
  Synthetic
atacgccatgctgggtctcccaagatagaaccagcccaaagggcctccccagagtctcttacaaacttagccaatcaattaacatgcataagcgatccatacttcacccaatcagtgtcccgtacttgggagtcggccat

SEQ ID NO: 379000 - DNA, 140 bp, Artificial Sequence
  Synthetic
atggccgactcccaagtacgggacactgattgggtgaagtatggatcgcttatgcatgttaattgattggctaagtttgtaagagactctggggaggccctttgggctggttctatcttgggagacccagcatggcgtat

SEQ ID NO: 379001 - DNA, 140 bp, Artificial Sequence
  Synthetic
atacgccatgctgggtctccaagaggttccctcagcctccttctcaaataacctgatccttgagggttacaccttcaccactctatgctcatttcacccaaacataaaatgaaatgtcttcgtacttgggagtcggccat

SEQ ID NO: 379002 - DNA, 140 bp, Artificial Sequence
  Synthetic
atggccgactcccaagtacgaagacatttcattttatgtttgggtgaaatgagcatagagtggtgaaggtgtaaccctcaaggatcaggttatttgagaaggaggctgagggaacctcttggagacccagcatggcgtat

SEQ ID NO: 379003 - DNA, 140 bp, Artificial Sequence
  Synthetic
aggccctggctgctgatatgaccttcaccactctatgctcatttcacccaaacataaaatgaaatgtcttaacatgattgcaccattaagaaaaacaaatctgatgaagattaagcctgagaccttttgggacagcggtg

SEQ ID NO: 379004 - DNA, 140 bp, Artificial Sequence
  Synthetic
caccgctgtcccaaaaggtctcaggcttaatcttcatcagatttgtttttcttaatggtgcaatcatgttaagacatttcattttatgtttgggtgaaatgagcatagagtggtgaaggtcatatcagcagccagggcct

SEQ ID NO: 379005 - DNA, 140 bp, Artificial Sequence
  Synthetic
aggccctggctgctgatatgaacatgattgcaccattaagaaaaacaaatctgatgaagattaagcctgattaaggcccaaccttcatctttttaccataatcttgttctcagtaccattgaccttttgggacagcggtg

SEQ ID NO: 379006 - DNA, 140 bp, Artificial Sequence
  Synthetic
caccgctgtcccaaaaggtcaatggtactgagaacaagattatggtaaaaagatgaaggttgggccttaatcaggcttaatcttcatcagatttgtttttcttaatggtgcaatcatgttcatatcagcagccagggcct

SEQ ID NO: 379007 - DNA, 140 bp, Artificial Sequence
  Synthetic
atacgccatgctgggtctccgggggtcttagcctactccaattgcccagggacaagtttcggaaaagctctttctttgtttgggtcatcatcttattccaaaaggccttttccatgccttcgtacttgggagtcggccat

SEQ ID NO: 379008 - DNA, 140 bp, Artificial Sequence
  Synthetic
atggccgactcccaagtacgaaggcatggaaaaggccttttggaataagatgatgacccaaacaaagaaagagcttttccgaaacttgtccctgggcaattggagtaggctaagacccccggagacccagcatggcgtat

SEQ ID NO: 379009 - DNA, 140 bp, Artificial Sequence
  Synthetic
atacgccatgctgggtctccgtctgcaaggatcatcttgcatctactgaccagctgaaatcagttggtctcaacctcgaggggagcggagtatctactgatatcccatctgcaacaaagccgtacttgggagtcggccat

SEQ ID NO: 379010 - DNA, 140 bp, Artificial Sequence
  Synthetic
atggccgactcccaagtacggctttgttgcagatgggatatcagtagatactccgctcccctcgaggttgagaccaactgatttcagctggtcagtagatgcaagatgatccttgcagacggagacccagcatggcgtat

SEQ ID NO: 379011 - DNA, 140 bp, Artificial Sequence
  Synthetic
aggccctggctgctgatatggagcgaatgcttacccccaccgccagatggtgtcagaggctttccaaggtgccgctatgtgcacaaagcccaaggaaccgggccctgcccaggtgactacgaccttttgggacagcggtg

SEQ ID NO: 379012 - DNA, 140 bp, Artificial Sequence
  Synthetic
caccgctgtcccaaaaggtcgtagtcacctgggcagggcccggttccttgggctttgtgcacatagcggcaccttggaaagcctctgacaccatctggcggtgggggtaagcattcgctccatatcagcagccagggcct

SEQ ID NO: 379013 - DNA, 140 bp, Artificial Sequence
  Synthetic
aggccctggctgctgatatgtgtaatttacagaggagtcaattttgctgagggggtgattgcattcttgatattggctaaaccaaaagaaacgttccttcagtcaccccccattcgagaggaccttttgggacagcggtg

SEQ ID NO: 379014 - DNA, 140 bp, Artificial Sequence
  Synthetic
caccgctgtcccaaaaggtcctctcgaatggggggtgactgaaggaacgtttcttttggtttagccaatatcaagaatgcaatcaccccctcagcaaaattgactcctctgtaaattacacatatcagcagccagggcct

SEQ ID NO: 379015 - DNA, 140 bp, Artificial Sequence
  Synthetic
atacgccatgctgggtctccggagtatgaaatcgaaaattttggtgctcaacactccacgacccttttcaaaattgacaataatacttttgttcgtctggacaggccccacacgcctcagcgtacttgggagtcggccat

SEQ ID NO: 379016 - DNA, 140 bp, Artificial Sequence
  Synthetic
atggccgactcccaagtacgctgaggcgtgtggggcctgtccagacgaacaaaagtattattgtcaattttgaaaagggtcgtggagtgttgagcaccaaaattttcgatttcatactccggagacccagcatggcgtat

SEQ ID NO: 379017 - DNA, 140 bp, Artificial Sequence
  Synthetic
atacgccatgctgggtctcctacaactgggagactaatttggacactagatgctaatatcaatgctgatattggtgaatgggctttttgggaaaataaaaaaatctctccgaacaactaccgtacttgggagtcggccat

SEQ ID NO: 379018 - DNA, 140 bp, Artificial Sequence
  Synthetic
atggccgactcccaagtacggtagttgttcggagagatttttttattttcccaaaaagcccattcaccaatatcagcattgatattagcatctagtgtccaaattagtctcccagttgtaggagacccagcatggcgtat

SEQ ID NO: 379019 - DNA, 140 bp, Artificial Sequence
  Synthetic
atacgccatgctgggtctcccaccaggcagtattcggacctggttccaaagaatccccctgggatggttccattgcacataccagaaggggaaacaacattgccgtctcagaattcgacacgtacttgggagtcggccat

SEQ ID NO: 379020 - DNA, 140 bp, Artificial Sequence
  Synthetic
atggccgactcccaagtacgtgtcgaattctgagacggcaatgttgtttccccttctggtatgtgcaatggaaccatcccagggggattctttggaaccaggtccgaatactgcctggtgggagacccagcatggcgtat

SEQ ID NO: 379021 - DNA, 140 bp, Artificial Sequence
  Synthetic
atacgccatgctgggtctcctgcaacaattataggcactaacggcaaccatatgcagatctccaccatcgggataagaccgagctccagccaaatcccgagttcctcaccgaccacggcacgtacttgggagtcggccat

SEQ ID NO: 379022 - DNA, 140 bp, Artificial Sequence
  Synthetic
atggccgactcccaagtacgtgccgtggtcggtgaggaactcgggatttggctggagctcggtcttatcccgatggtggagatctgcatatggttgccgttagtgcctataattgttgcaggagacccagcatggcgtat

SEQ ID NO: 379023 - DNA, 140 bp, Artificial Sequence
  Synthetic
atacgccatgctgggtctccgatggccaccgaggaaccaacaacaccaccgggaagctcccccggcccaacaacagaagcacccactctcaccaccccagaaaatataacaacagcggttcgtacttgggagtcggccat

SEQ ID NO: 379024 - DNA, 140 bp, Artificial Sequence
  Synthetic
atggccgactcccaagtacgaaccgctgttgttatattttctggggtggtgagagtgggtgcttctgttgttgggccgggggagcttcccggtggtgttgttggttcctcggtggccatcggagacccagcatggcgtat

SEQ ID NO: 379025 - DNA, 140 bp, Artificial Sequence
  Synthetic
atacgccatgctgggtctccagtaacagggattcttgggagtcttgggcttcgaaaacgcagcagaagacaaactaacaccaaagccacgggtaagtgcaatcccaacttacactactggcgtacttgggagtcggccat

SEQ ID NO: 379026 - DNA, 140 bp, Artificial Sequence
  Synthetic
atggccgactcccaagtacgccagtagtgtaagttgggattgcacttacccgtggctttggtgttagtttgtcttctgctgcgttttcgaagcccaagactcccaagaatccctgttactggagacccagcatggcgtat

SEQ ID NO: 379027 - DNA, 140 bp, Artificial Sequence
  Synthetic
aggccctggctgctgatatgaaactaacaccaaagccacgggtaagtgcaatcccaacttacactactggactgcacaagaacaacataatgctgctgggattgcctggatcccgtacttgaccttttgggacagcggtg

SEQ ID NO: 379028 - DNA, 140 bp, Artificial Sequence
  Synthetic
caccgctgtcccaaaaggtcaagtacgggatccaggcaatcccagcagcattatgttgttcttgtgcagtccagtagtgtaagttgggattgcacttacccgtggctttggtgttagtttcatatcagcagccagggcct

SEQ ID NO: 379029 - DNA, 140 bp, Artificial Sequence
  Synthetic
atacgccatgctgggtctccatgccttagtctgtggacttaggcaacttgcaaatgaaacaactcaagctctgcagcttttcttaagagccacaacggagctgcggacatataccatactcgtacttgggagtcggccat

SEQ ID NO: 379030 - DNA, 140 bp, Artificial Sequence
  Synthetic
atggccgactcccaagtacgagtatggtatatgtccgcagctccgttgtggctcttaagaaaagctgcagagcttgagttgtttcatttgcaagttgcctaagtccacagactaaggcatggagacccagcatggcgtat

SEQ ID NO: 379031 - DNA, 140 bp, Artificial Sequence
  Synthetic
aggccctggctgctgatatgctgcagcttttcttaagagccacaacggagctgcggacatataccatactcaacaggaaggccatagatttccttctgcgacgatggggcgggacatgcagaccttttgggacagcggtg

SEQ ID NO: 379032 - DNA, 140 bp, Artificial Sequence
  Synthetic
caccgctgtcccaaaaggtctgcatgtcccgccccatcgtcgcagaaggaaatctatggccttcctgttgagtatggtatatgtccgcagctccgttgtggctcttaagaaaagctgcagcatatcagcagccagggcct

SEQ ID NO: 379033 - DNA, 140 bp, Artificial Sequence
  Synthetic
atacgccatgctgggtctccatcactgataaaatcaaccaaatcatccatgatttcatcgacaaccccttacctaatcaggataatgatgataattggtggacaggctggagacagtggacgtacttgggagtcggccat

SEQ ID NO: 379034 - DNA, 140 bp, Artificial Sequence
  Synthetic
atggccgactcccaagtacgtccactgtctccagcctgtccaccaattatcatcattatcctgattaggtaaggggttgtcgatgaaatcatggatgatttggttgattttatcagtgatggagacccagcatggcgtat

SEQ ID NO: 379035 - DNA, 140 bp, Artificial Sequence
  Synthetic
atacgccatgctgggtctccctttgcgtttgcaagctgctttgctgaatatcaatttgaatcatcaatttaagcttgatacatttctagcattttaaattataaaccgatactgatacttcgtacttgggagtcggccat

SEQ ID NO: 379036 - DNA, 140 bp, Artificial Sequence
  Synthetic
atggccgactcccaagtacgaagtatcagtatcggtttataatttaaaatgctagaaatgtatcaagcttaaattgatgattcaaattgatattcagcaaagcagcttgcaaacgcaaagggagacccagcatggcgtat

SEQ ID NO: 379037 - DNA, 140 bp, Artificial Sequence
  Synthetic
atacgccatgctgggtctccaaaaatcctttgaactggaatgctttgatactctttctcaatactatataagttccttcccaagaataatattgatgaagattaagaaaaagtgacattgcgtacttgggagtcggccat

SEQ ID NO: 379038 - DNA, 140 bp, Artificial Sequence
  Synthetic
atggccgactcccaagtacgcaatgtcactttttcttaatcttcatcaatattattcttgggaaggaacttatatagtattgagaaagagtatcaaagcattccagttcaaaggatttttggagacccagcatggcgtat

SEQ ID NO: 379039 - DNA, 140 bp, Artificial Sequence
  Synthetic
aggccctggctgctgatatgagttccttcccaagaataatattgatgaagattaagaaaaagtgacattgtgcccacttttgtaatcttcatccacctacacattcatattcaggaatctgaccttttgggacagcggtg

SEQ ID NO: 379040 - DNA, 140 bp, Artificial Sequence
  Synthetic
caccgctgtcccaaaaggtcagattcctgaatatgaatgtgtaggtggatgaagattacaaaagtgggcacaatgtcactttttcttaatcttcatcaatattattcttgggaaggaactcatatcagcagccagggcct

SEQ ID NO: 379041 - DNA, 140 bp, Artificial Sequence
  Synthetic
atacgccatgctgggtctcctcccgaggcggcaattcagttaatttcatatcaagataacatccatttccaagaccacagataactatattattaatctttaccacaaatatggagagggcgtacttgggagtcggccat

SEQ ID NO: 379042 - DNA, 140 bp, Artificial Sequence
  Synthetic
atggccgactcccaagtacgccctctccatatttgtggtaaagattaataatatagttatctgtggtcttggaaatggatgttatcttgatatgaaattaactgaattgccgcctcgggaggagacccagcatggcgtat

SEQ ID NO: 379043 - DNA, 140 bp, Artificial Sequence
  Synthetic
aggccctggctgctgatatgaagaccacagataactatattattaatctttaccacaaatatggagaggggtcgtgagcgcgggagatcaaggaattcacgtgccgaccagcaaaattcagaccttttgggacagcggtg

SEQ ID NO: 379044 - DNA, 140 bp, Artificial Sequence
  Synthetic
caccgctgtcccaaaaggtctgaattttgctggtcggcacgtgaattccttgatctcccgcgctcacgacccctctccatatttgtggtaaagattaataatatagttatctgtggtcttcatatcagcagccagggcct

SEQ ID NO: 379045 - DNA, 140 bp, Artificial Sequence
  Synthetic
atacgccatgctgggtctccagactaccgtagtagtcgaagtacttcgcaagttagagtccctacggttttccataagaaaggtactgggacccttactgtccctccagcacctaaggatcgtacttgggagtcggccat

SEQ ID NO: 379046 - DNA, 140 bp, Artificial Sequence
  Synthetic
atggccgactcccaagtacgatccttaggtgctggagggacagtaagggtcccagtacctttcttatggaaaaccgtagggactctaacttgcgaagtacttcgactactacggtagtctggagacccagcatggcgtat

SEQ ID NO: 379047 - DNA, 140 bp, Artificial Sequence
  Synthetic
atacgccatgctgggtctccaaaggaccatcaacttgaaagcctaaccgaccgggagctcctacttcttatagcacggaagacctgtggatcaactgattcatcgcttaatatagctgctcgtacttgggagtcggccat

SEQ ID NO: 379048 - DNA, 140 bp, Artificial Sequence
  Synthetic
atggccgactcccaagtacgagcagctatattaagcgatgaatcagttgatccacaggtcttccgtgctataagaagtaggagctcccggtcggttaggctttcaagttgatggtcctttggagacccagcatggcgtat

SEQ ID NO: 379049 - DNA, 140 bp, Artificial Sequence
  Synthetic
aggccctggctgctgatatgtagcacggaagacctgtggatcaactgattcatcgcttaatatagctgctcctaaagacctaagactagcaaatcctacggctgatgacttcaagcaagagaccttttgggacagcggtg

SEQ ID NO: 379050 - DNA, 140 bp, Artificial Sequence
  Synthetic
caccgctgtcccaaaaggtctcttgcttgaagtcatcagccgtaggatttgctagtcttaggtctttaggagcagctatattaagcgatgaatcagttgatccacaggtcttccgtgctacatatcagcagccagggcct

SEQ ID NO: 379051 - DNA, 140 bp, Artificial Sequence
  Synthetic
atacgccatgctgggtctcccctaaagacctaagactagcaaatcctacggctgatgacttcaagcaagacggcagtccaaaattaaccctaaaattactagtcgagactgctgagttttcgtacttgggagtcggccat

SEQ ID NO: 379052 - DNA, 140 bp, Artificial Sequence
  Synthetic
atggccgactcccaagtacgaaaactcagcagtctcgactagtaattttagggttaattttggactgccgtcttgcttgaagtcatcagccgtaggatttgctagtcttaggtctttaggggagacccagcatggcgtat

SEQ ID NO: 379053 - DNA, 140 bp, Artificial Sequence
  Synthetic
atacgccatgctgggtctccttgacgttgagtgctgtcttagtgcggaaattctctaagtcacagcttagtcaattatgtgagagtcatcttaggagggaaaacttaggacaagaccaagcgtacttgggagtcggccat

SEQ ID NO: 379054 - DNA, 140 bp, Artificial Sequence
  Synthetic
atggccgactcccaagtacgcttggtcttgtcctaagttttccctcctaagatgactctcacataattgactaagctgtgacttagagaatttccgcactaagacagcactcaacgtcaaggagacccagcatggcgtat

SEQ ID NO: 379055 - DNA, 140 bp, Artificial Sequence
  Synthetic
aggccctggctgctgatatgtcaattatgtgagagtcatcttaggagggaaaacttaggacaagaccaagctgaatcagttctcgaggtttatcaacgtttacatagtgataaaggaggtgaccttttgggacagcggtg

SEQ ID NO: 379056 - DNA, 140 bp, Artificial Sequence
  Synthetic
caccgctgtcccaaaaggtcacctcctttatcactatgtaaacgttgataaacctcgagaactgattcagcttggtcttgtcctaagttttccctcctaagatgactctcacataattgacatatcagcagccagggcct

SEQ ID NO: 379057 - DNA, 140 bp, Artificial Sequence
  Synthetic
atacgccatgctgggtctccgtttatatctgctttcctccatgtagcattgcaactttcctgtgagagctccactgtagtgatatcaggcctacgcttacttgcccccccaagcgttaatcgtacttgggagtcggccat

SEQ ID NO: 379058 - DNA, 140 bp, Artificial Sequence
  Synthetic
atggccgactcccaagtacgattaacgcttgggggggcaagtaagcgtaggcctgatatcactacagtggagctctcacaggaaagttgcaatgctacatggaggaaagcagatataaacggagacccagcatggcgtat

SEQ ID NO: 379059 - DNA, 140 bp, Artificial Sequence
  Synthetic
aggccctggctgctgatatgccactgtagtgatatcaggcctacgcttacttgcccccccaagcgttaatgaagggctccctcctgcaccaggggaatatacttggtcagaagatagtacgaccttttgggacagcggtg

SEQ ID NO: 379060 - DNA, 140 bp, Artificial Sequence
  Synthetic
caccgctgtcccaaaaggtcgtactatcttctgaccaagtatattcccctggtgcaggagggagcccttcattaacgcttgggggggcaagtaagcgtaggcctgatatcactacagtggcatatcagcagccagggcct

SEQ ID NO: 379061 - DNA, 140 bp, Artificial Sequence
  Synthetic
atacgccatgctgggtctccagatggtatttttaaagagggggacaggataggaataaagataatgactaaagccaatataaagatacgaacacaagtagaaattaaaatagaaatcaaacgtacttgggagtcggccat

SEQ ID NO: 379062 - DNA, 140 bp, Artificial Sequence
  Synthetic
atggccgactcccaagtacgtttgatttctattttaatttctacttgtgttcgtatctttatattggctttagtcattatctttattcctatcctgtccccctctttaaaaataccatctggagacccagcatggcgtat

SEQ ID NO: 379063 - DNA, 140 bp, Artificial Sequence
  Synthetic
atacgccatgctgggtctccacaatctccccttgttcaatatgaaatataatagtgagtatttgtttcatgatgtcaatcatttattgttaaaaataaacaaagtcagtaagagtgttagcgtacttgggagtcggccat

SEQ ID NO: 379064 - DNA, 140 bp, Artificial Sequence
  Synthetic
atggccgactcccaagtacgctaacactcttactgactttgtttatttttaacaataaatgattgacatcatgaaacaaatactcactattatatttcatattgaacaaggggagattgtggagacccagcatggcgtat

SEQ ID NO: 379065 - DNA, 140 bp, Artificial Sequence
  Synthetic
atacgccatgctgggtctccgatcgttatattgcaaggatcctccctagaagcgttgaatcatctcaagtagcctagaacaagaacagcagagcattaaattgaaatagataataaggatcgtacttgggagtcggccat

SEQ ID NO: 379066 - DNA, 140 bp, Artificial Sequence
  Synthetic
atggccgactcccaagtacgatccttattatctatttcaatttaatgctctgctgttcttgttctaggctacttgagatgattcaacgcttctagggaggatccttgcaatataacgatcggagacccagcatggcgtat

SEQ ID NO: 379067 - DNA, 140 bp, Artificial Sequence
  Synthetic
aggccctggctgctgatatgagcctagaacaagaacagcagagcattaaattgaaatagataataaggatattgcttgtttttaagatagttttaggaagtttaaaattaagaaaaagaagaccttttgggacagcggtg

SEQ ID NO: 379068 - DNA, 140 bp, Artificial Sequence
  Synthetic
caccgctgtcccaaaaggtcttctttttcttaattttaaacttcctaaaactatcttaaaaacaagcaatatccttattatctatttcaatttaatgctctgctgttcttgttctaggctcatatcagcagccagggcct

SEQ ID NO: 379069 - DNA, 140 bp, Artificial Sequence
  Synthetic
atacgccatgctgggtctccagtcttaggtatagggtagtcctacacgtcctatattatacagtctaaacttgtaaaattaaactacaagaacatgatgaaaattaatgagaaggttccacgtacttgggagtcggccat

SEQ ID NO: 379070 - DNA, 140 bp, Artificial Sequence
  Synthetic
atggccgactcccaagtacgtggaaccttctcattaattttcatcatgttcttgtagtttaattttacaagtttagactgtataatataggacgtgtaggactaccctatacctaagactggagacccagcatggcgtat

SEQ ID NO: 379071 - DNA, 140 bp, Artificial Sequence
  Synthetic
atacgccatgctgggtctccagattgacttcaatccaaacaccttgctctgccaattttcatctccttaagatatatgattttgttcctgcgagataaggttatcaaatagggtgtgtatcgtacttgggagtcggccat

SEQ ID NO: 379072 - DNA, 140 bp, Artificial Sequence
  Synthetic
atggccgactcccaagtacgatacacaccctatttgataaccttatctcgcaggaacaaaatcatatatcttaaggagatgaaaattggcagagcaaggtgtttggattgaagtcaatctggagacccagcatggcgtat

SEQ ID NO: 379073 - DNA, 140 bp, Artificial Sequence
  Synthetic
atacgccatgctgggtctccgactcatcacatttttaattgaactagtctactcgcagaatcctaccgggaatagaaattagaacatttgtgatactttgactataggaaataattttcacgtacttgggagtcggccat

SEQ ID NO: 379074 - DNA, 140 bp, Artificial Sequence
  Synthetic
atggccgactcccaagtacgtgaaaattatttcctatagtcaaagtatcacaaatgttctaatttctattcccggtaggattctgcgagtagactagttcaattaaaaatgtgatgagtcggagacccagcatggcgtat

SEQ ID NO: 379075 - DNA, 140 bp, Artificial Sequence
  Synthetic
atacgccatgctgggtctccacactacctgagatcaggttattcttccaacttattctgcaagtaattgtttagcatcataacaacaacgttataatttaagaatcaagtcttgtaacagcgtacttgggagtcggccat

SEQ ID NO: 379076 - DNA, 140 bp, Artificial Sequence
  Synthetic
atggccgactcccaagtacgctgttacaagacttgattcttaaattataacgttgttgttatgatgctaaacaattacttgcagaataagttggaagaataacctgatctcaggtagtgtggagacccagcatggcgtat

SEQ ID NO: 379077 - DNA, 140 bp, Artificial Sequence
  Synthetic
atacgccatgctgggtctccgtgcaaggatggaaggtttactgggctggacttgagtttgatgtcaaccaaaagggtattaccctgttaaatcgtcttaaagtgaatgattttgctcctgcgtacttgggagtcggccat

SEQ ID NO: 379078 - DNA, 140 bp, Artificial Sequence
  Synthetic
atggccgactcccaagtacgcaggagcaaaatcattcactttaagacgatttaacagggtaatacccttttggttgacatcaaactcaagtccagcccagtaaaccttccatccttgcacggagacccagcatggcgtat

SEQ ID NO: 379079 - DNA, 140 bp, Artificial Sequence
  Synthetic
aggccctggctgctgatatgaaagggtattaccctgttaaatcgtcttaaagtgaatgattttgctcctgcatgggcgatgacccggaacctcttcccacacttgttcaaaaaccaacaggaccttttgggacagcggtg

SEQ ID NO: 379080 - DNA, 140 bp, Artificial Sequence
  Synthetic
caccgctgtcccaaaaggtcctgttggtttttgaacaagtgtgggaagaggttccgggtcatcgcccatgcaggagcaaaatcattcactttaagacgatttaacagggtaataccctttcatatcagcagccagggcct

SEQ ID NO: 379081 - DNA, 140 bp, Artificial Sequence
  Synthetic
atacgccatgctgggtctccgattcttgaccaattaatggatcattccctcattgagccgctatcaggggccctgaacctaattgctgattggttactaacaacatctactaatcacttccgtacttgggagtcggccat

SEQ ID NO: 379082 - DNA, 140 bp, Artificial Sequence
  Synthetic
atggccgactcccaagtacggaagtgattagtagatgttgttagtaaccaatcagcaattaggttcagggcccctgatagcggctcaatgagggaatgatccattaattggtcaagaatcggagacccagcatggcgtat

SEQ ID NO: 379083 - DNA, 140 bp, Artificial Sequence
  Synthetic
atacgccatgctgggtctcctcttataaggtcaaatattattaactttataaataagctcgagactcttcatgtcgttaattacaagggacttctaagcagtgttgagataggaacaccacgtacttgggagtcggccat

SEQ ID NO: 379084 - DNA, 140 bp, Artificial Sequence
  Synthetic
atggccgactcccaagtacgtggtgttcctatctcaacactgcttagaagtcccttgtaattaacgacatgaagagtctcgagcttatttataaagttaataatatttgaccttataagaggagacccagcatggcgtat

SEQ ID NO: 379085 - DNA, 140 bp, Artificial Sequence
  Synthetic
aggccctggctgctgatatgaattctccctactacatgaatcgacacttaaacctgttgccactcctaaaccgtcaagcattacttcattgatcatggagttcaacagttctttggcaatgaccttttgggacagcggtg

SEQ ID NO: 379086 - DNA, 140 bp, Artificial Sequence
  Synthetic
caccgctgtcccaaaaggtcattgccaaagaactgttgaactccatgatcaatgaagtaatgcttgacggtttaggagtggcaacaggtttaagtgtcgattcatgtagtagggagaattcatatcagcagccagggcct

SEQ ID NO: 379087 - DNA, 140 bp, Artificial Sequence
  Synthetic
atacgccatgctgggtctccttacatgtgtagtcacctgtatagcatgaccctagtcatgcctttaattaatacttaatctaacagttaatataatgtataactttccatgttcaaagagcgtacttgggagtcggccat

SEQ ID NO: 379088 - DNA, 140 bp, Artificial Sequence
  Synthetic
atggccgactcccaagtacgctctttgaacatggaaagttatacattatattaactgttagattaagtattaattaaaggcatgactagggtcatgctatacaggtgactacacatgtaaggagacccagcatggcgtat

SEQ ID NO: 379089 - DNA, 140 bp, Artificial Sequence
  Synthetic
atacgccatgctgggtctcctagtcaaaacaatgtgagatccagtttcactcacagcatctattcactatttacagtatgatgagcccaaattaacacagtagaggtctagatttattaacgtacttgggagtcggccat

SEQ ID NO: 379090 - DNA, 140 bp, Artificial Sequence
  Synthetic
atggccgactcccaagtacgttaataaatctagacctctactgtgttaatttgggctcatcatactgtaaatagtgaatagatgctgtgagtgaaactggatctcacattgttttgactaggagacccagcatggcgtat

SEQ ID NO: 379091 - DNA, 140 bp, Artificial Sequence
  Synthetic
atacgccatgctgggtctcctgccaccataggactttttcaattcctctattttatgatggctacccaacatacacaatatcctgatgcaagattgtcttccccaattgtcttagaccaacgtacttgggagtcggccat

SEQ ID NO: 379092 - DNA, 140 bp, Artificial Sequence
  Synthetic
atggccgactcccaagtacgttggtctaagacaattggggaagacaatcttgcatcaggatattgtgtatgttgggtagccatcataaaatagaggaattgaaaaagtcctatggtggcaggagacccagcatggcgtat

SEQ ID NO: 379093 - DNA, 140 bp, Artificial Sequence
  Synthetic
atacgccatgctgggtctccatgacactattgttttacgatttatcagtgatgtccctgtagctacaatcccaatagactacattgctccgatgttaataaatgttctggcagatagtaacgtacttgggagtcggccat

SEQ ID NO: 379094 - DNA, 140 bp, Artificial Sequence
  Synthetic
atggccgactcccaagtacgttactatctgccagaacatttattaacatcggagcaatgtagtctattgggattgtagctacagggacatcactgataaatcgtaaaacaatagtgtcatggagacccagcatggcgtat

SEQ ID NO: 379095 - DNA, 140 bp, Artificial Sequence
  Synthetic
aggccctggctgctgatatgccaatagactacattgctccgatgttaataaatgttctggcagatagtaaaaatgtaccattggaacctccctgcttgagtttcttggatgaaatagtcagaccttttgggacagcggtg

SEQ ID NO: 379096 - DNA, 140 bp, Artificial Sequence
  Synthetic
caccgctgtcccaaaaggtctgactatttcatccaagaaactcaagcagggaggttccaatggtacatttttactatctgccagaacatttattaacatcggagcaatgtagtctattggcatatcagcagccagggcct

SEQ ID NO: 379097 - DNA, 140 bp, Artificial Sequence
  Synthetic
atacgccatgctgggtctccaaatgtaccattggaacctccctgcttgagtttcttggatgaaatagtcaattataccgtgcaggatgcagcattccttaattattacatgaatcagattcgtacttgggagtcggccat

SEQ ID NO: 379098 - DNA, 140 bp, Artificial Sequence
  Synthetic
atggccgactcccaagtacgaatctgattcatgtaataattaaggaatgctgcatcctgcacggtataattgactatttcatccaagaaactcaagcagggaggttccaatggtacatttggagacccagcatggcgtat

SEQ ID NO: 379099 - DNA, 140 bp, Artificial Sequence
  Synthetic
atacgccatgctgggtctccggtcattcacaaaaacagatatctatctgctctattcttctggcatgatcttgccatcctcacccgtcgagggagaatgaaccgaggaaatgtgcgctctcgtacttgggagtcggccat

SEQ ID NO: 379100 - DNA, 140 bp, Artificial Sequence
  Synthetic
atggccgactcccaagtacgagagcgcacatttcctcggttcattctccctcgacgggtgaggatggcaagatcatgccagaagaatagagcagatagatatctgtttttgtgaatgaccggagacccagcatggcgtat

SEQ ID NO: 379101 - DNA, 140 bp, Artificial Sequence
  Synthetic
aggccctggctgctgatatgttgccatcctcacccgtcgagggagaatgaaccgaggaaatgtgcgctctacttggtttgtaacgaatgaggttgttgacattctaggatatggtgattagaccttttgggacagcggtg

SEQ ID NO: 379102 - DNA, 140 bp, Artificial Sequence
  Synthetic
caccgctgtcccaaaaggtctaatcaccatatcctagaatgtcaacaacctcattcgttacaaaccaagtagagcgcacatttcctcggttcattctccctcgacgggtgaggatggcaacatatcagcagccagggcct

SEQ ID NO: 379103 - DNA, 140 bp, Artificial Sequence
  Synthetic
atacgccatgctgggtctccttccacatgcatcaactgactggtaccaacctaatatcttcaaggaggctattcaaggacacacacatattatttcagtctctacagccgaggtccttatcgtacttgggagtcggccat

SEQ ID NO: 379104 - DNA, 140 bp, Artificial Sequence
  Synthetic
atggccgactcccaagtacgataaggacctcggctgtagagactgaaataatatgtgtgtgtccttgaatagcctccttgaagatattaggttggtaccagtcagttgatgcatgtggaaggagacccagcatggcgtat

SEQ ID NO: 379105 - DNA, 140 bp, Artificial Sequence
  Synthetic
aggccctggctgctgatatgattcaaggacacacacatattatttcagtctctacagccgaggtccttattatgtgtaaggatcttgtcacaagtcgttttaatacccttctgattgctggaccttttgggacagcggtg

SEQ ID NO: 379106 - DNA, 140 bp, Artificial Sequence
  Synthetic
caccgctgtcccaaaaggtccagcaatcagaagggtattaaaacgacttgtgacaagatccttacacataataaggacctcggctgtagagactgaaataatatgtgtgtgtccttgaatcatatcagcagccagggcct

SEQ ID NO: 379107 - DNA, 140 bp, Artificial Sequence
  Synthetic
atacgccatgctgggtctccaatattcaatctctgtatgacgcaggagactacctgttgtccatattgggatcagaggggtacaaaataatcaaatatctcgaacctctgtgtttggctacgtacttgggagtcggccat

SEQ ID NO: 379108 - DNA, 140 bp, Artificial Sequence
  Synthetic
atggccgactcccaagtacgtagccaaacacagaggttcgagatatttgattattttgtacccctctgatcccaatatggacaacaggtagtctcctgcgtcatacagagattgaatattggagacccagcatggcgtat

SEQ ID NO: 379109 - DNA, 140 bp, Artificial Sequence
  Synthetic
aggccctggctgctgatatgatcagaggggtacaaaataatcaaatatctcgaacctctgtgtttggctaagattcaactatgttcccaatatacagaacgaaaagggcggtttttaaccgaccttttgggacagcggtg

SEQ ID NO: 379110 - DNA, 140 bp, Artificial Sequence
  Synthetic
caccgctgtcccaaaaggtcggttaaaaaccgcccttttcgttctgtatattgggaacatagttgaatcttagccaaacacagaggttcgagatatttgattattttgtacccctctgatcatatcagcagccagggcct

SEQ ID NO: 379111 - DNA, 140 bp, Artificial Sequence
  Synthetic
atacgccatgctgggtctccagggttgaaaaaatcacaattgtctaaaatccgcgagtttcaccaactgttgctcagactccgatctacaccacaacaattatgtgaattattttcaatccgtacttgggagtcggccat

SEQ ID NO: 379112 - DNA, 140 bp, Artificial Sequence
  Synthetic
atggccgactcccaagtacggattgaaaataattcacataattgttgtggtgtagatcggagtctgagcaacagttggtgaaactcgcggattttagacaattgtgattttttcaaccctggagacccagcatggcgtat

SEQ ID NO: 379113 - DNA, 140 bp, Artificial Sequence
  Synthetic
atacgccatgctgggtctcccaaaaacactggggccacccagttctgcatagtgaaaaggccatccaaaaggttaaaaatcatgcaacagttctaaaggcattgcggccgattatcatctcgtacttgggagtcggccat

SEQ ID NO: 379114 - DNA, 140 bp, Artificial Sequence
  Synthetic
atggccgactcccaagtacgagatgataatcggccgcaatgcctttagaactgttgcatgatttttaaccttttggatggccttttcactatgcagaactgggtggccccagtgtttttgggagacccagcatggcgtat

SEQ ID NO: 379115 - DNA, 140 bp, Artificial Sequence
  Synthetic
atacgccatgctgggtctccagtcaaggcacttggtacagtgtgatatcagaccgatgtttaacgccgggattgaattcctacattaggcgaaatcaattccctccacttccaatgatcacgtacttgggagtcggccat

SEQ ID NO: 379116 - DNA, 140 bp, Artificial Sequence
  Synthetic
atggccgactcccaagtacgtgatcattggaagtggagggaattgatttcgcctaatgtaggaattcaatcccggcgttaaacatcggtctgatatcacactgtaccaagtgccttgactggagacccagcatggcgtat

SEQ ID NO: 379117 - DNA, 140 bp, Artificial Sequence
  Synthetic
aggccctggctgctgatatgattgaattcctacattaggcgaaatcaattccctccacttccaatgatcaaagatcttttatgggaattttaccatttggatcatcctccattattctccgaccttttgggacagcggtg

SEQ ID NO: 379118 - DNA, 140 bp, Artificial Sequence
  Synthetic
caccgctgtcccaaaaggtcggagaataatggaggatgatccaaatggtaaaattcccataaaagatctttgatcattggaagtggagggaattgatttcgcctaatgtaggaattcaatcatatcagcagccagggcct

SEQ ID NO: 379119 - DNA, 140 bp, Artificial Sequence
  Synthetic
atacgccatgctgggtctccagttgaacagacctgttgggatgcagtttttgagcctaacgttttgggctacagtccaccttatcgattcaataccaaacgtgtacctgaacaattcctgcgtacttgggagtcggccat

SEQ ID NO: 379120 - DNA, 140 bp, Artificial Sequence
  Synthetic
atggccgactcccaagtacgcaggaattgttcaggtacacgtttggtattgaatcgataaggtggactgtagcccaaaacgttaggctcaaaaactgcatcccaacaggtctgttcaactggagacccagcatggcgtat

SEQ ID NO: 379121 - DNA, 140 bp, Artificial Sequence
  Synthetic
aggccctggctgctgatatgacagtccaccttatcgattcaataccaaacgtgtacctgaacaattcctggagcaagaggatttttctattgagagtgtcttacaatacgcccaagaactgaccttttgggacagcggtg

SEQ ID NO: 379122 - DNA, 140 bp, Artificial Sequence
  Synthetic
caccgctgtcccaaaaggtcagttcttgggcgtattgtaagacactctcaatagaaaaatcctcttgctccaggaattgttcaggtacacgtttggtattgaatcgataaggtggactgtcatatcagcagccagggcct

SEQ ID NO: 379123 - DNA, 140 bp, Artificial Sequence
  Synthetic
atacgccatgctgggtctccgccacagttcgtggaagtagttttgtcacagacctggaaaaatacaatctggccttcaggtatgaattcacagctcccttcatcaaatattgcaaccaatcgtacttgggagtcggccat

SEQ ID NO: 379124 - DNA, 140 bp, Artificial Sequence
  Synthetic
atggccgactcccaagtacgattggttgcaatatttgatgaagggagctgtgaattcatacctgaaggccagattgtatttttccaggtctgtgacaaaactacttccacgaactgtggcggagacccagcatggcgtat

SEQ ID NO: 379125 - DNA, 140 bp, Artificial Sequence
  Synthetic
atacgccatgctgggtctccgctatggggttcgcaatgtctttgattggatgcacttcctaattccacagtgttacatgcatgttagtgattattataacccaccacataatgtaaccttcgtacttgggagtcggccat

SEQ ID NO: 379126 - DNA, 140 bp, Artificial Sequence
  Synthetic
atggccgactcccaagtacgaaggttacattatgtggtgggttataataatcactaacatgcatgtaacactgtggaattaggaagtgcatccaatcaaagacattgcgaaccccatagcggagacccagcatggcgtat

SEQ ID NO: 379127 - DNA, 140 bp, Artificial Sequence
  Synthetic
atacgccatgctgggtctccttggcggtattgaggggcttcaacaaaagttatggactagtatctcatgtgctcaaatctcattggtagagatcaagaccgggttcaaattgcgatcagccgtacttgggagtcggccat

SEQ ID NO: 379128 - DNA, 140 bp, Artificial Sequence
  Synthetic
atggccgactcccaagtacggctgatcgcaatttgaacccggtcttgatctctaccaatgagatttgagcacatgagatactagtccataacttttgttgaagcccctcaataccgccaaggagacccagcatggcgtat

SEQ ID NO: 379129 - DNA, 140 bp, Artificial Sequence
  Synthetic
aggccctggctgctgatatggctcaaatctcattggtagagatcaagaccgggttcaaattgcgatcagcagtcatgggggataatcaatgtattacagtattatcagtctttccactaggaccttttgggacagcggtg

SEQ ID NO: 379130 - DNA, 140 bp, Artificial Sequence
  Synthetic
caccgctgtcccaaaaggtcctagtggaaagactgataatactgtaatacattgattatcccccatgactgctgatcgcaatttgaacccggtcttgatctctaccaatgagatttgagccatatcagcagccagggcct

SEQ ID NO: 379131 - DNA, 140 bp, Artificial Sequence
  Synthetic
atacgccatgctgggtctccgtggctgctagcttggccaaagtcacaagtgcctgtgggatattcctcaagcctgatgagactttcgtacactcaggctttatctattttggcaaaaagccgtacttgggagtcggccat

SEQ ID NO: 379132 - DNA, 140 bp, Artificial Sequence
  Synthetic
atggccgactcccaagtacggctttttgccaaaatagataaagcctgagtgtacgaaagtctcatcaggcttgaggaatatcccacaggcacttgtgactttggccaagctagcagccacggagacccagcatggcgtat

SEQ ID NO: 379133 - DNA, 140 bp, Artificial Sequence
  Synthetic
atacgccatgctgggtctcctaccatgtcgtgttgcagctgcctttcatacatatttctctgttcggatcttacaacatcatcaccttggtttccataagggttcagaccttggacaattcgtacttgggagtcggccat

SEQ ID NO: 379134 - DNA, 140 bp, Artificial Sequence
  Synthetic
atggccgactcccaagtacgaattgtccaaggtctgaacccttatggaaaccaaggtgatgatgttgtaagatccgaacagagaaatatgtatgaaaggcagctgcaacacgacatggtaggagacccagcatggcgtat

SEQ ID NO: 379135 - DNA, 140 bp, Artificial Sequence
  Synthetic
atacgccatgctgggtctccttcctcaggtattgggtggattatccttcctaaatccagaaaagtgcctttatcgcaacttgggtgatcctgtaacttcaggcctattccagttgaagcacgtacttgggagtcggccat

SEQ ID NO: 379136 - DNA, 140 bp, Artificial Sequence
  Synthetic
atggccgactcccaagtacgtgcttcaactggaataggcctgaagttacaggatcacccaagttgcgataaaggcacttttctggatttaggaaggataatccacccaatacctgaggaaggagacccagcatggcgtat

SEQ ID NO: 379137 - DNA, 140 bp, Artificial Sequence
  Synthetic
atacgccatgctgggtctccaaagcccagggaattgtagcgcgattgactttgttctaaacccaggcgggttaaatgtccctggatcacaggatttaacatctttccttcgtcagattgtcgtacttgggagtcggccat

SEQ ID NO: 379138 - DNA, 140 bp, Artificial Sequence
  Synthetic
atggccgactcccaagtacgacaatctgacgaaggaaagatgttaaatcctgtgatccagggacatttaacccgcctgggtttagaacaaagtcaatcgcgctacaattccctgggctttggagacccagcatggcgtat

SEQ ID NO: 379139 - DNA, 140 bp, Artificial Sequence
  Synthetic
aggccctggctgctgatatgttaaatgtccctggatcacaggatttaacatctttccttcgtcagattgtcagaaggagtatcacactttcggcaaggaacaagttaatcaacacgttatgaccttttgggacagcggtg

SEQ ID NO: 379140 - DNA, 140 bp, Artificial Sequence
  Synthetic
caccgctgtcccaaaaggtcataacgtgttgattaacttgttccttgccgaaagtgtgatactccttctgacaatctgacgaaggaaagatgttaaatcctgtgatccagggacatttaacatatcagcagccagggcct

SEQ ID NO: 379141 - DNA, 140 bp, Artificial Sequence
  Synthetic
atacgccatgctgggtctcccagaaggagtatcacactttcggcaaggaacaagttaatcaacacgttatttcacgcttctgcagatcttgaagacgaattagtatgtaaatggttacttcgtacttgggagtcggccat

SEQ ID NO: 379142 - DNA, 140 bp, Artificial Sequence
  Synthetic
atggccgactcccaagtacgaagtaaccatttacatactaattcgtcttcaagatctgcagaagcgtgaaataacgtgttgattaacttgttccttgccgaaagtgtgatactccttctgggagacccagcatggcgtat

SEQ ID NO: 379143 - DNA, 140 bp, Artificial Sequence
  Synthetic
atacgccatgctgggtctccaccaagcgggaaaagattacaaatcttgggatacctcgagggaaccagaactttattagcatctaaaatgataagcaataatgcagagacaccaatcttgcgtacttgggagtcggccat

SEQ ID NO: 379144 - DNA, 140 bp, Artificial Sequence
  Synthetic
atggccgactcccaagtacgcaagattggtgtctctgcattattgcttatcattttagatgctaataaagttctggttccctcgaggtatcccaagatttgtaatcttttcccgcttggtggagacccagcatggcgtat

SEQ ID NO: 379145 - DNA, 140 bp, Artificial Sequence
  Synthetic
atacgccatgctgggtctcccctagaccattgtgacccagctttaatggaagcaattcaaccaattaagtgtactgttgatattgctcaaattcttagagaatactcctgggctcatattcgtacttgggagtcggccat

SEQ ID NO: 379146 - DNA, 140 bp, Artificial Sequence
  Synthetic
atggccgactcccaagtacgaatatgagcccaggagtattctctaagaatttgagcaatatcaacagtacacttaattggttgaattgcttccattaaagctgggtcacaatggtctaggggagacccagcatggcgtat

SEQ ID NO: 379147 - DNA, 140 bp, Artificial Sequence
  Synthetic
aggccctggctgctgatatgccacaaacaatactagtccatatgtatcagttgcattaaaaaggaacgtggttagtgcttggcctgatgcatctagattggggtggacgattggtgatgggaccttttgggacagcggtg

SEQ ID NO: 379148 - DNA, 140 bp, Artificial Sequence
  Synthetic
caccgctgtcccaaaaggtcccatcaccaatcgtccaccccaatctagatgcatcaggccaagcactaaccacgttcctttttaatgcaactgatacatatggactagtattgtttgtggcatatcagcagccagggcct

SEQ ID NO: 379149 - DNA, 140 bp, Artificial Sequence
  Synthetic
atacgccatgctgggtctccttaagccgaggtgcccatcagctgcattaagagaagctattgaattgacctctaggttgacctgggtcactcaaggtagtgcaaacagcgatcagttaatcgtacttgggagtcggccat

SEQ ID NO: 379150 - DNA, 140 bp, Artificial Sequence
  Synthetic
atggccgactcccaagtacgattaactgatcgctgtttgcactaccttgagtgacccaggtcaacctagaggtcaattcaatagcttctcttaatgcagctgatgggcacctcggcttaaggagacccagcatggcgtat

SEQ ID NO: 379151 - DNA, 140 bp, Artificial Sequence
  Synthetic
aggccctggctgctgatatgtctaggttgacctgggtcactcaaggtagtgcaaacagcgatcagttaattcgcccttttcttgaggcaagagtaaacttgagtgtacaagagattcttcgaccttttgggacagcggtg

SEQ ID NO: 379152 - DNA, 140 bp, Artificial Sequence
  Synthetic
caccgctgtcccaaaaggtcgaagaatctcttgtacactcaagtttactcttgcctcaagaaaagggcgaattaactgatcgctgtttgcactaccttgagtgacccaggtcaacctagacatatcagcagccagggcct

SEQ ID NO: 379153 - DNA, 140 bp, Artificial Sequence
  Synthetic
atacgccatgctgggtctcccagtatagccctcactcctttatggctaaccgcatgagtaacacagcaacgcgcttgatggtatctaccaacacactaggagagttttccggagggggtccgtacttgggagtcggccat

SEQ ID NO: 379154 - DNA, 140 bp, Artificial Sequence
  Synthetic
atggccgactcccaagtacggaccccctccggaaaactctcctagtgtgttggtagataccatcaagcgcgttgctgtgttactcatgcggttagccataaaggagtgagggctatactgggagacccagcatggcgtat

SEQ ID NO: 379155 - DNA, 140 bp, Artificial Sequence
  Synthetic
aggccctggctgctgatatggcgcttgatggtatctaccaacacactaggagagttttccggagggggtcaggctgcacgtgatagcaacattatatttcaaaatgtgattaactttgcagaccttttgggacagcggtg

SEQ ID NO: 379156 - DNA, 140 bp, Artificial Sequence
  Synthetic
caccgctgtcccaaaaggtctgcaaagttaatcacattttgaaatataatgttgctatcacgtgcagcctgaccccctccggaaaactctcctagtgtgttggtagataccatcaagcgccatatcagcagccagggcct

SEQ ID NO: 379157 - DNA, 140 bp, Artificial Sequence
  Synthetic
atacgccatgctgggtctccatatcacagggcccatattcacctgacgaattgttgtacgagggaagtaccggcccaatacttaacatacacaaccacgctaaatctagatttgagtaagcgtacttgggagtcggccat

SEQ ID NO: 379158 - DNA, 140 bp, Artificial Sequence
  Synthetic
atggccgactcccaagtacgcttactcaaatctagatttagcgtggttgtgtatgttaagtattgggccggtacttccctcgtacaacaattcgtcaggtgaatatgggccctgtgatatggagacccagcatggcgtat

SEQ ID NO: 379159 - DNA, 140 bp, Artificial Sequence
  Synthetic
aggccctggctgctgatatgcggcccaatacttaacatacacaaccacgctaaatctagatttgagtaagtaccgtaataatgaactgatttatgattcagagccactaagaggaggtctgaccttttgggacagcggtg

SEQ ID NO: 379160 - DNA, 140 bp, Artificial Sequence
  Synthetic
caccgctgtcccaaaaggtcagacctcctcttagtggctctgaatcataaatcagttcattattacggtacttactcaaatctagatttagcgtggttgtgtatgttaagtattgggccgcatatcagcagccagggcct

SEQ ID NO: 379161 - DNA, 140 bp, Artificial Sequence
  Synthetic
atacgccatgctgggtctccatattattgaggatgacttaatacggttgccacatttatccggctgggaattagcaaaaacagtcttgcaatcaataatctctgatagtagcaattcatccgtacttgggagtcggccat

SEQ ID NO: 379162 - DNA, 140 bp, Artificial Sequence
  Synthetic
atggccgactcccaagtacggatgaattgctactatcagagattattgattgcaagactgtttttgctaattcccagccggataaatgtggcaaccgtattaagtcatcctcaataatatggagacccagcatggcgtat

SEQ ID NO: 379163 - DNA, 140 bp, Artificial Sequence
  Synthetic
aggccctggctgctgatatgttagcaaaaacagtcttgcaatcaataatctctgatagtagcaattcatcaacagatcccattagcagcggtgaaacaagatccttcacaacccacttctgaccttttgggacagcggtg

SEQ ID NO: 379164 - DNA, 140 bp, Artificial Sequence
  Synthetic
caccgctgtcccaaaaggtcagaagtgggttgtgaaggatcttgtttcaccgctgctaatgggatctgttgatgaattgctactatcagagattattgattgcaagactgtttttgctaacatatcagcagccagggcct

SEQ ID NO: 379165 - DNA, 140 bp, Artificial Sequence
  Synthetic
atacgccatgctgggtctccttttatttgggtaatactattctgtgcacgaaaaagatcggactcacagaatttctatactatctccagaatcagatccacaacttatcacatagatccccgtacttgggagtcggccat

SEQ ID NO: 379166 - DNA, 140 bp, Artificial Sequence
  Synthetic
atggccgactcccaagtacggggatctatgtgataagttgtggatctgattctggagatagtatagaaattctgtgagtccgatctttttcgtgcacagaatagtattacccaaataaaaggagacccagcatggcgtat

SEQ ID NO: 379167 - DNA, 140 bp, Artificial Sequence
  Synthetic
atacgccatgctgggtctccttcgaatcttcaaaccgacatttagacactcaagtgtcatgtccaggttgatggatatagaccccaacttctcaatatatattggtgggactgcaggtgacgtacttgggagtcggccat

SEQ ID NO: 379168 - DNA, 140 bp, Artificial Sequence
  Synthetic
atggccgactcccaagtacgtcacctgcagtcccaccaatatatattgagaagttggggtctatatccatcaacctggacatgacacttgagtgtctaaatgtcggtttgaagattcgaaggagacccagcatggcgtat

SEQ ID NO: 379169 - DNA, 140 bp, Artificial Sequence
  Synthetic
atacgccatgctgggtctccctttcttgagctttgttgaggagtgggttatctttaggaaggcaaacatcccactatgggttatctatcctctcgaaggccaacgccctgatcctcctggcgtacttgggagtcggccat

SEQ ID NO: 379170 - DNA, 140 bp, Artificial Sequence
  Synthetic
atggccgactcccaagtacgccaggaggatcagggcgttggccttcgagaggatagataacccatagtgggatgtttgccttcctaaagataacccactcctcaacaaagctcaagaaagggagacccagcatggcgtat

SEQ ID NO: 379171 - DNA, 140 bp, Artificial Sequence
  Synthetic
atacgccatgctgggtctccaaaataaaggctctatactttcaagatctggagagaaatgctcttcaaatctagtttataattgcaagagtacagcaagcaattttttccatgcatcattcgtacttgggagtcggccat

SEQ ID NO: 379172 - DNA, 140 bp, Artificial Sequence
  Synthetic
atggccgactcccaagtacgaatgatgcatggaaaaaattgcttgctgtactcttgcaattataaactagatttgaagagcatttctctccagatcttgaaagtatagagcctttattttggagacccagcatggcgtat

SEQ ID NO: 379173 - DNA, 140 bp, Artificial Sequence
  Synthetic
aggccctggctgctgatatgctagtttataattgcaagagtacagcaagcaattttttccatgcatcattggcttattggagaggtcgacacagacctaagaagactataggtgcaaccagaccttttgggacagcggtg

SEQ ID NO: 379174 - DNA, 140 bp, Artificial Sequence
  Synthetic
caccgctgtcccaaaaggtctggttgcacctatagtcttcttaggtctgtgtcgacctctccaataagccaatgatgcatggaaaaaattgcttgctgtactcttgcaattataaactagcatatcagcagccagggcct

SEQ ID NO: 379175 - DNA, 140 bp, Artificial Sequence
  Synthetic
atacgccatgctgggtctccccgcctggcctagaccttaataggaacgatgatactttcattcctaccagaattaaacagatagtccaaggagactctagaaacgacagaacgaccaccacgtacttgggagtcggccat

SEQ ID NO: 379176 - DNA, 140 bp, Artificial Sequence
  Synthetic
atggccgactcccaagtacgtggtggtcgttctgtcgtttctagagtctccttggactatctgtttaattctggtaggaatgaaagtatcatcgttcctattaaggtctaggccaggcggggagacccagcatggcgtat

SEQ ID NO: 379177 - DNA, 140 bp, Artificial Sequence
  Synthetic
aggccctggctgctgatatgaattaaacagatagtccaaggagactctagaaacgacagaacgaccaccacgagatttccacccaaaagtaggtccactccaacatcagcaaccgagcctgaccttttgggacagcggtg

SEQ ID NO: 379178 - DNA, 140 bp, Artificial Sequence
  Synthetic
caccgctgtcccaaaaggtcaggctcggttgctgatgttggagtggacctacttttgggtggaaatctcgtggtggtcgttctgtcgtttctagagtctccttggactatctgtttaattcatatcagcagccagggcct

SEQ ID NO: 379179 - DNA, 140 bp, Artificial Sequence
  Synthetic
atacgccatgctgggtctcctacacatttggatgaggatcacaatgccaaagagttcccatccaatccgcatcgtttagtagtaccattctttaaattaacaaaagatggggaatacagtcgtacttgggagtcggccat

SEQ ID NO: 379180 - DNA, 140 bp, Artificial Sequence
  Synthetic
atggccgactcccaagtacgactgtattccccatcttttgttaatttaaagaatggtactactaaacgatgcggattggatgggaactctttggcattgtgatcctcatccaaatgtgtaggagacccagcatggcgtat

SEQ ID NO: 379181 - DNA, 140 bp, Artificial Sequence
  Synthetic
atacgccatgctgggtctccacatttaagaaccatggttgatactaccatatattgtcgcttcactggaattgtttcatcaatgcattataagttagatgaagtactatgggaatataatcgtacttgggagtcggccat

SEQ ID NO: 379182 - DNA, 140 bp, Artificial Sequence
  Synthetic
atggccgactcccaagtacgattatattcccatagtacttcatctaacttataatgcattgatgaaacaattccagtgaagcgacaatatatggtagtatcaaccatggttcttaaatgtggagacccagcatggcgtat

SEQ ID NO: 379183 - DNA, 140 bp, Artificial Sequence
  Synthetic
atacgccatgctgggtctccagtatatacgattatttgtaatcatatcaatcctaaaactttgaaagtggtcatcttaaaagtcttcctcagcgatttggatgggatgtgctggattaaccgtacttgggagtcggccat

SEQ ID NO: 379184 - DNA, 140 bp, Artificial Sequence
  Synthetic
atggccgactcccaagtacggttaatccagcacatcccatccaaatcgctgaggaagacttttaagatgaccactttcaaagttttaggattgatatgattacaaataatcgtatatactggagacccagcatggcgtat

SEQ ID NO: 379185 - DNA, 140 bp, Artificial Sequence
  Synthetic
atacgccatgctgggtctccaattatcttgctcctatgtttggatcaggatatttaatcaaacctataacatcaagtgcaaagtcaagtgagtggtatttatgcttatctaatctactttcgtacttgggagtcggccat

SEQ ID NO: 379186 - DNA, 140 bp, Artificial Sequence
  Synthetic
atggccgactcccaagtacgaaagtagattagataagcataaataccactcacttgactttgcacttgatgttataggtttgattaaatatcctgatccaaacataggagcaagataattggagacccagcatggcgtat

SEQ ID NO: 379187 - DNA, 140 bp, Artificial Sequence
  Synthetic
atacgccatgctgggtctccgtgtttgccatcgatttaatcatacacgtaactgtacatgcagtgaaaggttcctggttcaaactttatatctacaccgaatgagtgatgctgagataaacgtacttgggagtcggccat

SEQ ID NO: 379188 - DNA, 140 bp, Artificial Sequence
  Synthetic
atggccgactcccaagtacgtttatctcagcatcactcattcggtgtagatataaagtttgaaccaggaacctttcactgcatgtacagttacgtgtatgattaaatcgatggcaaacacggagacccagcatggcgtat

SEQ ID NO: 379189 - DNA, 140 bp, Artificial Sequence
  Synthetic
atacgccatgctgggtctccggtctagttcagtctaattctaactgcaccaaaggctctagaaatattttaaataaccaggtgtatatcaaagtcaatacaagtgtaaaaacaatatgcacgtacttgggagtcggccat

SEQ ID NO: 379190 - DNA, 140 bp, Artificial Sequence
  Synthetic
atggccgactcccaagtacgtgcatattgtttttacacttgtattgactttgatatacacctggttatttaaaatatttctagagcctttggtgcagttagaattagactgaactagaccggagacccagcatggcgtat

SEQ ID NO: 379191 - DNA, 140 bp, Artificial Sequence
  Synthetic
aggccctggctgctgatatgaaataaccaggtgtatatcaaagtcaatacaagtgtaaaaacaatatgcaagggaccacatttaggatcagtttattgactcttccaatacacagagttggaccttttgggacagcggtg

SEQ ID NO: 379192 - DNA, 140 bp, Artificial Sequence
  Synthetic
caccgctgtcccaaaaggtccaactctgtgtattggaagagtcaataaactgatcctaaatgtggtcccttgcatattgtttttacacttgtattgactttgatatacacctggttatttcatatcagcagccagggcct

SEQ ID NO: 379193 - DNA, 140 bp, Artificial Sequence
  Synthetic
atacgccatgctgggtctccgtaaataatagcttttcctgtctattatgacttaaataaacatatctataacgaccatcacagctaagtcgttgccctagttcatatattaaattaaaatcgtacttgggagtcggccat

SEQ ID NO: 379194 - DNA, 140 bp, Artificial Sequence
  Synthetic
atggccgactcccaagtacgattttaatttaatatatgaactagggcaacgacttagctgtgatggtcgttatagatatgtttatttaagtcataatagacaggaaaagctattatttacggagacccagcatggcgtat

SEQ ID NO: 379195 - DNA, 140 bp, Artificial Sequence
  Synthetic
aggccctggctgctgatatgacgaccatcacagctaagtcgttgccctagttcatatattaaattaaaatttagaagctaggttaactctaattacataagtattaagaaaaaattactagaccttttgggacagcggtg

SEQ ID NO: 379196 - DNA, 140 bp, Artificial Sequence
  Synthetic
caccgctgtcccaaaaggtctagtaattttttcttaatacttatgtaattagagttaacctagcttctaaattttaatttaatatatgaactagggcaacgacttagctgtgatggtcgtcatatcagcagccagggcct

SEQ ID NO: 379197 - DNA, 140 bp, Artificial Sequence
  Synthetic
atacgccatgctgggtctccttagaagctaggttaactctaattacataagtattaagaaaaaattactaagactaatactctcatgccaagaactagtaatgtgtttcacatgacagatcgtacttgggagtcggccat

SEQ ID NO: 379198 - DNA, 140 bp, Artificial Sequence
  Synthetic
atggccgactcccaagtacgatctgtcatgtgaaacacattactagttcttggcatgagagtattagtcttagtaattttttcttaatacttatgtaattagagttaacctagcttctaaggagacccagcatggcgtat

SEQ ID NO: 379199 - DNA, 140 bp, Artificial Sequence
  Synthetic
atacgccatgctgggtctcctatacagccaaaatatttcatagggccgatgggaataacataagaggaacatgatcaatgaaccctttattccaactaggcagttgattgataatctacacgtacttgggagtcggccat

SEQ ID NO: 379200 - DNA, 140 bp, Artificial Sequence
  Synthetic
atggccgactcccaagtacgtgtagattatcaatcaactgcctagttggaataaagggttcattgatcatgttcctcttatgttattcccatcggccctatgaaatattttggctgtataggagacccagcatggcgtat

SEQ ID NO: 379201 - DNA, 140 bp, Artificial Sequence
  Synthetic
atacgccatgctgggtctccaatgatttaataagtaataataaaaaaatcacattaaagatgcaggaagatcttgacctcgccaggaaaattaagcgcacacaaataaattaaaaaatctcgtacttgggagtcggccat

SEQ ID NO: 379202 - DNA, 140 bp, Artificial Sequence
  Synthetic
atggccgactcccaagtacgagattttttaatttatttgtgtgcgcttaattttcctggcgaggtcaagatcttcctgcatctttaatgtgatttttttattattacttattaaatcattggagacccagcatggcgtat

SEQ ID NO: 379203 - DNA, 140 bp, Artificial Sequence
  Synthetic
atacgccatgctgggtctccaccaccagacagggggcagagcaaggagagagcggctcggacacatggcctccaagatccgaccttggacggagcgaaaaaggtgccggagttgaccccacgtacttgggagtcggccat

SEQ ID NO: 379204 - DNA, 140 bp, Artificial Sequence
  Synthetic
atggccgactcccaagtacgtggggtcaactccggcacctttttcgctccgtccaaggtcggatcttggaggccatgtgtccgagccgctctctccttgctctgccccctgtctggtggtggagacccagcatggcgtat

SEQ ID NO: 379205 - DNA, 140 bp, Artificial Sequence
  Synthetic
atacgccatgctgggtctcctcgaggagatatacccaaagcctgtcagaaaagcctccggccggtcccaccgtcaccaaagatcgatagaggttgggtctgtatttttcaattccaagaccgtacttgggagtcggccat

SEQ ID NO: 379206 - DNA, 140 bp, Artificial Sequence
  Synthetic
atggccgactcccaagtacggtcttggaattgaaaaatacagacccaacctctatcgatctttggtgacggtgggaccggccggaggcttttctgacaggctttgggtatatctcctcgaggagacccagcatggcgtat

SEQ ID NO: 379207 - DNA, 140 bp, Artificial Sequence
  Synthetic
atacgccatgctgggtctcctagtctatcatgtcataagcttataagtcagtttttaatttcccctctatcctaatcaattgataatgctgtcaatagggaaattcccctgtattgtaatcgtacttgggagtcggccat

SEQ ID NO: 379208 - DNA, 140 bp, Artificial Sequence
  Synthetic
atggccgactcccaagtacgattacaatacaggggaatttccctattgacagcattatcaattgattaggatagaggggaaattaaaaactgacttataagcttatgacatgatagactaggagacccagcatggcgtat

SEQ ID NO: 379209 - DNA, 140 bp, Artificial Sequence
  Synthetic
atacgccatgctgggtctcccacagcctctccctgctgcaacatggacagatgagactccgagcaacctttcaggagcacttcgtcccgggctttcatttcacccaaagctgagacccgtcgtacttgggagtcggccat

SEQ ID NO: 379210 - DNA, 140 bp, Artificial Sequence
  Synthetic
atggccgactcccaagtacgacgggtctcagctttgggtgaaatgaaagcccgggacgaagtgctcctgaaaggttgctcggagtctcatctgtccatgttgcagcagggagaggctgtgggagacccagcatggcgtat

SEQ ID NO: 379211 - DNA, 140 bp, Artificial Sequence
  Synthetic
atacgccatgctgggtctccttaaaatgtactaatcgggtcaaggaactctcactgatcaagcctgaatccaagatagaaccagcccaaagggcctccccagagtctctcacaagcttagcgtacttgggagtcggccat

SEQ ID NO: 379212 - DNA, 140 bp, Artificial Sequence
  Synthetic
atggccgactcccaagtacgctaagcttgtgagagactctggggaggccctttgggctggttctatcttggattcaggcttgatcagtgagagttccttgacccgattagtacattttaaggagacccagcatggcgtat

SEQ ID NO: 379213 - DNA, 140 bp, Artificial Sequence
  Synthetic
aggccctggctgctgatatgcaagatagaaccagcccaaagggcctccccagagtctctcacaagcttagccaatcaattaacatgcataagcgatccatacttcgcccaattagtatccgaccttttgggacagcggtg

SEQ ID NO: 379214 - DNA, 140 bp, Artificial Sequence
  Synthetic
caccgctgtcccaaaaggtcggatactaattgggcgaagtatggatcgcttatgcatgttaattgattggctaagcttgtgagagactctggggaggccctttgggctggttctatcttgcatatcagcagccagggcct

SEQ ID NO: 379215 - DNA, 140 bp, Artificial Sequence
  Synthetic
aggccctggctgctgatatgaaattgacaataatacttttgttcgtctggacaggccccacacgcctcagttccttttccagctgaatgataccattcaccttcaccaacagttgagcaagaccttttgggacagcggtg

SEQ ID NO: 379216 - DNA, 140 bp, Artificial Sequence
  Synthetic
caccgctgtcccaaaaggtcttgctcaactgttggtgaaggtgaatggtatcattcagctggaaaaggaactgaggcgtgtggggcctgtccagacgaacaaaagtattattgtcaatttcatatcagcagccagggcct

SEQ ID NO: 379217 - DNA, 140 bp, Artificial Sequence
  Synthetic
atacgccatgctgggtctcccaccaggaagtattcggacctggttccaaagaattcccctgggatggttccattgcacataccagaaggggaaacaacattgccgtctcagaattcgacacgtacttgggagtcggccat

SEQ ID NO: 379218 - DNA, 140 bp, Artificial Sequence
  Synthetic
atggccgactcccaagtacgtgtcgaattctgagacggcaatgttgtttccccttctggtatgtgcaatggaaccatcccaggggaattctttggaaccaggtccgaatacttcctggtgggagacccagcatggcgtat

SEQ ID NO: 379219 - DNA, 140 bp, Artificial Sequence
  Synthetic
atacgccatgctgggtctccgatggccaccgaggaaccaacaacaccaccgggaagctcccctggctcaacaacagaagcgcccactctcaccaccccagaaaatataacaacagcggttcgtacttgggagtcggccat

SEQ ID NO: 379220 - DNA, 140 bp, Artificial Sequence
  Synthetic
atggccgactcccaagtacgaaccgctgttgttatattttctggggtggtgagagtgggcgcttctgttgttgagccaggggagcttcccggtggtgttgttggttcctcggtggccatcggagacccagcatggcgtat

SEQ ID NO: 379221 - DNA, 140 bp, Artificial Sequence
  Synthetic
aggccctggctgctgatatgatgtcgttaattacaagggacttctaagcagtgttgagataggaacaccaagctatgcaatcatcattaccaggactaatatgggttatcttgtcgaggtgaccttttgggacagcggtg

SEQ ID NO: 379222 - DNA, 140 bp, Artificial Sequence
  Synthetic
caccgctgtcccaaaaggtcacctcgacaagataacccatattagtcctggtaatgatgattgcatagcttggtgttcctatctcaacactgcttagaagtcccttgtaattaacgacatcatatcagcagccagggcct

SEQ ID NO: 379223 - DNA, 140 bp, Artificial Sequence
  Synthetic
atacgccatgctgggtctcctcaggaaccagataaatctgcgatggatatacgacaccctggtcctgtcaaattctccctactacatgaatcgacacttaaacctgttgccactcctaaacgtacttgggagtcggccat

SEQ ID NO: 379224 - DNA, 140 bp, Artificial Sequence
  Synthetic
atggccgactcccaagtacgtttaggagtggcaacaggtttaagtgtcgattcatgtagtagggagaatttgacaggaccagggtgtcgtatatccatcgcagatttatctggttcctgaggagacccagcatggcgtat

SEQ ID NO: 379225 - DNA, 140 bp, Artificial Sequence
  Synthetic
aggccctggctgctgatatgtccatcgtaggacagaatcattttcctgtatgatcttagtttaatctctctttatacaatgattaataaggagcttgtttaaaatgttacaaaagtatacgaccttttgggacagcggtg

SEQ ID NO: 379226 - DNA, 140 bp, Artificial Sequence
  Synthetic
caccgctgtcccaaaaggtcgtatacttttgtaacattttaaacaagctccttattaatcattgtataaagagagattaaactaagatcatacaggaaaatgattctgtcctacgatggacatatcagcagccagggcct

SEQ ID NO: 379227 - DNA, 140 bp, Artificial Sequence
  Synthetic
atacgccatgctgggtctcctgtgacctagtgacaagagcatgtggactctactctgagtattcgctgaaccctaaactaaggacatgccgtttaccgaaacatatctatagattaaaatcgtacttgggagtcggccat

SEQ ID NO: 379228 - DNA, 140 bp, Artificial Sequence
  Synthetic
atggccgactcccaagtacgattttaatctatagatatgtttcggtaaacggcatgtccttagtttagggttcagcgaatactcagagtagagtccacatgctcttgtcactaggtcacaggagacccagcatggcgtat

SEQ ID NO: 379229 - DNA, 140 bp, Artificial Sequence
  Synthetic
aggccctggctgctgatatgaatgtccaaaccctctgcgaagcattacttgcagatggtttggctaaagcctttccaagcaatatgatggttgtcacagagagggaacaaaaggagagccgaccttttgggacagcggtg

SEQ ID NO: 379230 - DNA, 140 bp, Artificial Sequence
  Synthetic
caccgctgtcccaaaaggtcggctctccttttgttccctctctgtgacaaccatcatattgcttggaaaggctttagccaaaccatctgcaagtaatgcttcgcagagggtttggacattcatatcagcagccagggcct

SEQ ID NO: 379231 - DNA, 140 bp, Artificial Sequence
  Synthetic
atacgccatgctgggtctccatggcccctctctcagatgcaatttttgatgacttgcaaggtacacttgccagtataggaactgcctttgagcgatcaatctccgaaactagacatatttcgtacttgggagtcggccat

SEQ ID NO: 379232 - DNA, 140 bp, Artificial Sequence
  Synthetic
atggccgactcccaagtacgaaatatgtctagtttcggagattgatcgctcaaaggcagttcctatactggcaagtgtaccttgcaagtcatcaaaaattgcatctgagagaggggccatggagacccagcatggcgtat

SEQ ID NO: 379233 - DNA, 140 bp, Artificial Sequence
  Synthetic
atacgccatgctgggtctccactactgatccaaaaatacggcgttaagaagttatttttgaatacacttgctactgaacatagtattgagagtgaagtgatatcaggttacaccactccacgtacttgggagtcggccat

SEQ ID NO: 379234 - DNA, 140 bp, Artificial Sequence
  Synthetic
atggccgactcccaagtacgtggagtggtgtaacctgatatcacttcactctcaatactatgttcagtagcaagtgtattcaaaaataacttcttaacgccgtatttttggatcagtagtggagacccagcatggcgtat

SEQ ID NO: 379235 - DNA, 140 bp, Artificial Sequence
  Synthetic
atacgccatgctgggtctcccatattaaataactcagctagtcaaataactgatattacacaccgagattggttttcaaatcaaaaaaataggattccaaatgatgctgatattattacccgtacttgggagtcggccat

SEQ ID NO: 379236 - DNA, 140 bp, Artificial Sequence
  Synthetic
atggccgactcccaagtacgggtaataatatcagcatcatttggaatcctatttttttgatttgaaaaccaatctcggtgtgtaatatcagttatttgactagctgagttatttaatatgggagacccagcatggcgtat

SEQ ID NO: 379237 - DNA, 140 bp, Artificial Sequence
  Synthetic
atacgccatgctgggtctcccaaccttgagaactactcagcatcaaacccaggcaaactgtctccatgtcgtacaatgtgctcttcaacagcaagtacaaagagggtcatattggctaagcgtacttgggagtcggccat

SEQ ID NO: 379238 - DNA, 140 bp, Artificial Sequence
  Synthetic
atggccgactcccaagtacgcttagccaatatgaccctctttgtacttgctgttgaagagcacattgtacgacatggagacagtttgcctgggtttgatgctgagtagttctcaaggttgggagacccagcatggcgtat

SEQ ID NO: 379239 - DNA, 140 bp, Artificial Sequence
  Synthetic
atacgccatgctgggtctccagggactacatttaggatcagtttattgactcttccaatatacagagttggaagcaccgattcaaggtttctaagacgctctatcgattatgttgataatcgtacttgggagtcggccat

SEQ ID NO: 379240 - DNA, 140 bp, Artificial Sequence
  Synthetic
atggccgactcccaagtacgattatcaacataatcgatagagcgtcttagaaaccttgaatcggtgcttccaactctgtatattggaagagtcaataaactgatcctaaatgtagtccctggagacccagcatggcgtat

SEQ ID NO: 379241 - DNA, 140 bp, Artificial Sequence
  Synthetic
atacgccatgctgggtctccccccatttgggggcattcctaaagtgttgcaaaggtatgtgggtcgtattgctttgccttttcctaacctggctcctcctacaattctaacctgcttgatcgtacttgggagtcggccat

SEQ ID NO: 379242 - DNA, 140 bp, Artificial Sequence
  Synthetic
atggccgactcccaagtacgatcaagcaggttagaattgtaggaggagccaggttaggaaaaggcaaagcaatacgacccacatacctttgcaacactttaggaatgcccccaaatggggggagacccagcatggcgtat

SEQ ID NO: 379243 - DNA, 140 bp, Artificial Sequence
  Synthetic
aggccctggctgctgatatggctttgccttttcctaacctggctcctcctacaattctaacctgcttgataagtgtgattacctgagtaatagactaatttcgtcctggtaattagcattgaccttttgggacagcggtg

SEQ ID NO: 379244 - DNA, 140 bp, Artificial Sequence
  Synthetic
caccgctgtcccaaaaggtcaatgctaattaccaggacgaaattagtctattactcaggtaatcacacttatcaagcaggttagaattgtaggaggagccaggttaggaaaaggcaaagccatatcagcagccagggcct

SEQ ID NO: 379245 - DNA, 140 bp, Artificial Sequence
  Synthetic
atacgccatgctgggtctccgctggtgttaatgtaggggagcaatatcagcaactgcgtgaggctgctactgaagctgaaaagcaactccaacaatatgctgaaacacgtgagttggacacgtacttgggagtcggccat

SEQ ID NO: 379246 - DNA, 140 bp, Artificial Sequence
  Synthetic
atggccgactcccaagtacgtgtccaactcacgtgtttcagcatattgttggagttgcttttcagcttcagtagcagcctcacgcagttgctgatattgctcccctacattaacaccagcggagacccagcatggcgtat

SEQ ID NO: 379247 - DNA, 140 bp, Artificial Sequence
  Synthetic
aggccctggctgctgatatggaaaaaattcatgatgaagattaaaaccttcatcatcctttaaaaagagagctattctttatctgaatgtccttattaatgtctaagagctattattttggaccttttgggacagcggtg

SEQ ID NO: 379248 - DNA, 140 bp, Artificial Sequence
  Synthetic
caccgctgtcccaaaaggtccaaaataatagctcttagacattaataaggacattcagataaagaatagctctctttttaaaggatgatgaaggttttaatcttcatcatgaattttttccatatcagcagccagggcct

SEQ ID NO: 379249 - DNA, 140 bp, Artificial Sequence
  Synthetic
atacgccatgctgggtctcccctaatcaattgataatgctgtcaatagggaaattcccctgtattgtaataagacctcattaacatatttcccctgcttagtactatgcagaaacccccgcgtacttgggagtcggccat

SEQ ID NO: 379250 - DNA, 140 bp, Artificial Sequence
  Synthetic
atggccgactcccaagtacgcgggggtttctgcatagtactaagcaggggaaatatgttaatgaggtcttattacaatacaggggaatttccctattgacagcattatcaattgattaggggagacccagcatggcgtat

SEQ ID NO: 379251 - DNA, 140 bp, Artificial Sequence
  Synthetic
atacgccatgctgggtctccccaatcaattaacatgcataagcgatccatacttcgcccaatcagtgtccgatgttcaccccttcaagcctccttcctagcaaattgacctagctgtacccgtacttgggagtcggccat

SEQ ID NO: 379252 - DNA, 140 bp, Artificial Sequence
  Synthetic
atggccgactcccaagtacgggtacagctaggtcaatttgctaggaaggaggcttgaaggggtgaacatcggacactgattgggcgaagtatggatcgcttatgcatgttaattgattggggagacccagcatggcgtat

SEQ ID NO: 379253 - DNA, 140 bp, Artificial Sequence
  Synthetic
atacgccatgctgggtctcccatgggcgatgacccggaacctcttcccacacttgttcaaaaaccaacagtctgaagtccaaactcccatttgggccttgagggtaattcttgccgccggcgtacttgggagtcggccat

SEQ ID NO: 379254 - DNA, 140 bp, Artificial Sequence
  Synthetic
atggccgactcccaagtacgccggcggcaagaattaccctcaaggcccaaatgggagtttggacttcagactgttggtttttgaacaagtgtgggaagaggttccgggtcatcgcccatgggagacccagcatggcgtat

SEQ ID NO: 379255 - DNA, 140 bp, Artificial Sequence
  Synthetic
atacgccatgctgggtctccttaattgccgtaataaaaattgtacgatagggctaacattgattccataatccatcgtaggacagaatcattttcctgtatgatcttagtttaatctctccgtacttgggagtcggccat

SEQ ID NO: 379256 - DNA, 140 bp, Artificial Sequence
  Synthetic
atggccgactcccaagtacggagagattaaactaagatcatacaggaaaatgattctgtcctacgatggattatggaatcaatgttagccctatcgtacaatttttattacggcaattaaggagacccagcatggcgtat

SEQ ID NO: 379257 - DNA, 140 bp, Artificial Sequence
  Synthetic
aggccctggctgctgatatgatacacaatatcctgatgcaagattgtcttccccaattgtcttagaccaatgtgacctagtgacaagagcatgtggactttactctgagtattcgctgaagaccttttgggacagcggtg

SEQ ID NO: 379258 - DNA, 140 bp, Artificial Sequence
  Synthetic
caccgctgtcccaaaaggtcttcagcgaatactcagagtaaagtccacatgctcttgtcactaggtcacattggtctaagacaattggggaagacaatcttgcatcaggatattgtgtatcatatcagcagccagggcct

SEQ ID NO: 379259 - DNA, 140 bp, Artificial Sequence
  Synthetic
atacgccatgctgggtctccgcttggctgagggagactccccccaatgtgccttaatccagataacaaaacggatccctactttccaagatgcctctcctccaatcgtgcatataaagtccgtacttgggagtcggccat

SEQ ID NO: 379260 - DNA, 140 bp, Artificial Sequence
  Synthetic
atggccgactcccaagtacggactttatatgcacgattggaggagaggcatcttggaaagtagggatccgttttgttatctggattaaggcacattggggggagtctccctcagccaagcggagacccagcatggcgtat

SEQ ID NO: 379261 - DNA, 140 bp, Artificial Sequence
  Synthetic
aggccctggctgctgatatgcttttaggaagctagcagtacatatactatgggacaactcaaccctcttgttaaaatgtactaatcggttcaaggaactctcactgatcaagcctgaatcgaccttttgggacagcggtg

SEQ ID NO: 379262 - DNA, 140 bp, Artificial Sequence
  Synthetic
caccgctgtcccaaaaggtcgattcaggcttgatcagtgagagttccttgaaccgattagtacattttaacaagagggttgagttgtcccatagtatatgtactgctagcttcctaaaagcatatcagcagccagggcct

SEQ ID NO: 379263 - DNA, 140 bp, Artificial Sequence
  Synthetic
atacgccatgctgggtctcctgcaacaattataggcactaacggcaatcatatgcagatctccaccatcgggatgagaccgagctccagccaaatcccgagttcctcaccgaccacggcacgtacttgggagtcggccat

SEQ ID NO: 379264 - DNA, 140 bp, Artificial Sequence
  Synthetic
atggccgactcccaagtacgtgccgtggtcggtgaggaactcgggatttggctggagctcggtctcatcccgatggtggagatctgcatatgattgccgttagtgcctataattgttgcaggagacccagcatggcgtat

SEQ ID NO: 379265 - DNA, 140 bp, Artificial Sequence
  Synthetic
aggccctggctgctgatatgctagtttataattgcaagagtacagcaagcaattttttccatgcatcattggcttattggagaggtcgacatagacctaagaagactataggtgcaactagaccttttgggacagcggtg

SEQ ID NO: 379266 - DNA, 140 bp, Artificial Sequence
  Synthetic
caccgctgtcccaaaaggtctagttgcacctatagtcttcttaggtctatgtcgacctctccaataagccaatgatgcatggaaaaaattgcttgctgtactcttgcaattataaactagcatatcagcagccagggcct

SEQ ID NO: 379267 - DNA, 140 bp, Artificial Sequence
  Synthetic
atacgccatgctgggtctccttggttttccttcattagagaaggtcctatatcataggtataaccttgttgattcgagaaacggaccattagtttctataacgagacaccttgccctcctcgtacttgggagtcggccat

SEQ ID NO: 379268 - DNA, 140 bp, Artificial Sequence
  Synthetic
atggccgactcccaagtacgaggagggcaaggtgtctcgttatagaaactaatggtccgtttctcgaatcaacaaggttatacctatgatataggaccttctctaatgaaggaaaaccaaggagacccagcatggcgtat

SEQ ID NO: 379269 - DNA, 140 bp, Artificial Sequence
  Synthetic
atacgccatgctgggtctcccggacacacaaaaagaaagaaggttttttgatctttattgtgtgcgaataactatgaggaagattaataattttcctctcattgacacttacattaagatcgtacttgggagtcggccat

SEQ ID NO: 379270 - DNA, 140 bp, Artificial Sequence
  Synthetic
atggccgactcccaagtacgatcttaatgtaagtgtcaatgagaggaaaattattaatcttcctcatagttattcgcacacaataaagatcaaaaaaccttctttctttttgtgtgtccgggagacccagcatggcgtat

SEQ ID NO: 379271 - DNA, 140 bp, Artificial Sequence
  Synthetic
aggccctggctgctgatatgactatgaggaagattaataattttcctctcattgacacttacattaagattaagattctcattgatctgttacttactctgaggataataattggtgttcgaccttttgggacagcggtg

SEQ ID NO: 379272 - DNA, 140 bp, Artificial Sequence
  Synthetic
caccgctgtcccaaaaggtcgaacaccaattattatcctcagagtaagtaacagatcaatgagaatcttaatcttaatgtaagtgtcaatgagaggaaaattattaatcttcctcatagtcatatcagcagccagggcct

SEQ ID NO: 379273 - DNA, 140 bp, Artificial Sequence
  Synthetic
atacgccatgctgggtctcctaagattctcattgatctgttacttactctgaggataataattggtgttcagaagtaccccattccccagtgggggcaaagacagtccaaaagactcaaccgtacttgggagtcggccat

SEQ ID NO: 379274 - DNA, 140 bp, Artificial Sequence
  Synthetic
atggccgactcccaagtacggttgagtcttttggactgtctttgcccccactggggaatggggtacttctgaacaccaattattatcctcagagtaagtaacagatcaatgagaatcttaggagacccagcatggcgtat

SEQ ID NO: 379275 - DNA, 140 bp, Artificial Sequence
  Synthetic
atacgccatgctgggtctcctacccaggagttggacctaattccaaagcttagagtgggacctagtgtatcctcggggctgtaatataatcagccatttaacacataacaagccctactgcgtacttgggagtcggccat

SEQ ID NO: 379276 - DNA, 140 bp, Artificial Sequence
  Synthetic
atggccgactcccaagtacgcagtagggcttgttatgtgttaaatggctgattatattacagccccgaggatacactaggtcccactctaagctttggaattaggtccaactcctgggtaggagacccagcatggcgtat

SEQ ID NO: 379277 - DNA, 140 bp, Artificial Sequence
  Synthetic
aggccctggctgctgatatgcctcggggctgtaatataatcagccatttaacacataacaagccctactgttttcttgttttgccgtgcatttagaataagagacaacttaaacctccgagaccttttgggacagcggtg

SEQ ID NO: 379278 - DNA, 140 bp, Artificial Sequence
  Synthetic
caccgctgtcccaaaaggtctcggaggtttaagttgtctcttattctaaatgcacggcaaaacaagaaaacagtagggcttgttatgtgttaaatggctgattatattacagccccgaggcatatcagcagccagggcct

SEQ ID NO: 379279 - DNA, 140 bp, Artificial Sequence
  Synthetic
atacgccatgctgggtctcctcatagccccaagatggagagtcgggcccacaaagcatggatgacgcacaccgcatcaggtttcgaaacagattaccataagattttaacagcaggattgcgtacttgggagtcggccat

SEQ ID NO: 379280 - DNA, 140 bp, Artificial Sequence
  Synthetic
atggccgactcccaagtacgcaatcctgctgttaaaatcttatggtaatctgtttcgaaacctgatgcggtgtgcgtcatccatgctttgtgggcccgactctccatcttggggctatgaggagacccagcatggcgtat

SEQ ID NO: 379281 - DNA, 140 bp, Artificial Sequence
  Synthetic
aggccctggctgctgatatgccgcatcaggtttcgaaacagattaccataagattttaacagcaggattgtcagtccaacaaggcattgtgagacaacgggtcattcaagtccaccaggtgaccttttgggacagcggtg

SEQ ID NO: 379282 - DNA, 140 bp, Artificial Sequence
  Synthetic
caccgctgtcccaaaaggtcacctggtggacttgaatgacccgttgtctcacaatgccttgttggactgacaatcctgctgttaaaatcttatggtaatctgtttcgaaacctgatgcggcatatcagcagccagggcct

SEQ ID NO: 379283 - DNA, 140 bp, Artificial Sequence
  Synthetic
atacgccatgctgggtctccgtgttgattttcaagagagtgcagacagtttcttgctgatgctatgtttacatcatgcttatcagggtgactacaagcaattcttggaaagcaatgcagtcgtacttgggagtcggccat

SEQ ID NO: 379284 - DNA, 140 bp, Artificial Sequence
  Synthetic
atggccgactcccaagtacgactgcattgctttccaagaattgcttgtagtcaccctgataagcatgatgtaaacatagcatcagcaagaaactgtctgcactctcttgaaaatcaacacggagacccagcatggcgtat

SEQ ID NO: 379285 - DNA, 140 bp, Artificial Sequence
  Synthetic
aggccctggctgctgatatgcatcatgcttatcagggtgactacaagcaattcttggaaagcaatgcagtcaagtaccttgagggtcatggctttcgctttgaggtcaggaaaaaggaaggaccttttgggacagcggtg

SEQ ID NO: 379286 - DNA, 140 bp, Artificial Sequence
  Synthetic
caccgctgtcccaaaaggtccttcctttttcctgacctcaaagcgaaagccatgaccctcaaggtacttgactgcattgctttccaagaattgcttgtagtcaccctgataagcatgatgcatatcagcagccagggcct

SEQ ID NO: 379287 - DNA, 140 bp, Artificial Sequence
  Synthetic
atacgccatgctgggtctccatcaggagaacactggctgcaatgcctgaagaggagacaacagaagcaaatgccggacagttcctctcttttgctagcttatttcttcctaagctagttgcgtacttgggagtcggccat

SEQ ID NO: 379288 - DNA, 140 bp, Artificial Sequence
  Synthetic
atggccgactcccaagtacgcaactagcttaggaagaaataagctagcaaaagagaggaactgtccggcatttgcttctgttgtctcctcttcaggcattgcagccagtgttctcctgatggagacccagcatggcgtat

SEQ ID NO: 379289 - DNA, 140 bp, Artificial Sequence
  Synthetic
aggccctggctgctgatatgtgccggacagttcctctcttttgctagcttatttcttcctaagctagttgtcggagaaaaagcctgtctagaaaaggtgcagcggcaaattcaagttcatgaccttttgggacagcggtg

SEQ ID NO: 379290 - DNA, 140 bp, Artificial Sequence
  Synthetic
caccgctgtcccaaaaggtcatgaacttgaatttgccgctgcaccttttctagacaggctttttctccgacaactagcttaggaagaaataagctagcaaaagagaggaactgtccggcacatatcagcagccagggcct

SEQ ID NO: 379291 - DNA, 140 bp, Artificial Sequence
  Synthetic
atacgccatgctgggtctcccatgatggtcattttcagactgatgagaacaaattttctaattaagttcctccttatacatcaagggatgcatatggtagcaggacacgatgctaacgatcgtacttgggagtcggccat

SEQ ID NO: 379292 - DNA, 140 bp, Artificial Sequence
  Synthetic
atggccgactcccaagtacgatcgttagcatcgtgtcctgctaccatatgcatcccttgatgtataaggaggaacttaattagaaaatttgttctcatcagtctgaaaatgaccatcatgggagacccagcatggcgtat

SEQ ID NO: 379293 - DNA, 140 bp, Artificial Sequence
  Synthetic
aggccctggctgctgatatgtccttatacatcaagggatgcatatggtagcaggacacgatgctaacgatgctgtcatcgcaaactctgtagctcaagcacgtttttcaggattattgatgaccttttgggacagcggtg

SEQ ID NO: 379294 - DNA, 140 bp, Artificial Sequence
  Synthetic
caccgctgtcccaaaaggtcatcaataatcctgaaaaacgtgcttgagctacagagtttgcgatgacagcatcgttagcatcgtgtcctgctaccatatgcatcccttgatgtataaggacatatcagcagccagggcct

SEQ ID NO: 379295 - DNA, 140 bp, Artificial Sequence
  Synthetic
atacgccatgctgggtctccgtcttcatcctttggcaagaactgctaaggtcaagaacgaagtaaattcctttaaggctgcccttagctcgctagcacaacatggagagtatgctcctttcgtacttgggagtcggccat

SEQ ID NO: 379296 - DNA, 140 bp, Artificial Sequence
  Synthetic
atggccgactcccaagtacgaaaggagcatactctccatgttgtgctagcgagctaagggcagccttaaaggaatttacttcgttcttgaccttagcagttcttgccaaaggatgaagacggagacccagcatggcgtat

SEQ ID NO: 379297 - DNA, 140 bp, Artificial Sequence
  Synthetic
aggccctggctgctgatatgtttaaggctgcccttagctcgctagcacaacatggagagtatgctccttttgctcgcttgctgaatctttctggagtcaacaatctcgagcacggactgtgaccttttgggacagcggtg

SEQ ID NO: 379298 - DNA, 140 bp, Artificial Sequence
  Synthetic
caccgctgtcccaaaaggtcacagtccgtgctcgagattgttgactccagaaagattcagcaagcgagcaaaaggagcatactctccatgttgtgctagcgagctaagggcagccttaaacatatcagcagccagggcct

SEQ ID NO: 379299 - DNA, 140 bp, Artificial Sequence
  Synthetic
atacgccatgctgggtctccaccctggcaggagtaaatgtgggggaacagtatcagcaactacgagaagcagccactgaggcagaaaaacaattgcagaaatacgctgaatctcgcgagccgtacttgggagtcggccat

SEQ ID NO: 379300 - DNA, 140 bp, Artificial Sequence
  Synthetic
atggccgactcccaagtacggctcgcgagattcagcgtatttctgcaattgtttttctgcctcagtggctgcttctcgtagttgctgatactgttcccccacatttactcctgccagggtggagacccagcatggcgtat

SEQ ID NO: 379301 - DNA, 140 bp, Artificial Sequence
  Synthetic
aggccctggctgctgatatgagccactgaggcagaaaaacaattgcagaaatacgctgaatctcgcgagcttgaccatctaggtctcgatgatcaagagaagaagatcttgaaagacttcgaccttttgggacagcggtg

SEQ ID NO: 379302 - DNA, 140 bp, Artificial Sequence
  Synthetic
caccgctgtcccaaaaggtcgaagtctttcaagatcttcttctcttgatcatcgagacctagatggtcaagctcgcgagattcagcgtatttctgcaattgtttttctgcctcagtggctcatatcagcagccagggcct

SEQ ID NO: 379303 - DNA, 140 bp, Artificial Sequence
  Synthetic
atacgccatgctgggtctccactacggaaggaaaggctagccaagctcactgaggcaatcacctccacatcccttctcaagacaggaaaacagtatgatgatgacaacgatatcccctttcgtacttgggagtcggccat

SEQ ID NO: 379304 - DNA, 140 bp, Artificial Sequence
  Synthetic
atggccgactcccaagtacgaaaggggatatcgttgtcatcatcatactgttttcctgtcttgagaagggatgtggaggtgattgcctcagtgagcttggctagcctttccttccgtagtggagacccagcatggcgtat

SEQ ID NO: 379305 - DNA, 140 bp, Artificial Sequence
  Synthetic
aggccctggctgctgatatgcccttctcaagacaggaaaacagtatgatgatgacaacgatatcccctttcctgggcccatcaatgataacgaaaactcagaacagcaagacgatgatccgaccttttgggacagcggtg

SEQ ID NO: 379306 - DNA, 140 bp, Artificial Sequence
  Synthetic
caccgctgtcccaaaaggtcggatcatcgtcttgctgttctgagttttcgttatcattgatgggcccaggaaaggggatatcgttgtcatcatcatactgttttcctgtcttgagaagggcatatcagcagccagggcct

SEQ ID NO: 379307 - DNA, 140 bp, Artificial Sequence
  Synthetic
atacgccatgctgggtctccatggcagatacaacaattatggagactatcctagtgagacggcgaatgcccctgaagaccttgttctttttgaccttgaagatggtgacgaggatgatcacgtacttgggagtcggccat

SEQ ID NO: 379308 - DNA, 140 bp, Artificial Sequence
  Synthetic
atggccgactcccaagtacgtgatcatcctcgtcaccatcttcaaggtcaaaaagaacaaggtcttcaggggcattcgccgtctcactaggatagtctccataattgttgtatctgccatggagacccagcatggcgtat

SEQ ID NO: 379309 - DNA, 140 bp, Artificial Sequence
  Synthetic
aggccctggctgctgatatgcctgaagaccttgttctttttgaccttgaagatggtgacgaggatgatcaccgaccgtcaagttcatcagagaacaacaacaaacacagtcttacaggaagaccttttgggacagcggtg

SEQ ID NO: 379310 - DNA, 140 bp, Artificial Sequence
  Synthetic
caccgctgtcccaaaaggtcttcctgtaagactgtgtttgttgttgttctctgatgaacttgacggtcggtgatcatcctcgtcaccatcttcaaggtcaaaaagaacaaggtcttcaggcatatcagcagccagggcct

SEQ ID NO: 379311 - DNA, 140 bp, Artificial Sequence
  Synthetic
atacgccatgctgggtctccaagaaagactccacacaaaacaatgacaatcctgcacagcgggctcaagaatacgccagggataacatccaggatacaccaacaccccatcgagctctaacgtacttgggagtcggccat

SEQ ID NO: 379312 - DNA, 140 bp, Artificial Sequence
  Synthetic
atggccgactcccaagtacgttagagctcgatggggtgttggtgtatcctggatgttatccctggcgtattcttgagcccgctgtgcaggattgtcattgttttgtgtggagtctttcttggagacccagcatggcgtat

SEQ ID NO: 379313 - DNA, 140 bp, Artificial Sequence
  Synthetic
aggccctggctgctgatatgatacgccagggataacatccaggatacaccaacaccccatcgagctctaactcccatcagcgaagaaaccggctccaatggtcacaatgaagatgacattgaccttttgggacagcggtg

SEQ ID NO: 379314 - DNA, 140 bp, Artificial Sequence
  Synthetic
caccgctgtcccaaaaggtcaatgtcatcttcattgtgaccattggagccggtttcttcgctgatgggagttagagctcgatggggtgttggtgtatcctggatgttatccctggcgtatcatatcagcagccagggcct

SEQ ID NO: 379315 - DNA, 140 bp, Artificial Sequence
  Synthetic
atacgccatgctgggtctcccattaccaccacaaaaaataccactgctccaccagcacctgtttatcggagtaattcagaaaaggagcccctcccgcaagaaaaatcccagaagcaaccacgtacttgggagtcggccat

SEQ ID NO: 379316 - DNA, 140 bp, Artificial Sequence
  Synthetic
atggccgactcccaagtacgtggttgcttctgggatttttcttgcgggaggggctccttttctgaattactccgataaacaggtgctggtggagcagtggtattttttgtggtggtaatgggagacccagcatggcgtat

SEQ ID NO: 379317 - DNA, 140 bp, Artificial Sequence
  Synthetic
aggccctggctgctgatatggtaattcagaaaaggagcccctcccgcaagaaaaatcccagaagcaaccaaaccaagtgagtggtagtgagaataccgacaataaacctcactcagagcagaccttttgggacagcggtg

SEQ ID NO: 379318 - DNA, 140 bp, Artificial Sequence
  Synthetic
caccgctgtcccaaaaggtctgctctgagtgaggtttattgtcggtattctcactaccactcacttggtttggttgcttctgggatttttcttgcgggaggggctccttttctgaattaccatatcagcagccagggcct

SEQ ID NO: 379319 - DNA, 140 bp, Artificial Sequence
  Synthetic
atacgccatgctgggtctccatgccatcctatactattacatgatgacggaggagccgattgtctttagcactagtgatgggaaagaatacgtataccctgattctcttgaaggggagcacgtacttgggagtcggccat

SEQ ID NO: 379320 - DNA, 140 bp, Artificial Sequence
  Synthetic
atggccgactcccaagtacgtgctccccttcaagagaatcagggtatacgtattctttcccatcactagtgctaaagacaatcggctcctccgtcatcatgtaatagtataggatggcatggagacccagcatggcgtat

SEQ ID NO: 379321 - DNA, 140 bp, Artificial Sequence
  Synthetic
aggccctggctgctgatatgactagtgatgggaaagaatacgtataccctgattctcttgaaggggagcatccaccgtggctcagtgaaaaagaggccttgaatgaggacaataggtttagaccttttgggacagcggtg

SEQ ID NO: 379322 - DNA, 140 bp, Artificial Sequence
  Synthetic
caccgctgtcccaaaaggtctaaacctattgtcctcattcaaggcctctttttcactgagccacggtggatgctccccttcaagagaatcagggtatacgtattctttcccatcactagtcatatcagcagccagggcct

SEQ ID NO: 379323 - DNA, 140 bp, Artificial Sequence
  Synthetic
atacgccatgctgggtctccaaattcatggctatccttcagcaccacaagtaatttcttcataatgacagatcattgtaaggttattaccaccatccctgcaacaaagcatgaaaaccaccgtacttgggagtcggccat

SEQ ID NO: 379324 - DNA, 140 bp, Artificial Sequence
  Synthetic
atggccgactcccaagtacggtggttttcatgctttgttgcagggatggtggtaataaccttacaatgatctgtcattatgaagaaattacttgtggtgctgaaggatagccatgaatttggagacccagcatggcgtat

SEQ ID NO: 379325 - DNA, 140 bp, Artificial Sequence
  Synthetic
aggccctggctgctgatatgatcattgtaaggttattaccaccatccctgcaacaaagcatgaaaaccacactcaacaacgccctaccacaggataccttggagaccatacaccaagatcgaccttttgggacagcggtg

SEQ ID NO: 379326 - DNA, 140 bp, Artificial Sequence
  Synthetic
caccgctgtcccaaaaggtcgatcttggtgtatggtctccaaggtatcctgtggtagggcgttgttgagtgtggttttcatgctttgttgcagggatggtggtaataaccttacaatgatcatatcagcagccagggcct

SEQ ID NO: 379327 - DNA, 140 bp, Artificial Sequence
  Synthetic
atacgccatgctgggtctccaataatcccaagaccaaaccgcacacatccagatcaacccaaaccctcaaacaccaccccactccgcgatcccagaccaaactccgccccagacaagcaccgtacttgggagtcggccat

SEQ ID NO: 379328 - DNA, 140 bp, Artificial Sequence
  Synthetic
atggccgactcccaagtacggtgcttgtctggggcggagtttggtctgggatcgcggagtggggtggtgtttgagggtttgggttgatctggatgtgtgcggtttggtcttgggattattggagacccagcatggcgtat

SEQ ID NO: 379329 - DNA, 140 bp, Artificial Sequence
  Synthetic
aggccctggctgctgatatgacaccaccccactccgcgatcccagaccaaactccgccccagacaagcaccccacccatcccagaaaccgcacggccgagaatcgatccccagcattcaagaccttttgggacagcggtg

SEQ ID NO: 379330 - DNA, 140 bp, Artificial Sequence
  Synthetic
caccgctgtcccaaaaggtcttgaatgctggggatcgattctcggccgtgcggtttctgggatgggtggggtgcttgtctggggcggagtttggtctgggatcgcggagtggggtggtgtcatatcagcagccagggcct

SEQ ID NO: 379331 - DNA, 140 bp, Artificial Sequence
  Synthetic
atacgccatgctgggtctccattgcacagactttgatccttaggagtttattctagctatctacaaaacgggtccaaaacggaatgatttccactagggctgcagcaatcaatgatccttcgtacttgggagtcggccat

SEQ ID NO: 379332 - DNA, 140 bp, Artificial Sequence
  Synthetic
atggccgactcccaagtacgaaggatcattgattgctgcagccctagtggaaatcattccgttttggacccgttttgtagatagctagaataaactcctaaggatcaaagtctgtgcaatggagacccagcatggcgtat

SEQ ID NO: 379333 - DNA, 140 bp, Artificial Sequence
  Synthetic
aggccctggctgctgatatgggtccaaaacggaatgatttccactagggctgcagcaatcaatgatccttcattaccaatcagaaaccagtgtacacgtggccctgaactatcaggatgggaccttttgggacagcggtg

SEQ ID NO: 379334 - DNA, 140 bp, Artificial Sequence
  Synthetic
caccgctgtcccaaaaggtcccatcctgatagttcagggccacgtgtacactggtttctgattggtaatgaaggatcattgattgctgcagccctagtggaaatcattccgttttggacccatatcagcagccagggcct

SEQ ID NO: 379335 - DNA, 140 bp, Artificial Sequence
  Synthetic
atacgccatgctgggtctcccgacactgagccccacataagctcagggtccgactgccttcccagacccaaaaacacggccccccggactcgcaacacccagacacagaccgatccggttcgtacttgggagtcggccat

SEQ ID NO: 379336 - DNA, 140 bp, Artificial Sequence
  Synthetic
atggccgactcccaagtacgaaccggatcggtctgtgtctgggtgttgcgagtccggggggccgtgtttttgggtctgggaaggcagtcggaccctgagcttatgtggggctcagtgtcgggagacccagcatggcgtat

SEQ ID NO: 379337 - DNA, 140 bp, Artificial Sequence
  Synthetic
aggccctggctgctgatatgaaaacacggccccccggactcgcaacacccagacacagaccgatccggtttgcaatcacaattttgaagacgttacacaagcactaacatcattaaccaagaccttttgggacagcggtg

SEQ ID NO: 379338 - DNA, 140 bp, Artificial Sequence
  Synthetic
caccgctgtcccaaaaggtcttggttaatgatgttagtgcttgtgtaacgtcttcaaaattgtgattgcaaaccggatcggtctgtgtctgggtgttgcgagtccggggggccgtgttttcatatcagcagccagggcct

SEQ ID NO: 379339 - DNA, 140 bp, Artificial Sequence
  Synthetic
atacgccatgctgggtctcctagatctagagaatggcttaaagccaatgtatgacatggctaaagtcatttctgcattgaatagatcttgtgctgagatggtagcaaaatatgatctcctcgtacttgggagtcggccat

SEQ ID NO: 379340 - DNA, 140 bp, Artificial Sequence
  Synthetic
atggccgactcccaagtacgaggagatcatattttgctaccatctcagcacaagatctattcaatgcagaaatgactttagccatgtcatacattggctttaagccattctctagatctaggagacccagcatggcgtat

SEQ ID NO: 379341 - DNA, 140 bp, Artificial Sequence
  Synthetic
aggccctggctgctgatatgtctgcattgaatagatcttgtgctgagatggtagcaaaatatgatctcctggtgatgacaactggccgcgcaaccgccaccgccgctgcaactgaggcttgaccttttgggacagcggtg

SEQ ID NO: 379342 - DNA, 140 bp, Artificial Sequence
  Synthetic
caccgctgtcccaaaaggtcaagcctcagttgcagcggcggtggcggttgcgcggccagttgtcatcaccaggagatcatattttgctaccatctcagcacaagatctattcaatgcagacatatcagcagccagggcct

SEQ ID NO: 379343 - DNA, 140 bp, Artificial Sequence
  Synthetic
atacgccatgctgggtctccagtgcgattagaggcaagattaacaagcaagaggataaagtacctaaggaagttcaagaagcttttcgtaatctggacagtaccagctcactaacagaagcgtacttgggagtcggccat

SEQ ID NO: 379344 - DNA, 140 bp, Artificial Sequence
  Synthetic
atggccgactcccaagtacgcttctgttagtgagctggtactgtccagattacgaaaagcttcttgaacttccttaggtactttatcctcttgcttgttaatcttgcctctaatcgcactggagacccagcatggcgtat

SEQ ID NO: 379345 - DNA, 140 bp, Artificial Sequence
  Synthetic
aggccctggctgctgatatgagttcaagaagcttttcgtaatctggacagtaccagctcactaacagaagagaactttggcaagccagatatatctgcaaaggacctacgagacatcatggaccttttgggacagcggtg

SEQ ID NO: 379346 - DNA, 140 bp, Artificial Sequence
  Synthetic
caccgctgtcccaaaaggtccatgatgtctcgtaggtcctttgcagatatatctggcttgccaaagttctcttctgttagtgagctggtactgtccagattacgaaaagcttcttgaactcatatcagcagccagggcct

SEQ ID NO: 379347 - DNA, 140 bp, Artificial Sequence
  Synthetic
atacgccatgctgggtctccaatttgcaagctaggaaaagacaattctgcattggacattattcatgctgagttccaagccagccttgctgaaggtgattctccccaatgtgccctgatccgtacttgggagtcggccat

SEQ ID NO: 379348 - DNA, 140 bp, Artificial Sequence
  Synthetic
atggccgactcccaagtacggatcagggcacattggggagaatcaccttcagcaaggctggcttggaactcagcatgaataatgtccaatgcagaattgtcttttcctagcttgcaaattggagacccagcatggcgtat

SEQ ID NO: 379349 - DNA, 140 bp, Artificial Sequence
  Synthetic
aggccctggctgctgatatgagttccaagccagccttgctgaaggtgattctccccaatgtgccctgatccaaataacaaaacggatccccatcttccaggatgccactccgcccacaatgaccttttgggacagcggtg

SEQ ID NO: 379350 - DNA, 140 bp, Artificial Sequence
  Synthetic
caccgctgtcccaaaaggtcattgtgggcggagtggcatcctggaagatggggatccgttttgttatttggatcagggcacattggggagaatcaccttcagcaaggctggcttggaactcatatcagcagccagggcct

SEQ ID NO: 379351 - DNA, 140 bp, Artificial Sequence
  Synthetic
atacgccatgctgggtctccgtccagttcctccatcaccaaaaatagacagaggttgggtttgcattttccaattgcaggacgggaagacacttgggctcaagatatagggtcccccagtcgtacttgggagtcggccat

SEQ ID NO: 379352 - DNA, 140 bp, Artificial Sequence
  Synthetic
atggccgactcccaagtacgactgggggaccctatatcttgagcccaagtgtcttcccgtcctgcaattggaaaatgcaaacccaacctctgtctatttttggtgatggaggaactggacggagacccagcatggcgtat

SEQ ID NO: 379353 - DNA, 140 bp, Artificial Sequence
  Synthetic
aggccctggctgctgatatgcaattgcaggacgggaagacacttgggctcaagatatagggtcccccagtcaaagacacgtgcggtcccatcctccctcaccttcagacatcaacgcatggaccttttgggacagcggtg

SEQ ID NO: 379354 - DNA, 140 bp, Artificial Sequence
  Synthetic
caccgctgtcccaaaaggtccatgcgttgatgtctgaaggtgagggaggatgggaccgcacgtgtctttgactgggggaccctatatcttgagcccaagtgtcttcccgtcctgcaattgcatatcagcagccagggcct

SEQ ID NO: 379355 - DNA, 140 bp, Artificial Sequence
  Synthetic
atacgccatgctgggtctccaggctgatcttcgggataagagacatgaaaaaccaaaaagccgtttacatccagatccaagatcaagagtggcttggaaataaggggcacttgttctttgcgtacttgggagtcggccat

SEQ ID NO: 379356 - DNA, 140 bp, Artificial Sequence
  Synthetic
atggccgactcccaagtacgcaaagaacaagtgccccttatttccaagccactcttgatcttggatctggatgtaaacggctttttggtttttcatgtctcttatcccgaagatcagcctggagacccagcatggcgtat

SEQ ID NO: 379357 - DNA, 140 bp, Artificial Sequence
  Synthetic
aggccctggctgctgatatgccagatccaagatcaagagtggcttggaaataaggggcacttgttctttgtctcaaaggacttacaaaaacaagggtgatgaagattaagaaaaagcctcgaccttttgggacagcggtg

SEQ ID NO: 379358 - DNA, 140 bp, Artificial Sequence
  Synthetic
caccgctgtcccaaaaggtcgaggctttttcttaatcttcatcacccttgtttttgtaagtcctttgagacaaagaacaagtgccccttatttccaagccactcttgatcttggatctggcatatcagcagccagggcct

SEQ ID NO: 379359 - DNA, 140 bp, Artificial Sequence
  Synthetic
atacgccatgctgggtctccatcgattccaatcacgatgaggagaatcatcctacccacggcaccacctgaatacatggaggctgtttacccaatgagaacaatgaattctggtgcagaccgtacttgggagtcggccat

SEQ ID NO: 379360 - DNA, 140 bp, Artificial Sequence
  Synthetic
atggccgactcccaagtacggtctgcaccagaattcattgttctcattgggtaaacagcctccatgtattcaggtggtgccgtgggtaggatgattctcctcatcgtgattggaatcgatggagacccagcatggcgtat

SEQ ID NO: 379361 - DNA, 140 bp, Artificial Sequence
  Synthetic
aggccctggctgctgatatgaatacatggaggctgtttacccaatgagaacaatgaattctggtgcagacaacactgccagtggccctaattacacaacaactggtgtgatgacaaatgagaccttttgggacagcggtg

SEQ ID NO: 379362 - DNA, 140 bp, Artificial Sequence
  Synthetic
caccgctgtcccaaaaggtctcatttgtcatcacaccagttgttgtgtaattagggccactggcagtgttgtctgcaccagaattcattgttctcattgggtaaacagcctccatgtattcatatcagcagccagggcct

SEQ ID NO: 379363 - DNA, 140 bp, Artificial Sequence
  Synthetic
atacgccatgctgggtctcccgagccacacgcctaacagtgttgcctctgcatttatattggaagctatggtgaatgtaatatctggcccgaaagtgctgatgaagcaaatcccaatctgcgtacttgggagtcggccat

SEQ ID NO: 379364 - DNA, 140 bp, Artificial Sequence
  Synthetic
atggccgactcccaagtacgcagattgggatttgcttcatcagcactttcgggccagatattacattcaccatagcttccaatataaatgcagaggcaacactgttaggcgtgtggctcgggagacccagcatggcgtat

SEQ ID NO: 379365 - DNA, 140 bp, Artificial Sequence
  Synthetic
aggccctggctgctgatatggtgaatgtaatatctggcccgaaagtgctgatgaagcaaatcccaatctggcttcctctgggtgtctctgaccagaagacatatagctttgattcaaccagaccttttgggacagcggtg

SEQ ID NO: 379366 - DNA, 140 bp, Artificial Sequence
  Synthetic
caccgctgtcccaaaaggtctggttgaatcaaagctatatgtcttctggtcagagacacccagaggaagccagattgggatttgcttcatcagcactttcgggccagatattacattcaccatatcagcagccagggcct

SEQ ID NO: 379367 - DNA, 140 bp, Artificial Sequence
  Synthetic
atacgccatgctgggtctcctcaaatccccttgtgagaatcaaccgacttggtcctggcatacctgatcacccactacgactcctaagaataggaaatcaagccttcctacaagagtttgcgtacttgggagtcggccat

SEQ ID NO: 379368 - DNA, 140 bp, Artificial Sequence
  Synthetic
atggccgactcccaagtacgcaaactcttgtaggaaggcttgatttcctattcttaggagtcgtagtgggtgatcaggtatgccaggaccaagtcggttgattctcacaaggggatttgaggagacccagcatggcgtat

SEQ ID NO: 379369 - DNA, 140 bp, Artificial Sequence
  Synthetic
aggccctggctgctgatatgcccactacgactcctaagaataggaaatcaagccttcctacaagagtttgtgctacctcctgtacaactgccacaatacttcacttttgatctgacagcggaccttttgggacagcggtg

SEQ ID NO: 379370 - DNA, 140 bp, Artificial Sequence
  Synthetic
caccgctgtcccaaaaggtccgctgtcagatcaaaagtgaagtattgtggcagttgtacaggaggtagcacaaactcttgtaggaaggcttgatttcctattcttaggagtcgtagtgggcatatcagcagccagggcct

SEQ ID NO: 379371 - DNA, 140 bp, Artificial Sequence
  Synthetic
atacgccatgctgggtctcctccagctgtgtcaactggcacgctccgcccagggatctcattccatcccaaattaaggcctatcctgctaccaggaagagctggaaagaagggctccaaccgtacttgggagtcggccat

SEQ ID NO: 379372 - DNA, 140 bp, Artificial Sequence
  Synthetic
atggccgactcccaagtacggttggagcccttctttccagctcttcctggtagcaggataggccttaatttgggatggaatgagatccctgggcggagcgtgccagttgacacagctggaggagacccagcatggcgtat

SEQ ID NO: 379373 - DNA, 140 bp, Artificial Sequence
  Synthetic
aggccctggctgctgatatgaattaaggcctatcctgctaccaggaagagctggaaagaagggctccaactccgatctaacatctcctgacaaaatccaggctataatgaatttcctacagaccttttgggacagcggtg

SEQ ID NO: 379374 - DNA, 140 bp, Artificial Sequence
  Synthetic
caccgctgtcccaaaaggtctgtaggaaattcattatagcctggattttgtcaggagatgttagatcggagttggagcccttctttccagctcttcctggtagcaggataggccttaattcatatcagcagccagggcct

SEQ ID NO: 379375 - DNA, 140 bp, Artificial Sequence
  Synthetic
atacgccatgctgggtctccaagtgccagaactcctggttcacaggctgactgggaagaagacaactaccaagaatggtcaaccaatcattccaattctgctaccaaagtacattggtctcgtacttgggagtcggccat

SEQ ID NO: 379376 - DNA, 140 bp, Artificial Sequence
  Synthetic
atggccgactcccaagtacgagaccaatgtactttggtagcagaattggaatgattggttgaccattcttggtagttgtcttcttcccagtcagcctgtgaaccaggagttctggcacttggagacccagcatggcgtat

SEQ ID NO: 379377 - DNA, 140 bp, Artificial Sequence
  Synthetic
aggccctggctgctgatatgaagaatggtcaaccaatcattccaattctgctaccaaagtacattggtcttgatcctctatctcaaggtgatctcacaatggtgatcactcaggactgtggaccttttgggacagcggtg

SEQ ID NO: 379378 - DNA, 140 bp, Artificial Sequence
  Synthetic
caccgctgtcccaaaaggtccacagtcctgagtgatcaccattgtgagatcaccttgagatagaggatcaagaccaatgtactttggtagcagaattggaatgattggttgaccattcttcatatcagcagccagggcct

SEQ ID NO: 379379 - DNA, 140 bp, Artificial Sequence
  Synthetic
atacgccatgctgggtctcctgagactcaacatcacactgccagagcacctcaccgcaagtctatacaacaatcaaccccggcatctacaacctgcaaaaaccagcccatctgatactcccgtacttgggagtcggccat

SEQ ID NO: 379380 - DNA, 140 bp, Artificial Sequence
  Synthetic
atggccgactcccaagtacgggagtatcagatgggctggtttttgcaggttgtagatgccggggttgattgttgtatagacttgcggtgaggtgctctggcagtgtgatgttgagtctcaggagacccagcatggcgtat

SEQ ID NO: 379381 - DNA, 140 bp, Artificial Sequence
  Synthetic
aggccctggctgctgatatgaatcaaccccggcatctacaacctgcaaaaaccagcccatctgatactcctggcatcgggggcaagacaaggcagccaagcagcagcccccgagccgagcgaccttttgggacagcggtg

SEQ ID NO: 379382 - DNA, 140 bp, Artificial Sequence
  Synthetic
caccgctgtcccaaaaggtcgctcggctcgggggctgctgcttggctgccttgtcttgcccccgatgccaggagtatcagatgggctggtttttgcaggttgtagatgccggggttgattcatatcagcagccagggcct

SEQ ID NO: 379383 - DNA, 140 bp, Artificial Sequence
  Synthetic
atacgccatgctgggtctcccaaacgcacagatggacaagcaaagaacatcaagccaggagcaacacagaccccaagtctaagctgatcaacccctcccgcaatcccaccaacgccagcacgtacttgggagtcggccat

SEQ ID NO: 379384 - DNA, 140 bp, Artificial Sequence
  Synthetic
atggccgactcccaagtacgtgctggcgttggtgggattgcgggaggggttgatcagcttagacttggggtctgtgttgctcctggcttgatgttctttgcttgtccatctgtgcgtttgggagacccagcatggcgtat

SEQ ID NO: 379385 - DNA, 140 bp, Artificial Sequence
  Synthetic
aggccctggctgctgatatgccccaagtctaagctgatcaacccctcccgcaatcccaccaacgccagcaaaaatcccccaactcgataccaaccccaagcaaatcagctcaaaccgtctgaccttttgggacagcggtg

SEQ ID NO: 379386 - DNA, 140 bp, Artificial Sequence
  Synthetic
caccgctgtcccaaaaggtcagacggtttgagctgatttgcttggggttggtatcgagttgggggatttttgctggcgttggtgggattgcgggaggggttgatcagcttagacttggggcatatcagcagccagggcct

SEQ ID NO: 379387 - DNA, 140 bp, Artificial Sequence
  Synthetic
atacgccatgctgggtctcccttcttatgccacagcttatattaagaaaaagaacttgatgaagattaaggcaaccagtggtgctatcttcatctctttgatttgagtcttaagtgaatacgtacttgggagtcggccat

SEQ ID NO: 379388 - DNA, 140 bp, Artificial Sequence
  Synthetic
atggccgactcccaagtacgtattcacttaagactcaaatcaaagagatgaagatagcaccactggttgccttaatcttcatcaagttctttttcttaatataagctgtggcataagaagggagacccagcatggcgtat

SEQ ID NO: 379389 - DNA, 140 bp, Artificial Sequence
  Synthetic
aggccctggctgctgatatggcaaccagtggtgctatcttcatctctttgatttgagtcttaagtgaatacacaggttctaatactgttcttctgtccaacggtataattcagccaggccgaccttttgggacagcggtg

SEQ ID NO: 379390 - DNA, 140 bp, Artificial Sequence
  Synthetic
caccgctgtcccaaaaggtcggcctggctgaattataccgttggacagaagaacagtattagaacctgtgtattcacttaagactcaaatcaaagagatgaagatagcaccactggttgccatatcagcagccagggcct

SEQ ID NO: 379391 - DNA, 140 bp, Artificial Sequence
  Synthetic
atacgccatgctgggtctccttgccccgtgagcgcttcaggaaaacatctttctttgtttgggtaataatcctattccataaagtcttttcaatcccgttgggggttgtacacaacaatacgtacttgggagtcggccat

SEQ ID NO: 379392 - DNA, 140 bp, Artificial Sequence
  Synthetic
atggccgactcccaagtacgtattgttgtgtacaacccccaacgggattgaaaagactttatggaataggattattacccaaacaaagaaagatgttttcctgaagcgctcacggggcaaggagacccagcatggcgtat

SEQ ID NO: 379393 - DNA, 140 bp, Artificial Sequence
  Synthetic
aggccctggctgctgatatgcctattccataaagtcttttcaatcccgttgggggttgtacacaacaataccctacaagtgagtgatattgacaagtttgtgtgccgagacaaactctctgaccttttgggacagcggtg

SEQ ID NO: 379394 - DNA, 140 bp, Artificial Sequence
  Synthetic
caccgctgtcccaaaaggtcagagagtttgtctcggcacacaaacttgtcaatatcactcacttgtagggtattgttgtgtacaacccccaacgggattgaaaagactttatggaataggcatatcagcagccagggcct

SEQ ID NO: 379395 - DNA, 140 bp, Artificial Sequence
  Synthetic
atacgccatgctgggtctccagcaactgatgtaccaacggcaaccaaaagatggggttttcgagctggtgttccaccaaaggtggtaaattgcgaagctggagaatgggctgagaactgtcgtacttgggagtcggccat

SEQ ID NO: 379396 - DNA, 140 bp, Artificial Sequence
  Synthetic
atggccgactcccaagtacgacagttctcagcccattctccagcttcgcaatttaccacctttggtggaacaccagctcgaaaaccccatcttttggttgccgttggtacatcagttgctggagacccagcatggcgtat

SEQ ID NO: 379397 - DNA, 140 bp, Artificial Sequence
  Synthetic
aggccctggctgctgatatgttccaccaaaggtggtaaattgcgaagctggagaatgggctgagaactgttataacctggctataaagaaagttgatggtagtgagtgcctaccagaagcgaccttttgggacagcggtg

SEQ ID NO: 379398 - DNA, 140 bp, Artificial Sequence
  Synthetic
caccgctgtcccaaaaggtcgcttctggtaggcactcactaccatcaactttctttatagccaggttataacagttctcagcccattctccagcttcgcaatttaccacctttggtggaacatatcagcagccagggcct

SEQ ID NO: 379399 - DNA, 140 bp, Artificial Sequence
  Synthetic
atacgccatgctgggtctcccaggaactggaccatgcccaggaggactcgcctttcacaaagaaggagccttcttcctgtatgaccgactcgcatcaacaatcatttatcggggtacaaccgtacttgggagtcggccat

SEQ ID NO: 379400 - DNA, 140 bp, Artificial Sequence
  Synthetic
atggccgactcccaagtacggttgtaccccgataaatgattgttgatgcgagtcggtcatacaggaagaaggctccttctttgtgaaaggcgagtcctcctgggcatggtccagttcctgggagacccagcatggcgtat

SEQ ID NO: 379401 - DNA, 140 bp, Artificial Sequence
  Synthetic
aggccctggctgctgatatgttcttcctgtatgaccgactcgcatcaacaatcatttatcggggtacaacctttgccgaaggagttattgcatttctgatcttgcctaaggcgcgaaagggaccttttgggacagcggtg

SEQ ID NO: 379402 - DNA, 140 bp, Artificial Sequence
  Synthetic
caccgctgtcccaaaaggtccctttcgcgccttaggcaagatcagaaatgcaataactccttcggcaaaggttgtaccccgataaatgattgttgatgcgagtcggtcatacaggaagaacatatcagcagccagggcct

SEQ ID NO: 379403 - DNA, 140 bp, Artificial Sequence
  Synthetic
atacgccatgctgggtctccccctccagttactatcacacgacaacaataaactacgtggttgataattttggaaccaacaccacagagtttctgttccaagtcgatcatttgacgtatgcgtacttgggagtcggccat

SEQ ID NO: 379404 - DNA, 140 bp, Artificial Sequence
  Synthetic
atggccgactcccaagtacgcatacgtcaaatgatcgacttggaacagaaactctgtggtgttggttccaaaattatcaaccacgtagtttattgttgtcgtgtgatagtaactggagggggagacccagcatggcgtat

SEQ ID NO: 379405 - DNA, 140 bp, Artificial Sequence
  Synthetic
aggccctggctgctgatatgtggaaccaacaccacagagtttctgttccaagtcgatcatttgacgtatgtgcagctcgaggcaagattcacaccacaattccttgtcctcctaaatgaagaccttttgggacagcggtg

SEQ ID NO: 379406 - DNA, 140 bp, Artificial Sequence
  Synthetic
caccgctgtcccaaaaggtcttcatttaggaggacaaggaattgtggtgtgaatcttgcctcgagctgcacatacgtcaaatgatcgacttggaacagaaactctgtggtgttggttccacatatcagcagccagggcct

SEQ ID NO: 379407 - DNA, 140 bp, Artificial Sequence
  Synthetic
atacgccatgctgggtctccgaaaataaatcccactgttgataccagcatgggtgagtgggctttctgggaaaataaaaaaacttcacaaaaaccctttcaagtgaagagttgtctttcgcgtacttgggagtcggccat

SEQ ID NO: 379408 - DNA, 140 bp, Artificial Sequence
  Synthetic
atggccgactcccaagtacgcgaaagacaactcttcacttgaaagggtttttgtgaagtttttttattttcccagaaagcccactcacccatgctggtatcaacagtgggatttattttcggagacccagcatggcgtat

SEQ ID NO: 379409 - DNA, 140 bp, Artificial Sequence
  Synthetic
aggccctggctgctgatatgaaaataaaaaaacttcacaaaaaccctttcaagtgaagagttgtctttcgtacctgtaccagaaacccagaaccaggtccttgacacgacagcgacggtcgaccttttgggacagcggtg

SEQ ID NO: 379410 - DNA, 140 bp, Artificial Sequence
  Synthetic
caccgctgtcccaaaaggtcgaccgtcgctgtcgtgtcaaggacctggttctgggtttctggtacaggtacgaaagacaactcttcacttgaaagggtttttgtgaagtttttttattttcatatcagcagccagggcct

SEQ ID NO: 379411 - DNA, 140 bp, Artificial Sequence
  Synthetic
atacgccatgctgggtctccggtttcagaggattccactccagtggttcagatgcaaaacatcaagggaaaggacacaatgccaaccacagtgacgggtgtaccaacaaccacaccctctcgtacttgggagtcggccat

SEQ ID NO: 379412 - DNA, 140 bp, Artificial Sequence
  Synthetic
atggccgactcccaagtacgagagggtgtggttgttggtacacccgtcactgtggttggcattgtgtcctttcccttgatgttttgcatctgaaccactggagtggaatcctctgaaaccggagacccagcatggcgtat

SEQ ID NO: 379413 - DNA, 140 bp, Artificial Sequence
  Synthetic
aggccctggctgctgatatgaggacacaatgccaaccacagtgacgggtgtaccaacaaccacaccctctccatttccaatcaatgctcgcaacactgatcataccaaatcatttatcgggaccttttgggacagcggtg

SEQ ID NO: 379414 - DNA, 140 bp, Artificial Sequence
  Synthetic
caccgctgtcccaaaaggtcccgataaatgatttggtatgatcagtgttgcgagcattgattggaaatggagagggtgtggttgttggtacacccgtcactgtggttggcattgtgtcctcatatcagcagccagggcct

SEQ ID NO: 379415 - DNA, 140 bp, Artificial Sequence
  Synthetic
atacgccatgctgggtctccccagccaaccaaccaacagcacagaatcgacgacactaaacccaacatcagagccctccagtagaggcacgggaccatccagccccacggtccccaacaccgtacttgggagtcggccat

SEQ ID NO: 379416 - DNA, 140 bp, Artificial Sequence
  Synthetic
atggccgactcccaagtacggtgttggggaccgtggggctggatggtcccgtgcctctactggagggctctgatgttgggtttagtgtcgtcgattctgtgctgttggttggttggctggggagacccagcatggcgtat

SEQ ID NO: 379417 - DNA, 140 bp, Artificial Sequence
  Synthetic
aggccctggctgctgatatggagccctccagtagaggcacgggaccatccagccccacggtccccaacaccacagaaagccacgccgaacttggcaagacaaccccaaccacactcccaggaccttttgggacagcggtg

SEQ ID NO: 379418 - DNA, 140 bp, Artificial Sequence
  Synthetic
caccgctgtcccaaaaggtcctgggagtgtggttggggttgtcttgccaagttcggcgtggctttctgtggtgttggggaccgtggggctggatggtcccgtgcctctactggagggctccatatcagcagccagggcct

SEQ ID NO: 379419 - DNA, 140 bp, Artificial Sequence
  Synthetic
atacgccatgctgggtctccctcagtggacctggcttcctgacgaacacaatacggggggttacaaatctcctgacaggatccagaagaaagcgaagggatgtcactcccaatacacaaccgtacttgggagtcggccat

SEQ ID NO: 379420 - DNA, 140 bp, Artificial Sequence
  Synthetic
atggccgactcccaagtacggttgtgtattgggagtgacatcccttcgctttcttctggatcctgtcaggagatttgtaaccccccgtattgtgttcgtcaggaagccaggtccactgagggagacccagcatggcgtat

SEQ ID NO: 379421 - DNA, 140 bp, Artificial Sequence
  Synthetic
aggccctggctgctgatatgcctgacaggatccagaagaaagcgaagggatgtcactcccaatacacaacccaaatgcaacccaaacctgcactattggacagccttggatgagggtgctgaccttttgggacagcggtg

SEQ ID NO: 379422 - DNA, 140 bp, Artificial Sequence
  Synthetic
caccgctgtcccaaaaggtcagcaccctcatccaaggctgtccaatagtgcaggtttgggttgcatttgggttgtgtattgggagtgacatcccttcgctttcttctggatcctgtcaggcatatcagcagccagggcct

SEQ ID NO: 379423 - DNA, 140 bp, Artificial Sequence
  Synthetic
atacgccatgctgggtctccttacactgaaggcataatggagaatcaaaatggattgatctgtggattgaggcagctggccaacgaaacgacacaagctcttcaattgttcttaagggcacgtacttgggagtcggccat

SEQ ID NO: 379424 - DNA, 140 bp, Artificial Sequence
  Synthetic
atggccgactcccaagtacgtgcccttaagaacaattgaagagcttgtgtcgtttcgttggccagctgcctcaatccacagatcaatccattttgattctccattatgccttcagtgtaaggagacccagcatggcgtat

SEQ ID NO: 379425 - DNA, 140 bp, Artificial Sequence
  Synthetic
aggccctggctgctgatatgggcagctggccaacgaaacgacacaagctcttcaattgttcttaagggcaactactgagttgcgtacattctctatactaaatcggaaagcaatagacttgaccttttgggacagcggtg

SEQ ID NO: 379426 - DNA, 140 bp, Artificial Sequence
  Synthetic
caccgctgtcccaaaaggtcaagtctattgctttccgatttagtatagagaatgtacgcaactcagtagttgcccttaagaacaattgaagagcttgtgtcgtttcgttggccagctgcccatatcagcagccagggcct

SEQ ID NO: 379427 - DNA, 140 bp, Artificial Sequence
  Synthetic
atacgccatgctgggtctccgcattgaaccccaagattggaccaaaaatatcactgataaaattgatcaaataatccatgactttgtcgataataatcttccaaatcagaatgatggcagcgtacttgggagtcggccat

SEQ ID NO: 379428 - DNA, 140 bp, Artificial Sequence
  Synthetic
atggccgactcccaagtacgctgccatcattctgatttggaagattattatcgacaaagtcatggattatttgatcaattttatcagtgatatttttggtccaatcttggggttcaatgcggagacccagcatggcgtat

SEQ ID NO: 379429 - DNA, 140 bp, Artificial Sequence
  Synthetic
aggccctggctgctgatatgataatccatgactttgtcgataataatcttccaaatcagaatgatggcagcaactggtggactggatggaaacaatgggttcctgctggaataggaatcagaccttttgggacagcggtg

SEQ ID NO: 379430 - DNA, 140 bp, Artificial Sequence
  Synthetic
caccgctgtcccaaaaggtctgattcctattccagcaggaacccattgtttccatccagtccaccagttgctgccatcattctgatttggaagattattatcgacaaagtcatggattatcatatcagcagccagggcct

SEQ ID NO: 379431 - DNA, 140 bp, Artificial Sequence
  Synthetic
atacgccatgctgggtctccctttgaactaatatagcatcatactttctaatattcccccaatatgaatttttgttttcgattttatttaatgatatatcctctgtatacctcactaatgcgtacttgggagtcggccat

SEQ ID NO: 379432 - DNA, 140 bp, Artificial Sequence
  Synthetic
atggccgactcccaagtacgcattagtgaggtatacagaggatatatcattaaataaaatcgaaaacaaaaattcatattgggggaatattagaaagtatgatgctatattagttcaaagggagacccagcatggcgtat

SEQ ID NO: 379433 - DNA, 140 bp, Artificial Sequence
  Synthetic
aggccctggctgctgatatgtttgttttcgattttatttaatgatatatcctctgtatacctcactaatgtactcgagcataatttccctgatagacttgattgtatttgatgattaagggaccttttgggacagcggtg

SEQ ID NO: 379434 - DNA, 140 bp, Artificial Sequence
  Synthetic
caccgctgtcccaaaaggtcccttaatcatcaaatacaatcaagtctatcagggaaattatgctcgagtacattagtgaggtatacagaggatatatcattaaataaaatcgaaaacaaacatatcagcagccagggcct

SEQ ID NO: 379435 - DNA, 140 bp, Artificial Sequence
  Synthetic
atacgccatgctgggtctccttatgctaggaccacaaatacacttgatgaagattaagaaaaagataatcttatgattatcattgatcttcatctataccttaaatactctattcaaggacgtacttgggagtcggccat

SEQ ID NO: 379436 - DNA, 140 bp, Artificial Sequence
  Synthetic
atggccgactcccaagtacgtccttgaatagagtatttaaggtatagatgaagatcaatgataatcataagattatctttttcttaatcttcatcaagtgtatttgtggtcctagcataaggagacccagcatggcgtat

SEQ ID NO: 379437 - DNA, 140 bp, Artificial Sequence
  Synthetic
aggccctggctgctgatatgttatgattatcattgatcttcatctataccttaaatactctattcaaggagagtatgacaaaaccaagtagtattggataaacttgtcctgcattcaaatgaccttttgggacagcggtg

SEQ ID NO: 379438 - DNA, 140 bp, Artificial Sequence
  Synthetic
caccgctgtcccaaaaggtcatttgaatgcaggacaagtttatccaatactacttggttttgtcatactctccttgaatagagtatttaaggtatagatgaagatcaatgataatcataacatatcagcagccagggcct

SEQ ID NO: 379439 - DNA, 140 bp, Artificial Sequence
  Synthetic
atacgccatgctgggtctccatatcatttgaaactaattagtgactaaaacacacaactcaagtcggccagaatggaagttgttcatgaaagaggtcgctccaggatctcccgacaaaaccgtacttgggagtcggccat

SEQ ID NO: 379440 - DNA, 140 bp, Artificial Sequence
  Synthetic
atggccgactcccaagtacggttttgtcgggagatcctggagcgacctctttcatgaacaacttccattctggccgacttgagttgtgtgttttagtcactaattagtttcaaatgatatggagacccagcatggcgtat

SEQ ID NO: 379441 - DNA, 140 bp, Artificial Sequence
  Synthetic
aggccctggctgctgatatggaatggaagttgttcatgaaagaggtcgctccaggatctcccgacaaaacacaagggatggacctagtcatttagtacgggcgagatcatcctctcgagcgaccttttgggacagcggtg

SEQ ID NO: 379442 - DNA, 140 bp, Artificial Sequence
  Synthetic
caccgctgtcccaaaaggtcgctcgagaggatgatctcgcccgtactaaatgactaggtccatcccttgtgttttgtcgggagatcctggagcgacctctttcatgaacaacttccattccatatcagcagccagggcct

SEQ ID NO: 379443 - DNA, 140 bp, Artificial Sequence
  Synthetic
atacgccatgctgggtctcctccccactgtctttcatcggaaaaagacagatttattgacagttccaccagcacctaaagatgtatgcccgactttaaagaaagggtttctatgtgacagcgtacttgggagtcggccat

SEQ ID NO: 379444 - DNA, 140 bp, Artificial Sequence
  Synthetic
atggccgactcccaagtacgctgtcacatagaaaccctttctttaaagtcgggcatacatctttaggtgctggtggaactgtcaataaatctgtctttttccgatgaaagacagtggggaggagacccagcatggcgtat

SEQ ID NO: 379445 - DNA, 140 bp, Artificial Sequence
  Synthetic
aggccctggctgctgatatggcacctaaagatgtatgcccgactttaaagaaagggtttctatgtgacagcaatttctgtaaaaaggatcaccaacttgaaagcttaacagatagagagtgaccttttgggacagcggtg

SEQ ID NO: 379446 - DNA, 140 bp, Artificial Sequence
  Synthetic
caccgctgtcccaaaaggtcactctctatctgttaagctttcaagttggtgatcctttttacagaaattgctgtcacatagaaaccctttctttaaagtcgggcatacatctttaggtgccatatcagcagccagggcct

SEQ ID NO: 379447 - DNA, 140 bp, Artificial Sequence
  Synthetic
atacgccatgctgggtctccagcatagttgctccaaaagattcacgtctggctaatcctattgctgaggatttccaacaaaaagatgggcctaaggtaacactgtcgatgcttatagagacgtacttgggagtcggccat

SEQ ID NO: 379448 - DNA, 140 bp, Artificial Sequence
  Synthetic
atggccgactcccaagtacgtctctataagcatcgacagtgttaccttaggcccatctttttgttggaaatcctcagcaataggattagccagacgtgaatcttttggagcaactatgctggagacccagcatggcgtat

SEQ ID NO: 379449 - DNA, 140 bp, Artificial Sequence
  Synthetic
aggccctggctgctgatatgtttccaacaaaaagatgggcctaaggtaacactgtcgatgcttatagagacagcagagtattggtccaaacaggacattaagaacatcgatgattcaagagaccttttgggacagcggtg

SEQ ID NO: 379450 - DNA, 140 bp, Artificial Sequence
  Synthetic
caccgctgtcccaaaaggtctcttgaatcatcgatgttcttaatgtcctgtttggaccaatactctgctgtctctataagcatcgacagtgttaccttaggcccatctttttgttggaaacatatcagcagccagggcct

SEQ ID NO: 379451 - DNA, 140 bp, Artificial Sequence
  Synthetic
atacgccatgctgggtctccatctcaacttagcttgctatgtgaaagccacttacggcgagaaggacttggtcaagaccaatcagagtcagttctggaggtatatcaacgcttacacagccgtacttgggagtcggccat

SEQ ID NO: 379452 - DNA, 140 bp, Artificial Sequence
  Synthetic
atggccgactcccaagtacggctgtgtaagcgttgatatacctccagaactgactctgattggtcttgaccaagtccttctcgccgtaagtggctttcacatagcaagctaagttgagatggagacccagcatggcgtat

SEQ ID NO: 379453 - DNA, 140 bp, Artificial Sequence
  Synthetic
aggccctggctgctgatatggtcaagaccaatcagagtcagttctggaggtatatcaacgcttacacagcgataaaggtgggaatttcgaggcagcactatggcagcagtgggatcggcagaccttttgggacagcggtg

SEQ ID NO: 379454 - DNA, 140 bp, Artificial Sequence
  Synthetic
caccgctgtcccaaaaggtctgccgatcccactgctgccatagtgctgcctcgaaattcccacctttatcgctgtgtaagcgttgatatacctccagaactgactctgattggtcttgaccatatcagcagccagggcct

SEQ ID NO: 379455 - DNA, 140 bp, Artificial Sequence
  Synthetic
atacgccatgctgggtctcccatgtgagagttcatctgttgttatttcaggtttgagaatgctgataccccagtcggaagccactgaggttgtaaccccctccgaaacctgcacatggtccgtacttgggagtcggccat

SEQ ID NO: 379456 - DNA, 140 bp, Artificial Sequence
  Synthetic
atggccgactcccaagtacggaccatgtgcaggtttcggagggggttacaacctcagtggcttccgactggggtatcagcattctcaaacctgaaataacaacagatgaactctcacatgggagacccagcatggcgtat

SEQ ID NO: 379457 - DNA, 140 bp, Artificial Sequence
  Synthetic
aggccctggctgctgatatgcagtcggaagccactgaggttgtaaccccctccgaaacctgcacatggtcagaaggaggaagttcccattgaagccccaaatcacaaggcgagctaaaaagaccttttgggacagcggtg

SEQ ID NO: 379458 - DNA, 140 bp, Artificial Sequence
  Synthetic
caccgctgtcccaaaaggtctttttagctcgccttgtgatttggggcttcaatgggaacttcctccttctgaccatgtgcaggtttcggagggggttacaacctcagtggcttccgactgcatatcagcagccagggcct

SEQ ID NO: 379459 - DNA, 140 bp, Artificial Sequence
  Synthetic
atacgccatgctgggtctcctaaatggtgatttcaggaagattagtgtttgccctcaaaatcagatccgagcaataatcatctactctacagccagttaatttctaatataaaggttaaacgtacttgggagtcggccat

SEQ ID NO: 379460 - DNA, 140 bp, Artificial Sequence
  Synthetic
atggccgactcccaagtacgtttaacctttatattagaaattaactggctgtagagtagatgattattgctcggatctgattttgagggcaaacactaatcttcctgaaatcaccatttaggagacccagcatggcgtat

SEQ ID NO: 379461 - DNA, 140 bp, Artificial Sequence
  Synthetic
aggccctggctgctgatatggcaataatcatctactctacagccagttaatttctaatataaaggttaaaaaaatgctgcaggccagctattgttccacaggtcccaattcttcttgttagaccttttgggacagcggtg

SEQ ID NO: 379462 - DNA, 140 bp, Artificial Sequence
  Synthetic
caccgctgtcccaaaaggtctaacaagaagaattgggacctgtggaacaatagctggcctgcagcatttttttaacctttatattagaaattaactggctgtagagtagatgattattgccatatcagcagccagggcct

SEQ ID NO: 379463 - DNA, 140 bp, Artificial Sequence
  Synthetic
atacgccatgctgggtctccaatgccaccaacttaattctaagattttgtatatctcggaaattcaaaattaaatgctacgttattgattcaattaagaaaaagacaatggaccatcaaacgtacttgggagtcggccat

SEQ ID NO: 379464 - DNA, 140 bp, Artificial Sequence
  Synthetic
atggccgactcccaagtacgtttgatggtccattgtctttttcttaattgaatcaataacgtagcatttaattttgaatttccgagatatacaaaatcttagaattaagttggtggcattggagacccagcatggcgtat

SEQ ID NO: 379465 - DNA, 140 bp, Artificial Sequence
  Synthetic
aggccctggctgctgatatgtaaatgctacgttattgattcaattaagaaaaagacaatggaccatcaaaattagttcaatacctgaactaatgcacttatagaaacaggagaaccagccgaccttttgggacagcggtg

SEQ ID NO: 379466 - DNA, 140 bp, Artificial Sequence
  Synthetic
caccgctgtcccaaaaggtcggctggttctcctgtttctataagtgcattagttcaggtattgaactaattttgatggtccattgtctttttcttaattgaatcaataacgtagcatttacatatcagcagccagggcct

SEQ ID NO: 379467 - DNA, 140 bp, Artificial Sequence
  Synthetic
atacgccatgctgggtctccgttcgttaattcaaaaacaaatgatgaagattaatgcagatgtctaaaggataaacactccatgcatcagtgttataattgggctctgtagaaaatcttccgtacttgggagtcggccat

SEQ ID NO: 379468 - DNA, 140 bp, Artificial Sequence
  Synthetic
atggccgactcccaagtacggaagattttctacagagcccaattataacactgatgcatggagtgtttatcctttagacatctgcattaatcttcatcatttgtttttgaattaacgaacggagacccagcatggcgtat

SEQ ID NO: 379469 - DNA, 140 bp, Artificial Sequence
  Synthetic
aggccctggctgctgatatgataaacactccatgcatcagtgttataattgggctctgtagaaaatcttcatctcctccaacctacctcaaagaaggattttaccgcgattgggagttatgaccttttgggacagcggtg

SEQ ID NO: 379470 - DNA, 140 bp, Artificial Sequence
  Synthetic
caccgctgtcccaaaaggtcataactcccaatcgcggtaaaatccttctttgaggtaggttggaggagatgaagattttctacagagcccaattataacactgatgcatggagtgtttatcatatcagcagccagggcct

SEQ ID NO: 379471 - DNA, 140 bp, Artificial Sequence
  Synthetic
atacgccatgctgggtctccacacagcattttatcttgcaacgtcgacattcccatcaatctgaggagtaacagctatcaaaacaacgcatatgtagacattgtcggtaatagtactgcccgtacttgggagtcggccat

SEQ ID NO: 379472 - DNA, 140 bp, Artificial Sequence
  Synthetic
atggccgactcccaagtacgggcagtactattaccgacaatgtctacatatgcgttgttttgatagctgttactcctcagattgatgggaatgtcgacgttgcaagataaaatgctgtgtggagacccagcatggcgtat

SEQ ID NO: 379473 - DNA, 140 bp, Artificial Sequence
  Synthetic
aggccctggctgctgatatgacagctatcaaaacaacgcatatgtagacattgtcggtaatagtactgcctaagacaactatttataataacagttggaattcattttttcacccaagctgaccttttgggacagcggtg

SEQ ID NO: 379474 - DNA, 140 bp, Artificial Sequence
  Synthetic
caccgctgtcccaaaaggtcagcttgggtgaaaaaatgaattccaactgttattataaatagttgtcttaggcagtactattaccgacaatgtctacatatgcgttgttttgatagctgtcatatcagcagccagggcct

SEQ ID NO: 379475 - DNA, 140 bp, Artificial Sequence
  Synthetic
atacgccatgctgggtctccacgtaacataagaaaagaacaacccttgacccagagtgaacaagctcatactatcaaggctaatcctcgggcctgcctggagtccacaatggccaaggctcgtacttgggagtcggccat

SEQ ID NO: 379476 - DNA, 140 bp, Artificial Sequence
  Synthetic
atggccgactcccaagtacgagccttggccattgtggactccaggcaggcccgaggattagccttgatagtatgagcttgttcactctgggtcaagggttgttcttttcttatgttacgtggagacccagcatggcgtat

SEQ ID NO: 379477 - DNA, 140 bp, Artificial Sequence
  Synthetic
aggccctggctgctgatatgctatcaaggctaatcctcgggcctgcctggagtccacaatggccaaggctactgggaggtacaaccttatctccccaaagaaagatcttgaaaaagggctgaccttttgggacagcggtg

SEQ ID NO: 379478 - DNA, 140 bp, Artificial Sequence
  Synthetic
caccgctgtcccaaaaggtcagccctttttcaagatctttctttggggagataaggttgtacctcccagtagccttggccattgtggactccaggcaggcccgaggattagccttgatagcatatcagcagccagggcct

SEQ ID NO: 379479 - DNA, 140 bp, Artificial Sequence
  Synthetic
atacgccatgctgggtctccggaaggttacctgggctgggattgaatttgatgttacacagaaagggatggccttattgcacaggctcaagaccagtgattttgctccagcctggtcaatcgtacttgggagtcggccat

SEQ ID NO: 379480 - DNA, 140 bp, Artificial Sequence
  Synthetic
atggccgactcccaagtacgattgaccaggctggagcaaaatcactggtcttgagcctgtgcaataaggccatccctttctgtgtaacatcaaattcaatcccagcccaggtaaccttccggagacccagcatggcgtat

SEQ ID NO: 379481 - DNA, 140 bp, Artificial Sequence
  Synthetic
aggccctggctgctgatatggccttattgcacaggctcaagaccagtgattttgctccagcctggtcaatgaccaggaacttatttccacatctctttcaaaacccgaactctacaattggaccttttgggacagcggtg

SEQ ID NO: 379482 - DNA, 140 bp, Artificial Sequence
  Synthetic
caccgctgtcccaaaaggtccaattgtagagttcgggttttgaaagagatgtggaaataagttcctggtcattgaccaggctggagcaaaatcactggtcttgagcctgtgcaataaggccatatcagcagccagggcct

SEQ ID NO: 379483 - DNA, 140 bp, Artificial Sequence
  Synthetic
atacgccatgctgggtctcccagctaattgatcaatcgttgatcgaacccttggcaggagcgctaggcttaattgctgattggcttcttactactggaacaaaccactttcaaatgcgcacgtacttgggagtcggccat

SEQ ID NO: 379484 - DNA, 140 bp, Artificial Sequence
  Synthetic
atggccgactcccaagtacgtgcgcatttgaaagtggtttgttccagtagtaagaagccaatcagcaattaagcctagcgctcctgccaagggttcgatcaacgattgatcaattagctgggagacccagcatggcgtat

SEQ ID NO: 379485 - DNA, 140 bp, Artificial Sequence
  Synthetic
aggccctggctgctgatatgaattgctgattggcttcttactactggaacaaaccactttcaaatgcgcacacaacaggctaaggagcaactaagtctaaaaatgttgtccctggtgcgagaccttttgggacagcggtg

SEQ ID NO: 379486 - DNA, 140 bp, Artificial Sequence
  Synthetic
caccgctgtcccaaaaggtctcgcaccagggacaacatttttagacttagttgctccttagcctgttgtgtgcgcatttgaaagtggtttgttccagtagtaagaagccaatcagcaattcatatcagcagccagggcct

SEQ ID NO: 379487 - DNA, 140 bp, Artificial Sequence
  Synthetic
atacgccatgctgggtctccttacaatggacttctcagtagcattgaaattggcaccaaaagccatacaattataattacccggacaaatatgggttttttggtagagttgcaagagcctcgtacttgggagtcggccat

SEQ ID NO: 379488 - DNA, 140 bp, Artificial Sequence
  Synthetic
atggccgactcccaagtacgaggctcttgcaactctaccaaaaaacccatatttgtccgggtaattataattgtatggcttttggtgccaatttcaatgctactgagaagtccattgtaaggagacccagcatggcgtat

SEQ ID NO: 379489 - DNA, 140 bp, Artificial Sequence
  Synthetic
aggccctggctgctgatatgttataattacccggacaaatatgggttttttggtagagttgcaagagcctgacaaatcagccatgaacaccagaaaaccaggaccagtcaaattctccctgaccttttgggacagcggtg

SEQ ID NO: 379490 - DNA, 140 bp, Artificial Sequence
  Synthetic
caccgctgtcccaaaaggtcagggagaatttgactggtcctggttttctggtgttcatggctgatttgtcaggctcttgcaactctaccaaaaaacccatatttgtccgggtaattataacatatcagcagccagggcct

SEQ ID NO: 379491 - DNA, 140 bp, Artificial Sequence
  Synthetic
atacgccatgctgggtctcctgcaagcactaatcttagaattcaatagttctctcgctatttaactcaactcatcaaaatgctaacttgtgatccttaagctgcaccttagacttttgatcgtacttgggagtcggccat

SEQ ID NO: 379492 - DNA, 140 bp, Artificial Sequence
  Synthetic
atggccgactcccaagtacgatcaaaagtctaaggtgcagcttaaggatcacaagttagcattttgatgagttgagttaaatagcgagagaactattgaattctaagattagtgcttgcaggagacccagcatggcgtat

SEQ ID NO: 379493 - DNA, 140 bp, Artificial Sequence
  Synthetic
aggccctggctgctgatatgtcatcaaaatgctaacttgtgatccttaagctgcaccttagacttttgataagaatactaactattgatgattgtctttgacatgaggataagaacactggaccttttgggacagcggtg

SEQ ID NO: 379494 - DNA, 140 bp, Artificial Sequence
  Synthetic
caccgctgtcccaaaaggtccagtgttcttatcctcatgtcaaagacaatcatcaatagttagtattcttatcaaaagtctaaggtgcagcttaaggatcacaagttagcattttgatgacatatcagcagccagggcct

SEQ ID NO: 379495 - DNA, 140 bp, Artificial Sequence
  Synthetic
atacgccatgctgggtctcctaacagcagttagatccctcaagtatatcaagttcattctaccctttgcattgtcactctaattaaatcacctgatacaattatgttaattagctagattcgtacttgggagtcggccat

SEQ ID NO: 379496 - DNA, 140 bp, Artificial Sequence
  Synthetic
atggccgactcccaagtacgaatctagctaattaacataattgtatcaggtgatttaattagagtgacaatgcaaagggtagaatgaacttgatatacttgagggatctaactgctgttaggagacccagcatggcgtat

SEQ ID NO: 379497 - DNA, 140 bp, Artificial Sequence
  Synthetic
aggccctggctgctgatatgttgtcactctaattaaatcacctgatacaattatgttaattagctagattctctcatttttagacttgtttgctagaataattgatcatccacttgattagaccttttgggacagcggtg

SEQ ID NO: 379498 - DNA, 140 bp, Artificial Sequence
  Synthetic
caccgctgtcccaaaaggtctaatcaagtggatgatcaattattctagcaaacaagtctaaaaatgagagaatctagctaattaacataattgtatcaggtgatttaattagagtgacaacatatcagcagccagggcct

SEQ ID NO: 379499 - DNA, 140 bp, Artificial Sequence
  Synthetic
atacgccatgctgggtctcctactaatgacaaagagattagattagctatagcttgaggaagattaagaaaaagtgtctgtggggtctttccgtgtagaagggcacacagccataattctcgtacttgggagtcggccat

SEQ ID NO: 379500 - DNA, 140 bp, Artificial Sequence
  Synthetic
atggccgactcccaagtacgagaattatggctgtgtgcccttctacacggaaagaccccacagacactttttcttaatcttcctcaagctatagctaatctaatctctttgtcattagtaggagacccagcatggcgtat

SEQ ID NO: 379501 - DNA, 140 bp, Artificial Sequence
  Synthetic
aggccctggctgctgatatgaaagtgtctgtggggtctttccgtgtagaagggcacacagccataattcttcctctttatacaacatggctacacaacatacgcaatatccagacgcaaggaccttttgggacagcggtg

SEQ ID NO: 379502 - DNA, 140 bp, Artificial Sequence
  Synthetic
caccgctgtcccaaaaggtccttgcgtctggatattgcgtatgttgtgtagccatgttgtataaagaggaagaattatggctgtgtgcccttctacacggaaagaccccacagacactttcatatcagcagccagggcct

SEQ ID NO: 379503 - DNA, 140 bp, Artificial Sequence
  Synthetic
atacgccatgctgggtctccgtggattgtattccgcatactccttaaatccccaactaaagaactgtagactaccgaaacatatataccgactaaaatatgacaccactgttacagagttcgtacttgggagtcggccat

SEQ ID NO: 379504 - DNA, 140 bp, Artificial Sequence
  Synthetic
atggccgactcccaagtacgaactctgtaacagtggtgtcatattttagtcggtatatatgtttcggtagtctacagttctttagttggggatttaaggagtatgcggaatacaatccacggagacccagcatggcgtat

SEQ ID NO: 379505 - DNA, 140 bp, Artificial Sequence
  Synthetic
aggccctggctgctgatatgctaccgaaacatatataccgactaaaatatgacaccactgttacagagtttttgagtgatgtgccggtagcaacattgccagcggattttttagtacctagaccttttgggacagcggtg

SEQ ID NO: 379506 - DNA, 140 bp, Artificial Sequence
  Synthetic
caccgctgtcccaaaaggtctaggtactaaaaaatccgctggcaatgttgctaccggcacatcactcaaaaactctgtaacagtggtgtcatattttagtcggtatatatgtttcggtagcatatcagcagccagggcct

SEQ ID NO: 379507 - DNA, 140 bp, Artificial Sequence
  Synthetic
atacgccatgctgggtctcctgcagtcaatttttagaagaaattgtcaattatactctacaagatattcgcttcctaaactattacctcaatcgagccggagtgcataacgatcatgtggcgtacttgggagtcggccat

SEQ ID NO: 379508 - DNA, 140 bp, Artificial Sequence
  Synthetic
atggccgactcccaagtacgccacatgatcgttatgcactccggctcgattgaggtaatagtttaggaagcgaatatcttgtagagtataattgacaatttcttctaaaaattgactgcaggagacccagcatggcgtat

SEQ ID NO: 379509 - DNA, 140 bp, Artificial Sequence
  Synthetic
aggccctggctgctgatatgcttcctaaactattacctcaatcgagccggagtgcataacgatcatgtggatagggattttggacaaaaaattcgcaatctaatttgcgacaatgaggttgaccttttgggacagcggtg

SEQ ID NO: 379510 - DNA, 140 bp, Artificial Sequence
  Synthetic
caccgctgtcccaaaaggtcaacctcattgtcgcaaattagattgcgaattttttgtccaaaatccctatccacatgatcgttatgcactccggctcgattgaggtaatagtttaggaagcatatcagcagccagggcct

SEQ ID NO: 379511 - DNA, 140 bp, Artificial Sequence
  Synthetic
atacgccatgctgggtctccgcgactaaatagagggaataatcgctcaacatggtttgcaagtgataatttggtagatatcctaggttatggagattatattttttggaaaataccattacgtacttgggagtcggccat

SEQ ID NO: 379512 - DNA, 140 bp, Artificial Sequence
  Synthetic
atggccgactcccaagtacgtaatggtattttccaaaaaatataatctccataacctaggatatctaccaaattatcacttgcaaaccatgttgagcgattattccctctatttagtcgcggagacccagcatggcgtat

SEQ ID NO: 379513 - DNA, 140 bp, Artificial Sequence
  Synthetic
aggccctggctgctgatatgtggtagatatcctaggttatggagattatattttttggaaaataccattatcactactaccagtggatacacaaggcctcccacatgcagccaaggactggaccttttgggacagcggtg

SEQ ID NO: 379514 - DNA, 140 bp, Artificial Sequence
  Synthetic
caccgctgtcccaaaaggtccagtccttggctgcatgtgggaggccttgtgtatccactggtagtagtgataatggtattttccaaaaaatataatctccataacctaggatatctaccacatatcagcagccagggcct

SEQ ID NO: 379515 - DNA, 140 bp, Artificial Sequence
  Synthetic
atacgccatgctgggtctcctgtccatctctacagcagatgtcttaatcatgtgtaaggacataatcacctgtcgatttaatactttactgattgctgctgtggcaaatctagaggattccgtacttgggagtcggccat

SEQ ID NO: 379516 - DNA, 140 bp, Artificial Sequence
  Synthetic
atggccgactcccaagtacggaatcctctagatttgccacagcagcaatcagtaaagtattaaatcgacaggtgattatgtccttacacatgattaagacatctgctgtagagatggacaggagacccagcatggcgtat

SEQ ID NO: 379517 - DNA, 140 bp, Artificial Sequence
  Synthetic
aggccctggctgctgatatgtgtcgatttaatactttactgattgctgctgtggcaaatctagaggattcagttcattcagattaccctttaccagaaacagtgtctgacctatacaaaggaccttttgggacagcggtg

SEQ ID NO: 379518 - DNA, 140 bp, Artificial Sequence
  Synthetic
caccgctgtcccaaaaggtcctttgtataggtcagacactgtttctggtaaagggtaatctgaatgaactgaatcctctagatttgccacagcagcaatcagtaaagtattaaatcgacacatatcagcagccagggcct

SEQ ID NO: 379519 - DNA, 140 bp, Artificial Sequence
  Synthetic
atacgccatgctgggtctccaaattccttgagccgttatgcttagcaaagatccaactctgctcaaattacactgagaggaaaggaagattcctcactcaaatgcatttagctgtaaatccgtacttgggagtcggccat

SEQ ID NO: 379520 - DNA, 140 bp, Artificial Sequence
  Synthetic
atggccgactcccaagtacggatttacagctaaatgcatttgagtgaggaatcttcctttcctctcagtgtaatttgagcagagttggatctttgctaagcataacggctcaaggaatttggagacccagcatggcgtat

SEQ ID NO: 379521 - DNA, 140 bp, Artificial Sequence
  Synthetic
aggccctggctgctgatatgcactgagaggaaaggaagattcctcactcaaatgcatttagctgtaaatcatacacttgaggaacttacagggtcccgagaattaaggccacaacagattgaccttttgggacagcggtg

SEQ ID NO: 379522 - DNA, 140 bp, Artificial Sequence
  Synthetic
caccgctgtcccaaaaggtcaatctgttgtggccttaattctcgggaccctgtaagttcctcaagtgtatgatttacagctaaatgcatttgagtgaggaatcttcctttcctctcagtgcatatcagcagccagggcct

SEQ ID NO: 379523 - DNA, 140 bp, Artificial Sequence
  Synthetic
atacgccatgctgggtctcctcaacaactctgtgagttgttttcagtgcaaaagcattgggggcaccctgtcttgcatagcgaaaaggctatccaaaaagtaaagaagcatgcaacagtgcgtacttgggagtcggccat

SEQ ID NO: 379524 - DNA, 140 bp, Artificial Sequence
  Synthetic
atggccgactcccaagtacgcactgttgcatgcttctttactttttggatagccttttcgctatgcaagacagggtgcccccaatgcttttgcactgaaaacaactcacagagttgttgaggagacccagcatggcgtat

SEQ ID NO: 379525 - DNA, 140 bp, Artificial Sequence
  Synthetic
aggccctggctgctgatatgtcttgcatagcgaaaaggctatccaaaaagtaaagaagcatgcaacagtgataaaagcattgcgcccaataataatctttgaaacatattgtgtgtttaagaccttttgggacagcggtg

SEQ ID NO: 379526 - DNA, 140 bp, Artificial Sequence
  Synthetic
caccgctgtcccaaaaggtcttaaacacacaatatgtttcaaagattattattgggcgcaatgcttttatcactgttgcatgcttctttactttttggatagccttttcgctatgcaagacatatcagcagccagggcct

SEQ ID NO: 379527 - DNA, 140 bp, Artificial Sequence
  Synthetic
atacgccatgctgggtctcctgacttctgacagatgcttaacaccaggcctttcctcttacatcaaaagaaaccaatttcctccactacctatgatcaaagaacttttgtgggaattttacgtacttgggagtcggccat

SEQ ID NO: 379528 - DNA, 140 bp, Artificial Sequence
  Synthetic
atggccgactcccaagtacgtaaaattcccacaaaagttctttgatcataggtagtggaggaaattggtttcttttgatgtaagaggaaaggcctggtgttaagcatctgtcagaagtcaggagacccagcatggcgtat

SEQ ID NO: 379529 - DNA, 140 bp, Artificial Sequence
  Synthetic
aggccctggctgctgatatgaaccaatttcctccactacctatgatcaaagaacttttgtgggaattttatcacttagatcatcctccgttattctccaccaaagtgattagtgatttgagaccttttgggacagcggtg

SEQ ID NO: 379530 - DNA, 140 bp, Artificial Sequence
  Synthetic
caccgctgtcccaaaaggtctcaaatcactaatcactttggtggagaataacggaggatgatctaagtgataaaattcccacaaaagttctttgatcataggtagtggaggaaattggttcatatcagcagccagggcct

SEQ ID NO: 379531 - DNA, 140 bp, Artificial Sequence
  Synthetic
atacgccatgctgggtctccgcagtttttgaacccaatgttcttggttataacccaccgaataaatttgctacaaaaagggtacctgagcaattccttgaacaggagaatttctcaatagcgtacttgggagtcggccat

SEQ ID NO: 379532 - DNA, 140 bp, Artificial Sequence
  Synthetic
atggccgactcccaagtacgctattgagaaattctcctgttcaaggaattgctcaggtaccctttttgtagcaaatttattcggtgggttataaccaagaacattgggttcaaaaactgcggagacccagcatggcgtat

SEQ ID NO: 379533 - DNA, 140 bp, Artificial Sequence
  Synthetic
aggccctggctgctgatatgtacaaaaagggtacctgagcaattccttgaacaggagaatttctcaatagagagtgtcctacattatgctcaacgtctggaatatcttctcccggagtacgaccttttgggacagcggtg

SEQ ID NO: 379534 - DNA, 140 bp, Artificial Sequence
  Synthetic
caccgctgtcccaaaaggtcgtactccgggagaagatattccagacgttgagcataatgtaggacactctctattgagaaattctcctgttcaaggaattgctcaggtaccctttttgtacatatcagcagccagggcct

SEQ ID NO: 379535 - DNA, 140 bp, Artificial Sequence
  Synthetic
atacgccatgctgggtctccttttgggaaattgccatatccaacacgcaatgttcaaactctgtgcgaagctttgttagcagatggtttggcgaaagcattcccaagcaatatgatggttcgtacttgggagtcggccat

SEQ ID NO: 379536 - DNA, 140 bp, Artificial Sequence
  Synthetic
atggccgactcccaagtacgaaccatcatattgcttgggaatgctttcgccaaaccatctgctaacaaagcttcgcacagagtttgaacattgcgtgttggatatggcaatttcccaaaaggagacccagcatggcgtat

SEQ ID NO: 379537 - DNA, 140 bp, Artificial Sequence
  Synthetic
aggccctggctgctgatatgctttgttagcagatggtttggcgaaagcattcccaagcaatatgatggttgtgacagagcgcgagcaaaaagaaagccttttgcatcaagcgtcttggcagaccttttgggacagcggtg

SEQ ID NO: 379538 - DNA, 140 bp, Artificial Sequence
  Synthetic
caccgctgtcccaaaaggtctgccaagacgcttgatgcaaaaggctttctttttgctcgcgctctgtcacaaccatcatattgcttgggaatgctttcgccaaaccatctgctaacaaagcatatcagcagccagggcct

SEQ ID NO: 379539 - DNA, 140 bp, Artificial Sequence
  Synthetic
atacgccatgctgggtctccttgtaacagacttggaaaaatacaatttagcattccgatatgagtttacagctccttttattgaatactgtaatcgttgttacggtgtaagaaatttgttcgtacttgggagtcggccat

SEQ ID NO: 379540 - DNA, 140 bp, Artificial Sequence
  Synthetic
atggccgactcccaagtacgaacaaatttcttacaccgtaacaacgattacagtattcaataaaaggagctgtaaactcatatcggaatgctaaattgtatttttccaagtctgttacaaggagacccagcatggcgtat

SEQ ID NO: 379541 - DNA, 140 bp, Artificial Sequence
  Synthetic
aggccctggctgctgatatggctccttttattgaatactgtaatcgttgttacggtgtaagaaatttgtttaattggatgcactacactataccacagtgttatatacatgtgagtgattgaccttttgggacagcggtg

SEQ ID NO: 379542 - DNA, 140 bp, Artificial Sequence
  Synthetic
caccgctgtcccaaaaggtcaatcactcacatgtatataacactgtggtatagtgtagtgcatccaattaaacaaatttcttacaccgtaacaacgattacagtattcaataaaaggagccatatcagcagccagggcct

SEQ ID NO: 379543 - DNA, 140 bp, Artificial Sequence
  Synthetic
atacgccatgctgggtctccgaaggtccaagctcttaccgtggtcatctaggcgggattgagggacttcaacaaaaactctggacaagcatctcatgtgcacagatttcattagttgaaacgtacttgggagtcggccat

SEQ ID NO: 379544 - DNA, 140 bp, Artificial Sequence
  Synthetic
atggccgactcccaagtacgtttcaactaatgaaatctgtgcacatgagatgcttgtccagagtttttgttgaagtccctcaatcccgcctagatgaccacggtaagagcttggaccttcggagacccagcatggcgtat

SEQ ID NO: 379545 - DNA, 140 bp, Artificial Sequence
  Synthetic
aggccctggctgctgatatgacaaaaactctggacaagcatctcatgtgcacagatttcattagttgaaatcaaaaccggttttaaactgcgatctgcggtaatgggtgacaatcaatgtgaccttttgggacagcggtg

SEQ ID NO: 379546 - DNA, 140 bp, Artificial Sequence
  Synthetic
caccgctgtcccaaaaggtcacattgattgtcacccattaccgcagatcgcagtttaaaaccggttttgatttcaactaatgaaatctgtgcacatgagatgcttgtccagagtttttgtcatatcagcagccagggcct

SEQ ID NO: 379547 - DNA, 140 bp, Artificial Sequence
  Synthetic
atacgccatgctgggtctccattaagttctgaagataatgccgctagagtagctgctagcttagcaaaagtcacaagtgcctgcggcatctttttaaaacctgatgaaacttttgttcaccgtacttgggagtcggccat

SEQ ID NO: 379548 - DNA, 140 bp, Artificial Sequence
  Synthetic
atggccgactcccaagtacggtgaacaaaagtttcatcaggttttaaaaagatgccgcaggcacttgtgacttttgctaagctagcagctactctagcggcattatcttcagaacttaatggagacccagcatggcgtat

SEQ ID NO: 379549 - DNA, 140 bp, Artificial Sequence
  Synthetic
aggccctggctgctgatatgtcacaagtgcctgcggcatctttttaaaacctgatgaaacttttgttcactcaggtttcatttattttggcaaaaaacaatatttgaatggagtacaattgaccttttgggacagcggtg

SEQ ID NO: 379550 - DNA, 140 bp, Artificial Sequence
  Synthetic
caccgctgtcccaaaaggtcaattgtactccattcaaatattgttttttgccaaaataaatgaaacctgagtgaacaaaagtttcatcaggttttaaaaagatgccgcaggcacttgtgacatatcagcagccagggcct

SEQ ID NO: 379551 - DNA, 140 bp, Artificial Sequence
  Synthetic
atacgccatgctgggtctcctctttgatgatcttcaagggacactagctagcataggcacggcttttgaaagatctatctccgaaactaggcacgtagtcccttgtagagtagcagctgccgtacttgggagtcggccat

SEQ ID NO: 379552 - DNA, 140 bp, Artificial Sequence
  Synthetic
atggccgactcccaagtacggcagctgctactctacaagggactacgtgcctagtttcggagatagatctttcaaaagccgtgcctatgctagctagtgtcccttgaagatcatcaaagaggagacccagcatggcgtat

SEQ ID NO: 379553 - DNA, 140 bp, Artificial Sequence
  Synthetic
aggccctggctgctgatatgagatctatctccgaaactaggcacgtagtcccttgtagagtagcagctgcattccatacctttttttccgtaagaatcttacaatatcatcatcttggctgaccttttgggacagcggtg

SEQ ID NO: 379554 - DNA, 140 bp, Artificial Sequence
  Synthetic
caccgctgtcccaaaaggtcagccaagatgatgatattgtaagattcttacggaaaaaaaggtatggaatgcagctgctactctacaagggactacgtgcctagtttcggagatagatctcatatcagcagccagggcct

SEQ ID NO: 379555 - DNA, 140 bp, Artificial Sequence
  Synthetic
atacgccatgctgggtctcctttggaactataactttggccttggcagtaccacaagtcttgggtggcttatcattcctaaatccagaaaaatgtttttatagaaatctgggtgatcctgcgtacttgggagtcggccat

SEQ ID NO: 379556 - DNA, 140 bp, Artificial Sequence
  Synthetic
atggccgactcccaagtacgcaggatcacccagatttctataaaaacatttttctggatttaggaatgataagccacccaagacttgtggtactgccaaggccaaagttatagttccaaaggagacccagcatggcgtat

SEQ ID NO: 379557 - DNA, 140 bp, Artificial Sequence
  Synthetic
aggccctggctgctgatatgatcattcctaaatccagaaaaatgtttttatagaaatctgggtgatcctgttacttcagggctgtttcagctcaagacatatcttcaaatgatccacatggaccttttgggacagcggtg

SEQ ID NO: 379558 - DNA, 140 bp, Artificial Sequence
  Synthetic
caccgctgtcccaaaaggtccatgtggatcatttgaagatatgtcttgagctgaaacagccctgaagtaacaggatcacccagatttctataaaaacatttttctggatttaggaatgatcatatcagcagccagggcct

SEQ ID NO: 379559 - DNA, 140 bp, Artificial Sequence
  Synthetic
atacgccatgctgggtctccaattgactttgtgttaaaccctagtgggttaaacgtaccggggtcacaggatttgacatccttcctacgtcagatagtgcgccgaacaattactctaagtcgtacttgggagtcggccat

SEQ ID NO: 379560 - DNA, 140 bp, Artificial Sequence
  Synthetic
atggccgactcccaagtacgacttagagtaattgttcggcgcactatctgacgtaggaaggatgtcaaatcctgtgaccccggtacgtttaacccactagggtttaacacaaagtcaattggagacccagcatggcgtat

SEQ ID NO: 379561 - DNA, 140 bp, Artificial Sequence
  Synthetic
aggccctggctgctgatatgatttgacatccttcctacgtcagatagtgcgccgaacaattactctaagtgctaaaaataaattaataaacactttgttccattcttctgctgatttagagaccttttgggacagcggtg

SEQ ID NO: 379562 - DNA, 140 bp, Artificial Sequence
  Synthetic
caccgctgtcccaaaaggtctctaaatcagcagaagaatggaacaaagtgtttattaatttatttttagcacttagagtaattgttcggcgcactatctgacgtaggaaggatgtcaaatcatatcagcagccagggcct

SEQ ID NO: 379563 - DNA, 140 bp, Artificial Sequence
  Synthetic
atacgccatgctgggtctccggtttgccgccgatatattttctcgcactcccagtgggaaacgtttacagatcttaggttaccttgaagggactagaacattgttagcctctaaaattatcgtacttgggagtcggccat

SEQ ID NO: 379564 - DNA, 140 bp, Artificial Sequence
  Synthetic
atggccgactcccaagtacgataattttagaggctaacaatgttctagtcccttcaaggtaacctaagatctgtaaacgtttcccactgggagtgcgagaaaatatatcggcggcaaaccggagacccagcatggcgtat

SEQ ID NO: 379565 - DNA, 140 bp, Artificial Sequence
  Synthetic
aggccctggctgctgatatgatcttaggttaccttgaagggactagaacattgttagcctctaaaattataaatcataatactgagacacctatcctagatcgattgaggaaaattacgcgaccttttgggacagcggtg

SEQ ID NO: 379566 - DNA, 140 bp, Artificial Sequence
  Synthetic
caccgctgtcccaaaaggtcgcgtaattttcctcaatcgatctaggataggtgtctcagtattatgatttataattttagaggctaacaatgttctagtcccttcaaggtaacctaagatcatatcagcagccagggcct

SEQ ID NO: 379567 - DNA, 140 bp, Artificial Sequence
  Synthetic
atacgccatgctgggtctccctggctgatgccctaactcagataacctgcactgtggacttagcacagattcttcgcgagtacacctgggcacacatactagagggaaggcagctcattgcgtacttgggagtcggccat

SEQ ID NO: 379568 - DNA, 140 bp, Artificial Sequence
  Synthetic
atggccgactcccaagtacgcaatgagctgccttccctctagtatgtgtgcccaggtgtactcgcgaagaatctgtgctaagtccacagtgcaggttatctgagttagggcatcagccagggagacccagcatggcgtat

SEQ ID NO: 379569 - DNA, 140 bp, Artificial Sequence
  Synthetic
aggccctggctgctgatatgtcttcgcgagtacacctgggcacacatactagagggaaggcagctcattggagcaacacttccttgtatactagaacaactaaatgtcatctggctcaaagaccttttgggacagcggtg

SEQ ID NO: 379570 - DNA, 140 bp, Artificial Sequence
  Synthetic
caccgctgtcccaaaaggtctttgagccagatgacatttagttgttctagtatacaaggaagtgttgctccaatgagctgccttccctctagtatgtgtgcccaggtgtactcgcgaagacatatcagcagccagggcct

SEQ ID NO: 379571 - DNA, 140 bp, Artificial Sequence
  Synthetic
atacgccatgctgggtctccaccttttgtttctattgcaattaaaaaacatgtagtaagtgcttggcctgatcaatcacgacttagttggacaattggagatggcatcccttatatcggacgtacttgggagtcggccat

SEQ ID NO: 379572 - DNA, 140 bp, Artificial Sequence
  Synthetic
atggccgactcccaagtacgtccgatataagggatgccatctccaattgtccaactaagtcgtgattgatcaggccaagcacttactacatgttttttaattgcaatagaaacaaaaggtggagacccagcatggcgtat

SEQ ID NO: 379573 - DNA, 140 bp, Artificial Sequence
  Synthetic
aggccctggctgctgatatgatcaatcacgacttagttggacaattggagatggcatcccttatatcggatctcgaacagaggataagattgggcagccagccatcaaaccaaaatgcccgaccttttgggacagcggtg

SEQ ID NO: 379574 - DNA, 140 bp, Artificial Sequence
  Synthetic
caccgctgtcccaaaaggtcgggcattttggtttgatggctggctgcccaatcttatcctctgttcgagatccgatataagggatgccatctccaattgtccaactaagtcgtgattgatcatatcagcagccagggcct

SEQ ID NO: 379575 - DNA, 140 bp, Artificial Sequence
  Synthetic
atacgccatgctgggtctccttactcaaggtggagcaaacagcgacttactagttaaacccttcatagaagcacgagtaaatttaagcgtacaggaaattctccaaatgacaccttctcacgtacttgggagtcggccat

SEQ ID NO: 379576 - DNA, 140 bp, Artificial Sequence
  Synthetic
atggccgactcccaagtacgtgagaaggtgtcatttggagaatttcctgtacgcttaaatttactcgtgcttctatgaagggtttaactagtaagtcgctgtttgctccaccttgagtaaggagacccagcatggcgtat

SEQ ID NO: 379577 - DNA, 140 bp, Artificial Sequence
  Synthetic
aggccctggctgctgatatggcacgagtaaatttaagcgtacaggaaattctccaaatgacaccttctcattactccggcaacattgtgcatcgatataatgatcaatatagtccacactgaccttttgggacagcggtg

SEQ ID NO: 379578 - DNA, 140 bp, Artificial Sequence
  Synthetic
caccgctgtcccaaaaggtcagtgtggactatattgatcattatatcgatgcacaatgttgccggagtaatgagaaggtgtcatttggagaatttcctgtacgcttaaatttactcgtgccatatcagcagccagggcct

SEQ ID NO: 379579 - DNA, 140 bp, Artificial Sequence
  Synthetic
atacgccatgctgggtctccacaaacactcttggagaattttcaggaggaggtcagtcagcaagagatagtaatattatcttccagaatgtcattaattttgctgttgcactttttgatccgtacttgggagtcggccat

SEQ ID NO: 379580 - DNA, 140 bp, Artificial Sequence
  Synthetic
atggccgactcccaagtacggatcaaaaagtgcaacagcaaaattaatgacattctggaagataatattactatctcttgctgactgacctcctcctgaaaattctccaagagtgtttgtggagacccagcatggcgtat

SEQ ID NO: 379581 - DNA, 140 bp, Artificial Sequence
  Synthetic
aggccctggctgctgatatgtaatattatcttccagaatgtcattaattttgctgttgcactttttgatctacgatttaggaacgtggctacttcttctatacaacatcatcgggctcatgaccttttgggacagcggtg

SEQ ID NO: 379582 - DNA, 140 bp, Artificial Sequence
  Synthetic
caccgctgtcccaaaaggtcatgagcccgatgatgttgtatagaagaagtagccacgttcctaaatcgtagatcaaaaagtgcaacagcaaaattaatgacattctggaagataatattacatatcagcagccagggcct

SEQ ID NO: 379583 - DNA, 140 bp, Artificial Sequence
  Synthetic
atacgccatgctgggtctccttatacatcaacattgccattggaccttacacggtatcgggataatgagttgatttacgatgacaatccattaagaggtggtttaaattgcaatctttctcgtacttgggagtcggccat

SEQ ID NO: 379584 - DNA, 140 bp, Artificial Sequence
  Synthetic
atggccgactcccaagtacgagaaagattgcaatttaaaccacctcttaatggattgtcatcgtaaatcaactcattatcccgataccgtgtaaggtccaatggcaatgttgatgtataaggagacccagcatggcgtat

SEQ ID NO: 379585 - DNA, 140 bp, Artificial Sequence
  Synthetic
aggccctggctgctgatatgtgatttacgatgacaatccattaagaggtggtttaaattgcaatctttcttttgataatccgcttttcaagggccagagacttaacataattgaagaagagaccttttgggacagcggtg

SEQ ID NO: 379586 - DNA, 140 bp, Artificial Sequence
  Synthetic
caccgctgtcccaaaaggtctcttcttcaattatgttaagtctctggcccttgaaaagcggattatcaaaagaaagattgcaatttaaaccacctcttaatggattgtcatcgtaaatcacatatcagcagccagggcct

SEQ ID NO: 379587 - DNA, 140 bp, Artificial Sequence
  Synthetic
atacgccatgctgggtctcctccaatctataatttctgacagcaacaattcatcaacggatccaatcagtagtggggaaacacgatcattcaccactcacttcttgacatatcctaagatcgtacttgggagtcggccat

SEQ ID NO: 379588 - DNA, 140 bp, Artificial Sequence
  Synthetic
atggccgactcccaagtacgatcttaggatatgtcaagaagtgagtggtgaatgatcgtgtttccccactactgattggatccgttgatgaattgttgctgtcagaaattatagattggaggagacccagcatggcgtat

SEQ ID NO: 379589 - DNA, 140 bp, Artificial Sequence
  Synthetic
aggccctggctgctgatatgagtggggaaacacgatcattcaccactcacttcttgacatatcctaagattggactactatatagttttggtgcactcatcagttattatctaggcaacagaccttttgggacagcggtg

SEQ ID NO: 379590 - DNA, 140 bp, Artificial Sequence
  Synthetic
caccgctgtcccaaaaggtctgttgcctagataataactgatgagtgcaccaaaactatatagtagtccaatcttaggatatgtcaagaagtgagtggtgaatgatcgtgtttccccactcatatcagcagccagggcct

SEQ ID NO: 379591 - DNA, 140 bp, Artificial Sequence
  Synthetic
atacgccatgctgggtctccgctactcaaatacataatttacctcatcgctcgttgagaatccttaaacctactttgaaacacgctagtgttatctcgagattaataagtattgactctccgtacttgggagtcggccat

SEQ ID NO: 379592 - DNA, 140 bp, Artificial Sequence
  Synthetic
atggccgactcccaagtacggagagtcaatacttattaatctcgagataacactagcgtgtttcaaagtaggtttaaggattctcaacgagcgatgaggtaaattatgtatttgagtagcggagacccagcatggcgtat

SEQ ID NO: 379593 - DNA, 140 bp, Artificial Sequence
  Synthetic
aggccctggctgctgatatgtactttgaaacacgctagtgttatctcgagattaataagtattgactctcacttctcaatttatattggaggaactgctggtgatcgaggactttccgatgaccttttgggacagcggtg

SEQ ID NO: 379594 - DNA, 140 bp, Artificial Sequence
  Synthetic
caccgctgtcccaaaaggtcatcggaaagtcctcgatcaccagcagttcctccaatataaattgagaagtgagagtcaatacttattaatctcgagataacactagcgtgtttcaaagtacatatcagcagccagggcct

SEQ ID NO: 379595 - DNA, 140 bp, Artificial Sequence
  Synthetic
atacgccatgctgggtctcctagaaagtggatagttgaacgcaagacagctattccactgtgggtcatctaccctctagaaggtcaaagtcctagtccgatcaacagttttctacaccaccgtacttgggagtcggccat

SEQ ID NO: 379596 - DNA, 140 bp, Artificial Sequence
  Synthetic
atggccgactcccaagtacggtggtgtagaaaactgttgatcggactaggactttgaccttctagagggtagatgacccacagtggaatagctgtcttgcgttcaactatccactttctaggagacccagcatggcgtat

SEQ ID NO: 379597 - DNA, 140 bp, Artificial Sequence
  Synthetic
aggccctggctgctgatatgaccctctagaaggtcaaagtcctagtccgatcaacagttttctacaccacgtcatcgcattgttgcaacatgagtcctcccacgatcatgtttgtgctgcgaccttttgggacagcggtg

SEQ ID NO: 379598 - DNA, 140 bp, Artificial Sequence
  Synthetic
caccgctgtcccaaaaggtcgcagcacaaacatgatcgtgggaggactcatgttgcaacaatgcgatgacgtggtgtagaaaactgttgatcggactaggactttgaccttctagagggtcatatcagcagccagggcct

SEQ ID NO: 379599 - DNA, 140 bp, Artificial Sequence
  Synthetic
atacgccatgctgggtctccaaagcacagcaagtaacttctttcatgcttcattagcatactggagaagtcgatctaaaaatcaagacaaaagagagatgacaaagatattatctttgaccgtacttgggagtcggccat

SEQ ID NO: 379600 - DNA, 140 bp, Artificial Sequence
  Synthetic
atggccgactcccaagtacggtcaaagataatatctttgtcatctctcttttgtcttgatttttagatcgacttctccagtatgctaatgaagcatgaaagaagttacttgctgtgctttggagacccagcatggcgtat

SEQ ID NO: 379601 - DNA, 140 bp, Artificial Sequence
  Synthetic
aggccctggctgctgatatgcgatctaaaaatcaagacaaaagagagatgacaaagatattatctttgacgcaaacggaaaagaaaaattcattcggctatacagcacatccagaaagcagaccttttgggacagcggtg

SEQ ID NO: 379602 - DNA, 140 bp, Artificial Sequence
  Synthetic
caccgctgtcccaaaaggtctgctttctggatgtgctgtatagccgaatgaatttttcttttccgtttgcgtcaaagataatatctttgtcatctctcttttgtcttgatttttagatcgcatatcagcagccagggcct

SEQ ID NO: 379603 - DNA, 140 bp, Artificial Sequence
  Synthetic
atacgccatgctgggtctccgacgaggctacatatgataggaaaaacaaagttttgaaagcttccagacctggcaagtattcccagaatacaaccaaagccccacccaaccaaaccagttcgtacttgggagtcggccat

SEQ ID NO: 379604 - DNA, 140 bp, Artificial Sequence
  Synthetic
atggccgactcccaagtacgaactggtttggttgggtggggctttggttgtattctgggaatacttgccaggtctggaagctttcaaaactttgtttttcctatcatatgtagcctcgtcggagacccagcatggcgtat

SEQ ID NO: 379605 - DNA, 140 bp, Artificial Sequence
  Synthetic
aggccctggctgctgatatgtggcaagtattcccagaatacaaccaaagccccacccaaccaaaccagttgtcgcgatgtatctcccaatatcacaggcacagatgggtgcccttctgccgaccttttgggacagcggtg

SEQ ID NO: 379606 - DNA, 140 bp, Artificial Sequence
  Synthetic
caccgctgtcccaaaaggtcggcagaagggcacccatctgtgcctgtgatattgggagatacatcgcgacaactggtttggttgggtggggctttggttgtattctgggaatacttgccacatatcagcagccagggcct

SEQ ID NO: 379607 - DNA, 140 bp, Artificial Sequence
  Synthetic
atacgccatgctgggtctccactgccgttttttacattgtctcataattataacgaaagaccctctatcagaaagtctgaggggacaacagagattgtaaggcttactcggcagctgaggcgtacttgggagtcggccat

SEQ ID NO: 379608 - DNA, 140 bp, Artificial Sequence
  Synthetic
atggccgactcccaagtacgcctcagctgccgagtaagccttacaatctctgttgtcccctcagactttctgatagagggtctttcgttataattatgagacaatgtaaaaaacggcagtggagacccagcatggcgtat

SEQ ID NO: 379609 - DNA, 140 bp, Artificial Sequence
  Synthetic
aggccctggctgctgatatggaaagtctgaggggacaacagagattgtaaggcttactcggcagctgagggcaataccagacaccacaatatattgccgcttcacgggaatagtttcttcgaccttttgggacagcggtg

SEQ ID NO: 379610 - DNA, 140 bp, Artificial Sequence
  Synthetic
caccgctgtcccaaaaggtcgaagaaactattcccgtgaagcggcaatatattgtggtgtctggtattgccctcagctgccgagtaagccttacaatctctgttgtcccctcagactttccatatcagcagccagggcct

SEQ ID NO: 379611 - DNA, 140 bp, Artificial Sequence
  Synthetic
atacgccatgctgggtctccctgctataacacttgccgaaggtgaaggttcgggtgcattactcttattacaaaaatataaagtagaaaccttgttttttaatacactagccacagaacacgtacttgggagtcggccat

SEQ ID NO: 379612 - DNA, 140 bp, Artificial Sequence
  Synthetic
atggccgactcccaagtacgtgttctgtggctagtgtattaaaaaacaaggtttctactttatatttttgtaataagagtaatgcacccgaaccttcaccttcggcaagtgttatagcagggagacccagcatggcgtat

SEQ ID NO: 379613 - DNA, 140 bp, Artificial Sequence
  Synthetic
aggccctggctgctgatatgcaaaaatataaagtagaaaccttgttttttaatacactagccacagaacacagcattgaagcagaaattatttctggaataactacaccaagaatgcttcgaccttttgggacagcggtg

SEQ ID NO: 379614 - DNA, 140 bp, Artificial Sequence
  Synthetic
caccgctgtcccaaaaggtcgaagcattcttggtgtagttattccagaaataatttctgcttcaatgctgtgttctgtggctagtgtattaaaaaacaaggtttctactttatatttttgcatatcagcagccagggcct

SEQ ID NO: 379615 - DNA, 140 bp, Artificial Sequence
  Synthetic
atacgccatgctgggtctccaattctgcaagccagattaccgatattactaatccaagttggttggcagaccaaaaatctaggatccctaagcaagtagagattataaccatggatgctgcgtacttgggagtcggccat

SEQ ID NO: 379616 - DNA, 140 bp, Artificial Sequence
  Synthetic
atggccgactcccaagtacgcagcatccatggttataatctctacttgcttagggatcctagatttttggtctgccaaccaacttggattagtaatatcggtaatctggcttgcagaattggagacccagcatggcgtat

SEQ ID NO: 379617 - DNA, 140 bp, Artificial Sequence
  Synthetic
aggccctggctgctgatatgccaaaaatctaggatccctaagcaagtagagattataaccatggatgctgaaacaacagaaaacattaatcggtcaaaattgtacgaagcagtccaacaggaccttttgggacagcggtg

SEQ ID NO: 379618 - DNA, 140 bp, Artificial Sequence
  Synthetic
caccgctgtcccaaaaggtcctgttggactgcttcgtacaattttgaccgattaatgttttctgttgtttcagcatccatggttataatctctacttgcttagggatcctagatttttggcatatcagcagccagggcct

SEQ ID NO: 379619 - DNA, 140 bp, Artificial Sequence
  Synthetic
atacgccatgctgggtctccagttttcttaagtgacattgatggaatcctatggctgaatgataaccttacccctttgtttgggctgggttacttgatcaagccgatcacctctagcccacgtacttgggagtcggccat

SEQ ID NO: 379620 - DNA, 140 bp, Artificial Sequence
  Synthetic
atggccgactcccaagtacgtgggctagaggtgatcggcttgatcaagtaacccagcccaaacaaaggggtaaggttatcattcagccataggattccatcaatgtcacttaagaaaactggagacccagcatggcgtat

SEQ ID NO: 379621 - DNA, 140 bp, Artificial Sequence
  Synthetic
aggccctggctgctgatatgcccctttgtttgggctgggttacttgatcaagccgatcacctctagcccaaaatctagtgagtggtacctatgtctctcaaaccttctttcaacttcaaggaccttttgggacagcggtg

SEQ ID NO: 379622 - DNA, 140 bp, Artificial Sequence
  Synthetic
caccgctgtcccaaaaggtccttgaagttgaaagaaggtttgagagacataggtaccactcactagattttgggctagaggtgatcggcttgatcaagtaacccagcccaaacaaaggggcatatcagcagccagggcct

SEQ ID NO: 379623 - DNA, 140 bp, Artificial Sequence
  Synthetic
atacgccatgctgggtctcccactccagctacaaattcagaggagctcatattggcttagccaccttgtccagtatgccaatcataatttgcatttagattatattaatctcggtttccccgtacttgggagtcggccat

SEQ ID NO: 379624 - DNA, 140 bp, Artificial Sequence
  Synthetic
atggccgactcccaagtacggggaaaccgagattaatataatctaaatgcaaattatgattggcatactggacaaggtggctaagccaatatgagctcctctgaatttgtagctggagtgggagacccagcatggcgtat

SEQ ID NO: 379625 - DNA, 140 bp, Artificial Sequence
  Synthetic
aggccctggctgctgatatgcagtatgccaatcataatttgcatttagattatattaatctcggtttcccttcattggagagggttttataccatagatacaatttagtcgattctcagagaccttttgggacagcggtg

SEQ ID NO: 379626 - DNA, 140 bp, Artificial Sequence
  Synthetic
caccgctgtcccaaaaggtctctgagaatcgactaaattgtatctatggtataaaaccctctccaatgaagggaaaccgagattaatataatctaaatgcaaattatgattggcatactgcatatcagcagccagggcct

SEQ ID NO: 379627 - DNA, 140 bp, Artificial Sequence
  Synthetic
atacgccatgctgggtctccattagggagttggttaatgactataatcaacaaagacaaagtcgaacccaaacatatcatttcattaaaacaataaaaggtcgtattacaaaattggtaacgtacttgggagtcggccat

SEQ ID NO: 379628 - DNA, 140 bp, Artificial Sequence
  Synthetic
atggccgactcccaagtacgttaccaattttgtaatacgaccttttattgttttaatgaaatgatatgtttgggttcgactttgtctttgttgattatagtcattaaccaactccctaatggagacccagcatggcgtat

SEQ ID NO: 379629 - DNA, 140 bp, Artificial Sequence
  Synthetic
aggccctggctgctgatatgaacatatcatttcattaaaacaataaaaggtcgtattacaaaattggtaaatgattaccttaagttctttctaataatacaagccttaaagcacaattgcgaccttttgggacagcggtg

SEQ ID NO: 379630 - DNA, 140 bp, Artificial Sequence
  Synthetic
caccgctgtcccaaaaggtcgcaattgtgctttaaggcttgtattattagaaagaacttaaggtaatcatttaccaattttgtaatacgaccttttattgttttaatgaaatgatatgttcatatcagcagccagggcct

SEQ ID NO: 379631 - DNA, 140 bp, Artificial Sequence
  Synthetic
atacgccatgctgggtctcctcgattctatcatactcgaaactgttcatgtgaaaaccggttcctagtacagactttatacttatcacgcatgcaggattcggaaatcaaactaatagatcgtacttgggagtcggccat

SEQ ID NO: 379632 - DNA, 140 bp, Artificial Sequence
  Synthetic
atggccgactcccaagtacgatctattagtttgatttccgaatcctgcatgcgtgataagtataaagtctgtactaggaaccggttttcacatgaacagtttcgagtatgatagaatcgaggagacccagcatggcgtat

SEQ ID NO: 379633 - DNA, 140 bp, Artificial Sequence
  Synthetic
aggccctggctgctgatatgagactttatacttatcacgcatgcaggattcggaaatcaaactaatagatagattgaccggccttcttagtctatgtccaaatggtttttttcggtaagggaccttttgggacagcggtg

SEQ ID NO: 379634 - DNA, 140 bp, Artificial Sequence
  Synthetic
caccgctgtcccaaaaggtcccttaccgaaaaaaaccatttggacatagactaagaaggccggtcaatctatctattagtttgatttccgaatcctgcatgcgtgataagtataaagtctcatatcagcagccagggcct

SEQ ID NO: 379635 - DNA, 140 bp, Artificial Sequence
  Synthetic
atacgccatgctgggtctcctatgtaaattgaccctaagaaagagtaattcgacacacagagttctcaagtgaaacccctcatctcagattatctgtggttgcaattctaatatccgattcgtacttgggagtcggccat

SEQ ID NO: 379636 - DNA, 140 bp, Artificial Sequence
  Synthetic
atggccgactcccaagtacgaatcggatattagaattgcaaccacagataatctgagatgaggggtttcacttgagaactctgtgtgtcgaattactctttcttagggtcaatttacataggagacccagcatggcgtat

SEQ ID NO: 379637 - DNA, 140 bp, Artificial Sequence
  Synthetic
aggccctggctgctgatatgtgaaacccctcatctcagattatctgtggttgcaattctaatatccgattgttaccccgtgagtataactccagattaatataagaaaataccttttgtcgaccttttgggacagcggtg

SEQ ID NO: 379638 - DNA, 140 bp, Artificial Sequence
  Synthetic
caccgctgtcccaaaaggtcgacaaaaggtattttcttatattaatctggagttatactcacggggtaacaatcggatattagaattgcaaccacagataatctgagatgaggggtttcacatatcagcagccagggcct

SEQ ID NO: 379639 - DNA, 140 bp, Artificial Sequence
  Synthetic
atacgccatgctgggtctccattaagaaaaagttaatctgcttgctttaattataactttaatattcgacaaatagttaacggtctcatcactcaaaaatttcattaacaaaagaagtaccgtacttgggagtcggccat

SEQ ID NO: 379640 - DNA, 140 bp, Artificial Sequence
  Synthetic
atggccgactcccaagtacggtacttcttttgttaatgaaatttttgagtgatgagaccgttaactatttgtcgaatattaaagttataattaaagcaagcagattaactttttcttaatggagacccagcatggcgtat

SEQ ID NO: 379641 - DNA, 140 bp, Artificial Sequence
  Synthetic
aggccctggctgctgatatgaaatagttaacggtctcatcactcaaaaatttcattaacaaaagaagtactctgagtatattcacatatcatatgtgattaacatataagcaacgcatgagaccttttgggacagcggtg

SEQ ID NO: 379642 - DNA, 140 bp, Artificial Sequence
  Synthetic
caccgctgtcccaaaaggtctcatgcgttgcttatatgttaatcacatatgatatgtgaatatactcagagtacttcttttgttaatgaaatttttgagtgatgagaccgttaactatttcatatcagcagccagggcct

SEQ ID NO: 379643 - DNA, 140 bp, Artificial Sequence
  Synthetic
atacgccatgctgggtctccgaaaattccaaacaataaatcgtgtctatcccgcatttagtgtctttaatttaagatctcaaatccaaaaaactgggtttatgttgatgtaaatcaataacgtacttgggagtcggccat

SEQ ID NO: 379644 - DNA, 140 bp, Artificial Sequence
  Synthetic
atggccgactcccaagtacgttattgatttacatcaacataaacccagttttttggatttgagatcttaaattaaagacactaaatgcgggatagacacgatttattgtttggaattttcggagacccagcatggcgtat

SEQ ID NO: 379645 - DNA, 140 bp, Artificial Sequence
  Synthetic
atacgccatgctgggtctcccggtgatgttaggtatataggaaagctcgatcacgatgtcccttactcagaaaaagaaaaacggaagccctattggccatttaatcgtacacaaaaatatcgtacttgggagtcggccat

SEQ ID NO: 379646 - DNA, 140 bp, Artificial Sequence
  Synthetic
atggccgactcccaagtacgatatttttgtgtacgattaaatggccaatagggcttccgtttttctttttctgagtaagggacatcgtgatcgagctttcctatatacctaacatcaccgggagacccagcatggcgtat

SEQ ID NO: 379647 - DNA, 140 bp, Artificial Sequence
  Synthetic
aggccctggctgctgatatgatgtcccttactcagaaaaagaaaaacggaagccctattggccatttaatcgtacacaaaaatatctttaccaaattgttttctcttttttgtgtgtccagaccttttgggacagcggtg

SEQ ID NO: 379648 - DNA, 140 bp, Artificial Sequence
  Synthetic
caccgctgtcccaaaaggtctggacacacaaaaaagagaaaacaatttggtaaagatatttttgtgtacgattaaatggccaatagggcttccgtttttctttttctgagtaagggacatcatatcagcagccagggcct

SEQ ID NO: 379649 - DNA, 140 bp, Artificial Sequence
  Synthetic
atacgccatgctgggtctcccggacacacaaaaagaaagaagaatttttaggatcttttgtgtgcgaataactatgaggaagattaataattttcctctcattgaaatttatatcggaatcgtacttgggagtcggccat

SEQ ID NO: 379650 - DNA, 140 bp, Artificial Sequence
  Synthetic
atggccgactcccaagtacgattccgatataaatttcaatgagaggaaaattattaatcttcctcatagttattcgcacacaaaagatcctaaaaattcttctttctttttgtgtgtccgggagacccagcatggcgtat

SEQ ID NO: 379651 - DNA, 140 bp, Artificial Sequence
  Synthetic
atacgccatgctgggtctcccctatcgtgattttcgagacatattgtgtttttaaatatagcattgcaaaacattattttgatagtcaaggatcttggtacagtgttacctcagatagaacgtacttgggagtcggccat

SEQ ID NO: 379652 - DNA, 140 bp, Artificial Sequence
  Synthetic
atggccgactcccaagtacgttctatctgaggtaacactgtaccaagatccttgactatcaaaataatgttttgcaatgctatatttaaaaacacaatatgtctcgaaaatcacgataggggagacccagcatggcgtat

SEQ ID NO: 379653 - DNA, 140 bp, Artificial Sequence
  Synthetic
atacgccatgctgggtctccacagctggccaacgagacgactcaagctcttcaactgttcctgagagccacaaccgagctacgcaccttttcaatcctcaaccgtaaggcaattgatttccgtacttgggagtcggccat

SEQ ID NO: 379654 - DNA, 140 bp, Artificial Sequence
  Synthetic
atggccgactcccaagtacggaaatcaattgccttacggttgaggattgaaaaggtgcgtagctcggttgtggctctcaggaacagttgaagagcttgagtcgtctcgttggccagctgtggagacccagcatggcgtat

SEQ ID NO: 379655 - DNA, 140 bp, Artificial Sequence
  Synthetic
atacgccatgctgggtctccagttccacctcagactctgcagggtgatccaacaaccttaatagaaacattattgttaaaggacagcattagttcacagtcaaacaagcaagattgagaacgtacttgggagtcggccat

SEQ ID NO: 379656 - DNA, 140 bp, Artificial Sequence
  Synthetic
atggccgactcccaagtacgttctcaatcttgcttgtttgactgtgaactaatgctgtcctttaacaataatgtttctattaaggttgttggatcaccctgcagagtctgaggtggaactggagacccagcatggcgtat

SEQ ID NO: 379657 - DNA, 140 bp, Artificial Sequence
  Synthetic
aggccctggctgctgatatgtattgttaaaggacagcattagttcacagtcaaacaagcaagattgagaattaaccttggttttgaacttgaacacttaggggattgaagattcaacaacgaccttttgggacagcggtg

SEQ ID NO: 379658 - DNA, 140 bp, Artificial Sequence
  Synthetic
caccgctgtcccaaaaggtcgttgttgaatcttcaatcccctaagtgttcaagttcaaaaccaaggttaattctcaatcttgcttgtttgactgtgaactaatgctgtcctttaacaatacatatcagcagccagggcct

SEQ ID NO: 379659 - DNA, 140 bp, Artificial Sequence
  Synthetic
atacgccatgctgggtctcccctaaagcttggggtaaaacattggaaatagttaaaagacaaattgctcggaatcacaaaattccgagtatggattctcgtcctcagaaaatctggatggcgtacttgggagtcggccat

SEQ ID NO: 379660 - DNA, 140 bp, Artificial Sequence
  Synthetic
atggccgactcccaagtacgccatccagattttctgaggacgagaatccatactcggaattttgtgattccgagcaatttgtcttttaactatttccaatgttttaccccaagctttaggggagacccagcatggcgtat

SEQ ID NO: 379661 - DNA, 140 bp, Artificial Sequence
  Synthetic
atacgccatgctgggtctcctttagtttttcttcagattgcttcatggcaaagctcagcctcaaatcaatgaaaccaggatttaattatatggattacttgaatctaagattacttgacacgtacttgggagtcggccat

SEQ ID NO: 379662 - DNA, 140 bp, Artificial Sequence
  Synthetic
atggccgactcccaagtacgtgtcaagtaatcttagattcaagtaatccatataattaaatcctggtttcattgatttgaggctgagctttgccatgaagcaatctgaagaaaaactaaaggagacccagcatggcgtat

SEQ ID NO: 379663 - DNA, 140 bp, Artificial Sequence
  Synthetic
atacgccatgctgggtctcctttagtgacaagggaaagaagcctttttattaagttgtaataatcagatctgcgaaccggtagagtttagttgcaacctaacacacataaagcattgatccgtacttgggagtcggccat

SEQ ID NO: 379664 - DNA, 140 bp, Artificial Sequence
  Synthetic
atggccgactcccaagtacggatcaatgctttatgtgtgttaggttgcaactaaactctaccggttcgcagatctgattattacaacttaataaaaaggcttctttcccttgtcactaaaggagacccagcatggcgtat

SEQ ID NO: 379665 - DNA, 140 bp, Artificial Sequence
  Synthetic
atacgccatgctgggtctccaaaaacattaagagaacacttgctgccatgccggaagaggagacaactgaagctaatgccggtcagtttctctcctttgcaagtctattccttccgaaatcgtacttgggagtcggccat

SEQ ID NO: 379666 - DNA, 140 bp, Artificial Sequence
  Synthetic
atggccgactcccaagtacgatttcggaaggaatagacttgcaaaggagagaaactgaccggcattagcttcagttgtctcctcttccggcatggcagcaagtgttctcttaatgtttttggagacccagcatggcgtat

SEQ ID NO: 379667 - DNA, 140 bp, Artificial Sequence
  Synthetic
atacgccatgctgggtctcctggtagtaggagaaaaggcttgccttgagaaggttcaaaggcaaattcaagtacatgcagagcaaggactgatacaatatccaacagcttggcaatcagtcgtacttgggagtcggccat

SEQ ID NO: 379668 - DNA, 140 bp, Artificial Sequence
  Synthetic
atggccgactcccaagtacgactgattgccaagctgttggatattgtatcagtccttgctctgcatgtacttgaatttgcctttgaaccttctcaaggcaagccttttctcctactaccaggagacccagcatggcgtat

SEQ ID NO: 379669 - DNA, 140 bp, Artificial Sequence
  Synthetic
atacgccatgctgggtctccgtcttccccttagagactgatgcaggcgagcaggaacagagcgccgaggacaatgcagcgagggtggccgccagcctagcaaaagttacaagtgcctgtgcgtacttgggagtcggccat

SEQ ID NO: 379670 - DNA, 140 bp, Artificial Sequence
  Synthetic
atggccgactcccaagtacgcacaggcacttgtaacttttgctaggctggcggccaccctcgctgcattgtcctcggcgctctgttcctgctcgcctgcatcagtctctaaggggaagacggagacccagcatggcgtat

SEQ ID NO: 379671 - DNA, 140 bp, Artificial Sequence
  Synthetic
aggccctggctgctgatatgattgattgtcaaaacagtacttgatcatatcctacaaaagacagaacgaggagttcgtctccatcctcttgcaaggaccgccaaggtaaaaaatgaggtggaccttttgggacagcggtg

SEQ ID NO: 379672 - DNA, 140 bp, Artificial Sequence
  Synthetic
caccgctgtcccaaaaggtccacctcattttttaccttggcggtccttgcaagaggatggagacgaactcctcgttctgtcttttgtaggatatgatcaagtactgttttgacaatcaatcatatcagcagccagggcct

SEQ ID NO: 379673 - DNA, 140 bp, Artificial Sequence
  Synthetic
atacgccatgctgggtctccgagttcgtctccatcctcttgcaaggaccgccaaggtaaaaaatgaggtgaactcctttaaggctgcactcagctccctggccaagcatggagagtatgccgtacttgggagtcggccat

SEQ ID NO: 379674 - DNA, 140 bp, Artificial Sequence
  Synthetic
atggccgactcccaagtacggcatactctccatgcttggccagggagctgagtgcagccttaaaggagttcacctcattttttaccttggcggtccttgcaagaggatggagacgaactcggagacccagcatggcgtat

SEQ ID NO: 379675 - DNA, 140 bp, Artificial Sequence
  Synthetic
aggccctggctgctgatatgaactcctttaaggctgcactcagctccctggccaagcatggagagtatgctcctttcgcccgacttttgaacctttctggagtaaataatcttgagcatggaccttttgggacagcggtg

SEQ ID NO: 379676 - DNA, 140 bp, Artificial Sequence
  Synthetic
caccgctgtcccaaaaggtccatgctcaagattatttactccagaaaggttcaaaagtcgggcgaaaggagcatactctccatgcttggccagggagctgagtgcagccttaaaggagttcatatcagcagccagggcct

SEQ ID NO: 379677 - DNA, 140 bp, Artificial Sequence
  Synthetic
aggccctggctgctgatatgcaagaggaaggtccaaaaattaccttgttgactctgatcaagacggcagaacactgggcgagacaagacatcagaaccatagaggattcaaaattaagaggaccttttgggacagcggtg

SEQ ID NO: 379678 - DNA, 140 bp, Artificial Sequence
  Synthetic
caccgctgtcccaaaaggtcctcttaattttgaatcctctatggttctgatgtcttgtctcgcccagtgttctgccgtcttgatcagagtcaacaaggtaatttttggaccttcctcttgcatatcagcagccagggcct

SEQ ID NO: 379679 - DNA, 140 bp, Artificial Sequence
  Synthetic
atacgccatgctgggtctccgggagtaccctcgcaggagtaaatgttggagaacagtatcaacaactcagagaggctgccactgaggctgagaagcaactccaacaatatgcagagtctccgtacttgggagtcggccat

SEQ ID NO: 379680 - DNA, 140 bp, Artificial Sequence
  Synthetic
atggccgactcccaagtacggagactctgcatattgttggagttgcttctcagcctcagtggcagcctctctgagttgttgatactgttctccaacatttactcctgcgagggtactcccggagacccagcatggcgtat

SEQ ID NO: 379681 - DNA, 140 bp, Artificial Sequence
  Synthetic
aggccctggctgctgatatgagaggctgccactgaggctgagaagcaactccaacaatatgcagagtctcgcgaacttgaccatcttggacttgatgatcaggaaaagaaaattcttatggaccttttgggacagcggtg

SEQ ID NO: 379682 - DNA, 140 bp, Artificial Sequence
  Synthetic
caccgctgtcccaaaaggtccataagaattttcttttcctgatcatcaagtccaagatggtcaagttcgcgagactctgcatattgttggagttgcttctcagcctcagtggcagcctctcatatcagcagccagggcct

SEQ ID NO: 379683 - DNA, 140 bp, Artificial Sequence
  Synthetic
aggccctggctgctgatatgaacttccatcagaaaaagaacgaaatcagcttccagcaaacaaacgctatggtaactctaagaaaagagcgcctggccaagctgacagaagctatcactggaccttttgggacagcggtg

SEQ ID NO: 379684 - DNA, 140 bp, Artificial Sequence
  Synthetic
caccgctgtcccaaaaggtccagtgatagcttctgtcagcttggccaggcgctcttttcttagagttaccatagcgtttgtttgctggaagctgatttcgttctttttctgatggaagttcatatcagcagccagggcct

SEQ ID NO: 379685 - DNA, 140 bp, Artificial Sequence
  Synthetic
atacgccatgctgggtctccggtaactctaagaaaagagcgcctggccaagctgacagaagctatcactgctgcgtcactgcccaaaacaagtggacattacgatgatgatgacgacattcgtacttgggagtcggccat

SEQ ID NO: 379686 - DNA, 140 bp, Artificial Sequence
  Synthetic
atggccgactcccaagtacgaatgtcgtcatcatcatcgtaatgtccacttgttttgggcagtgacgcagcagtgatagcttctgtcagcttggccaggcgctcttttcttagagttaccggagacccagcatggcgtat

SEQ ID NO: 379687 - DNA, 140 bp, Artificial Sequence
  Synthetic
aggccctggctgctgatatgccctttccaggacccatcaatgatgacgacaatcctggccatcaagatgatgatccgactgactcacaggatacgaccattcccgatgtggtggttgatcgaccttttgggacagcggtg

SEQ ID NO: 379688 - DNA, 140 bp, Artificial Sequence
  Synthetic
caccgctgtcccaaaaggtcgatcaaccaccacatcgggaatggtcgtatcctgtgagtcagtcggatcatcatcttgatggccaggattgtcgtcatcattgatgggtcctggaaagggcatatcagcagccagggcct

SEQ ID NO: 379689 - DNA, 140 bp, Artificial Sequence
  Synthetic
atacgccatgctgggtctccccgatgatggaagctacggcgaataccagagttactcggaaaacggcatgaatgcaccagatgacttggtcctattcgatctagacgaggacgacgaggacgtacttgggagtcggccat

SEQ ID NO: 379690 - DNA, 140 bp, Artificial Sequence
  Synthetic
atggccgactcccaagtacgtcctcgtcgtcctcgtctagatcgaataggaccaagtcatctggtgcattcatgccgttttccgagtaactctggtattcgccgtagcttccatcatcggggagacccagcatggcgtat

SEQ ID NO: 379691 - DNA, 140 bp, Artificial Sequence
  Synthetic
atacgccatgctgggtctcccactaagccagtgcctaatagatcgaccaagggtggacaacagaagaacagtcaaaagggccagcatatagagggcagacagacacaatccaggccaattcgtacttgggagtcggccat

SEQ ID NO: 379692 - DNA, 140 bp, Artificial Sequence
  Synthetic
atggccgactcccaagtacgaattggcctggattgtgtctgtctgccctctatatgctggcccttttgactgttcttctgttgtccacccttggtcgatctattaggcactggcttagtgggagacccagcatggcgtat

SEQ ID NO: 379693 - DNA, 140 bp, Artificial Sequence
  Synthetic
aggccctggctgctgatatggtcaaaagggccagcatatagagggcagacagacacaatccaggccaattcaaaatgtcccaggccctcacagaacaatccaccacgccagtgcgccactgaccttttgggacagcggtg

SEQ ID NO: 379694 - DNA, 140 bp, Artificial Sequence
  Synthetic
caccgctgtcccaaaaggtcagtggcgcactggcgtggtggattgttctgtgagggcctgggacattttgaattggcctggattgtgtctgtctgccctctatatgctggcccttttgaccatatcagcagccagggcct

SEQ ID NO: 379695 - DNA, 140 bp, Artificial Sequence
  Synthetic
aggccctggctgctgatatgacctcttgcacaaagtgattcttgtacacaaataatgttttaccctacaggaggtagcaacgatccatcccatcaaaaaataagtattttatgacttactgaccttttgggacagcggtg

SEQ ID NO: 379696 - DNA, 140 bp, Artificial Sequence
  Synthetic
caccgctgtcccaaaaggtcagtaagtcataaaatacttattttttgatgggatggatcgttgctacctcctgtagggtaaaacattatttgtgtacaagaatcactttgtgcaagaggtcatatcagcagccagggcct

SEQ ID NO: 379697 - DNA, 140 bp, Artificial Sequence
  Synthetic
atacgccatgctgggtctcccacggacaatgacagaagaaatgaaccctccggctcaaccagccctcgcatgctgacaccaattaacgaagaggcagacccactggacgatgccgacgaccgtacttgggagtcggccat

SEQ ID NO: 379698 - DNA, 140 bp, Artificial Sequence
  Synthetic
atggccgactcccaagtacggtcgtcggcatcgtccagtgggtctgcctcttcgttaattggtgtcagcatgcgagggctggttgagccggagggttcatttcttctgtcattgtccgtgggagacccagcatggcgtat

SEQ ID NO: 379699 - DNA, 140 bp, Artificial Sequence
  Synthetic
aggccctggctgctgatatgtgctgacaccaattaacgaagaggcagacccactggacgatgccgacgacgagacgtctagccttccgcccttggagtcagatgatgaagagcaggacaggaccttttgggacagcggtg

SEQ ID NO: 379700 - DNA, 140 bp, Artificial Sequence
  Synthetic
caccgctgtcccaaaaggtcctgtcctgctcttcatcatctgactccaagggcggaaggctagacgtctcgtcgtcggcatcgtccagtgggtctgcctcttcgttaattggtgtcagcacatatcagcagccagggcct

SEQ ID NO: 379701 - DNA, 140 bp, Artificial Sequence
  Synthetic
atacgccatgctgggtctccgcttcaagttgtggaggaggtgtttggtattggctattgttatattacaatcaataacaagcttgtaaaaatattgttcttgtttcaagaggtagattgtcgtacttgggagtcggccat

SEQ ID NO: 379702 - DNA, 140 bp, Artificial Sequence
  Synthetic
atggccgactcccaagtacgacaatctacctcttgaaacaagaacaatatttttacaagcttgttattgattgtaatataacaatagccaataccaaacacctcctccacaacttgaagcggagacccagcatggcgtat

SEQ ID NO: 379703 - DNA, 140 bp, Artificial Sequence
  Synthetic
atacgccatgctgggtctccggacggaacttccaaccgcacacccactgtcgccccaccggctcccgtatacagagatcactctgaaaagaaagaactcccgcaagacgagcaacaagatcgtacttgggagtcggccat

SEQ ID NO: 379704 - DNA, 140 bp, Artificial Sequence
  Synthetic
atggccgactcccaagtacgatcttgttgctcgtcttgcgggagttctttcttttcagagtgatctctgtatacgggagccggtggggcgacagtgggtgtgcggttggaagttccgtccggagacccagcatggcgtat

SEQ ID NO: 379705 - DNA, 140 bp, Artificial Sequence
  Synthetic
aggccctggctgctgatatgacagagatcactctgaaaagaaagaactcccgcaagacgagcaacaagatcaggaccacactcaagaggccaggaaccaggacagtgacaacacccagtcgaccttttgggacagcggtg

SEQ ID NO: 379706 - DNA, 140 bp, Artificial Sequence
  Synthetic
caccgctgtcccaaaaggtcgactgggtgttgtcactgtcctggttcctggcctcttgagtgtggtcctgatcttgttgctcgtcttgcgggagttctttcttttcagagtgatctctgtcatatcagcagccagggcct

SEQ ID NO: 379707 - DNA, 140 bp, Artificial Sequence
  Synthetic
atacgccatgctgggtctcccaggaccacactcaagaggccaggaaccaggacagtgacaacacccagtcagaacactcttttgaggagatgtatcgccacattctaagatcacaggggccgtacttgggagtcggccat

SEQ ID NO: 379708 - DNA, 140 bp, Artificial Sequence
  Synthetic
atggccgactcccaagtacggcccctgtgatcttagaatgtggcgatacatctcctcaaaagagtgttctgactgggtgttgtcactgtcctggttcctggcctcttgagtgtggtcctgggagacccagcatggcgtat

SEQ ID NO: 379709 - DNA, 140 bp, Artificial Sequence
  Synthetic
aggccctggctgctgatatgagaacactcttttgaggagatgtatcgccacattctaagatcacaggggccatttgatgctgttttgtattatcatatgatgaaggatgagcctgtagttgaccttttgggacagcggtg

SEQ ID NO: 379710 - DNA, 140 bp, Artificial Sequence
  Synthetic
caccgctgtcccaaaaggtcaactacaggctcatccttcatcatatgataatacaaaacagcatcaaatggcccctgtgatcttagaatgtggcgatacatctcctcaaaagagtgttctcatatcagcagccagggcct

SEQ ID NO: 379711 - DNA, 140 bp, Artificial Sequence
  Synthetic
aggccctggctgctgatatgaattggtggacaggatggagacaatggataccggcaggtattggagttacaggcgttataattgcagttatcgctttattctgtatatgcaaatttgtctgaccttttgggacagcggtg

SEQ ID NO: 379712 - DNA, 140 bp, Artificial Sequence
  Synthetic
caccgctgtcccaaaaggtcagacaaatttgcatatacagaataaagcgataactgcaattataacgcctgtaactccaatacctgccggtatccattgtctccatcctgtccaccaattcatatcagcagccagggcct

SEQ ID NO: 379713 - DNA, 140 bp, Artificial Sequence
  Synthetic
atacgccatgctgggtctccccagacaccaagcaagacctgagaaaaaaccatggctaaagctacgggacgatacaatctaatatcgcccaaaaaggacctggagaaaggggttgtcttacgtacttgggagtcggccat

SEQ ID NO: 379714 - DNA, 140 bp, Artificial Sequence
  Synthetic
atggccgactcccaagtacgtaagacaacccctttctccaggtcctttttgggcgatattagattgtatcgtcccgtagctttagccatggttttttctcaggtcttgcttggtgtctggggagacccagcatggcgtat

SEQ ID NO: 379715 - DNA, 140 bp, Artificial Sequence
  Synthetic
aggccctggctgctgatatgaaaagtgattcttatttttgaatttaaagctagcttattattactagccgtttttcaaagttcaatttgagtcttaatgcaaataggcgttaagccacaggaccttttgggacagcggtg

SEQ ID NO: 379716 - DNA, 140 bp, Artificial Sequence
  Synthetic
caccgctgtcccaaaaggtcctgtggcttaacgcctatttgcattaagactcaaattgaactttgaaaaacggctagtaataataagctagctttaaattcaaaaataagaatcacttttcatatcagcagccagggcct

SEQ ID NO: 379717 - DNA, 140 bp, Artificial Sequence
  Synthetic
atacgccatgctgggtctccacgatcgttttataattaagaaaaaactaatgatgaagattaaaaccttcatcatccttacgtcaattgaattctctagcactcgaagcttattgtcttccgtacttgggagtcggccat

SEQ ID NO: 379718 - DNA, 140 bp, Artificial Sequence
  Synthetic
atggccgactcccaagtacggaagacaataagcttcgagtgctagagaattcaattgacgtaaggatgatgaaggttttaatcttcatcattagttttttcttaattataaaacgatcgtggagacccagcatggcgtat

SEQ ID NO: 379719 - DNA, 140 bp, Artificial Sequence
  Synthetic
atacgccatgctgggtctcccgacatcttctgtgatattgagaacaatccaggattatgctacgcatcccaaatgcaacaaacgaagccaaacccgaagacgcgcaacagtcaaacccaacgtacttgggagtcggccat

SEQ ID NO: 379720 - DNA, 140 bp, Artificial Sequence
  Synthetic
atggccgactcccaagtacgttgggtttgactgttgcgcgtcttcgggtttggcttcgtttgttgcatttgggatgcgtagcataatcctggattgttctcaatatcacagaagatgtcgggagacccagcatggcgtat

SEQ ID NO: 379721 - DNA, 140 bp, Artificial Sequence
  Synthetic
atacgccatgctgggtctccagaaattaacacttgacaattttttatattacttaactacccaaattcataatctaccacatcgctcattgcgaatacttaagccaacattcaaacatgccgtacttgggagtcggccat

SEQ ID NO: 379722 - DNA, 140 bp, Artificial Sequence
  Synthetic
atggccgactcccaagtacggcatgtttgaatgttggcttaagtattcgcaatgagcgatgtggtagattatgaatttgggtagttaagtaatataaaaaattgtcaagtgttaatttctggagacccagcatggcgtat

SEQ ID NO: 379723 - DNA, 140 bp, Artificial Sequence
  Synthetic
atacgccatgctgggtctccaactcgaactaacatgggttttctggtggagctccaagaacccgacaaatcggcaatgaaccgcaagaagcctgggccggcgaaattttccctccttcatcgtacttgggagtcggccat

SEQ ID NO: 379724 - DNA, 140 bp, Artificial Sequence
  Synthetic
atggccgactcccaagtacgatgaaggagggaaaatttcgccggcccaggcttcttgcggttcattgccgatttgtcgggttcttggagctccaccagaaaacccatgttagttcgagttggagacccagcatggcgtat

SEQ ID NO: 379725 - DNA, 140 bp, Artificial Sequence
  Synthetic
atacgccatgctgggtctccaacaacgcattacgagtcttgagaatggtctaaagccagtttatgatatggcaaaaacaatctcctcattgaacagggtttgtgctgagatggttgcaaacgtacttgggagtcggccat

SEQ ID NO: 379726 - DNA, 140 bp, Artificial Sequence
  Synthetic
atggccgactcccaagtacgtttgcaaccatctcagcacaaaccctgttcaatgaggagattgtttttgccatatcataaactggctttagaccattctcaagactcgtaatgcgttgttggagacccagcatggcgtat

SEQ ID NO: 379727 - DNA, 140 bp, Artificial Sequence
  Synthetic
atacgccatgctgggtctcctttgattcttgaatttaatagctctcttgctatctaactaagatggaatacttcatattgagctaactcatatatgctgactcaatagttatcttgacatcgtacttgggagtcggccat

SEQ ID NO: 379728 - DNA, 140 bp, Artificial Sequence
  Synthetic
atggccgactcccaagtacgatgtcaagataactattgagtcagcatatatgagttagctcaatatgaagtattccatcttagttagatagcaagagagctattaaattcaagaatcaaaggagacccagcatggcgtat

SEQ ID NO: 379729 - DNA, 140 bp, Artificial Sequence
  Synthetic
aggccctggctgctgatatgaggccatataccctgccaggtcaaattcaacaattgctaggggtggcaacagcaatacaggcttcctgacaccggagtcagtcaatggagacactccatcgaccttttgggacagcggtg

SEQ ID NO: 379730 - DNA, 140 bp, Artificial Sequence
  Synthetic
caccgctgtcccaaaaggtcgatggagtgtctccattgactgactccggtgtcaggaagcctgtattgctgttgccacccctagcaattgttgaatttgacctggcagggtatatggcctcatatcagcagccagggcct

SEQ ID NO: 379731 - DNA, 140 bp, Artificial Sequence
  Synthetic
aggccctggctgctgatatgcaactgaggcttattgggccgaacatggtcaaccaccacctggaccatcactttatgaagaaagtgcgattcggggtaagattgaatctagagatgagacgaccttttgggacagcggtg

SEQ ID NO: 379732 - DNA, 140 bp, Artificial Sequence
  Synthetic
caccgctgtcccaaaaggtcgtctcatctctagattcaatcttaccccgaatcgcactttcttcataaagtgatggtccaggtggtggttgaccatgttcggcccaataagcctcagttgcatatcagcagccagggcct

SEQ ID NO: 379733 - DNA, 140 bp, Artificial Sequence
  Synthetic
aggccctggctgctgatatgtgtacatcctcacgacaatcttgtttacacatgtaagagtacagccagcaatttcttccatgcgtcattggcgtactggaggagcaggcacagaaacagcgaccttttgggacagcggtg

SEQ ID NO: 379734 - DNA, 140 bp, Artificial Sequence
  Synthetic
caccgctgtcccaaaaggtcgctgtttctgtgcctgctcctccagtacgccaatgacgcatggaagaaattgctggctgtactcttacatgtgtaaacaagattgtcgtgaggatgtacacatatcagcagccagggcct

SEQ ID NO: 379735 - DNA, 140 bp, Artificial Sequence
  Synthetic
atacgccatgctgggtctcccactaactgaggaaaattttgggaaacctgacatttcggcaaaggatttgagaaacattatgtatgatcacttgcctggttttggaactgctttccaccacgtacttgggagtcggccat

SEQ ID NO: 379736 - DNA, 140 bp, Artificial Sequence
  Synthetic
atggccgactcccaagtacgtggtggaaagcagttccaaaaccaggcaagtgatcatacataatgtttctcaaatcctttgccgaaatgtcaggtttcccaaaattttcctcagttagtgggagacccagcatggcgtat

SEQ ID NO: 379737 - DNA, 140 bp, Artificial Sequence
  Synthetic
atacgccatgctgggtctcctgtgccctaattcaaattacaaaaagagttccaatcttccaagatgctgctccacctgtcatccacatccgctctcgaggtgacattccccgagcttgcccgtacttgggagtcggccat

SEQ ID NO: 379738 - DNA, 140 bp, Artificial Sequence
  Synthetic
atggccgactcccaagtacgggcaagctcggggaatgtcacctcgagagcggatgtggatgacaggtggagcagcatcttggaagattggaactctttttgtaatttgaattagggcacaggagacccagcatggcgtat

SEQ ID NO: 379739 - DNA, 140 bp, Artificial Sequence
  Synthetic
atacgccatgctgggtctccaggttatcatcaccaattgtattggaccaatgtgacctagtcactagagcttgcgggttatattcatcatactcccttaatccgcaactacgcaactgtacgtacttgggagtcggccat

SEQ ID NO: 379740 - DNA, 140 bp, Artificial Sequence
  Synthetic
atggccgactcccaagtacgtacagttgcgtagttgcggattaagggagtatgatgaatataacccgcaagctctagtgactaggtcacattggtccaatacaattggtgatgataacctggagacccagcatggcgtat

SEQ ID NO: 379741 - DNA, 140 bp, Artificial Sequence
  Synthetic
aggccctggctgctgatatgagggaaggtcatcaaataatctcacatcgtctagtcctacctttctttacattatctcaagggacacgccaattaacgtcatccaatgagtcacaaacccgaccttttgggacagcggtg

SEQ ID NO: 379742 - DNA, 140 bp, Artificial Sequence
  Synthetic
caccgctgtcccaaaaggtcgggtttgtgactcattggatgacgttaattggcgtgtcccttgagataatgtaaagaaaggtaggactagacgatgtgagattatttgatgaccttccctcatatcagcagccagggcct

SEQ ID NO: 379743 - DNA, 140 bp, Artificial Sequence
  Synthetic
atacgccatgctgggtctcctcgctagcagcttaaaatataaatgtaataggagctatatctctgacagtattataatcaattgttattaagtaacccaaaccaaaagtgatgaagattacgtacttgggagtcggccat

SEQ ID NO: 379744 - DNA, 140 bp, Artificial Sequence
  Synthetic
atggccgactcccaagtacgtaatcttcatcacttttggtttgggttacttaataacaattgattataatactgtcagagatatagctcctattacatttatattttaagctgctagcgaggagacccagcatggcgtat

SEQ ID NO: 379745 - DNA, 140 bp, Artificial Sequence
  Synthetic
atacgccatgctgggtctccacaattgctagaggtggcaacagcaatacaggcttcctgacaccggagtcagtcaatggggacactccatcgaatccactcaggccaattgccgatgacacgtacttgggagtcggccat

SEQ ID NO: 379746 - DNA, 140 bp, Artificial Sequence
  Synthetic
atggccgactcccaagtacgtgtcatcggcaattggcctgagtggattcgatggagtgtccccattgactgactccggtgtcaggaagcctgtattgctgttgccacctctagcaattgtggagacccagcatggcgtat

SEQ ID NO: 379747 - DNA, 140 bp, Artificial Sequence
  Synthetic
atacgccatgctgggtctccccagtttgttctgattatcccaattttaagattgtgtctatgctttaccagagcggagattacttactctccatattagggtctgatgggtataaaattacgtacttgggagtcggccat

SEQ ID NO: 379748 - DNA, 140 bp, Artificial Sequence
  Synthetic
atggccgactcccaagtacgtaattttatacccatcagaccctaatatggagagtaagtaatctccgctctggtaaagcatagacacaatcttaaaattgggataatcagaacaaactggggagacccagcatggcgtat

SEQ ID NO: 379749 - DNA, 140 bp, Artificial Sequence
  Synthetic
atacgccatgctgggtctcctacaccgagaggaagggccgattcttaacacaaatgcatttagctgtaaatcacaccctagaagaaattacagaaatgcgtgcactaaagccttcacaggcgtacttgggagtcggccat

SEQ ID NO: 379750 - DNA, 140 bp, Artificial Sequence
  Synthetic
atggccgactcccaagtacgcctgtgaaggctttagtgcacgcatttctgtaatttcttctagggtgtgatttacagctaaatgcatttgtgttaagaatcggcccttcctctcggtgtaggagacccagcatggcgtat

SEQ ID NO: 379751 - DNA, 140 bp, Artificial Sequence
  Synthetic
aggccctggctgctgatatggaccgatgacactccaacaggatcaaatggagcgttgcgtccaggaatttcatttcatccaaaacttcgccccattcttttacccaacaaaagtgggaaggaccttttgggacagcggtg

SEQ ID NO: 379752 - DNA, 140 bp, Artificial Sequence
  Synthetic
caccgctgtcccaaaaggtccttcccacttttgttgggtaaaagaatggggcgaagttttggatgaaatgaaattcctggacgcaacgctccatttgatcctgttggagtgtcatcggtccatatcagcagccagggcct

SEQ ID NO: 379753 - DNA, 140 bp, Artificial Sequence
  Synthetic
atacgccatgctgggtctccaaggggaacagtgccgatctaacatctccggagaaaatccaagcaataatgacttcactccaggactttaagatcgttccaattgatccaaccaaaaatacgtacttgggagtcggccat

SEQ ID NO: 379754 - DNA, 140 bp, Artificial Sequence
  Synthetic
atggccgactcccaagtacgtatttttggttggatcaattggaacgatcttaaagtcctggagtgaagtcattattgcttggattttctccggagatgttagatcggcactgttccccttggagacccagcatggcgtat

SEQ ID NO: 379755 - DNA, 140 bp, Artificial Sequence
  Synthetic
aggccctggctgctgatatgttagtgatgtcgacaaactagtttgtcgtgacaaactgtcatccacaaatcaattgagatcagttggactgaatctcgaggggaatggagtggcaactgagaccttttgggacagcggtg

SEQ ID NO: 379756 - DNA, 140 bp, Artificial Sequence
  Synthetic
caccgctgtcccaaaaggtctcagttgccactccattcccctcgagattcagtccaactgatctcaattgatttgtggatgacagtttgtcacgacaaactagtttgtcgacatcactaacatatcagcagccagggcct

SEQ ID NO: 379757 - DNA, 140 bp, Artificial Sequence
  Synthetic
aggccctggctgctgatatgaaggtgacttctaaaaatggacaaccaatcatccctgttcttttgccaaagtacattgggttggacccggtggctccaggagacctcaccatggtaatcagaccttttgggacagcggtg

SEQ ID NO: 379758 - DNA, 140 bp, Artificial Sequence
  Synthetic
caccgctgtcccaaaaggtctgattaccatggtgaggtctcctggagccaccgggtccaacccaatgtactttggcaaaagaacagggatgattggttgtccatttttagaagtcaccttcatatcagcagccagggcct

SEQ ID NO: 379759 - DNA, 140 bp, Artificial Sequence
  Synthetic
atacgccatgctgggtctccagggatagtgataacatctatttagtaatccgtccattagaggagacacttttaattgatcaatatactaaaggtgctttacaccattgtcttttttctccgtacttgggagtcggccat

SEQ ID NO: 379760 - DNA, 140 bp, Artificial Sequence
  Synthetic
atggccgactcccaagtacggagaaaaaagacaatggtgtaaagcacctttagtatattgatcaattaaaagtgtctcctctaatggacggattactaaatagatgttatcactatccctggagacccagcatggcgtat

SEQ ID NO: 379761 - DNA, 140 bp, Artificial Sequence
  Synthetic
atacgccatgctgggtctccagtactaaacgtgtaccggaacaatttttagagcaagaaaacttttctattgagaatgttctttcctacgcgcaaaaactcgagtatctactaccacaatcgtacttgggagtcggccat

SEQ ID NO: 379762 - DNA, 140 bp, Artificial Sequence
  Synthetic
atggccgactcccaagtacgattgtggtagtagatactcgagtttttgcgcgtaggaaagaacattctcaatagaaaagttttcttgctctaaaaattgttccggtacacgtttagtactggagacccagcatggcgtat

SEQ ID NO: 379763 - DNA, 140 bp, Artificial Sequence
  Synthetic
atacgccatgctgggtctcctcctaaatgtagaacttaacaaaagactcataatatacttgtttttaaaggattgattgatgaaagatcataactaataacattacaaataatcctactacgtacttgggagtcggccat

SEQ ID NO: 379764 - DNA, 140 bp, Artificial Sequence
  Synthetic
atggccgactcccaagtacgtagtaggattatttgtaatgttattagttatgatctttcatcaatcaatcctttaaaaacaagtatattatgagtcttttgttaagttctacatttaggaggagacccagcatggcgtat

SEQ ID NO: 379765 - DNA, 140 bp, Artificial Sequence
  Synthetic
atacgccatgctgggtctcctaatcaatacggtgattcaaatgttaatctttctcattgcacatactttttgcccttatcctcaaattgcctgcatgcttacatctgaggatagccagtgcgtacttgggagtcggccat

SEQ ID NO: 379766 - DNA, 140 bp, Artificial Sequence
  Synthetic
atggccgactcccaagtacgcactggctatcctcagatgtaagcatgcaggcaatttgaggataagggcaaaaagtatgtgcaatgagaaagattaacatttgaatcaccgtattgattaggagacccagcatggcgtat

SEQ ID NO: 379767 - DNA, 140 bp, Artificial Sequence
  Synthetic
aggccctggctgctgatatgtgagacagagtacttgttcgaggttgacaatttgacctacgtccaacttgaatcaagattcacaccacagtttctgctccagctgaatgagacaatatatgaccttttgggacagcggtg

SEQ ID NO: 379768 - DNA, 140 bp, Artificial Sequence
  Synthetic
caccgctgtcccaaaaggtcatatattgtctcattcagctggagcagaaactgtggtgtgaatcttgattcaagttggacgtaggtcaaattgtcaacctcgaacaagtactctgtctcacatatcagcagccagggcct

SEQ ID NO: 379769 - DNA, 140 bp, Artificial Sequence
  Synthetic
atacgccatgctgggtctccttcacaatccaagtacagacattgcccttctaattaagaaaaaatcggcgatgaagattaagccgacagtgagcgtaatcttcatctctcttagattattcgtacttgggagtcggccat

SEQ ID NO: 379770 - DNA, 140 bp, Artificial Sequence
  Synthetic
atggccgactcccaagtacgaataatctaagagagatgaagattacgctcactgtcggcttaatcttcatcgccgattttttcttaattagaagggcaatgtctgtacttggattgtgaaggagacccagcatggcgtat

SEQ ID NO: 379771 - DNA, 140 bp, Artificial Sequence
  Synthetic
atacgccatgctgggtctcctgttttccagagtaggggtcgtcaggtccttttcaatcgtgtaaccaaaataaactccactagaaggatattgtggggcaacaacacaatgggcgttacacgtacttgggagtcggccat

SEQ ID NO: 379772 - DNA, 140 bp, Artificial Sequence
  Synthetic
atggccgactcccaagtacgtgtaacgcccattgtgttgttgccccacaatatccttctagtggagtttattttggttacacgattgaaaaggacctgacgacccctactctggaaaacaggagacccagcatggcgtat

SEQ ID NO: 379773 - DNA, 140 bp, Artificial Sequence
  Synthetic
aggccctggctgctgatatggaaataccttctttacaatatagcagactagataataatcttcgtgttaatgataattaaggcattgaccacgctcatcagaaggctcactagaataaacgaccttttgggacagcggtg

SEQ ID NO: 379774 - DNA, 140 bp, Artificial Sequence
  Synthetic
caccgctgtcccaaaaggtcgtttattctagtgagccttctgatgagcgtggtcaatgccttaattatcattaacacgaagattattatctagtctgctatattgtaaagaaggtatttccatatcagcagccagggcct

SEQ ID NO: 379775 - DNA, 140 bp, Artificial Sequence
  Synthetic
atacgccatgctgggtctcctccacaatagcacattacaggttagtgatgtcgacaaactagtttgtcgtgacaaactgtcatccacaaatcaattgagatcagttggactgaatctcgacgtacttgggagtcggccat

SEQ ID NO: 379776 - DNA, 140 bp, Artificial Sequence
  Synthetic
atggccgactcccaagtacgtcgagattcagtccaactgatctcaattgatttgtggatgacagtttgtcacgacaaactagtttgtcgacatcactaacctgtaatgtgctattgtggaggagacccagcatggcgtat

SEQ ID NO: 379777 - DNA, 140 bp, Artificial Sequence
  Synthetic
aggccctggctgctgatatggacaaactgtcatccacaaatcaattgagatcagttggactgaatctcgaagggaatggagtggcaactgacgtgccatctgcaactaaaagatggggctgaccttttgggacagcggtg

SEQ ID NO: 379778 - DNA, 140 bp, Artificial Sequence
  Synthetic
caccgctgtcccaaaaggtcagccccatcttttagttgcagatggcacgtcagttgccactccattcccttcgagattcagtccaactgatctcaattgatttgtggatgacagtttgtccatatcagcagccagggcct

SEQ ID NO: 379779 - DNA, 140 bp, Artificial Sequence
  Synthetic
aggccctggctgctgatatgctggtttgtttcagagccatatcaccaagatagagaacaacctaggtctccggagggggcaagggcatcagtgtgctcagttgaaaatcccttgtcaacagaccttttgggacagcggtg

SEQ ID NO: 379780 - DNA, 140 bp, Artificial Sequence
  Synthetic
caccgctgtcccaaaaggtctgttgacaagggattttcaactgagcacactgatgcccttgccccctccggagacctaggttgttctctatcttggtgatatggctctgaaacaaaccagcatatcagcagccagggcct

SEQ ID NO: 379781 - DNA, 140 bp, Artificial Sequence
  Synthetic
aggccctggctgctgatatgtcaggtccggtgtcccaccaaaggtggtcaattatgaagctggtgaatgggctgaaaactgctacaatcttgaaatcaaaaaacctgacgggagtgagtggaccttttgggacagcggtg

SEQ ID NO: 379782 - DNA, 140 bp, Artificial Sequence
  Synthetic
caccgctgtcccaaaaggtccactcactcccgtcaggttttttgatttcaagattgtagcagttttcagcccattcaccagcttcataattgaccacctttggtgggacaccggacctgacatatcagcagccagggcct

SEQ ID NO: 379783 - DNA, 140 bp, Artificial Sequence
  Synthetic
aggccctggctgctgatatgaagctaagaaggacttcttcagctcacaccccttgagagagccggtcaatgcaacggaggacccgtctagtggctactattctaccacaattagatatcagaccttttgggacagcggtg

SEQ ID NO: 379784 - DNA, 140 bp, Artificial Sequence
  Synthetic
caccgctgtcccaaaaggtctgatatctaattgtggtagaatagtagccactagacgggtcctccgttgcattgaccggctctctcaaggggtgtgagctgaagaagtccttcttagcttcatatcagcagccagggcct

SEQ ID NO: 379785 - DNA, 140 bp, Artificial Sequence
  Synthetic
aggccctggctgctgatatgatttgacctacgtccaacttgaatcaagattcacaccacagtttctgctccagctgaatgagacaatatatacaagtgggaaaaggagcaataccacggggaccttttgggacagcggtg

SEQ ID NO: 379786 - DNA, 140 bp, Artificial Sequence
  Synthetic
caccgctgtcccaaaaggtccccgtggtattgctccttttcccacttgtatatattgtctcattcagctggagcagaaactgtggtgtgaatcttgattcaagttggacgtaggtcaaatcatatcagcagccagggcct

SEQ ID NO: 379787 - DNA, 140 bp, Artificial Sequence
  Synthetic
aggccctggctgctgatatgaaaactaatttggaaggtcaaccccgaaattgatacaacaatcggggagtgggccttctgggaaactaaaaaaacctcactagaaaaattcgcagtgaaggaccttttgggacagcggtg

SEQ ID NO: 379788 - DNA, 140 bp, Artificial Sequence
  Synthetic
caccgctgtcccaaaaggtccttcactgcgaatttttctagtgaggtttttttagtttcccagaaggcccactccccgattgttgtatcaatttcggggttgaccttccaaattagttttcatatcagcagccagggcct

SEQ ID NO: 379789 - DNA, 140 bp, Artificial Sequence
  Synthetic
atacgccatgctgggtctccagttgtctttcacagttgtatcaaacggagccaaaaacatcagtggtcagagtccggcgcgaacttcttccgacccagggaccaacacaacaactgaagacgtacttgggagtcggccat

SEQ ID NO: 379790 - DNA, 140 bp, Artificial Sequence
  Synthetic
atggccgactcccaagtacgtcttcagttgttgtgttggtccctgggtcggaagaagttcgcgccggactctgaccactgatgtttttggctccgtttgatacaactgtgaaagacaactggagacccagcatggcgtat

SEQ ID NO: 379791 - DNA, 140 bp, Artificial Sequence
  Synthetic
atacgccatgctgggtctccgtgcgaaaaacaaacttattaataccttatttcatgcgtcagctgacttcgaagacgaaatggtttgtaaatggctattatcatcaactcctgttatgagcgtacttgggagtcggccat

SEQ ID NO: 379792 - DNA, 140 bp, Artificial Sequence
  Synthetic
atggccgactcccaagtacgctcataacaggagttgatgataatagccatttacaaaccatttcgtcttcgaagtcagctgacgcatgaaataaggtattaataagtttgtttttcgcacggagacccagcatggcgtat

SEQ ID NO: 379793 - DNA, 140 bp, Artificial Sequence
  Synthetic
atacgccatgctgggtctcctccacgagtccccaatccctcacaaccaaaccaggtccggacaacagcacccataatacacccgtgtataaacttgacatctctgaggcaactcaagttgcgtacttgggagtcggccat

SEQ ID NO: 379794 - DNA, 140 bp, Artificial Sequence
  Synthetic
atggccgactcccaagtacgcaacttgagttgcctcagagatgtcaagtttatacacgggtgtattatgggtgctgttgtccggacctggtttggttgtgagggattggggactcgtggaggagacccagcatggcgtat

SEQ ID NO: 379795 - DNA, 140 bp, Artificial Sequence
  Synthetic
aggccctggctgctgatatgccataatacacccgtgtataaacttgacatctctgaggcaactcaagttgaacaacatcaccgcagaacagacaacgacagcacagcctccgacactcccgaccttttgggacagcggtg

SEQ ID NO: 379796 - DNA, 140 bp, Artificial Sequence
  Synthetic
caccgctgtcccaaaaggtcgggagtgtcggaggctgtgctgtcgttgtctgttctgcggtgatgttgttcaacttgagttgcctcagagatgtcaagtttatacacgggtgtattatggcatatcagcagccagggcct

SEQ ID NO: 379797 - DNA, 140 bp, Artificial Sequence
  Synthetic
atacgccatgctgggtctcctctgccacgaccgcagccggacccccaaaagcagagaacaccaacacgagcaagagcactgacttcctggaccccgccaccacaacaagtccccaaaacccgtacttgggagtcggccat

SEQ ID NO: 379798 - DNA, 140 bp, Artificial Sequence
  Synthetic
atggccgactcccaagtacgggttttggggacttgttgtggtggcggggtccaggaagtcagtgctcttgctcgtgttggtgttctctgcttttgggggtccggctgcggtcgtggcagaggagacccagcatggcgtat

SEQ ID NO: 379799 - DNA, 140 bp, Artificial Sequence
  Synthetic
atacgccatgctgggtctccacagcgagaccgctggcaacaacaacactcatcaccaagataccggagaagagagtgccagcagcgggaagctaggcttaattaccaatactattgctggcgtacttgggagtcggccat

SEQ ID NO: 379800 - DNA, 140 bp, Artificial Sequence
  Synthetic
atggccgactcccaagtacgccagcaatagtattggtaattaagcctagcttcccgctgctggcactctcttctccggtatcttggtgatgagtgttgttgttgccagcggtctcgctgtggagacccagcatggcgtat

SEQ ID NO: 379801 - DNA, 140 bp, Artificial Sequence
  Synthetic
atacgccatgctgggtctccaaccctacgaacaatgtccgcagtgttcaaatgcaaagcaaccaggtgggaaaccattcgtgtcagtggcagtcaagaaacatattgttagtgcatggcccgtacttgggagtcggccat

SEQ ID NO: 379802 - DNA, 140 bp, Artificial Sequence
  Synthetic
atggccgactcccaagtacgggccatgcactaacaatatgtttcttgactgccactgacacgaatggtttcccacctggttgctttgcatttgaacactgcggacattgttcgtagggttggagacccagcatggcgtat

SEQ ID NO: 379803 - DNA, 140 bp, Artificial Sequence
  Synthetic
atacgccatgctgggtctccagtcgcaggactgatcacaggcgggagaagaactcgaagagaagcaattgtcaatgctcaacccaaatgcaaccctaatttacattactggactactcagcgtacttgggagtcggccat

SEQ ID NO: 379804 - DNA, 140 bp, Artificial Sequence
  Synthetic
atggccgactcccaagtacgctgagtagtccagtaatgtaaattagggttgcatttgggttgagcattgacaattgcttctcttcgagttcttctcccgcctgtgatcagtcctgcgactggagacccagcatggcgtat

SEQ ID NO: 379805 - DNA, 140 bp, Artificial Sequence
  Synthetic
atacgccatgctgggtctccgatgaaggtgctgcaatcggactggcctggataccatatttcgggccagcagccgagggaatttacacagaggggctaatgcacaatcaagatggtttaacgtacttgggagtcggccat

SEQ ID NO: 379806 - DNA, 140 bp, Artificial Sequence
  Synthetic
atggccgactcccaagtacgttaaaccatcttgattgtgcattagcccctctgtgtaaattccctcggctgctggcccgaaatatggtatccaggccagtccgattgcagcaccttcatcggagacccagcatggcgtat

SEQ ID NO: 379807 - DNA, 140 bp, Artificial Sequence
  Synthetic
aggccctggctgctgatatgatgcagttgcactgttcgatattaaatttagaaacactgaggctacagatatccagtataatcgtgctcaccttcatctaactaagtgttgcacccgggagaccttttgggacagcggtg

SEQ ID NO: 379808 - DNA, 140 bp, Artificial Sequence
  Synthetic
caccgctgtcccaaaaggtctcccgggtgcaacacttagttagatgaaggtgagcacgattatactggatatctgtagcctcagtgtttctaaatttaatatcgaacagtgcaactgcatcatatcagcagccagggcct

SEQ ID NO: 379809 - DNA, 140 bp, Artificial Sequence
  Synthetic
atacgccatgctgggtctccaaaattgatcagattattcatgattttgttgataaaacccttccggaccagggggacaatgacaattggtggacaggatggagacaatggataccggcagcgtacttgggagtcggccat

SEQ ID NO: 379810 - DNA, 140 bp, Artificial Sequence
  Synthetic
atggccgactcccaagtacgctgccggtatccattgtctccatcctgtccaccaattgtcattgtccccctggtccggaagggttttatcaacaaaatcatgaataatctgatcaattttggagacccagcatggcgtat

SEQ ID NO: 379811 - DNA, 140 bp, Artificial Sequence
  Synthetic
atacgccatgctgggtctccagcaatattattttccagaatgttataaattatgcagttgcactgttcgatattaaatttagaaacactgaggctacagatatccaatataatcgtgctccgtacttgggagtcggccat

SEQ ID NO: 379812 - DNA, 140 bp, Artificial Sequence
  Synthetic
atggccgactcccaagtacggagcacgattatattggatatctgtagcctcagtgtttctaaatttaatatcgaacagtgcaactgcataatttataacattctggaaaataatattgctggagacccagcatggcgtat

SEQ ID NO: 379813 - DNA, 140 bp, Artificial Sequence
  Synthetic
atacgccatgctgggtctccacatacacatctacattggatttagatttaacaagataccgagaaaacgaattgatttatgacaataatcctctaaaaggaggactcaattgcaatatctcgtacttgggagtcggccat

SEQ ID NO: 379814 - DNA, 140 bp, Artificial Sequence
  Synthetic
atggccgactcccaagtacgagatattgcaattgagtcctccttttagaggattattgtcataaatcaattcgttttctcggtatcttgttaaatctaaatccaatgtagatgtgtatgtggagacccagcatggcgtat

SEQ ID NO: 379815 - DNA, 140 bp, Artificial Sequence
  Synthetic
atacgccatgctgggtctcctcctttcgcccgacttttgaacctttctggagtaaataatcttgagcatggtcttttccctcaactatcggcaattgcactcggagtcgccacagcacaccgtacttgggagtcggccat

SEQ ID NO: 379816 - DNA, 140 bp, Artificial Sequence
  Synthetic
atggccgactcccaagtacggtgtgctgtggcgactccgagtgcaattgccgatagttgagggaaaagaccatgctcaagattatttactccagaaaggttcaaaagtcgggcgaaaggaggagacccagcatggcgtat

SEQ ID NO: 379817 - DNA, 140 bp, Artificial Sequence
  Synthetic
aggccctggctgctgatatggcagtggagaaacaagatcattcactacccatttcttaacttatcccaagataggacttctgtacagttttggggcctttgtaagttattatcttggcaagaccttttgggacagcggtg

SEQ ID NO: 379818 - DNA, 140 bp, Artificial Sequence
  Synthetic
caccgctgtcccaaaaggtcttgccaagataataacttacaaaggccccaaaactgtacagaagtcctatcttgggataagttaagaaatgggtagtgaatgatcttgtttctccactgccatatcagcagccagggcct

SEQ ID NO: 379819 - DNA, 140 bp, Artificial Sequence
  Synthetic
aggccctggctgctgatatgtaataatcagatctgcgaaccggtagagtttagttgcaacctaacacacataaagcattggtcaaaaagtcaatagaaatttaaacagtgagtggagacagaccttttgggacagcggtg

SEQ ID NO: 379820 - DNA, 140 bp, Artificial Sequence
  Synthetic
caccgctgtcccaaaaggtctgtctccactcactgtttaaatttctattgactttttgaccaatgctttatgtgtgttaggttgcaactaaactctaccggttcgcagatctgattattacatatcagcagccagggcct

SEQ ID NO: 379821 - DNA, 140 bp, Artificial Sequence
  Synthetic
atacgccatgctgggtctcctgcgcgttcctactgtatttcataagaagagagttgaaccattaacagttcctccagcacctaaagacatatgtccgaccttgaaaaaaggatttttgtgcgtacttgggagtcggccat

SEQ ID NO: 379822 - DNA, 140 bp, Artificial Sequence
  Synthetic
atggccgactcccaagtacgcacaaaaatccttttttcaaggtcggacatatgtctttaggtgctggaggaactgttaatggttcaactctcttcttatgaaatacagtaggaacgcgcaggagacccagcatggcgtat

SEQ ID NO: 379823 - DNA, 140 bp, Artificial Sequence
  Synthetic
atacgccatgctgggtctcctgacagtagtttttgcaaaaaagatcaccagttggagagtttaactgatagggaattactcctactaatcgcccgtaagacttgtggatcagtagaacaacgtacttgggagtcggccat

SEQ ID NO: 379824 - DNA, 140 bp, Artificial Sequence
  Synthetic
atggccgactcccaagtacgttgttctactgatccacaagtcttacgggcgattagtaggagtaattccctatcagttaaactctccaactggtgatcttttttgcaaaaactactgtcaggagacccagcatggcgtat

SEQ ID NO: 379825 - DNA, 140 bp, Artificial Sequence
  Synthetic
atacgccatgctgggtctccgggaattactcctactaatcgcccgtaagacttgtggatcagtagaacaacaattaaatataactgcacccaaggactcgcgcttagcaaatccaacggccgtacttgggagtcggccat

SEQ ID NO: 379826 - DNA, 140 bp, Artificial Sequence
  Synthetic
atggccgactcccaagtacggccgttggatttgctaagcgcgagtccttgggtgcagttatatttaattgttgttctactgatccacaagtcttacgggcgattagtaggagtaattcccggagacccagcatggcgtat

SEQ ID NO: 379827 - DNA, 140 bp, Artificial Sequence
  Synthetic
atacgccatgctgggtctcctaagagtacagccagcaatttcttccatgcatcattggcgtactggaggagcaggcacagaaacagcaaccgaaaatacttggcaagagactcttcaactcgtacttgggagtcggccat

SEQ ID NO: 379828 - DNA, 140 bp, Artificial Sequence
  Synthetic
atggccgactcccaagtacgagttgaagagtctcttgccaagtattttcggttgctgtttctgtgcctgctcctccagtacgccaatgatgcatggaagaaattgctggctgtactcttaggagacccagcatggcgtat

SEQ ID NO: 379829 - DNA, 140 bp, Artificial Sequence
  Synthetic
atacgccatgctgggtctcctcaaaattaagagcattgttgactctatgtgctgtgatgacgaggaaattctcaaaatcccagctgagtcttttatgtgagacacacctaaggcgcgaggcgtacttgggagtcggccat

SEQ ID NO: 379830 - DNA, 140 bp, Artificial Sequence
  Synthetic
atggccgactcccaagtacgcctcgcgccttaggtgtgtctcacataaaagactcagctgggattttgagaatttcctcgtcatcacagcacatagagtcaacaatgctcttaattttgaggagacccagcatggcgtat

SEQ ID NO: 379831 - DNA, 140 bp, Artificial Sequence
  Synthetic
atacgccatgctgggtctccggcttgggcaagatcaggcagaacccgttctcgaagtatatcaacgattacacagtgataaaggaggcagttttgaagctgcactatggcaacaatgggacgtacttgggagtcggccat

SEQ ID NO: 379832 - DNA, 140 bp, Artificial Sequence
  Synthetic
atggccgactcccaagtacgtcccattgttgccatagtgcagcttcaaaactgcctcctttatcactgtgtaatcgttgatatacttcgagaacgggttctgcctgatcttgcccaagccggagacccagcatggcgtat

SEQ ID NO: 379833 - DNA, 140 bp, Artificial Sequence
  Synthetic
aggccctggctgctgatatgagttaccgtgtgaaagttctgctgtcgttgtttcagggttaagaacattggttcctcaatcagataatgaggaagcttcaaccaacccggggacatgctcgaccttttgggacagcggtg

SEQ ID NO: 379834 - DNA, 140 bp, Artificial Sequence
  Synthetic
caccgctgtcccaaaaggtcgagcatgtccccgggttggttgaagcttcctcattatctgattgaggaaccaatgttcttaaccctgaaacaacgacagcagaactttcacacggtaactcatatcagcagccagggcct

SEQ ID NO: 379835 - DNA, 140 bp, Artificial Sequence
  Synthetic
atacgccatgctgggtctccaccctaacagtgatcaaagaaaatcataatctcgtatcgctcgtaatataacctgccaagcatacctcttgcacaaagtgattcttgtacacaaataatgcgtacttgggagtcggccat

SEQ ID NO: 379836 - DNA, 140 bp, Artificial Sequence
  Synthetic
atggccgactcccaagtacgcattatttgtgtacaagaatcactttgtgcaagaggtatgcttggcaggttatattacgagcgatacgagattatgattttctttgatcactgttagggtggagacccagcatggcgtat

SEQ ID NO: 379837 - DNA, 140 bp, Artificial Sequence
  Synthetic
atacgccatgctgggtctccttttactctacaggaggtagcaacgatccatcccatcaaaaaataagtatttcatgacttactaatgatctcttaaaatattaagaaaaactgacggaaccgtacttgggagtcggccat

SEQ ID NO: 379838 - DNA, 140 bp, Artificial Sequence
  Synthetic
atggccgactcccaagtacggttccgtcagtttttcttaatattttaagagatcattagtaagtcatgaaatacttattttttgatgggatggatcgttgctacctcctgtagagtaaaaggagacccagcatggcgtat

SEQ ID NO: 379839 - DNA, 140 bp, Artificial Sequence
  Synthetic
aggccctggctgctgatatgtgttatattacaatcaataacaagcttgtaaaaatattgttcttgtttcaagaggtagattgtgaccggaaatgctaaactaatgatgaagattaatgcggaccttttgggacagcggtg

SEQ ID NO: 379840 - DNA, 140 bp, Artificial Sequence
  Synthetic
caccgctgtcccaaaaggtccgcattaatcttcatcattagtttagcatttccggtcacaatctacctcttgaaacaagaacaatatttttacaagcttgttattgattgtaatataacacatatcagcagccagggcct

SEQ ID NO: 379841 - DNA, 140 bp, Artificial Sequence
  Synthetic
atacgccatgctgggtctccgaggtctgataagaataaaccttattattcagattaggccccaagaggcattcttcatctccttttagcaaagtactatttcagggtagtccaattagtgcgtacttgggagtcggccat

SEQ ID NO: 379842 - DNA, 140 bp, Artificial Sequence
  Synthetic
atggccgactcccaagtacgcactaattggactaccctgaaatagtactttgctaaaaggagatgaagaatgcctcttggggcctaatctgaataataaggtttattcttatcagacctcggagacccagcatggcgtat

SEQ ID NO: 379843 - DNA, 140 bp, Artificial Sequence
  Synthetic
aggccctggctgctgatatggtctctaagctaaattggtctgtacacatcccatacattgtattaggggcaataatatctaattgaacttagccgtttaaaatttagtgcataaatctgggaccttttgggacagcggtg

SEQ ID NO: 379844 - DNA, 140 bp, Artificial Sequence
  Synthetic
caccgctgtcccaaaaggtcccagatttatgcactaaattttaaacggctaagttcaattagatattattgcccctaatacaatgtatgggatgtgtacagaccaatttagcttagagaccatatcagcagccagggcct

SEQ ID NO: 379845 - DNA, 140 bp, Artificial Sequence
  Synthetic
aggccctggctgctgatatgaataatatctaattgaacttagccgtttaaaatttagtgcataaatctgggctaacaccaccaggtcaactccattggctgaaaagaagcttacctacaagaccttttgggacagcggtg

SEQ ID NO: 379846 - DNA, 140 bp, Artificial Sequence
  Synthetic
caccgctgtcccaaaaggtcttgtaggtaagcttcttttcagccaatggagttgacctggtggtgttagcccagatttatgcactaaattttaaacggctaagttcaattagatattattcatatcagcagccagggcct

SEQ ID NO: 379847 - DNA, 140 bp, Artificial Sequence
  Synthetic
atacgccatgctgggtctccctcagtatgctgactgtgatttacatttaagttatatccgccttggttttccatcattagagaaagtactataccacaggtataacctcgtcgattcaaacgtacttgggagtcggccat

SEQ ID NO: 379848 - DNA, 140 bp, Artificial Sequence
  Synthetic
atggccgactcccaagtacgtttgaatcgacgaggttatacctgtggtatagtactttctctaatgatggaaaaccaaggcggatataacttaaatgtaaatcacagtcagcatactgagggagacccagcatggcgtat

SEQ ID NO: 379849 - DNA, 140 bp, Artificial Sequence
  Synthetic
aggccctggctgctgatatgccatcattagagaaagtactataccacaggtataacctcgtcgattcaaaaagaggtccactagtctctatcactcagcacttagcacatcttagagcaggaccttttgggacagcggtg

SEQ ID NO: 379850 - DNA, 140 bp, Artificial Sequence
  Synthetic
caccgctgtcccaaaaggtcctgctctaagatgtgctaagtgctgagtgatagagactagtggacctctttttgaatcgacgaggttatacctgtggtatagtactttctctaatgatggcatatcagcagccagggcct

SEQ ID NO: 379851 - DNA, 140 bp, Artificial Sequence
  Synthetic
atacgccatgctgggtctccaagaggtccactagtctctatcactcagcacttagcacatcttagagcagagattcgagaattaactaatgattataatcaacagcgacaaagtcgaactcgtacttgggagtcggccat

SEQ ID NO: 379852 - DNA, 140 bp, Artificial Sequence
  Synthetic
atggccgactcccaagtacgagttcgactttgtcgctgttgattataatcattagttaattctcgaatctctgctctaagatgtgctaagtgctgagtgatagagactagtggacctcttggagacccagcatggcgtat

SEQ ID NO: 379853 - DNA, 140 bp, Artificial Sequence
  Synthetic
aggccctggctgctgatatgaaagctacgggacgatacaatctaatatcgcccaaaaaggacctggagaaaggggttgtcttaagcgacctctgtaacttcttagttagccaaactattcgaccttttgggacagcggtg

SEQ ID NO: 379854 - DNA, 140 bp, Artificial Sequence
  Synthetic
caccgctgtcccaaaaggtcgaatagtttggctaactaagaagttacagaggtcgcttaagacaacccctttctccaggtcctttttgggcgatattagattgtatcgtcccgtagctttcatatcagcagccagggcct

SEQ ID NO: 379855 - DNA, 140 bp, Artificial Sequence
  Synthetic
aggccctggctgctgatatgggaatggccctattgcatagactgaaaactaatgactttgcccctgcatggtcaatgacaaggaatctctttcctcatttatttcaaaatccgaattccagaccttttgggacagcggtg

SEQ ID NO: 379856 - DNA, 140 bp, Artificial Sequence
  Synthetic
caccgctgtcccaaaaggtctggaattcggattttgaaataaatgaggaaagagattccttgtcattgaccatgcaggggcaaagtcattagttttcagtctatgcaatagggccattcccatatcagcagccagggcct

SEQ ID NO: 379857 - DNA, 140 bp, Artificial Sequence
  Synthetic
atacgccatgctgggtctcctgatattaaatggctacacaacatacccaatacccagacgccaggttatcatcaccaattgtattggaccaatgtgaccttgtcactagagcttgcgggtcgtacttgggagtcggccat

SEQ ID NO: 379858 - DNA, 140 bp, Artificial Sequence
  Synthetic
atggccgactcccaagtacgacccgcaagctctagtgacaaggtcacattggtccaatacaattggtgatgataacctggcgtctgggtattgggtatgttgtgtagccatttaatatcaggagacccagcatggcgtat

SEQ ID NO: 379859 - DNA, 140 bp, Artificial Sequence
  Synthetic
atacgccatgctgggtctccgattgaattaccgtgcatagtatcctgatacttgcaaaggttggttatcaacatacagattataaaaaactcataaattgctctcatacatcatattgatcgtacttgggagtcggccat

SEQ ID NO: 379860 - DNA, 140 bp, Artificial Sequence
  Synthetic
atggccgactcccaagtacgatcaatatgatgtatgagagcaatttatgagttttttataatctgtatgttgataaccaacctttgcaagtatcaggatactatgcacggtaattcaatcggagacccagcatggcgtat

SEQ ID NO: 379861 - DNA, 140 bp, Artificial Sequence
  Synthetic
atacgccatgctgggtctcctggtctgatctctgattggctgctaacaaccaacactaaccatttcaacatgcgaacacaacgtgtcaaggaacaattgagcctaaaaatgctgtcgttgcgtacttgggagtcggccat

SEQ ID NO: 379862 - DNA, 140 bp, Artificial Sequence
  Synthetic
atggccgactcccaagtacgcaacgacagcatttttaggctcaattgttccttgacacgttgtgttcgcatgttgaaatggttagtgttggttgttagcagccaatcagagatcagaccaggagacccagcatggcgtat

SEQ ID NO: 379863 - DNA, 140 bp, Artificial Sequence
  Synthetic
atacgccatgctgggtctccattcgatccaatattctcaagtttattaacaaattggatgctctacatgtcgtgaactacaacggattgttgagcagtattgaaattggaactcaaaatccgtacttgggagtcggccat

SEQ ID NO: 379864 - DNA, 140 bp, Artificial Sequence
  Synthetic
atggccgactcccaagtacggattttgagttccaatttcaatactgctcaacaatccgttgtagttcacgacatgtagagcatccaatttgttaataaacttgagaatattggatcgaatggagacccagcatggcgtat

SEQ ID NO: 379865 - DNA, 140 bp, Artificial Sequence
  Synthetic
aggccctggctgctgatatgacaatatagcagactagataataatcttcgtgttaatgataattaaggcattgaccacgctcatcagaaggctcactagaataaacgttgcaaaaaggatgaccttttgggacagcggtg

SEQ ID NO: 379866 - DNA, 140 bp, Artificial Sequence
  Synthetic
caccgctgtcccaaaaggtcatcctttttgcaacgtttattctagtgagccttctgatgagcgtggtcaatgccttaattatcattaacacgaagattattatctagtctgctatattgtcatatcagcagccagggcct

SEQ ID NO: 379867 - DNA, 140 bp, Artificial Sequence
  Synthetic
aggccctggctgctgatatggttattgatataataatgttatatcaatgtcctgtcagatggaatagtgttttggttgataacacgacttcttaaaacaaaattgatctttaagattaaggaccttttgggacagcggtg

SEQ ID NO: 379868 - DNA, 140 bp, Artificial Sequence
  Synthetic
caccgctgtcccaaaaggtccttaatcttaaagatcaattttgttttaagaagtcgtgttatcaaccaaaacactattccatctgacaggacattgatataacattattatatcaataaccatatcagcagccagggcct

SEQ ID NO: 379869 - DNA, 140 bp, Artificial Sequence
  Synthetic
atacgccatgctgggtctccccttaatctttgtgtaaaataagagattaggtgtaataactttaacatttttgtctagtaagttactatttcatacagaatgataaaattaaaagaaaagcgtacttgggagtcggccat

SEQ ID NO: 379870 - DNA, 140 bp, Artificial Sequence
  Synthetic
atggccgactcccaagtacgcttttcttttaattttatcattctgtatgaaatagtaacttactagacaaaaatgttaaagttattacacctaatctcttattttacacaaagattaaggggagacccagcatggcgtat

SEQ ID NO: 379871 - DNA, 140 bp, Artificial Sequence
  Synthetic
atacgccatgctgggtctccgttatcttgacatctctgctttcataatcagatatataagcataataaataaatactcatatttcttgataatttgtttaaccacagataaatcctcactcgtacttgggagtcggccat

SEQ ID NO: 379872 - DNA, 140 bp, Artificial Sequence
  Synthetic
atggccgactcccaagtacgagtgaggatttatctgtggttaaacaaattatcaagaaatatgagtatttatttattatgcttatatatctgattatgaaagcagagatgtcaagataacggagacccagcatggcgtat

SEQ ID NO: 379873 - DNA, 140 bp, Artificial Sequence
  Synthetic
aggccctggctgctgatatgaaatactcatatttcttgataatttgtttaaccacagataaatcctcactgtaagccagcttccaagttgacacccttacaaaaaccaggactcagaatcgaccttttgggacagcggtg

SEQ ID NO: 379874 - DNA, 140 bp, Artificial Sequence
  Synthetic
caccgctgtcccaaaaggtcgattctgagtcctggtttttgtaagggtgtcaacttggaagctggcttacagtgaggatttatctgtggttaaacaaattatcaagaaatatgagtatttcatatcagcagccagggcct

SEQ ID NO: 379875 - DNA, 140 bp, Artificial Sequence
  Synthetic
atacgccatgctgggtctcccctcaaacaagagattccaagacaacatcatagaattgctttattatatgaataagcattttatcaccagaaatcctatatactaaatggttaattgtaacgtacttgggagtcggccat

SEQ ID NO: 379876 - DNA, 140 bp, Artificial Sequence
  Synthetic
atggccgactcccaagtacgttacaattaaccatttagtatataggatttctggtgataaaatgcttattcatataataaagcaattctatgatgttgtcttggaatctcttgtttgaggggagacccagcatggcgtat

SEQ ID NO: 379877 - DNA, 140 bp, Artificial Sequence
  Synthetic
atacgccatgctgggtctccaactctatactcgtaattaacattagataagtagattaagaaaaaagcctgaggaagattaagaaaaactgcttattgggtctttccgtgttttagatgacgtacttgggagtcggccat

SEQ ID NO: 379878 - DNA, 140 bp, Artificial Sequence
  Synthetic
atggccgactcccaagtacgtcatctaaaacacggaaagacccaataagcagtttttcttaatcttcctcaggcttttttcttaatctacttatctaatgttaattacgagtatagagttggagacccagcatggcgtat

SEQ ID NO: 379879 - DNA, 140 bp, Artificial Sequence
  Synthetic
aggccctggctgctgatatggaggaagattaagaaaaactgcttattgggtctttccgtgttttagatgaagcagttgaaattcttcctcttgatattaaatggctacacaacatacccagaccttttgggacagcggtg

SEQ ID NO: 379880 - DNA, 140 bp, Artificial Sequence
  Synthetic
caccgctgtcccaaaaggtctgggtatgttgtgtagccatttaatatcaagaggaagaatttcaactgcttcatctaaaacacggaaagacccaataagcagtttttcttaatcttcctccatatcagcagccagggcct

SEQ ID NO: 379881 - DNA, 140 bp, Artificial Sequence
  Synthetic
aggccctggctgctgatatgtagtcactagagcttgcgggttatattcatcatactcccttaatccgcaactacgcaactgtaaactcccgaaacatatctaccgtttgaaatacgatgtgaccttttgggacagcggtg

SEQ ID NO: 379882 - DNA, 140 bp, Artificial Sequence
  Synthetic
caccgctgtcccaaaaggtcacatcgtatttcaaacggtagatatgtttcgggagtttacagttgcgtagttgcggattaagggagtatgatgaatataacccgcaagctctagtgactacatatcagcagccagggcct

SEQ ID NO: 379883 - DNA, 140 bp, Artificial Sequence
  Synthetic
atacgccatgctgggtctccaactgttaccaagttcttgagtgatgtaccagtggcgacattgcccatagatttcatagtcccagttcttctcaaggcactgtcaggcaatggattctgtcgtacttgggagtcggccat

SEQ ID NO: 379884 - DNA, 140 bp, Artificial Sequence
  Synthetic
atggccgactcccaagtacgacagaatccattgcctgacagtgccttgagaagaactgggactatgaaatctatgggcaatgtcgccactggtacatcactcaagaacttggtaacagttggagacccagcatggcgtat

SEQ ID NO: 379885 - DNA, 140 bp, Artificial Sequence
  Synthetic
atacgccatgctgggtctcctttaactcgaaggggtagattaaatcgaggaaactctagatcaacatggtttgttcatgatgatttaatagacatcttaggctatggggactatgtttttcgtacttgggagtcggccat

SEQ ID NO: 379886 - DNA, 140 bp, Artificial Sequence
  Synthetic
atggccgactcccaagtacgaaaaacatagtccccatagcctaagatgtctattaaatcatcatgaacaaaccatgttgatctagagtttcctcgatttaatctaccccttcgagttaaaggagacccagcatggcgtat

SEQ ID NO: 379887 - DNA, 140 bp, Artificial Sequence
  Synthetic
atacgccatgctgggtctcctggaagatcccaatttcaatgttaccactgaacacacaaggaatcccccatgctgctatggactggtatcaggcatcagtattcaaagaagcggttcaagcgtacttgggagtcggccat

SEQ ID NO: 379888 - DNA, 140 bp, Artificial Sequence
  Synthetic
atggccgactcccaagtacgcttgaaccgcttctttgaatactgatgcctgataccagtccatagcagcatgggggattccttgtgtgttcagtggtaacattgaaattgggatcttccaggagacccagcatggcgtat

SEQ ID NO: 379889 - DNA, 140 bp, Artificial Sequence
  Synthetic
atacgccatgctgggtctccggcatacacacattgtttctgtttctactgccgacgtcttgataatgtgcaaagatttaattacatgtcgattcaacacaactctaatctcaaaaatagccgtacttgggagtcggccat

SEQ ID NO: 379890 - DNA, 140 bp, Artificial Sequence
  Synthetic
atggccgactcccaagtacggctatttttgagattagagttgtgttgaatcgacatgtaattaaatctttgcacattatcaagacgtcggcagtagaaacagaaacaatgtgtgtatgccggagacccagcatggcgtat

SEQ ID NO: 379891 - DNA, 140 bp, Artificial Sequence
  Synthetic
aggccctggctgctgatatgatttagctgtaaatcacaccctagaagaaattacagaaatgcgtgcactaaagccttcacaggctcaaaagatccgtgaattccatagaacattgataaggaccttttgggacagcggtg

SEQ ID NO: 379892 - DNA, 140 bp, Artificial Sequence
  Synthetic
caccgctgtcccaaaaggtccttatcaatgttctatggaattcacggatcttttgagcctgtgaaggctttagtgcacgcatttctgtaatttcttctagggtgtgatttacagctaaatcatatcagcagccagggcct

SEQ ID NO: 379893 - DNA, 140 bp, Artificial Sequence
  Synthetic
aggccctggctgctgatatggctggagatgacgccacaacaactttgtgagctattttccattcaaaaacactgggggcatcctgtgctacatagtgaaacagcaatccaaaaagttaaagaccttttgggacagcggtg

SEQ ID NO: 379894 - DNA, 140 bp, Artificial Sequence
  Synthetic
caccgctgtcccaaaaggtctttaactttttggattgctgtttcactatgtagcacaggatgcccccagtgtttttgaatggaaaatagctcacaaagttgttgtggcgtcatctccagccatatcagcagccagggcct

SEQ ID NO: 379895 - DNA, 140 bp, Artificial Sequence
  Synthetic
aggccctggctgctgatatgactgggggcatcctgtgctacatagtgaaacagcaatccaaaaagttaaaaaacatgctacggtgctaaaagcattacgccctatagtgattttcgagacgaccttttgggacagcggtg

SEQ ID NO: 379896 - DNA, 140 bp, Artificial Sequence
  Synthetic
caccgctgtcccaaaaggtcgtctcgaaaatcactatagggcgtaatgcttttagcaccgtagcatgttttttaactttttggattgctgtttcactatgtagcacaggatgcccccagtcatatcagcagccagggcct

SEQ ID NO: 379897 - DNA, 140 bp, Artificial Sequence
  Synthetic
aggccctggctgctgatatgaacaatcgagcgcaaggtttcaaggttgaactgagagtgtctagacaacaaaatattgatactccagacaccaagcaagacctgagaaaaaaaccatggcgaccttttgggacagcggtg

SEQ ID NO: 379898 - DNA, 140 bp, Artificial Sequence
  Synthetic
caccgctgtcccaaaaggtcgccatggtttttttctcaggtcttgcttggtgtctggagtatcaatattttgttgtctagacactctcagttcaaccttgaaaccttgcgctcgattgttcatatcagcagccagggcct

SEQ ID NO: 379899 - DNA, 140 bp, Artificial Sequence
  Synthetic
atacgccatgctgggtctccttattagtgacttaagtatttttataaaagacagagctaccgcagtagaaaggacatgctgggatgcagtattcgagcctaatgttctaggatataatcccgtacttgggagtcggccat

SEQ ID NO: 379900 - DNA, 140 bp, Artificial Sequence
  Synthetic
atggccgactcccaagtacgggattatatcctagaacattaggctcgaatactgcatcccagcatgtcctttctactgcggtagctctgtcttttataaaaatacttaagtcactaataaggagacccagcatggcgtat

SEQ ID NO: 379901 - DNA, 140 bp, Artificial Sequence
  Synthetic
aggccctggctgctgatatgaggacatgctgggatgcagtattcgagcctaatgttctaggatataatccacctcacaaatttagtactaaacgtgtaccggaacaatttttagagcaaggaccttttgggacagcggtg

SEQ ID NO: 379902 - DNA, 140 bp, Artificial Sequence
  Synthetic
caccgctgtcccaaaaggtccttgctctaaaaattgttccggtacacgtttagtactaaatttgtgaggtggattatatcctagaacattaggctcgaatactgcatcccagcatgtcctcatatcagcagccagggcct

SEQ ID NO: 379903 - DNA, 140 bp, Artificial Sequence
  Synthetic
aggccctggctgctgatatgctactaccacaatatcggaacttttctttctcattgaaagagaaagagttgaatgtaggtagaaccttcggaaaattgccttatccgactcgcaatgttcgaccttttgggacagcggtg

SEQ ID NO: 379904 - DNA, 140 bp, Artificial Sequence
  Synthetic
caccgctgtcccaaaaggtcgaacattgcgagtcggataaggcaattttccgaaggttctacctacattcaactctttctctttcaatgagaaagaaaagttccgatattgtggtagtagcatatcagcagccagggcct

SEQ ID NO: 379905 - DNA, 140 bp, Artificial Sequence
  Synthetic
aggccctggctgctgatatggaatgtaggtagaaccttcggaaaattgccttatccgactcgcaatgttcaaacactttgtgaagctctgttagctgatggtcttgctaaagcatttcctgaccttttgggacagcggtg

SEQ ID NO: 379906 - DNA, 140 bp, Artificial Sequence
  Synthetic
caccgctgtcccaaaaggtcaggaaatgctttagcaagaccatcagctaacagagcttcacaaagtgtttgaacattgcgagtcggataaggcaattttccgaaggttctacctacattccatatcagcagccagggcct

SEQ ID NO: 379907 - DNA, 140 bp, Artificial Sequence
  Synthetic
aggccctggctgctgatatgttagagggagtagctttgtaactgatttagagaaatacaatcttgcatttagatatgagtttacagcaccttttatagaatattgcaaccgttgctatgggaccttttgggacagcggtg

SEQ ID NO: 379908 - DNA, 140 bp, Artificial Sequence
  Synthetic
caccgctgtcccaaaaggtcccatagcaacggttgcaatattctataaaaggtgctgtaaactcatatctaaatgcaagattgtatttctctaaatcagttacaaagctactccctctaacatatcagcagccagggcct

SEQ ID NO: 379909 - DNA, 140 bp, Artificial Sequence
  Synthetic
atacgccatgctgggtctccacacgaatgcaaagtttgattcttgaatttaatagctctcttgctatctaactaaggtagaatacttcatattgagctaactcatatatgctgactcaatcgtacttgggagtcggccat

SEQ ID NO: 379910 - DNA, 140 bp, Artificial Sequence
  Synthetic
atggccgactcccaagtacgattgagtcagcatatatgagttagctcaatatgaagtattctaccttagttagatagcaagagagctattaaattcaagaatcaaactttgcattcgtgtggagacccagcatggcgtat

SEQ ID NO: 379911 - DNA, 140 bp, Artificial Sequence
  Synthetic
aggccctggctgctgatatggattgaaggactgcaacaaaaactctggacaagtatttcatgtgctcaaatttctttagttgaaattaagactggttttaagttacgctcagctgtgatggaccttttgggacagcggtg

SEQ ID NO: 379912 - DNA, 140 bp, Artificial Sequence
  Synthetic
caccgctgtcccaaaaggtccatcacagctgagcgtaacttaaaaccagtcttaatttcaactaaagaaatttgagcacatgaaatacttgtccagagtttttgttgcagtccttcaatccatatcagcagccagggcct

SEQ ID NO: 379913 - DNA, 140 bp, Artificial Sequence
  Synthetic
aggccctggctgctgatatgctacttgatcacaatactccgtatacctatcatcatatatttaatcaagacgatatcctttaaaacttattcagtactataatcactctcatttcaaattgaccttttgggacagcggtg

SEQ ID NO: 379914 - DNA, 140 bp, Artificial Sequence
  Synthetic
caccgctgtcccaaaaggtcaatttgaaatgagagtgattatagtactgaataagttttaaaggatatcgtcttgattaaatatatgatgataggtatacggagtattgtgatcaagtagcatatcagcagccagggcct

SEQ ID NO: 379915 - DNA, 140 bp, Artificial Sequence
  Synthetic
atacgccatgctgggtctccgaaacatttgtacattcaggttttatctattttggaaaaaaacaatatttgaatggggtccaattgcctcagtcccttaaaacggctacaagaatggcaccgtacttgggagtcggccat

SEQ ID NO: 379916 - DNA, 140 bp, Artificial Sequence
  Synthetic
atggccgactcccaagtacggtgccattcttgtagccgttttaagggactgaggcaattggaccccattcaaatattgtttttttccaaaatagataaaacctgaatgtacaaatgtttcggagacccagcatggcgtat

SEQ ID NO: 379917 - DNA, 140 bp, Artificial Sequence
  Synthetic
aggccctggctgctgatatgactgaacccgcaggtcacatgtgttaggtttcacagattctatatattactaactctatactcgtaattaacattagataagtagattaagaaaaaagccgaccttttgggacagcggtg

SEQ ID NO: 379918 - DNA, 140 bp, Artificial Sequence
  Synthetic
caccgctgtcccaaaaggtcggcttttttcttaatctacttatctaatgttaattacgagtatagagttagtaatatatagaatctgtgaaacctaacacatgtgacctgcgggttcagtcatatcagcagccagggcct

SEQ ID NO: 379919 - DNA, 140 bp, Artificial Sequence
  Synthetic
atacgccatgctgggtctcccattgtctgatgcaatttttgatgatcttcaagggaccctggctagtataggcactgcttttgagcgatccatctctgagacacgacatatctttccttgcgtacttgggagtcggccat

SEQ ID NO: 379920 - DNA, 140 bp, Artificial Sequence
  Synthetic
atggccgactcccaagtacgcaaggaaagatatgtcgtgtctcagagatggatcgctcaaaagcagtgcctatactagccagggtcccttgaagatcatcaaaaattgcatcagacaatgggagacccagcatggcgtat

SEQ ID NO: 379921 - DNA, 140 bp, Artificial Sequence
  Synthetic
aggccctggctgctgatatgggtgcttggagggttatccttcttgaatcctgagaaatgtttctaccggaatctaggagatccagttacctcaggcttattccagttaaaaacttatctcgaccttttgggacagcggtg

SEQ ID NO: 379922 - DNA, 140 bp, Artificial Sequence
  Synthetic
caccgctgtcccaaaaggtcgagataagtttttaactggaataagcctgaggtaactggatctcctagattccggtagaaacatttctcaggattcaagaaggataaccctccaagcacccatatcagcagccagggcct

SEQ ID NO: 379923 - DNA, 140 bp, Artificial Sequence
  Synthetic
aggccctggctgctgatatgtaaagcattggtcaaaaagtcaatagaaatttaaacagtgagtggagacaactttcaaatggaagctccatacgagagaggacgcccccgagctgccagagaccttttgggacagcggtg

SEQ ID NO: 379924 - DNA, 140 bp, Artificial Sequence
  Synthetic
caccgctgtcccaaaaggtctctggcagctcgggggcgtcctctctcgtatggagcttccatttgaaagttgtctccactcactgtttaaatttctattgactttttgaccaatgctttacatatcagcagccagggcct

SEQ ID NO: 379925 - DNA, 140 bp, Artificial Sequence
  Synthetic
atacgccatgctgggtctcccgaatgattgagatggatgatttattcttacctttaattgcgaagaaccctgggaactgcactgccattgactttgtgctaaatcctagcggattaaatgcgtacttgggagtcggccat

SEQ ID NO: 379926 - DNA, 140 bp, Artificial Sequence
  Synthetic
atggccgactcccaagtacgcatttaatccgctaggatttagcacaaagtcaatggcagtgcagttcccagggttcttcgcaattaaaggtaagaataaatcatccatctcaatcattcgggagacccagcatggcgtat

SEQ ID NO: 379927 - DNA, 140 bp, Artificial Sequence
  Synthetic
aggccctggctgctgatatggggaagcgattgcaaattctaggatacctggaaggaacacgcacattattagcctctaagatcatcaacaataatacagagacaccggttttggacagacgaccttttgggacagcggtg

SEQ ID NO: 379928 - DNA, 140 bp, Artificial Sequence
  Synthetic
caccgctgtcccaaaaggtcgtctgtccaaaaccggtgtctctgtattattgttgatgatcttagaggctaataatgtgcgtgttccttccaggtatcctagaatttgcaatcgcttccccatatcagcagccagggcct

SEQ ID NO: 379929 - DNA, 140 bp, Artificial Sequence
  Synthetic
atacgccatgctgggtctcctgatttagcacagattctgagggaatattcatgggctcatattttagagggaagacctcttattggagccacactcccatgtatgattgagcaattcaaacgtacttgggagtcggccat

SEQ ID NO: 379930 - DNA, 140 bp, Artificial Sequence
  Synthetic
atggccgactcccaagtacgtttgaattgctcaatcatacatgggagtgtggctccaataagaggtcttccctctaaaatatgagcccatgaatattccctcagaatctgtgctaaatcaggagacccagcatggcgtat

SEQ ID NO: 379931 - DNA, 140 bp, Artificial Sequence
  Synthetic
aggccctggctgctgatatgtctatgctttaccagagcggagattacttactctccatattagggtctgatgggtataaaattattaagttcctcgaaccattgtgcttggccaaaattcgaccttttgggacagcggtg

SEQ ID NO: 379932 - DNA, 140 bp, Artificial Sequence
  Synthetic
caccgctgtcccaaaaggtcgaattttggccaagcacaatggttcgaggaacttaataattttatacccatcagaccctaatatggagagtaagtaatctccgctctggtaaagcatagacatatcagcagccagggcct

SEQ ID NO: 379933 - DNA, 140 bp, Artificial Sequence
  Synthetic
aggccctggctgctgatatggcaaccaggtgggaaaccattcgtgtcagtggcagtcaagaaacatattgttagtgcatggccgaacgcatcccgaataagctggactatcggggatggagaccttttgggacagcggtg

SEQ ID NO: 379934 - DNA, 140 bp, Artificial Sequence
  Synthetic
caccgctgtcccaaaaggtctccatccccgatagtccagcttattcgggatgcgttcggccatgcactaacaatatgtttcttgactgccactgacacgaatggtttcccacctggttgccatatcagcagccagggcct

SEQ ID NO: 379935 - DNA, 140 bp, Artificial Sequence
  Synthetic
atacgccatgctgggtctccatcccatacattggatcaaggacagaagataagataggacaacctgctattaaaccaaaatgtccttccgcagccttaagagaggccattgaattggcgtcgtacttgggagtcggccat

SEQ ID NO: 379936 - DNA, 140 bp, Artificial Sequence
  Synthetic
atggccgactcccaagtacgacgccaattcaatggcctctcttaaggctgcggaaggacattttggtttaatagcaggttgtcctatcttatcttctgtccttgatccaatgtatgggatggagacccagcatggcgtat

SEQ ID NO: 379937 - DNA, 140 bp, Artificial Sequence
  Synthetic
aggccctggctgctgatatgcccgtttaacatgggtaactcaaggcagttcgaacagtgacttgctaataaaaccatttttggaagcacgagtaaatttaagtgttcaagaaatacttcagaccttttgggacagcggtg

SEQ ID NO: 379938 - DNA, 140 bp, Artificial Sequence
  Synthetic
caccgctgtcccaaaaggtctgaagtatttcttgaacacttaaatttactcgtgcttccaaaaatggttttattagcaagtcactgttcgaactgccttgagttacccatgttaaacgggcatatcagcagccagggcct

SEQ ID NO: 379939 - DNA, 140 bp, Artificial Sequence
  Synthetic
aggccctggctgctgatatgaaaccatttttggaagcacgagtaaatttaagtgttcaagaaatacttcaaatgaccccttcacattactcaggaaatattgttcacaggtacaacgatcgaccttttgggacagcggtg

SEQ ID NO: 379940 - DNA, 140 bp, Artificial Sequence
  Synthetic
caccgctgtcccaaaaggtcgatcgttgtacctgtgaacaatatttcctgagtaatgtgaaggggtcatttgaagtatttcttgaacacttaaatttactcgtgcttccaaaaatggtttcatatcagcagccagggcct

SEQ ID NO: 379941 - DNA, 140 bp, Artificial Sequence
  Synthetic
aggccctggctgctgatatggttattaagtaacccaaaccaaaaatgatgaagattaagaaaaacctacctcgactgagagagtgttttttcattaaccttcatcttgtaaacgttgagcgaccttttgggacagcggtg

SEQ ID NO: 379942 - DNA, 140 bp, Artificial Sequence
  Synthetic
caccgctgtcccaaaaggtcgctcaacgtttacaagatgaaggttaatgaaaaaacactctctcagtcgaggtaggtttttcttaatcttcatcatttttggtttgggttacttaataaccatatcagcagccagggcct

SEQ ID NO: 379943 - DNA, 140 bp, Artificial Sequence
  Synthetic
aggccctggctgctgatatgttgcactgttcgatattaaatttagaaacactgaggctacagatatccaatataatcgtgctcaccttcatctaactaagtgttgcacccgggaagtaccgaccttttgggacagcggtg

SEQ ID NO: 379944 - DNA, 140 bp, Artificial Sequence
  Synthetic
caccgctgtcccaaaaggtcggtacttcccgggtgcaacacttagttagatgaaggtgagcacgattatattggatatctgtagcctcagtgtttctaaatttaatatcgaacagtgcaacatatcagcagccagggcct

SEQ ID NO: 379945 - DNA, 140 bp, Artificial Sequence
  Synthetic
aggccctggctgctgatatggaaaacttttctattgagaatgttctttcctacgcacaaaaactcgagtatctactaccacaatatcggaacttttctttctcattgaaagagaaagagtgaccttttgggacagcggtg

SEQ ID NO: 379946 - DNA, 140 bp, Artificial Sequence
  Synthetic
caccgctgtcccaaaaggtcactctttctctttcaatgagaaagaaaagttccgatattgtggtagtagatactcgagtttttgtgcgtaggaaagaacattctcaatagaaaagttttccatatcagcagccagggcct

SEQ ID NO: 379947 - DNA, 140 bp, Artificial Sequence
  Synthetic
atacgccatgctgggtctccacagacccaattagcagtggagaaacaagatcattcactacccatttcttaacttatcccaagataggacttctgtacagttttggggcctttgtaagttcgtacttgggagtcggccat

SEQ ID NO: 379948 - DNA, 140 bp, Artificial Sequence
  Synthetic
atggccgactcccaagtacgaacttacaaaggccccaaaactgtacagaagtcctatcttgggataagttaagaaatgggtagtgaatgatcttgtttctccactgctaattgggtctgtggagacccagcatggcgtat

SEQ ID NO: 379949 - DNA, 140 bp, Artificial Sequence
  Synthetic
aggccctggctgctgatatgtagatatgagtttacagcaccttttatagaatattgcaaccgttgctatggtgttaagaatgtttttaattggatgcattatacaatcccacagtgttatgaccttttgggacagcggtg

SEQ ID NO: 379950 - DNA, 140 bp, Artificial Sequence
  Synthetic
caccgctgtcccaaaaggtcataacactgtgggattgtataatgcatccaattaaaaacattcttaacaccatagcaacggttgcaatattctataaaaggtgctgtaaactcatatctacatatcagcagccagggcct

SEQ ID NO: 379951 - DNA, 140 bp, Artificial Sequence
  Synthetic
atacgccatgctgggtctcctgagtattgatcctcatttttctatttacataggcggtgctgcaggtgacagaggactctcagatgcggccaggttatttttgagaacgtccatttcatccgtacttgggagtcggccat

SEQ ID NO: 379952 - DNA, 140 bp, Artificial Sequence
  Synthetic
atggccgactcccaagtacggatgaaatggacgttctcaaaaataacctggccgcatctgagagtcctctgtcacctgcagcaccgcctatgtaaatagaaaaatgaggatcaatactcaggagacccagcatggcgtat

SEQ ID NO: 379953 - DNA, 140 bp, Artificial Sequence
  Synthetic
aggccctggctgctgatatgagaggactctcagatgcggccaggttatttttgagaacgtccatttcatcttttcttacatttgtaaaagaatggataattaatcgcggaacaattgtccgaccttttgggacagcggtg

SEQ ID NO: 379954 - DNA, 140 bp, Artificial Sequence
  Synthetic
caccgctgtcccaaaaggtcggacaattgttccgcgattaattatccattcttttacaaatgtaagaaaagatgaaatggacgttctcaaaaataacctggccgcatctgagagtcctctcatatcagcagccagggcct

SEQ ID NO: 379955 - DNA, 140 bp, Artificial Sequence
  Synthetic
aggccctggctgctgatatgagactcttcaactggatcaagcacaaacaacagtgatggtcatattgagagaagtcaagaacaaaccaccagagatccacatgatggcactgaacggaatgaccttttgggacagcggtg

SEQ ID NO: 379956 - DNA, 140 bp, Artificial Sequence
  Synthetic
caccgctgtcccaaaaggtcattccgttcagtgccatcatgtggatctctggtggtttgttcttgacttctctcaatatgaccatcactgttgtttgtgcttgatccagttgaagagtctcatatcagcagccagggcct

SEQ ID NO: 379957 - DNA, 140 bp, Artificial Sequence
  Synthetic
aggccctggctgctgatatggaagtcaagaacaaaccaccagagatccacatgatggcactgaacggaatctagtcctacaaatgagccatgaaataaaaagaacgacaattccacaagagaccttttgggacagcggtg

SEQ ID NO: 379958 - DNA, 140 bp, Artificial Sequence
  Synthetic
caccgctgtcccaaaaggtctcttgtggaattgtcgttctttttatttcatggctcatttgtaggactagattccgttcagtgccatcatgtggatctctggtggtttgttcttgacttccatatcagcagccagggcct

SEQ ID NO: 379959 - DNA, 140 bp, Artificial Sequence
  Synthetic
atacgccatgctgggtctccaaacacgcaccagggtccgtcgttccagtcctttctaagtgactctgcttgtggtacagcaaatccaaaactaaatttcgatcgatcgagacacaatgtgcgtacttgggagtcggccat

SEQ ID NO: 379960 - DNA, 140 bp, Artificial Sequence
  Synthetic
atggccgactcccaagtacgcacattgtgtctcgatcgatcgaaatttagttttggatttgctgtaccacaagcagagtcacttagaaaggactggaacgacggaccctggtgcgtgtttggagacccagcatggcgtat

SEQ ID NO: 379961 - DNA, 140 bp, Artificial Sequence
  Synthetic
aggccctggctgctgatatggcaggataaccgcagctttccatacgtttttttcggtgagaatcttgcaatatcatcatctcgggttcaataaaggttttgaccttggacagttaacactgaccttttgggacagcggtg

SEQ ID NO: 379962 - DNA, 140 bp, Artificial Sequence
  Synthetic
caccgctgtcccaaaaggtcagtgttaactgtccaaggtcaaaacctttattgaacccgagatgatgatattgcaagattctcaccgaaaaaaacgtatggaaagctgcggttatcctgccatatcagcagccagggcct

SEQ ID NO: 379963 - DNA, 140 bp, Artificial Sequence
  Synthetic
aggccctggctgctgatatgagatcaggaccacattcaagaggccaggaaccaagacagtgacaacacccagccagaacattcttttgaggagatgtatcgccacattctaagatcacaggaccttttgggacagcggtg

SEQ ID NO: 379964 - DNA, 140 bp, Artificial Sequence
  Synthetic
caccgctgtcccaaaaggtcctgtgatcttagaatgtggcgatacatctcctcaaaagaatgttctggctgggtgttgtcactgtcttggttcctggcctcttgaatgtggtcctgatctcatatcagcagccagggcct

SEQ ID NO: 379965 - DNA, 140 bp, Artificial Sequence
  Synthetic
aggccctggctgctgatatgtgcccttatcctcaaattgcctacatgcttacatttggggataaccagtgtgacttggattggagatgtgaagaaaaaatcgggacccatttctaggttggaccttttgggacagcggtg

SEQ ID NO: 379966 - DNA, 140 bp, Artificial Sequence
  Synthetic
caccgctgtcccaaaaggtccaacctagaaatgggtcccgattttttcttcacatctccaatccaagtcacactggttatccccaaatgtaagcatgtaggcaatttgaggataagggcacatatcagcagccagggcct

SEQ ID NO: 379967 - DNA, 140 bp, Artificial Sequence
  Synthetic
aggccctggctgctgatatggccttactattgattcagaaataccaagttaagaccttatttttcaacacgctagctactgagtccagtatagagtcagaaatagtatcaggaatgactagaccttttgggacagcggtg

SEQ ID NO: 379968 - DNA, 140 bp, Artificial Sequence
  Synthetic
caccgctgtcccaaaaggtctagtcattcctgatactatttctgactctatactggactcagtagctagcgtgttgaaaaataaggtcttaacttggtatttctgaatcaatagtaaggccatatcagcagccagggcct

SEQ ID NO: 379969 - DNA, 140 bp, Artificial Sequence
  Synthetic
aggccctggctgctgatatgacatcatattgatctgatttcaataaacaactatttaaataacgaaaggagtccctatattatacactatatttagcctctctccctgcgtgataatcaagaccttttgggacagcggtg

SEQ ID NO: 379970 - DNA, 140 bp, Artificial Sequence
  Synthetic
caccgctgtcccaaaaggtcttgattatcacgcagggagagaggctaaatatagtgtataatatagggactcctttcgttatttaaatagttgtttattgaaatcagatcaatatgatgtcatatcagcagccagggcct

SEQ ID NO: 379971 - DNA, 140 bp, Artificial Sequence
  Synthetic
aggccctggctgctgatatgcgtcagctgacttcgaagacgaaatggtttgtaaatggctattatcatcaactcctgttatgagtcgttttgcggccgatatcttttcacgcacgccgaggaccttttgggacagcggtg

SEQ ID NO: 379972 - DNA, 140 bp, Artificial Sequence
  Synthetic
caccgctgtcccaaaaggtcctcggcgtgcgtgaaaagatatcggccgcaaaacgactcataacaggagttgatgataatagccatttacaaaccatttcgtcttcgaagtcagctgacgcatatcagcagccagggcct

SEQ ID NO: 379973 - DNA, 140 bp, Artificial Sequence
  Synthetic
aggccctggctgctgatatggagattattcttaacaactcagcaagccaaataacagacataacaaatcctacttggtttaaagaccaaagagcaaggctacctaagcaagtcgaggttagaccttttgggacagcggtg

SEQ ID NO: 379974 - DNA, 140 bp, Artificial Sequence
  Synthetic
caccgctgtcccaaaaggtctaacctcgacttgcttaggtagccttgctctttggtctttaaaccaagtaggatttgttatgtctgttatttggcttgctgagttgttaagaataatctccatatcagcagccagggcct

SEQ ID NO: 379975 - DNA, 140 bp, Artificial Sequence
  Synthetic
aggccctggctgctgatatgagcagtggtccttaaagtctttctaagtgatactgagggtatgttatggctaaatgataatttagccccgttttttgccactggttatttaattaagccagaccttttgggacagcggtg

SEQ ID NO: 379976 - DNA, 140 bp, Artificial Sequence
  Synthetic
caccgctgtcccaaaaggtctggcttaattaaataaccagtggcaaaaaacggggctaaattatcatttagccataacataccctcagtatcacttagaaagactttaaggaccactgctcatatcagcagccagggcct

SEQ ID NO: 379977 - DNA, 140 bp, Artificial Sequence
  Synthetic
atacgccatgctgggtctcctaaatgataatttagccccgttttttgccactggttatttaattaagccaataacgtcaagtgctagatctagtgagtggtatctttgtctgacgaacttcgtacttgggagtcggccat

SEQ ID NO: 379978 - DNA, 140 bp, Artificial Sequence
  Synthetic
atggccgactcccaagtacgaagttcgtcagacaaagataccactcactagatctagcacttgacgttattggcttaattaaataaccagtggcaaaaaacggggctaaattatcatttaggagacccagcatggcgtat

SEQ ID NO: 379979 - DNA, 140 bp, Artificial Sequence
  Synthetic
aggccctggctgctgatatgacatacagattataaaaaactcataaattgctctcatacatcatattgatctgatttcaataaacaactatttaaataacgaaaggagtccctatattatgaccttttgggacagcggtg

SEQ ID NO: 379980 - DNA, 140 bp, Artificial Sequence
  Synthetic
caccgctgtcccaaaaggtcataatatagggactcctttcgttatttaaatagttgtttattgaaatcagatcaatatgatgtatgagagcaatttatgagttttttataatctgtatgtcatatcagcagccagggcct

SEQ ID NO: 379981 - DNA, 140 bp, Artificial Sequence
  Synthetic
aggccctggctgctgatatgttaaaacataatgggacatggcaagctgagtttaagaaattaccagagttgattagtgtgtgcaataggttctaccatattagagattgcaattgtgaaggaccttttgggacagcggtg

SEQ ID NO: 379982 - DNA, 140 bp, Artificial Sequence
  Synthetic
caccgctgtcccaaaaggtccttcacaattgcaatctctaatatggtagaacctattgcacacactaatcaactctggtaatttcttaaactcagcttgccatgtcccattatgttttaacatatcagcagccagggcct

SEQ ID NO: 379983 - DNA, 140 bp, Artificial Sequence
  Synthetic
aggccctggctgctgatatgaacgtttcttagttcaaaccttatatttacatagaatgcaggattctgaagttaagcttatcgaaaggctgacagggcttctgagtttatttccggatgggaccttttgggacagcggtg

SEQ ID NO: 379984 - DNA, 140 bp, Artificial Sequence
  Synthetic
caccgctgtcccaaaaggtcccatccggaaataaactcagaagccctgtcagcctttcgataagcttaacttcagaatcctgcattctatgtaaatataaggtttgaactaagaaacgttcatatcagcagccagggcct

SEQ ID NO: 379985 - DNA, 140 bp, Artificial Sequence
  Synthetic
aggccctggctgctgatatgacatcatattgatctaatctcaataaacaactatttaaataacgaaaggagtccctatattatatactatatttagcctctctccctgcgtgataatcaagaccttttgggacagcggtg

SEQ ID NO: 379986 - DNA, 140 bp, Artificial Sequence
  Synthetic
caccgctgtcccaaaaggtcttgattatcacgcagggagagaggctaaatatagtatataatatagggactcctttcgttatttaaatagttgtttattgagattagatcaatatgatgtcatatcagcagccagggcct

SEQ ID NO: 379987 - DNA, 140 bp, Artificial Sequence
  Synthetic
aggccctggctgctgatatgcgcaacataataaactctgcactctttataattaagctttaacgaaaggtctgggctcatattgttattgatataataatgttgtatcaatatcctgtcagaccttttgggacagcggtg

SEQ ID NO: 379988 - DNA, 140 bp, Artificial Sequence
  Synthetic
caccgctgtcccaaaaggtctgacaggatattgatacaacattattatatcaataacaatatgagcccagacctttcgttaaagcttaattataaagagtgcagagtttattatgttgcgcatatcagcagccagggcct

SEQ ID NO: 379989 - DNA, 140 bp, Artificial Sequence
  Synthetic
aggccctggctgctgatatggatggaatagtgttttggttgataacacaacttcttaaaacaaaattgatctttaagattaagttttttataattatcattactttaatttgtcgttttagaccttttgggacagcggtg

SEQ ID NO: 379990 - DNA, 140 bp, Artificial Sequence
  Synthetic
caccgctgtcccaaaaggtctaaaacgacaaattaaagtaatgataattataaaaaacttaatcttaaagatcaattttgttttaagaagttgtgttatcaaccaaaacactattccatccatatcagcagccagggcct

SEQ ID NO: 379991 - DNA, 140 bp, Artificial Sequence
  Synthetic
aggccctggctgctgatatgacgctcatcagaaggctcgccagaataaacgttgcaaaaaggattcctggaaaaatggtcgcacacaaaaatttaaaaataaatctatttcttcttttttgaccttttgggacagcggtg

SEQ ID NO: 379992 - DNA, 140 bp, Artificial Sequence
  Synthetic
caccgctgtcccaaaaggtcaaaaaagaagaaatagatttatttttaaatttttgtgtgcgaccatttttccaggaatcctttttgcaacgtttattctggcgagccttctgatgagcgtcatatcagcagccagggcct

SEQ ID NO: 379993 - DNA, 140 bp, Artificial Sequence
  Synthetic
aggccctggctgctgatatgtaattttctctatcagatcgtagaactgctggtgcatgattcatcaagacaacaggcttttaaaactaccataagtgatcatgtacatcctcacgacaatgaccttttgggacagcggtg

SEQ ID NO: 379994 - DNA, 140 bp, Artificial Sequence
  Synthetic
caccgctgtcccaaaaggtcattgtcgtgaggatgtacatgatcacttatggtagttttaaaagcctgttgtcttgatgaatcatgcaccagcagttctacgatctgatagagaaaattacatatcagcagccagggcct

SEQ ID NO: 379995 - DNA, 140 bp, Artificial Sequence
  Synthetic
aggccctggctgctgatatgtcacaaagatagagaacaacctaggtctctgaagggagcaagggcatcagtgtgctcagttgaaaatcccttgtcaacatctaggtcttatcacatcacagaccttttgggacagcggtg

SEQ ID NO: 379996 - DNA, 140 bp, Artificial Sequence
  Synthetic
caccgctgtcccaaaaggtctgtgatgtgataagacctagatgttgacaagggattttcaactgagcacactgatgcccttgctcccttcagagacctaggttgttctctatctttgtgacatatcagcagccagggcct

SEQ ID NO: 379997 - DNA, 140 bp, Artificial Sequence
  Synthetic
atacgccatgctgggtctcccctaaagcttggggtaaaacattggaaatagttaaaagacaaattgctcggaatcacaacattccgagtatggattctcgtcctcagaaagtctggatgacgtacttgggagtcggccat

SEQ ID NO: 379998 - DNA, 140 bp, Artificial Sequence
  Synthetic
atggccgactcccaagtacgtcatccagactttctgaggacgagaatccatactcggaatgttgtgattccgagcaatttgtcttttaactatttccaatgttttaccccaagctttaggggagacccagcatggcgtat

SEQ ID NO: 379999 - DNA, 140 bp, Artificial Sequence
  Synthetic
atacgccatgctgggtctccaggacacatgatggtgattttccgtttgatgcgaacaaattttttgatcaaatttctcctaatacaccaagggatgcacatggttgccgggcatgatgcccgtacttgggagtcggccat

SEQ ID NO: 380000 - DNA, 140 bp, Artificial Sequence
  Synthetic
atggccgactcccaagtacgggcatcatgcccggcaaccatgtgcatcccttggtgtattaggagaaatttgatcaaaaaatttgttcgcatcaaacggaaaatcaccatcatgtgtcctggagacccagcatggcgtat

SEQ ID NO: 380001 - DNA, 140 bp, Artificial Sequence
  Synthetic
aggccctggctgctgatatgaatttctcctaatacaccaagggatgcacatggttgccgggcatgatgccaacgacgctgtgatttcaaattcagtggctcaagctcgtttttcaggtttgaccttttgggacagcggtg

SEQ ID NO: 380002 - DNA, 140 bp, Artificial Sequence
  Synthetic
caccgctgtcccaaaaggtcaaacctgaaaaacgagcttgagccactgaatttgaaatcacagcgtcgttggcatcatgcccggcaaccatgtgcatcccttggtgtattaggagaaattcatatcagcagccagggcct

SEQ ID NO: 380003 - DNA, 140 bp, Artificial Sequence
  Synthetic
aggccctggctgctgatatgggtaactctaagaaaagagcgcctggccaagctgacggaagctatcactgctgcgtcactgcccaaaacaagtggacattacgatgatgatgacgacattgaccttttgggacagcggtg

SEQ ID NO: 380004 - DNA, 140 bp, Artificial Sequence
  Synthetic
caccgctgtcccaaaaggtcaatgtcgtcatcatcatcgtaatgtccacttgttttgggcagtgacgcagcagtgatagcttccgtcagcttggccaggcgctcttttcttagagttacccatatcagcagccagggcct

SEQ ID NO: 380005 - DNA, 140 bp, Artificial Sequence
  Synthetic
aggccctggctgctgatatgccctttccaggacccatcaatgatgacgacaatcctggccatcaagatgatgatccaactgactcacaagatacgaccattcctgatgtggtggttgatcgaccttttgggacagcggtg

SEQ ID NO: 380006 - DNA, 140 bp, Artificial Sequence
  Synthetic
caccgctgtcccaaaaggtcgatcaaccaccacatcaggaatggtcgtatcttgtgagtcagttggatcatcatcttgatggccaggattgtcgtcatcattgatgggtcctggaaagggcatatcagcagccagggcct

SEQ ID NO: 380007 - DNA, 140 bp, Artificial Sequence
  Synthetic
aggccctggctgctgatatgacatcttagagcagagattcgagaattaactaatgattataatcaacagcgacaaagtcggactcaaacatatcactttattcgtactgcaaaaggacgagaccttttgggacagcggtg

SEQ ID NO: 380008 - DNA, 140 bp, Artificial Sequence
  Synthetic
caccgctgtcccaaaaggtctcgtccttttgcagtacgaataaagtgatatgtttgagtccgactttgtcgctgttgattataatcattagttaattctcgaatctctgctctaagatgtcatatcagcagccagggcct

SEQ ID NO: 380009 - DNA, 140 bp, Artificial Sequence
  Synthetic
atacgccatgctgggtctcccactaagccagtgcctaatagatcaaccaagggtggacaacagaaaaacagtcaaaagggccagcatacagagggcagacagacacaatccaggccaactcgtacttgggagtcggccat

SEQ ID NO: 380010 - DNA, 140 bp, Artificial Sequence
  Synthetic
atggccgactcccaagtacgagttggcctggattgtgtctgtctgccctctgtatgctggcccttttgactgtttttctgttgtccacccttggttgatctattaggcactggcttagtgggagacccagcatggcgtat

SEQ ID NO: 380011 - DNA, 140 bp, Artificial Sequence
  Synthetic
aggccctggctgctgatatggtcaaaagggccagcatacagagggcagacagacacaatccaggccaactcaaaatgtcccaggccctcacagaacaatccaccacgccagtgctccactgaccttttgggacagcggtg

SEQ ID NO: 380012 - DNA, 140 bp, Artificial Sequence
  Synthetic
caccgctgtcccaaaaggtcagtggagcactggcgtggtggattgttctgtgagggcctgggacattttgagttggcctggattgtgtctgtctgccctctgtatgctggcccttttgaccatatcagcagccagggcct

SEQ ID NO: 380013 - DNA, 140 bp, Artificial Sequence
  Synthetic
aggccctggctgctgatatgtgctgacaccaatcaacgaagaggcagacccactggacgatgccgacgacgagacgtctagccttccgcccctggagtcagacgatgaagaacaggacaggaccttttgggacagcggtg

SEQ ID NO: 380014 - DNA, 140 bp, Artificial Sequence
  Synthetic
caccgctgtcccaaaaggtcctgtcctgttcttcatcgtctgactccaggggcggaaggctagacgtctcgtcgtcggcatcgtccagtgggtctgcctcttcgttgattggtgtcagcacatatcagcagccagggcct

SEQ ID NO: 380015 - DNA, 140 bp, Artificial Sequence
  Synthetic
atacgccatgctgggtctccggacggaacttccaaccgcacacccactgtcgccccaccggctcccgtatacagagatcactctgaaaagagagaactcccgcaagatgagcaacaagatcgtacttgggagtcggccat

SEQ ID NO: 380016 - DNA, 140 bp, Artificial Sequence
  Synthetic
atggccgactcccaagtacgatcttgttgctcatcttgcgggagttctctcttttcagagtgatctctgtatacgggagccggtggggcgacagtgggtgtgcggttggaagttccgtccggagacccagcatggcgtat

SEQ ID NO: 380017 - DNA, 140 bp, Artificial Sequence
  Synthetic
atacgccatgctgggtctccggaatatccaccatggctcactgaaaaagaggctatgaatgaagagaatagatttgttacattggatggtcaacaattttattggccggtaatgaatcaccgtacttgggagtcggccat

SEQ ID NO: 380018 - DNA, 140 bp, Artificial Sequence
  Synthetic
atggccgactcccaagtacggtgattcattaccggccaataaaattgttgaccatccaatgtaacaaatctattctcttcattcatagcctctttttcagtgagccatggtggatattccggagacccagcatggcgtat

SEQ ID NO: 380019 - DNA, 140 bp, Artificial Sequence
  Synthetic
atacgccatgctgggtctccaaaaattcacaatgcagcatgtgtgacatattactgccgcaatgaatttaacgcaacataataaactctgcactctttataattaagctttaacgaaaggcgtacttgggagtcggccat

SEQ ID NO: 380020 - DNA, 140 bp, Artificial Sequence
  Synthetic
atggccgactcccaagtacgcctttcgttaaagcttaattataaagagtgcagagtttattatgttgcgttaaattcattgcggcagtaatatgtcacacatgctgcattgtgaatttttggagacccagcatggcgtat

SEQ ID NO: 380021 - DNA, 140 bp, Artificial Sequence
  Synthetic
atacgccatgctgggtctccaaaaacggtgatagccttaatctttgtgtaaaataagagattaggtgtaataaccttaacatttttgtctagtaagctactatttcatacagaatgataacgtacttgggagtcggccat

SEQ ID NO: 380022 - DNA, 140 bp, Artificial Sequence
  Synthetic
atggccgactcccaagtacgttatcattctgtatgaaatagtagcttactagacaaaaatgttaaggttattacacctaatctcttattttacacaaagattaaggctatcaccgtttttggagacccagcatggcgtat

SEQ ID NO: 380023 - DNA, 140 bp, Artificial Sequence
  Synthetic
aggccctggctgctgatatggtcaaaagggccagcatatagagggcagacagacacaatccaagccaattcaaaatgtcccaggccctcacagaacaatccaccacgccagcgcgccaccgaccttttgggacagcggtg

SEQ ID NO: 380024 - DNA, 140 bp, Artificial Sequence
  Synthetic
caccgctgtcccaaaaggtcggtggcgcgctggcgtggtggattgttctgtgagggcctgggacattttgaattggcttggattgtgtctgtctgccctctatatgctggcccttttgaccatatcagcagccagggcct

SEQ ID NO: 380025 - DNA, 140 bp, Artificial Sequence
  Synthetic
atacgccatgctgggtctcccacggacaatgacagaagaaatgaaccctccggctcaaccagccctcgcatgctgacaccaatcagcgaagaggcagacccactggatgacgccgacgaccgtacttgggagtcggccat

SEQ ID NO: 380026 - DNA, 140 bp, Artificial Sequence
  Synthetic
atggccgactcccaagtacggtcgtcggcgtcatccagtgggtctgcctcttcgctgattggtgtcagcatgcgagggctggttgagccggagggttcatttcttctgtcattgtccgtgggagacccagcatggcgtat

SEQ ID NO: 380027 - DNA, 140 bp, Artificial Sequence
  Synthetic
atacgccatgctgggtctccgagacgtccagccttccgcccctggagtcagacgatgaagagcaggacagggacggaacccccaaccgcacacccactgtcgccccaccggctcccgtatcgtacttgggagtcggccat

SEQ ID NO: 380028 - DNA, 140 bp, Artificial Sequence
  Synthetic
atggccgactcccaagtacgatacgggagccggtggggcgacagtgggtgtgcggttgggggttccgtccctgtcctgctcttcatcgtctgactccaggggcggaaggctggacgtctcggagacccagcatggcgtat

SEQ ID NO: 380029 - DNA, 140 bp, Artificial Sequence
  Synthetic
aggccctggctgctgatatggtatgtgtttttcagcttcaagatggtaaaacacttggactcaaaatttgagcccatcttccttccctccgaaagaggcgactaatagcagaggcttcaagaccttttgggacagcggtg

SEQ ID NO: 380030 - DNA, 140 bp, Artificial Sequence
  Synthetic
caccgctgtcccaaaaggtcttgaagcctctgctattagtcgcctctttcggagggaaggaagatgggctcaaattttgagtccaagtgttttaccatcttgaagctgaaaaacacataccatatcagcagccagggcct

SEQ ID NO: 380031 - DNA, 140 bp, Artificial Sequence
  Synthetic
atacgccatgctgggtctccagggatagtgataacatctatttagtaatccgtccattagaggagacacttttaattgatcaatatactaaaggtactttacaccattgtctttttcctccgtacttgggagtcggccat

SEQ ID NO: 380032 - DNA, 140 bp, Artificial Sequence
  Synthetic
atggccgactcccaagtacggaggaaaaagacaatggtgtaaagtacctttagtatattgatcaattaaaagtgtctcctctaatggacggattactaaatagatgttatcactatccctggagacccagcatggcgtat

SEQ ID NO: 380033 - DNA, 140 bp, Artificial Sequence
  Synthetic
atacgccatgctgggtctccctgctgaactatagggtacgttacattaatgatacacttgtgagtatcagccctggataatataagtcaattaaacgaccaagataaaattgttcttatccgtacttgggagtcggccat

SEQ ID NO: 380034 - DNA, 140 bp, Artificial Sequence
  Synthetic
atggccgactcccaagtacggataagaacaattttatcttggtcgtttaattgacttatattatccagggctgatactcacaagtgtatcattaatgtaacgtaccctatagttcagcagggagacccagcatggcgtat

SEQ ID NO: 380035 - DNA, 140 bp, Artificial Sequence
  Synthetic
atacgccatgctgggtctcccaggtcaaattcaacaattgctaggggtggcaacagcaatacaggcttcctgacaccggagtcagtcaatggagacactccatcgaatccactcaggccacgtacttgggagtcggccat

SEQ ID NO: 380036 - DNA, 140 bp, Artificial Sequence
  Synthetic
atggccgactcccaagtacgtggcctgagtggattcgatggagtgtctccattgactgactccggtgtcaggaagcctgtattgctgttgccacccctagcaattgttgaatttgacctgggagacccagcatggcgtat

SEQ ID NO: 380037 - DNA, 140 bp, Artificial Sequence
  Synthetic
aggccctggctgctgatatggatttgacagcactcaaactgatcacccaaccactgcctgctgcaacatggaccgatgacactccaacaggatcaaatggagcgttgcgcccagggatttgaccttttgggacagcggtg

SEQ ID NO: 380038 - DNA, 140 bp, Artificial Sequence
  Synthetic
caccgctgtcccaaaaggtcaaatccctgggcgcaacgctccatttgatcctgttggagtgtcatcggtccatgttgcagcaggcagtggttgggtgatcagtttgagtgctgtcaaatccatatcagcagccagggcct

SEQ ID NO: 380039 - DNA, 140 bp, Artificial Sequence
  Synthetic
atacgccatgctgggtctcccatttcatccaaaacttcgccccattcttttacccaacaagagtgggaagaaggggaatagtgccgatctaacatctccggagaaaatccaagcaataatcgtacttgggagtcggccat

SEQ ID NO: 380040 - DNA, 140 bp, Artificial Sequence
  Synthetic
atggccgactcccaagtacgattattgcttggattttctccggagatgttagatcggcactattccccttcttcccactcttgttgggtaaaagaatggggcgaagttttggatgaaatgggagacccagcatggcgtat

SEQ ID NO: 380041 - DNA, 140 bp, Artificial Sequence
  Synthetic
atacgccatgctgggtctccaaaactaatttggaaggtcaaccccgaaattgatacaacaatcggggagtgggccttctgggaaactaaaaaaaacctcactagaaaaattcgcagtgaacgtacttgggagtcggccat

SEQ ID NO: 380042 - DNA, 140 bp, Artificial Sequence
  Synthetic
atggccgactcccaagtacgttcactgcgaatttttctagtgaggttttttttagtttcccagaaggcccactccccgattgttgtatcaatttcggggttgaccttccaaattagttttggagacccagcatggcgtat

SEQ ID NO: 380043 - DNA, 140 bp, Artificial Sequence
  Synthetic
aggccctggctgctgatatggagttgtctttcacagctgtatcaaacagagccaaaaacatcagtggtcagagtccggcgcgaacttcttccgacccagggaccaacacaacaactgaaggaccttttgggacagcggtg

SEQ ID NO: 380044 - DNA, 140 bp, Artificial Sequence
  Synthetic
caccgctgtcccaaaaggtccttcagttgttgtgttggtccctgggtcggaagaagttcgcgccggactctgaccactgatgtttttggctctgtttgatacagctgtgaaagacaactccatatcagcagccagggcct

SEQ ID NO: 380045 - DNA, 140 bp, Artificial Sequence
  Synthetic
aggccctggctgctgatatggattgattgatgaaagatcataactaataacattacaaataatcctactataatcaatacggtgatccaaatgttaatctttctcattgcaaatactcttgaccttttgggacagcggtg

SEQ ID NO: 380046 - DNA, 140 bp, Artificial Sequence
  Synthetic
caccgctgtcccaaaaggtcaagagtatttgcaatgagaaagattaacatttggatcaccgtattgattatagtaggattatttgtaatgttattagttatgatctttcatcaatcaatccatatcagcagccagggcct

SEQ ID NO: 380047 - DNA, 140 bp, Artificial Sequence
  Synthetic
atacgccatgctgggtctcctgcccttatcctcaaattgcctacatgcttacatctgaggatagccagtgtgacttggattggagatgtggagaaaaaatcgggacccatttctaggttgcgtacttgggagtcggccat

SEQ ID NO: 380048 - DNA, 140 bp, Artificial Sequence
  Synthetic
atggccgactcccaagtacgcaacctagaaatgggtcccgattttttctccacatctccaatccaagtcacactggctatcctcagatgtaagcatgtaggcaatttgaggataagggcaggagacccagcatggcgtat

SEQ ID NO: 380049 - DNA, 140 bp, Artificial Sequence
  Synthetic
aggccctggctgctgatatggaacaacatcaccgcagaacagacaacgacagcacagcctccgacactccccccgccacgaccgcagccggacccccaaaagcagagaacaccaacacgagaccttttgggacagcggtg

SEQ ID NO: 380050 - DNA, 140 bp, Artificial Sequence
  Synthetic
caccgctgtcccaaaaggtctcgtgttggtgttctctgcttttgggggtccggctgcggtcgtggcggggggagtgtcggaggctgtgctgtcgttgtctgttctgcggtgatgttgttccatatcagcagccagggcct

SEQ ID NO: 380051 - DNA, 140 bp, Artificial Sequence
  Synthetic
atacgccatgctgggtctcctccacaatagcacattacaggttagtgatgtcgacaaactggtttgccgtgacaaactgtcatccacaaatcaattgagatcagttggactgaatctcgacgtacttgggagtcggccat

SEQ ID NO: 380052 - DNA, 140 bp, Artificial Sequence
  Synthetic
atggccgactcccaagtacgtcgagattcagtccaactgatctcaattgatttgtggatgacagtttgtcacggcaaaccagtttgtcgacatcactaacctgtaatgtgctattgtggaggagacccagcatggcgtat

SEQ ID NO: 380053 - DNA, 140 bp, Artificial Sequence
  Synthetic
aggccctggctgctgatatgtcaagcatcatggcaccacgcaagtgatgattttggtgaacatgccacagttagagggagtagttttgtaactgatttagagaaatacaatcttgcatttgaccttttgggacagcggtg

SEQ ID NO: 380054 - DNA, 140 bp, Artificial Sequence
  Synthetic
caccgctgtcccaaaaggtcaaatgcaagattgtatttctctaaatcagttacaaaactactccctctaactgtggcatgttcaccaaaatcatcacttgcgtggtgccatgatgcttgacatatcagcagccagggcct

SEQ ID NO: 380055 - DNA, 140 bp, Artificial Sequence
  Synthetic
aggccctggctgctgatatgaggcaattgatttcttgctgcagcgatggggcggcacatgccacattttgggaccggactgctgtatcgaaccacatgattggaccaagaacataacagagaccttttgggacagcggtg

SEQ ID NO: 380056 - DNA, 140 bp, Artificial Sequence
  Synthetic
caccgctgtcccaaaaggtctctgttatgttcttggtccaatcatgtggttcgatacagcagtccggtcccaaaatgtggcatgtgccgccccatcgctgcagcaagaaatcaattgcctcatatcagcagccagggcct

SEQ ID NO: 380057 - DNA, 140 bp, Artificial Sequence
  Synthetic
atacgccatgctgggtctccccacaaaatcatggcttcagaaaattcctctgcaatggttcaagtgcacagtcaaggaagggaagctgcagtgtcgcatctgacaacccttgccacaatccgtacttgggagtcggccat

SEQ ID NO: 380058 - DNA, 140 bp, Artificial Sequence
  Synthetic
atggccgactcccaagtacggattgtggcaagggttgtcagatgcgacactgcagcttcccttccttgactgtgcacttgaaccattgcagaggaattttctgaagccatgattttgtggggagacccagcatggcgtat

SEQ ID NO: 380059 - DNA, 140 bp, Artificial Sequence
  Synthetic
atacgccatgctgggtctcccccgccacgaccgcagccggacccctaaaagcagagaacaccaacacgagcaagggtaccgacctcctggaccccgccaccacaacaagtccccaaaacccgtacttgggagtcggccat

SEQ ID NO: 380060 - DNA, 140 bp, Artificial Sequence
  Synthetic
atggccgactcccaagtacgggttttggggacttgttgtggtggcggggtccaggaggtcggtacccttgctcgtgttggtgttctctgcttttaggggtccggctgcggtcgtggcgggggagacccagcatggcgtat

SEQ ID NO: 380061 - DNA, 140 bp, Artificial Sequence
  Synthetic
atacgccatgctgggtctccagtcgcaggactgatcacaggcgggaggagagctcgaagagaagcaattgtcaatgctcaacccaaatgcaaccctaatttacattactggactactcagcgtacttgggagtcggccat

SEQ ID NO: 380062 - DNA, 140 bp, Artificial Sequence
  Synthetic
atggccgactcccaagtacgctgagtagtccagtaatgtaaattagggttgcatttgggttgagcattgacaattgcttctcttcgagctctcctcccgcctgtgatcagtcctgcgactggagacccagcatggcgtat

SEQ ID NO: 380063 - DNA, 140 bp, Artificial Sequence
  Synthetic
atacgccatgctgggtctccgatgaaggtgctgcaatcggactggcctggataccatatttcgggccagcagccgagggaatttacacagaggggctgatgcacaatcaagatggtttaacgtacttgggagtcggccat

SEQ ID NO: 380064 - DNA, 140 bp, Artificial Sequence
  Synthetic
atggccgactcccaagtacgttaaaccatcttgattgtgcatcagcccctctgtgtaaattccctcggctgctggcccgaaatatggtatccaggccagtccgattgcagcaccttcatcggagacccagcatggcgtat

SEQ ID NO: 380065 - DNA, 140 bp, Artificial Sequence
  Synthetic
aggccctggctgctgatatggtattggagttacaggcgttataattgcagttatcgctttattctgtatatgcaaatttgtcttttagtttttcttcagattgcttcatggcaaagctcagaccttttgggacagcggtg

SEQ ID NO: 380066 - DNA, 140 bp, Artificial Sequence
  Synthetic
caccgctgtcccaaaaggtctgagctttgccatgaagcaatctgaagaaaaactaaaagacaaatttgcatatacagaataaagcgataactgcaattataacgcctgtaactccaataccatatcagcagccagggcct

SEQ ID NO: 380067 - DNA, 140 bp, Artificial Sequence
  Synthetic
atacgccatgctgggtctccagattacttgacaaatgataatataatacactggagctttaaacatagccaatgtgattctaactcttttaaactcacagttaatcataaataaggtttgcgtacttgggagtcggccat

SEQ ID NO: 380068 - DNA, 140 bp, Artificial Sequence
  Synthetic
atggccgactcccaagtacgcaaaccttatttatgattaactgtgagtttaaaagagttagaatcacattggctatgtttaaagctccagtgtattatattatcatttgtcaagtaatctggagacccagcatggcgtat

SEQ ID NO: 380069 - DNA, 140 bp, Artificial Sequence
  Synthetic
atacgccatgctgggtctccccgacaatccctaattatgtttatcactgcattcttgaatatcgctctccagttaccgtgtgaaagttctgctgtcgttgtttcagggttaagaacattgcgtacttgggagtcggccat

SEQ ID NO: 380070 - DNA, 140 bp, Artificial Sequence
  Synthetic
atggccgactcccaagtacgcaatgttcttaaccctgaaacaacgacagcagaactttcacacggtaactggagagcgatattcaagaatgcagtgataaacataattagggattgtcggggagacccagcatggcgtat

SEQ ID NO: 380071 - DNA, 140 bp, Artificial Sequence
  Synthetic
atacgccatgctgggtctcccaagacgatatcctttaagacttattcagtactataatcactctcgtttcaaattaataagatgtgcatgattgccctaatatatgaagaggtatgataccgtacttgggagtcggccat

SEQ ID NO: 380072 - DNA, 140 bp, Artificial Sequence
  Synthetic
atggccgactcccaagtacggtatcatacctcttcatatattagggcaatcatgcacatcttattaatttgaaacgagagtgattatagtactgaataagtcttaaaggatatcgtcttgggagacccagcatggcgtat

SEQ ID NO: 380073 - DNA, 140 bp, Artificial Sequence
  Synthetic
atacgccatgctgggtctccttttaccctacaggaggtagcaacgatccatcccatcaaaaaataagtattttatgacttactaatgacctcttaaaatattaagaaaaactgacggaaccgtacttgggagtcggccat

SEQ ID NO: 380074 - DNA, 140 bp, Artificial Sequence
  Synthetic
atggccgactcccaagtacggttccgtcagtttttcttaatattttaagaggtcattagtaagtcataaaatacttattttttgatgggatggatcgttgctacctcctgtagggtaaaaggagacccagcatggcgtat

SEQ ID NO: 380075 - DNA, 140 bp, Artificial Sequence
  Synthetic
atacgccatgctgggtctccggtgccaacagttcttagatgaaatcattaagtacacaatgcaagatgctctcttcttgaaatattatctcaaaaatgtgggtgctcaagaagactgtgtcgtacttgggagtcggccat

SEQ ID NO: 380076 - DNA, 140 bp, Artificial Sequence
  Synthetic
atggccgactcccaagtacgacacagtcttcttgagcacccacatttttgagataatatttcaagaagagagcatcttgcattgtgtacttaatgatttcatctaagaactgttggcaccggagacccagcatggcgtat

SEQ ID NO: 380077 - DNA, 140 bp, Artificial Sequence
  Synthetic
atacgccatgctgggtctccgtctctaagctaaattggtctgtacacatctcatacattgtattaggggcaataatatctaattgaacttagccgtttaaaatttagtgcataaatctggcgtacttgggagtcggccat

SEQ ID NO: 380078 - DNA, 140 bp, Artificial Sequence
  Synthetic
atggccgactcccaagtacgccagatttatgcactaaattttaaacggctaagttcaattagatattattgcccctaatacaatgtatgagatgtgtacagaccaatttagcttagagacggagacccagcatggcgtat

SEQ ID NO: 380079 - DNA, 140 bp, Artificial Sequence
  Synthetic
aggccctggctgctgatatgaataatatctaattgaacttagccgtttaaaatttagtgcataaatctgggctaactccaccaggtcaactccattggctgaaaagaagcctacctacaagaccttttgggacagcggtg

SEQ ID NO: 380080 - DNA, 140 bp, Artificial Sequence
  Synthetic
caccgctgtcccaaaaggtcttgtaggtaggcttcttttcagccaatggagttgacctggtggagttagcccagatttatgcactaaattttaaacggctaagttcaattagatattattcatatcagcagccagggcct

SEQ ID NO: 380081 - DNA, 140 bp, Artificial Sequence
  Synthetic
atacgccatgctgggtctcccgaacatcactttgagcgccctcacatttaaaaaataggaacgtcgttccaacaatcgagcgcaaggtttcaaggttgaactgagagtgtctagacaacacgtacttgggagtcggccat

SEQ ID NO: 380082 - DNA, 140 bp, Artificial Sequence
  Synthetic
atggccgactcccaagtacgtgttgtctagacactctcagttcaaccttgaaaccttgcgctcgattgttggaacgacgttcctattttttaaatgtgagggcgctcaaagtgatgttcgggagacccagcatggcgtat

SEQ ID NO: 380083 - DNA, 140 bp, Artificial Sequence
  Synthetic
atacgccatgctgggtctccacaattgaatcaccgctgtgggcattgagagtcatccttgcagcagggatacaagaccagctgattgaccagtctttgattgaacccttagcaggagccccgtacttgggagtcggccat

SEQ ID NO: 380084 - DNA, 140 bp, Artificial Sequence
  Synthetic
atggccgactcccaagtacggggctcctgctaagggttcaatcaaagactggtcaatcagctggtcttgtatccctgctgcaaggatgactctcaatgcccacagcggtgattcaattgtggagacccagcatggcgtat

SEQ ID NO: 380085 - DNA, 140 bp, Artificial Sequence
  Synthetic
aggccctggctgctgatatgacgatcattttataattaagaaaaaactaatgatgaagattaaaaccttcatcatccttacgtcaattgaattctctagcactcgaagcttattgtcttcgaccttttgggacagcggtg

SEQ ID NO: 380086 - DNA, 140 bp, Artificial Sequence
  Synthetic
caccgctgtcccaaaaggtcgaagacaataagcttcgagtgctagagaattcaattgacgtaaggatgatgaaggttttaatcttcatcattagttttttcttaattataaaatgatcgtcatatcagcagccagggcct

SEQ ID NO: 380087 - DNA, 140 bp, Artificial Sequence
  Synthetic
atacgccatgctgggtctcccctcaaataagagattccaagacaacatcatagaattgctttatcatatgaataagcattttatcaccagaaatcttatatactaaatggttaattgtaacgtacttgggagtcggccat

SEQ ID NO: 380088 - DNA, 140 bp, Artificial Sequence
  Synthetic
atggccgactcccaagtacgttacaattaaccatttagtatataagatttctggtgataaaatgcttattcatatgataaagcaattctatgatgttgtcttggaatctcttatttgaggggagacccagcatggcgtat

SEQ ID NO: 380089 - DNA, 140 bp, Artificial Sequence
  Synthetic
atacgccatgctgggtctccatttcatagtcccaattcttctcaaggcactgtcaggcaatgggttctgtcctgttgagccgcggtgccaacagttcttagatgaaatcattaagtacaccgtacttgggagtcggccat

SEQ ID NO: 380090 - DNA, 140 bp, Artificial Sequence
  Synthetic
atggccgactcccaagtacggtgtacttaatgatttcatctaagaactgttggcaccgcggctcaacaggacagaacccattgcctgacagtgccttgagaagaattgggactatgaaatggagacccagcatggcgtat

SEQ ID NO: 380091 - DNA, 140 bp, Artificial Sequence
  Synthetic
aggccctggctgctgatatgaatgcaagatgctctcttcttgaaatattatctcaaaaatgtgggtgctcaagaagactgtgttgatgaccactttcaagagaaaatcttatcttcaattgaccttttgggacagcggtg

SEQ ID NO: 380092 - DNA, 140 bp, Artificial Sequence
  Synthetic
caccgctgtcccaaaaggtcaattgaagataagattttctcttgaaagtggtcatcaacacagtcttcttgagcacccacatttttgagataatatttcaagaagagagcatcttgcattcatatcagcagccagggcct

SEQ ID NO: 380093 - DNA, 140 bp, Artificial Sequence
  Synthetic
aggccctggctgctgatatgcaagaagactgtgttgatgaccactttcaagagaaaatcttatcttcaattcagggcaatgaatttttacatcaaatgtttttctggtatgatctggctagaccttttgggacagcggtg

SEQ ID NO: 380094 - DNA, 140 bp, Artificial Sequence
  Synthetic
caccgctgtcccaaaaggtctagccagatcataccagaaaaacatttgatgtaaaaattcattgccctgaattgaagataagattttctcttgaaagtggtcatcaacacagtcttcttgcatatcagcagccagggcct

SEQ ID NO: 380095 - DNA, 140 bp, Artificial Sequence
  Synthetic
atacgccatgctgggtctcctcttatatcaaaagaaatcaattccctccgttgccaatgattaaagaactactatgggaattttaccaccttgaccatcctccacttttctcaaccaaaacgtacttgggagtcggccat

SEQ ID NO: 380096 - DNA, 140 bp, Artificial Sequence
  Synthetic
atggccgactcccaagtacgttttggttgagaaaagtggaggatggtcaaggtggtaaaattcccatagtagttctttaatcattggcaacggagggaattgatttcttttgatataagaggagacccagcatggcgtat

SEQ ID NO: 380097 - DNA, 140 bp, Artificial Sequence
  Synthetic
atacgccatgctgggtctccttattagtgacttaagtatttttataaaagacagagctactgcagtagaaaggacatgctgggatgcagtattcgagcctaatgttctaggatataatcccgtacttgggagtcggccat

SEQ ID NO: 380098 - DNA, 140 bp, Artificial Sequence
  Synthetic
atggccgactcccaagtacgggattatatcctagaacattaggctcgaatactgcatcccagcatgtcctttctactgcagtagctctgtcttttataaaaatacttaagtcactaataaggagacccagcatggcgtat

SEQ ID NO: 380099 - DNA, 140 bp, Artificial Sequence
  Synthetic
aggccctggctgctgatatgtttctttagttgaaattaagactggttttaagttacgctcagctgtgatgggtgacaatcagtgcattaccgttttatcagtcttccccttagagactgagaccttttgggacagcggtg

SEQ ID NO: 380100 - DNA, 140 bp, Artificial Sequence
  Synthetic
caccgctgtcccaaaaggtctcagtctctaaggggaagactgataaaacggtaatgcactgattgtcacccatcacagctgagcgtaacttaaaaccagtcttaatttcaactaaagaaacatatcagcagccagggcct

SEQ ID NO: 380101 - DNA, 140 bp, Artificial Sequence
  Synthetic
atacgccatgctgggtctcccgcagacgagcaggaacagagcgccgaagacaatgcagcgagggtggccgctagcctagcaaaagttacaagtgcctgtggaatctttttaaaacctgatcgtacttgggagtcggccat

SEQ ID NO: 380102 - DNA, 140 bp, Artificial Sequence
  Synthetic
atggccgactcccaagtacgatcaggttttaaaaagattccacaggcacttgtaacttttgctaggctagcggccaccctcgctgcattgtcttcggcgctctgttcctgctcgtctgcgggagacccagcatggcgtat

SEQ ID NO: 380103 - DNA, 140 bp, Artificial Sequence
  Synthetic
aggccctggctgctgatatgggtgcttggaggattatccttcttgaatcctgagaaatgtttctaccggaatctaggagatccagttacctcaggtttattccagttaaaaacttatctcgaccttttgggacagcggtg

SEQ ID NO: 380104 - DNA, 140 bp, Artificial Sequence
  Synthetic
caccgctgtcccaaaaggtcgagataagtttttaactggaataaacctgaggtaactggatctcctagattccggtagaaacatttctcaggattcaagaaggataatcctccaagcacccatatcagcagccagggcct

SEQ ID NO: 380105 - DNA, 140 bp, Artificial Sequence
  Synthetic
aggccctggctgctgatatgataaatcctcactgtaagccagcttccaagttgacacccttacaaaaaccaggactcagaatccctcaaataagagattccaagacaacatcatagaattgaccttttgggacagcggtg

SEQ ID NO: 380106 - DNA, 140 bp, Artificial Sequence
  Synthetic
caccgctgtcccaaaaggtcaattctatgatgttgtcttggaatctcttatttgagggattctgagtcctggtttttgtaagggtgtcaacttggaagctggcttacagtgaggatttatcatatcagcagccagggcct

SEQ ID NO: 380107 - DNA, 140 bp, Artificial Sequence
  Synthetic
atacgccatgctgggtctccattgggctggtattgagtttgatgtgactcacaaaggaatggccctattgcatagactgaaaactaatgactttgcccctgcatggtcaatgacaaggaacgtacttgggagtcggccat

SEQ ID NO: 380108 - DNA, 140 bp, Artificial Sequence
  Synthetic
atggccgactcccaagtacgttccttgtcattgaccatgcaggggcaaagtcattagttttcagtctatgcaatagggccattcctttgtgagtcacatcaaactcaataccagcccaatggagacccagcatggcgtat

SEQ ID NO: 380109 - DNA, 140 bp, Artificial Sequence
  Synthetic
aggccctggctgctgatatggcaaccaggtgggaaaccattcgtgtcagtggcagtcaagaaacatattgttagtgcatggcctaacgcatcccgactaagctggactatcggggatggagaccttttgggacagcggtg

SEQ ID NO: 380110 - DNA, 140 bp, Artificial Sequence
  Synthetic
caccgctgtcccaaaaggtctccatccccgatagtccagcttagtcgggatgcgttaggccatgcactaacaatatgtttcttgactgccactgacacgaatggtttcccacctggttgccatatcagcagccagggcct

SEQ ID NO: 380111 - DNA, 140 bp, Artificial Sequence
  Synthetic
atacgccatgctgggtctcccccgtttaacatgggtaactcaaggcagttcgaacagtgacttgctaataaagccatttttggaagcacgagtaaatttaagtgttcaagaaatacttcacgtacttgggagtcggccat

SEQ ID NO: 380112 - DNA, 140 bp, Artificial Sequence
  Synthetic
atggccgactcccaagtacgtgaagtatttcttgaacacttaaatttactcgtgcttccaaaaatggctttattagcaagtcactgttcgaactgccttgagttacccatgttaaacgggggagacccagcatggcgtat

SEQ ID NO: 380113 - DNA, 140 bp, Artificial Sequence
  Synthetic
atacgccatgctgggtctcccagctcagtatttaacatacacatctacattggatttagatttaacaagataccgagaaaacgaattgatttatgacaataatcctctaaaaggaggactcgtacttgggagtcggccat

SEQ ID NO: 380114 - DNA, 140 bp, Artificial Sequence
  Synthetic
atggccgactcccaagtacgagtcctccttttagaggattattgtcataaatcaattcgttttctcggtatcttgttaaatctaaatccaatgtagatgtgtatgttaaatactgagctgggagacccagcatggcgtat

SEQ ID NO: 380115 - DNA, 140 bp, Artificial Sequence
  Synthetic
atacgccatgctgggtctccttttcttacatttgtaaaagaatggataattaatcgcggaacaattgtccctttatggatagtatatccgctagagggtcaaaacccaacacctgttaatcgtacttgggagtcggccat

SEQ ID NO: 380116 - DNA, 140 bp, Artificial Sequence
  Synthetic
atggccgactcccaagtacgattaacaggtgttgggttttgaccctctagcggatatactatccataaagggacaattgttccgcgattaattatccattcttttacaaatgtaagaaaaggagacccagcatggcgtat

SEQ ID NO: 380117 - DNA, 140 bp, Artificial Sequence
  Synthetic
atacgccatgctgggtctccgaagtcaagaacaaaccaccagagatccacatgatggcactgaacggaatctagttctacaaatgagccatgaaataaaaagaacgacaattccacaagacgtacttgggagtcggccat

SEQ ID NO: 380118 - DNA, 140 bp, Artificial Sequence
  Synthetic
atggccgactcccaagtacgtcttgtggaattgtcgttctttttatttcatggctcatttgtagaactagattccgttcagtgccatcatgtggatctctggtggtttgttcttgacttcggagacccagcatggcgtat

SEQ ID NO: 380119 - DNA, 140 bp, Artificial Sequence
  Synthetic
atacgccatgctgggtctccaaatctcaggatcataactcggcatccaagagggaaggtcatcaaataatctcacaccgtctagtcctacctttctttacattatctcaagggacacgcccgtacttgggagtcggccat

SEQ ID NO: 380120 - DNA, 140 bp, Artificial Sequence
  Synthetic
atggccgactcccaagtacgggcgtgtcccttgagataatgtaaagaaaggtaggactagacggtgtgagattatttgatgaccttccctcttggatgccgagttatgatcctgagatttggagacccagcatggcgtat

SEQ ID NO: 380121 - DNA, 140 bp, Artificial Sequence
  Synthetic
aggccctggctgctgatatgctcacaccgtctagtcctacctttctttacattatctcaagggacacgccaattaacgtcatctaatgagtcacagacccaagacgagatatcaaagtacgaccttttgggacagcggtg

SEQ ID NO: 380122 - DNA, 140 bp, Artificial Sequence
  Synthetic
caccgctgtcccaaaaggtcgtactttgatatctcgtcttgggtctgtgactcattagatgacgttaattggcgtgtcccttgagataatgtaaagaaaggtaggactagacggtgtgagcatatcagcagccagggcct

SEQ ID NO: 380123 - DNA, 140 bp, Artificial Sequence
  Synthetic
atacgccatgctgggtctccttacggcaattgagatccgtcattgataccacagtttattgtaggtttaccggtatagtctcgtccatgcattacaaacttgatgaggtcctttgggaaacgtacttgggagtcggccat

SEQ ID NO: 380124 - DNA, 140 bp, Artificial Sequence
  Synthetic
atggccgactcccaagtacgtttcccaaaggacctcatcaagtttgtaatgcatggacgagactataccggtaaacctacaataaactgtggtatcaatgacggatctcaattgccgtaaggagacccagcatggcgtat

SEQ ID NO: 380125 - DNA, 140 bp, Artificial Sequence
  Synthetic
aggccctggctgctgatatgccctggataatataagtcaattaaacgaccaagataaaattgttcttatctcgctagcagcttaaaatatgaatgtaataggagctatatctctgacagtgaccttttgggacagcggtg

SEQ ID NO: 380126 - DNA, 140 bp, Artificial Sequence
  Synthetic
caccgctgtcccaaaaggtcactgtcagagatatagctcctattacattcatattttaagctgctagcgagataagaacaattttatcttggtcgtttaattgacttatattatccagggcatatcagcagccagggcct

SEQ ID NO: 380127 - DNA, 140 bp, Artificial Sequence
  Synthetic
aggccctggctgctgatatgccggtatagtctcgtccatgcattacaaacttgatgaggtcctttgggaaatagagagttttaagtcggctgtgacgctagcagagggagaaggtgctgggaccttttgggacagcggtg

SEQ ID NO: 380128 - DNA, 140 bp, Artificial Sequence
  Synthetic
caccgctgtcccaaaaggtcccagcaccttctccctctgctagcgtcacagccgacttaaaactctctatttcccaaaggacctcatcaagtttgtaatgcatggacgagactataccggcatatcagcagccagggcct

SEQ ID NO: 380129 - DNA, 140 bp, Artificial Sequence
  Synthetic
aggccctggctgctgatatgtacttggtttaaagaccaaagagcaaggctacctaagcaagtcgaggttataaccatggatgcagagacgacagagaatataaacagatcgaaattgtacgaccttttgggacagcggtg

SEQ ID NO: 380130 - DNA, 140 bp, Artificial Sequence
  Synthetic
caccgctgtcccaaaaggtcgtacaatttcgatctgtttatattctctgtcgtctctgcatccatggttataacctcgacttgcttaggtagccttgctctttggtctttaaaccaagtacatatcagcagccagggcct

SEQ ID NO: 380131 - DNA, 140 bp, Artificial Sequence
  Synthetic
aggccctggctgctgatatgtaaccatggatgcagagacgacagagaatataaacagatcgaaattgtacgaagctgtatataaactgatcttacaccatattgatcccagcgtattgaagaccttttgggacagcggtg

SEQ ID NO: 380132 - DNA, 140 bp, Artificial Sequence
  Synthetic
caccgctgtcccaaaaggtcttcaatacgctgggatcaatatggtgtaagatcagtttatatacagcttcgtacaatttcgatctgtttatattctctgtcgtctctgcatccatggttacatatcagcagccagggcct

SEQ ID NO: 380133 - DNA, 140 bp, Artificial Sequence
  Synthetic
atacgccatgctgggtctcctgctgacaccaattaacgaagaggcagacccactggacgatgccgacgacgagacgtctagtcttccgcccttggagtcagacgatgaagaacaggacagcgtacttgggagtcggccat

SEQ ID NO: 380134 - DNA, 140 bp, Artificial Sequence
  Synthetic
atggccgactcccaagtacgctgtcctgttcttcatcgtctgactccaagggcggaagactagacgtctcgtcgtcggcatcgtccagtgggtctgcctcttcgttaattggtgtcagcaggagacccagcatggcgtat

SEQ ID NO: 380135 - DNA, 140 bp, Artificial Sequence
  Synthetic
atacgccatgctgggtctccttaaattgaaattgttactgtaatcacacctggtttgtttcagagccacatcacaaagatagagaacagcctaggtctccgaagggaacaagggcaccagcgtacttgggagtcggccat

SEQ ID NO: 380136 - DNA, 140 bp, Artificial Sequence
  Synthetic
atggccgactcccaagtacgctggtgcccttgttcccttcggagacctaggctgttctctatctttgtgatgtggctctgaaacaaaccaggtgtgattacagtaacaatttcaatttaaggagacccagcatggcgtat

SEQ ID NO: 380137 - DNA, 140 bp, Artificial Sequence
  Synthetic
atacgccatgctgggtctccaccgttgctatggtgttaagaatgtttttaattggatgcattatacaatcccacagtgttatatgcatgtcagtgattattataatccaccgcataacctcgtacttgggagtcggccat

SEQ ID NO: 380138 - DNA, 140 bp, Artificial Sequence
  Synthetic
atggccgactcccaagtacgaggttatgcggtggattataataatcactgacatgcatataacactgtgggattgtataatgcatccaattaaaaacattcttaacaccatagcaacggtggagacccagcatggcgtat

SEQ ID NO: 380139 - DNA, 140 bp, Artificial Sequence
  Synthetic
atacgccatgctgggtctcctgctaaaagcattacgccctatagtgattttcgagacatactgtgtttttaaatatagtattgccaaacattattttgatagtcaagggtcttggtacagcgtacttgggagtcggccat

SEQ ID NO: 380140 - DNA, 140 bp, Artificial Sequence
  Synthetic
atggccgactcccaagtacgctgtaccaagacccttgactatcaaaataatgtttggcaatactatatttaaaaacacagtatgtctcgaaaatcactatagggcgtaatgcttttagcaggagacccagcatggcgtat

SEQ ID NO: 380141 - DNA, 140 bp, Artificial Sequence
  Synthetic
aggccctggctgctgatatgagatggaatagtgttttggttgataacacgacttcttaaaacaaaattgatctttaagattaagttttttataattatcattactttaatttatcgatttgaccttttgggacagcggtg

SEQ ID NO: 380142 - DNA, 140 bp, Artificial Sequence
  Synthetic
caccgctgtcccaaaaggtcaaatcgataaattaaagtaatgataattataaaaaacttaatcttaaagatcaattttgttttaagaagtcgtgttatcaaccaaaacactattccatctcatatcagcagccagggcct

SEQ ID NO: 380143 - DNA, 140 bp, Artificial Sequence
  Synthetic
aggccctggctgctgatatgcacgctcatcagaaggctcgccaaaataaacgttgcaaaaaggattcctggaaaaatggtcgcacacaaaaatttaaaaataaatctatttcttctttttgaccttttgggacagcggtg

SEQ ID NO: 380144 - DNA, 140 bp, Artificial Sequence
  Synthetic
caccgctgtcccaaaaggtcaaaaagaagaaatagatttatttttaaatttttgtgtgcgaccatttttccaggaatcctttttgcaacgtttattttggcgagccttctgatgagcgtgcatatcagcagccagggcct

SEQ ID NO: 380145 - DNA, 140 bp, Artificial Sequence
  Synthetic
aggccctggctgctgatatgtgtgctcagttgaaaatcccttgtcaacatctaggtcttatcacatcacaggttccacctcaggctctgcagggtgatccaacaaccttaatagaaacatgaccttttgggacagcggtg

SEQ ID NO: 380146 - DNA, 140 bp, Artificial Sequence
  Synthetic
caccgctgtcccaaaaggtcatgtttctattaaggttgttggatcaccctgcagagcctgaggtggaacctgtgatgtgataagacctagatgttgacaagggattttcaactgagcacacatatcagcagccagggcct

SEQ ID NO: 380147 - DNA, 140 bp, Artificial Sequence
  Synthetic
atacgccatgctgggtctcctattgttaaaggacaacattaggtcacagtcaaacaagcaagattgagaattaaccttgattttgaacttgaacacctagaggattggagattcaacaaccgtacttgggagtcggccat

SEQ ID NO: 380148 - DNA, 140 bp, Artificial Sequence
  Synthetic
atggccgactcccaagtacggttgttgaatctccaatcctctaggtgttcaagttcaaaatcaaggttaattctcaatcttgcttgtttgactgtgacctaatgttgtcctttaacaataggagacccagcatggcgtat

SEQ ID NO: 380149 - DNA, 140 bp, Artificial Sequence
  Synthetic
atacgccatgctgggtctccaagcaggtgttgattttcaagagagtgcggacagtttccttctcatgctttgtcttcatcatgcgtaccaaggagattacaaacttttcttggaaagtggcgtacttgggagtcggccat

SEQ ID NO: 380150 - DNA, 140 bp, Artificial Sequence
  Synthetic
atggccgactcccaagtacgccactttccaagaaaagtttgtaatctccttggtacgcatgatgaagacaaagcatgagaaggaaactgtccgcactctcttgaaaatcaacacctgcttggagacccagcatggcgtat

SEQ ID NO: 380151 - DNA, 140 bp, Artificial Sequence
  Synthetic
aggccctggctgctgatatggtgatggagtgaagcgccttgaggaattgctgccagcagtatctagtggaaaaaacattaagagaacacttgctgccatgccggaagaggagacgactgagaccttttgggacagcggtg

SEQ ID NO: 380152 - DNA, 140 bp, Artificial Sequence
  Synthetic
caccgctgtcccaaaaggtctcagtcgtctcctcttccggcatggcagcaagtgttctcttaatgttttttccactagatactgctggcagcaattcctcaaggcgcttcactccatcaccatatcagcagccagggcct

SEQ ID NO: 380153 - DNA, 140 bp, Artificial Sequence
  Synthetic
atacgccatgctgggtctccaaaaacattaagagaacacttgctgccatgccggaagaggagacgactgaagctaatgccggccagtttctctcctttgcaagtctattccttccgaaatcgtacttgggagtcggccat

SEQ ID NO: 380154 - DNA, 140 bp, Artificial Sequence
  Synthetic
atggccgactcccaagtacgatttcggaaggaatagacttgcaaaggagagaaactggccggcattagcttcagtcgtctcctcttccggcatggcagcaagtgttctcttaatgtttttggagacccagcatggcgtat

SEQ ID NO: 380155 - DNA, 140 bp, Artificial Sequence
  Synthetic
atacgccatgctgggtctccaggtacaacgatcaatacagtcctcattctttcatggccaatcgtatgagtaactcagcaacgcgattgattgtttctacaaacactttaggtgagttttcgtacttgggagtcggccat

SEQ ID NO: 380156 - DNA, 140 bp, Artificial Sequence
  Synthetic
atggccgactcccaagtacgaaaactcacctaaagtgtttgtagaaacaatcaatcgcgttgctgagttactcatacgattggccatgaaagaatgaggactgtattgatcgttgtacctggagacccagcatggcgtat

SEQ ID NO: 380157 - DNA, 140 bp, Artificial Sequence
  Synthetic
aggccctggctgctgatatgatgctcctttcgcccgacttttgaacctttctggagtaaataatcttgagcatggtcttttccctcaactgtcggcaattgcactcggagtcgccacagcgaccttttgggacagcggtg

SEQ ID NO: 380158 - DNA, 140 bp, Artificial Sequence
  Synthetic
caccgctgtcccaaaaggtcgctgtggcgactccgagtgcaattgccgacagttgagggaaaagaccatgctcaagattatttactccagaaaggttcaaaagtcgggcgaaaggagcatcatatcagcagccagggcct

SEQ ID NO: 380159 - DNA, 140 bp, Artificial Sequence
  Synthetic
atacgccatgctgggtctccgggagcaccctcgcaggagtaaatgtgggagaacagtatcaacagctcagagaggctgccactgaagctgagaagcaactccaacaatatgcagagtctccgtacttgggagtcggccat

SEQ ID NO: 380160 - DNA, 140 bp, Artificial Sequence
  Synthetic
atggccgactcccaagtacggagactctgcatattgttggagttgcttctcagcttcagtggcagcctctctgagctgttgatactgttctcccacatttactcctgcgagggtgctcccggagacccagcatggcgtat

SEQ ID NO: 380161 - DNA, 140 bp, Artificial Sequence
  Synthetic
atacgccatgctgggtctcctctcgtgaacttgaccatcttggacttgatgatcaggaaaagaaaattcttatgaacttccatcagaaaaagaacgaaatcagcttccagcaaacaaacgcgtacttgggagtcggccat

SEQ ID NO: 380162 - DNA, 140 bp, Artificial Sequence
  Synthetic
atggccgactcccaagtacgcgtttgtttgctggaagctgatttcgttctttttctgatggaagttcataagaattttcttttcctgatcatcaagtccaagatggtcaagttcacgagaggagacccagcatggcgtat

SEQ ID NO: 380163 - DNA, 140 bp, Artificial Sequence
  Synthetic
atacgccatgctgggtctcccactaagccagtgcctaacagatcgaccaagggtgaacaacagaaaaacagtcaaaagggccagcatacagagggcagacagacacaatccaggccaactcgtacttgggagtcggccat

SEQ ID NO: 380164 - DNA, 140 bp, Artificial Sequence
  Synthetic
atggccgactcccaagtacgagttggcctggattgtgtctgtctgccctctgtatgctggcccttttgactgtttttctgttgttcacccttggtcgatctgttaggcactggcttagtgggagacccagcatggcgtat

SEQ ID NO: 380165 - DNA, 140 bp, Artificial Sequence
  Synthetic
aggccctggctgctgatatggtcaaaagggccagcatacagagggcagacagacacaatccaggccaactcaaaatgtcccaggccctcgcagaacaatccaccatgccagcgctccactgaccttttgggacagcggtg

SEQ ID NO: 380166 - DNA, 140 bp, Artificial Sequence
  Synthetic
caccgctgtcccaaaaggtcagtggagcgctggcatggtggattgttctgcgagggcctgggacattttgagttggcctggattgtgtctgtctgccctctgtatgctggcccttttgaccatatcagcagccagggcct

SEQ ID NO: 380167 - DNA, 140 bp, Artificial Sequence
  Synthetic
aggccctggctgctgatatgtgctgacaccaattaacgaggaggcagacccactggacgatgccgacgacgagacgtccagccttccgcccttggagtcagatgatgaagaacaggacaggaccttttgggacagcggtg

SEQ ID NO: 380168 - DNA, 140 bp, Artificial Sequence
  Synthetic
caccgctgtcccaaaaggtcctgtcctgttcttcatcatctgactccaagggcggaaggctggacgtctcgtcgtcggcatcgtccagtgggtctgcctcctcgttaattggtgtcagcacatatcagcagccagggcct

SEQ ID NO: 380169 - DNA, 140 bp, Artificial Sequence
  Synthetic
atacgccatgctgggtctccggacggaacttccaaccgcacacccactgtcgccccaccggctcccgtatacagagatcactctgaaaagaaagaactcccgcaagatgagcaacaagaccgtacttgggagtcggccat

SEQ ID NO: 380170 - DNA, 140 bp, Artificial Sequence
  Synthetic
atggccgactcccaagtacggtcttgttgctcatcttgcgggagttctttcttttcagagtgatctctgtatacgggagccggtggggcgacagtgggtgtgcggttggaagttccgtccggagacccagcatggcgtat

SEQ ID NO: 380171 - DNA, 140 bp, Artificial Sequence
  Synthetic
aggccctggctgctgatatgacagagatcactctgaaaagaaagaactcccgcaagatgagcaacaagaccaggaccacactcaagaggccaagaaccaggacagtgacaacacccagccgaccttttgggacagcggtg

SEQ ID NO: 380172 - DNA, 140 bp, Artificial Sequence
  Synthetic
caccgctgtcccaaaaggtcggctgggtgttgtcactgtcctggttcttggcctcttgagtgtggtcctggtcttgttgctcatcttgcgggagttctttcttttcagagtgatctctgtcatatcagcagccagggcct

SEQ ID NO: 380173 - DNA, 140 bp, Artificial Sequence
  Synthetic
atacgccatgctgggtctcccatttgatgctgttttgtattatcatatgatgaaggatgagcctgtagttttcagtaccagtgatggcaaagagtacacgtatccggactcccttgaagacgtacttgggagtcggccat

SEQ ID NO: 380174 - DNA, 140 bp, Artificial Sequence
  Synthetic
atggccgactcccaagtacgtcttcaagggagtccggatacgtgtactctttgccatcactggtactgaaaactacaggctcatccttcatcatatgataatacaaaacagcatcaaatgggagacccagcatggcgtat

SEQ ID NO: 380175 - DNA, 140 bp, Artificial Sequence
  Synthetic
atacgccatgctgggtctccaagaataaattcatggcaattctgcaacatcatcagtgaatgagcatggaataatgggatgatttaaccgacaaatagctaacattaaatagtcaaggaacgtacttgggagtcggccat

SEQ ID NO: 380176 - DNA, 140 bp, Artificial Sequence
  Synthetic
atggccgactcccaagtacgttccttgactatttaatgttagctatttgtcggttaaatcatcccattattccatgctcattcactgatgatgttgcagaattgccatgaatttattcttggagacccagcatggcgtat

SEQ ID NO: 380177 - DNA, 140 bp, Artificial Sequence
  Synthetic
atacgccatgctgggtctcccgcaaacaggaagaatttttgatgtctaaggtgtgaattattatcacaataaaagtgattcttatttttgaatttaaagctagcttattattactagccgcgtacttgggagtcggccat

SEQ ID NO: 380178 - DNA, 140 bp, Artificial Sequence
  Synthetic
atggccgactcccaagtacgcggctagtaataataagctagctttaaattcaaaaataagaatcacttttattgtgataataattcacaccttagacatcaaaaattcttcctgtttgcgggagacccagcatggcgtat

SEQ ID NO: 380179 - DNA, 140 bp, Artificial Sequence
  Synthetic
aggccctggctgctgatatgagctctgttagctgatggtcttgctaaagcatttcctagcaatatgatggtagttacggaacgtgagcaaaaagaaagcttattgcatcaagcatcatgggaccttttgggacagcggtg

SEQ ID NO: 380180 - DNA, 140 bp, Artificial Sequence
  Synthetic
caccgctgtcccaaaaggtcccatgatgcttgatgcaataagctttctttttgctcacgttccgtaactaccatcatattgctaggaaatgctttagcaagaccatcagctaacagagctcatatcagcagccagggcct

SEQ ID NO: 380181 - DNA, 140 bp, Artificial Sequence
  Synthetic
atacgccatgctgggtctccttataaccataattgtaactcaatatcttagctagtgatttatctaaattaaattacattatgcttttataacttacttattagcccgcccaacatttaccgtacttgggagtcggccat

SEQ ID NO: 380182 - DNA, 140 bp, Artificial Sequence
  Synthetic
atggccgactcccaagtacggtaaatgttgggcgggctaataagtaagttataaaagcataatgtaatttaatttagataaatcactagctaagatattgagttacaattatggttataaggagacccagcatggcgtat

SEQ ID NO: 380183 - DNA, 140 bp, Artificial Sequence
  Synthetic
atacgccatgctgggtctccagaagagcttacgtccagtcccgccatcgcccaagattgatcgaggttgggtatgtgtttttcagcttcaagatggtaaaacacttggactcaaaatttgcgtacttgggagtcggccat

SEQ ID NO: 380184 - DNA, 140 bp, Artificial Sequence
  Synthetic
atggccgactcccaagtacgcaaattttgagtccaagtgttttaccatcttgaagctgaaaaacacatacccaacctcgatcaatcttgggcgatggcgggactggacgtaagctcttctggagacccagcatggcgtat

SEQ ID NO: 380185 - DNA, 140 bp, Artificial Sequence
  Synthetic
atacgccatgctgggtctccagccaatctcccttccctccgaacgaggcgactaatagcagaggcttcaactgctgaactatagggtacgttacattaatgatacacttgtgagcatcagcgtacttgggagtcggccat

SEQ ID NO: 380186 - DNA, 140 bp, Artificial Sequence
  Synthetic
atggccgactcccaagtacgctgatgctcacaagtgtatcattaatgtaacgtaccctatagttcagcagttgaagcctctgctattagtcgcctcgttcggagggaagggagattggctggagacccagcatggcgtat

SEQ ID NO: 380187 - DNA, 140 bp, Artificial Sequence
  Synthetic
atacgccatgctgggtctccccctaaataatataagtcaattaaacgaccaagataaaattgttcatatcccgctagcagcttaaaatataaatgtaataggagctatatctgtgacagtcgtacttgggagtcggccat

SEQ ID NO: 380188 - DNA, 140 bp, Artificial Sequence
  Synthetic
atggccgactcccaagtacgactgtcacagatatagctcctattacatttatattttaagctgctagcgggatatgaacaattttatcttggtcgtttaattgacttatattatttagggggagacccagcatggcgtat

SEQ ID NO: 380189 - DNA, 140 bp, Artificial Sequence
  Synthetic
aggccctggctgctgatatgagaaaaacctacctcgactgagagagtgtttttccattaaccttcatcttgtaaacgttgagcaaaattgttaaaaatatgaggcgggttatattgcctagaccttttgggacagcggtg

SEQ ID NO: 380190 - DNA, 140 bp, Artificial Sequence
  Synthetic
caccgctgtcccaaaaggtctaggcaatataacccgcctcatatttttaacaattttgctcaacgtttacaagatgaaggttaatggaaaaacactctctcagtcgaggtaggtttttctcatatcagcagccagggcct

SEQ ID NO: 380191 - DNA, 140 bp, Artificial Sequence
  Synthetic
aggccctggctgctgatatgacaattgctaggggtggcaacagcaatacaggcttcctgacaccggagtcagtcaatggagacactccatcaaatccactcagaccaattgctgatgacagaccttttgggacagcggtg

SEQ ID NO: 380192 - DNA, 140 bp, Artificial Sequence
  Synthetic
caccgctgtcccaaaaggtctgtcatcagcaattggtctgagtggatttgatggagtgtctccattgactgactccggtgtcaggaagcctgtattgctgttgccacccctagcaattgtcatatcagcagccagggcct

SEQ ID NO: 380193 - DNA, 140 bp, Artificial Sequence
  Synthetic
atacgccatgctgggtctccccatcgaccatgctagccacacaccaggcagtgtgtcatcagcattcatccttgaagctatggtgaatgtcatatcgggccccaaagtgctaatgaagcacgtacttgggagtcggccat

SEQ ID NO: 380194 - DNA, 140 bp, Artificial Sequence
  Synthetic
atggccgactcccaagtacgtgcttcattagcactttggggcccgatatgacattcaccatagcttcaaggatgaatgctgatgacacactgcctggtgtgtggctagcatggtcgatggggagacccagcatggcgtat

SEQ ID NO: 380195 - DNA, 140 bp, Artificial Sequence
  Synthetic
atacgccatgctgggtctccaattccaatttggcttcctctaggtgtcgctgatcaaaagacctacagctttgactcaactacggccgccatcatgcttgcttcatatactatcacccatcgtacttgggagtcggccat

SEQ ID NO: 380196 - DNA, 140 bp, Artificial Sequence
  Synthetic
atggccgactcccaagtacgatgggtgatagtatatgaagcaagcatgatggcggccgtagttgagtcaaagctgtaggtcttttgatcagcgacacctagaggaagccaaattggaattggagacccagcatggcgtat

SEQ ID NO: 380197 - DNA, 140 bp, Artificial Sequence
  Synthetic
atacgccatgctgggtctccttcggcaaggcaaccaatccacttgtcagagtcaatcggctgggtcctggaatcccggatcaccccctcaggctcctgcgaattggaaaccaggctttcccgtacttgggagtcggccat

SEQ ID NO: 380198 - DNA, 140 bp, Artificial Sequence
  Synthetic
atggccgactcccaagtacgggaaagcctggtttccaattcgcaggagcctgagggggtgatccgggattccaggacccagccgattgactctgacaagtggattggttgccttgccgaaggagacccagcatggcgtat

SEQ ID NO: 380199 - DNA, 140 bp, Artificial Sequence
  Synthetic
aggccctggctgctgatatgaagctactattccattcagaatgataaaattaaaagaaaagacatgactgtaaaatcagaaataccttctttacaatatagcagactagataataatcttgaccttttgggacagcggtg

SEQ ID NO: 380200 - DNA, 140 bp, Artificial Sequence
  Synthetic
caccgctgtcccaaaaggtcaagattattatctagtctgctatattgtaaagaaggtatttctgattttacagtcatgtcttttcttttaattttatcattctgaatggaatagtagcttcatatcagcagccagggcct

SEQ ID NO: 380201 - DNA, 140 bp, Artificial Sequence
  Synthetic
aggccctggctgctgatatgagggatagtggtaacatctatttagtaatccgtctattagaggagatacttttaattgatcaatatactaaaggtgctttacaccgttgtctcttttttcgaccttttgggacagcggtg

SEQ ID NO: 380202 - DNA, 140 bp, Artificial Sequence
  Synthetic
caccgctgtcccaaaaggtcgaaaaaagagacaacggtgtaaagcacctttagtatattgatcaattaaaagtatctcctctaatagacggattactaaatagatgttaccactatccctcatatcagcagccagggcct

SEQ ID NO: 380203 - DNA, 140 bp, Artificial Sequence
  Synthetic
atacgccatgctgggtctcctcctaaatgtagaacttaacaaaaaactcataatatacttgtctttaaaagattgattgatgaaagatcatgactaataacattacaaataatcctactacgtacttgggagtcggccat

SEQ ID NO: 380204 - DNA, 140 bp, Artificial Sequence
  Synthetic
atggccgactcccaagtacgtagtaggattatttgtaatgttattagtcatgatctttcatcaatcaatcttttaaagacaagtatattatgagttttttgttaagttctacatttaggaggagacccagcatggcgtat

SEQ ID NO: 380205 - DNA, 140 bp, Artificial Sequence
  Synthetic
atacgccatgctgggtctcctaatcaatacggtgattcaaatgttaatctttctcattgcacatactctttgcccttatcctcaaattgcctacatgcttacatttggggataaccagtgcgtacttgggagtcggccat

SEQ ID NO: 380206 - DNA, 140 bp, Artificial Sequence
  Synthetic
atggccgactcccaagtacgcactggttatccccaaatgtaagcatgtaggcaatttgaggataagggcaaagagtatgtgcaatgagaaagattaacatttgaatcaccgtattgattaggagacccagcatggcgtat

SEQ ID NO: 380207 - DNA, 140 bp, Artificial Sequence
  Synthetic
aggccctggctgctgatatgcaaagtacattgggttggacccggtggctccaggagacctcaccatggtaatcacacaggattgtgacacgtgtcattctcctgcaagtcttccagctgtgaccttttgggacagcggtg

SEQ ID NO: 380208 - DNA, 140 bp, Artificial Sequence
  Synthetic
caccgctgtcccaaaaggtcacagctggaagacttgcaggagaatgacacgtgtcacaatcctgtgtgattaccatggtgaggtctcctggagccaccgggtccaacccaatgtactttgcatatcagcagccagggcct

SEQ ID NO: 380209 - DNA, 140 bp, Artificial Sequence
  Synthetic
atacgccatgctgggtctcctgttttccagagtaggggtcatcaggtccttttcaatcgtataaccaaagtaaacttcactagaaggatattgtggggcaacaacacaatgggtgtcacacgtacttgggagtcggccat

SEQ ID NO: 380210 - DNA, 140 bp, Artificial Sequence
  Synthetic
atggccgactcccaagtacgtgtgacacccattgtgttgttgccccacaatatccttctagtgaagtttactttggttatacgattgaaaaggacctgatgacccctactctggaaaacaggagacccagcatggcgtat

SEQ ID NO: 380211 - DNA, 140 bp, Artificial Sequence
  Synthetic
aggccctggctgctgatatgctgtaatcatacctggtttgtttcagagccatatcaccaagatagagaacaacctaggtctccggagggggcaagggcatcagtgtgctcagttgaaaatgaccttttgggacagcggtg

SEQ ID NO: 380212 - DNA, 140 bp, Artificial Sequence
  Synthetic
caccgctgtcccaaaaggtcattttcaactgagcacactgatgcccttgccccctccggagacctaggttgttctctatcttggtgatatggctctgaaacaaaccaggtatgattacagcatatcagcagccagggcct

SEQ ID NO: 380213 - DNA, 140 bp, Artificial Sequence
  Synthetic
aggccctggctgctgatatgtgcacaaagtatcaggaacaggaccgtgtgccggagactttgccttccacaaagagggtgctttcttcctgtatgatcgacttgcttccacagttatttagaccttttgggacagcggtg

SEQ ID NO: 380214 - DNA, 140 bp, Artificial Sequence
  Synthetic
caccgctgtcccaaaaggtctaaataactgtggaagcaagtcgatcatacaggaagaaagcaccctctttgtggaaggcaaagtctccggcacacggtcctgttcctgatactttgtgcacatatcagcagccagggcct

SEQ ID NO: 380215 - DNA, 140 bp, Artificial Sequence
  Synthetic
atacgccatgctgggtctcccagctgaatgagacaatatatgcaagtgggaaaaggagcaacaccacgggaaaactaatttggaaagtcaaccccgaaattgatacaacaatcggggagtcgtacttgggagtcggccat

SEQ ID NO: 380216 - DNA, 140 bp, Artificial Sequence
  Synthetic
atggccgactcccaagtacgactccccgattgttgtatcaatttcggggttgactttccaaattagttttcccgtggtgttgctccttttcccacttgcatatattgtctcattcagctgggagacccagcatggcgtat

SEQ ID NO: 380217 - DNA, 140 bp, Artificial Sequence
  Synthetic
atacgccatgctgggtctccagttgtctttcacagctgtatcaaacggagccaaaaacctcagtggtcagagtccggcgcgaacttcttccgacccaaagaccaacacaacaactgaagacgtacttgggagtcggccat

SEQ ID NO: 380218 - DNA, 140 bp, Artificial Sequence
  Synthetic
atggccgactcccaagtacgtcttcagttgttgtgttggtctttgggtcggaagaagttcgcgccggactctgaccactgaggtttttggctccgtttgatacagctgtgaaagacaactggagacccagcatggcgtat

SEQ ID NO: 380219 - DNA, 140 bp, Artificial Sequence
  Synthetic
atacgccatgctgggtctcctccacgagtcctcaaccccccacaaccaaaccaggtccggacaacagcacttataatacacccgtatataaacttgacacctctgaggcaactcaagttgcgtacttgggagtcggccat

SEQ ID NO: 380220 - DNA, 140 bp, Artificial Sequence
  Synthetic
atggccgactcccaagtacgcaacttgagttgcctcagaggtgtcaagtttatatacgggtgtattataagtgctgttgtccggacctggtttggttgtggggggttgaggactcgtggaggagacccagcatggcgtat

SEQ ID NO: 380221 - DNA, 140 bp, Artificial Sequence
  Synthetic
atacgccatgctgggtctcccccgccacgaccgcagccggacacccaaaagcagagaacaccaacacgagcaagagcgctgactccctggaccccgccaccacgacaagtcccccaaacccgtacttgggagtcggccat

SEQ ID NO: 380222 - DNA, 140 bp, Artificial Sequence
  Synthetic
atggccgactcccaagtacgggtttgggggacttgtcgtggtggcggggtccagggagtcagcgctcttgctcgtgttggtgttctctgcttttgggtgtccggctgcggtcgtggcgggggagacccagcatggcgtat

SEQ ID NO: 380223 - DNA, 140 bp, Artificial Sequence
  Synthetic
atacgccatgctgggtctcctctgtgggttgaggcagctggccaacgagacgactcaagctcttcaactgttcctgagagctacaactgagctacgcaccttttcaatcctcaaccgtaacgtacttgggagtcggccat

SEQ ID NO: 380224 - DNA, 140 bp, Artificial Sequence
  Synthetic
atggccgactcccaagtacgttacggttgaggattgaaaaggtgcgtagctcagttgtagctctcaggaacagttgaagagcttgagtcgtctcgttggccagctgcctcaacccacagaggagacccagcatggcgtat

SEQ ID NO: 380225 - DNA, 140 bp, Artificial Sequence
  Synthetic
aggccctggctgctgatatgtgcaaatttgtcttttagtttttcttcagattgcttcatggcaaagctcagcctcaaatcaatgaaattaggatttaattatatggatcacttgaatctagaccttttgggacagcggtg

SEQ ID NO: 380226 - DNA, 140 bp, Artificial Sequence
  Synthetic
caccgctgtcccaaaaggtctagattcaagtgatccatataattaaatcctaatttcattgatttgaggctgagctttgccatgaagcaatctgaagaaaaactaaaagacaaatttgcacatatcagcagccagggcct

SEQ ID NO: 380227 - DNA, 140 bp, Artificial Sequence
  Synthetic
atacgccatgctgggtctccagattacttgacaaatgataatataatacactggagcttcaaacatagccaatgtgattctaactcctttaaactcacagttaatcataaacaaggtttgcgtacttgggagtcggccat

SEQ ID NO: 380228 - DNA, 140 bp, Artificial Sequence
  Synthetic
atggccgactcccaagtacgcaaaccttgtttatgattaactgtgagtttaaaggagttagaatcacattggctatgtttgaagctccagtgtattatattatcatttgtcaagtaatctggagacccagcatggcgtat

SEQ ID NO: 380229 - DNA, 140 bp, Artificial Sequence
  Synthetic
atacgccatgctgggtctccacatcaatctagttatatctttgagaatgataaacttgatgaagattaagaaaaaggtaatctttcgattatctttaatcttcatccttgattctacaatcgtacttgggagtcggccat

SEQ ID NO: 380230 - DNA, 140 bp, Artificial Sequence
  Synthetic
atggccgactcccaagtacgattgtagaatcaaggatgaagattaaagataatcgaaagattacctttttcttaatcttcatcaagtttatcattctcaaagatataactagattgatgtggagacccagcatggcgtat

SEQ ID NO: 380231 - DNA, 140 bp, Artificial Sequence
  Synthetic
atacgccatgctgggtctccacttttaaatggaagcttcatatgagagaggacgcccccgagctgccagacagcattcaagggatggacacgaccaccatgttcgagcacgatcatcatccgtacttgggagtcggccat

SEQ ID NO: 380232 - DNA, 140 bp, Artificial Sequence
  Synthetic
atggccgactcccaagtacggatgatgatcgtgctcgaacatggtggtcgtgtccatcccttgaatgctgtctggcagctcgggggcgtcctctctcatatgaagcttccatttaaaagtggagacccagcatggcgtat

SEQ ID NO: 380233 - DNA, 140 bp, Artificial Sequence
  Synthetic
aggccctggctgctgatatgtcaaaattaagagcattgttgactctatgtgccgtgatgacgaggaaattctcaaaatcccagctgagtcttttatgtgagacacacctaaggcgcgagggaccttttgggacagcggtg

SEQ ID NO: 380234 - DNA, 140 bp, Artificial Sequence
  Synthetic
caccgctgtcccaaaaggtccctcgcgccttaggtgtgtctcacataaaagactcagctgggattttgagaatttcctcgtcatcacggcacatagagtcaacaatgctcttaattttgacatatcagcagccagggcct

SEQ ID NO: 380235 - DNA, 140 bp, Artificial Sequence
  Synthetic
atacgccatgctgggtctccaagacgatatcctttaaaacttattcagtactataatcactctcgtttcaaattaataagatatgcataattgccttaatatatgaagaggtatgatacacgtacttgggagtcggccat

SEQ ID NO: 380236 - DNA, 140 bp, Artificial Sequence
  Synthetic
atggccgactcccaagtacgtgtatcatacctcttcatatattaaggcaattatgcatatcttattaatttgaaacgagagtgattatagtactgaataagttttaaaggatatcgtcttggagacccagcatggcgtat

SEQ ID NO: 380237 - DNA, 140 bp, Artificial Sequence
  Synthetic
atacgccatgctgggtctccaccctaacagtgacaaaagaaaatcataatctcgtatcgctcgtaatataacctgccaagcatacctcttacacaaagtgattcttgtacacaaataatgcgtacttgggagtcggccat

SEQ ID NO: 380238 - DNA, 140 bp, Artificial Sequence
  Synthetic
atggccgactcccaagtacgcattatttgtgtacaagaatcactttgtgtaagaggtatgcttggcaggttatattacgagcgatacgagattatgattttcttttgtcactgttagggtggagacccagcatggcgtat

SEQ ID NO: 380239 - DNA, 140 bp, Artificial Sequence
  Synthetic
aggccctggctgctgatatgacctgccaagcatacctcttacacaaagtgattcttgtacacaaataatgttttactctacaggaggtagcaacgatccatcccatcgaaaaataagtatgaccttttgggacagcggtg

SEQ ID NO: 380240 - DNA, 140 bp, Artificial Sequence
  Synthetic
caccgctgtcccaaaaggtcatacttatttttcgatgggatggatcgttgctacctcctgtagagtaaaacattatttgtgtacaagaatcactttgtgtaagaggtatgcttggcaggtcatatcagcagccagggcct

SEQ ID NO: 380241 - DNA, 140 bp, Artificial Sequence
  Synthetic
atacgccatgctgggtctcctttatgacttactaatgatctcttataatattaagaaaaactgatggaacataaatcctttctacttcaagttgtggaggaggtctttggtattggctatcgtacttgggagtcggccat

SEQ ID NO: 380242 - DNA, 140 bp, Artificial Sequence
  Synthetic
atggccgactcccaagtacgatagccaataccaaagacctcctccacaacttgaagtagaaaggatttatgttccatcagtttttcttaatattataagagatcattagtaagtcataaaggagacccagcatggcgtat

SEQ ID NO: 380243 - DNA, 140 bp, Artificial Sequence
  Synthetic
aggccctggctgctgatatgataaatcctttctacttcaagttgtggaggaggtctttggtattggctattgttatattacaatcaataacaagcttgtaaaaatattgttcttgtttcagaccttttgggacagcggtg

SEQ ID NO: 380244 - DNA, 140 bp, Artificial Sequence
  Synthetic
caccgctgtcccaaaaggtctgaaacaagaacaatatttttacaagcttgttattgattgtaatataacaatagccaataccaaagacctcctccacaacttgaagtagaaaggatttatcatatcagcagccagggcct

SEQ ID NO: 380245 - DNA, 140 bp, Artificial Sequence
  Synthetic
aggccctggctgctgatatggaccccaatcaacgaagaggcagacccactggacgatgccgacgacgagacgtctagccttccgcccttagagtcagatgatgaagaacaggacagggacgaccttttgggacagcggtg

SEQ ID NO: 380246 - DNA, 140 bp, Artificial Sequence
  Synthetic
caccgctgtcccaaaaggtcgtccctgtcctgttcttcatcatctgactctaagggcggaaggctagacgtctcgtcgtcggcatcgtccagtgggtctgcctcttcgttgattggggtccatatcagcagccagggcct

SEQ ID NO: 380247 - DNA, 140 bp, Artificial Sequence
  Synthetic
atacgccatgctgggtctccacacgtcttttagctgtataccagtcgcccttgagatacgccacaaaagtgtctctaagctaaattggtctgtacacatctcatacattgtattagaggccgtacttgggagtcggccat

SEQ ID NO: 380248 - DNA, 140 bp, Artificial Sequence
  Synthetic
atggccgactcccaagtacggcctctaatacaatgtatgagatgtgtacagaccaatttagcttagagacacttttgtggcgtatctcaagggcgactggtatacagctaaaagacgtgtggagacccagcatggcgtat

SEQ ID NO: 380249 - DNA, 140 bp, Artificial Sequence
  Synthetic
atacgccatgctgggtctccaatagtatctaattgaacttagccgtttaaaatttagtgcataaatctgggctaactcccccaggttaactccattagctgaaaagaagcccacccacaacgtacttgggagtcggccat

SEQ ID NO: 380250 - DNA, 140 bp, Artificial Sequence
  Synthetic
atggccgactcccaagtacgttgtgggtgggcttcttttcagctaatggagttaacctgggggagttagcccagatttatgcactaaattttaaacggctaagttcaattagatactattggagacccagcatggcgtat

SEQ ID NO: 380251 - DNA, 140 bp, Artificial Sequence
  Synthetic
atacgccatgctgggtctcccgaacatcactttgagcgccctcacaatttaaaaataggagcgtcgttccaacaatcgagcgcaaggtttcagggttgaactgagagtgtctagacaacacgtacttgggagtcggccat

SEQ ID NO: 380252 - DNA, 140 bp, Artificial Sequence
  Synthetic
atggccgactcccaagtacgtgttgtctagacactctcagttcaaccctgaaaccttgcgctcgattgttggaacgacgctcctatttttaaattgtgagggcgctcaaagtgatgttcgggagacccagcatggcgtat

SEQ ID NO: 380253 - DNA, 140 bp, Artificial Sequence
  Synthetic
aggccctggctgctgatatgaaagctacgggacgatacaatctaatatcgcccaaaaaggacctggagaaaggggttgtcttaagcgacctctgtaacttcttagttagtcaaactattcgaccttttgggacagcggtg

SEQ ID NO: 380254 - DNA, 140 bp, Artificial Sequence
  Synthetic
caccgctgtcccaaaaggtcgaatagtttgactaactaagaagttacagaggtcgcttaagacaacccctttctccaggtcctttttgggcgatattagattgtatcgtcccgtagctttcatatcagcagccagggcct

SEQ ID NO: 380255 - DNA, 140 bp, Artificial Sequence
  Synthetic
atacgccatgctgggtctccaagggtggaaggtctattgggctggtattgagtttgatgtgactaacaaaggaatggccctattgcatagactgaaaactaatgactttgcccctgcatgcgtacttgggagtcggccat

SEQ ID NO: 380256 - DNA, 140 bp, Artificial Sequence
  Synthetic
atggccgactcccaagtacgcatgcaggggcaaagtcattagttttcagtctatgcaatagggccattcctttgttagtcacatcaaactcaataccagcccaatagaccttccacccttggagacccagcatggcgtat

SEQ ID NO: 380257 - DNA, 140 bp, Artificial Sequence
  Synthetic
aggccctggctgctgatatgggaatggccctattgcatagactgaaaactaatgactttgcccctgcatggtcgatgacaaggaatctatttcctcatttatttcaaaatccgaattctagaccttttgggacagcggtg

SEQ ID NO: 380258 - DNA, 140 bp, Artificial Sequence
  Synthetic
caccgctgtcccaaaaggtctagaattcggattttgaaataaatgaggaaatagattccttgtcatcgaccatgcaggggcaaagtcattagttttcagtctatgcaatagggccattcccatatcagcagccagggcct

SEQ ID NO: 380259 - DNA, 140 bp, Artificial Sequence
  Synthetic
aggccctggctgctgatatgaagaaaaaactaatgatgaagattaaaaccttcatcatccttacgtcaattgaattctctagcactagaagcttattgtcttcaatgtaaaagaaaagctgaccttttgggacagcggtg

SEQ ID NO: 380260 - DNA, 140 bp, Artificial Sequence
  Synthetic
caccgctgtcccaaaaggtcagcttttcttttacattgaagacaataagcttctagtgctagagaattcaattgacgtaaggatgatgaaggttttaatcttcatcattagttttttcttcatatcagcagccagggcct

SEQ ID NO: 380261 - DNA, 140 bp, Artificial Sequence
  Synthetic
aggccctggctgctgatatgttccctccttcatgagtccacactgaaagcatttacacaagggtcctcaacacgaatgcaaagtttgattcttgaatttaatagctctcttgctatctaagaccttttgggacagcggtg

SEQ ID NO: 380262 - DNA, 140 bp, Artificial Sequence
  Synthetic
caccgctgtcccaaaaggtcttagatagcaagagagctattaaattcaagaatcaaactttgcattcgtgttgaggacccttgtgtaaatgctttcagtgtggactcatgaaggagggaacatatcagcagccagggcct

SEQ ID NO: 380263 - DNA, 140 bp, Artificial Sequence
  Synthetic
aggccctggctgctgatatgtgagctaaagtggtctgtacacatctcatacattgtattaggggcaataatatctaattgaacttagccatttaaaatttagtgcataaatctgggctaagaccttttgggacagcggtg

SEQ ID NO: 380264 - DNA, 140 bp, Artificial Sequence
  Synthetic
caccgctgtcccaaaaggtcttagcccagatttatgcactaaattttaaatggctaagttcaattagatattattgcccctaatacaatgtatgagatgtgtacagaccactttagctcacatatcagcagccagggcct

SEQ ID NO: 380265 - DNA, 140 bp, Artificial Sequence
  Synthetic
atacgccatgctgggtctccaataagcattttatcaccagaaatccaatatactaaatggttaattgtaactgaacccgcaggtcacgtgtgttaggtttcacagattatatatattactcgtacttgggagtcggccat

SEQ ID NO: 380266 - DNA, 140 bp, Artificial Sequence
  Synthetic
atggccgactcccaagtacgagtaatatatataatctgtgaaacctaacacacgtgacctgcgggttcagttacaattaaccatttagtatattggatttctggtgataaaatgcttattggagacccagcatggcgtat

SEQ ID NO: 380267 - DNA, 140 bp, Artificial Sequence
  Synthetic
atacgccatgctgggtctcctgacaaccggtcgggcaacagcaaccgctgcggcaactgaggcttattgggctgaacatggtcaaccaccacctggaccatcactttatgaagaaagtgccgtacttgggagtcggccat

SEQ ID NO: 380268 - DNA, 140 bp, Artificial Sequence
  Synthetic
atggccgactcccaagtacggcactttcttcataaagtgatggtccaggtggtggttgaccatgttcagcccaataagcctcagttgccgcagcggttgctgttgcccgaccggttgtcaggagacccagcatggcgtat

SEQ ID NO: 380269 - DNA, 140 bp, Artificial Sequence
  Synthetic
atacgccatgctgggtctccctacgcaactgtaaactcccgaaacatatctaccgtttaaaatatgatgtaactgttaccaagttcttaagtgatgtaccagtggcgacattgcccatagcgtacttgggagtcggccat

SEQ ID NO: 380270 - DNA, 140 bp, Artificial Sequence
  Synthetic
atggccgactcccaagtacgctatgggcaatgtcgccactggtacatcacttaagaacttggtaacagttacatcatattttaaacggtagatatgtttcgggagtttacagttgcgtagggagacccagcatggcgtat

SEQ ID NO: 380271 - DNA, 140 bp, Artificial Sequence
  Synthetic
aggccctggctgctgatatgaactgttaccaagttcttaagtgatgtaccagtggcgacattgcccatagatttcatagtcccaattcttctcaaggcactgtcaggcaatgggttctgtgaccttttgggacagcggtg

SEQ ID NO: 380272 - DNA, 140 bp, Artificial Sequence
  Synthetic
caccgctgtcccaaaaggtcacagaacccattgcctgacagtgccttgagaagaattgggactatgaaatctatgggcaatgtcgccactggtacatcacttaagaacttggtaacagttcatatcagcagccagggcct

SEQ ID NO: 380273 - DNA, 140 bp, Artificial Sequence
  Synthetic
atacgccatgctgggtctccaagaagactgtgttgatgaccactttcaagagaaaatcttatcttcaattcagggcaatgaatttttacatcaaatgtttttctggtatgacctggctatcgtacttgggagtcggccat

SEQ ID NO: 380274 - DNA, 140 bp, Artificial Sequence
  Synthetic
atggccgactcccaagtacgatagccaggtcataccagaaaaacatttgatgtaaaaattcattgccctgaattgaagataagattttctcttgaaagtggtcatcaacacagtcttcttggagacccagcatggcgtat

SEQ ID NO: 380275 - DNA, 140 bp, Artificial Sequence
  Synthetic
atacgccatgctgggtctcctggaagatcccgatttcaatgttaccactgaactcacaaggaatcccccatgctgctatggattggtatcaggcatcagtattcaaagaagcggttcaagcgtacttgggagtcggccat

SEQ ID NO: 380276 - DNA, 140 bp, Artificial Sequence
  Synthetic
atggccgactcccaagtacgcttgaaccgcttctttgaatactgatgcctgataccaatccatagcagcatgggggattccttgtgagttcagtggtaacattgaaatcgggatcttccaggagacccagcatggcgtat

SEQ ID NO: 380277 - DNA, 140 bp, Artificial Sequence
  Synthetic
atacgccatgctgggtctccattatgctcaaagtacaccgagaggaagggccgattcttaacacaaatgcatttagctgtaaatcacaccctggaagaaattacagaaatgcgtgcgctacgtacttgggagtcggccat

SEQ ID NO: 380278 - DNA, 140 bp, Artificial Sequence
  Synthetic
atggccgactcccaagtacgtagcgcacgcatttctgtaatttcttccagggtgtgatttacagctaaatgcatttgtgttaagaatcggcccttcctctcggtgtactttgagcataatggagacccagcatggcgtat

SEQ ID NO: 380279 - DNA, 140 bp, Artificial Sequence
  Synthetic
atacgccatgctgggtctcccttgacatctctgccttcataatcagatatataagcataataaataaatactcatatttcttgataatttgtttaaccacagataaatcctcactgtaagcgtacttgggagtcggccat

SEQ ID NO: 380280 - DNA, 140 bp, Artificial Sequence
  Synthetic
atggccgactcccaagtacgcttacagtgaggatttatctgtggttaaacaaattatcaagaaatatgagtatttatttattatgcttatatatctgattatgaaggcagagatgtcaagggagacccagcatggcgtat

SEQ ID NO: 380281 - DNA, 140 bp, Artificial Sequence
  Synthetic
atacgccatgctgggtctccaaacatgctacggtgctaaaagcattacgccctatagtgattttcgagacatattgtgtttttaaatatagtattgcaaaacattattttgatagtcaagcgtacttgggagtcggccat

SEQ ID NO: 380282 - DNA, 140 bp, Artificial Sequence
  Synthetic
atggccgactcccaagtacgcttgactatcaaaataatgttttgcaatactatatttaaaaacacaatatgtctcgaaaatcactatagggcgtaatgcttttagcaccgtagcatgtttggagacccagcatggcgtat

SEQ ID NO: 380283 - DNA, 140 bp, Artificial Sequence
  Synthetic
aggccctggctgctgatatgttaaaagaaaagacatgactgtaaaatcagaaataccttctttacaatatagcagactagataataatcttcgtgttaatgataattaaggcattgaccagaccttttgggacagcggtg

SEQ ID NO: 380284 - DNA, 140 bp, Artificial Sequence
  Synthetic
caccgctgtcccaaaaggtctggtcaatgccttaattatcattaacacgaagattattatctagtctgctatattgtaaagaaggtatttctgattttacagtcatgtcttttcttttaacatatcagcagccagggcct

SEQ ID NO: 380285 - DNA, 140 bp, Artificial Sequence
  Synthetic
atacgccatgctgggtctcctcaagcatcatggcaccacacaagtgatgattttggtgagcatgccacagttagagggagtagctttgtaactgatttagagaaatacaatcttgcatttcgtacttgggagtcggccat

SEQ ID NO: 380286 - DNA, 140 bp, Artificial Sequence
  Synthetic
atggccgactcccaagtacgaaatgcaagattgtatttctctaaatcagttacaaagctactccctctaactgtggcatgctcaccaaaatcatcacttgtgtggtgccatgatgcttgaggagacccagcatggcgtat

SEQ ID NO: 380287 - DNA, 140 bp, Artificial Sequence
  Synthetic
atacgccatgctgggtctcccgcagacgagcaggaacagagcgccgaagacaatgcagcgagggtggctgccagcctagcaaaagtcacaagtgcttgtggaatctttttaaaacctgatcgtacttgggagtcggccat

SEQ ID NO: 380288 - DNA, 140 bp, Artificial Sequence
  Synthetic
atggccgactcccaagtacgatcaggttttaaaaagattccacaagcacttgtgacttttgctaggctggcagccaccctcgctgcattgtcttcggcgctctgttcctgctcgtctgcgggagacccagcatggcgtat

SEQ ID NO: 380289 - DNA, 140 bp, Artificial Sequence
  Synthetic
atacgccatgctgggtctccgcgtccagtcccaccatcacccaagattgatcgaggttgggtatgtgtttttcagcttcaagatggtaaaacacttggactcaaaatttgagccaatctccgtacttgggagtcggccat

SEQ ID NO: 380290 - DNA, 140 bp, Artificial Sequence
  Synthetic
atggccgactcccaagtacggagattggctcaaattttgagtccaagtgttttaccatcttgaagctgaaaaacacatacccaacctcgatcaatcttgggtgatggtgggactggacgcggagacccagcatggcgtat

SEQ ID NO: 380291 - DNA, 140 bp, Artificial Sequence
  Synthetic
aggccctggctgctgatatgtgggaactgcactgccattgactttgtgttaaatcctagcggattaaatgtccctgggtcacaagacttaacttcatttctgcgccagattgtacgtagggaccttttgggacagcggtg

SEQ ID NO: 380292 - DNA, 140 bp, Artificial Sequence
  Synthetic
caccgctgtcccaaaaggtccctacgtacaatctggcgcagaaatgaagttaagtcttgtgacccagggacatttaatccgctaggatttaacacaaagtcaatggcagtgcagttcccacatatcagcagccagggcct

SEQ ID NO: 380293 - DNA, 140 bp, Artificial Sequence
  Synthetic
aggccctggctgctgatatggtcagctgacttcgaagacgaaatggtttgtaaatggctattatcatcaactcctgttatgagtcgttttgcagccgatattttttcacgtacgccgagcgaccttttgggacagcggtg

SEQ ID NO: 380294 - DNA, 140 bp, Artificial Sequence
  Synthetic
caccgctgtcccaaaaggtcgctcggcgtacgtgaaaaaatatcggctgcaaaacgactcataacaggagttgatgataatagccatttacaaaccatttcgtcttcgaagtcagctgaccatatcagcagccagggcct

SEQ ID NO: 380295 - DNA, 140 bp, Artificial Sequence
  Synthetic
atacgccatgctgggtctcctgaggaaaataacattgcaaaggtggagtctatggtttagttatcttgatcattgtgataatatcctggcggaggctttaacccaaataacttgcacagtcgtacttgggagtcggccat

SEQ ID NO: 380296 - DNA, 140 bp, Artificial Sequence
  Synthetic
atggccgactcccaagtacgactgtgcaagttatttgggttaaagcctccgccaggatattatcacaatgatcaagataactaaaccatagactccacctttgcaatgttattttcctcaggagacccagcatggcgtat

SEQ ID NO: 380297 - DNA, 140 bp, Artificial Sequence
  Synthetic
aggccctggctgctgatatgcattgtgataatatcctggcggaggctttaacccaaataacttgcacagttgatttagcacagatcctgagggaatattcatgggcacatattttagagggaccttttgggacagcggtg

SEQ ID NO: 380298 - DNA, 140 bp, Artificial Sequence
  Synthetic
caccgctgtcccaaaaggtccctctaaaatatgtgcccatgaatattccctcaggatctgtgctaaatcaactgtgcaagttatttgggttaaagcctccgccaggatattatcacaatgcatatcagcagccagggcct

SEQ ID NO: 380299 - DNA, 140 bp, Artificial Sequence
  Synthetic
aggccctggctgctgatatgtggcaatcagtaggacacatgatggtgattttccgtttgatgcgaacaaattttttgatcaaatttcttctaatacaccaagggatgcacatggttgccggaccttttgggacagcggtg

SEQ ID NO: 380300 - DNA, 140 bp, Artificial Sequence
  Synthetic
caccgctgtcccaaaaggtccggcaaccatgtgcatcccttggtgtattagaagaaatttgatcaaaaaatttgttcgcatcaaacggaaaatcaccatcatgtgtcctactgattgccacatatcagcagccagggcct

SEQ ID NO: 380301 - DNA, 140 bp, Artificial Sequence
  Synthetic
atacgccatgctgggtctccaattgcaatatctcattcgataacccatttttccaaggtaaacggctgaacattatagaagatgatcttattcgactgcctcacttatctggatgggagccgtacttgggagtcggccat

SEQ ID NO: 380302 - DNA, 140 bp, Artificial Sequence
  Synthetic
atggccgactcccaagtacggctcccatccagataagtgaggcagtcgaataagatcatcttctataatgttcagccgtttaccttggaaaaatgggttatcgaatgagatattgcaattggagacccagcatggcgtat

SEQ ID NO: 380303 - DNA, 140 bp, Artificial Sequence
  Synthetic
aggccctggctgctgatatgctttatggatagtatatccgctagagggtcaaaacccaacacctgttaataatttcctccatcagatcgtagaattgctggtgcatgattcatcaagacagaccttttgggacagcggtg

SEQ ID NO: 380304 - DNA, 140 bp, Artificial Sequence
  Synthetic
caccgctgtcccaaaaggtctgtcttgatgaatcatgcaccagcaattctacgatctgatggaggaaattattaacaggtgttgggttttgaccctctagcggatatactatccataaagcatatcagcagccagggcct

SEQ ID NO: 380305 - DNA, 140 bp, Artificial Sequence
  Synthetic
aggccctggctgctgatatggcgtactggaggagcaggcacagaaacagcaaccgaaaatacttggcaagagattcttcaactggatcaagcacaaacaacagtgatggtcatattgagagaccttttgggacagcggtg

SEQ ID NO: 380306 - DNA, 140 bp, Artificial Sequence
  Synthetic
caccgctgtcccaaaaggtctctcaatatgaccatcactgttgtttgtgcttgatccagttgaagaatctcttgccaagtattttcggttgctgtttctgtgcctgctcctccagtacgccatatcagcagccagggcct

SEQ ID NO: 380307 - DNA, 140 bp, Artificial Sequence
  Synthetic
aggccctggctgctgatatgctagtcctacaaatgagccatgaaataaaaagaacgacaattccacaagaaaacacgcaccagggtccgtcattccagtcatttctaagtgactctgcttgaccttttgggacagcggtg

SEQ ID NO: 380308 - DNA, 140 bp, Artificial Sequence
  Synthetic
caccgctgtcccaaaaggtcaagcagagtcacttagaaatgactggaatgacggaccctggtgcgtgttttcttgtggaattgtcgttctttttatttcatggctcatttgtaggactagcatatcagcagccagggcct

SEQ ID NO: 380309 - DNA, 140 bp, Artificial Sequence
  Synthetic
atacgccatgctgggtctccgtggtacagcaaattcaaaactaaatttcgatagatcgagacacaatgtgaaatctcaggatcataactcagcatccaagagggaagatcatcaaataatcgtacttgggagtcggccat

SEQ ID NO: 380310 - DNA, 140 bp, Artificial Sequence
  Synthetic
atggccgactcccaagtacgattatttgatgatcttccctcttggatgctgagttatgatcctgagatttcacattgtgtctcgatctatcgaaatttagttttgaatttgctgtaccacggagacccagcatggcgtat

SEQ ID NO: 380311 - DNA, 140 bp, Artificial Sequence
  Synthetic
atacgccatgctgggtctccctcacaccgtctagtcctacccttctttacattatctcaagggacacgcaaattaacgtcatccaatgagtcacaaacccaagacgagatatcaaaataccgtacttgggagtcggccat

SEQ ID NO: 380312 - DNA, 140 bp, Artificial Sequence
  Synthetic
atggccgactcccaagtacggtattttgatatctcgtcttgggtttgtgactcattggatgacgttaatttgcgtgtcccttgagataatgtaaagaagggtaggactagacggtgtgagggagacccagcatggcgtat

SEQ ID NO: 380313 - DNA, 140 bp, Artificial Sequence
  Synthetic
atacgccatgctgggtctccgaagctgtacataaattgatcttacaccatgttgatcccagcgtattgaaagcagtggtccttaaagtctttctaagtgataccgagggtatgttatggccgtacttgggagtcggccat

SEQ ID NO: 380314 - DNA, 140 bp, Artificial Sequence
  Synthetic
atggccgactcccaagtacggccataacataccctcggtatcacttagaaagactttaaggaccactgctttcaatacgctgggatcaacatggtgtaagatcaatttatgtacagcttcggagacccagcatggcgtat

SEQ ID NO: 380315 - DNA, 140 bp, Artificial Sequence
  Synthetic
aggccctggctgctgatatgtacttggtttaaagaccaaagagcaaggctacctaggcaagtcgaggttataaccatggacgcagagacaacagagaatataaacagatcgaaattgtacgaccttttgggacagcggtg

SEQ ID NO: 380316 - DNA, 140 bp, Artificial Sequence
  Synthetic
caccgctgtcccaaaaggtcgtacaatttcgatctgtttatattctctgttgtctctgcgtccatggttataacctcgacttgcctaggtagccttgctctttggtctttaaaccaagtacatatcagcagccagggcct

SEQ ID NO: 380317 - DNA, 140 bp, Artificial Sequence
  Synthetic
atacgccatgctgggtctccgaagctgtatataaattgatcttacaccatattgatcccagcgtattgaaagcagtggtccttaaagtctttctaagtgatactgagggtatgttatggccgtacttgggagtcggccat

SEQ ID NO: 380318 - DNA, 140 bp, Artificial Sequence
  Synthetic
atggccgactcccaagtacggccataacataccctcagtatcacttagaaagactttaaggaccactgctttcaatacgctgggatcaatatggtgtaagatcaatttatatacagcttcggagacccagcatggcgtat

SEQ ID NO: 380319 - DNA, 140 bp, Artificial Sequence
  Synthetic
atacgccatgctgggtctcccttatcaactacacgtaagatgccacaccaaaaccatctcagttgtaaacaggtaatacttacggcattgcaactgcaaattcaacggagcccatactggcgtacttgggagtcggccat

SEQ ID NO: 380320 - DNA, 140 bp, Artificial Sequence
  Synthetic
atggccgactcccaagtacgccagtatgggctccgttgaatttgcagttgcaatgccgtaagtattacctgtttacaactgagatggttttggtgtggcatcttacgtgtagttgataagggagacccagcatggcgtat

SEQ ID NO: 380321 - DNA, 140 bp, Artificial Sequence
  Synthetic
atacgccatgctgggtctcctctttaagaatgataaacttgatgaagattaagaaaaaggtaatctttcgattatctttagtcttcatccttgattctacaatcatgacagttgtctttacgtacttgggagtcggccat

SEQ ID NO: 380322 - DNA, 140 bp, Artificial Sequence
  Synthetic
atggccgactcccaagtacgtaaagacaactgtcatgattgtagaatcaaggatgaagactaaagataatcgaaagattacctttttcttaatcttcatcaagtttatcattcttaaagaggagacccagcatggcgtat

SEQ ID NO: 380323 - DNA, 140 bp, Artificial Sequence
  Synthetic
aggccctggctgctgatatgaccctgggaactgcactgccattgactttgtgctaaatcctagcggattaaatgttcctgggtcgcaagacttaacttcatttctgcgccagattgtacggaccttttgggacagcggtg

SEQ ID NO: 380324 - DNA, 140 bp, Artificial Sequence
  Synthetic
caccgctgtcccaaaaggtccgtacaatctggcgcagaaatgaagttaagtcttgcgacccaggaacatttaatccgctaggatttagcacaaagtcaatggcagtgcagttcccagggtcatatcagcagccagggcct

SEQ ID NO: 380325 - DNA, 140 bp, Artificial Sequence
  Synthetic
atacgccatgctgggtctccgttaagcttattgaaaggctgacagggcttctgagtttatttccggatggtctctacaggtttgattgaattaccgtgtatagtatcctgatacttgtaacgtacttgggagtcggccat

SEQ ID NO: 380326 - DNA, 140 bp, Artificial Sequence
  Synthetic
atggccgactcccaagtacgttacaagtatcaggatactatacacggtaattcaatcaaacctgtagagaccatccggaaataaactcagaagccctgtcagcctttcaataagcttaacggagacccagcatggcgtat

SEQ ID NO: 380327 - DNA, 140 bp, Artificial Sequence
  Synthetic
atacgccatgctgggtctccaggttggttatcaacatacagattataaaaaactcataaattgctctcatacatcatattgatctaatttcaataaataactatttaaataacaaaagagcgtacttgggagtcggccat

SEQ ID NO: 380328 - DNA, 140 bp, Artificial Sequence
  Synthetic
atggccgactcccaagtacgctcttttgttatttaaatagttatttattgaaattagatcaatatgatgtatgagagcaatttatgagttttttataatctgtatgttgataaccaacctggagacccagcatggcgtat

SEQ ID NO: 380329 - DNA, 140 bp, Artificial Sequence
  Synthetic
atacgccatgctgggtctccgtccttatattatacactgtatttagcctctctccctgcgtgataatcaaaaaattcacaatgcagcatgtgtgacatattactgccgcaatgaatctaacgtacttgggagtcggccat

SEQ ID NO: 380330 - DNA, 140 bp, Artificial Sequence
  Synthetic
atggccgactcccaagtacgttagattcattgcggcagtaatatgtcacacatgctgcattgtgaattttttgattatcacgcagggagagaggctaaatacagtgtataatataaggacggagacccagcatggcgtat

SEQ ID NO: 380331 - DNA, 140 bp, Artificial Sequence
  Synthetic
aggccctggctgctgatatgaaaattcacaatgcagcatgtgtgacatattactgccgcaatgaatctaacacaacataataaactctgcactctttataattaagctttaatgaaaggtgaccttttgggacagcggtg

SEQ ID NO: 380332 - DNA, 140 bp, Artificial Sequence
  Synthetic
caccgctgtcccaaaaggtcacctttcattaaagcttaattataaagagtgcagagtttattatgttgtgttagattcattgcggcagtaatatgtcacacatgctgcattgtgaattttcatatcagcagccagggcct

SEQ ID NO: 380333 - DNA, 140 bp, Artificial Sequence
  Synthetic
atacgccatgctgggtctccgaggggagacctcttattggagccacactcccatgtatgattgagcaattcaaagtggtttggctgaaaccctacgaacaatgtccgcagtgttcaaatgcgtacttgggagtcggccat

SEQ ID NO: 380334 - DNA, 140 bp, Artificial Sequence
  Synthetic
atggccgactcccaagtacgcatttgaacactgcggacattgttcgtagggtttcagccaaaccactttgaattgctcaatcatacatgggagtgtggctccaataagaggtctcccctcggagacccagcatggcgtat

SEQ ID NO: 380335 - DNA, 140 bp, Artificial Sequence
  Synthetic
atacgccatgctgggtctccaaaatggtgatagccttaatctttgtgtaaaataagagattgggtgtaataactttaactttttgtctagtaagctactatttcatacagaacgataaaacgtacttgggagtcggccat

SEQ ID NO: 380336 - DNA, 140 bp, Artificial Sequence
  Synthetic
atggccgactcccaagtacgttttatcgttctgtatgaaatagtagcttactagacaaaaagttaaagttattacacccaatctcttattttacacaaagattaaggctatcaccattttggagacccagcatggcgtat

SEQ ID NO: 380337 - DNA, 140 bp, Artificial Sequence
  Synthetic
atacgccatgctgggtctccttaaaagaaaaggcatgattgtaaaatcagaaataccttctttacaatatagcagactagataataatcttcgtgttaatgataattaagacattgaccacgtacttgggagtcggccat

SEQ ID NO: 380338 - DNA, 140 bp, Artificial Sequence
  Synthetic
atggccgactcccaagtacgtggtcaatgtcttaattatcattaacacgaagattattatctagtctgctatattgtaaagaaggtatttctgattttacaatcatgccttttcttttaaggagacccagcatggcgtat

SEQ ID NO: 380339 - DNA, 140 bp, Artificial Sequence
  Synthetic
aggccctggctgctgatatgccccttaataaggctgactaaaacactatataaccttctacttgatcacaatactccgtatacctatcatcatatatttaatcaagacgatatcctttaagaccttttgggacagcggtg

SEQ ID NO: 380340 - DNA, 140 bp, Artificial Sequence
  Synthetic
caccgctgtcccaaaaggtcttaaaggatatcgtcttgattaaatatatgatgataggtatacggagtattgtgatcaagtagaaggttatatagtgttttagtcagccttattaaggggcatatcagcagccagggcct

SEQ ID NO: 380341 - DNA, 140 bp, Artificial Sequence
  Synthetic
atacgccatgctgggtctcctcacaaagatagagaacaacctaggtctccgaagggagcaagggcatcagtgtgctcagttgaaaatcccttgtcaacatctaggtcttatcacatcacacgtacttgggagtcggccat

SEQ ID NO: 380342 - DNA, 140 bp, Artificial Sequence
  Synthetic
atggccgactcccaagtacgtgtgatgtgataagacctagatgttgacaagggattttcaactgagcacactgatgcccttgctcccttcggagacctaggttgttctctatctttgtgaggagacccagcatggcgtat

SEQ ID NO: 380343 - DNA, 140 bp, Artificial Sequence
  Synthetic
atacgccatgctgggtctccctgggctcatattgttattgatataataatgttgtatcaatatcctgtcagatggaatagtgttttggttgataacacgacttcttaaaacaaaattgatcgtacttgggagtcggccat

SEQ ID NO: 380344 - DNA, 140 bp, Artificial Sequence
  Synthetic
atggccgactcccaagtacgatcaattttgttttaagaagtcgtgttatcaaccaaaacactattccatctgacaggatattgatacaacattattatatcaataacaatatgagcccagggagacccagcatggcgtat

SEQ ID NO: 380345 - DNA, 140 bp, Artificial Sequence
  Synthetic
aggccctggctgctgatatggatggaatagtgttttggttgataacacgacttcttaaaacaaaattgatctttaagattaagttttttataattatcattactttaatttgtcgatttagaccttttgggacagcggtg

SEQ ID NO: 380346 - DNA, 140 bp, Artificial Sequence
  Synthetic
caccgctgtcccaaaaggtctaaatcgacaaattaaagtaatgataattataaaaaacttaatcttaaagatcaattttgttttaagaagtcgtgttatcaaccaaaacactattccatccatatcagcagccagggcct

SEQ ID NO: 380347 - DNA, 140 bp, Artificial Sequence
  Synthetic
aggccctggctgctgatatggtctgtacacatctcatacattgtattaggggcaataatatctaattgaacttagccatttaaaatttagtgcataaatctgggctaactccaccaggtcgaccttttgggacagcggtg

SEQ ID NO: 380348 - DNA, 140 bp, Artificial Sequence
  Synthetic
caccgctgtcccaaaaggtcgacctggtggagttagcccagatttatgcactaaattttaaatggctaagttcaattagatattattgcccctaatacaatgtatgagatgtgtacagaccatatcagcagccagggcct

SEQ ID NO: 380349 - DNA, 140 bp, Artificial Sequence
  Synthetic
aggccctggctgctgatatggaggtctgataagaataaaccttattattcagattaggccccaagaggcattcttcatctctctccagcaaagcactatttcagggtagtccaattagtggaccttttgggacagcggtg

SEQ ID NO: 380350 - DNA, 140 bp, Artificial Sequence
  Synthetic
caccgctgtcccaaaaggtccactaattggactaccctgaaatagtgctttgctggagagagatgaagaatgcctcttggggcctaatctgaataataaggtttattcttatcagacctccatatcagcagccagggcct

SEQ ID NO: 380351 - DNA, 140 bp, Artificial Sequence
  Synthetic
atacgccatgctgggtctccacacgtcctttagctgtataccagtcgcccttgagatacgccacaaaagtgtctccaagctaaattggtctgtacacatctcatacattgtattagaggccgtacttgggagtcggccat

SEQ ID NO: 380352 - DNA, 140 bp, Artificial Sequence
  Synthetic
atggccgactcccaagtacggcctctaatacaatgtatgagatgtgtacagaccaatttagcttggagacacttttgtggcgtatctcaagggcgactggtatacagctaaaggacgtgtggagacccagcatggcgtat

SEQ ID NO: 380353 - DNA, 140 bp, Artificial Sequence
  Synthetic
atacgccatgctgggtctcctaacattagataagtaggttaagaaaaaagcttgaggaagattaagaaaaactgcttattgggtctttccgtgttttagatgaagcagttgacattcttccgtacttgggagtcggccat

SEQ ID NO: 380354 - DNA, 140 bp, Artificial Sequence
  Synthetic
atggccgactcccaagtacggaagaatgtcaactgcttcatctaaaacacggaaagacccaataagcagtttttcttaatcttcctcaagcttttttcttaacctacttatctaatgttaggagacccagcatggcgtat

SEQ ID NO: 380355 - DNA, 140 bp, Artificial Sequence
  Synthetic
atacgccatgctgggtctccgaatcacaaaattccgagtatggattctcgtcctcagaaagtctggatgacgccgagtctcactgaatctgacatggattaccacaagatcttgacagcacgtacttgggagtcggccat

SEQ ID NO: 380356 - DNA, 140 bp, Artificial Sequence
  Synthetic
atggccgactcccaagtacgtgctgtcaagatcttgtggtaatccatgtcagattcagtgagactcggcgtcatccagactttctgaggacgagaatccatactcggaattttgtgattcggagacccagcatggcgtat

SEQ ID NO: 380357 - DNA, 140 bp, Artificial Sequence
  Synthetic
aggccctggctgctgatatgcctgcgaattggaaaccaggctttcctccaggagttcgttcttccaccagtccaactaccccagtatttcacctttgatttgacagcactcaaactgatcgaccttttgggacagcggtg

SEQ ID NO: 380358 - DNA, 140 bp, Artificial Sequence
  Synthetic
caccgctgtcccaaaaggtcgatcagtttgagtgctgtcaaatcaaaggtgaaatactggggtagttggactggtggaagaacgaactcctggaggaaagcctggtttccaattcgcaggcatatcagcagccagggcct

SEQ ID NO: 380359 - DNA, 140 bp, Artificial Sequence
  Synthetic
atacgccatgctgggtctccaatttccatcagaaaaagaacgaaatcagcttccagcaaacaaacgctatggtaactctaaagaaagagcgcctggccaagctgacggaagctatcactgcgtacttgggagtcggccat

SEQ ID NO: 380360 - DNA, 140 bp, Artificial Sequence
  Synthetic
atggccgactcccaagtacgcagtgatagcttccgtcagcttggccaggcgctctttctttagagttaccatagcgtttgtttgctggaagctgatttcgttctttttctgatggaaattggagacccagcatggcgtat

SEQ ID NO: 380361 - DNA, 140 bp, Artificial Sequence
  Synthetic
aggccctggctgctgatatgccgatgatggaagctacggcgaataccagagttactcggaaaacggcatgaatgcaccagatgacttgatcctattcgatctagacgaggacgatgaggagaccttttgggacagcggtg

SEQ ID NO: 380362 - DNA, 140 bp, Artificial Sequence
  Synthetic
caccgctgtcccaaaaggtctcctcatcgtcctcgtctagatcgaataggatcaagtcatctggtgcattcatgccgttttccgagtaactctggtattcgccgtagcttccatcatcggcatatcagcagccagggcct

SEQ ID NO: 380363 - DNA, 140 bp, Artificial Sequence
  Synthetic
aggccctggctgctgatatggtcaaaagggccagcatacagagggcagacagacacaatccaggccaactcaaaatatcccaggccctcacagaacaatccaccacgcaagtgctccactgaccttttgggacagcggtg

SEQ ID NO: 380364 - DNA, 140 bp, Artificial Sequence
  Synthetic
caccgctgtcccaaaaggtcagtggagcacttgcgtggtggattgttctgtgagggcctgggatattttgagttggcctggattgtgtctgtctgccctctgtatgctggcccttttgaccatatcagcagccagggcct

SEQ ID NO: 380365 - DNA, 140 bp, Artificial Sequence
  Synthetic
aggccctggctgctgatatgattactggactactcaggatgaaggtgctgcaatcggattggcctggataccatatttcgggccagcagccgaaggaatttacacagaggggctaatgcagaccttttgggacagcggtg

SEQ ID NO: 380366 - DNA, 140 bp, Artificial Sequence
  Synthetic
caccgctgtcccaaaaggtctgcattagcccctctgtgtaaattccttcggctgctggcccgaaatatggtatccaggccaatccgattgcagcaccttcatcctgagtagtccagtaatcatatcagcagccagggcct

SEQ ID NO: 380367 - DNA, 140 bp, Artificial Sequence
  Synthetic
atacgccatgctgggtctccggacggaacctccaatcgcacacccactgtcgccccaccggctcccgtatacagagatcactctgaaaagaaagaactcccgcaagatgagcgacaagatcgtacttgggagtcggccat

SEQ ID NO: 380368 - DNA, 140 bp, Artificial Sequence
  Synthetic
atggccgactcccaagtacgatcttgtcgctcatcttgcgggagttctttcttttcagagtgatctctgtatacgggagccggtggggcgacagtgggtgtgcgattggaggttccgtccggagacccagcatggcgtat

SEQ ID NO: 380369 - DNA, 140 bp, Artificial Sequence
  Synthetic
atacgccatgctgggtctccttgcttccacagttatctaccgaggaacgactttcgctgaaggtgtcgttgcatttctgatactgccccaagctaagaaggacttcttcagctcacaccccgtacttgggagtcggccat

SEQ ID NO: 380370 - DNA, 140 bp, Artificial Sequence
  Synthetic
atggccgactcccaagtacggggtgtgagctgaagaagtccttcttagcttggggcagtatcagaaatgcaacgacaccttcagcgaaagtcgttcctcggtagataactgtggaagcaaggagacccagcatggcgtat

SEQ ID NO: 380371 - DNA, 140 bp, Artificial Sequence
  Synthetic
aggccctggctgctgatatgaatcatggcttcagaaaattcctctgcaatggttcaagtgcacagtcaaggaaggaaagctgcagtgtcgcatctgacaacccttgccacaatctccacggaccttttgggacagcggtg

SEQ ID NO: 380372 - DNA, 140 bp, Artificial Sequence
  Synthetic
caccgctgtcccaaaaggtccgtggagattgtggcaagggttgtcagatgcgacactgcagctttccttccttgactgtgcacttgaaccattgcagaggaattttctgaagccatgattcatatcagcagccagggcct

SEQ ID NO: 380373 - DNA, 140 bp, Artificial Sequence
  Synthetic
atacgccatgctgggtctccacggatccaatttgcaatcatagttttgaggaggtagtacaaacattagcttcattggctactgttgtgcaacaacaaaccatcgcatcagaatcattagcgtacttgggagtcggccat

SEQ ID NO: 380374 - DNA, 140 bp, Artificial Sequence
  Synthetic
atggccgactcccaagtacgctaatgattctgatgcgatggtttgttgttgcacaacagtagccaatgaagctaatgtttgtactacctcctcaaaactatgattgcaaattggatccgtggagacccagcatggcgtat

SEQ ID NO: 380375 - DNA, 140 bp, Artificial Sequence
  Synthetic
aggccctggctgctgatatgctttatgaagaaagtgcgattcggggtaagattgaatctagagatgagaccgtccctcaaagtgttagggaggcattcaacaatctagacagtaccacttgaccttttgggacagcggtg

SEQ ID NO: 380376 - DNA, 140 bp, Artificial Sequence
  Synthetic
caccgctgtcccaaaaggtcaagtggtactgtctagattgttgaatgcctccctaacactttgagggacggtctcatctctagattcaatcttaccccgaatcgcactttcttcataaagcatatcagcagccagggcct

SEQ ID NO: 380377 - DNA, 140 bp, Artificial Sequence
  Synthetic
aggccctggctgctgatatggtatgtgtttttcagcttcaagatggtaaaacacttggactcaaaatttgagccaatctcccttccctccgaaagaggcgactaatagcagaggcttcaagaccttttgggacagcggtg

SEQ ID NO: 380378 - DNA, 140 bp, Artificial Sequence
  Synthetic
caccgctgtcccaaaaggtcttgaagcctctgctattagtcgcctctttcggagggaagggagattggctcaaattttgagtccaagtgttttaccatcttgaagctgaaaaacacataccatatcagcagccagggcct

SEQ ID NO: 380379 - DNA, 140 bp, Artificial Sequence
  Synthetic
atacgccatgctgggtctccttcggcaaggcaactaatccacttgtcagagtcaatcggctgggtcctggaatcccggatcaccccctcagactcctgcgaattggaaaccaggccttcccgtacttgggagtcggccat

SEQ ID NO: 380380 - DNA, 140 bp, Artificial Sequence
  Synthetic
atggccgactcccaagtacgggaaggcctggtttccaattcgcaggagtctgagggggtgatccgggattccaggacccagccgattgactctgacaagtggattagttgccttgccgaaggagacccagcatggcgtat

SEQ ID NO: 380381 - DNA, 140 bp, Artificial Sequence
  Synthetic
atacgccatgctgggtctccagggatagtgataacatctatttagtaatccgtccattagaggagatactttaaattgatcgatatactaaaggtgctttacaccattgtcttttttctccgtacttgggagtcggccat

SEQ ID NO: 380382 - DNA, 140 bp, Artificial Sequence
  Synthetic
atggccgactcccaagtacggagaaaaaagacaatggtgtaaagcacctttagtatatcgatcaatttaaagtatctcctctaatggacggattactaaatagatgttatcactatccctggagacccagcatggcgtat

SEQ ID NO: 380383 - DNA, 140 bp, Artificial Sequence
  Synthetic
aggccctggctgctgatatggtcaaggaaggaaagctgcagtgtcgcatctgacaacccttgccacaatctccacgagtcctcaacctcccacaaccaaaacaggtccggacaacagcacgaccttttgggacagcggtg

SEQ ID NO: 380384 - DNA, 140 bp, Artificial Sequence
  Synthetic
caccgctgtcccaaaaggtcgtgctgttgtccggacctgttttggttgtgggaggttgaggactcgtggagattgtggcaagggttgtcagatgcgacactgcagctttccttccttgaccatatcagcagccagggcct

SEQ ID NO: 380385 - DNA, 140 bp, Artificial Sequence
  Synthetic
atacgccatgctgggtctcctcctaaatgtagaacttaacaaaagactcataatatacttggttttaaaagattgattgatagaagatcataactaataacattacaaataatcctactacgtacttgggagtcggccat

SEQ ID NO: 380386 - DNA, 140 bp, Artificial Sequence
  Synthetic
atggccgactcccaagtacgtagtaggattatttgtaatgttattagttatgatcttctatcaatcaatcttttaaaaccaagtatattatgagtcttttgttaagttctacatttaggaggagacccagcatggcgtat

SEQ ID NO: 380387 - DNA, 140 bp, Artificial Sequence
  Synthetic
aggccctggctgctgatatgttcttcatctccttttagcaaaatactatttcaggatagtccagctagtgacacgtcttttagctgtataccagttgcccctgagatacgccacaaaagtgaccttttgggacagcggtg

SEQ ID NO: 380388 - DNA, 140 bp, Artificial Sequence
  Synthetic
caccgctgtcccaaaaggtcacttttgtggcgtatctcaggggcaactggtatacagctaaaagacgtgtcactagctggactatcctgaaatagtattttgctaaaaggagatgaagaacatatcagcagccagggcct

SEQ ID NO: 380389 - DNA, 140 bp, Artificial Sequence
  Synthetic
atacgccatgctgggtctccaataaaggttttgaccttggacagttaacactcggcaaacctctggatttcggaacaatatcattggcactagcggtaccgcaggtgcttggagggttatcgtacttgggagtcggccat

SEQ ID NO: 380390 - DNA, 140 bp, Artificial Sequence
  Synthetic
atggccgactcccaagtacgataaccctccaagcacctgcggtaccgctagtgccaatgatattgttccgaaatccagaggtttgccgagtgttaactgtccaaggtcaaaacctttattggagacccagcatggcgtat

SEQ ID NO: 380391 - DNA, 140 bp, Artificial Sequence
  Synthetic
atacgccatgctgggtctccgcaacggaggacccgtctagtggctactattctaccacaattagatatcaggctaccggctttggaaccaatgagacagagtatttgttcgaggttgacacgtacttgggagtcggccat

SEQ ID NO: 380392 - DNA, 140 bp, Artificial Sequence
  Synthetic
atggccgactcccaagtacgtgtcaacctcgaacaaatactctgtctcattggttccaaagccggtagcctgatatctaattgtggtagaatagtagccactagacgggtcctccgttgcggagacccagcatggcgtat

SEQ ID NO: 380393 - DNA, 140 bp, Artificial Sequence
  Synthetic
aggccctggctgctgatatggtcaaggaagggaagctgcagtgtcgcatctgacaacccttgccacaatctccacgagtcttcgaccccccataaccaaaccaggtccggacaacagcacgaccttttgggacagcggtg

SEQ ID NO: 380394 - DNA, 140 bp, Artificial Sequence
  Synthetic
caccgctgtcccaaaaggtcgtgctgttgtccggacctggtttggttatggggggtcgaagactcgtggagattgtggcaagggttgtcagatgcgacactgcagcttcccttccttgaccatatcagcagccagggcct

SEQ ID NO: 380395 - DNA, 140 bp, Artificial Sequence
  Synthetic
aggccctggctgctgatatggaaatttatatcggaatttaaattgaaattgttactgtaatcatacctggtttgtttcagagccatatcaccaagatagagaacaacctaggtctccggagaccttttgggacagcggtg

SEQ ID NO: 380396 - DNA, 140 bp, Artificial Sequence
  Synthetic
caccgctgtcccaaaaggtctccggagacctaggttgttctctatcttggtgatatggctctgaaacaaaccaggtatgattacagtaacaatttcaatttaaattccgatataaatttccatatcagcagccagggcct

SEQ ID NO: 380397 - DNA, 140 bp, Artificial Sequence
  Synthetic
atacgccatgctgggtctccccacaatacacccgtgtataaacttgacatctctgaggcaactcaagttgaacaacatcaccgcagaacagacaacgccagcacaacctccgacactccccgtacttgggagtcggccat

SEQ ID NO: 380398 - DNA, 140 bp, Artificial Sequence
  Synthetic
atggccgactcccaagtacggggagtgtcggaggttgtgctggcgttgtctgttctgcggtgatgttgttcaacttgagttgcctcagagatgtcaagtttatacacgggtgtattgtggggagacccagcatggcgtat

SEQ ID NO: 380399 - DNA, 140 bp, Artificial Sequence
  Synthetic
atacgccatgctgggtctcccccgccacgaccgcagccggacccctaaaagcagagaacaccaacacgagcaagggcactgacctcctggaccccgccaccacaacaagtccccaaaacccgtacttgggagtcggccat

SEQ ID NO: 380400 - DNA, 140 bp, Artificial Sequence
  Synthetic
atggccgactcccaagtacgggttttggggacttgttgtggtggcggggtccaggaggtcagtgcccttgctcgtgttggtgttctctgcttttaggggtccggctgcggtcgtggcgggggagacccagcatggcgtat

SEQ ID NO: 380401 - DNA, 140 bp, Artificial Sequence
  Synthetic
aggccctggctgctgatatgggcaattgatttcttgctgcagcgatggggcggcacatgccacattttgggaccggactgctgtatcgaaccacatgattggactaagaacataacggacgaccttttgggacagcggtg

SEQ ID NO: 380402 - DNA, 140 bp, Artificial Sequence
  Synthetic
caccgctgtcccaaaaggtcgtccgttatgttcttagtccaatcatgtggttcgatacagcagtccggtcccaaaatgtggcatgtgccgccccatcgctgcagcaagaaatcaattgcccatatcagcagccagggcct

SEQ ID NO: 380403 - DNA, 140 bp, Artificial Sequence
  Synthetic
aggccctggctgctgatatgtaataatcagatctgcgaaccggtagagtttagttgcaacctaacacacataaagcattgatcaaaaagtcaatagaaacttaaacagtgagtggaggcagaccttttgggacagcggtg

SEQ ID NO: 380404 - DNA, 140 bp, Artificial Sequence
  Synthetic
caccgctgtcccaaaaggtctgcctccactcactgtttaagtttctattgactttttgatcaatgctttatgtgtgttaggttgcaactaaactctaccggttcgcagatctgattattacatatcagcagccagggcct

SEQ ID NO: 380405 - DNA, 140 bp, Artificial Sequence
  Synthetic
aggccctggctgctgatatgtttatgacttactaatgatctcttaaaatattaagaaaaactgacggaacataaattctttctgcttcaagttgtggaggaggtgtttggtatttgctatgaccttttgggacagcggtg

SEQ ID NO: 380406 - DNA, 140 bp, Artificial Sequence
  Synthetic
caccgctgtcccaaaaggtcatagcaaataccaaacacctcctccacaacttgaagcagaaagaatttatgttccgtcagtttttcttaatattttaagagatcattagtaagtcataaacatatcagcagccagggcct

SEQ ID NO: 380407 - DNA, 140 bp, Artificial Sequence
  Synthetic
atacgccatgctgggtctccgagtcgccacagcccacgggagcaccctcgcaggagtaaatgttggagaacagtatcaacagctcagagaggcagccactgaggctgagaagcaactccacgtacttgggagtcggccat

SEQ ID NO: 380408 - DNA, 140 bp, Artificial Sequence
  Synthetic
atggccgactcccaagtacgtggagttgcttctcagcctcagtggctgcctctctgagctgttgatactgttctccaacatttactcctgcgagggtgctcccgtgggctgtggcgactcggagacccagcatggcgtat

SEQ ID NO: 380409 - DNA, 140 bp, Artificial Sequence
  Synthetic
aggccctggctgctgatatgtgttatattacaatcaataacaagcttgtaaaaatattgttcttgtttcaagaggtagattgtggccggaaatgctaaactaatgatgaagattaatgcggaccttttgggacagcggtg

SEQ ID NO: 380410 - DNA, 140 bp, Artificial Sequence
  Synthetic
caccgctgtcccaaaaggtccgcattaatcttcatcattagtttagcatttccggccacaatctacctcttgaaacaagaacaatatttttacaagcttgttattgattgtaatataacacatatcagcagccagggcct

SEQ ID NO: 380411 - DNA, 140 bp, Artificial Sequence
  Synthetic
aggccctggctgctgatatgttcttcatctccttttagcaaagtactatttcagggtagtccaattagtgacacgtcccttagttgtatatcagtcgcccctgagatacgccacaaaagtgaccttttgggacagcggtg

SEQ ID NO: 380412 - DNA, 140 bp, Artificial Sequence
  Synthetic
caccgctgtcccaaaaggtcacttttgtggcgtatctcaggggcgactgatatacaactaagggacgtgtcactaattggactaccctgaaatagtactttgctaaaaggagatgaagaacatatcagcagccagggcct

SEQ ID NO: 380413 - DNA, 140 bp, Artificial Sequence
  Synthetic
aggccctggctgctgatatgaataatatctaattgaacttagccgtttaaaatttagtgcataaatctgggctaactccaccaggtcaactccattggttgaaaaaaggcctacctacaagaccttttgggacagcggtg

SEQ ID NO: 380414 - DNA, 140 bp, Artificial Sequence
  Synthetic
caccgctgtcccaaaaggtcttgtaggtaggccttttttcaaccaatggagttgacctggtggagttagcccagatttatgcactaaattttaaacggctaagttcaattagatattattcatatcagcagccagggcct

SEQ ID NO: 380415 - DNA, 140 bp, Artificial Sequence
  Synthetic
aggccctggctgctgatatgaacaatcgagcgcaaggtttcaaagttgaactgagagtgtctagacaacaaagtatcgatactccagacaccaagcaagacctgagaaaaaaccatggctgaccttttgggacagcggtg

SEQ ID NO: 380416 - DNA, 140 bp, Artificial Sequence
  Synthetic
caccgctgtcccaaaaggtcagccatggttttttctcaggtcttgcttggtgtctggagtatcgatactttgttgtctagacactctcagttcaactttgaaaccttgcgctcgattgttcatatcagcagccagggcct

SEQ ID NO: 380417 - DNA, 140 bp, Artificial Sequence
  Synthetic
aggccctggctgctgatatggaacccgacaaatcggcaatgaaccgcaagaagcctgggccggcgaaattttccctccttcatgagtccacactgaaagcatttacacaaggatcctcgagaccttttgggacagcggtg

SEQ ID NO: 380418 - DNA, 140 bp, Artificial Sequence
  Synthetic
caccgctgtcccaaaaggtctcgaggatccttgtgtaaatgctttcagtgtggactcatgaaggagggaaaatttcgccggcccaggcttcttgcggttcattgccgatttgtcgggttccatatcagcagccagggcct

SEQ ID NO: 380419 - DNA, 140 bp, Artificial Sequence
  Synthetic
aggccctggctgctgatatggacttcactccaggactttaagatcgttccaattgatccaaccaaaaatatcatgggaatcgaagtgccagaaactctggtccacaagctgaccggtaaggaccttttgggacagcggtg

SEQ ID NO: 380420 - DNA, 140 bp, Artificial Sequence
  Synthetic
caccgctgtcccaaaaggtccttaccggtcagcttgtggaccagagtttctggcacttcgattcccatgatatttttggttggatcaattggaacgatcttaaagtcctggagtgaagtccatatcagcagccagggcct

SEQ ID NO: 380421 - DNA, 140 bp, Artificial Sequence
  Synthetic
aggccctggctgctgatatgaataagcattttatcaccagaaaccttatatactaaatggttaattgtaactgaatccgcaggtcacatgtgttaggtttcacagattctgtatattactgaccttttgggacagcggtg

SEQ ID NO: 380422 - DNA, 140 bp, Artificial Sequence
  Synthetic
caccgctgtcccaaaaggtcagtaatatacagaatctgtgaaacctaacacatgtgacctgcggattcagttacaattaaccatttagtatataaggtttctggtgataaaatgcttattcatatcagcagccagggcct

SEQ ID NO: 380423 - DNA, 140 bp, Artificial Sequence
  Synthetic
atacgccatgctgggtctcccccaccggctcccgtatacagagatcactccgaaaagaaagaactcccgcaagatgaacaacaagatcaggaccacattcaagaggccaggaaccaagaccgtacttgggagtcggccat

SEQ ID NO: 380424 - DNA, 140 bp, Artificial Sequence
  Synthetic
atggccgactcccaagtacggtcttggttcctggcctcttgaatgtggtcctgatcttgttgttcatcttgcgggagttctttcttttcggagtgatctctgtatacgggagccggtgggggagacccagcatggcgtat

SEQ ID NO: 380425 - DNA, 140 bp, Artificial Sequence
  Synthetic
atacgccatgctgggtctcccctgttgagccgcggtgccaacagttcttagatgagatcatcaagtacacaatgcaagatgctctcttcttgaaatactatctcaaaaatgtgggtgctccgtacttgggagtcggccat

SEQ ID NO: 380426 - DNA, 140 bp, Artificial Sequence
  Synthetic
atggccgactcccaagtacggagcacccacatttttgagatagtatttcaagaagagagcatcttgcattgtgtacttgatgatctcatctaagaactgttggcaccgcggctcaacaggggagacccagcatggcgtat

SEQ ID NO: 380427 - DNA, 140 bp, Artificial Sequence
  Synthetic
atacgccatgctgggtctccgtatagagtcagaaatagtatcaggaatgactactcctaggatgcttctacctgttatgtcaaaattccataatgaccaaattgagattattcttaacaacgtacttgggagtcggccat

SEQ ID NO: 380428 - DNA, 140 bp, Artificial Sequence
  Synthetic
atggccgactcccaagtacgttgttaagaataatctcaatttggtcattatggaattttgacataacaggtagaagcatcctaggagtagtcattcctgatactatttctgactctatacggagacccagcatggcgtat

SEQ ID NO: 380429 - DNA, 140 bp, Artificial Sequence
  Synthetic
atacgccatgctgggtctccacctcacaaatttagtactaaacgtgtaccggaacaatttttagagcaagaaaacttttctattgagaatgttctttcctacgcgcaaaaacttgagtatcgtacttgggagtcggccat

SEQ ID NO: 380430 - DNA, 140 bp, Artificial Sequence
  Synthetic
atggccgactcccaagtacgatactcaagtttttgcgcgtaggaaagaacattctcaatagaaaagttttcttgctctaaaaattgttccggtacacgtttagtactaaatttgtgaggtggagacccagcatggcgtat

SEQ ID NO: 380431 - DNA, 140 bp, Artificial Sequence
  Synthetic
atacgccatgctgggtctccaaaactaccataaatgatcatgtacatcctcacgacaatcttgtttacacatgtaagagtacagccagcaatttcttccatgcgtcattggcgtactggacgtacttgggagtcggccat

SEQ ID NO: 380432 - DNA, 140 bp, Artificial Sequence
  Synthetic
atggccgactcccaagtacgtccagtacgccaatgacgcatggaagaaattgctggctgtactcttacatgtgtaaacaagattgtcgtgaggatgtacatgatcatttatggtagttttggagacccagcatggcgtat

SEQ ID NO: 380433 - DNA, 140 bp, Artificial Sequence
  Synthetic
atacgccatgctgggtctcccattgtctgatgcaatttttgatgatcttcaagggaccctagctagtataggcaccgcttttgagcggtccatttctgagacacgacatatctttccttgcgtacttgggagtcggccat

SEQ ID NO: 380434 - DNA, 140 bp, Artificial Sequence
  Synthetic
atggccgactcccaagtacgcaaggaaagatatgtcgtgtctcagaaatggaccgctcaaaagcggtgcctatactagctagggtcccttgaagatcatcaaaaattgcatcagacaatgggagacccagcatggcgtat

SEQ ID NO: 380435 - DNA, 140 bp, Artificial Sequence
  Synthetic
atacgccatgctgggtctccttgatatagtaatgttgtatcaatatcttgccagatggaatagtgctttggttgataacacgacttcttaaaacaaaactgatctttaagattaagttttcgtacttgggagtcggccat

SEQ ID NO: 380436 - DNA, 140 bp, Artificial Sequence
  Synthetic
atggccgactcccaagtacgaaaacttaatcttaaagatcagttttgttttaagaagtcgtgttatcaaccaaagcactattccatctggcaagatattgatacaacattactatatcaaggagacccagcatggcgtat

SEQ ID NO: 380437 - DNA, 140 bp, Artificial Sequence
  Synthetic
aggccctggctgctgatatggcaaccaggtgggaaaccattcgtgtcagtggcagtcaagaaacatattgttagtgcatggccgaacgcgtcccgactaagctggactatcggggatggagaccttttgggacagcggtg

SEQ ID NO: 380438 - DNA, 140 bp, Artificial Sequence
  Synthetic
caccgctgtcccaaaaggtctccatccccgatagtccagcttagtcgggacgcgttcggccatgcactaacaatatgtttcttgactgccactgacacgaatggtttcccacctggttgccatatcagcagccagggcct

SEQ ID NO: 380439 - DNA, 140 bp, Artificial Sequence
  Synthetic
aggccctggctgctgatatggactgtaaaatcagaaataccttctttacaatatagcagactagataataatcttcgtgttaatgataattaaggcattgaccacgctcatcagaaggctgaccttttgggacagcggtg

SEQ ID NO: 380440 - DNA, 140 bp, Artificial Sequence
  Synthetic
caccgctgtcccaaaaggtcagccttctgatgagcgtggtcaatgccttaattatcattaacacgaagattattatctagtctgctatattgtaaagaaggtatttctgattttacagtccatatcagcagccagggcct

SEQ ID NO: 380441 - DNA, 140 bp, Artificial Sequence
  Synthetic
aggccctggctgctgatatgatcttcgtgttaatgataattaaggcattgaccacgctcatcagaaggctcactagaataaacgttgcaaaaaggatccctggaaaaatggtcgcacacagaccttttgggacagcggtg

SEQ ID NO: 380442 - DNA, 140 bp, Artificial Sequence
  Synthetic
caccgctgtcccaaaaggtctgtgtgcgaccatttttccagggatcctttttgcaacgtttattctagtgagccttctgatgagcgtggtcaatgccttaattatcattaacacgaagatcatatcagcagccagggcct

SEQ ID NO: 380443 - DNA, 140 bp, Artificial Sequence
  Synthetic
aggccctggctgctgatatgaagccatttttggaagcacgagtaaatttgagtgttcaagaaatacttcaaatgactccttcacattactcaggaaatattgttcacaggtacaacgatcgaccttttgggacagcggtg

SEQ ID NO: 380444 - DNA, 140 bp, Artificial Sequence
  Synthetic
caccgctgtcccaaaaggtcgatcgttgtacctgtgaacaatatttcctgagtaatgtgaaggagtcatttgaagtatttcttgaacactcaaatttactcgtgcttccaaaaatggcttcatatcagcagccagggcct

SEQ ID NO: 380445 - DNA, 140 bp, Artificial Sequence
  Synthetic
atacgccatgctgggtctcccagagattcgagaattgaccaatgattataatcaacagcgacaaagtcggactcaaacatatcactttattcgtactgcaaaaggacgaatcacaaaactcgtacttgggagtcggccat

SEQ ID NO: 380446 - DNA, 140 bp, Artificial Sequence
  Synthetic
atggccgactcccaagtacgagttttgtgattcgtccttttgcagtacgaataaagtgatatgtttgagtccgactttgtcgctgttgattataatcattggtcaattctcgaatctctgggagacccagcatggcgtat

SEQ ID NO: 380447 - DNA, 140 bp, Artificial Sequence
  Synthetic
aggccctggctgctgatatgttttgtgtgcgaataactatgaggaagattaataattttcctctcattgaaatttatatcggaatttaaattgaaattgttactgtaatcatacctggttgaccttttgggacagcggtg

SEQ ID NO: 380448 - DNA, 140 bp, Artificial Sequence
  Synthetic
caccgctgtcccaaaaggtcaaccaggtatgattacagtaacaatttcaatttaaattccgatataaatttcaatgagaggaaaattattaatcttcctcatagttattcgcacacaaaacatatcagcagccagggcct

SEQ ID NO: 380449 - DNA, 140 bp, Artificial Sequence
  Synthetic
atacgccatgctgggtctccaattgacgtcatccaatgagtcacaaacccaagacgagatatcaaagtacttacggcaattgagatccgtcattgataccacagtttattgtaggtttaccgtacttgggagtcggccat

SEQ ID NO: 380450 - DNA, 140 bp, Artificial Sequence
  Synthetic
atggccgactcccaagtacggtaaacctacaataaactgtggtatcaatgacggatctcaattgccgtaagtactttgatatctcgtcttgggtttgtgactcattggatgacgtcaattggagacccagcatggcgtat

SEQ ID NO: 380451 - DNA, 140 bp, Artificial Sequence
  Synthetic
atacgccatgctgggtctccctgcctgctgcaacatggaccgatgacactccaactggatcaaatggagcgttgcgtccaggaatttcatttcatccaaaacttcgccccattcttttaccgtacttgggagtcggccat

SEQ ID NO: 380452 - DNA, 140 bp, Artificial Sequence
  Synthetic
atggccgactcccaagtacggtaaaagaatggggcgaagttttggatgaaatgaaattcctggacgcaacgctccatttgatccagttggagtgtcatcggtccatgttgcagcaggcagggagacccagcatggcgtat

SEQ ID NO: 380453 - DNA, 140 bp, Artificial Sequence
  Synthetic
aggccctggctgctgatatgaagaatttttaggatcttttgtgtgcgaataactatgaggaagattaataattttcctctcattgaaatttatatcggaatttaaattgaaattgttactgaccttttgggacagcggtg

SEQ ID NO: 380454 - DNA, 140 bp, Artificial Sequence
  Synthetic
caccgctgtcccaaaaggtcagtaacaatttcaatttaaattccgatataaatttcaatgagaggaaaattattaatcttcctcatagttattcgcacacaaaagatcctaaaaattcttcatatcagcagccagggcct

SEQ ID NO: 380455 - DNA, 140 bp, Artificial Sequence
  Synthetic
aggccctggctgctgatatgacatcatattgatccgatttcaataaacaactatttaaataacgaaaggagtccctatattatacactatatttagcctctctccctgcttgataatcaagaccttttgggacagcggtg

SEQ ID NO: 380456 - DNA, 140 bp, Artificial Sequence
  Synthetic
caccgctgtcccaaaaggtcttgattatcaagcagggagagaggctaaatatagtgtataatatagggactcctttcgttatttaaatagttgtttattgaaatcggatcaatatgatgtcatatcagcagccagggcct

SEQ ID NO: 380457 - DNA, 140 bp, Artificial Sequence
  Synthetic
atacgccatgctgggtctccaaaatggtgatagacttaatctttgtgtaaaataagagattaggtgtaataactttaacatttttgtctagtaagctactatttcatacagaatgataaacgtacttgggagtcggccat

SEQ ID NO: 380458 - DNA, 140 bp, Artificial Sequence
  Synthetic
atggccgactcccaagtacgtttatcattctgtatgaaatagtagcttactagacaaaaatgttaaagttattacacctaatctcttattttacacaaagattaagtctatcaccattttggagacccagcatggcgtat

SEQ ID NO: 380459 - DNA, 140 bp, Artificial Sequence
  Synthetic
aggccctggctgctgatatgaactttaacatttttgtctagtaagctactatttcatacagaatgataaaattaaaagaagaggcaggactgtaaaatcataaataccttctttacaatagaccttttgggacagcggtg

SEQ ID NO: 380460 - DNA, 140 bp, Artificial Sequence
  Synthetic
caccgctgtcccaaaaggtctattgtaaagaaggtatttatgattttacagtcctgcctcttcttttaattttatcattctgtatgaaatagtagcttactagacaaaaatgttaaagttcatatcagcagccagggcct

SEQ ID NO: 380461 - DNA, 140 bp, Artificial Sequence
  Synthetic
atacgccatgctgggtctccttaagaaaaaatcggcgatgaagattaagccgacagtgagcgtaatcttcatctctcttagattatttgtcttccagagtaggggtcatcaggtccttttcgtacttgggagtcggccat

SEQ ID NO: 380462 - DNA, 140 bp, Artificial Sequence
  Synthetic
atggccgactcccaagtacgaaaaggacctgatgacccctactctggaagacaaataatctaagagagatgaagattacgctcactgtcggcttaatcttcatcgccgattttttcttaaggagacccagcatggcgtat

SEQ ID NO: 380463 - DNA, 140 bp, Artificial Sequence
  Synthetic
atacgccatgctgggtctccacacaatgggtgttacaggaatattgcagttacctcgtgatcgattcaagaggacatcattctttctttgggtaattatccttttccaaagaacattttccgtacttgggagtcggccat

SEQ ID NO: 380464 - DNA, 140 bp, Artificial Sequence
  Synthetic
atggccgactcccaagtacggaaaatgttctttggaaaaggataattacccaaagaaagaatgatgtcctcttgaatcgatcacgaggtaactgcaatattcctgtaacacccattgtgtggagacccagcatggcgtat

SEQ ID NO: 380465 - DNA, 140 bp, Artificial Sequence
  Synthetic
atacgccatgctgggtctccaatgtaaaagaaaagctggtctaacaagatgacaaccagaacaaagagcaggggccacactgcggccacgactcaaaacgacagaatgccaggccctgagcgtacttgggagtcggccat

SEQ ID NO: 380466 - DNA, 140 bp, Artificial Sequence
  Synthetic
atggccgactcccaagtacgctcagggcctggcattctgtcgttttgagtcgtggccgcagtgtggcccctgctctttgttctggttgtcatcttgttagaccagcttttcttttacattggagacccagcatggcgtat

SEQ ID NO: 380467 - DNA, 140 bp, Artificial Sequence
  Synthetic
atacgccatgctgggtctccctgctgaactatagggtacgttacattaatgatacacttgtgagtatcagccctggataatataagtcaattaaacgaccaagataaaattgtccttatccgtacttgggagtcggccat

SEQ ID NO: 380468 - DNA, 140 bp, Artificial Sequence
  Synthetic
atggccgactcccaagtacggataaggacaattttatcttggtcgtttaattgacttatattatccagggctgatactcacaagtgtatcattaatgtaacgtaccctatagttcagcagggagacccagcatggcgtat

SEQ ID NO: 380469 - DNA, 140 bp, Artificial Sequence
  Synthetic
aggccctggctgctgatatggtcaaggaagggaagctgcagtgtcgcatctgacaacccttgccacaatctccacgagtcttcaaccccccacaaccaaaccaggtccggacaacagcacgaccttttgggacagcggtg

SEQ ID NO: 380470 - DNA, 140 bp, Artificial Sequence
  Synthetic
caccgctgtcccaaaaggtcgtgctgttgtccggacctggtttggttgtggggggttgaagactcgtggagattgtggcaagggttgtcagatgcgacactgcagcttcccttccttgaccatatcagcagccagggcct

SEQ ID NO: 380471 - DNA, 140 bp, Artificial Sequence
  Synthetic
atacgccatgctgggtctccaccacaattagatatcaggctaccggttttggaactaatgagacagagtacttgttcgaggttgacaatttgacctacgtccaacttgaatcaagattcacgtacttgggagtcggccat

SEQ ID NO: 380472 - DNA, 140 bp, Artificial Sequence
  Synthetic
atggccgactcccaagtacgtgaatcttgattcaagttggacgtaggtcaaattgtcaacctcgaacaagtactctgtctcattagttccaaaaccggtagcctgatatctaattgtggtggagacccagcatggcgtat

SEQ ID NO: 380473 - DNA, 140 bp, Artificial Sequence
  Synthetic
atacgccatgctgggtctccaggagcaacaccacgggaaaactaatttggaaggtcaaccccgaaattgatacaacaatcggggagtgggccttctgggaaactaaaaaaacctcactagcgtacttgggagtcggccat

SEQ ID NO: 380474 - DNA, 140 bp, Artificial Sequence
  Synthetic
atggccgactcccaagtacgctagtgaggtttttttagtttcccagaaggcccactccccgattgttgtatcaatttcggggttgaccttccaaattagttttcccgtggtgttgctcctggagacccagcatggcgtat

SEQ ID NO: 380475 - DNA, 140 bp, Artificial Sequence
  Synthetic
aggccctggctgctgatatgaattattatcacaataaaagtgattcttagttttgaatttaaagctagcttattattactagccgtttttcaaagttcaatttgagtcttaatgcaaatagaccttttgggacagcggtg

SEQ ID NO: 380476 - DNA, 140 bp, Artificial Sequence
  Synthetic
caccgctgtcccaaaaggtctatttgcattaagactcaaattgaactttgaaaaacggctagtaataataagctagctttaaattcaaaactaagaatcacttttattgtgataataattcatatcagcagccagggcct

SEQ ID NO: 380477 - DNA, 140 bp, Artificial Sequence
  Synthetic
aggccctggctgctgatatggatggaatagtgttttggttgataacacgacttcttaaaacaaaattgatctttaagattaagtttttataattatcattactttaatttgtcgatttaagaccttttgggacagcggtg

SEQ ID NO: 380478 - DNA, 140 bp, Artificial Sequence
  Synthetic
caccgctgtcccaaaaggtcttaaatcgacaaattaaagtaatgataattataaaaacttaatcttaaagatcaattttgttttaagaagtcgtgttatcaaccaaaacactattccatccatatcagcagccagggcct

SEQ ID NO: 380479 - DNA, 140 bp, Artificial Sequence
  Synthetic
aggccctggctgctgatatgagcagactagataataatcttcgtgttaatgataattaagacattgaccacgctcatcagaaggctcgccaaaataaacgttgcaaaaaggattcctggagaccttttgggacagcggtg

SEQ ID NO: 380480 - DNA, 140 bp, Artificial Sequence
  Synthetic
caccgctgtcccaaaaggtctccaggaatcctttttgcaacgtttattttggcgagccttctgatgagcgtggtcaatgtcttaattatcattaacacgaagattattatctagtctgctcatatcagcagccagggcct

SEQ ID NO: 380481 - DNA, 140 bp, Artificial Sequence
  Synthetic
aggccctggctgctgatatgttgaaccattaacagttcctccagcacctaaagacatatgtccgaccttgaaaaaaggatttttgtgtgacagtagtttttgcaaaaaagaccaccagttgaccttttgggacagcggtg

SEQ ID NO: 380482 - DNA, 140 bp, Artificial Sequence
  Synthetic
caccgctgtcccaaaaggtcaactggtggtcttttttgcaaaaactactgtcacacaaaaatccttttttcaaggtcggacatatgtctttaggtgctggaggaactgttaatggttcaacatatcagcagccagggcct

SEQ ID NO: 380483 - DNA, 140 bp, Artificial Sequence
  Synthetic
aggccctggctgctgatatgtgctgacaccaatcaacgaagaggcagacccactggacgatgccgacgacgagacgtctagccttccgcccttggagtcagatgatgaagaacaggacaggaccttttgggacagcggtg

SEQ ID NO: 380484 - DNA, 140 bp, Artificial Sequence
  Synthetic
caccgctgtcccaaaaggtcctgtcctgttcttcatcatctgactccaagggcggaaggctagacgtctcgtcgtcggcatcgtccagtgggtctgcctcttcgttgattggtgtcagcacatatcagcagccagggcct

SEQ ID NO: 380485 - DNA, 140 bp, Artificial Sequence
  Synthetic
atacgccatgctgggtctccattaaccttcatcttgtaaacgttgagcaaaattgttaaaaatatgaggcgggttatattgcctactgctcctcctgaatatatggaggccatataccctcgtacttgggagtcggccat

SEQ ID NO: 380486 - DNA, 140 bp, Artificial Sequence
  Synthetic
atggccgactcccaagtacgagggtatatggcctccatatattcaggaggagcagtaggcaatataacccgcctcatatttttaacaattttgctcaacgtttacaagatgaaggttaatggagacccagcatggcgtat

SEQ ID NO: 380487 - DNA, 140 bp, Artificial Sequence
  Synthetic
atacgccatgctgggtctccagaatgataaaattaaaagaaaagacatgactgtaaaatcagaaataccttctttacaatatagcagactagataataatcttcgtgttaatgataattacgtacttgggagtcggccat

SEQ ID NO: 380488 - DNA, 140 bp, Artificial Sequence
  Synthetic
atggccgactcccaagtacgtaattatcattaacacgaagattattatctagtctgctatattgtaaagaaggtatttctgattttacagtcatgtcttttcttttaattttatcattctggagacccagcatggcgtat

SEQ ID NO: 380489 - DNA, 140 bp, Artificial Sequence
  Synthetic
aggccctggctgctgatatgcatcaaaaaataagtattttatgatttactaatgatctcttaaaatattaagaaaaactgacggaacataaattctttctgcttcaagttgtggaggagggaccttttgggacagcggtg

SEQ ID NO: 380490 - DNA, 140 bp, Artificial Sequence
  Synthetic
caccgctgtcccaaaaggtccctcctccacaacttgaagcagaaagaatttatgttccgtcagtttttcttaatattttaagagatcattagtaaatcataaaatacttattttttgatgcatatcagcagccagggcct

SEQ ID NO: 380491 - DNA, 140 bp, Artificial Sequence
  Synthetic
atacgccatgctgggtctccccatcgaccatgccagccacataccaggcagtgtttcatcagcattcatccttgaagctatggtgaatgtcatatcgggccccaaagtgctaatgaagcacgtacttgggagtcggccat

SEQ ID NO: 380492 - DNA, 140 bp, Artificial Sequence
  Synthetic
atggccgactcccaagtacgtgcttcattagcactttggggcccgatatgacattcaccatagcttcaaggatgaatgctgatgaaacactgcctggtatgtggctggcatggtcgatggggagacccagcatggcgtat

SEQ ID NO: 380493 - DNA, 140 bp, Artificial Sequence
  Synthetic
aggccctggctgctgatatgcagcattcaagggatggacacgaccaccatgttcgagcacgatcatcatccagagagaatcatcgaggcgagcaccgtcaatcaaggagcgcctcacaaggaccttttgggacagcggtg

SEQ ID NO: 380494 - DNA, 140 bp, Artificial Sequence
  Synthetic
caccgctgtcccaaaaggtccttgtgaggcgctccttgattgacggtgctcgcctcgatgattctctctggatgatgatcgtgctcgaacatggtggtcgtgtccatcccttgaatgctgcatatcagcagccagggcct

SEQ ID NO: 380495 - DNA, 140 bp, Artificial Sequence
  Synthetic
atacgccatgctgggtctcctcaaaatccgaattccactattgaatcaccgctgtgggcactgagagtcatccttgcagcagggatacaggaccagttaattgaccagtctttgattgaacgtacttgggagtcggccat

SEQ ID NO: 380496 - DNA, 140 bp, Artificial Sequence
  Synthetic
atggccgactcccaagtacgttcaatcaaagactggtcaattaactggtcctgtatccctgctgcaaggatgactctcagtgcccacagcggtgattcaatagtggaattcggattttgaggagacccagcatggcgtat

SEQ ID NO: 380497 - DNA, 140 bp, Artificial Sequence
  Synthetic
aggccctggctgctgatatgggcgacattgcccatagatttcatagtcccaattcttctcaaggcactatcaggcaatgggttctgtcctgttgagccgcggtgccaacagttcttagatgaccttttgggacagcggtg

SEQ ID NO: 380498 - DNA, 140 bp, Artificial Sequence
  Synthetic
caccgctgtcccaaaaggtcatctaagaactgttggcaccgcggctcaacaggacagaacccattgcctgatagtgccttgagaagaattgggactatgaaatctatgggcaatgtcgcccatatcagcagccagggcct

SEQ ID NO: 380499 - DNA, 140 bp, Artificial Sequence
  Synthetic
atacgccatgctgggtctcccaattttaagattgtgtctatgctttaccagagcggagattacttactctccatattagggtctgatgggtataaaatcattaagtttctcgaaccattgcgtacttgggagtcggccat

SEQ ID NO: 380500 - DNA, 140 bp, Artificial Sequence
  Synthetic
atggccgactcccaagtacgcaatggttcgagaaacttaatgattttatacccatcagaccctaatatggagagtaagtaatctccgctctggtaaagcatagacacaatcttaaaattgggagacccagcatggcgtat

SEQ ID NO: 380501 - DNA, 140 bp, Artificial Sequence
  Synthetic
atacgccatgctgggtctccactaaaagatggggcttcaggtccggtgtcccaccaaaggtggtcaattatgaagctggtgaatgggctgaaaactgctacaatcttgaaatcaaaaaaccgtacttgggagtcggccat

SEQ ID NO: 380502 - DNA, 140 bp, Artificial Sequence
  Synthetic
atggccgactcccaagtacggttttttgatttcaagattgtagcagttttcagcccattcaccagcttcataattgaccacctttggtgggacaccggacctgaagccccatcttttagtggagacccagcatggcgtat

SEQ ID NO: 380503 - DNA, 140 bp, Artificial Sequence
  Synthetic
aggccctggctgctgatatgaattaacgtcatccaatgagtcacaaacccaagacgagatatcaaaatacttacggcaattaagatccgtaattgataccacagtttattgtaggtttacgaccttttgggacagcggtg

SEQ ID NO: 380504 - DNA, 140 bp, Artificial Sequence
  Synthetic
caccgctgtcccaaaaggtcgtaaacctacaataaactgtggtatcaattacggatcttaattgccgtaagtattttgatatctcgtcttgggtttgtgactcattggatgacgttaattcatatcagcagccagggcct

SEQ ID NO: 380505 - DNA, 140 bp, Artificial Sequence
  Synthetic
atacgccatgctgggtctcctgtgctcagttgaaaatcccttgtcaacatctaggtcttatcacatcacaagttccacctcagactctgcagggtgatccaacaaccctaatagaaaaatcgtacttgggagtcggccat

SEQ ID NO: 380506 - DNA, 140 bp, Artificial Sequence
  Synthetic
atggccgactcccaagtacgatttttctattagggttgttggatcaccctgcagagtctgaggtggaacttgtgatgtgataagacctagatgttgacaagggattttcaactgagcacaggagacccagcatggcgtat

SEQ ID NO: 380507 - DNA, 140 bp, Artificial Sequence
  Synthetic
aggccctggctgctgatatgagttccacctcagactctgcagggtgatccaacaaccctaatagaaaaattattgttaacggacagcattagttcacagtcaaacaagcaagattgagaagaccttttgggacagcggtg

SEQ ID NO: 380508 - DNA, 140 bp, Artificial Sequence
  Synthetic
caccgctgtcccaaaaggtcttctcaatcttgcttgtttgactgtgaactaatgctgtccgttaacaataatttttctattagggttgttggatcaccctgcagagtctgaggtggaactcatatcagcagccagggcct

SEQ ID NO: 380509 - DNA, 140 bp, Artificial Sequence
  Synthetic
atacgccatgctgggtctccttaaccttgattttgaacttcaacacctagaggattggagattcaacaaccctaaaacttggggtaaaacattggaaatagttgaaagacaaattgctcgcgtacttgggagtcggccat

SEQ ID NO: 380510 - DNA, 140 bp, Artificial Sequence
  Synthetic
atggccgactcccaagtacgcgagcaatttgtctttcaactatttccaatgttttaccccaagttttagggttgttgaatctccaatcctctaggtgttgaagttcaaaatcaaggttaaggagacccagcatggcgtat

SEQ ID NO: 380511 - DNA, 140 bp, Artificial Sequence
  Synthetic
atacgccatgctgggtctccggtctgtccgttcaacaggggattgttcggcaaagagtcatcccagtgtatcaagtaaacaatcttgaggaaatttgccaacttatcatacaggcctttgcgtacttgggagtcggccat

SEQ ID NO: 380512 - DNA, 140 bp, Artificial Sequence
  Synthetic
atggccgactcccaagtacgcaaaggcctgtatgataagttggcaaatttcctcaagattgtttacttgatacactgggatgactctttgccgaacaatcccctgttgaacggacagaccggagacccagcatggcgtat

SEQ ID NO: 380513 - DNA, 140 bp, Artificial Sequence
  Synthetic
aggccctggctgctgatatgtgtcttcatcatgcgtaccaaggagatcacaaacttttcttggaaagtggtgcagtcaagtatttggaagggcacgggttccgttttgaagtcaagaaacgaccttttgggacagcggtg

SEQ ID NO: 380514 - DNA, 140 bp, Artificial Sequence
  Synthetic
caccgctgtcccaaaaggtcgtttcttgacttcaaaacggaacccgtgcccttccaaatacttgactgcaccactttccaagaaaagtttgtgatctccttggtacgcatgatgaagacacatatcagcagccagggcct

SEQ ID NO: 380515 - DNA, 140 bp, Artificial Sequence
  Synthetic
aggccctggctgctgatatgaaaaacattaagagaacacttgctgccatgccggaagaggagacgactgaagctaatgccggtcagtttctctcttttgcaagtctattccttccgaaatgaccttttgggacagcggtg

SEQ ID NO: 380516 - DNA, 140 bp, Artificial Sequence
  Synthetic
caccgctgtcccaaaaggtcatttcggaaggaatagacttgcaaaagagagaaactgaccggcattagcttcagtcgtctcctcttccggcatggcagcaagtgttctcttaatgtttttcatatcagcagccagggcct

SEQ ID NO: 380517 - DNA, 140 bp, Artificial Sequence
  Synthetic
atacgccatgctgggtctccgggagcaccctcgcaggagtaaatgttggagaacagtatcaacagctcagagaggctgccactgaagctgagaagcaactccaacaatatgcagaatctccgtacttgggagtcggccat

SEQ ID NO: 380518 - DNA, 140 bp, Artificial Sequence
  Synthetic
atggccgactcccaagtacggagattctgcatattgttggagttgcttctcagcttcagtggcagcctctctgagctgttgatactgttctccaacatttactcctgcgagggtgctcccggagacccagcatggcgtat

SEQ ID NO: 380519 - DNA, 140 bp, Artificial Sequence
  Synthetic
aggccctggctgctgatatgaatgcaccagatgacttggtcctattcgatctagacgaggacgacgaggacactaagccagtgcctaacagattgaccaagggtggacaacagaaaaacagaccttttgggacagcggtg

SEQ ID NO: 380520 - DNA, 140 bp, Artificial Sequence
  Synthetic
caccgctgtcccaaaaggtctgtttttctgttgtccacccttggtcaatctgttaggcactggcttagtgtcctcgtcgtcctcgtctagatcgaataggaccaagtcatctggtgcattcatatcagcagccagggcct

SEQ ID NO: 380521 - DNA, 140 bp, Artificial Sequence
  Synthetic
aggccctggctgctgatatgcaaaatgtcccaggccctcgcagaacaatccaccacgccagtgctccactcacggacaacgacagaggaaatgaaccctccggctcaaccagccctcgcagaccttttgggacagcggtg

SEQ ID NO: 380522 - DNA, 140 bp, Artificial Sequence
  Synthetic
caccgctgtcccaaaaggtctgcgagggctggttgagccggagggttcatttcctctgtcgttgtccgtgagtggagcactggcgtggtggattgttctgcgagggcctgggacattttgcatatcagcagccagggcct

SEQ ID NO: 380523 - DNA, 140 bp, Artificial Sequence
  Synthetic
atacgccatgctgggtctcctaaatgtaataggagctatacctctgacagtattataattaattgttattaagtaacccaaaccaaaaatgatgaagattaagaaaaacctacctcgactcgtacttgggagtcggccat

SEQ ID NO: 380524 - DNA, 140 bp, Artificial Sequence
  Synthetic
atggccgactcccaagtacgagtcgaggtaggtttttcttaatcttcatcatttttggtttgggttacttaataacaattaattataatactgtcagaggtatagctcctattacatttaggagacccagcatggcgtat

SEQ ID NO: 380525 - DNA, 140 bp, Artificial Sequence
  Synthetic
aggccctggctgctgatatggagacgtctagtcttccgcccttggagtcagacgatgaagaacaggacagggacgaaacttccaaccgcacacccactgtcgccccaccggctcccgtatgaccttttgggacagcggtg

SEQ ID NO: 380526 - DNA, 140 bp, Artificial Sequence
  Synthetic
caccgctgtcccaaaaggtcatacgggagccggtggggcgacagtgggtgtgcggttggaagtttcgtccctgtcctgttcttcatcgtctgactccaagggcggaagactagacgtctccatatcagcagccagggcct

SEQ ID NO: 380527 - DNA, 140 bp, Artificial Sequence
  Synthetic
atacgccatgctgggtctccacagagatcactctgaaaagaaagaactcccgcaagatgagcagcaagatcaggaccacactcaagaggccaggaaccaggacagtgacaacacccagcccgtacttgggagtcggccat

SEQ ID NO: 380528 - DNA, 140 bp, Artificial Sequence
  Synthetic
atggccgactcccaagtacgggctgggtgttgtcactgtcctggttcctggcctcttgagtgtggtcctgatcttgctgctcatcttgcgggagttctttcttttcagagtgatctctgtggagacccagcatggcgtat

SEQ ID NO: 380529 - DNA, 140 bp, Artificial Sequence
  Synthetic
atacgccatgctgggtctccaagaataaattcatggcaatcctgcaacatcatcagtgaatgagaatggaataatgggatgatttaaccgacaaatagctaacattaaatagtcaagaaacgtacttgggagtcggccat

SEQ ID NO: 380530 - DNA, 140 bp, Artificial Sequence
  Synthetic
atggccgactcccaagtacgtttcttgactatttaatgttagctatttgtcggttaaatcatcccattattccattctcattcactgatgatgttgcaggattgccatgaatttattcttggagacccagcatggcgtat

SEQ ID NO: 380531 - DNA, 140 bp, Artificial Sequence
  Synthetic
atacgccatgctgggtctcctttttcaaagttcaatttgagtcttaatgcaaataggcgttaagccacagttatagccataattgtaactcaatatcttagctagcgatttatctaaattcgtacttgggagtcggccat

SEQ ID NO: 380532 - DNA, 140 bp, Artificial Sequence
  Synthetic
atggccgactcccaagtacgaatttagataaatcgctagctaagatattgagttacaattatggctataactgtggcttaacgcctatttgcattaagactcaaattgaactttgaaaaaggagacccagcatggcgtat

SEQ ID NO: 380533 - DNA, 140 bp, Artificial Sequence
  Synthetic
atacgccatgctgggtctccgccagattgtacgtaggactatcaccctaagtgcgaaaaacaaacttattaataccttatttcatgcatcagctgacttcgaagacgaaatggtttgtaacgtacttgggagtcggccat

SEQ ID NO: 380534 - DNA, 140 bp, Artificial Sequence
  Synthetic
atggccgactcccaagtacgttacaaaccatttcgtcttcgaagtcagctgatgcatgaaataaggtattaataagtttgtttttcgcacttagggtgatagtcctacgtacaatctggcggagacccagcatggcgtat

SEQ ID NO: 380535 - DNA, 140 bp, Artificial Sequence
  Synthetic
atacgccatgctgggtctcctttcacgcacgccgagcgggaagcgattgcaaattctaggatacttggaaggaacacgcacattattagcctctaagatcatcaacaataatacagagaccgtacttgggagtcggccat

SEQ ID NO: 380536 - DNA, 140 bp, Artificial Sequence
  Synthetic
atggccgactcccaagtacggtctctgtattattgttgatgatcttagaggctaataatgtgcgtgttccttccaagtatcctagaatttgcaatcgcttcccgctcggcgtgcgtgaaaggagacccagcatggcgtat

SEQ ID NO: 380537 - DNA, 140 bp, Artificial Sequence
  Synthetic
atacgccatgctgggtctcccgacatcttctgtgatattgagaacaatccaggattatgttacgcatcccaaatgcaacaaacaaagccaaacccgaagatgcgcaacagtcaaacccaacgtacttgggagtcggccat

SEQ ID NO: 380538 - DNA, 140 bp, Artificial Sequence
  Synthetic
atggccgactcccaagtacgttgggtttgactgttgcgcatcttcgggtttggctttgtttgttgcatttgggatgcgtaacataatcctggattgttctcaatatcacagaagatgtcgggagacccagcatggcgtat

SEQ ID NO: 380539 - DNA, 140 bp, Artificial Sequence
  Synthetic
atacgccatgctgggtctccccaacccggggacatgctcatggtctgatgagggtaccccttaataaggctgactaaaacactatataaccttctacttgatcacaatactccgtatacccgtacttgggagtcggccat

SEQ ID NO: 380540 - DNA, 140 bp, Artificial Sequence
  Synthetic
atggccgactcccaagtacgggtatacggagtattgtgatcaagtagaaggttatatagtgttttagtcagccttattaaggggtaccctcatcagaccatgagcatgtccccgggttggggagacccagcatggcgtat

SEQ ID NO: 380541 - DNA, 140 bp, Artificial Sequence
  Synthetic
atacgccatgctgggtctccgcaggactgtaaaatcataaataccttctttacaatatagcagactagataataatctttgtgttaatgataattaagacattgaccacgctcatcagaacgtacttgggagtcggccat

SEQ ID NO: 380542 - DNA, 140 bp, Artificial Sequence
  Synthetic
atggccgactcccaagtacgttctgatgagcgtggtcaatgtcttaattatcattaacacaaagattattatctagtctgctatattgtaaagaaggtatttatgattttacagtcctgcggagacccagcatggcgtat

SEQ ID NO: 380543 - DNA, 140 bp, Artificial Sequence
  Synthetic
atacgccatgctgggtctccgtatgtgttttccagcttcaagatggtaaaacacttggactcaaaatttgagccaatctcccttccctccgaaagaggcgaccaatagcagaggcttcaacgtacttgggagtcggccat

SEQ ID NO: 380544 - DNA, 140 bp, Artificial Sequence
  Synthetic
atggccgactcccaagtacgttgaagcctctgctattggtcgcctctttcggagggaagggagattggctcaaattttgagtccaagtgttttaccatcttgaagctggaaaacacatacggagacccagcatggcgtat

SEQ ID NO: 380545 - DNA, 140 bp, Artificial Sequence
  Synthetic
aggccctggctgctgatatgtgttataaattatgcagttgcactgttcgatattaaatttagaaacactgaggctacagatatccagtataatcgtgctcaccttcatctaactaagtgtgaccttttgggacagcggtg

SEQ ID NO: 380546 - DNA, 140 bp, Artificial Sequence
  Synthetic
caccgctgtcccaaaaggtcacacttagttagatgaaggtgagcacgattatactggatatctgtagcctcagtgtttctaaatttaatatcgaacagtgcaactgcataatttataacacatatcagcagccagggcct

SEQ ID NO: 380547 - DNA, 140 bp, Artificial Sequence
  Synthetic
atacgccatgctgggtctccccctagataatataagtcaattaaacgaccaagccaaaattgttcatatcccgctagcagcttaaaatataaatgaaataggagctatatctctgacagtcgtacttgggagtcggccat

SEQ ID NO: 380548 - DNA, 140 bp, Artificial Sequence
  Synthetic
atggccgactcccaagtacgactgtcagagatatagctcctatttcatttatattttaagctgctagcgggatatgaacaattttggcttggtcgtttaattgacttatattatctagggggagacccagcatggcgtat

SEQ ID NO: 380549 - DNA, 140 bp, Artificial Sequence
  Synthetic
atacgccatgctgggtctcccaaggcaaacagctgaacattatagaagatgaccttattcgactgcctcacttatctggatgggagctagctaagaccatcatgcaatcaattatttcagcgtacttgggagtcggccat

SEQ ID NO: 380550 - DNA, 140 bp, Artificial Sequence
  Synthetic
atggccgactcccaagtacgctgaaataattgattgcatgatggtcttagctagctcccatccagataagtgaggcagtcgaataaggtcatcttctataatgttcagctgtttgccttgggagacccagcatggcgtat

SEQ ID NO: 380551 - DNA, 140 bp, Artificial Sequence
  Synthetic
aggccctggctgctgatatggaccgatgacactccaacaggatcaaatggagcgctgcgtccaggaatttcgtttcatccaaaacttcgccccattcttttacctaacaaaagtgggaaggaccttttgggacagcggtg

SEQ ID NO: 380552 - DNA, 140 bp, Artificial Sequence
  Synthetic
caccgctgtcccaaaaggtccttcccacttttgttaggtaaaagaatggggcgaagttttggatgaaacgaaattcctggacgcagcgctccatttgatcctgttggagtgtcatcggtccatatcagcagccagggcct

SEQ ID NO: 380553 - DNA, 140 bp, Artificial Sequence
  Synthetic
atacgccatgctgggtctcctcatgggtatcgaagtgccagaaactctggtccacaagctgaccggtaagaaggtgacttctaaaaatggacaaccaatcatccctgttcttttgccaaacgtacttgggagtcggccat

SEQ ID NO: 380554 - DNA, 140 bp, Artificial Sequence
  Synthetic
atggccgactcccaagtacgtttggcaaaagaacagggatgattggttgtccatttttagaagtcaccttcttaccggtcagcttgtggaccagagtttctggcacttcgatacccatgaggagacccagcatggcgtat

SEQ ID NO: 380555 - DNA, 140 bp, Artificial Sequence
  Synthetic
atacgccatgctgggtctcccacaggattgtgacacgtgtcattctcctgcaagtcttccagctgtgattgagaagtaattgcaataattgactcagatccagttttacagaatcttctccgtacttgggagtcggccat

SEQ ID NO: 380556 - DNA, 140 bp, Artificial Sequence
  Synthetic
atggccgactcccaagtacggagaagattctgtaaaactggatctgagtcaattattgcaattacttctcaatcacagctggaagacttgcaggagaatgacacgtgtcacaatcctgtgggagacccagcatggcgtat

SEQ ID NO: 380557 - DNA, 140 bp, Artificial Sequence
  Synthetic
aggccctggctgctgatatggagaagtaattgcaataattgactcagatccagttttacagaatcttctcagggatagtgataacatctatttagtaatccgtctattagaggagatactgaccttttgggacagcggtg

SEQ ID NO: 380558 - DNA, 140 bp, Artificial Sequence
  Synthetic
caccgctgtcccaaaaggtcagtatctcctctaatagacggattactaaatagatgttatcactatccctgagaagattctgtaaaactggatctgagtcaattattgcaattacttctccatatcagcagccagggcct

SEQ ID NO: 380559 - DNA, 140 bp, Artificial Sequence
  Synthetic
atacgccatgctgggtctccctaagtcatttaactcagtatgctgactgcgatttacatttaagttatatccgccttggttttccatcattagagaaagtactataccacaggtataacccgtacttgggagtcggccat

SEQ ID NO: 380560 - DNA, 140 bp, Artificial Sequence
  Synthetic
atggccgactcccaagtacgggttatacctgtggtatagtactttctctaatgatggaaaaccaaggcggatataacttaaatgtaaatcgcagtcagcatactgagttaaatgacttagggagacccagcatggcgtat

SEQ ID NO: 380561 - DNA, 140 bp, Artificial Sequence
  Synthetic
aggccctggctgctgatatgtaactatgaggaagattaataattttcctctcattgaaatttatatcggaatttaaattgaaattgttactgtaatcatacctggtttgtttcagagccagaccttttgggacagcggtg

SEQ ID NO: 380562 - DNA, 140 bp, Artificial Sequence
  Synthetic
caccgctgtcccaaaaggtctggctctgaaacaaaccaggtatgattacagtaacaatttcaatttaaattccgatataaatttcaatgagaggaaaattattaatcttcctcatagttacatatcagcagccagggcct

SEQ ID NO: 380563 - DNA, 140 bp, Artificial Sequence
  Synthetic
atacgccatgctgggtctcctcctaaatgtagaacttaacaaaagactcacaatatacttgtcttaaagagattgattgatgaaagatcatgactaataacattacaaataatcctactacgtacttgggagtcggccat

SEQ ID NO: 380564 - DNA, 140 bp, Artificial Sequence
  Synthetic
atggccgactcccaagtacgtagtaggattatttgtaatgttattagtcatgatctttcatcaatcaatctctttaagacaagtatattgtgagtcttttgttaagttctacatttaggaggagacccagcatggcgtat

SEQ ID NO: 380565 - DNA, 140 bp, Artificial Sequence
  Synthetic
aggccctggctgctgatatggattgattgatgaaagatcatgactaataacattacaaataatcctactataatcaatacggtgattcaaatattaatctttctaattgcacatactctcgaccttttgggacagcggtg

SEQ ID NO: 380566 - DNA, 140 bp, Artificial Sequence
  Synthetic
caccgctgtcccaaaaggtcgagagtatgtgcaattagaaagattaatatttgaatcaccgtattgattatagtaggattatttgtaatgttattagtcatgatctttcatcaatcaatccatatcagcagccagggcct

SEQ ID NO: 380567 - DNA, 140 bp, Artificial Sequence
  Synthetic
atacgccatgctgggtctcctgcccctatcctcaaattgcctacatgcctacatctgaggatagccagtgtgacttggattggagatgtagggaagaaatcggaacccatctccaggttgcgtacttgggagtcggccat

SEQ ID NO: 380568 - DNA, 140 bp, Artificial Sequence
  Synthetic
atggccgactcccaagtacgcaacctggagatgggttccgatttcttccctacatctccaatccaagtcacactggctatcctcagatgtaggcatgtaggcaatttgaggataggggcaggagacccagcatggcgtat

SEQ ID NO: 380569 - DNA, 140 bp, Artificial Sequence
  Synthetic
aggccctggctgctgatatgtgacttggattggagatgtagggaagaaatcggaacccatctccaggttgttcacaatccaagcacagacatcgcccttctaattaagaaaaaatcggcggaccttttgggacagcggtg

SEQ ID NO: 380570 - DNA, 140 bp, Artificial Sequence
  Synthetic
caccgctgtcccaaaaggtccgccgattttttcttaattagaagggcgatgtctgtgcttggattgtgaacaacctggagatgggttccgatttcttccctacatctccaatccaagtcacatatcagcagccagggcct

SEQ ID NO: 380571 - DNA, 140 bp, Artificial Sequence
  Synthetic
atacgccatgctgggtctccatgaagattaagccgacagtgagcgcaatcttcatctctcttagattatttgttttccagagtaggggtcatcaggtcctttccaatcatataaccaaaacgtacttgggagtcggccat

SEQ ID NO: 380572 - DNA, 140 bp, Artificial Sequence
  Synthetic
atggccgactcccaagtacgttttggttatatgattggaaaggacctgatgacccctactctggaaaacaaataatctaagagagatgaagattgcgctcactgtcggcttaatcttcatggagacccagcatggcgtat

SEQ ID NO: 380573 - DNA, 140 bp, Artificial Sequence
  Synthetic
aggccctggctgctgatatgtgttttccagagtaggggtcatcaggtcctttccaatcatataaccaaaataaacttcactagaaggatattgtgaggcaacaacacaatgggtattacagaccttttgggacagcggtg

SEQ ID NO: 380574 - DNA, 140 bp, Artificial Sequence
  Synthetic
caccgctgtcccaaaaggtctgtaatacccattgtgttgttgcctcacaatatccttctagtgaagtttattttggttatatgattggaaaggacctgatgacccctactctggaaaacacatatcagcagccagggcct

SEQ ID NO: 380575 - DNA, 140 bp, Artificial Sequence
  Synthetic
atacgccatgctgggtctccggctaccggttttggaaccaatgagacggagtacttgttcgaggttgacaatttgacctacgtccaacttgaatcaagattcacgccacagtttttgctccgtacttgggagtcggccat

SEQ ID NO: 380576 - DNA, 140 bp, Artificial Sequence
  Synthetic
atggccgactcccaagtacggagcaaaaactgtggcgtgaatcttgattcaagttggacgtaggtcaaattgtcaacctcgaacaagtactccgtctcattggttccaaaaccggtagccggagacccagcatggcgtat

SEQ ID NO: 380577 - DNA, 140 bp, Artificial Sequence
  Synthetic
atacgccatgctgggtctccgggccttctgggaaactaaaaaaacctcactagaaaaattcgcagtgaagagttgtctttcacagctgtatcaaacggagccaaagacatcagtggtcagcgtacttgggagtcggccat

SEQ ID NO: 380578 - DNA, 140 bp, Artificial Sequence
  Synthetic
atggccgactcccaagtacgctgaccactgatgtctttggctccgtttgatacagctgtgaaagacaactcttcactgcgaatttttctagtgaggtttttttagtttcccagaaggcccggagacccagcatggcgtat

SEQ ID NO: 380579 - DNA, 140 bp, Artificial Sequence
  Synthetic
atacgccatgctgggtctccagtccggcgcgaacttcttccgacccagagacctacacaacaactgaagaccacaaaatcatggcttcagaaaattcctctgcaatggttcaagtgcacacgtacttgggagtcggccat

SEQ ID NO: 380580 - DNA, 140 bp, Artificial Sequence
  Synthetic
atggccgactcccaagtacgtgtgcacttgaaccattgcagaggaattttctgaagccatgattttgtggtcttcagttgttgtgtaggtctctgggtcggaagaagttcgcgccggactggagacccagcatggcgtat

SEQ ID NO: 380581 - DNA, 140 bp, Artificial Sequence
  Synthetic
atacgccatgctgggtctccatcaaggaagggaagctgcagtgtcgcatctgataacccttgccacaatctccacgagtcctcaatcccctacaaccaaaccaggtcaggacaacagcaccgtacttgggagtcggccat

SEQ ID NO: 380582 - DNA, 140 bp, Artificial Sequence
  Synthetic
atggccgactcccaagtacggtgctgttgtcctgacctggtttggttgtaggggattgaggactcgtggagattgtggcaagggttatcagatgcgacactgcagcttcccttccttgatggagacccagcatggcgtat

SEQ ID NO: 380583 - DNA, 140 bp, Artificial Sequence
  Synthetic
aggccctggctgctgatatgaaaaaggtaatctttcgattatctttagtcttcatccttgattctacaatcatgacagttgtctttagtgacaagggaaagaagcctttttagtaagttggaccttttgggacagcggtg

SEQ ID NO: 380584 - DNA, 140 bp, Artificial Sequence
  Synthetic
caccgctgtcccaaaaggtccaacttactaaaaaggcttctttcccttgtcactaaagacaactgtcatgattgtagaatcaaggatgaagactaaagataatcgaaagattacctttttcatatcagcagccagggcct

SEQ ID NO: 380585 - DNA, 140 bp, Artificial Sequence
  Synthetic
aggccctggctgctgatatgaacaacatcatcgcagaacagacaacgacagcacagcctccgacactccccccgccacgaccgcagccggacccccaaaagcagagaacatcaacacgaggaccttttgggacagcggtg

SEQ ID NO: 380586 - DNA, 140 bp, Artificial Sequence
  Synthetic
caccgctgtcccaaaaggtcctcgtgttgatgttctctgcttttgggggtccggctgcggtcgtggcggggggagtgtcggaggctgtgctgtcgttgtctgttctgcgatgatgttgttcatatcagcagccagggcct

SEQ ID NO: 380587 - DNA, 140 bp, Artificial Sequence
  Synthetic
atacgccatgctgggtctcccaagagcgctgactccctggaccccgccaccacgacaagtccccaaaactacagcgagaccgctggcaacaacaacactcatcaccaagataccggagaacgtacttgggagtcggccat

SEQ ID NO: 380588 - DNA, 140 bp, Artificial Sequence
  Synthetic
atggccgactcccaagtacgttctccggtatcttggtgatgagtgttgttgttgccagcggtctcgctgtagttttggggacttgtcgtggtggcggggtccagggagtcagcgctcttgggagacccagcatggcgtat

SEQ ID NO: 380589 - DNA, 140 bp, Artificial Sequence
  Synthetic
atacgccatgctgggtctccgattagtgtgtgcaataggttctatcatattagagattgcaattgtgaagaacgtttcttagttcaaaccttatatttacatagaatgcaggattctgaacgtacttgggagtcggccat

SEQ ID NO: 380590 - DNA, 140 bp, Artificial Sequence
  Synthetic
atggccgactcccaagtacgttcagaatcctgcattctatgtaaatataaggtttgaactaagaaacgttcttcacaattgcaatctctaatatgatagaacctattgcacacactaatcggagacccagcatggcgtat

SEQ ID NO: 380591 - DNA, 140 bp, Artificial Sequence
  Synthetic
atacgccatgctgggtctccgagagtgccggcagcgggaagctgggcttgattgccaatactattgctggagtcgcagggctgatcacaggcgggagaagaactcgaagagaagcaattgcgtacttgggagtcggccat

SEQ ID NO: 380592 - DNA, 140 bp, Artificial Sequence
  Synthetic
atggccgactcccaagtacgcaattgcttctcttcgagttcttctcccgcctgtgatcagccctgcgactccagcaatagtattggcaatcaagcccagcttcccgctgccggcactctcggagacccagcatggcgtat

SEQ ID NO: 380593 - DNA, 140 bp, Artificial Sequence
  Synthetic
aggccctggctgctgatatgagtcgcagggctgatcacaggcgggagaagaactcgaagagaagcaattgtcaatgctcaacccaaatgcaaccccaatctacattactggactactcaggaccttttgggacagcggtg

SEQ ID NO: 380594 - DNA, 140 bp, Artificial Sequence
  Synthetic
caccgctgtcccaaaaggtcctgagtagtccagtaatgtagattggggttgcatttgggttgagcattgacaattgcttctcttcgagttcttctcccgcctgtgatcagccctgcgactcatatcagcagccagggcct

SEQ ID NO: 380595 - DNA, 140 bp, Artificial Sequence
  Synthetic
aggccctggctgctgatatgaatatagcagactagataataatcttcgtgttaatgataattaaggcattgaccacgctcatcagaaggctcactagaataaacgttgcaaaaaggatccgaccttttgggacagcggtg

SEQ ID NO: 380596 - DNA, 140 bp, Artificial Sequence
  Synthetic
caccgctgtcccaaaaggtcggatcctttttgcaacgtttattctagtgagccttctgatgagcgtggtcaatgccttaattatcattaacacgaagattattatctagtctgctatattcatatcagcagccagggcct

SEQ ID NO: 380597 - DNA, 140 bp, Artificial Sequence
  Synthetic
atacgccatgctgggtctcctctgtggattgaggcagctggccaatgagacgactcaagctcttcaactgttcctgagagccacaactgagctacgcaccttttcaatcctcaaccgtaacgtacttgggagtcggccat

SEQ ID NO: 380598 - DNA, 140 bp, Artificial Sequence
  Synthetic
atggccgactcccaagtacgttacggttgaggattgaaaaggtgcgtagctcagttgtggctctcaggaacagttgaagagcttgagtcgtctcattggccagctgcctcaatccacagaggagacccagcatggcgtat

SEQ ID NO: 380599 - DNA, 140 bp, Artificial Sequence
  Synthetic
atacgccatgctgggtctccagattacttgacaaatgataatataatacactggagctttaaatatagccaatgtgattctaactcctttaaactcacaattaatcataaacaaggtttgcgtacttgggagtcggccat

SEQ ID NO: 380600 - DNA, 140 bp, Artificial Sequence
  Synthetic
atggccgactcccaagtacgcaaaccttgtttatgattaattgtgagtttaaaggagttagaatcacattggctatatttaaagctccagtgtattatattatcatttgtcaagtaatctggagacccagcatggcgtat

SEQ ID NO: 380601 - DNA, 140 bp, Artificial Sequence
  Synthetic
atacgccatgctgggtctcctttaatttgtcgatttaaaaatggtgatagccttaatctttgtgtaaaataagagattaggtgtaataactttaacatttttgtctagtaagctactattcgtacttgggagtcggccat

SEQ ID NO: 380602 - DNA, 140 bp, Artificial Sequence
  Synthetic
atggccgactcccaagtacgaatagtagcttactagacaaaaatgttaaagttattacacctaatctcttattttacacaaagattaaggctatcaccatttttaaatcgacaaattaaaggagacccagcatggcgtat

SEQ ID NO: 380603 - DNA, 140 bp, Artificial Sequence
  Synthetic
aggccctggctgctgatatgtgcccttatcctcaaattgcctgcatgcttacatctgaggatagccagtgtgacttggattggaaatgtggagaaaaaatcgggacccatttctaggttggaccttttgggacagcggtg

SEQ ID NO: 380604 - DNA, 140 bp, Artificial Sequence
  Synthetic
caccgctgtcccaaaaggtccaacctagaaatgggtcccgattttttctccacatttccaatccaagtcacactggctatcctcagatgtaagcatgcaggcaatttgaggataagggcacatatcagcagccagggcct

SEQ ID NO: 380605 - DNA, 140 bp, Artificial Sequence
  Synthetic
aggccctggctgctgatatgataccttctttacaatatagcagactagataataatcttcgtgttaatgataattaaggcattgaccacgctcatcagaaggctcactagaataaacgttgaccttttgggacagcggtg

SEQ ID NO: 380606 - DNA, 140 bp, Artificial Sequence
  Synthetic
caccgctgtcccaaaaggtcaacgtttattctagtgagccttctgatgagcgtggtcaatgccttaattatcattaacacgaagattattatctagtctgctatattgtaaagaaggtatcatatcagcagccagggcct

SEQ ID NO: 380607 - DNA, 140 bp, Artificial Sequence
  Synthetic
atacgccatgctgggtctccgcattgaccacgctcatcagaaggctcactagaataaacgttgcaaaaaggatccctggaaaaatggtcgcacacaaaaatttaaaaataaatctatttccgtacttgggagtcggccat

SEQ ID NO: 380608 - DNA, 140 bp, Artificial Sequence
  Synthetic
atggccgactcccaagtacggaaatagatttatttttaaatttttgtgtgcgaccatttttccagggatcctttttgcaacgtttattctagtgagccttctgatgagcgtggtcaatgcggagacccagcatggcgtat

SEQ ID NO: 380609 - DNA, 140 bp, Artificial Sequence
  Synthetic
aggccctggctgctgatatgaggaagattaataattttcctctcattgaaatttatatcggaatttaaattgaaattgttactgtaatcatacctggtttgtttcagagccatatcaccagaccttttgggacagcggtg

SEQ ID NO: 380610 - DNA, 140 bp, Artificial Sequence
  Synthetic
caccgctgtcccaaaaggtctggtgatatggctctgaaacaaaccaggtatgattacagtaacaatttcaatttaaattccgatataaatttcaatgagaggaaaattattaatcttcctcatatcagcagccagggcct

SEQ ID NO: 380611 - DNA, 140 bp, Artificial Sequence
  Synthetic
atacgccatgctgggtctcctgatgatttccagcaagaggaaggtccaaaaattaccttgttgacactgatcaagacggcagaacactgggcgagacaagacatcaggaccacagaggatcgtacttgggagtcggccat

SEQ ID NO: 380612 - DNA, 140 bp, Artificial Sequence
  Synthetic
atggccgactcccaagtacgatcctctgtggtcctgatgtcttgtctcgcccagtgttctgccgtcttgatcagtgtcaacaaggtaatttttggaccttcctcttgctggaaatcatcaggagacccagcatggcgtat

SEQ ID NO: 380613 - DNA, 140 bp, Artificial Sequence
  Synthetic
atacgccatgctgggtctccccctttccaggacccatcaatgatgacgacaatcctggccatcaagatgatgatccgactgactcacaggatacgaccattcccgatgtggtagttgatccgtacttgggagtcggccat

SEQ ID NO: 380614 - DNA, 140 bp, Artificial Sequence
  Synthetic
atggccgactcccaagtacggatcaactaccacatcgggaatggtcgtatcctgtgagtcagtcggatcatcatcttgatggccaggattgtcgtcatcattgatgggtcctggaaagggggagacccagcatggcgtat

SEQ ID NO: 380615 - DNA, 140 bp, Artificial Sequence
  Synthetic
atacgccatgctgggtctccaagacggtatcctttaaaacttattcagtactataatcactctcgtttcaaattaataagatatgcataattgctttaatatatgaagaggtatgatacacgtacttgggagtcggccat

SEQ ID NO: 380616 - DNA, 140 bp, Artificial Sequence
  Synthetic
atggccgactcccaagtacgtgtatcatacctcttcatatattaaagcaattatgcatatcttattaatttgaaacgagagtgattatagtactgaataagttttaaaggataccgtcttggagacccagcatggcgtat

SEQ ID NO: 380617 - DNA, 140 bp, Artificial Sequence
  Synthetic
aggccctggctgctgatatgttcttcatctccttttagcaaagtactatttcagggtagtccaattagtgacacgtcttttagctgtatatcagtcgcccctgagatacgccacaaaagtgaccttttgggacagcggtg

SEQ ID NO: 380618 - DNA, 140 bp, Artificial Sequence
  Synthetic
caccgctgtcccaaaaggtcacttttgtggcgtatctcaggggcgactgatatacagctaaaagacgtgtcactaattggactaccctgaaatagtactttgctaaaaggagatgaagaacatatcagcagccagggcct

SEQ ID NO: 380619 - DNA, 140 bp, Artificial Sequence
  Synthetic
aggccctggctgctgatatgaataatatctaattgaacttagccgtttaaaatttagtgcataaacctgggctaactccaccaggtcaactccattggctgaaaagaagcccacctacaagaccttttgggacagcggtg

SEQ ID NO: 380620 - DNA, 140 bp, Artificial Sequence
  Synthetic
caccgctgtcccaaaaggtcttgtaggtgggcttcttttcagccaatggagttgacctggtggagttagcccaggtttatgcactaaattttaaacggctaagttcaattagatattattcatatcagcagccagggcct

SEQ ID NO: 380621 - DNA, 140 bp, Artificial Sequence
  Synthetic
atacgccatgctgggtctcccgaacatcactttgagcgcccttacaattaaaaaataggaacgtcgttccaacaattgagcgcaaggtttcaaggttgaactgagagtgcctaaacaccacgtacttgggagtcggccat

SEQ ID NO: 380622 - DNA, 140 bp, Artificial Sequence
  Synthetic
atggccgactcccaagtacgtggtgtttaggcactctcagttcaaccttgaaaccttgcgctcaattgttggaacgacgttcctattttttaattgtaagggcgctcaaagtgatgttcgggagacccagcatggcgtat

SEQ ID NO: 380623 - DNA, 140 bp, Artificial Sequence
  Synthetic
aggccctggctgctgatatgaacaattgagcgcaaggtttcaaggttgaactgagagtgcctaaacaccaaaatatcgataattcagacaccaagcaagacctgagaaggaaccatggctgaccttttgggacagcggtg

SEQ ID NO: 380624 - DNA, 140 bp, Artificial Sequence
  Synthetic
caccgctgtcccaaaaggtcagccatggttccttctcaggtcttgcttggtgtctgaattatcgatattttggtgtttaggcactctcagttcaaccttgaaaccttgcgctcaattgttcatatcagcagccagggcct

SEQ ID NO: 380625 - DNA, 140 bp, Artificial Sequence
  Synthetic
aggccctggctgctgatatgcattgtgataatatcctggcggaggctttaacccaaataacttgcacagttgatttagcacagatcctgagggaatattcatgggctcatattttagagggaccttttgggacagcggtg

SEQ ID NO: 380626 - DNA, 140 bp, Artificial Sequence
  Synthetic
caccgctgtcccaaaaggtccctctaaaatatgagcccatgaatattccctcaggatctgtgctaaatcaactgtgcaagttatttgggttaaagcctccgccaggatattatcacaatgcatatcagcagccagggcct

SEQ ID NO: 380627 - DNA, 140 bp, Artificial Sequence
  Synthetic
atacgccatgctgggtctcccaattgagtcaccactgtgggcattgagagtcatccttgcagcaggggtacaggaccagctgattgaccagtctttgattgaacccttagcaggagccctcgtacttgggagtcggccat

SEQ ID NO: 380628 - DNA, 140 bp, Artificial Sequence
  Synthetic
atggccgactcccaagtacgagggctcctgctaagggttcaatcaaagactggtcaatcagctggtcctgtacccctgctgcaaggatgactctcaatgcccacagtggtgactcaattgggagacccagcatggcgtat

SEQ ID NO: 380629 - DNA, 140 bp, Artificial Sequence
  Synthetic
aggccctggctgctgatatgcactgcccaaaacaagtggacattacgatgatgatgacgacattccctttccaggacccatcaatgatgacgacaatcctggccatcaagatgatgatccgaccttttgggacagcggtg

SEQ ID NO: 380630 - DNA, 140 bp, Artificial Sequence
  Synthetic
caccgctgtcccaaaaggtcggatcatcatcttgatggccaggattgtcgtcatcattgatgggtcctggaaagggaatgtcgtcatcatcatcgtaatgtccacttgttttgggcagtgcatatcagcagccagggcct

SEQ ID NO: 380631 - DNA, 140 bp, Artificial Sequence
  Synthetic
aggccctggctgctgatatgaaagaaagaagaatttttaggatcttttgtgtgcgaataactatgaggaagattaataattttcctctcattgaaatttatatcggaatttaaattgaaagaccttttgggacagcggtg

SEQ ID NO: 380632 - DNA, 140 bp, Artificial Sequence
  Synthetic
caccgctgtcccaaaaggtctttcaatttaaattccgatataaatttcaatgagaggaaaattattaatcttcctcatagttattcgcacacaaaagatcctaaaaattcttctttctttcatatcagcagccagggcct

SEQ ID NO: 380633 - DNA, 140 bp, Artificial Sequence
  Synthetic
atacgccatgctgggtctccattcgatccaatattctcaagtttattaaccaattggatgctctacatgtcgtgaactacaacgggttgttgagcagtattgaaattggaactcaaaatccgtacttgggagtcggccat

SEQ ID NO: 380634 - DNA, 140 bp, Artificial Sequence
  Synthetic
atggccgactcccaagtacggattttgagttccaatttcaatactgctcaacaacccgttgtagttcacgacatgtagagcatccaattggttaataaacttgagaatattggatcgaatggagacccagcatggcgtat

SEQ ID NO: 380635 - DNA, 140 bp, Artificial Sequence
  Synthetic
atacgccatgctgggtctccattgtgaccggaaaagctaaactaatgatgaagattaatgcggaggtctgatgagaataaaccttattattcagattaggccccaagaggcattcttcatcgtacttgggagtcggccat

SEQ ID NO: 380636 - DNA, 140 bp, Artificial Sequence
  Synthetic
atggccgactcccaagtacgatgaagaatgcctcttggggcctaatctgaataataaggtttattctcatcagacctccgcattaatcttcatcattagtttagcttttccggtcacaatggagacccagcatggcgtat

SEQ ID NO: 380637 - DNA, 140 bp, Artificial Sequence
  Synthetic
atacgccatgctgggtctccaataagcatgttatcaccagaaatccaatatactaaatagttaattgtaactgaacccgcaggtcacgtgtgttaggtttcacagattatatatattactcgtacttgggagtcggccat

SEQ ID NO: 380638 - DNA, 140 bp, Artificial Sequence
  Synthetic
atggccgactcccaagtacgagtaatatatataatctgtgaaacctaacacacgtgacctgcgggttcagttacaattaactatttagtatattggatttctggtgataacatgcttattggagacccagcatggcgtat

SEQ ID NO: 380639 - DNA, 140 bp, Artificial Sequence
  Synthetic
aggccctggctgctgatatgctgaacccgcaggtcacgtgtgttaggtttcacagattatatatattactaactccatacccgtaattaacattagataagtagattaagaaaaacgcttgaccttttgggacagcggtg

SEQ ID NO: 380640 - DNA, 140 bp, Artificial Sequence
  Synthetic
caccgctgtcccaaaaggtcaagcgtttttcttaatctacttatctaatgttaattacgggtatggagttagtaatatatataatctgtgaaacctaacacacgtgacctgcgggttcagcatatcagcagccagggcct

SEQ ID NO: 380641 - DNA, 140 bp, Artificial Sequence
  Synthetic
atacgccatgctgggtctccttttctttctcattgaaagagaaagagttgaatgtaggtagaactttcggaaaattgccttatccgactcgcaatgttcaaacactttgtgaagctctgtcgtacttgggagtcggccat

SEQ ID NO: 380642 - DNA, 140 bp, Artificial Sequence
  Synthetic
atggccgactcccaagtacgacagagcttcacaaagtgtttgaacattgcgagtcggataaggcaattttccgaaagttctacctacattcaactctttctctttcaatgagaaagaaaaggagacccagcatggcgtat

SEQ ID NO: 380643 - DNA, 140 bp, Artificial Sequence
  Synthetic
atacgccatgctgggtctccaatgcaagatgctctcttcctgaaatattatctcaaaaatgtgggtgctcaagaggactgtgttgatgaccactttcaagagaaaatcttatcttcaattcgtacttgggagtcggccat

SEQ ID NO: 380644 - DNA, 140 bp, Artificial Sequence
  Synthetic
atggccgactcccaagtacgaattgaagataagattttctcttgaaagtggtcatcaacacagtcctcttgagcacccacatttttgagataatatttcaggaagagagcatcttgcattggagacccagcatggcgtat

SEQ ID NO: 380645 - DNA, 140 bp, Artificial Sequence
  Synthetic
aggccctggctgctgatatgaagaggactgtgttgatgaccactttcaagagaaaatcttatcttcaattcagggcaatgaatttttacatcaaatgttcttctggtatgacctggctatgaccttttgggacagcggtg

SEQ ID NO: 380646 - DNA, 140 bp, Artificial Sequence
  Synthetic
caccgctgtcccaaaaggtcatagccaggtcataccagaagaacatttgatgtaaaaattcattgccctgaattgaagataagattttctcttgaaagtggtcatcaacacagtcctcttcatatcagcagccagggcct

SEQ ID NO: 380647 - DNA, 140 bp, Artificial Sequence
  Synthetic
atacgccatgctgggtctcctggaagatcccaatttcaatgttacccctgaacacacaaggaatcccccatgctgctatggattggtatcaggcatcagtattcaaagaagcggttcaagcgtacttgggagtcggccat

SEQ ID NO: 380648 - DNA, 140 bp, Artificial Sequence
  Synthetic
atggccgactcccaagtacgcttgaaccgcttctttgaatactgatgcctgataccaatccatagcagcatgggggattccttgtgtgttcaggggtaacattgaaattgggatcttccaggagacccagcatggcgtat

SEQ ID NO: 380649 - DNA, 140 bp, Artificial Sequence
  Synthetic
atacgccatgctgggtctccagatccgtgaattccatagaacattgataaggctggagatgacgccacaacaactttgtgagctattttccatacaaaaacactgggggcatcctgtgctcgtacttgggagtcggccat

SEQ ID NO: 380650 - DNA, 140 bp, Artificial Sequence
  Synthetic
atggccgactcccaagtacgagcacaggatgcccccagtgtttttgtatggaaaatagctcacaaagttgttgtggcgtcatctccagccttatcaatgttctatggaattcacggatctggagacccagcatggcgtat

SEQ ID NO: 380651 - DNA, 140 bp, Artificial Sequence
  Synthetic
aggccctggctgctgatatgatttgagtcttaatgcaaataggcgttaagccacagttatagccataattgtaactcaatatcctaactagcgatttatctaaattaaattacattatgcgaccttttgggacagcggtg

SEQ ID NO: 380652 - DNA, 140 bp, Artificial Sequence
  Synthetic
caccgctgtcccaaaaggtcgcataatgtaatttaatttagataaatcgctagttaggatattgagttacaattatggctataactgtggcttaacgcctatttgcattaagactcaaatcatatcagcagccagggcct

SEQ ID NO: 380653 - DNA, 140 bp, Artificial Sequence
  Synthetic
aggccctggctgctgatatgatattgtgtttttaaatatagtattgcaaaacattattttgatagtcaaggatcttggtacagtgttacttcagataggaatttaacgccaggtcttaatgaccttttgggacagcggtg

SEQ ID NO: 380654 - DNA, 140 bp, Artificial Sequence
  Synthetic
caccgctgtcccaaaaggtcattaagacctggcgttaaattcctatctgaagtaacactgtaccaagatccttgactatcaaaataatgttttgcaatactatatttaaaaacacaatatcatatcagcagccagggcct

SEQ ID NO: 380655 - DNA, 140 bp, Artificial Sequence
  Synthetic
aggccctggctgctgatatgaaacactttgtgaagctctgttagctgatggtcttgctaaagcatttcctagcaatatgatggtagtcacagagcgtgagcaaaaagaaagcttattgcagaccttttgggacagcggtg

SEQ ID NO: 380656 - DNA, 140 bp, Artificial Sequence
  Synthetic
caccgctgtcccaaaaggtctgcaataagctttctttttgctcacgctctgtgactaccatcatattgctaggaaatgctttagcaagaccatcagctaacagagcttcacaaagtgtttcatatcagcagccagggcct

SEQ ID NO: 380657 - DNA, 140 bp, Artificial Sequence
  Synthetic
aggccctggctgctgatatgtgcatgtcagtgattattataatccaccgcataacctcactctggaaaatcgagacaacccccccgaagggcccagttcatacagaggtcatatgggagggaccttttgggacagcggtg

SEQ ID NO: 380658 - DNA, 140 bp, Artificial Sequence
  Synthetic
caccgctgtcccaaaaggtccctcccatatgacctctgtatgaactgggcccttcgggggggttgtctcgattttccagagtgaggttatgcggtggattataataatcactgacatgcacatatcagcagccagggcct

SEQ ID NO: 380659 - DNA, 140 bp, Artificial Sequence
  Synthetic
atacgccatgctgggtctcccaggataaccgcagctttccatacgtttttttcggtgagaatcttgcaacatcatcacctcgggttcaataagggttttgaccttggacagttgacacttcgtacttgggagtcggccat

SEQ ID NO: 380660 - DNA, 140 bp, Artificial Sequence
  Synthetic
atggccgactcccaagtacgaagtgtcaactgtccaaggtcaaaacccttattgaacccgaggtgatgatgttgcaagattctcaccgaaaaaaacgtatggaaagctgcggttatcctgggagacccagcatggcgtat

SEQ ID NO: 380661 - DNA, 140 bp, Artificial Sequence
  Synthetic
aggccctggctgctgatatgtgggaactgcactgccattgactttgtgctaaatcctagcggattaaatgtccccgggtcgcaagacttaacttcatttctgcgccagattgtgcgtagggaccttttgggacagcggtg

SEQ ID NO: 380662 - DNA, 140 bp, Artificial Sequence
  Synthetic
caccgctgtcccaaaaggtccctacgcacaatctggcgcagaaatgaagttaagtcttgcgacccggggacatttaatccgctaggatttagcacaaagtcaatggcagtgcagttcccacatatcagcagccagggcct

SEQ ID NO: 380663 - DNA, 140 bp, Artificial Sequence
  Synthetic
aggccctggctgctgatatgtcggaatttaaattgaaattgttactgtaatcatacctggtttgtttcagagccatatcaccaagatagagaacaacctaggtctccggagggggcaagggaccttttgggacagcggtg

SEQ ID NO: 380664 - DNA, 140 bp, Artificial Sequence
  Synthetic
caccgctgtcccaaaaggtcccttgccccctccggagacctaggttgttctctatcttggtgatatggctctgaaacaaaccaggtatgattacagtaacaatttcaatttaaattccgacatatcagcagccagggcct

SEQ ID NO: 380665 - DNA, 140 bp, Artificial Sequence
  Synthetic
aggccctggctgctgatatgtggatgacgccgagtctcactgaatctgacatggattaccacaagatcttgacagcaggtctgtccgttcaacaggggattgttcggcaaagagtcatccgaccttttgggacagcggtg

SEQ ID NO: 380666 - DNA, 140 bp, Artificial Sequence
  Synthetic
caccgctgtcccaaaaggtcggatgactctttgccgaacaatcccctgttgaacggacagacctgctgtcaagatcttgtggtaatccatgtcagattcagtgagactcggcgtcatccacatatcagcagccagggcct

SEQ ID NO: 380667 - DNA, 140 bp, Artificial Sequence
  Synthetic
atacgccatgctgggtctccaatatagtcctcattctttcatggccaatcgtatgagtaattcagcgacgcgattgattgtttctactaacactttaggtgagttttcaggaggtggccacgtacttgggagtcggccat

SEQ ID NO: 380668 - DNA, 140 bp, Artificial Sequence
  Synthetic
atggccgactcccaagtacgtggccacctcctgaaaactcacctaaagtgttagtagaaacaatcaatcgcgtcgctgaattactcatacgattggccatgaaagaatgaggactatattggagacccagcatggcgtat

SEQ ID NO: 380669 - DNA, 140 bp, Artificial Sequence
  Synthetic
aggccctggctgctgatatgcattatagaagatgatcttattcgactgcctcacttatctggatgggagctagccaagaccatcatgcaatcaattatttcagatagcaacaattcgtctgaccttttgggacagcggtg

SEQ ID NO: 380670 - DNA, 140 bp, Artificial Sequence
  Synthetic
caccgctgtcccaaaaggtcagacgaattgttgctatctgaaataattgattgcatgatggtcttggctagctcccatccagataagtgaggcagtcgaataagatcatcttctataatgcatatcagcagccagggcct

SEQ ID NO: 380671 - DNA, 140 bp, Artificial Sequence
  Synthetic
atacgccatgctgggtctccagggatagtgataacatctatttagtaatccgtccattagaggagatacttttaattgatcaatatactaaaggtgctttacaccattgtctttttcctccgtacttgggagtcggccat

SEQ ID NO: 380672 - DNA, 140 bp, Artificial Sequence
  Synthetic
atggccgactcccaagtacggaggaaaaagacaatggtgtaaagcacctttagtatattgatcaattaaaagtatctcctctaatggacggattactaaatagatgttatcactatccctggagacccagcatggcgtat

SEQ ID NO: 380673 - DNA, 140 bp, Artificial Sequence
  Synthetic
aggccctggctgctgatatgagaggactctcagatgcggccaggttatttttgagaacgtccatttcatcttttcttgcatttataaaagagtggataattaatcgcggaacaattgtccgaccttttgggacagcggtg

SEQ ID NO: 380674 - DNA, 140 bp, Artificial Sequence
  Synthetic
caccgctgtcccaaaaggtcggacaattgttccgcgattaattatccactcttttataaatgcaagaaaagatgaaatggacgttctcaaaaataacctggccgcatctgagagtcctctcatatcagcagccagggcct

SEQ ID NO: 380675 - DNA, 140 bp, Artificial Sequence
  Synthetic
atacgccatgctgggtctccctagtcctacaaatgagccatgaaataaaaagaacgacaattccacaagaaagcacgcaccagggtccgtcgttccagtcatttctaagtgactctgcttcgtacttgggagtcggccat

SEQ ID NO: 380676 - DNA, 140 bp, Artificial Sequence
  Synthetic
atggccgactcccaagtacgaagcagagtcacttagaaatgactggaacgacggaccctggtgcgtgctttcttgtggaattgtcgttctttttatttcatggctcatttgtaggactagggagacccagcatggcgtat

SEQ ID NO: 380677 - DNA, 140 bp, Artificial Sequence
  Synthetic
atacgccatgctgggtctccgtggtacagcaaatccaaaactaaatttcgatagatcgagacataatgtgaaatctcaggatcataactcggcatccaagagggaaggtcatcaaataatcgtacttgggagtcggccat

SEQ ID NO: 380678 - DNA, 140 bp, Artificial Sequence
  Synthetic
atggccgactcccaagtacgattatttgatgaccttccctcttggatgccgagttatgatcctgagatttcacattatgtctcgatctatcgaaatttagttttggatttgctgtaccacggagacccagcatggcgtat

SEQ ID NO: 380679 - DNA, 140 bp, Artificial Sequence
  Synthetic
aggccctggctgctgatatgaaatctcaggatcataactcggcatccaagagggaaggtcatcaaataatctcacaccgtctagtcctacctttctttacattgtctcaagggacgcgccgaccttttgggacagcggtg

SEQ ID NO: 380680 - DNA, 140 bp, Artificial Sequence
  Synthetic
caccgctgtcccaaaaggtcggcgcgtcccttgagacaatgtaaagaaaggtaggactagacggtgtgagattatttgatgaccttccctcttggatgccgagttatgatcctgagatttcatatcagcagccagggcct

SEQ ID NO: 380681 - DNA, 140 bp, Artificial Sequence
  Synthetic
aggccctggctgctgatatgtacttggttcaaagaccaaagagcaaggctacctaggcaagtcgaggttataaccatggatgcagagacgacagaaaatataaacagatcgaaattgtacgaccttttgggacagcggtg

SEQ ID NO: 380682 - DNA, 140 bp, Artificial Sequence
  Synthetic
caccgctgtcccaaaaggtcgtacaatttcgatctgtttatattttctgtcgtctctgcatccatggttataacctcgacttgcctaggtagccttgctctttggtctttgaaccaagtacatatcagcagccagggcct

SEQ ID NO: 380683 - DNA, 140 bp, Artificial Sequence
  Synthetic
aggccctggctgctgatatgaacgtttcttagttcaaaccttatatctacatagaatgcaggattctgaagttaagcttatcgaaaggctgacagggcttctgagtttattcccggatgggaccttttgggacagcggtg

SEQ ID NO: 380684 - DNA, 140 bp, Artificial Sequence
  Synthetic
caccgctgtcccaaaaggtcccatccgggaataaactcagaagccctgtcagcctttcgataagcttaacttcagaatcctgcattctatgtagatataaggtttgaactaagaaacgttcatatcagcagccagggcct

SEQ ID NO: 380685 - DNA, 140 bp, Artificial Sequence
  Synthetic
atacgccatgctgggtctcctctctacaggtttgattgaattaccgtgcatagtatcctgatacttgtgaaggttgattatcaacgtacagattataaaaaactcacaaattgctctcatcgtacttgggagtcggccat

SEQ ID NO: 380686 - DNA, 140 bp, Artificial Sequence
  Synthetic
atggccgactcccaagtacgatgagagcaatttgtgagttttttataatctgtacgttgataatcaaccttcacaagtatcaggatactatgcacggtaattcaatcaaacctgtagagaggagacccagcatggcgtat

SEQ ID NO: 380687 - DNA, 140 bp, Artificial Sequence
  Synthetic
aggccctggctgctgatatgaggttgattatcaacgtacagattataaaaaactcacaaattgctctcatacatcatattgatcgaatttcaataaataactatttaaataacgaaagaagaccttttgggacagcggtg

SEQ ID NO: 380688 - DNA, 140 bp, Artificial Sequence
  Synthetic
caccgctgtcccaaaaggtcttctttcgttatttaaatagttatttattgaaattcgatcaatatgatgtatgagagcaatttgtgagttttttataatctgtacgttgataatcaacctcatatcagcagccagggcct

SEQ ID NO: 380689 - DNA, 140 bp, Artificial Sequence
  Synthetic
atacgccatgctgggtctccgtccttatattatacactatatttagcctctctccctgcgtgataatcaaaaaattcacaatgcagcatgtgtgacatattacttccgcgatgaatctaacgtacttgggagtcggccat

SEQ ID NO: 380690 - DNA, 140 bp, Artificial Sequence
  Synthetic
atggccgactcccaagtacgttagattcatcgcggaagtaatatgtcacacatgctgcattgtgaattttttgattatcacgcagggagagaggctaaatatagtgtataatataaggacggagacccagcatggcgtat

SEQ ID NO: 380691 - DNA, 140 bp, Artificial Sequence
  Synthetic
atacgccatgctgggtctccaaaatggtgatagccttaatctttgtgtaaaataagagattaggtgtaataactttaacattttgtctagtaagctactatttcatacagaatgataaaacgtacttgggagtcggccat

SEQ ID NO: 380692 - DNA, 140 bp, Artificial Sequence
  Synthetic
atggccgactcccaagtacgttttatcattctgtatgaaatagtagcttactagacaaaatgttaaagttattacacctaatctcttattttacacaaagattaaggctatcaccattttggagacccagcatggcgtat

SEQ ID NO: 380693 - DNA, 140 bp, Artificial Sequence
  Synthetic
atacgccatgctgggtctcccgctcatcaggaggctcgccaggataaacgttgcaaaaaggattcctggaaaaatggtcgcacacaaaaatttaaaaataaatctatttcttcttttttgcgtacttgggagtcggccat

SEQ ID NO: 380694 - DNA, 140 bp, Artificial Sequence
  Synthetic
atggccgactcccaagtacgcaaaaaagaagaaatagatttatttttaaatttttgtgtgcgaccatttttccaggaatcctttttgcaacgtttatcctggcgagcctcctgatgagcgggagacccagcatggcgtat

SEQ ID NO: 380695 - DNA, 140 bp, Artificial Sequence
  Synthetic
aggccctggctgctgatatgagccaatctcccttccctccgaaagaggcgaccaatagcagaggcttcaactgctgaactacagggtacgttacattaatgatacacttgtgagtatcaggaccttttgggacagcggtg

SEQ ID NO: 380696 - DNA, 140 bp, Artificial Sequence
  Synthetic
caccgctgtcccaaaaggtcctgatactcacaagtgtatcattaatgtaacgtaccctgtagttcagcagttgaagcctctgctattggtcgcctctttcggagggaagggagattggctcatatcagcagccagggcct

SEQ ID NO: 380697 - DNA, 140 bp, Artificial Sequence
  Synthetic
aggccctggctgctgatatgtgtgctcagttgaaaatcccttgtcaacatctaggccttatcacatcacaagttccgccttaaactctgcagggtgatccaacaaccttaatagcaacatgaccttttgggacagcggtg

SEQ ID NO: 380698 - DNA, 140 bp, Artificial Sequence
  Synthetic
caccgctgtcccaaaaggtcatgttgctattaaggttgttggatcaccctgcagagtttaaggcggaacttgtgatgtgataaggcctagatgttgacaagggattttcaactgagcacacatatcagcagccagggcct

SEQ ID NO: 380699 - DNA, 140 bp, Artificial Sequence
  Synthetic
atacgccatgctgggtctccagttccgccttaaactctgcagggtgatccaacaaccttaatagcaacattattgttaaaggacagcattagttcacagtcaaacaagcaagattgagaacgtacttgggagtcggccat

SEQ ID NO: 380700 - DNA, 140 bp, Artificial Sequence
  Synthetic
atggccgactcccaagtacgttctcaatcttgcttgtttgactgtgaactaatgctgtcctttaacaataatgttgctattaaggttgttggatcaccctgcagagtttaaggcggaactggagacccagcatggcgtat

SEQ ID NO: 380701 - DNA, 140 bp, Artificial Sequence
  Synthetic
atacgccatgctgggtctccttaactttgattttgaacctgaacacccagaggactggagactcaacaaccctaaagcctggggtaaaacattagaaatagtttaaagacaaattgctcgcgtacttgggagtcggccat

SEQ ID NO: 380702 - DNA, 140 bp, Artificial Sequence
  Synthetic
atggccgactcccaagtacgcgagcaatttgtctttaaactatttctaatgttttaccccaggctttagggttgttgagtctccagtcctctgggtgttcaggttcaaaatcaaagttaaggagacccagcatggcgtat

SEQ ID NO: 380703 - DNA, 140 bp, Artificial Sequence
  Synthetic
atacgccatgctgggtctcccgcagtcaagtatttggaagggcacgggttccgttttgaagtcaagaagcgtgatggagtgaagcgccttgaggaattgctgccagcagtatctagtgggcgtacttgggagtcggccat

SEQ ID NO: 380704 - DNA, 140 bp, Artificial Sequence
  Synthetic
atggccgactcccaagtacgcccactagatactgctggcagcaattcctcaaggcgcttcactccatcacgcttcttgacttcaaaacggaacccgtgcccttccaaatacttgactgcgggagacccagcatggcgtat

SEQ ID NO: 380705 - DNA, 140 bp, Artificial Sequence
  Synthetic
atacgccatgctgggtctccagaaacattaagagaacacttgctgccatgccggaagaggagacgactgaagctaatgccggtcagttcctctcctttgcaagtctattccttccgaaatcgtacttgggagtcggccat

SEQ ID NO: 380706 - DNA, 140 bp, Artificial Sequence
  Synthetic
atggccgactcccaagtacgatttcggaaggaatagacttgcaaaggagaggaactgaccggcattagcttcagtcgtctcctcttccggcatggcagcaagtgttctcttaatgtttctggagacccagcatggcgtat

SEQ ID NO: 380707 - DNA, 140 bp, Artificial Sequence
  Synthetic
atacgccatgctgggtctcctttaagtcggctgtgacgctggcagagggagaaggtgctggtgccttactattgattcagaaataccaagttaagaccttatttttcaacacgctagctacgtacttgggagtcggccat

SEQ ID NO: 380708 - DNA, 140 bp, Artificial Sequence
  Synthetic
atggccgactcccaagtacgtagctagcgtgttgaaaaataaggtcttaacttggtatttctgaatcaatagtaaggcaccagcaccttctccctctgccagcgtcacagccgacttaaaggagacccagcatggcgtat

SEQ ID NO: 380709 - DNA, 140 bp, Artificial Sequence
  Synthetic
atacgccatgctgggtctccgatgacaccatcgaccatgccagccacacaccaggcagtgtgtcatcagcattcatcctcgaagctatggtgaatgtcatatcgggccccaaagtgctaacgtacttgggagtcggccat

SEQ ID NO: 380710 - DNA, 140 bp, Artificial Sequence
  Synthetic
atggccgactcccaagtacgttagcactttggggcccgatatgacattcaccatagcttcgaggatgaatgctgatgacacactgcctggtgtgtggctggcatggtcgatggtgtcatcggagacccagcatggcgtat

SEQ ID NO: 380711 - DNA, 140 bp, Artificial Sequence
  Synthetic
atacgccatgctgggtctccccgatgatggaggctacggcgaataccaaagttactcggaaaacggcatgagtgcaccagatgacttggtcctattcgatctagacgaggacgacgaggacgtacttgggagtcggccat

SEQ ID NO: 380712 - DNA, 140 bp, Artificial Sequence
  Synthetic
atggccgactcccaagtacgtcctcgtcgtcctcgtctagatcgaataggaccaagtcatctggtgcactcatgccgttttccgagtaactttggtattcgccgtagcctccatcatcggggagacccagcatggcgtat

SEQ ID NO: 380713 - DNA, 140 bp, Artificial Sequence
  Synthetic
aggccctggctgctgatatgagtgcaccagatgacttggtcctattcgatctagacgaggacgacgaggacaccaagccagtgcctaacagatcgaccaagggtggacaacagaaaaacagaccttttgggacagcggtg

SEQ ID NO: 380714 - DNA, 140 bp, Artificial Sequence
  Synthetic
caccgctgtcccaaaaggtctgtttttctgttgtccacccttggtcgatctgttaggcactggcttggtgtcctcgtcgtcctcgtctagatcgaataggaccaagtcatctggtgcactcatatcagcagccagggcct

SEQ ID NO: 380715 - DNA, 140 bp, Artificial Sequence
  Synthetic
atacgccatgctgggtctccgtcaaaagggccagcatacagagggcagacagacacaatccacgccaactcaaaacgtcacaggccctcgcagaacaatccaccatgccagtgctccactcgtacttgggagtcggccat

SEQ ID NO: 380716 - DNA, 140 bp, Artificial Sequence
  Synthetic
atggccgactcccaagtacgagtggagcactggcatggtggattgttctgcgagggcctgtgacgttttgagttggcgtggattgtgtctgtctgccctctgtatgctggcccttttgacggagacccagcatggcgtat

SEQ ID NO: 380717 - DNA, 140 bp, Artificial Sequence
  Synthetic
aggccctggctgctgatatgcaaaacgtcacaggccctcgcagaacaatccaccatgccagtgctccactcacggacaatgacagaagaaacggaccctccggctcaaccagccctcgcagaccttttgggacagcggtg

SEQ ID NO: 380718 - DNA, 140 bp, Artificial Sequence
  Synthetic
caccgctgtcccaaaaggtctgcgagggctggttgagccggagggtccgtttcttctgtcattgtccgtgagtggagcactggcatggtggattgttctgcgagggcctgtgacgttttgcatatcagcagccagggcct

SEQ ID NO: 380719 - DNA, 140 bp, Artificial Sequence
  Synthetic
atacgccatgctgggtctcctgctgaccccaatcaacgaagaggcagacccactagacgatgccgacgacgagacgtctagccttccgcccttagagtcagatgatgaagaacaggacagcgtacttgggagtcggccat

SEQ ID NO: 380720 - DNA, 140 bp, Artificial Sequence
  Synthetic
atggccgactcccaagtacgctgtcctgttcttcatcatctgactctaagggcggaaggctagacgtctcgtcgtcggcatcgtctagtgggtctgcctcttcgttgattggggtcagcaggagacccagcatggcgtat

SEQ ID NO: 380721 - DNA, 140 bp, Artificial Sequence
  Synthetic
aggccctggctgctgatatggagacgtctagccttccgcccttagagtcagatgatgaagaacaggacagggacggaacttctaaccgcacacccactgtcgccccaccggctcccgtatgaccttttgggacagcggtg

SEQ ID NO: 380722 - DNA, 140 bp, Artificial Sequence
  Synthetic
caccgctgtcccaaaaggtcatacgggagccggtggggcgacagtgggtgtgcggttagaagttccgtccctgtcctgttcttcatcatctgactctaagggcggaaggctagacgtctccatatcagcagccagggcct

SEQ ID NO: 380723 - DNA, 140 bp, Artificial Sequence
  Synthetic
atacgccatgctgggtctccggaatatccaccatggctcactgaaaaagaggccatgaatgatgagaatagatttgttacactggatggtcaacaattttattggccagtaatgaatcaccgtacttgggagtcggccat

SEQ ID NO: 380724 - DNA, 140 bp, Artificial Sequence
  Synthetic
atggccgactcccaagtacggtgattcattactggccaataaaattgttgaccatccagtgtaacaaatctattctcatcattcatggcctctttttcagtgagccatggtggatattccggagacccagcatggcgtat

SEQ ID NO: 380725 - DNA, 140 bp, Artificial Sequence
  Synthetic
atacgccatgctgggtctccaggaataaattcatggcaatcctgcaacatcatcagtgaatgagcatgtaataatgggatgatttaatcgacaaatagctaacattaaatagtcaaggaacgtacttgggagtcggccat

SEQ ID NO: 380726 - DNA, 140 bp, Artificial Sequence
  Synthetic
atggccgactcccaagtacgttccttgactatttaatgttagctatttgtcgattaaatcatcccattattacatgctcattcactgatgatgttgcaggattgccatgaatttattcctggagacccagcatggcgtat

SEQ ID NO: 380727 - DNA, 140 bp, Artificial Sequence
  Synthetic
atacgccatgctgggtctccattagtacaagtgatttgtaaattgggaaaagatagcaattcattggacattattcatgctgagttccaggccagcctggctgaaggagactcccctcaacgtacttgggagtcggccat

SEQ ID NO: 380728 - DNA, 140 bp, Artificial Sequence
  Synthetic
atggccgactcccaagtacgttgaggggagtctccttcagccaggctggcctggaactcagcatgaataatgtccaatgaattgctatcttttcccaatttacaaatcacttgtactaatggagacccagcatggcgtat

SEQ ID NO: 380729 - DNA, 140 bp, Artificial Sequence
  Synthetic
aggccctggctgctgatatggtatgtgtttttcagcttcaagatggtaaaacacttggactcaaaatttgagccaatctcttttccctccgaaagaggcaactaatagcagaggcttcaagaccttttgggacagcggtg

SEQ ID NO: 380730 - DNA, 140 bp, Artificial Sequence
  Synthetic
caccgctgtcccaaaaggtcttgaagcctctgctattagttgcctctttcggagggaaaagagattggctcaaattttgagtccaagtgttttaccatcttgaagctgaaaaacacataccatatcagcagccagggcct

SEQ ID NO: 380731 - DNA, 140 bp, Artificial Sequence
  Synthetic
atacgccatgctgggtctccctgctgaactatagggtatgttacattaatgatacacttgtgagtatcagccctagataatataagtcaattaaacaaccaagataaaattgttcatatccgtacttgggagtcggccat

SEQ ID NO: 380732 - DNA, 140 bp, Artificial Sequence
  Synthetic
atggccgactcccaagtacggatatgaacaattttatcttggttgtttaattgacttatattatctagggctgatactcacaagtgtatcattaatgtaacataccctatagttcagcagggagacccagcatggcgtat

SEQ ID NO: 380733 - DNA, 140 bp, Artificial Sequence
  Synthetic
aggccctggctgctgatatgagaaaaacctacctcgactgagagagtgttttttcattaaccttcatcttgtaaacgttgagcaaaattgttaaaaatatgaggcgggttatattgcctagaccttttgggacagcggtg

SEQ ID NO: 380734 - DNA, 140 bp, Artificial Sequence
  Synthetic
caccgctgtcccaaaaggtctaggcaatataacccgcctcatatttttaacaattttgctcaacgtttacaagatgaaggttaatgaaaaaacactctctcagtcgaggtaggtttttctcatatcagcagccagggcct

SEQ ID NO: 380735 - DNA, 140 bp, Artificial Sequence
  Synthetic
aggccctggctgctgatatggttttgtattatcatatgatgaaggatgagcctgtagttttcagtaccagtgatggtaaagagtacacgtatccggactcccttgaagaggaatatccacgaccttttgggacagcggtg

SEQ ID NO: 380736 - DNA, 140 bp, Artificial Sequence
  Synthetic
caccgctgtcccaaaaggtcgtggatattcctcttcaagggagtccggatacgtgtactctttaccatcactggtactgaaaactacaggctcatccttcatcatatgataatacaaaaccatatcagcagccagggcct

SEQ ID NO: 380737 - DNA, 140 bp, Artificial Sequence
  Synthetic
aggccctggctgctgatatgcgaaaacaggaagaatttttgatgtctaaggtgtgaattattatcacaataaaagtgattcttatttttgaatttaaagctagcttattattactagccggaccttttgggacagcggtg

SEQ ID NO: 380738 - DNA, 140 bp, Artificial Sequence
  Synthetic
caccgctgtcccaaaaggtccggctagtaataataagctagctttaaattcaaaaataagaatcacttttattgtgataataattcacaccttagacatcaaaaattcttcctgttttcgcatatcagcagccagggcct

SEQ ID NO: 380739 - DNA, 140 bp, Artificial Sequence
  Synthetic
aggccctggctgctgatatgccatatcaccaagatagagaacaacctaggtctccggagggggcaagggcatcagtgtgctcagttgaaaatcccttgtcaacatctaggccttatcacagaccttttgggacagcggtg

SEQ ID NO: 380740 - DNA, 140 bp, Artificial Sequence
  Synthetic
caccgctgtcccaaaaggtctgtgataaggcctagatgttgacaagggattttcaactgagcacactgatgcccttgccccctccggagacctaggttgttctctatcttggtgatatggcatatcagcagccagggcct

SEQ ID NO: 380741 - DNA, 140 bp, Artificial Sequence
  Synthetic
aggccctggctgctgatatggagaagtaattgcaataattgactcagatccagttttacagaatcttctcagggatagtgataacatctttttaataatccgtctactagaagagatactgaccttttgggacagcggtg

SEQ ID NO: 380742 - DNA, 140 bp, Artificial Sequence
  Synthetic
caccgctgtcccaaaaggtcagtatctcttctagtagacggattattaaaaagatgttatcactatccctgagaagattctgtaaaactggatctgagtcaattattgcaattacttctccatatcagcagccagggcct

SEQ ID NO: 380743 - DNA, 140 bp, Artificial Sequence
  Synthetic
atacgccatgctgggtctccctcaaagtacaccgagaggaagggccgattcttaacacaaatgcatttagctgtaaatcacaccctggaagaaattacagaaatacgtgcactaaagcctcgtacttgggagtcggccat

SEQ ID NO: 380744 - DNA, 140 bp, Artificial Sequence
  Synthetic
atggccgactcccaagtacgaggctttagtgcacgtatttctgtaatttcttccagggtgtgatttacagctaaatgcatttgtgttaagaatcggcccttcctctcggtgtactttgagggagacccagcatggcgtat

SEQ ID NO: 380745 - DNA, 140 bp, Artificial Sequence
  Synthetic
atacgccatgctgggtctcctcctaaatgtagagcttaacaaaagactcataatatacctgtttttaaaagattgattgatgaaagatcatgactaataacattacaaacaatcctactacgtacttgggagtcggccat

SEQ ID NO: 380746 - DNA, 140 bp, Artificial Sequence
  Synthetic
atggccgactcccaagtacgtagtaggattgtttgtaatgttattagtcatgatctttcatcaatcaatcttttaaaaacaggtatattatgagtcttttgttaagctctacatttaggaggagacccagcatggcgtat

SEQ ID NO: 380747 - DNA, 140 bp, Artificial Sequence
  Synthetic
aggccctggctgctgatatggattgattgatgaaagatcatgactaataacattacaaacaatcctactataatcaatacggtgattcaaatgtcaatctttctcattgcacatacttttgaccttttgggacagcggtg

SEQ ID NO: 380748 - DNA, 140 bp, Artificial Sequence
  Synthetic
caccgctgtcccaaaaggtcaaaagtatgtgcaatgagaaagattgacatttgaatcaccgtattgattatagtaggattgtttgtaatgttattagtcatgatctttcatcaatcaatccatatcagcagccagggcct

SEQ ID NO: 380749 - DNA, 140 bp, Artificial Sequence
  Synthetic
atacgccatgctgggtctcctgcccttatcctcaaattgcctacatgcttacatctgaggacagccagtgtgacttggattggagatgtggaggaaaaatcggggcccatttctaagttgcgtacttgggagtcggccat

SEQ ID NO: 380750 - DNA, 140 bp, Artificial Sequence
  Synthetic
atggccgactcccaagtacgcaacttagaaatgggccccgatttttcctccacatctccaatccaagtcacactggctgtcctcagatgtaagcatgtaggcaatttgaggataagggcaggagacccagcatggcgtat

SEQ ID NO: 380751 - DNA, 140 bp, Artificial Sequence
  Synthetic
aggccctggctgctgatatgtgacttggattggagatgtggaggaaaaatcggggcccatttctaagttgttcacaatctaagtacagacattgctcttctaattaagaaaaaatcggcggaccttttgggacagcggtg

SEQ ID NO: 380752 - DNA, 140 bp, Artificial Sequence
  Synthetic
caccgctgtcccaaaaggtccgccgattttttcttaattagaagagcaatgtctgtacttagattgtgaacaacttagaaatgggccccgatttttcctccacatctccaatccaagtcacatatcagcagccagggcct

SEQ ID NO: 380753 - DNA, 140 bp, Artificial Sequence
  Synthetic
aggccctggctgctgatatgtgtcttccagagtaggggtcatcaggtccttttcaattggataaccaaaataagcttcactagaaggatattgtgaggcgacaacacaatgggtgttacagaccttttgggacagcggtg

SEQ ID NO: 380754 - DNA, 140 bp, Artificial Sequence
  Synthetic
caccgctgtcccaaaaggtctgtaacacccattgtgttgtcgcctcacaatatccttctagtgaagcttattttggttatccaattgaaaaggacctgatgacccctactctggaagacacatatcagcagccagggcct

SEQ ID NO: 380755 - DNA, 140 bp, Artificial Sequence
  Synthetic
aggccctggctgctgatatgttgggtaattatccttttccaaagaacattttccatcccgcttggagttatccacaatagtacattacaggttagtgatgtcgacaaactagtttgtcgtgaccttttgggacagcggtg

SEQ ID NO: 380756 - DNA, 140 bp, Artificial Sequence
  Synthetic
caccgctgtcccaaaaggtcacgacaaactagtttgtcgacatcactaacctgtaatgtactattgtggataactccaagcgggatggaaaatgttctttggaaaaggataattacccaacatatcagcagccagggcct

SEQ ID NO: 380757 - DNA, 140 bp, Artificial Sequence
  Synthetic
atacgccatgctgggtctccgccaaataacagacataacaaatcctacttggtttaaagaccaaagagcaaggctacctaggcaagtcgaggttataaccatggatgcagagacgacagacgtacttgggagtcggccat

SEQ ID NO: 380758 - DNA, 140 bp, Artificial Sequence
  Synthetic
atggccgactcccaagtacgtctgtcgtctctgcatccatggttataacctcgacttgcctaggtagccttgctctttggtctttaaaccaagtaggatttgttatgtctgttatttggcggagacccagcatggcgtat

SEQ ID NO: 380759 - DNA, 140 bp, Artificial Sequence
  Synthetic
atacgccatgctgggtctccaacccccctgaagggcctagttcatacaggggtcatatgggagggattgaaggactgcaacaaaaactctggacaagtatttcatgtgctcaaatttcttcgtacttgggagtcggccat

SEQ ID NO: 380760 - DNA, 140 bp, Artificial Sequence
  Synthetic
atggccgactcccaagtacgaagaaatttgagcacatgaaatacttgtccagagtttttgttgcagtccttcaatccctcccatatgacccctgtatgaactaggcccttcaggggggttggagacccagcatggcgtat

SEQ ID NO: 380761 - DNA, 140 bp, Artificial Sequence
  Synthetic
atacgccatgctgggtctccagttgtctttcacagctgtatcaaacggacccaaaaacatcagtggtcagagtccggcgcgaacttcttccgacccagagaccaacacaacaaatgaagacgtacttgggagtcggccat

SEQ ID NO: 380762 - DNA, 140 bp, Artificial Sequence
  Synthetic
atggccgactcccaagtacgtcttcatttgttgtgttggtctctgggtcggaagaagttcgcgccggactctgaccactgatgtttttgggtccgtttgatacagctgtgaaagacaactggagacccagcatggcgtat

SEQ ID NO: 380763 - DNA, 140 bp, Artificial Sequence
  Synthetic
atacgccatgctgggtctccccataatacacccgtgtataaacttgacatctctgaggcaactcaagttggacaacatcaccgtagagcagacaacgacagcacagcctccgacactccccgtacttgggagtcggccat

SEQ ID NO: 380764 - DNA, 140 bp, Artificial Sequence
  Synthetic
atggccgactcccaagtacggggagtgtcggaggctgtgctgtcgttgtctgctctacggtgatgttgtccaacttgagttgcctcagagatgtcaagtttatacacgggtgtattatggggagacccagcatggcgtat

SEQ ID NO: 380765 - DNA, 140 bp, Artificial Sequence
  Synthetic
atacgccatgctgggtctcccccgccacgaccgcagccggacccttaaaagcagagaacaccaacacgagtaagagcgctgactccctggacctcgccaccacgacaagcccccaaaactcgtacttgggagtcggccat

SEQ ID NO: 380766 - DNA, 140 bp, Artificial Sequence
  Synthetic
atggccgactcccaagtacgagttttgggggcttgtcgtggtggcgaggtccagggagtcagcgctcttactcgtgttggtgttctctgcttttaagggtccggctgcggtcgtggcgggggagacccagcatggcgtat

SEQ ID NO: 380767 - DNA, 140 bp, Artificial Sequence
  Synthetic
aggccctggctgctgatatgcctctggatttcggaacaatatcattggcactagcggtaccgcaggtgcttggagggttatccttcttgaatcctgagaaatgtttctaccggaatctaggaccttttgggacagcggtg

SEQ ID NO: 380768 - DNA, 140 bp, Artificial Sequence
  Synthetic
caccgctgtcccaaaaggtcctagattccggtagaaacatttctcaggattcaagaaggataaccctccaagcacctgcggtaccgctagtgccaatgatattgttccgaaatccagaggcatatcagcagccagggcct

SEQ ID NO: 380769 - DNA, 140 bp, Artificial Sequence
  Synthetic
atacgccatgctgggtctccagccgaaggaatttacacagaggggctaatgcacaaccaagatggtttaatctgtgggttgaggcagctggccaacgaaacgactcaagctctccaactgcgtacttgggagtcggccat

SEQ ID NO: 380770 - DNA, 140 bp, Artificial Sequence
  Synthetic
atggccgactcccaagtacgcagttggagagcttgagtcgtttcgttggccagctgcctcaacccacagattaaaccatcttggttgtgcattagcccctctgtgtaaattccttcggctggagacccagcatggcgtat

SEQ ID NO: 380771 - DNA, 140 bp, Artificial Sequence
  Synthetic
atacgccatgctgggtctccttcctgagagccacaactgagctgcgaaccttttcaatcctcaaccgtaaggcaattgacttcctgctgcagcgatggggtggcacatgccacattttggcgtacttgggagtcggccat

SEQ ID NO: 380772 - DNA, 140 bp, Artificial Sequence
  Synthetic
atggccgactcccaagtacgccaaaatgtggcatgtgccaccccatcgctgcagcaggaagtcaattgccttacggttgaggattgaaaaggttcgcagctcagttgtggctctcaggaaggagacccagcatggcgtat

SEQ ID NO: 380773 - DNA, 140 bp, Artificial Sequence
  Synthetic
aggccctggctgctgatatgaaaaaggtaatctttcgattatctttagtcttcatccttgattctacaatcatgacagttgtctttaatgaaaaaggaaaaaagcctttttattaagttggaccttttgggacagcggtg

SEQ ID NO: 380774 - DNA, 140 bp, Artificial Sequence
  Synthetic
caccgctgtcccaaaaggtccaacttaataaaaaggcttttttcctttttcattaaagacaactgtcatgattgtagaatcaaggatgaagactaaagataatcgaaagattacctttttcatatcagcagccagggcct

SEQ ID NO: 380775 - DNA, 140 bp, Artificial Sequence
  Synthetic
atacgccatgctgggtctcctaataatcagatctgcaaaccggtagaatttagttgtaacctaacacacacaaagcattggtaaaaaagtcaatagaaatttaaacagtgagtgcagacacgtacttgggagtcggccat

SEQ ID NO: 380776 - DNA, 140 bp, Artificial Sequence
  Synthetic
atggccgactcccaagtacgtgtctgcactcactgtttaaatttctattgacttttttaccaatgctttgtgtgtgttaggttacaactaaattctaccggtttgcagatctgattattaggagacccagcatggcgtat

SEQ ID NO: 380777 - DNA, 140 bp, Artificial Sequence
  Synthetic
aggccctggctgctgatatgaaggcagttcgaacagtgacttgctaataaaaccatttttggaagcacgagtaaatttaagtgttcaagaaatacttcaaatgaccccttcacattactcgaccttttgggacagcggtg

SEQ ID NO: 380778 - DNA, 140 bp, Artificial Sequence
  Synthetic
caccgctgtcccaaaaggtcgagtaatgtgaaggggtcatttgaagtatttcttgaacacttaaatttactcgtgcttccaaaaatggttttattagcaagtcactgttcgaactgccttcatatcagcagccagggcct

SEQ ID NO: 380779 - DNA, 140 bp, Artificial Sequence
  Synthetic
atacgccatgctgggtctcctgatgatttccagcaagaggaaggtccaaaaattaccttgttgacactgatcaagacggcagaacactgggcgagacaagacatccgaaccatagaggatcgtacttgggagtcggccat

SEQ ID NO: 380780 - DNA, 140 bp, Artificial Sequence
  Synthetic
atggccgactcccaagtacgatcctctatggttcggatgtcttgtctcgcccagtgttctgccgtcttgatcagtgtcaacaaggtaatttttggaccttcctcttgctggaaatcatcaggagacccagcatggcgtat

SEQ ID NO: 380781 - DNA, 140 bp, Artificial Sequence
  Synthetic
aggccctggctgctgatatgtcaagacggcagaacactgggcgagacaagacatccgaaccatagaggattccaaattaagggcattgttaactctatgtgctgtgatgacgaggaaattgaccttttgggacagcggtg

SEQ ID NO: 380782 - DNA, 140 bp, Artificial Sequence
  Synthetic
caccgctgtcccaaaaggtcaatttcctcgtcatcacagcacatagagttaacaatgcccttaatttggaatcctctatggttcggatgtcttgtctcgcccagtgttctgccgtcttgacatatcagcagccagggcct

SEQ ID NO: 380783 - DNA, 140 bp, Artificial Sequence
  Synthetic
atacgccatgctgggtctcctccaaattaagggcattgttaactctatgtgctgtgatgacgaggaaattctcaaaatcccagctgagtcttttgtgtgagacacacctaaggcgcgaagcgtacttgggagtcggccat

SEQ ID NO: 380784 - DNA, 140 bp, Artificial Sequence
  Synthetic
atggccgactcccaagtacgcttcgcgccttaggtgtgtctcacacaaaagactcagctgggattttgagaatttcctcgtcatcacagcacatagagttaacaatgcccttaatttggaggagacccagcatggcgtat

SEQ ID NO: 380785 - DNA, 140 bp, Artificial Sequence
  Synthetic
atacgccatgctgggtctccaattgataagatatgcataattgccttaatatataaagaggtatgatataacccaaacattgaccaaagaaaatcataatctcgtatcgctcgcaatatacgtacttgggagtcggccat

SEQ ID NO: 380786 - DNA, 140 bp, Artificial Sequence
  Synthetic
atggccgactcccaagtacgtatattgcgagcgatacgagattatgattttctttggtcaatgtttgggttatatcatacctctttatatattaaggcaattatgcatatcttatcaattggagacccagcatggcgtat

SEQ ID NO: 380787 - DNA, 140 bp, Artificial Sequence
  Synthetic
atacgccatgctgggtctccacctgccaagcatacctcttgcacaaagtgattcttgtacacaaataatgtttgactctacaggaggtagcaacgatccatctcatcaaaaaataagtatcgtacttgggagtcggccat

SEQ ID NO: 380788 - DNA, 140 bp, Artificial Sequence
  Synthetic
atggccgactcccaagtacgatacttattttttgatgagatggatcgttgctacctcctgtagagtcaaacattatttgtgtacaagaatcactttgtgcaagaggtatgcttggcaggtggagacccagcatggcgtat

SEQ ID NO: 380789 - DNA, 140 bp, Artificial Sequence
  Synthetic
atacgccatgctgggtctccataaattctttctgcttcaagttgtggaggaggtctatggtattcgctattgttatattacaatcaataacaagcttgtaaaaatattgttcttgtttcacgtacttgggagtcggccat

SEQ ID NO: 380790 - DNA, 140 bp, Artificial Sequence
  Synthetic
atggccgactcccaagtacgtgaaacaagaacaatatttttacaagcttgttattgattgtaatataacaatagcgaataccatagacctcctccacaacttgaagcagaaagaatttatggagacccagcatggcgtat

SEQ ID NO: 380791 - DNA, 140 bp, Artificial Sequence
  Synthetic
atacgccatgctgggtctccgctaactccaccaggtcaactccattggctgaaaagaagcccacctacaacgaacattactttgagcgccctcacaattaaaaaataagagcgtcgttcccgtacttgggagtcggccat

SEQ ID NO: 380792 - DNA, 140 bp, Artificial Sequence
  Synthetic
atggccgactcccaagtacgggaacgacgctcttattttttaattgtgagggcgctcaaagtaatgttcgttgtaggtgggcttcttttcagccaatggagttgacctggtggagttagcggagacccagcatggcgtat

SEQ ID NO: 380793 - DNA, 140 bp, Artificial Sequence
  Synthetic
aggccctggctgctgatatggataataatcttcgtgttaatgataattaaggcattgaccacgctcatcagaaggctcactagaataaacgttgcaaaaaggatccctggaaaaatggtcgaccttttgggacagcggtg

SEQ ID NO: 380794 - DNA, 140 bp, Artificial Sequence
  Synthetic
caccgctgtcccaaaaggtcgaccatttttccagggatcctttttgcaacgtttattctagtgagccttctgatgagcgtggtcaatgccttaattatcattaacacgaagattattatccatatcagcagccagggcct

SEQ ID NO: 380795 - DNA, 140 bp, Artificial Sequence
  Synthetic
aggccctggctgctgatatggatcttttgtgtgcgaataactatgaggaagattaataattttcctctcattgaaatttatatcggaatttaaattgaaattgttactgtaatcatacctgaccttttgggacagcggtg

SEQ ID NO: 380796 - DNA, 140 bp, Artificial Sequence
  Synthetic
caccgctgtcccaaaaggtcaggtatgattacagtaacaatttcaatttaaattccgatataaatttcaatgagaggaaaattattaatcttcctcatagttattcgcacacaaaagatccatatcagcagccagggcct

SEQ ID NO: 380797 - DNA, 140 bp, Artificial Sequence
  Synthetic
atacgccatgctgggtctccattcgatccaatattctcaagtttattaacaaattggatgctctacatgtcgtgaactacaatggattattgagcagtattgaaattggaactcaaaatccgtacttgggagtcggccat

SEQ ID NO: 380798 - DNA, 140 bp, Artificial Sequence
  Synthetic
atggccgactcccaagtacggattttgagttccaatttcaatactgctcaataatccattgtagttcacgacatgtagagcatccaatttgttaataaacttgagaatattggatcgaatggagacccagcatggcgtat

SEQ ID NO: 380799 - DNA, 140 bp, Artificial Sequence
  Synthetic
atacgccatgctgggtctcccaggatcataactcagcatccaagagggaaggtcatcaaataatctcacatcgtctagtcctacctttctttacattatctcaagggacacgccaattaacgtacttgggagtcggccat

SEQ ID NO: 380800 - DNA, 140 bp, Artificial Sequence
  Synthetic
atggccgactcccaagtacgttaattggcgtgtcccttgagataatgtaaagaaaggtaggactagacgatgtgagattatttgatgaccttccctcttggatgctgagttatgatcctgggagacccagcatggcgtat

SEQ ID NO: 380801 - DNA, 140 bp, Artificial Sequence
  Synthetic
atacgccatgctgggtctcccacgaatgcaaagtttaattcttgaattcaatagctctcttgctatctaactaagatggaatacttcatattgggctaactcatatatgctgactcaatacgtacttgggagtcggccat

SEQ ID NO: 380802 - DNA, 140 bp, Artificial Sequence
  Synthetic
atggccgactcccaagtacgtattgagtcagcatatatgagttagcccaatatgaagtattccatcttagttagatagcaagagagctattgaattcaagaattaaactttgcattcgtgggagacccagcatggcgtat

SEQ ID NO: 380803 - DNA, 140 bp, Artificial Sequence
  Synthetic
atacgccatgctgggtctccaataagcattttatcactagaaatccaatatacgaaatggttaattgtaactaaacccgcaggtcatgtgtgttaggtttcacaaattatatatattactcgtacttgggagtcggccat

SEQ ID NO: 380804 - DNA, 140 bp, Artificial Sequence
  Synthetic
atggccgactcccaagtacgagtaatatatataatttgtgaaacctaacacacatgacctgcgggtttagttacaattaaccatttcgtatattggatttctagtgataaaatgcttattggagacccagcatggcgtat

SEQ ID NO: 380805 - DNA, 140 bp, Artificial Sequence
  Synthetic
aggccctggctgctgatatgttgtcactagagcttgcgggttgtattcatcatactcccttaatccgcaactacgcaactgtaaactcccgaaacatatataccgtttaaaatatgatgtgaccttttgggacagcggtg

SEQ ID NO: 380806 - DNA, 140 bp, Artificial Sequence
  Synthetic
caccgctgtcccaaaaggtcacatcatattttaaacggtatatatgtttcgggagtttacagttgcgtagttgcggattaagggagtatgatgaatacaacccgcaagctctagtgacaacatatcagcagccagggcct

SEQ ID NO: 380807 - DNA, 140 bp, Artificial Sequence
  Synthetic
atacgccatgctgggtctcccctgttgagccgcggtgccaacagttcttagatgaaattattaagtacacaatgcaagatgctctcttcctgaaatattatctcaaaaatgtgggtgctccgtacttgggagtcggccat

SEQ ID NO: 380808 - DNA, 140 bp, Artificial Sequence
  Synthetic
atggccgactcccaagtacggagcacccacatttttgagataatatttcaggaagagagcatcttgcattgtgtacttaataatttcatctaagaactgttggcaccgcggctcaacaggggagacccagcatggcgtat

SEQ ID NO: 380809 - DNA, 140 bp, Artificial Sequence
  Synthetic
atacgccatgctgggtctcctggaagatcccaatttcactgttaccactgaacacacaaggaatcccccatgctgctatggattggtatcagacatcagtattcaaagaagcggttcaagcgtacttgggagtcggccat

SEQ ID NO: 380810 - DNA, 140 bp, Artificial Sequence
  Synthetic
atggccgactcccaagtacgcttgaaccgcttctttgaatactgatgtctgataccaatccatagcagcatgggggattccttgtgtgttcagtggtaacagtgaaattgggatcttccaggagacccagcatggcgtat

SEQ ID NO: 380811 - DNA, 140 bp, Artificial Sequence
  Synthetic
aggccctggctgctgatatgaaagatttaattacatgtcgattcaacacaactctaatctcaaaaatagcagaggttgaggacccagtttgctctgattatcccaattttaagattgtgtgaccttttgggacagcggtg

SEQ ID NO: 380812 - DNA, 140 bp, Artificial Sequence
  Synthetic
caccgctgtcccaaaaggtcacacaatcttaaaattgggataatcagagcaaactgggtcctcaacctctgctatttttgagattagagttgtgttgaatcgacatgtaattaaatctttcatatcagcagccagggcct

SEQ ID NO: 380813 - DNA, 140 bp, Artificial Sequence
  Synthetic
aggccctggctgctgatatgctatgctttaccagagcggagattacttactctccatattagggtctgatgggtataaaatcattaagtttctcgaaccattgtgcttggctaaaattcagaccttttgggacagcggtg

SEQ ID NO: 380814 - DNA, 140 bp, Artificial Sequence
  Synthetic
caccgctgtcccaaaaggtctgaattttagccaagcacaatggttcgagaaacttaatgattttatacccatcagaccctaatatggagagtaagtaatctccgctctggtaaagcatagcatatcagcagccagggcct

SEQ ID NO: 380815 - DNA, 140 bp, Artificial Sequence
  Synthetic
aggccctggctgctgatatgagaaaagacatgactgtaaaatcagaaataccttctttacaatatagcagactagataataatcttcgtgttaatgataattaaggcattgaccacgctcgaccttttgggacagcggtg

SEQ ID NO: 380816 - DNA, 140 bp, Artificial Sequence
  Synthetic
caccgctgtcccaaaaggtcgagcgtggtcaatgccttaattatcattaacacgaagattattatctagtctgctatattgtaaagaaggtatttctgattttacagtcatgtcttttctcatatcagcagccagggcct

SEQ ID NO: 380817 - DNA, 140 bp, Artificial Sequence
  Synthetic
aggccctggctgctgatatgtggtttgtttcagagccatatcaccaagatagagaacaacctaggtctccggagggggcaagggcatcagtgtgctcagttgaaaatcccttgtcaacatgaccttttgggacagcggtg

SEQ ID NO: 380818 - DNA, 140 bp, Artificial Sequence
  Synthetic
caccgctgtcccaaaaggtcatgttgacaagggattttcaactgagcacactgatgcccttgccccctccggagacctaggttgttctctatcttggtgatatggctctgaaacaaaccacatatcagcagccagggcct

SEQ ID NO: 380819 - DNA, 140 bp, Artificial Sequence
  Synthetic
atacgccatgctgggtctccagggatagtgataacatctttttaataatccgtctactagaagagatacttctaattgatcaatatactaaaggtgctttacaccattgtctcttttctccgtacttgggagtcggccat

SEQ ID NO: 380820 - DNA, 140 bp, Artificial Sequence
  Synthetic
atggccgactcccaagtacggagaaaagagacaatggtgtaaagcacctttagtatattgatcaattagaagtatctcttctagtagacggattattaaaaagatgttatcactatccctggagacccagcatggcgtat

SEQ ID NO: 380821 - DNA, 140 bp, Artificial Sequence
  Synthetic
aggccctggctgctgatatgccagcgatttatctaaattaaattacattatgcttttataacttacctactagcctgcccaacatttacacgatcgttttataattaagaaaaaactaatgaccttttgggacagcggtg

SEQ ID NO: 380822 - DNA, 140 bp, Artificial Sequence
  Synthetic
caccgctgtcccaaaaggtcattagttttttcttaattataaaacgatcgtgtaaatgttgggcaggctagtaggtaagttataaaagcataatgtaatttaatttagataaatcgctggcatatcagcagccagggcct

SEQ ID NO: 380823 - DNA, 140 bp, Artificial Sequence
  Synthetic
aggccctggctgctgatatggtttaaagacaaattgctcggaatcacaaaattccgagtatggattctcgtcctcagaaagtctggatgacgccgagtctcactgaatctgacatggattgaccttttgggacagcggtg

SEQ ID NO: 380824 - DNA, 140 bp, Artificial Sequence
  Synthetic
caccgctgtcccaaaaggtcaatccatgtcagattcagtgagactcggcgtcatccagactttctgaggacgagaatccatactcggaattttgtgattccgagcaatttgtctttaaaccatatcagcagccagggcct

SEQ ID NO: 380825 - DNA, 140 bp, Artificial Sequence
  Synthetic
aggccctggctgctgatatgggtactgcttttgagcgatccatctctgagacacgacatatctttccttgcagaataaccgcagctttccatacgttcttttcggtgagaatcttgcaatgaccttttgggacagcggtg

SEQ ID NO: 380826 - DNA, 140 bp, Artificial Sequence
  Synthetic
caccgctgtcccaaaaggtcattgcaagattctcaccgaaaagaacgtatggaaagctgcggttattctgcaaggaaagatatgtcgtgtctcagagatggatcgctcaaaagcagtacccatatcagcagccagggcct

SEQ ID NO: 380827 - DNA, 140 bp, Artificial Sequence
  Synthetic
aggccctggctgctgatatggcgcaacagtcaaacccaaacggacccaatttgcaatcatagttttgaggaggtagtacaaacattggcttcattggctactgttgtgcaacaacaaaccgaccttttgggacagcggtg

SEQ ID NO: 380828 - DNA, 140 bp, Artificial Sequence
  Synthetic
caccgctgtcccaaaaggtcggtttgttgttgcacaacagtagccaatgaagccaatgtttgtactacctcctcaaaactatgattgcaaattgggtccgtttgggtttgactgttgcgccatatcagcagccagggcct

SEQ ID NO: 380829 - DNA, 140 bp, Artificial Sequence
  Synthetic
aggccctggctgctgatatgatcagctgacttcgaagacgaaatggtttgtaagtggctcttatcatcaactcctgttatgagtcgtttcgcagccgatatattttcacgcacgccgagcgaccttttgggacagcggtg

SEQ ID NO: 380830 - DNA, 140 bp, Artificial Sequence
  Synthetic
caccgctgtcccaaaaggtcgctcggcgtgcgtgaaaatatatcggctgcgaaacgactcataacaggagttgatgataagagccacttacaaaccatttcgtcttcgaagtcagctgatcatatcagcagccagggcct

SEQ ID NO: 380831 - DNA, 140 bp, Artificial Sequence
  Synthetic
atacgccatgctgggtctccgcaacctggtgggaaaccattcgtgtcagtagcagtcaagaaacatattgttagtgcatggccaaatgcatcccgaataagctggactatcggggatggacgtacttgggagtcggccat

SEQ ID NO: 380832 - DNA, 140 bp, Artificial Sequence
  Synthetic
atggccgactcccaagtacgtccatccccgatagtccagcttattcgggatgcatttggccatgcactaacaatatgtttcttgactgctactgacacgaatggtttcccaccaggttgcggagacccagcatggcgtat

SEQ ID NO: 380833 - DNA, 140 bp, Artificial Sequence
  Synthetic
aggccctggctgctgatatgcgattgattgtttctacaaacactttaggtgagttttcaggaggtggccaatcggcacgcgacagcaatattattttccagaatgttataaattatgcaggaccttttgggacagcggtg

SEQ ID NO: 380834 - DNA, 140 bp, Artificial Sequence
  Synthetic
caccgctgtcccaaaaggtcctgcataatttataacattctggaaaataatattgctgtcgcgtgccgattggccacctcctgaaaactcacctaaagtgtttgtagaaacaatcaatcgcatatcagcagccagggcct

SEQ ID NO: 380835 - DNA, 140 bp, Artificial Sequence
  Synthetic
atacgccatgctgggtctccctttatggatagtatatccattagagggtcaaaatccaacacctgttaataatttcctccatcagatcgtagaactgctggtgcatgattcatcaagacacgtacttgggagtcggccat

SEQ ID NO: 380836 - DNA, 140 bp, Artificial Sequence
  Synthetic
atggccgactcccaagtacgtgtcttgatgaatcatgcaccagcagttctacgatctgatggaggaaattattaacaggtgttggattttgaccctctaatggatatactatccataaagggagacccagcatggcgtat

SEQ ID NO: 380837 - DNA, 140 bp, Artificial Sequence
  Synthetic
atacgccatgctgggtctccaaactcttcaactggatcaagcacaaacaacagtgatggtcatattaagagaagtcaagaacaaaccaccagagatccacatgatggcactgaacggagtcgtacttgggagtcggccat

SEQ ID NO: 380838 - DNA, 140 bp, Artificial Sequence
  Synthetic
atggccgactcccaagtacgactccgttcagtgccatcatgtggatctctggtggtttgttcttgacttctcttaatatgaccatcactgttgtttgtgcttgatccagttgaagagtttggagacccagcatggcgtat

SEQ ID NO: 380839 - DNA, 140 bp, Artificial Sequence
  Synthetic
aggccctggctgctgatatggaagtcaagaacaaaccaccagagatccacatgatggcactgaacggagtctagtcctgcaaatgagccatgaaataaaaagaacgacaattccacaagagaccttttgggacagcggtg

SEQ ID NO: 380840 - DNA, 140 bp, Artificial Sequence
  Synthetic
caccgctgtcccaaaaggtctcttgtggaattgtcgttctttttatttcatggctcatttgcaggactagactccgttcagtgccatcatgtggatctctggtggtttgttcttgacttccatatcagcagccagggcct

SEQ ID NO: 380841 - DNA, 140 bp, Artificial Sequence
  Synthetic
atacgccatgctgggtctccgaacacgcaccagggtccgtcgttccagtcatttctaagtgactctgcttgcggtacagcaaacccaaaactaaatttcgatagatcgagacacaatgtgcgtacttgggagtcggccat

SEQ ID NO: 380842 - DNA, 140 bp, Artificial Sequence
  Synthetic
atggccgactcccaagtacgcacattgtgtctcgatctatcgaaatttagttttgggtttgctgtaccgcaagcagagtcacttagaaatgactggaacgacggaccctggtgcgtgttcggagacccagcatggcgtat

SEQ ID NO: 380843 - DNA, 140 bp, Artificial Sequence
  Synthetic
aggccctggctgctgatatgaatacagtcctcattctttcatggccaatcgtatgagtaattcagcaacgcgattgattgtttctacaaacactttaggtgagttttcaggaggtggccagaccttttgggacagcggtg

SEQ ID NO: 380844 - DNA, 140 bp, Artificial Sequence
  Synthetic
caccgctgtcccaaaaggtctggccacctcctgaaaactcacctaaagtgtttgtagaaacaatcaatcgcgttgctgaattactcatacgattggccatgaaagaatgaggactgtattcatatcagcagccagggcct

SEQ ID NO: 380845 - DNA, 140 bp, Artificial Sequence
  Synthetic
atacgccatgctgggtctccaaataagcgttaagccacagttatagccataatggtaactcaatatcttagccagcgatttatctaaattaaattacattatgcttttataacttacctacgtacttgggagtcggccat

SEQ ID NO: 380846 - DNA, 140 bp, Artificial Sequence
  Synthetic
atggccgactcccaagtacgtaggtaagttataaaagcataatgtaatttaatttagataaatcgctggctaagatattgagttaccattatggctataactgtggcttaacgcttatttggagacccagcatggcgtat

SEQ ID NO: 380847 - DNA, 140 bp, Artificial Sequence
  Synthetic
  misc_feature (21)..(21): n is a, c, g, or t
atacgccatgctgggtctccnaagtgtctctgagctaaagtggtctgtacacatctcatacattgtattaggggcaataatatctaattgaacttagccatttaaaatttagtgcataaacgtacttgggagtcggccat

SEQ ID NO: 380848 - DNA, 140 bp, Artificial Sequence
  Synthetic
  misc_feature (120)..(120): n is a, c, g, or t
atggccgactcccaagtacgtttatgcactaaattttaaatggctaagttcaattagatattattgcccctaatacaatgtatgagatgtgtacagaccactttagctcagagacacttnggagacccagcatggcgtat

SEQ ID NO: 380849 - DNA, 140 bp, Artificial Sequence
  Synthetic
atacgccatgctgggtctccgacaactagaacaaagggcaggggccatactgtggccacgactcaaaacgacagaatgccaggccctgagctttcgggctggatctctgagcagctaatgcgtacttgggagtcggccat

SEQ ID NO: 380850 - DNA, 140 bp, Artificial Sequence
  Synthetic
atggccgactcccaagtacgcattagctgctcagagatccagcccgaaagctcagggcctggcattctgtcgttttgagtcgtggccacagtatggcccctgccctttgttctagttgtcggagacccagcatggcgtat

SEQ ID NO: 380851 - DNA, 140 bp, Artificial Sequence
  Synthetic
atacgccatgctgggtctcctaaatgataatctagccccgttttttgccactgggtatttaattaagccaataacgtcaagtgccaggtctagtgagtggtatctttgtctgacgaacttcgtacttgggagtcggccat

SEQ ID NO: 380852 - DNA, 140 bp, Artificial Sequence
  Synthetic
atggccgactcccaagtacgaagttcgtcagacaaagataccactcactagacctggcacttgacgttattggcttaattaaatacccagtggcaaaaaacggggctagattatcatttaggagacccagcatggcgtat

SEQ ID NO: 380853 - DNA, 140 bp, Artificial Sequence
  Synthetic
aggccctggctgctgatatgccgccttggttttccatcattagagaaagtactataccacaggtataaccttgtcgattcaaaaagaggtccactagtctctgtcactcagcacttagcagaccttttgggacagcggtg

SEQ ID NO: 380854 - DNA, 140 bp, Artificial Sequence
  Synthetic
caccgctgtcccaaaaggtctgctaagtgctgagtgacagagactagtggacctctttttgaatcgacaaggttatacctgtggtatagtactttctctaatgatggaaaaccaaggcggcatatcagcagccagggcct

SEQ ID NO: 380855 - DNA, 140 bp, Artificial Sequence
  Synthetic
aggccctggctgctgatatgtcacaaaactagtcaatgattatttaaaattctttcttattgtacaagcattaaaacataatgggacatggcaagctgagtttaagaaattaccagagttgaccttttgggacagcggtg

SEQ ID NO: 380856 - DNA, 140 bp, Artificial Sequence
  Synthetic
caccgctgtcccaaaaggtcaactctggtaatttcttaaactcagcttgccatgtcccattatgttttaatgcttgtacaataagaaagaattttaaataatcattgactagttttgtgacatatcagcagccagggcct

SEQ ID NO: 380857 - DNA, 140 bp, Artificial Sequence
  Synthetic
atacgccatgctgggtctccgttaagcttatcgaaaggctgacagggcttctgagtttatttccagatggtctctacaggttcgattgaataaccgtgcatagtattttgatacttgtaacgtacttgggagtcggccat

SEQ ID NO: 380858 - DNA, 140 bp, Artificial Sequence
  Synthetic
atggccgactcccaagtacgttacaagtatcaaaatactatgcacggttattcaatcgaacctgtagagaccatctggaaataaactcagaagccctgtcagcctttcgataagcttaacggagacccagcatggcgtat

SEQ ID NO: 380859 - DNA, 140 bp, Artificial Sequence
  Synthetic
atacgccatgctgggtctccaggttggttatcaacatacagattataaaaaactcataaattgctctcatacatcatcttgatctgatttcaataaataactatttagataacgaaaggacgtacttgggagtcggccat

SEQ ID NO: 380860 - DNA, 140 bp, Artificial Sequence
  Synthetic
atggccgactcccaagtacgtcctttcgttatctaaatagttatttattgaaatcagatcaagatgatgtatgagagcaatttatgagttttttataatctgtatgttgataaccaacctggagacccagcatggcgtat

SEQ ID NO: 380861 - DNA, 140 bp, Artificial Sequence
  Synthetic
aggccctggctgctgatatgacatcatcttgatctgatttcaataaataactatttagataacgaaaggagtccttacattatacactatatttggcctctctccctgcgtgataatcaagaccttttgggacagcggtg

SEQ ID NO: 380862 - DNA, 140 bp, Artificial Sequence
  Synthetic
caccgctgtcccaaaaggtcttgattatcacgcagggagagaggccaaatatagtgtataatgtaaggactcctttcgttatctaaatagttatttattgaaatcagatcaagatgatgtcatatcagcagccagggcct

SEQ ID NO: 380863 - DNA, 140 bp, Artificial Sequence
  Synthetic
atacgccatgctgggtctccaaaattcacaatacagcatgtgtgacatattactgctgcaatgagtctaacgcaacataataaactccgcactctttataattaagctttaacgataggtcgtacttgggagtcggccat

SEQ ID NO: 380864 - DNA, 140 bp, Artificial Sequence
  Synthetic
atggccgactcccaagtacgacctatcgttaaagcttaattataaagagtgcggagtttattatgttgcgttagactcattgcagcagtaatatgtcacacatgctgtattgtgaattttggagacccagcatggcgtat

SEQ ID NO: 380865 - DNA, 140 bp, Artificial Sequence
  Synthetic
aggccctggctgctgatatgtagcagactagataataatcttcgtgttaatgataattaaggcattgaccacgctcatcagaaggctcactagaataaacgttgcaaaaaggattcctgggaccttttgggacagcggtg

SEQ ID NO: 380866 - DNA, 140 bp, Artificial Sequence
  Synthetic
caccgctgtcccaaaaggtcccaggaatcctttttgcaacgtttattctagtgagccttctgatgagcgtggtcaatgccttaattatcattaacacgaagattattatctagtctgctacatatcagcagccagggcct

SEQ ID NO: 380867 - DNA, 140 bp, Artificial Sequence
  Synthetic
aggccctggctgctgatatgacgctcatcagaaggctcactagaataaacgttgcaaaaaggattcctggaaaaatggtcgcacacaaaaatttaaaaataaatctatttcttcttttttgaccttttgggacagcggtg

SEQ ID NO: 380868 - DNA, 140 bp, Artificial Sequence
  Synthetic
caccgctgtcccaaaaggtcaaaaaagaagaaatagatttatttttaaatttttgtgtgcgaccatttttccaggaatcctttttgcaacgtttattctagtgagccttctgatgagcgtcatatcagcagccagggcct

SEQ ID NO: 380869 - DNA, 140 bp, Artificial Sequence
  Synthetic
aggccctggctgctgatatgggcacatgccacattttgggaccggactgctgtatcgaaccacatgattggaccaagaacataacagacaaaattgatcagattattcatgattttgttggaccttttgggacagcggtg

SEQ ID NO: 380870 - DNA, 140 bp, Artificial Sequence
  Synthetic
caccgctgtcccaaaaggtccaacaaaatcatgaataatctgatcaattttgtctgttatgttcttggtccaatcatgtggttcgatacagcagtccggtcccaaaatgtggcatgtgcccatatcagcagccagggcct

SEQ ID NO: 380871 - DNA, 140 bp, Artificial Sequence
  Synthetic
aggccctggctgctgatatgagcattagttcacagtcaaacaagcaagattgagaattaaccttggttttgaacttgaatacttagaggattggagattcaacaaccctaaagcttgggggaccttttgggacagcggtg

SEQ ID NO: 380872 - DNA, 140 bp, Artificial Sequence
  Synthetic
caccgctgtcccaaaaggtcccccaagctttagggttgttgaatctccaatcctctaagtattcaagttcaaaaccaaggttaattctcaatcttgcttgtttgactgtgaactaatgctcatatcagcagccagggcct

SEQ ID NO: 380873 - DNA, 140 bp, Artificial Sequence
  Synthetic
aggccctggctgctgatatgtttcaagagagtgcggacagtttccttctcatgctttgtcttcatcatgcgtaccagggagattacaaacttttcttggaaagtggcgcagtcaagtattgaccttttgggacagcggtg

SEQ ID NO: 380874 - DNA, 140 bp, Artificial Sequence
  Synthetic
caccgctgtcccaaaaggtcaatacttgactgcgccactttccaagaaaagtttgtaatctccctggtacgcatgatgaagacaaagcatgagaaggaaactgtccgcactctcttgaaacatatcagcagccagggcct

SEQ ID NO: 380875 - DNA, 140 bp, Artificial Sequence
  Synthetic
atacgccatgctgggtctccaacgatgctgtgatttcaaattcagtggctcaagctcgtttttcaggtttattgattgtcaaaacagtacttgatcatatcctacaaaagacagaacgagcgtacttgggagtcggccat

SEQ ID NO: 380876 - DNA, 140 bp, Artificial Sequence
  Synthetic
atggccgactcccaagtacgctcgttctgtcttttgtaggatatgatcaagtactgttttgacaatcaataaacctgaaaaacgagcttgagccactgaatttgaaatcacagcatcgttggagacccagcatggcgtat

SEQ ID NO: 380877 - DNA, 140 bp, Artificial Sequence
  Synthetic
atacgccatgctgggtctcctccacctgtcatccacatccgctctcgaggtgacattccccgagcttgccagaaaagcttgcgtccagtcccgccatcacccaagattgatcgaggttggcgtacttgggagtcggccat

SEQ ID NO: 380878 - DNA, 140 bp, Artificial Sequence
  Synthetic
atggccgactcccaagtacgccaacctcgatcaatcttgggtgatggcgggactggacgcaagcttttctggcaagctcggggaatgtcacctcgagagcggatgtggatgacaggtggaggagacccagcatggcgtat

SEQ ID NO: 380879 - DNA, 140 bp, Artificial Sequence
  Synthetic
aggccctggctgctgatatgcttggacttgatgatcaggaaaagaaaattcttatgaacttccatcagaaaaagaacgaaatcagcttccagcaaacaaacgctatggtaactctaagaagaccttttgggacagcggtg

SEQ ID NO: 380880 - DNA, 140 bp, Artificial Sequence
  Synthetic
caccgctgtcccaaaaggtcttcttagagttaccatagcgtttgtttgctggaagctgatttcgttctttttctgatggaagttcataagaattttcttttcctgatcatcaagtccaagcatatcagcagccagggcct

SEQ ID NO: 380881 - DNA, 140 bp, Artificial Sequence
  Synthetic
aggccctggctgctgatatgtattcagattaggccccaagaggcattcttcatctccttttagcaaaatactatttcaggatagtccagctagtgacacgtcttttagctgtataccagtgaccttttgggacagcggtg

SEQ ID NO: 380882 - DNA, 140 bp, Artificial Sequence
  Synthetic
caccgctgtcccaaaaggtcactggtatacagctaaaagacgtgtcactagctggactatcctgaaatagtattttgctaaaaggagatgaagaatgcctcttggggcctaatctgaatacatatcagcagccagggcct

SEQ ID NO: 380883 - DNA, 140 bp, Artificial Sequence
  Synthetic
atacgccatgctgggtctcctgttacttcagataggaatctaacaccaggtcttaattcttatatcaaaagaaatcaattccctccgttgccaatgattaaagaactactatgggaatttcgtacttgggagtcggccat

SEQ ID NO: 380884 - DNA, 140 bp, Artificial Sequence
  Synthetic
atggccgactcccaagtacgaaattcccatagtagttctttaatcattggcaacggagggaattgatttcttttgatataagaattaagacctggtgttagattcctatctgaagtaacaggagacccagcatggcgtat

SEQ ID NO: 380885 - DNA, 140 bp, Artificial Sequence
  Synthetic
aggccctggctgctgatatgtctgtacacatctcatacattgtattaggggcaataatatctaattgaacttagccatttaaaatttagtgcataaatctgggctaactccaccaggtcagaccttttgggacagcggtg

SEQ ID NO: 380886 - DNA, 140 bp, Artificial Sequence
  Synthetic
caccgctgtcccaaaaggtctgacctggtggagttagcccagatttatgcactaaattttaaatggctaagttcaattagatattattgcccctaatacaatgtatgagatgtgtacagacatatcagcagccagggcct

SEQ ID NO: 380887 - DNA, 140 bp, Artificial Sequence
  Synthetic
aggccctggctgctgatatggaagaaatgaaccctccggctcaaccagccctcgcatgctgacaccaatcaacgaagaggcagacccactggacgatgccgacgacgagacgtctagcctgaccttttgggacagcggtg

SEQ ID NO: 380888 - DNA, 140 bp, Artificial Sequence
  Synthetic
caccgctgtcccaaaaggtcaggctagacgtctcgtcgtcggcatcgtccagtgggtctgcctcttcgttgattggtgtcagcatgcgagggctggttgagccggagggttcatttcttccatatcagcagccagggcct

SEQ ID NO: 380889 - DNA, 140 bp, Artificial Sequence
  Synthetic
atacgccatgctgggtctccaggagatgtatcgccacattctaagatcacaggggccatttgatgctgttttgtattatcatatgatgaaggatgagcctgtagttttcagtaccagtgacgtacttgggagtcggccat

SEQ ID NO: 380890 - DNA, 140 bp, Artificial Sequence
  Synthetic
atggccgactcccaagtacgtcactggtactgaaaactacaggctcatccttcatcatatgataatacaaaacagcatcaaatggcccctgtgatcttagaatgtggcgatacatctcctggagacccagcatggcgtat

SEQ ID NO: 380891 - DNA, 140 bp, Artificial Sequence
  Synthetic
atacgccatgctgggtctccgcgaacttgaccatcttggacttgatgatcaggaaaagaaaatccttatgaacttccatcagaagaagaacgaaatcagcttccagcaaacaaacgctatcgtacttgggagtcggccat

SEQ ID NO: 380892 - DNA, 140 bp, Artificial Sequence
  Synthetic
atggccgactcccaagtacgatagcgtttgtttgctggaagctgatttcgttcttcttctgatggaagttcataaggattttcttttcctgatcatcaagtccaagatggtcaagttcgcggagacccagcatggcgtat

SEQ ID NO: 380893 - DNA, 140 bp, Artificial Sequence
  Synthetic
atacgccatgctgggtctccggcaatcctgcaacatcatcagtgaatgagcatggaacaatgggatgattcaaccgacaaatagctaacattaggtagtcaaggaacgaaaacaggaagacgtacttgggagtcggccat

SEQ ID NO: 380894 - DNA, 140 bp, Artificial Sequence
  Synthetic
atggccgactcccaagtacgtcttcctgttttcgttccttgactacctaatgttagctatttgtcggttgaatcatcccattgttccatgctcattcactgatgatgttgcaggattgccggagacccagcatggcgtat

SEQ ID NO: 380895 - DNA, 140 bp, Artificial Sequence
  Synthetic
atacgccatgctgggtctccttatcgctttattctgtatatgcaaatttgtcttttagtctttcttcagattgtttcacggcaaaactcaacctcaaatcaatgaaactaggatttaattcgtacttgggagtcggccat

SEQ ID NO: 380896 - DNA, 140 bp, Artificial Sequence
  Synthetic
atggccgactcccaagtacgaattaaatcctagtttcattgatttgaggttgagttttgccgtgaaacaatctgaagaaagactaaaagacaaatttgcatatacagaataaagcgataaggagacccagcatggcgtat

SEQ ID NO: 380897 - DNA, 140 bp, Artificial Sequence
  Synthetic
atacgccatgctgggtctccttttataacttacctactagcctacccaacatttacacgatcattttataattaagaaaaaactaatgatgaagattaaaaccttcatcatccttacgtccgtacttgggagtcggccat

SEQ ID NO: 380898 - DNA, 140 bp, Artificial Sequence
  Synthetic
atggccgactcccaagtacggacgtaaggatgatgaaggttttaatcttcatcattagttttttcttaattataaaatgatcgtgtaaatgttgggtaggctagtaggtaagttataaaaggagacccagcatggcgtat

SEQ ID NO: 380899 - DNA, 140 bp, Artificial Sequence
  Synthetic
aggccctggctgctgatatggccacgactcaaaacgacagaatgccaggccctgagctttcgggctggatctctgagcagctaatgaccggaagaattcctgtaagcgacatcttctgtggaccttttgggacagcggtg

SEQ ID NO: 380900 - DNA, 140 bp, Artificial Sequence
  Synthetic
caccgctgtcccaaaaggtccacagaagatgtcgcttacaggaattcttccggtcattagctgctcagagatccagcccgaaagctcagggcctggcattctgtcgttttgagtcgtggccatatcagcagccagggcct

SEQ ID NO: 380901 - DNA, 140 bp, Artificial Sequence
  Synthetic
aggccctggctgctgatatggacgcccccgagctgccagacagcattcaagggatggacacgaccaccatgttcgagcacgatcatcatccagagagaattatcgaggtgagtaccgtcagaccttttgggacagcggtg

SEQ ID NO: 380902 - DNA, 140 bp, Artificial Sequence
  Synthetic
caccgctgtcccaaaaggtctgacggtactcacctcgataattctctctggatgatgatcgtgctcgaacatggtggtcgtgtccatcccttgaatgctgtctggcagctcgggggcgtccatatcagcagccagggcct

SEQ ID NO: 380903 - DNA, 140 bp, Artificial Sequence
  Synthetic
atacgccatgctgggtctcctttgtaaattgggaaaagatagcaactcattggacatcattcatgctgagttccaggccagcctggctgaaggagactctcctcaatgtgccctaattcacgtacttgggagtcggccat

SEQ ID NO: 380904 - DNA, 140 bp, Artificial Sequence
  Synthetic
atggccgactcccaagtacgtgaattagggcacattgaggagagtctccttcagccaggctggcctggaactcagcatgaatgatgtccaatgagttgctatcttttcccaatttacaaaggagacccagcatggcgtat

SEQ ID NO: 380905 - DNA, 140 bp, Artificial Sequence
  Synthetic
aggccctggctgctgatatggtaaacgttgagcaaaattgttacgaatatgaggcgggttatattgcctactgctcctcctgaatatatggaggccatataccctgtcaggtcaaattcagaccttttgggacagcggtg

SEQ ID NO: 380906 - DNA, 140 bp, Artificial Sequence
  Synthetic
caccgctgtcccaaaaggtctgaatttgacctgacagggtatatggcctccatatattcaggaggagcagtaggcaatataacccgcctcatattcgtaacaattttgctcaacgtttaccatatcagcagccagggcct

SEQ ID NO: 380907 - DNA, 140 bp, Artificial Sequence
  Synthetic
atacgccatgctgggtctccccagtcccaccatcgcccaagattgatcgaggttgggtatgtgtttttcagcttcaagatggtaaaacacttggactcaaaatttgagcccatcttccttcgtacttgggagtcggccat

SEQ ID NO: 380908 - DNA, 140 bp, Artificial Sequence
  Synthetic
atggccgactcccaagtacgaaggaagatgggctcaaattttgagtccaagtgttttaccatcttgaagctgaaaaacacatacccaacctcgatcaatcttgggcgatggtgggactggggagacccagcatggcgtat

SEQ ID NO: 380909 - DNA, 140 bp, Artificial Sequence
  Synthetic
aggccctggctgctgatatgctcaaaaatgtgggtgctcaagaagactgtgttgatgaccactttcaagaaaaaatcttatcttcaattcagggcaatgaatttttacatcaaatgttttgaccttttgggacagcggtg

SEQ ID NO: 380910 - DNA, 140 bp, Artificial Sequence
  Synthetic
caccgctgtcccaaaaggtcaaaacatttgatgtaaaaattcattgccctgaattgaagataagattttttcttgaaagtggtcatcaacacagtcttcttgagcacccacatttttgagcatatcagcagccagggcct

SEQ ID NO: 380911 - DNA, 140 bp, Artificial Sequence
  Synthetic
atacgccatgctgggtctcccttccgccagtccaactaccccagtatttcacctttgatttgacagcactcaaactgatcacccaaccactgcctgctgcaacatggaccgatgacactccgtacttgggagtcggccat

SEQ ID NO: 380912 - DNA, 140 bp, Artificial Sequence
  Synthetic
atggccgactcccaagtacggagtgtcatcggtccatgttgcagcaggcagtggttgggtgatcagtttgagtgctgtcaaatcaaaggtgaaatactggggtagttggactggcggaagggagacccagcatggcgtat

SEQ ID NO: 380913 - DNA, 140 bp, Artificial Sequence
  Synthetic
aggccctggctgctgatatgaaaaataagagcgtcgttccaacaatcgagcgcaaggttacaaggttgaactgagagtgtctagacaacaaaatatcgatactccagacaccaagcaagagaccttttgggacagcggtg

SEQ ID NO: 380914 - DNA, 140 bp, Artificial Sequence
  Synthetic
caccgctgtcccaaaaggtctcttgcttggtgtctggagtatcgatattttgttgtctagacactctcagttcaaccttgtaaccttgcgctcgattgttggaacgacgctcttatttttcatatcagcagccagggcct

SEQ ID NO: 380915 - DNA, 140 bp, Artificial Sequence
  Synthetic
aggccctggctgctgatatgaggcactgcttttgagcgatccatctctgagacacgacatatctttccttgcaggataaccgcagctttccatacgtttttttcggtgagaatcttgcaagaccttttgggacagcggtg

SEQ ID NO: 380916 - DNA, 140 bp, Artificial Sequence
  Synthetic
caccgctgtcccaaaaggtcttgcaagattctcaccgaaaaaaacgtatggaaagctgcggttatcctgcaaggaaagatatgtcgtgtctcagagatggatcgctcaaaagcagtgcctcatatcagcagccagggcct

SEQ ID NO: 380917 - DNA, 140 bp, Artificial Sequence
  Synthetic
atacgccatgctgggtctccagtagcaggactgatcacaggcgggagaaggactcgaagagaagtaattgtcaatgctcaacccaaatgcaaccccaatttacattactggactactcagcgtacttgggagtcggccat

SEQ ID NO: 380918 - DNA, 140 bp, Artificial Sequence
  Synthetic
atggccgactcccaagtacgctgagtagtccagtaatgtaaattggggttgcatttgggttgagcattgacaattacttctcttcgagtccttctcccgcctgtgatcagtcctgctactggagacccagcatggcgtat

SEQ ID NO: 380919 - DNA, 140 bp, Artificial Sequence
  Synthetic
atacgccatgctgggtctccgggatcgtcaggtccttttcaatcgtataaccaaaataaacttcactagaaggatattgtggggcaacaacacaatgggtgttacaggaatattgcagttcgtacttgggagtcggccat

SEQ ID NO: 380920 - DNA, 140 bp, Artificial Sequence
  Synthetic
atggccgactcccaagtacgaactgcaatattcctgtaacacccattgtgttgttgccccacaatatccttctagtgaagtttattttggttatacgattgaaaaggacctgacgatcccggagacccagcatggcgtat

SEQ ID NO: 380921 - DNA, 140 bp, Artificial Sequence
  Synthetic
atacgccatgctgggtctcccagacgggattcggggcttcccccggtgccggtatgtgcacaaagtatcaggaacgggaccgtgtgccggagactttgccttccacaaagagggtgctttcgtacttgggagtcggccat

SEQ ID NO: 380922 - DNA, 140 bp, Artificial Sequence
  Synthetic
atggccgactcccaagtacgaaagcaccctctttgtggaaggcaaagtctccggcacacggtcccgttcctgatactttgtgcacataccggcaccgggggaagccccgaatcccgtctgggagacccagcatggcgtat

SEQ ID NO: 380923 - DNA, 140 bp, Artificial Sequence
  Synthetic
aggccctggctgctgatatgatttaaaaatggtgatagccttaatctttgtgtaaaataagagattaggtgtaataactttaacatttttgtctagtaagctactattccattcagaatggaccttttgggacagcggtg

SEQ ID NO: 380924 - DNA, 140 bp, Artificial Sequence
  Synthetic
caccgctgtcccaaaaggtccattctgaatggaatagtagcttactagacaaaaatgttaaagttattacacctaatctcttattttacacaaagattaaggctatcaccatttttaaatcatatcagcagccagggcct

SEQ ID NO: 380925 - DNA, 140 bp, Artificial Sequence
  Synthetic
aggccctggctgctgatatgtcgctgaaggtgtcgttgcatttctgatactgccccaagctaagaaggacttcttcagctcacaccccttgagagagccggtcaatgcaacggaggacccgaccttttgggacagcggtg

SEQ ID NO: 380926 - DNA, 140 bp, Artificial Sequence
  Synthetic
caccgctgtcccaaaaggtcgggtcctccgttgcattgaccggctctctcaaggggtgtgagctgaagaagtccttcttagcttggggcagtatcagaaatgcaacgacaccttcagcgacatatcagcagccagggcct

SEQ ID NO: 380927 - DNA, 140 bp, Artificial Sequence
  Synthetic
aggccctggctgctgatatgttcttcagctcacaccccttgagagagccggtcaatgcaacggaggacccgtctagtggctactattctaccacaattagatatcaagctaccggttttggaccttttgggacagcggtg

SEQ ID NO: 380928 - DNA, 140 bp, Artificial Sequence
  Synthetic
caccgctgtcccaaaaggtccaaaaccggtagcttgatatctaattgtggtagaatagtagccactagacgggtcctccgttgcattgaccggctctctcaaggggtgtgagctgaagaacatatcagcagccagggcct

SEQ ID NO: 380929 - DNA, 140 bp, Artificial Sequence
  Synthetic
aggccctggctgctgatatggattgattgatagaagatcataactaataacattacaaataatcctactataatcaatacggtgattcaaatgttaatctttctcattgcacatactcttgaccttttgggacagcggtg

SEQ ID NO: 380930 - DNA, 140 bp, Artificial Sequence
  Synthetic
caccgctgtcccaaaaggtcaagagtatgtgcaatgagaaagattaacatttgaatcaccgtattgattatagtaggattatttgtaatgttattagttatgatcttctatcaatcaatccatatcagcagccagggcct

SEQ ID NO: 380931 - DNA, 140 bp, Artificial Sequence
  Synthetic
atacgccatgctgggtctccagggatagtgataacatctatttagtaatccgtctattagaggagatacttttaattgatcaatatactaaaggtgctttacaccattgtcttttttctccgtacttgggagtcggccat

SEQ ID NO: 380932 - DNA, 140 bp, Artificial Sequence
  Synthetic
atggccgactcccaagtacggagaaaaaagacaatggtgtaaagcacctttagtatattgatcaattaaaagtatctcctctaatagacggattactaaatagatgttatcactatccctggagacccagcatggcgtat

SEQ ID NO: 380933 - DNA, 140 bp, Artificial Sequence
  Synthetic
atacgccatgctgggtctcccactgggtgcaagccccagaaaccgacgcctatctaagtagacgcaatgactcggcgccgacccggcgaccggccaaaaggtggtggatgggtgatgccacgtacttgggagtcggccat

SEQ ID NO: 380934 - DNA, 140 bp, Artificial Sequence
  Synthetic
atggccgactcccaagtacgtggcatcacccatccaccaccttttggccggtcgccgggtcggcgccgagtcattgcgtctacttagataggcgtcggtttctggggcttgcacccagtgggagacccagcatggcgtat

SEQ ID NO: 380935 - DNA, 140 bp, Artificial Sequence
  Synthetic
atacgccatgctgggtctccgggttggtaagtcgtaaatcccggtcatcttggtagccactataggtgggtcttaagggaaggttaagattcctcttgtgcctgtggcgagacagcgcaccgtacttgggagtcggccat

SEQ ID NO: 380936 - DNA, 140 bp, Artificial Sequence
  Synthetic
atggccgactcccaagtacggtgcgctgtctcgccacaggcacaagaggaatcttaaccttcccttaagacccacctatagtggctaccaagatgaccgggatttacgacttaccaacccggagacccagcatggcgtat

SEQ ID NO: 380937 - DNA, 140 bp, Artificial Sequence
  Synthetic
atacgccatgctgggtctccggtccacaggtgttggccctaccggtgtgaataagggcccgacgtcaggctcgtcgttaaaccgagaccgacacccacctgggcaaacgacgcccacgtacgtacttgggagtcggccat

SEQ ID NO: 380938 - DNA, 140 bp, Artificial Sequence
  Synthetic
atggccgactcccaagtacgtacgtgggcgtcgtttgcccaggtgggtgtcggtctcggtttaacgacgagcctgacgtcgggcccttattcacaccggtagggccaacacctgtggaccggagacccagcatggcgtat

SEQ ID NO: 380939 - DNA, 140 bp, Artificial Sequence
  Synthetic
atacgccatgctgggtctcccggtccacgtcgcccttcaatgtctctcttgaccaataggctttgccggcgagttgacaaggaccagtgggggccggggacgggggggagggaccccccccgtacttgggagtcggccat

SEQ ID NO: 380940 - DNA, 140 bp, Artificial Sequence
  Synthetic
atggccgactcccaagtacggggggggtccctcccccccgtccccggcccccactggtccttgtcaactcgccggcaaagcctattggtcaagagagacattgaagggcgacgtggaccgggagacccagcatggcgtat

SEQ ID NO: 380941 - DNA, 140 bp, Artificial Sequence
  Synthetic
atacgccatgctgggtctccgccccgcccttcccggtgggacgggaaatgcatggggccacccagctccgcggcggcctgcagccggggtagcccaagagccttcgggtgagggcgggtgcgtacttgggagtcggccat

SEQ ID NO: 380942 - DNA, 140 bp, Artificial Sequence
  Synthetic
atggccgactcccaagtacgcacccgccctcacccgaaggctcttgggctaccccggctgcaggccgccgcggagctgggtggccccatgcatttcccgtcccaccgggaagggcggggcggagacccagcatggcgtat

SEQ ID NO: 380943 - DNA, 140 bp, Artificial Sequence
  Synthetic
atacgccatgctgggtctccgcatttttcctttctgtactaatcatggcagtccttctgctcttcctcgtggttgaggccggggccattctggccccggccacccacgcttgcagagccacgtacttgggagtcggccat

SEQ ID NO: 380944 - DNA, 140 bp, Artificial Sequence
  Synthetic
atggccgactcccaagtacgtggctctgcaagcgtgggtggccggggccagaatggccccggcctcaaccacgaggaagagcagaaggactgccatgattagtacagaaaggaaaaatgcggagacccagcatggcgtat

SEQ ID NO: 380945 - DNA, 140 bp, Artificial Sequence
  Synthetic
atacgccatgctgggtctccaggagcaatatttcctcacaaattgttgcgcccctgaggacatagggttctgccttgagggcggatgccttgtggccctaggttgcacggtttgtaccgacgtacttgggagtcggccat

SEQ ID NO: 380946 - DNA, 140 bp, Artificial Sequence
  Synthetic
atggccgactcccaagtacgtcggtacaaaccgtgcaacctagggccacaaggcatccgccctcaaggcagaaccctatgtcctcaggggcgcaacaatttgtgaggaaatattgctcctggagacccagcatggcgtat

SEQ ID NO: 380947 - DNA, 140 bp, Artificial Sequence
  Synthetic
atacgccatgctgggtctcccaaatgctggccactgtatcaggcgggtttggctgtgcggcctggcaagtccgcggcccagctcgtgggtgaactggggagcctctacgggcccctgtcgcgtacttgggagtcggccat

SEQ ID NO: 380948 - DNA, 140 bp, Artificial Sequence
  Synthetic
atggccgactcccaagtacgcgacaggggcccgtagaggctccccagttcacccacgagctgggccgcggacttgccaggccgcacagccaaacccgcctgatacagtggccagcatttgggagacccagcatggcgtat

SEQ ID NO: 380949 - DNA, 140 bp, Artificial Sequence
  Synthetic
atacgccatgctgggtctccgtctctgcttacgtagcggggatcttgggacttggggaggtttactctggggtgctcacgattggtgttgcgttgacgcgtcgggcctacccgatcccgacgtacttgggagtcggccat

SEQ ID NO: 380950 - DNA, 140 bp, Artificial Sequence
  Synthetic
atggccgactcccaagtacgtcgggatcgggtaggcccgacgcgtcaacgcaacaccaatcgtgagcaccccagagtaaacctccccaagtcccaagatccccgctacgtaagcagagacggagacccagcatggcgtat

SEQ ID NO: 380951 - DNA, 140 bp, Artificial Sequence
  Synthetic
atacgccatgctgggtctccatctaacgtgtgcagtagagtgtgagttaaagtgggaaagtgagttttggagatggactgaacagctggcctccaactattggattctggaatatctttgcgtacttgggagtcggccat

SEQ ID NO: 380952 - DNA, 140 bp, Artificial Sequence
  Synthetic
atggccgactcccaagtacgcaaagatattccagaatccaatagttggaggccagctgttcagtccatctccaaaactcactttcccactttaactcacactctactgcacacgttagatggagacccagcatggcgtat

SEQ ID NO: 380953 - DNA, 140 bp, Artificial Sequence
  Synthetic
atacgccatgctgggtctccgaaggtgccgtttgacttctggcgtggagtggtgagcctgacacccttgttggtgtgcttggcggccctcctcctgcttgagcagagacttgtcatggttcgtacttgggagtcggccat

SEQ ID NO: 380954 - DNA, 140 bp, Artificial Sequence
  Synthetic
atggccgactcccaagtacgaaccatgacaagtctctgctcaagcaggaggagggccgccaagcacaccaacaagggtgtcaggctcaccactccacgccagaagtcaaacggcaccttcggagacccagcatggcgtat

SEQ ID NO: 380955 - DNA, 140 bp, Artificial Sequence
  Synthetic
atacgccatgctgggtctccttcctcctggtgaccatggctggcatgtcgcaaggcgcgccggcctcggtgctcggatcacgcccattcgatcgtgggctgacatggcaggcctgttcgtcgtacttgggagtcggccat

SEQ ID NO: 380956 - DNA, 140 bp, Artificial Sequence
  Synthetic
atggccgactcccaagtacgacgaacaggcctgccatgtcagcccacgatcgaatgggcgtgatccgagcaccgaggccggcgcgccttgcgacatgccagccatggtcaccaggaggaaggagacccagcatggcgtat

SEQ ID NO: 380957 - DNA, 140 bp, Artificial Sequence
  Synthetic
atacgccatgctgggtctccgcagggcgaacggctcgcgcataccgactggggaaaaggtttgggaccgagggaacgtcacactgttgtgtgactgccccaatggtccctgggtgtggatcgtacttgggagtcggccat

SEQ ID NO: 380958 - DNA, 140 bp, Artificial Sequence
  Synthetic
atggccgactcccaagtacgatccacacccagggaccattggggcagtcacacaacagtgtgacgttccctcggtcccaaaccttttccccagtcggtatgcgcgagccgttcgccctgcggagacccagcatggcgtat

SEQ ID NO: 380959 - DNA, 140 bp, Artificial Sequence
  Synthetic
atacgccatgctgggtctcccccagccctttgccaagcgattggttggggcgaccctatcactcattggagccacgggcaaaatcagtggcccctctcatgtccccagtatgtctacggtcgtacttgggagtcggccat

SEQ ID NO: 380960 - DNA, 140 bp, Artificial Sequence
  Synthetic
atggccgactcccaagtacgaccgtagacatactggggacatgagaggggccactgattttgcccgtggctccaatgagtgatagggtcgccccaaccaatcgcttggcaaagggctgggggagacccagcatggcgtat

SEQ ID NO: 380961 - DNA, 140 bp, Artificial Sequence
  Synthetic
atacgccatgctgggtctccgctgtttcagtgacttgcgtgtggggctctgtctcttggtttgcttccactggtgggcgtgactcgaagatcgacgtgtggagtttggtgccagttggctcgtacttgggagtcggccat

SEQ ID NO: 380962 - DNA, 140 bp, Artificial Sequence
  Synthetic
atggccgactcccaagtacgagccaactggcaccaaactccacacgtcgatcttcgagtcacgcccaccagtggaagcaaaccaagagacagagccccacacgcaagtcactgaaacagcggagacccagcatggcgtat

SEQ ID NO: 380963 - DNA, 140 bp, Artificial Sequence
  Synthetic
atacgccatgctgggtctccctgccagttgtaccatagccgcactggggtcttcggaccgcgacaccgtggtggagctctccgagtggggagtgccctgtgctacatgcattctggatcgcgtacttgggagtcggccat

SEQ ID NO: 380964 - DNA, 140 bp, Artificial Sequence
  Synthetic
atggccgactcccaagtacgcgatccagaatgcatgtagcacagggcactccccactcggagagctccaccacggtgtcgcggtccgaagaccccagtgcggctatggtacaactggcagggagacccagcatggcgtat

SEQ ID NO: 380965 - DNA, 140 bp, Artificial Sequence
  Synthetic
atacgccatgctgggtctcctcggccggcctcgtgcggcacctgtgtgagggattgctggcccgaaactgggtcggtacgattcccattccatcggtgcggcgcgggaccccggctgacacgtacttgggagtcggccat

SEQ ID NO: 380966 - DNA, 140 bp, Artificial Sequence
  Synthetic
atggccgactcccaagtacgtgtcagccggggtcccgcgccgcaccgatggaatgggaatcgtaccgacccagtttcgggccagcaatccctcacacaggtgccgcacgaggccggccgaggagacccagcatggcgtat

SEQ ID NO: 380967 - DNA, 140 bp, Artificial Sequence
  Synthetic
atacgccatgctgggtctccaaggacttggaagccgtgcccttcgtcaataggacgactcccttcgccatcagggggcccctgggcgtccaggggagaggcaacccggtgcggtcgcccccgtacttgggagtcggccat

SEQ ID NO: 380968 - DNA, 140 bp, Artificial Sequence
  Synthetic
atggccgactcccaagtacgggggcgaccgcaccgggttgcctctcccctggacgcccaggggccccctgatggcgaagggagtcgtcctattgacgaagggcacggcttccaagtccttggagacccagcatggcgtat

SEQ ID NO: 380969 - DNA, 140 bp, Artificial Sequence
  Synthetic
atacgccatgctgggtctcctgggttttgggtcctacactatgaccaagatccgggattccctgcatttggtgaaatgtcccgcaccggccattgagcctcccaccgggacgtttgggttcgtacttgggagtcggccat

SEQ ID NO: 380970 - DNA, 140 bp, Artificial Sequence
  Synthetic
atggccgactcccaagtacgaacccaaacgtcccggtgggaggctcaatggccggtgcgggacatttcaccaaatgcagggaatcccggatcttggtcatagtgtaggacccaaaacccaggagacccagcatggcgtat

SEQ ID NO: 380971 - DNA, 140 bp, Artificial Sequence
  Synthetic
atacgccatgctgggtctcccttccccggacaacctccccttaacaactgtatgcttcttggcaccgaggtgtctgaggcattaggaggggctggccttacgggggggttctacgagccccgtacttgggagtcggccat

SEQ ID NO: 380972 - DNA, 140 bp, Artificial Sequence
  Synthetic
atggccgactcccaagtacggggctcgtagaacccccccgtaaggccagcccctcctaatgcctcagacacctcggtgccaagaagcatacagttgttaaggggaggttgtccggggaagggagacccagcatggcgtat

SEQ ID NO: 380973 - DNA, 140 bp, Artificial Sequence
  Synthetic
atacgccatgctgggtctccctggtgcgcaggtgttcggagctgatgggccgtcgtaatccagtctgcccggggtttgcatggctctcctcgggcaggcctgacgggttcatacatgtcccgtacttgggagtcggccat

SEQ ID NO: 380974 - DNA, 140 bp, Artificial Sequence
  Synthetic
atggccgactcccaagtacgggacatgtatgaacccgtcaggcctgcccgaggagagccatgcaaaccccgggcagactggattacgacggcccatcagctccgaacacctgcgcaccagggagacccagcatggcgtat

SEQ ID NO: 380975 - DNA, 140 bp, Artificial Sequence
  Synthetic
atacgccatgctgggtctccagggacacttgcaggaggtggatgcaggcaacttcatcccgccgccacgctggttgcttctggactttgtatttgtcctgttgtacctgatgaagttggccgtacttgggagtcggccat

SEQ ID NO: 380976 - DNA, 140 bp, Artificial Sequence
  Synthetic
atggccgactcccaagtacggccaacttcatcaggtacaacaggacaaatacaaagtccagaagcaaccagcgtggcggcgggatgaagttgcctgcatccacctcctgcaagtgtccctggagacccagcatggcgtat

SEQ ID NO: 380977 - DNA, 140 bp, Artificial Sequence
  Synthetic
atacgccatgctgggtctcctgaggctaggttggtcccgttgatccttctcctgctgtggtggtgggtgaaccagttggtagttcttggactgccggttgcgcacgccgccgtggctggtcgtacttgggagtcggccat

SEQ ID NO: 380978 - DNA, 140 bp, Artificial Sequence
  Synthetic
atggccgactcccaagtacgaccagccacggcggcgtgcgcaaccggcagtccaagaactaccaactggttcacccaccaccacagcaggagaaggatcaacgggaccaacctagcctcaggagacccagcatggcgtat

SEQ ID NO: 380979 - DNA, 140 bp, Artificial Sequence
  Synthetic
atacgccatgctgggtctccgaggtgtttgcggggccagccttgtcatggtgcttgggactccccttcgtaagtatgatactgggattggctaacctagtgttgtatttccgttggatggcgtacttgggagtcggccat

SEQ ID NO: 380980 - DNA, 140 bp, Artificial Sequence
  Synthetic
atggccgactcccaagtacgccatccaacggaaatacaacactaggttagccaatcccagtatcatacttacgaaggggagtcccaagcaccatgacaaggctggccccgcaaacacctcggagacccagcatggcgtat

SEQ ID NO: 380981 - DNA, 140 bp, Artificial Sequence
  Synthetic
atacgccatgctgggtctccgccctcagcgcctgatgttcctcgtgttatggaagctcgctcggggggctttcccgctggcacttctgatggggatctcggcgacccgcggccgcacctccgtacttgggagtcggccat

SEQ ID NO: 380982 - DNA, 140 bp, Artificial Sequence
  Synthetic
atggccgactcccaagtacggaggtgcggccgcgggtcgccgagatccccatcagaagtgccagcgggaaagccccccgagcgagcttccataacacgaggaacatcaggcgctgagggcggagacccagcatggcgtat

SEQ ID NO: 380983 - DNA, 140 bp, Artificial Sequence
  Synthetic
atacgccatgctgggtctccagtgctcggagccgaattctgcttcgacgtcacattcgaggtggacatgtcggtgctgggatgggtggtggccagcgtggtggcttgggccatagcactccgtacttgggagtcggccat

SEQ ID NO: 380984 - DNA, 140 bp, Artificial Sequence
  Synthetic
atggccgactcccaagtacggagtgctatggcccaagccaccacgctggccaccacccatcccagcaccgacatgtccacctcgaatgtgacgtcgaagcagaattcggctccgagcactggagacccagcatggcgtat

SEQ ID NO: 380985 - DNA, 140 bp, Artificial Sequence
  Synthetic
atacgccatgctgggtctccctgggctcgatgagcgcaggggggtggaagcacaaagctgtgatttacaggacgtggtgcaggggataccaggcgatacgccaacgggtggttcggagcccgtacttgggagtcggccat

SEQ ID NO: 380986 - DNA, 140 bp, Artificial Sequence
  Synthetic
atggccgactcccaagtacgggctccgaaccacccgttggcgtatcgcctggtatcccctgcaccacgtcctgtaaatcacagctttgtgcttccacccccctgcgctcatcgagcccagggagacccagcatggcgtat

SEQ ID NO: 380987 - DNA, 140 bp, Artificial Sequence
  Synthetic
atacgccatgctgggtctccccctcggggaggggcgacctaccaagcccttgaccttcgcctggtgtctggcctcatacatctggcctgacgcagtgatgatggtggtggtcgccatggtcgtacttgggagtcggccat

SEQ ID NO: 380988 - DNA, 140 bp, Artificial Sequence
  Synthetic
atggccgactcccaagtacgaccatggcgaccaccaccatcatcactgcgtcaggccagatgtatgaggccagacaccaggcgaaggtcaagggcttggtaggtcgcccctccccgagggggagacccagcatggcgtat

SEQ ID NO: 380989 - DNA, 140 bp, Artificial Sequence
  Synthetic
atacgccatgctgggtctccgcttctgttcggcttgttcgatgcgttggaccgggccttggaggagctcttggtctcccggccctcgttgcgccgactggcgcgggtggttgagtgctgtcgtacttgggagtcggccat

SEQ ID NO: 380990 - DNA, 140 bp, Artificial Sequence
  Synthetic
atggccgactcccaagtacgacagcactcaaccacccgcgccagtcggcgcaacgagggccgggagaccaagagctcctccaaggcccggtccaacgcatcgaacaagccgaacagaagcggagacccagcatggcgtat

SEQ ID NO: 380991 - DNA, 140 bp, Artificial Sequence
  Synthetic
atacgccatgctgggtctccgtgatggcgggtgagagggccactactgtaaggttggtctccaagatgtgtgcgagaggggcctatttgtttgaccacatgggctctttctcgcgcgcagcgtacttgggagtcggccat

SEQ ID NO: 380992 - DNA, 140 bp, Artificial Sequence
  Synthetic
atggccgactcccaagtacgctgcgcgcgagaaagagcccatgtggtcaaacaaataggcccctctcgcacacatcttggagaccaaccttacagtagtggccctctcacccgccatcacggagacccagcatggcgtat

SEQ ID NO: 380993 - DNA, 140 bp, Artificial Sequence
  Synthetic
atacgccatgctgggtctcctcaaggagcgcctactggaatgggatgcggcccttgaacccctatcatttaccaggacggactgtcgcatcataagggacgccgccaggaccctctcctgcgtacttgggagtcggccat

SEQ ID NO: 380994 - DNA, 140 bp, Artificial Sequence
  Synthetic
atggccgactcccaagtacgcaggagagggtcctggcggcgtcccttatgatgcgacagtccgtcctggtaaatgataggggttcaagggccgcatcccattccagtaggcgctccttgaggagacccagcatggcgtat

SEQ ID NO: 380995 - DNA, 140 bp, Artificial Sequence
  Synthetic
atacgccatgctgggtctcccggccagtgtgtcatgggcttgcctgtggtagctcgccgtggtgatgaagttttgatcggcgttttccaggatgtgaaccatttgcctcccgggtttgtccgtacttgggagtcggccat

SEQ ID NO: 380996 - DNA, 140 bp, Artificial Sequence
  Synthetic
atggccgactcccaagtacggacaaacccgggaggcaaatggttcacatcctggaaaacgccgatcaaaacttcatcaccacggcgagctaccacaggcaagcccatgacacactggccgggagacccagcatggcgtat

SEQ ID NO: 380997 - DNA, 140 bp, Artificial Sequence
  Synthetic
atacgccatgctgggtctccccgaccgcgccagtagtcatccgacggtgcggaaagggctttctcggagtcacaaaggctgccttgacgggtcgggaccctgacctacatccagggaacgcgtacttgggagtcggccat

SEQ ID NO: 380998 - DNA, 140 bp, Artificial Sequence
  Synthetic
atggccgactcccaagtacgcgttccctggatgtaggtcagggtcccgacccgtcaaggcagcctttgtgactccgagaaagccctttccgcaccgtcggatgactactggcgcggtcggggagacccagcatggcgtat

SEQ ID NO: 380999 - DNA, 140 bp, Artificial Sequence
  Synthetic
atacgccatgctgggtctcctcatggtgttggggacagccacctcacgcagcatggggacgtgcttaaatgggctgctgttcacgacattccatggggcttcttcccgaaccatcgccaccgtacttgggagtcggccat

SEQ ID NO: 381000 - DNA, 140 bp, Artificial Sequence
  Synthetic
atggccgactcccaagtacggtggcgatggttcgggaagaagccccatggaatgtcgtgaacagcagcccatttaagcacgtccccatgctgcgtgaggtggctgtccccaacaccatgaggagacccagcatggcgtat

SEQ ID NO: 381001 - DNA, 140 bp, Artificial Sequence
  Synthetic
atacgccatgctgggtctccgcccgtgggggcccttaatcccaggtggtggtcagccagtgatgatgtaaccgtgtacccccttccagatggggcaacctcgttgacgtcttgcacttgccgtacttgggagtcggccat

SEQ ID NO: 381002 - DNA, 140 bp, Artificial Sequence
  Synthetic
atggccgactcccaagtacggcaagtgcaagacgtcaacgaggttgccccatctggaagggggtacacggttacatcatcactggctgaccaccacctgggattaagggcccccacgggcggagacccagcatggcgtat

SEQ ID NO: 381003 - DNA, 140 bp, Artificial Sequence
  Synthetic
atacgccatgctgggtctcccaggcggagtcctgttgggtcattaggtccgacggggctctttgccatggcttgtccaagggggataaggtcgaactggacgtggccatggaagtgtctgcgtacttgggagtcggccat

SEQ ID NO: 381004 - DNA, 140 bp, Artificial Sequence
  Synthetic
atggccgactcccaagtacgcagacacttccatggccacgtccagttcgaccttatcccccttggacaagccatggcaaagagccccgtcggacctaatgacccaacaggactccgcctgggagacccagcatggcgtat

SEQ ID NO: 381005 - DNA, 140 bp, Artificial Sequence
  Synthetic
atacgccatgctgggtctccacttccgtgggtcgtccgggtcgcctgtcctgtgcgacgaggggcacgcagtaggcatgcttgtgtcagtgctacattctgggggaagggtcacggcagccgtacttgggagtcggccat

SEQ ID NO: 381006 - DNA, 140 bp, Artificial Sequence
  Synthetic
atggccgactcccaagtacggctgccgtgacccttcccccagaatgtagcactgacacaagcatgcctactgcgtgcccctcgtcgcacaggacaggcgacccggacgacccacggaagtggagacccagcatggcgtat

SEQ ID NO: 381007 - DNA, 140 bp, Artificial Sequence
  Synthetic
atacgccatgctgggtctcccagattcacacggccgtggacccaagtaccggcagacgccaaaaccaccactgaacccccgccggtgccggcaaaaggagttttcaaggaggccccgctgcgtacttgggagtcggccat

SEQ ID NO: 381008 - DNA, 140 bp, Artificial Sequence
  Synthetic
atggccgactcccaagtacgcagcggggcctccttgaaaactccttttgccggcaccggcgggggttcagtggtggttttggcgtctgccggtacttgggtccacggccgtgtgaatctgggagacccagcatggcgtat

SEQ ID NO: 381009 - DNA, 140 bp, Artificial Sequence
  Synthetic
atacgccatgctgggtctccttcatgcctacgggggctgggaagagcacccgagtccccttggagtacggcaatatgggccacaaggtcttgatcctgaacccctcggtggctactgtgacgtacttgggagtcggccat

SEQ ID NO: 381010 - DNA, 140 bp, Artificial Sequence
  Synthetic
atggccgactcccaagtacgtcacagtagccaccgaggggttcaggatcaagaccttgtggcccatattgccgtactccaaggggactcgggtgctcttcccagcccccgtaggcatgaaggagacccagcatggcgtat

SEQ ID NO: 381011 - DNA, 140 bp, Artificial Sequence
  Synthetic
atacgccatgctgggtctccgggccatgggcccttacatggagcggctggcgggtaaacatcccagtatctactgtggacacgatacgacagccttcacgaggatcaccgactcacccttcgtacttgggagtcggccat

SEQ ID NO: 381012 - DNA, 140 bp, Artificial Sequence
  Synthetic
atggccgactcccaagtacgaagggtgagtcggtgatcctcgtgaaggctgtcgtatcgtgtccacagtagatactgggatgtttacccgccagccgctccatgtaagggcccatggcccggagacccagcatggcgtat

SEQ ID NO: 381013 - DNA, 140 bp, Artificial Sequence
  Synthetic
atacgccatgctgggtctccgacctactctacctacgggaggttcttagccaaccctaggcagatgttgcgaggtgtctcggtggtaatctgtgatgagtgccacagtcatgactctacacgtacttgggagtcggccat

SEQ ID NO: 381014 - DNA, 140 bp, Artificial Sequence
  Synthetic
atggccgactcccaagtacgtgtagagtcatgactgtggcactcatcacagattaccaccgagacacctcgcaacatctgcctagggttggctaagaacctcccgtaggtagagtaggtcggagacccagcatggcgtat

SEQ ID NO: 381015 - DNA, 140 bp, Artificial Sequence
  Synthetic
atacgccatgctgggtctccgtgttgctggggattgggcgcgtcagggaactggctcgggggtgtggagtgcaacttgtgctctacgctacggccacgcctcctggatcgcctatgaccccgtacttgggagtcggccat

SEQ ID NO: 381016 - DNA, 140 bp, Artificial Sequence
  Synthetic
atggccgactcccaagtacggggtcataggcgatccaggaggcgtggccgtagcgtagagcacaagttgcactccacacccccgagccagttccctgacgcgcccaatccccagcaacacggagacccagcatggcgtat

SEQ ID NO: 381017 - DNA, 140 bp, Artificial Sequence
  Synthetic
atacgccatgctgggtctccagcacccttcaatcattgagacaaagctggatgtgggagagatccccttttatgggcacggcattcccctggagcggatgcggaccggcaggcaccttgtcgtacttgggagtcggccat

SEQ ID NO: 381018 - DNA, 140 bp, Artificial Sequence
  Synthetic
atggccgactcccaagtacgacaaggtgcctgccggtccgcatccgctccaggggaatgccgtgcccataaaaggggatctctcccacatccagctttgtctcaatgattgaagggtgctggagacccagcatggcgtat

SEQ ID NO: 381019 - DNA, 140 bp, Artificial Sequence
  Synthetic
atacgccatgctgggtctccattctgccattctaaggcggagtgcgagcggcttgccggtcagttttcctccaggggggttaatgccatagcctactataggggcaaagacagttccatccgtacttgggagtcggccat

SEQ ID NO: 381020 - DNA, 140 bp, Artificial Sequence
  Synthetic
atggccgactcccaagtacggatggaactgtctttgcccctatagtaggctatggcattaacccccctggaggaaaactgaccggcaagccgctcgcactccgccttagaatggcagaatggagacccagcatggcgtat

SEQ ID NO: 381021 - DNA, 140 bp, Artificial Sequence
  Synthetic
atacgccatgctgggtctccatcaaagatggagacctagtggtttgcgctactgacgcgctctctactgggtacacggggaatttcgactccgtcaccgactgtggtttagtggtggaggcgtacttgggagtcggccat

SEQ ID NO: 381022 - DNA, 140 bp, Artificial Sequence
  Synthetic
atggccgactcccaagtacgcctccaccactaaaccacagtcggtgacggagtcgaaattccccgtgtacccagtagagagcgcgtcagtagcgcaaaccactaggtctccatctttgatggagacccagcatggcgtat

SEQ ID NO: 381023 - DNA, 140 bp, Artificial Sequence
  Synthetic
atacgccatgctgggtctccaggtcgttgaggtgacccttgatcccaccataaccatctccctgcgtacggtgcccgcgtcggcagagttatcgatgcagaggcggggacgcacgggtagcgtacttgggagtcggccat

SEQ ID NO: 381024 - DNA, 140 bp, Artificial Sequence
  Synthetic
atggccgactcccaagtacgctacccgtgcgtccccgcctctgcatcgataactctgccgacgcgggcaccgtacgcagggagatggttatggtgggatcaagggtcacctcaacgacctggagacccagcatggcgtat

SEQ ID NO: 381025 - DNA, 140 bp, Artificial Sequence
  Synthetic
atacgccatgctgggtctccgggccggtctgggcggtactactacgcgggggtgggcaaagcccctgctggtgtggtgcggtccgggcccgtctggtcggcggtggaggccggagtgacccgtacttgggagtcggccat

SEQ ID NO: 381026 - DNA, 140 bp, Artificial Sequence
  Synthetic
atggccgactcccaagtacgggtcactccggcctccaccgccgaccagacgggcccggaccgcaccacaccagcaggggctttgcccacccccgcgtagtagtaccgcccagaccggcccggagacccagcatggcgtat

SEQ ID NO: 381027 - DNA, 140 bp, Artificial Sequence
  Synthetic
atacgccatgctgggtctcctggtatggtatggaacctgacttgactgcaaaccttctgagactttacgacgactgcccttacaccgcagccgttgcagctgacattggggaagccgcggcgtacttgggagtcggccat

SEQ ID NO: 381028 - DNA, 140 bp, Artificial Sequence
  Synthetic
atggccgactcccaagtacgccgcggcttccccaatgtcagctgcaacggctgcggtgtaagggcagtcgtcgtaaagtctcagaaggtttgcagtcaagtcaggttccataccataccaggagacccagcatggcgtat

SEQ ID NO: 381029 - DNA, 140 bp, Artificial Sequence
  Synthetic
atacgccatgctgggtctcctgttctttgcgggtctcgcgccccttagaatgcatcctgatgtcagttgggcaaaagttcgcggcgttaactggcccctcctggtgggtgttcagcggaccgtacttgggagtcggccat

SEQ ID NO: 381030 - DNA, 140 bp, Artificial Sequence
  Synthetic
atggccgactcccaagtacggtccgctgaacacccaccaggaggggccagttaacgccgcgaacttttgcccaactgacatcaggatgcattctaaggggcgcgagacccgcaaagaacaggagacccagcatggcgtat

SEQ ID NO: 381031 - DNA, 140 bp, Artificial Sequence
  Synthetic
atacgccatgctgggtctcccatgtgccgggaaacactgtctcccggaccatcggacgacccccagtgggcaggtctgaagggcccgaatcccgtcccactactgctgaggtggggcaatcgtacttgggagtcggccat

SEQ ID NO: 381032 - DNA, 140 bp, Artificial Sequence
  Synthetic
atggccgactcccaagtacgattgccccacctcagcagtagtgggacgggattcgggcccttcagacctgcccactgggggtcgtccgatggtccgggagacagtgtttcccggcacatgggagacccagcatggcgtat

SEQ ID NO: 381033 - DNA, 140 bp, Artificial Sequence
  Synthetic
atacgccatgctgggtctccgatttgccatccaaagtggccggccatcacattgtagacgacctggtccgtcgcctgggcgtggctgagggttatgtccgctgcgatgcgggtcccatctcgtacttgggagtcggccat

SEQ ID NO: 381034 - DNA, 140 bp, Artificial Sequence
  Synthetic
atggccgactcccaagtacgagatgggacccgcatcgcagcggacataaccctcagccacgcccaggcgacggaccaggtcgtctacaatgtgatggccggccactttggatggcaaatcggagacccagcatggcgtat

SEQ ID NO: 381035 - DNA, 140 bp, Artificial Sequence
  Synthetic
atacgccatgctgggtctcctgatggtggggcttgctattgcgggcggcatgatctacgcgtcatatacaggatcactcgtggtggttacagactgggatgtgaaggggggtggcaatcccgtacttgggagtcggccat

SEQ ID NO: 381036 - DNA, 140 bp, Artificial Sequence
  Synthetic
atggccgactcccaagtacgggattgccaccccccttcacatcccagtctgtaaccaccacgagtgatcctgtatatgacgcgtagatcatgccgcccgcaatagcaagccccaccatcaggagacccagcatggcgtat

SEQ ID NO: 381037 - DNA, 140 bp, Artificial Sequence
  Synthetic
atacgccatgctgggtctcccctttatcggagtggcgaccaggccaccccacaacccgttgtgcaggtccctccggtagaccatcggccggggggggaatctgcaccagcggatgctaagcgtacttgggagtcggccat

SEQ ID NO: 381038 - DNA, 140 bp, Artificial Sequence
  Synthetic
atggccgactcccaagtacgcttagcatccgctggtgcagattccccccccggccgatggtctaccggagggacctgcacaacgggttgtggggtggcctggtcgccactccgataaaggggagacccagcatggcgtat

SEQ ID NO: 381039 - DNA, 140 bp, Artificial Sequence
  Synthetic
atacgccatgctgggtctccacagtgacagatgcggtggcagccattcaggtggactgcgattggtcagttatgaccctgtcgatcggggaagtactgtccttggctcaggctaagaccgcgtacttgggagtcggccat

SEQ ID NO: 381040 - DNA, 140 bp, Artificial Sequence
  Synthetic
atggccgactcccaagtacgcggtcttagcctgagccaaggacagtacttccccgatcgacagggtcataactgaccaatcgcagtccacctgaatggctgccaccgcatctgtcactgtggagacccagcatggcgtat

SEQ ID NO: 381041 - DNA, 140 bp, Artificial Sequence
  Synthetic
atacgccatgctgggtctccccgaggcctactcagcaaccgccaagtggctcgctggctgctacacggggacgcgggccgtccccactgtttcaattgtggacaagctctttgccggtggcgtacttgggagtcggccat

SEQ ID NO: 381042 - DNA, 140 bp, Artificial Sequence
  Synthetic
atggccgactcccaagtacgccaccggcaaagagcttgtccacaattgaaacagtggggacggcccgcgtccccgtgtagcagccagcgagccacttggcggttgctgagtaggcctcggggagacccagcatggcgtat

SEQ ID NO: 381043 - DNA, 140 bp, Artificial Sequence
  Synthetic
atacgccatgctgggtctccatgggcggccgtggtaggccactgtcacagtgtaatagctgcggcagtggctgcttatggggcttccagaagtcccccgttggcggctgcggcctcctatcgtacttgggagtcggccat

SEQ ID NO: 381044 - DNA, 140 bp, Artificial Sequence
  Synthetic
atggccgactcccaagtacgataggaggccgcagccgccaacgggggacttctggaagccccataagcagccactgccgcagctattacactgtgacagtggcctaccacggccgcccatggagacccagcatggcgtat

SEQ ID NO: 381045 - DNA, 140 bp, Artificial Sequence
  Synthetic
atacgccatgctgggtctccctcatgggcttgggcgtcggaggcaacgctcagacgcgtctggcttcggctctcctcttgggggctgctggaactgctctgggtactcctgtcgtgggctcgtacttgggagtcggccat

SEQ ID NO: 381046 - DNA, 140 bp, Artificial Sequence
  Synthetic
atggccgactcccaagtacgagcccacgacaggagtacccagagcagttccagcagcccccaagaggagagccgaagccagacgcgtctgagcgttgcctccgacgcccaagcccatgagggagacccagcatggcgtat

SEQ ID NO: 381047 - DNA, 140 bp, Artificial Sequence
  Synthetic
atacgccatgctgggtctcctaaccatggcgggggcattcatgggcggggccagtgtttccccatccttggtcaccatcttattgggggccgtgggtggttgggagggcgtggtcaatgccgtacttgggagtcggccat

SEQ ID NO: 381048 - DNA, 140 bp, Artificial Sequence
  Synthetic
atggccgactcccaagtacggcattgaccacgccctcccaaccacccacggcccccaataagatggtgaccaaggatggggaaacactggccccgcccatgaatgcccccgccatggttaggagacccagcatggcgtat

SEQ ID NO: 381049 - DNA, 140 bp, Artificial Sequence
  Synthetic
atacgccatgctgggtctccggctagccttgtctttgacttcatggcagggaaactatcatcagaggacctgtggtatgccatcccggtgctcaccagcccgggggcgggccttgcggggcgtacttgggagtcggccat

SEQ ID NO: 381050 - DNA, 140 bp, Artificial Sequence
  Synthetic
atggccgactcccaagtacgccccgcaaggcccgcccccgggctggtgagcaccgggatggcataccacaggtcctctgatgatagtttccctgccatgaagtcaaagacaaggctagccggagacccagcatggcgtat

SEQ ID NO: 381051 - DNA, 140 bp, Artificial Sequence
  Synthetic
atacgccatgctgggtctccatcgccctagggctggtgttgtactcagcaaacaactctggcactactacatggttgaaccgtctgctgaccacgttgccgcggtcttcgtgcatccccgcgtacttgggagtcggccat

SEQ ID NO: 381052 - DNA, 140 bp, Artificial Sequence
  Synthetic
atggccgactcccaagtacgcggggatgcacgaagaccgcggcaacgtggtcagcagacggttcaaccatgtagtagtgccagagttgtttgctgagtacaacaccagccctagggcgatggagacccagcatggcgtat

SEQ ID NO: 381053 - DNA, 140 bp, Artificial Sequence
  Synthetic
atacgccatgctgggtctccacagttactttcagcaggcagactattgtgacaaggtatcagccgtgctccgacgcctgagcctcacgcgaactgtggtggccctggtcaacagggaacccgtacttgggagtcggccat

SEQ ID NO: 381054 - DNA, 140 bp, Artificial Sequence
  Synthetic
atggccgactcccaagtacgggttccctgttgaccagggccaccacagttcgcgtgaggctcaggcgtcggagcacggctgataccttgtcacaatagtctgcctgctgaaagtaactgtggagacccagcatggcgtat

SEQ ID NO: 381055 - DNA, 140 bp, Artificial Sequence
  Synthetic
atacgccatgctgggtctcctaaggttgacgaggtacaggttggatacgtctgggacttgtgggaatggatcatgcgccaagtgcgcatgttgatggccagactccgggctctctgcccccgtacttgggagtcggccat

SEQ ID NO: 381056 - DNA, 140 bp, Artificial Sequence
  Synthetic
atggccgactcccaagtacgggggcagagagcccggagtctggccatcaacatgcgcacttggcgcatgatccattcccacaagtcccagacgtatccaacctgtacctcgtcaaccttaggagacccagcatggcgtat

SEQ ID NO: 381057 - DNA, 140 bp, Artificial Sequence
  Synthetic
atacgccatgctgggtctccgtggtgtcactacccctgtggcactgcggggaggggtggtccggagaatggctgttggatggccatattgagagtcgctgcctatgtgggtgcgtcatcacgtacttgggagtcggccat

SEQ ID NO: 381058 - DNA, 140 bp, Artificial Sequence
  Synthetic
atggccgactcccaagtacgtgatgacgcacccacataggcagcgactctcaatatggccatccaacagccattctccggaccacccctccccgcagtgccacaggggtagtgacaccacggagacccagcatggcgtat

SEQ ID NO: 381059 - DNA, 140 bp, Artificial Sequence
  Synthetic
atacgccatgctgggtctcccaggcgacgtgctaaacgggcaactcaaagaaccagtttattccacaaagctgtgccgacactattggatggggaccgtgccggtcaacatgctgggctacgtacttgggagtcggccat

SEQ ID NO: 381060 - DNA, 140 bp, Artificial Sequence
  Synthetic
atggccgactcccaagtacgtagcccagcatgttgaccggcacggtccccatccaatagtgtcggcacagctttgtggaataaactggttctttgagttgcccgtttagcacgtcgcctgggagacccagcatggcgtat

SEQ ID NO: 381061 - DNA, 140 bp, Artificial Sequence
  Synthetic
atacgccatgctgggtctcctggggagacctcgcctctcttggcctccgacaccccgaaggtggtaccttttgggacgtctggctgggctgaggtggtggttacccctactcacgtggtgcgtacttgggagtcggccat

SEQ ID NO: 381062 - DNA, 140 bp, Artificial Sequence
  Synthetic
atggccgactcccaagtacgcaccacgtgagtaggggtaaccaccacctcagcccagccagacgtcccaaaaggtaccaccttcggggtgtcggaggccaagagaggcgaggtctccccaggagacccagcatggcgtat

SEQ ID NO: 381063 - DNA, 140 bp, Artificial Sequence
  Synthetic
atacgccatgctgggtctccattagacggacgtcgtcctacaagttgttgcgccagcaaattttatcggccgctgtagctgaaccctactatgttgacggcattccggtctcgtggggtgcgtacttgggagtcggccat

SEQ ID NO: 381064 - DNA, 140 bp, Artificial Sequence
  Synthetic
atggccgactcccaagtacgcaccccacgagaccggaatgccgtcaacatagtagggttcagctacagcggccgataaaatttgctggcgcaacaacttgtaggacgacgtccgtctaatggagacccagcatggcgtat

SEQ ID NO: 381065 - DNA, 140 bp, Artificial Sequence
  Synthetic
atacgccatgctgggtctccccgacgcgcgagcgccggccatggtctatggccctgggcaaagtgttaccattgacggggagcgctacaccctgccgcaccaactgcggcttaggaatgtcgtacttgggagtcggccat

SEQ ID NO: 381066 - DNA, 140 bp, Artificial Sequence
  Synthetic
atggccgactcccaagtacgacattcctaagccgcagttggtgcggcagggtgtagcgctccccgtcaatggtaacactttgcccagggccatagaccatggccggcgctcgcgcgtcggggagacccagcatggcgtat

SEQ ID NO: 381067 - DNA, 140 bp, Artificial Sequence
  Synthetic
atacgccatgctgggtctccggcgccctctgaggtttcatccgaggtgtccattgacattgggacggagactgaagactcagaactgactgaggccgatttgccgccagcagctgctgcccgtacttgggagtcggccat

SEQ ID NO: 381068 - DNA, 140 bp, Artificial Sequence
  Synthetic
atggccgactcccaagtacgggcagcagctgctggcggcaaatcggcctcagtcagttctgagtcttcagtctccgtcccaatgtcaatggacacctcggatgaaacctcagagggcgccggagacccagcatggcgtat

SEQ ID NO: 381069 - DNA, 140 bp, Artificial Sequence
  Synthetic
atacgccatgctgggtctccccccaggctattgagaatgctgcgaggattctcgagccccatattgatgtcatcatggaggactgcagtacaccctctctctgcggtagtagccgagagacgtacttgggagtcggccat

SEQ ID NO: 381070 - DNA, 140 bp, Artificial Sequence
  Synthetic
atggccgactcccaagtacgtctctcggctactaccgcagagagagggtgtactgcagtcctccatgatgacatcaatatggggctcgagaatcctcgcagcattctcaatagcctggggggagacccagcatggcgtat

SEQ ID NO: 381071 - DNA, 140 bp, Artificial Sequence
  Synthetic
atacgccatgctgggtctcctgcctgtgtgggatgaagacattccccgcactccatcgccagcattgatatcggttaccgagagctgttcagatgaaaagaccccgtcggtgtcctcttccgtacttgggagtcggccat

SEQ ID NO: 381072 - DNA, 140 bp, Artificial Sequence
  Synthetic
atggccgactcccaagtacggaagaggacaccgacggggtcttttcatctgaacagctctcggtaaccgatatcaatgctggcgatggagtgcggggaatgtcttcatcccacacaggcaggagacccagcatggcgtat

SEQ ID NO: 381073 - DNA, 140 bp, Artificial Sequence
  Synthetic
atacgccatgctgggtctccgcaggaggataccccgtcctctcatttattcgaagtcatcccaaagacggagccgttcgagggggaggaaagcgtcttcaacgtggctctttctgtattacgtacttgggagtcggccat

SEQ ID NO: 381074 - DNA, 140 bp, Artificial Sequence
  Synthetic
atggccgactcccaagtacgtaatacagaaagagccacgttgaagacgctttcctccccctcgaacggctccgtctttgggatgacttcgaataaatgagaggacggggtatcctcctgcggagacccagcatggcgtat

SEQ ID NO: 381075 - DNA, 140 bp, Artificial Sequence
  Synthetic
atacgccatgctgggtctccaaagccttgttttcacagagcgatgccacacgtaagctaacggtgaagatgtcttgctgcgtggagaagagcgtcacgcgcttctttcccttggggttgacgtacttgggagtcggccat

SEQ ID NO: 381076 - DNA, 140 bp, Artificial Sequence
  Synthetic
atggccgactcccaagtacgtcaaccccaagggaaagaagcgcgtgacgctcttctccacgcagcaagacatcttcaccgttagcttacgtgtggcatcgctctgtgaaaacaaggctttggagacccagcatggcgtat

SEQ ID NO: 381077 - DNA, 140 bp, Artificial Sequence
  Synthetic
atacgccatgctgggtctccccgtggctgatgtggctaacctgtgtaaaatggagatccagaaccatacagcctattgtgacaaggtgcgcactccgcttgaattgcaggtcgggtgcttcgtacttgggagtcggccat

SEQ ID NO: 381078 - DNA, 140 bp, Artificial Sequence
  Synthetic
atggccgactcccaagtacgaagcacccgacctgcaattcaagcggagtgcgcaccttgtcacaataggctgtatggttctggatctccattttacacaggttagccacatcagccacggggagacccagcatggcgtat

SEQ ID NO: 381079 - DNA, 140 bp, Artificial Sequence
  Synthetic
atacgccatgctgggtctccggtgggcaatgaacttacttttgaatgtgacaagtgtgaggctaggcaagagactttggcgtccttctcctacatttggtctggcgtgccgattactaggcgtacttgggagtcggccat

SEQ ID NO: 381080 - DNA, 140 bp, Artificial Sequence
  Synthetic
atggccgactcccaagtacgcctagtaatcggcacgccagaccaaatgtaggagaaggacgccaaagtctcttgcctagcctcacacttgtcacattcaaaagtaagttcattgcccaccggagacccagcatggcgtat

SEQ ID NO: 381081 - DNA, 140 bp, Artificial Sequence
  Synthetic
atacgccatgctgggtctccgccaccccggctaaaccccctgtggtgaggccggtgggctcattgttagtggccgacaccaccaaggtgtatgtcaccaatccagacaatgtgggtaggacgtacttgggagtcggccat

SEQ ID NO: 381082 - DNA, 140 bp, Artificial Sequence
  Synthetic
atggccgactcccaagtacgtcctacccacattgtctggattggtgacatacaccttggtggtgtcggccactaacaatgagcccaccggcctcaccacagggggtttagccggggtggcggagacccagcatggcgtat

SEQ ID NO: 381083 - DNA, 140 bp, Artificial Sequence
  Synthetic
atacgccatgctgggtctccgagtcgacaaggtaaccttctggcgtgcaccaagagttcatgacaaatttctcgtggattccattgagcgcgccaggaaggctgctcaagcctgcctaagcgtacttgggagtcggccat

SEQ ID NO: 381084 - DNA, 140 bp, Artificial Sequence
  Synthetic
atggccgactcccaagtacgcttaggcaggcttgagcagccttcctggcgcgctcaatggaatccacgagaaatttgtcatgaactcttggtgcacgccagaaggttaccttgtcgactcggagacccagcatggcgtat

SEQ ID NO: 381085 - DNA, 140 bp, Artificial Sequence
  Synthetic
atacgccatgctgggtctcccatgggttacacttatgaggaggcaataaggactgtaaggccacatgctgccatgggctggggatctaaggtgtcggttaaggacttggccacccctgcgcgtacttgggagtcggccat

SEQ ID NO: 381086 - DNA, 140 bp, Artificial Sequence
  Synthetic
atggccgactcccaagtacgcgcaggggtggccaagtccttaaccgacaccttagatccccagcccatggcagcatgtggccttacagtccttattgcctcctcataagtgtaacccatgggagacccagcatggcgtat

SEQ ID NO: 381087 - DNA, 140 bp, Artificial Sequence
  Synthetic
atacgccatgctgggtctccgggaagatggctgtccatgaccggcttcaggagatacttgaagggactccggtcccatttaccctgactgtgaaaaaggaggtgttcttcaaagatcgtacgtacttgggagtcggccat

SEQ ID NO: 381088 - DNA, 140 bp, Artificial Sequence
  Synthetic
atggccgactcccaagtacgtacgatctttgaagaacacctcctttttcacagtcagggtaaatgggaccggagtcccttcaagtatctcctgaagccggtcatggacagccatcttcccggagacccagcatggcgtat

SEQ ID NO: 381089 - DNA, 140 bp, Artificial Sequence
  Synthetic
atacgccatgctgggtctccaggaggaaaaggccccccgcctcattgtgttccctcccctggacttccggatagctgaaaagctcatcctgggggacccgggtcgagtggccaaggcggtcgtacttgggagtcggccat

SEQ ID NO: 381090 - DNA, 140 bp, Artificial Sequence
  Synthetic
atggccgactcccaagtacgaccgccttggccactcgacccgggtcccccaggatgagcttttcagctatccggaagtccaggggagggaacacaatgaggcggggggccttttcctcctggagacccagcatggcgtat

SEQ ID NO: 381091 - DNA, 140 bp, Artificial Sequence
  Synthetic
atacgccatgctgggtctccgttggggggggcttatgccttccagtacaccccaaaccagcgggttagggagatgctcaagctatgggagtcaaagaaaacgccatgcgccatctgtgtgcgtacttgggagtcggccat

SEQ ID NO: 381092 - DNA, 140 bp, Artificial Sequence
  Synthetic
atggccgactcccaagtacgcacacagatggcgcatggcgttttctttgactcccatagcttgagcatctccctaacccgctggtttggggtgtactggaaggcataagccccccccaacggagacccagcatggcgtat

SEQ ID NO: 381093 - DNA, 140 bp, Artificial Sequence
  Synthetic
atacgccatgctgggtctccgatgcgacgtgcttcgacagtagtattactgaggaggacgttgccctggagacagagctttacgctttggcttcagaccatccagagtgggtgcgggccccgtacttgggagtcggccat

SEQ ID NO: 381094 - DNA, 140 bp, Artificial Sequence
  Synthetic
atggccgactcccaagtacggggcccgcacccactctggatggtctgaagccaaagcgtaaagctctgtctccagggcaacgtcctcctcagtaatactactgtcgaagcacgtcgcatcggagacccagcatggcgtat

SEQ ID NO: 381095 - DNA, 140 bp, Artificial Sequence
  Synthetic
atacgccatgctgggtctcctggggaaatactatgcctctggcactatggtcactccggaaggggtgcccgtgggcgagaggtactgtaggtcctcaggtgttttgaccaccagcgcaagcgtacttgggagtcggccat

SEQ ID NO: 381096 - DNA, 140 bp, Artificial Sequence
  Synthetic
atggccgactcccaagtacgcttgcgctggtggtcaaaacacctgaggacctacagtacctctcgcccacgggcaccccttccggagtgaccatagtgccagaggcatagtatttccccaggagacccagcatggcgtat

SEQ ID NO: 381097 - DNA, 140 bp, Artificial Sequence
  Synthetic
atacgccatgctgggtctcccaattgtttgacctgctacatcaaggtgtcagccgcctgccagagagtgggactgaaaaatgtctcgctcctcattgcaggtgatgactgtctgatcatacgtacttgggagtcggccat

SEQ ID NO: 381098 - DNA, 140 bp, Artificial Sequence
  Synthetic
atggccgactcccaagtacgtatgatcagacagtcatcacctgcaatgaggagcgagacatttttcagtcccactctctggcaggcggctgacaccttgatgtagcaggtcaaacaattgggagacccagcatggcgtat

SEQ ID NO: 381099 - DNA, 140 bp, Artificial Sequence
  Synthetic
atacgccatgctgggtctcctgcgaaaggccagtgtgtgatcctagcgaagctctgggcagagcccttgccagctacgggtacgcgtgcgaaccttcgtatcatgcatcattggacacggcgtacttgggagtcggccat

SEQ ID NO: 381100 - DNA, 140 bp, Artificial Sequence
  Synthetic
atggccgactcccaagtacgccgtgtccaatgatgcatgatacgaaggttcgcacgcgtacccgtagctggcaagggctctgcccagagcttcgctaggatcacacactggcctttcgcaggagacccagcatggcgtat

SEQ ID NO: 381101 - DNA, 140 bp, Artificial Sequence
  Synthetic
atacgccatgctgggtctcccccccttctgctccacttggcttgccgagtgcaatgcggatgggaagcgccatttcttcctgactactgactttcggaggcctctcgctcgcatgtcgagcgtacttgggagtcggccat

SEQ ID NO: 381102 - DNA, 140 bp, Artificial Sequence
  Synthetic
atggccgactcccaagtacgctcgacatgcgagcgagaggcctccgaaagtcagtagtcaggaagaaatggcgcttcccatccgcattgcactcggcaagccaagtggagcagaagggggggagacccagcatggcgtat

SEQ ID NO: 381103 - DNA, 140 bp, Artificial Sequence
  Synthetic
atacgccatgctgggtctcctgagtatagtgaccctatggcttcggccattggttacatcctcctttatccctggcaccccatcacacggtgggtcatcattccgcacgtgctaacatgccgtacttgggagtcggccat

SEQ ID NO: 381104 - DNA, 140 bp, Artificial Sequence
  Synthetic
atggccgactcccaagtacggcatgttagcacgtgcggaatgatgacccaccgtgtgatggggtgccagggataaaggaggatgtaaccaatggccgaagccatagggtcactatactcaggagacccagcatggcgtat

SEQ ID NO: 381105 - DNA, 140 bp, Artificial Sequence
  Synthetic
atacgccatgctgggtctccgcatttcggggtggtggcacaccgtctgatcctgtgtggtgccaggttcatggtaattactacaagttcccactggacaaactgccaaacatcatcgtggcgtacttgggagtcggccat

SEQ ID NO: 381106 - DNA, 140 bp, Artificial Sequence
  Synthetic
atggccgactcccaagtacgccacgatgatgtttggcagtttgtccagtgggaacttgtagtaattaccatgaacctggcaccacacaggatcagacggtgtgccaccaccccgaaatgcggagacccagcatggcgtat

SEQ ID NO: 381107 - DNA, 140 bp, Artificial Sequence
  Synthetic
atacgccatgctgggtctccccctccacggaccagcagcgttgagggttaccgcagacacaactaaaacaaaaatggaggccggcaaggtgctgagcgacctcaagctcccgggcttggccgtacttgggagtcggccat

SEQ ID NO: 381108 - DNA, 140 bp, Artificial Sequence
  Synthetic
atggccgactcccaagtacggccaagcccgggagcttgaggtcgctcagcaccttgccggcctccatttttgttttagttgtgtctgcggtaaccctcaacgctgctggtccgtggagggggagacccagcatggcgtat

SEQ ID NO: 381109 - DNA, 140 bp, Artificial Sequence
  Synthetic
atacgccatgctgggtctccggtccaccgaaagaaggctggagcgttgcgaacacgcatgctccggtcgcgcggttgggctgagctagctcggggcctgttgtggcatccaggcctacggcgtacttgggagtcggccat

SEQ ID NO: 381110 - DNA, 140 bp, Artificial Sequence
  Synthetic
atggccgactcccaagtacgccgtaggcctggatgccacaacaggccccgagctagctcagcccaaccgcgcgaccggagcatgcgtgttcgcaacgctccagccttctttcggtggaccggagacccagcatggcgtat

SEQ ID NO: 381111 - DNA, 140 bp, Artificial Sequence
  Synthetic
atacgccatgctgggtctccctccccccccctgagattgctggtatcccagggggttttcccctgtcccccccctatatgggggtggttcatcaattggattttacaagccagaggagtccgtacttgggagtcggccat

SEQ ID NO: 381112 - DNA, 140 bp, Artificial Sequence
  Synthetic
atggccgactcccaagtacggactcctctggcttgtaaaatccaattgatgaaccacccccatataggggggggacaggggaaaaccccctgggataccagcaatctcagggggggggagggagacccagcatggcgtat

SEQ ID NO: 381113 - DNA, 140 bp, Artificial Sequence
  Synthetic
atacgccatgctgggtctccgctggcggtggttggggttcttagccctgttcatcgtggccctcttcgggtgaactaaattcatctgttgcggcaaggtctggtgactcatcatcactggcgtacttgggagtcggccat

SEQ ID NO: 381114 - DNA, 140 bp, Artificial Sequence
  Synthetic
atggccgactcccaagtacgccagtgatgatgagtcaccagaccttgccgcaacagatgaatttagttcacccgaagagggccacgatgaacagggctaagaaccccaaccaccgccagcggagacccagcatggcgtat

SEQ ID NO: 381115 - DNA, 140 bp, Artificial Sequence
  Synthetic
atacgccatgctgggtctccaggaggttcccgccctccccgccccaggggtctccccgctgggtgaaaagggcccggccttgggaggcatggtggttactaaccccctggcagggttaaacgtacttgggagtcggccat

SEQ ID NO: 381116 - DNA, 140 bp, Artificial Sequence
  Synthetic
atggccgactcccaagtacgtttaaccctgccagggggttagtaaccaccatgcctcccaaggccgggcccttttcacccagcggggagacccctggggcggggagggcgggaacctcctggagacccagcatggcgtat

SEQ ID NO: 381117 - DNA, 140 bp, Artificial Sequence
  Synthetic
aggccctggctgctgatatgggcccggccttgggaggcatggtggttactaaccccctggcagggttaaagcctgatggtgctaatgcactgccactacggtggcgggtcgctaccttatgaccttttgggacagcggtg

SEQ ID NO: 381118 - DNA, 140 bp, Artificial Sequence
  Synthetic
caccgctgtcccaaaaggtcataaggtagcgacccgccaccgtagtggcagtgcattagcaccatcaggctttaaccctgccagggggttagtaaccaccatgcctcccaaggccgggcccatatcagcagccagggcct

SEQ ID NO: 381119 - DNA, 140 bp, Artificial Sequence
  Synthetic
aggccctggctgctgatatggggctgctcgcagagccctccccggatggggcacagtgcactgtgatctgaaggggtgcaccccggtaagagctcggcccgaaggccgggttctacttttgaccttttgggacagcggtg

SEQ ID NO: 381120 - DNA, 140 bp, Artificial Sequence
  Synthetic
caccgctgtcccaaaaggtcaaaagtagaacccggccttcgggccgagctcttaccggggtgcaccccttcagatcacagtgcactgtgccccatccggggagggctctgcgagcagccccatatcagcagccagggcct

SEQ ID NO: 381121 - DNA, 140 bp, Artificial Sequence
  Synthetic
atacgccatgctgggtctccgatgccagggttggtaggtcgtaaatcccggtcatcttggtagccactataggtgggtcttaagagaaggttaagaatcctcttgtgcctgcggcgagaccgtacttgggagtcggccat

SEQ ID NO: 381122 - DNA, 140 bp, Artificial Sequence
  Synthetic
atggccgactcccaagtacggtctcgccgcaggcacaagaggattcttaaccttctcttaagacccacctatagtggctaccaagatgaccgggatttacgacctaccaaccctggcatcggagacccagcatggcgtat

SEQ ID NO: 381123 - DNA, 140 bp, Artificial Sequence
  Synthetic
aggccctggctgctgatatgcgcgcacggtccacaggtgttggccctaccggtgttaataagggcccgacgtcaggctcgtcgttaaaccgagcccgtcacccacctgggcaaacgacgcgaccttttgggacagcggtg

SEQ ID NO: 381124 - DNA, 140 bp, Artificial Sequence
  Synthetic
caccgctgtcccaaaaggtcgcgtcgtttgcccaggtgggtgacgggctcggtttaacgacgagcctgacgtcgggcccttattaacaccggtagggccaacacctgtggaccgtgcgcgcatatcagcagccagggcct

SEQ ID NO: 381125 - DNA, 140 bp, Artificial Sequence
  Synthetic
aggccctggctgctgatatgccacgtacggtccacgtcgcccttcaatgcctctcttggccaataggtttatccggcgagttgacaaggaccagtgggggccgggggtcatggggaaggagaccttttgggacagcggtg

SEQ ID NO: 381126 - DNA, 140 bp, Artificial Sequence
  Synthetic
caccgctgtcccaaaaggtctccttccccatgacccccggcccccactggtccttgtcaactcgccggataaacctattggccaagagaggcattgaagggcgacgtggaccgtacgtggcatatcagcagccagggcct

SEQ ID NO: 381127 - DNA, 140 bp, Artificial Sequence
  Synthetic
aggccctggctgctgatatgccccggaccctgcccttcccggtgggccgggaaatgcatggggccacccagctccgcggcggcctgcagccggggtagcccaagaatccttcgggtgagggaccttttgggacagcggtg

SEQ ID NO: 381128 - DNA, 140 bp, Artificial Sequence
  Synthetic
caccgctgtcccaaaaggtccctcacccgaaggattcttgggctaccccggctgcaggccgccgcggagctgggtggccccatgcatttcccggcccaccgggaagggcagggtccggggcatatcagcagccagggcct

SEQ ID NO: 381129 - DNA, 140 bp, Artificial Sequence
  Synthetic
aggccctggctgctgatatggcgggtggcattctctttttctataccatcatggcagtccttctgctctttctcgtggtggaggcgggggccatcttggcccccgccacccatgcttgtcgaccttttgggacagcggtg

SEQ ID NO: 381130 - DNA, 140 bp, Artificial Sequence
  Synthetic
caccgctgtcccaaaaggtcgacaagcatgggtggcgggggccaagatggcccccgcctccaccacgagaaagagcagaaggactgccatgatggtatagaaaaagagaatgccacccgccatatcagcagccagggcct

SEQ ID NO: 381131 - DNA, 140 bp, Artificial Sequence
  Synthetic
aggccctggctgctgatatggagcgaatggacaatatttcctcacaaattgttgcgccccagaagacgttgggttctgcctggagggcggatgcctggtggctctgggttgcacgatttggaccttttgggacagcggtg

SEQ ID NO: 381132 - DNA, 140 bp, Artificial Sequence
  Synthetic
caccgctgtcccaaaaggtccaaatcgtgcaacccagagccaccaggcatccgccctccaggcagaacccaacgtcttctggggcgcaacaatttgtgaggaaatattgtccattcgctccatatcagcagccagggcct

SEQ ID NO: 381133 - DNA, 140 bp, Artificial Sequence
  Synthetic
aggccctggctgctgatatgtactgaccgctgctggccactgtatcaggcgggtttggctgtgcgacctggtaagtccgcggcccaactggtgggagagctggggagcctctatgggcccgaccttttgggacagcggtg

SEQ ID NO: 381134 - DNA, 140 bp, Artificial Sequence
  Synthetic
caccgctgtcccaaaaggtcgggcccatagaggctccccagctctcccaccagttgggccgcggacttaccaggtcgcacagccaaacccgcctgatacagtggccagcagcggtcagtacatatcagcagccagggcct

SEQ ID NO: 381135 - DNA, 140 bp, Artificial Sequence
  Synthetic
aggccctggctgctgatatgttgtcggtctcagcctacgtggctgggatcttgggtctaggtgaggtgtactctggcgtcctggcagttggcgtcgcgttgacgcgccgggtctacccgagaccttttgggacagcggtg

SEQ ID NO: 381136 - DNA, 140 bp, Artificial Sequence
  Synthetic
caccgctgtcccaaaaggtctcgggtagacccggcgcgtcaacgcgacgccaactgccaggacgccagagtacacctcacctagacccaagatcccagccacgtaggctgagaccgacaacatatcagcagccagggcct

SEQ ID NO: 381137 - DNA, 140 bp, Artificial Sequence
  Synthetic
aggccctggctgctgatatgtgcccaacctgacgtgtgcagttgaatgtaagctaaagtgggaaagtgagttttggagatggactgaacagctggcctccaactactggatcttggaatagaccttttgggacagcggtg

SEQ ID NO: 381138 - DNA, 140 bp, Artificial Sequence
  Synthetic
caccgctgtcccaaaaggtctattccaagatccagtagttggaggccagctgttcagtccatctccaaaactcactttcccactttagcttacattcaactgcacacgtcaggttgggcacatatcagcagccagggcct

SEQ ID NO: 381139 - DNA, 140 bp, Artificial Sequence
  Synthetic
aggccctggctgctgatatgcctctggaaagtcccgtttgatttctggaaaggtgtgatgagcctgaccccgttgctggtctgcgtagccgcgttgctcctgctcgagcaacggattgtcgaccttttgggacagcggtg

SEQ ID NO: 381140 - DNA, 140 bp, Artificial Sequence
  Synthetic
caccgctgtcccaaaaggtcgacaatccgttgctcgagcaggagcaacgcggctacgcagaccagcaacggggtcaggctcatcacacctttccagaaatcaaacgggactttccagaggcatatcagcagccagggcct

SEQ ID NO: 381141 - DNA, 140 bp, Artificial Sequence
  Synthetic
aggccctggctgctgatatgatggtcttcctgttggtgacgatggcggggatgtcgcaaggcgcccctgcctccgttctggggtctcgcccctttgactacgggttgacatggcagtcttgaccttttgggacagcggtg

SEQ ID NO: 381142 - DNA, 140 bp, Artificial Sequence
  Synthetic
caccgctgtcccaaaaggtcaagactgccatgtcaacccgtagtcaaaggggcgagaccccagaacggaggcaggggcgccttgcgacatccccgccatcgtcaccaacaggaagaccatcatatcagcagccagggcct

SEQ ID NO: 381143 - DNA, 140 bp, Artificial Sequence
  Synthetic
  misc_feature (81)..(81): n is a, c, g, or t
aggccctggctgctgatatggctcgtgccggtctaacggctcgcgcttgaccactggggagaaggtgtgggatcgggggantgtcacactgttgtgtgactgccccaatggtccttgggtgaccttttgggacagcggtg

SEQ ID NO: 381144 - DNA, 140 bp, Artificial Sequence
  Synthetic
  misc_feature (60)..(60): n is a, c, g, or t
caccgctgtcccaaaaggtcacccaaggaccattggggcagtcacacaacagtgtgacantcccccgatcccacaccttctccccagtggtcaagcgcgagccgttagaccggcacgagccatatcagcagccagggcct

SEQ ID NO: 381145 - DNA, 140 bp, Artificial Sequence
  Synthetic
aggccctggctgctgatatggtggttaccagccttttgccaggcaatcggctggggtgatcccattacccactggagccacggacaaaatcagtggcccctgtcatgccctcagtatgtcgaccttttgggacagcggtg

SEQ ID NO: 381146 - DNA, 140 bp, Artificial Sequence
  Synthetic
caccgctgtcccaaaaggtcgacatactgagggcatgacaggggccactgattttgtccgtggctccagtgggtaatgggatcaccccagccgattgcctggcaaaaggctggtaaccaccatatcagcagccagggcct

SEQ ID NO: 381147 - DNA, 140 bp, Artificial Sequence
  Synthetic
  misc_feature (116)..(116): n is a, c, g, or t
aggccctggctgctgatatgtacgggtctgcatcagtcacttgcgtatggggttccgcctcttggtttgcctccaccggagggcgcgattcaaagatcgacgtgtggagtttggtnccaggaccttttgggacagcggtg

SEQ ID NO: 381148 - DNA, 140 bp, Artificial Sequence
  Synthetic
  misc_feature (25)..(25): n is a, c, g, or t
caccgctgtcccaaaaggtcctggnaccaaactccacacgtcgatctttgaatcgcgccctccggtggaggcaaaccaagaggcggaaccccatacgcaagtgactgatgcagacccgtacatatcagcagccagggcct

SEQ ID NO: 381149 - DNA, 140 bp, Artificial Sequence
  Synthetic
aggccctggctgctgatatgttggctctgccacctgtaccatagccgcactcgggtcgtcggaccgcgatactgtggtggagctttccgagtggggggtcccgtgcgtgacgtgtgttctgaccttttgggacagcggtg

SEQ ID NO: 381150 - DNA, 140 bp, Artificial Sequence
  Synthetic
caccgctgtcccaaaaggtcagaacacacgtcacgcacgggaccccccactcggaaagctccaccacagtatcgcggtccgacgacccgagtgcggctatggtacaggtggcagagccaacatatcagcagccagggcct

SEQ ID NO: 381151 - DNA, 140 bp, Artificial Sequence
  Synthetic
aggccctggctgctgatatgggatcgtcggccggcttcgtgtggcacctgtgtgcgggactgttggcccgaaaccgggtcggtcagattccccttccatcggtgcggcacggggccacgggaccttttgggacagcggtg

SEQ ID NO: 381152 - DNA, 140 bp, Artificial Sequence
  Synthetic
caccgctgtcccaaaaggtcccgtggccccgtgccgcaccgatggaaggggaatctgaccgacccggtttcgggccaacagtcccgcacacaggtgccacacgaagccggccgacgatcccatatcagcagccagggcct

SEQ ID NO: 381153 - DNA, 140 bp, Artificial Sequence
  Synthetic
atacgccatgctgggtctccaaaccgggtcggtcagattccccttccatcggtgcggcacggggccacggctgacaaaggatttggaggctgtgcccttcgtcaacaggacaactcccttcgtacttgggagtcggccat

SEQ ID NO: 381154 - DNA, 140 bp, Artificial Sequence
  Synthetic
atggccgactcccaagtacgaagggagttgtcctgttgacgaagggcacagcctccaaatcctttgtcagccgtggccccgtgccgcaccgatggaaggggaatctgaccgacccggtttggagacccagcatggcgtat

SEQ ID NO: 381155 - DNA, 140 bp, Artificial Sequence
  Synthetic
atacgccatgctgggtctcccaccataaggggtcccctgggcaaccaggggagaggcaacccggtgcggtcgcccctgggttttgggtcctacaccatgaccaagatccgggataccctacgtacttgggagtcggccat

SEQ ID NO: 381156 - DNA, 140 bp, Artificial Sequence
  Synthetic
atggccgactcccaagtacgtagggtatcccggatcttggtcatggtgtaggacccaaaacccaggggcgaccgcaccgggttgcctctcccctggttgcccaggggaccccttatggtgggagacccagcatggcgtat

SEQ ID NO: 381157 - DNA, 140 bp, Artificial Sequence
  Synthetic
  misc_feature (34)..(34): n is a, c, g, or t
atacgccatgctgggtctcccggaagtgtctgangcattggggggggctggcctcacgggggggttctacgagcccctggtgcgcaggtgttcggagctgatgggacgccggaatccagtcgtacttgggagtcggccat

SEQ ID NO: 381158 - DNA, 140 bp, Artificial Sequence
  Synthetic
  misc_feature (107)..(107): n is a, c, g, or t
atggccgactcccaagtacgactggattccggcgtcccatcagctccgaacacctgcgcaccaggggctcgtagaacccccccgtgaggccagccccccccaatgcntcagacacttccgggagacccagcatggcgtat

SEQ ID NO: 381159 - DNA, 140 bp, Artificial Sequence
  Synthetic
aggccctggctgctgatatgctgcccggggtatgcatggctttcctcgggccggcctgacggattcatacatgttcagggacacctgcaggaggtcgatgctggcaacttcatccccccagaccttttgggacagcggtg

SEQ ID NO: 381160 - DNA, 140 bp, Artificial Sequence
  Synthetic
caccgctgtcccaaaaggtctggggggatgaagttgccagcatcgacctcctgcaggtgtccctgaacatgtatgaatccgtcaggccggcccgaggaaagccatgcataccccgggcagcatatcagcagccagggcct

SEQ ID NO: 381161 - DNA, 140 bp, Artificial Sequence
  Synthetic
atacgccatgctgggtctccgggtgaaccagctggcggtccttggactgccggctgtggacgccgccgtagcgggtgaggtttttgcgggtcctgccttgtcgtggtgcctgggcctccccgtacttgggagtcggccat

SEQ ID NO: 381162 - DNA, 140 bp, Artificial Sequence
  Synthetic
atggccgactcccaagtacggggaggcccaggcaccacgacaaggcaggacccgcaaaaacctcacccgctacggcggcgtccacagccggcagtccaaggaccgccagctggttcacccggagacccagcatggcgtat

SEQ ID NO: 381163 - DNA, 140 bp, Artificial Sequence
  Synthetic
aggccctggctgctgatatgcaccgttagcatgatactgggtctggcaaacctggtgttgtacttccggtggatggggcctcaacgcctcatgttccttgtgctgtggaagctcgctcgggaccttttgggacagcggtg

SEQ ID NO: 381164 - DNA, 140 bp, Artificial Sequence
  Synthetic
caccgctgtcccaaaaggtcccgagcgagcttccacagcacaaggaacatgaggcgttgaggccccatccaccggaagtacaacaccaggtttgccagacccagtatcatgctaacggtgcatatcagcagccagggcct

SEQ ID NO: 381165 - DNA, 140 bp, Artificial Sequence
  Synthetic
aggccctggctgctgatatgggagcgttcccgcttgctcttctgatggggatttcggcgacccgcgggcgcacctctgtgctcggggccgagttctgcttcgacgtcacgttcgaggtgggaccttttgggacagcggtg

SEQ ID NO: 381166 - DNA, 140 bp, Artificial Sequence
  Synthetic
caccgctgtcccaaaaggtcccacctcgaacgtgacgtcgaagcagaactcggccccgagcacagaggtgcgcccgcgggtcgccgaaatccccatcagaagagcaagcgggaacgctcccatatcagcagccagggcct

SEQ ID NO: 381167 - DNA, 140 bp, Artificial Sequence
  Synthetic
atacgccatgctgggtctccctatagaacgtggtgtaaggggtatcaggcgatacgtcagcgggtggttcggagccccctcggggaggggcgtcctaccaaacccctaacgttcgcttggcgtacttgggagtcggccat

SEQ ID NO: 381168 - DNA, 140 bp, Artificial Sequence
  Synthetic
atggccgactcccaagtacgccaagcgaacgttaggggtttggtaggacgcccctccccgagggggctccgaaccacccgctgacgtatcgcctgataccccttacaccacgttctatagggagacccagcatggcgtat

SEQ ID NO: 381169 - DNA, 140 bp, Artificial Sequence
  Synthetic
  misc_feature (92)..(92): n is a, c, g, or t
aggccctggctgctgatatgtgcttggcctcatacatctggccggacgctgtgatgatggtggtggtggccttggtcctcctctttggcctnttcgacgcgttggactgggccttggagggaccttttgggacagcggtg

SEQ ID NO: 381170 - DNA, 140 bp, Artificial Sequence
  Synthetic
  misc_feature (49)..(49): n is a, c, g, or t
caccgctgtcccaaaaggtccctccaaggcccagtccaacgcgtcgaanaggccaaagaggaggaccaaggccaccaccaccatcatcacagcgtccggccagatgtatgaggccaagcacatatcagcagccagggcct

SEQ ID NO: 381171 - DNA, 140 bp, Artificial Sequence
  Synthetic
aggccctggctgctgatatgagatcttggtatcccggccctcgttgcggcgattggcgcgggtggttgagtgctgtgtgatggctggtgagcgggccacaaccgtccggctggtctccaagaccttttgggacagcggtg

SEQ ID NO: 381172 - DNA, 140 bp, Artificial Sequence
  Synthetic
caccgctgtcccaaaaggtcttggagaccagccggacggttgtggcccgctcaccagccatcacacagcactcaaccacccgcgccaatcgccgcaacgagggccgggataccaagatctcatatcagcagccagggcct

SEQ ID NO: 381173 - DNA, 140 bp, Artificial Sequence
  Synthetic
aggccctggctgctgatatggatgtgtgcgagaggtgcctatttgttcgatcatatgggttctttttcgcgcgccgtcaaggagcgcttgctggagtgggacgcggctctggaaccattagaccttttgggacagcggtg

SEQ ID NO: 381174 - DNA, 140 bp, Artificial Sequence
  Synthetic
caccgctgtcccaaaaggtctaatggttccagagccgcgtcccactccagcaagcgctccttgacggcgcgcgaaaaagaacccatatgatcgaacaaataggcacctctcgcacacatccatatcagcagccagggcct

SEQ ID NO: 381175 - DNA, 140 bp, Artificial Sequence
  Synthetic
aggccctggctgctgatatgtcattcactaggacggactgtcgcatcataagagatgccgcgaggaccctgtcctgcgggcagtgcgtcatgggtttacccgtggtagcacgccgtggcggaccttttgggacagcggtg

SEQ ID NO: 381176 - DNA, 140 bp, Artificial Sequence
  Synthetic
caccgctgtcccaaaaggtccgccacggcgtgctaccacgggtaaacccatgacgcactgcccgcaggacagggtcctcgcggcatctcttatgatgcgacagtccgtcctagtgaatgacatatcagcagccagggcct

SEQ ID NO: 381177 - DNA, 140 bp, Artificial Sequence
  Synthetic
aggccctggctgctgatatgatgaggttctcataggcgtctttcaggatgtgaaccacttgcctcctgggtttgtcccgaccgcgccagttgtcatccgtcggtgcgggaagggcttcctgaccttttgggacagcggtg

SEQ ID NO: 381178 - DNA, 140 bp, Artificial Sequence
  Synthetic
caccgctgtcccaaaaggtcaggaagcccttcccgcaccgacggatgacaactggcgcggtcgggacaaacccaggaggcaagtggttcacatcctgaaagacgcctatgagaacctcatcatatcagcagccagggcct

SEQ ID NO: 381179 - DNA, 140 bp, Artificial Sequence
  Synthetic
aggccctggctgctgatatggggggtcacgaaggcagccttgacaggtcgggatcctgacttacatccagggaacgtcatggtgttggggacggcaacgtcgcgaagcatggggacgtgcgaccttttgggacagcggtg

SEQ ID NO: 381180 - DNA, 140 bp, Artificial Sequence
  Synthetic
caccgctgtcccaaaaggtcgcacgtccccatgcttcgcgacgttgccgtccccaacaccatgacgttccctggatgtaagtcaggatcccgacctgtcaaggctgccttcgtgaccccccatatcagcagccagggcct

SEQ ID NO: 381181 - DNA, 140 bp, Artificial Sequence
  Synthetic
aggccctggctgctgatatgctaaacggcttgctgttcacgactttccatggggcttcgtcccggactatcgccacacctgtgggggccctcaaccccaggtggtggtcggccagtgatggaccttttgggacagcggtg

SEQ ID NO: 381182 - DNA, 140 bp, Artificial Sequence
  Synthetic
caccgctgtcccaaaaggtccatcactggccgaccaccacctggggttgagggcccccacaggtgtggcgatagtccgggacgaagccccatggaaagtcgtgaacagcaagccgtttagcatatcagcagccagggcct

SEQ ID NO: 381183 - DNA, 140 bp, Artificial Sequence
  Synthetic
aggccctggctgctgatatgacgtcacggtgtacccactcccggatggggcaacctcgttgacaccctgcacatgccaggctgagtcctgttgggtcatccggtccgacggggctttatggaccttttgggacagcggtg

SEQ ID NO: 381184 - DNA, 140 bp, Artificial Sequence
  Synthetic
caccgctgtcccaaaaggtccataaagccccgtcggaccggatgacccaacaggactcagcctggcatgtgcagggtgtcaacgaggttgccccatccgggagtgggtacaccgtgacgtcatatcagcagccagggcct

SEQ ID NO: 381185 - DNA, 140 bp, Artificial Sequence
  Synthetic
aggccctggctgctgatatgtcatggcctgagtaagggggataaggtggagctggatgtagccatggaggtctcggacttccgtggttcctccggctcgcccgttctgtgcgacgagggggaccttttgggacagcggtg

SEQ ID NO: 381186 - DNA, 140 bp, Artificial Sequence
  Synthetic
caccgctgtcccaaaaggtccccctcgtcgcacagaacgggcgagccggaggaaccacggaagtccgagacctccatggctacatccagctccaccttatcccccttactcaggccatgacatatcagcagccagggcct

SEQ ID NO: 381187 - DNA, 140 bp, Artificial Sequence
  Synthetic
aggccctggctgctgatatgcacgcagtaggaatgctcgtgtcagtgcttcattctggtggcagggttaccgcggctcgattcaccaggccgtggacccaagttccaacggatgccaagagaccttttgggacagcggtg

SEQ ID NO: 381188 - DNA, 140 bp, Artificial Sequence
  Synthetic
caccgctgtcccaaaaggtctcttggcatccgttggaacttgggtccacggcctggtgaatcgagccgcggtaaccctgccaccagaatgaagcactgacacgagcattcctactgcgtgcatatcagcagccagggcct

SEQ ID NO: 381189 - DNA, 140 bp, Artificial Sequence
  Synthetic
aggccctggctgctgatatgccaccactgaaccccccccggtaccggcaaaaggagttttcaaggaggccccgttgtttatgcccacgggggcgggaaagagcacccgcgtaccgttggagaccttttgggacagcggtg

SEQ ID NO: 381190 - DNA, 140 bp, Artificial Sequence
  Synthetic
caccgctgtcccaaaaggtctccaacggtacgcgggtgctctttcccgcccccgtgggcataaacaacggggcctccttgaaaactccttttgccggtaccggggggggttcagtggtggcatatcagcagccagggcct

SEQ ID NO: 381191 - DNA, 140 bp, Artificial Sequence
  Synthetic
aggccctggctgctgatatggtacggcaacatgggccacaaagtcctgatcttgaacccgtcggtggccactgtgagggccatgggcccctacatggagcgcctggcgggcaaacacccagaccttttgggacagcggtg

SEQ ID NO: 381192 - DNA, 140 bp, Artificial Sequence
  Synthetic
caccgctgtcccaaaaggtctgggtgtttgcccgccaggcgctccatgtaggggcccatggccctcacagtggccaccgacgggttcaagatcaggactttgtggcccatgttgccgtaccatatcagcagccagggcct

SEQ ID NO: 381193 - DNA, 140 bp, Artificial Sequence
  Synthetic
aggccctggctgctgatatgagcatttactgtgggcacgatacaaccgccttcacgaggatcactgattcgccactcacgtattcaacttacgggaggtttttggccaaccctaggcagagaccttttgggacagcggtg

SEQ ID NO: 381194 - DNA, 140 bp, Artificial Sequence
  Synthetic
caccgctgtcccaaaaggtctctgcctagggttggccaaaaacctcccgtaagttgaatacgtgagtggcgaatcagtgatcctcgtgaaggcggttgtatcgtgcccacagtaaatgctcatatcagcagccagggcct

SEQ ID NO: 381195 - DNA, 140 bp, Artificial Sequence
  Synthetic
aggccctggctgctgatatgtgctgaggggtgtgtctgtggtcatctgtgatgagtgccacagtcatgactcaacggtgttgctggggattgggcgtgtcagggagctggcgcgtggatggaccttttgggacagcggtg

SEQ ID NO: 381196 - DNA, 140 bp, Artificial Sequence
  Synthetic
caccgctgtcccaaaaggtccatccacgcgccagctccctgacacgcccaatccccagcaacaccgttgagtcatgactgtggcactcatcacagatgaccacagacacacccctcagcacatatcagcagccagggcct

SEQ ID NO: 381197 - DNA, 140 bp, Artificial Sequence
  Synthetic
  misc_feature (110)..(110): n is a, c, g, or t
aggccctggctgctgatatgtggggtgcaattagtgctctacgccaccgccacgccgcccgggtcgcccatgacccagcatccctctatcattgagactaaattggatgngggagagatcgaccttttgggacagcggtg

SEQ ID NO: 381198 - DNA, 140 bp, Artificial Sequence
  Synthetic
  misc_feature (31)..(31): n is a, c, g, or t
caccgctgtcccaaaaggtcgatctctcccncatccaatttagtctcaatgatagagggatgctgggtcatgggcgacccgggcggcgtggcggtggcgtagagcactaattgcaccccacatatcagcagccagggcct

SEQ ID NO: 381199 - DNA, 140 bp, Artificial Sequence
  Synthetic
atacgccatgctgggtctcctttccgcgaggggggtcaatgccatagcctactacaggggtaaggacagttctatcattaaggatggagacctggttgtgtgcgcgacggacgcactatccgtacttgggagtcggccat

SEQ ID NO: 381200 - DNA, 140 bp, Artificial Sequence
  Synthetic
atggccgactcccaagtacggatagtgcgtccgtcgcgcacacaaccaggtctccatccttaatgatagaactgtccttacccctgtagtaggctatggcattgacccccctcgcggaaaggagacccagcatggcgtat

SEQ ID NO: 381201 - DNA, 140 bp, Artificial Sequence
  Synthetic
aggccctggctgctgatatgcaccgggtacaccgggaacttcgactctgttaccgactgtgggttggtggtggaggaggtcgtcgaggtgacccttgatcccaccattaccatctccctggaccttttgggacagcggtg

SEQ ID NO: 381202 - DNA, 140 bp, Artificial Sequence
  Synthetic
caccgctgtcccaaaaggtccagggagatggtaatggtgggatcaagggtcacctcgacgacctcctccaccaccaacccacagtcggtaacagagtcgaagttcccggtgtacccggtgcatatcagcagccagggcct

SEQ ID NO: 381203 - DNA, 140 bp, Artificial Sequence
  Synthetic
aggccctggctgctgatatgcggacagtgcctgcgtcggctgaactgtcgatgcaaaggcgaggacgcacaggtagaggcaggtccggacgctactactacgcgggggtcggtaaggctcgaccttttgggacagcggtg

SEQ ID NO: 381204 - DNA, 140 bp, Artificial Sequence
  Synthetic
caccgctgtcccaaaaggtcgagccttaccgacccccgcgtagtagtagcgtccggacctgcctctacctgtgcgtcctcgcctttgcatcgacagttcagccgacgcaggcactgtccgcatatcagcagccagggcct

SEQ ID NO: 381205 - DNA, 140 bp, Artificial Sequence
  Synthetic
aggccctggctgctgatatgccgctggggtggtgcgttctgggcctgtctggtcggcggtagaagctggagtgacctggtacggaatggaacctgacttgactgcaaacctgctgagactgaccttttgggacagcggtg

SEQ ID NO: 381206 - DNA, 140 bp, Artificial Sequence
  Synthetic
caccgctgtcccaaaaggtcagtctcagcaggtttgcagtcaagtcaggttccattccgtaccaggtcactccagcttctaccgccgaccagacaggcccagaacgcaccaccccagcggcatatcagcagccagggcct

SEQ ID NO: 381207 - DNA, 140 bp, Artificial Sequence
  Synthetic
aggccctggctgctgatatgatacgacgactgcccttacaccgcagccgtcgcagctgacattggagaagccgcggtgttcttcgcggggcttgccccgttgaggatgcatcctgatgtcgaccttttgggacagcggtg

SEQ ID NO: 381208 - DNA, 140 bp, Artificial Sequence
  Synthetic
caccgctgtcccaaaaggtcgacatcaggatgcatcctcaacggggcaagccccgcgaagaacaccgcggcttctccaatgtcagctgcgacggctgcggtgtaagggcagtcgtcgtatcatatcagcagccagggcct

SEQ ID NO: 381209 - DNA, 140 bp, Artificial Sequence
  Synthetic
aggccctggctgctgatatgagttgggcaaaagtacgcggcgtcaactggcccctcctggtgggtgttcagcggaccatgtgccgggaaacactgtctcccggtccatcggatgacccccgaccttttgggacagcggtg

SEQ ID NO: 381210 - DNA, 140 bp, Artificial Sequence
  Synthetic
caccgctgtcccaaaaggtcgggggtcatccgatggaccgggagacagtgtttcccggcacatggtccgctgaacacccaccaggaggggccagttgacgccgcgtacttttgcccaactcatatcagcagccagggcct

SEQ ID NO: 381211 - DNA, 140 bp, Artificial Sequence
  Synthetic
  misc_feature (45)..(45): n is a, c, g, or t
aggccctggctgctgatatgagtgggcaggtctgaagggcccaantcctgtcccactcctgctgaggtggggcaatgatttaccatcgaaggtggccggccatcacatagtggacgacctgaccttttgggacagcggtg

SEQ ID NO: 381212 - DNA, 140 bp, Artificial Sequence
  Synthetic
  misc_feature (96)..(96): n is a, c, g, or t
caccgctgtcccaaaaggtcaggtcgtccactatgtgatggccggccaccttcgatggtaaatcattgccccacctcagcaggagtgggacagganttgggcccttcagacctgcccactcatatcagcagccagggcct

SEQ ID NO: 381213 - DNA, 140 bp, Artificial Sequence
  Synthetic
aggccctggctgctgatatgggtccgtaggctcggagtggccgagggttatgtccgctgcgatgctgggccgatcttaatggtcggcctggctatcgcggggggaatgatctacgcgtcagaccttttgggacagcggtg

SEQ ID NO: 381214 - DNA, 140 bp, Artificial Sequence
  Synthetic
caccgctgtcccaaaaggtctgacgcgtagatcattccccccgcgatagccaggccgaccattaagatcggcccagcatcgcagcggacataaccctcggccactccgagcctacggacccatatcagcagccagggcct

SEQ ID NO: 381215 - DNA, 140 bp, Artificial Sequence
  Synthetic
aggccctggctgctgatatgtacaccgggtccttagtggtggtgacagactgggatgtgaaggggggtggcagccccctttatcggcatggagaccaggccacgccacagccggtcgtgcgaccttttgggacagcggtg

SEQ ID NO: 381216 - DNA, 140 bp, Artificial Sequence
  Synthetic
caccgctgtcccaaaaggtcgcacgaccggctgtggcgtggcctggtctccatgccgataaagggggctgccaccccccttcacatcccagtctgtcaccaccactaaggacccggtgtacatatcagcagccagggcct

SEQ ID NO: 381217 - DNA, 140 bp, Artificial Sequence
  Synthetic
aggccctggctgctgatatgaggtccccccggtagaccatcggccggggggggagtctgcgccatcggatgccaagacagtgacagatgcggtggcggccatccaggtggactgtgattggaccttttgggacagcggtg

SEQ ID NO: 381218 - DNA, 140 bp, Artificial Sequence
  Synthetic
caccgctgtcccaaaaggtccaatcacagtccacctggatggccgccaccgcatctgtcactgtcttggcatccgatggcgcagactccccccccggccgatggtctaccggggggacctcatatcagcagccagggcct

SEQ ID NO: 381219 - DNA, 140 bp, Artificial Sequence
  Synthetic
aggccctggctgctgatatggtcggtgatgaccctgtcgatcggggaagtcctgtccttggctcaggctaagacagccgaggcctacacagcgactgccaagtggcttgctggctgctatgaccttttgggacagcggtg

SEQ ID NO: 381220 - DNA, 140 bp, Artificial Sequence
  Synthetic
caccgctgtcccaaaaggtcatagcagccagcaagccacttggcagtcgctgtgtaggcctcggctgtcttagcctgagccaaggacaggacttccccgatcgacagggtcatcaccgaccatatcagcagccagggcct

SEQ ID NO: 381221 - DNA, 140 bp, Artificial Sequence
  Synthetic
aggccctggctgctgatatgacggggacgcgggccgtccccactgtttccattgttgacaagctcttcgccggaggatgggcggccgtggtcggtcactgccacagtgttatagctgcgggaccttttgggacagcggtg

SEQ ID NO: 381222 - DNA, 140 bp, Artificial Sequence
  Synthetic
caccgctgtcccaaaaggtcccgcagctataacactgtggcagtgaccgaccacggccgcccatcctccggcgaagagcttgtcaacaatggaaacagtggggacggcccgcgtccccgtcatatcagcagccagggcct

SEQ ID NO: 381223 - DNA, 140 bp, Artificial Sequence
  Synthetic
aggccctggctgctgatatgcggtggcagcctacggggcttcaaggagcccaccgttggcggccgcggcttcctacctgatggggttgggcgtgggaggcaacgcgcaaacccgcttggcgaccttttgggacagcggtg

SEQ ID NO: 381224 - DNA, 140 bp, Artificial Sequence
  Synthetic
caccgctgtcccaaaaggtcgccaagcgggtttgcgcgttgcctcccacgcccaaccccatcaggtaggaagccgcggccgccaacggtgggctccttgaagccccgtaggctgccaccgcatatcagcagccagggcct

SEQ ID NO: 381225 - DNA, 140 bp, Artificial Sequence
  Synthetic
  misc_feature (74)..(74): n is a, c, g, or t
  misc_feature (80)..(80): n is a, c, g, or t
  misc_feature (82)..(82): n is a, c, g, or t
aggccctggctgctgatatgttctgctctcctgctgggggccgcgggcaccgctctgggcactcctgtcgtggncttgancntggcgggtgcgttcatgggtggtgctagcgtctcgcctgaccttttgggacagcggtg

SEQ ID NO: 381226 - DNA, 140 bp, Artificial Sequence
  Synthetic
  misc_feature (59)..(59): n is a, c, g, or t
  misc_feature (61)..(61): n is a, c, g, or t
  misc_feature (67)..(67): n is a, c, g, or t
caccgctgtcccaaaaggtcaggcgagacgctagcaccacccatgaacgcacccgccangntcaagnccacgacaggagtgcccagagcggtgcccgcggcccccagcaggagagcagaacatatcagcagccagggcct

SEQ ID NO: 381227 - DNA, 140 bp, Artificial Sequence
  Synthetic
  misc_feature (74)..(74): n is a, c, g, or t
  misc_feature (80)..(80): n is a, c, g, or t
aggccctggctgctgatatgtccctggtcaccattttactgggggccgtgggaggttgggagggcgtcgtcaangcggcnagccttgtcttcgacttcatggcggggaaactctcttcaggaccttttgggacagcggtg

SEQ ID NO: 381228 - DNA, 140 bp, Artificial Sequence
  Synthetic
  misc_feature (61)..(61): n is a, c, g, or t
  misc_feature (67)..(67): n is a, c, g, or t
caccgctgtcccaaaaggtcctgaagagagtttccccgccatgaagtcgaagacaaggctngccgcnttgacgacgccctcccaacctcccacggcccccagtaaaatggtgaccagggacatatcagcagccagggcct

SEQ ID NO: 381229 - DNA, 140 bp, Artificial Sequence
  Synthetic
aggccctggctgctgatatgaagatctgtggtatgctatcccggtactgaccagtccgggggcgggcctcgcggggatcgccctagggttggttttgtattcagctaacaactctggcacgaccttttgggacagcggtg

SEQ ID NO: 381230 - DNA, 140 bp, Artificial Sequence
  Synthetic
caccgctgtcccaaaaggtcgtgccagagttgttagctgaatacaaaaccaaccctagggcgatccccgcgaggcccgcccccggactggtcagtaccgggatagcataccacagatcttcatatcagcagccagggcct

SEQ ID NO: 381231 - DNA, 140 bp, Artificial Sequence
  Synthetic
aggccctggctgctgatatgtaccacttggttgaaccgtctgctgacaacattgccgaggtcgtcgtgtatcccagacagttattttcagcaggccgattactgtgacaaggtctcagccgaccttttgggacagcggtg

SEQ ID NO: 381232 - DNA, 140 bp, Artificial Sequence
  Synthetic
caccgctgtcccaaaaggtcggctgagaccttgtcacagtaatcggcctgctgaaaataactgtctgggatacacgacgacctcggcaatgttgtcagcagacggttcaaccaagtggtacatatcagcagccagggcct

SEQ ID NO: 381233 - DNA, 140 bp, Artificial Sequence
  Synthetic
  misc_feature (50)..(50): n is a, c, g, or t
aggccctggctgctgatatggtgctccgacgcttgagcctcacccgcacngtggtggccctggtcaacagggagcctaaggtggatgaggtccaggtggggtacgtctgggacttgtggggaccttttgggacagcggtg

SEQ ID NO: 381234 - DNA, 140 bp, Artificial Sequence
  Synthetic
  misc_feature (91)..(91): n is a, c, g, or t
caccgctgtcccaaaaggtccccacaagtcccagacgtaccccacctggacctcatccaccttaggctccctgttgaccagggccaccacngtgcgggtgaggctcaagcgtcggagcaccatatcagcagccagggcct

SEQ ID NO: 381235 - DNA, 140 bp, Artificial Sequence
  Synthetic
aggccctggctgctgatatgagtggatcatgcgccaagtgcgcatggtaatggctaggcttcgggccctctgccccgtggtgtcactacctttgtggcattgcggggagggatggtccgggaccttttgggacagcggtg

SEQ ID NO: 381236 - DNA, 140 bp, Artificial Sequence
  Synthetic
caccgctgtcccaaaaggtcccggaccatccctccccgcaatgccacaaaggtagtgacaccacggggcagagggcccgaagcctagccattaccatgcgcacttggcgcatgatccactcatatcagcagccagggcct

SEQ ID NO: 381237 - DNA, 140 bp, Artificial Sequence
  Synthetic
aggccctggctgctgatatgagaatggttgttggacggtcatgttgagagtcgctgcctctgcggctgcgtgataactggtgatgttctgaatgggcaactcaaagaacctgtttactccgaccttttgggacagcggtg

SEQ ID NO: 381238 - DNA, 140 bp, Artificial Sequence
  Synthetic
caccgctgtcccaaaaggtcggagtaaacaggttctttgagttgcccattcagaacatcaccagttatcacgcagccgcagaggcagcgactctcaacatgaccgtccaacaaccattctcatatcagcagccagggcct

SEQ ID NO: 381239 - DNA, 140 bp, Artificial Sequence
  Synthetic
aggccctggctgctgatatgacaaagctgtgccgacattactggatggggacagtccctgtgaacatgctgggctacggtgaaacatcgcctctcctggcctctgacaccccgaaggtaggaccttttgggacagcggtg

SEQ ID NO: 381240 - DNA, 140 bp, Artificial Sequence
  Synthetic
caccgctgtcccaaaaggtcctaccttcggggtgtcagaggccaggagaggcgatgtttcaccgtagcccagcatgttcacagggactgtccccatccagtaatgtcggcacagctttgtcatatcagcagccagggcct

SEQ ID NO: 381241 - DNA, 140 bp, Artificial Sequence
  Synthetic
aggccctggctgctgatatgtacctttcgggacgtctggctgggctgaggtggtagtgacccctacccacgtggtaatcaggagaacttccgcctacaagttgttgcgccagcagatcctgaccttttgggacagcggtg

SEQ ID NO: 381242 - DNA, 140 bp, Artificial Sequence
  Synthetic
caccgctgtcccaaaaggtcaggatctgctggcgcaacaacttgtaggcggaagttctcctgattaccacgtgggtaggggtcactaccacctcagcccagccagacgtcccgaaaggtacatatcagcagccagggcct

SEQ ID NO: 381243 - DNA, 140 bp, Artificial Sequence
  Synthetic
aggccctggctgctgatatgatcggctgctgtagctgagccctattacgttgatggcatcccggtctcgtgggacgcggacgcacgagcgcccgccatggtctacggccccggacaaagtgaccttttgggacagcggtg

SEQ ID NO: 381244 - DNA, 140 bp, Artificial Sequence
  Synthetic
caccgctgtcccaaaaggtcactttgtccggggccgtagaccatggcgggcgctcgtgcgtccgcgtcccacgagaccgggatgccatcaacgtaatagggctcagctacagcagccgatcatatcagcagccagggcct

SEQ ID NO: 381245 - DNA, 140 bp, Artificial Sequence
  Synthetic
aggccctggctgctgatatggttaccattgacggggagcgctataccctgccgcaccaactgcggctcaggaatgtggcgccctctgaggtttcatccgaggtgtccatagacattgggagaccttttgggacagcggtg

SEQ ID NO: 381246 - DNA, 140 bp, Artificial Sequence
  Synthetic
caccgctgtcccaaaaggtctcccaatgtctatggacacctcggatgaaacctcagagggcgccacattcctgagccgcagttggtgcggcagggtatagcgctccccgtcaatggtaaccatatcagcagccagggcct

SEQ ID NO: 381247 - DNA, 140 bp, Artificial Sequence
  Synthetic
atacgccatgctgggtctccgcggctctccaggcaattgagaatgctgcgaggattctcgagccacacattgatgtcatcatggaggactgcagtacaccctctctctgtggtagtagcccgtacttgggagtcggccat

SEQ ID NO: 381248 - DNA, 140 bp, Artificial Sequence
  Synthetic
atggccgactcccaagtacgggctactaccacagagagagggtgtactgcagtcctccatgatgacatcaatgtgtggctcgagaatcctcgcagcattctcaattgcctggagagccgcggagacccagcatggcgtat

SEQ ID NO: 381249 - DNA, 140 bp, Artificial Sequence
  Synthetic
atacgccatgctgggtctccgagagatgcctgtgtggggagaagacatcccccgcactccatcgcctgcactaatctcggttacggagagcagctcagatgagaagaccccgtcggtgtccgtacttgggagtcggccat

SEQ ID NO: 381250 - DNA, 140 bp, Artificial Sequence
  Synthetic
atggccgactcccaagtacggacaccgacggggtcttctcatctgagctgctctccgtaaccgagattagtgcaggcgatggagtgcgggggatgtcttctccccacacaggcatctctcggagacccagcatggcgtat

SEQ ID NO: 381251 - DNA, 140 bp, Artificial Sequence
  Synthetic
aggccctggctgctgatatgctcctcgcaggaggataccccgtcctctgactcattcgaagtcatccaagagtctgagacagccgaaggggaggaaagtgtcttcaacgtggctctttccgaccttttgggacagcggtg

SEQ ID NO: 381252 - DNA, 140 bp, Artificial Sequence
  Synthetic
caccgctgtcccaaaaggtcggaaagagccacgttgaagacactttcctccccttcggctgtctcagactcttggatgacttcgaatgagtcagaggacggggtatcctcctgcgaggagcatatcagcagccagggcct

SEQ ID NO: 381253 - DNA, 140 bp, Artificial Sequence
  Synthetic
aggccctggctgctgatatggtattaaaagccttatttccacagagcgatgctacaaggaagctcactgtcaagatgtcttgctgtgttgagaagagcgtcacacgcttcttttctttaggaccttttgggacagcggtg

SEQ ID NO: 381254 - DNA, 140 bp, Artificial Sequence
  Synthetic
caccgctgtcccaaaaggtcctaaagaaaagaagcgtgtgacgctcttctcaacacagcaagacatcttgacagtgagcttccttgtagcatcgctctgtggaaataaggcttttaataccatatcagcagccagggcct

SEQ ID NO: 381255 - DNA, 140 bp, Artificial Sequence
  Synthetic
atacgccatgctgggtctcccaagatgtcttgctgtgttgagaagagcgtcacacgcttcttttctttagggttgacagtggctgacgtggctagcctgtgtgagatggaaatccagaaccgtacttgggagtcggccat

SEQ ID NO: 381256 - DNA, 140 bp, Artificial Sequence
  Synthetic
atggccgactcccaagtacggttctggatttccatctcacacaggctagccacgtcagccactgtcaaccctaaagaaaagaagcgtgtgacgctcttctcaacacagcaagacatcttgggagacccagcatggcgtat

SEQ ID NO: 381257 - DNA, 140 bp, Artificial Sequence
  Synthetic
  misc_feature (107)..(107): n is a, c, g, or t
aggccctggctgctgatatgcatacagcctattgtgacaaggtgcgcactccgcttgaattgcaggttgggtgcttggtgggcaatgaacttacctttgaatgtganaagtgtgaggctagaccttttgggacagcggtg

SEQ ID NO: 381258 - DNA, 140 bp, Artificial Sequence
  Synthetic
  misc_feature (34)..(34): n is a, c, g, or t
caccgctgtcccaaaaggtctagcctcacacttntcacattcaaaggtaagttcattgcccaccaagcacccaacctgcaattcaagcggagtgcgcaccttgtcacaataggctgtatgcatatcagcagccagggcct

SEQ ID NO: 381259 - DNA, 140 bp, Artificial Sequence
  Synthetic
aggccctggctgctgatatgggcaagagaccttggcttccttctcctacatctggtctggagtaccactgacgagggccacgccggccaaaccccctgtggtgaggccggtgggatccttgaccttttgggacagcggtg

SEQ ID NO: 381260 - DNA, 140 bp, Artificial Sequence
  Synthetic
caccgctgtcccaaaaggtcaaggatcccaccggcctcaccacagggggtttggccggcgtggccctcgtcagtggtactccagaccagatgtaggagaaggaagccaaggtctcttgcccatatcagcagccagggcct

SEQ ID NO: 381261 - DNA, 140 bp, Artificial Sequence
  Synthetic
aggccctggctgctgatatggttggtggctgacactactaaggtgtatgtcaccaacccagacaatgttgggaggagggtagacaaggtgaccttctggcgagcccctagggtccacgatgaccttttgggacagcggtg

SEQ ID NO: 381262 - DNA, 140 bp, Artificial Sequence
  Synthetic
caccgctgtcccaaaaggtcatcgtggaccctaggggctcgccagaaggtcaccttgtctaccctcctcccaacattgtctgggttggtgacatacaccttagtagtgtcagccaccaaccatatcagcagccagggcct

SEQ ID NO: 381263 - DNA, 140 bp, Artificial Sequence
  Synthetic
atacgccatgctgggtctccggaggagggtagacaaggtgaccttctggcgagcccctagggtccacgataaatacctcgtggattccatcgagcgagctaagagggcagctcaagcctgcgtacttgggagtcggccat

SEQ ID NO: 381264 - DNA, 140 bp, Artificial Sequence
  Synthetic
atggccgactcccaagtacgcaggcttgagctgccctcttagctcgctcgatggaatccacgaggtatttatcgtggaccctaggggctcgccagaaggtcaccttgtctaccctcctccggagacccagcatggcgtat

SEQ ID NO: 381265 - DNA, 140 bp, Artificial Sequence
  Synthetic
aggccctggctgctgatatgcttaagcatgggttacacttatgaggaggcaataaggactgttaggccacatgctgccatgggctggggatctaaggtgtcggtcaaggatctagccaccgaccttttgggacagcggtg

SEQ ID NO: 381266 - DNA, 140 bp, Artificial Sequence
  Synthetic
caccgctgtcccaaaaggtcggtggctagatccttgaccgacaccttagatccccagcccatggcagcatgtggcctaacagtccttattgcctcctcataagtgtaacccatgcttaagcatatcagcagccagggcct

SEQ ID NO: 381267 - DNA, 140 bp, Artificial Sequence
  Synthetic
atacgccatgctgggtctccatgctgccatgggctggggatctaaggtgtcggtcaaggatctagccacccctgcggggaagatggcggtccacgatcgacttcaggagatacttgaaggcgtacttgggagtcggccat

SEQ ID NO: 381268 - DNA, 140 bp, Artificial Sequence
  Synthetic
atggccgactcccaagtacgccttcaagtatctcctgaagtcgatcgtggaccgccatcttccccgcaggggtggctagatccttgaccgacaccttagatccccagcccatggcagcatggagacccagcatggcgtat

SEQ ID NO: 381269 - DNA, 140 bp, Artificial Sequence
  Synthetic
aggccctggctgctgatatggactccggtcccctttactcttactgtgaaaaaggaggtgttcttcaaagaccgtaaggaggagaaggccccccgcctcattgtgttcccccccctggacgaccttttgggacagcggtg

SEQ ID NO: 381270 - DNA, 140 bp, Artificial Sequence
  Synthetic
caccgctgtcccaaaaggtcgtccaggggggggaacacaatgaggcggggggccttctcctccttacggtctttgaagaacacctcctttttcacagtaagagtaaaggggaccggagtccatatcagcagccagggcct

SEQ ID NO: 381271 - DNA, 140 bp, Artificial Sequence
  Synthetic
aggccctggctgctgatatgtttcggatagctgaaaagcttatcttaggagatcccgggcgggtagccaaggcggtgttggggggggcctatgccttccagtacaccccaaaccagcgcggaccttttgggacagcggtg

SEQ ID NO: 381272 - DNA, 140 bp, Artificial Sequence
  Synthetic
caccgctgtcccaaaaggtccgcgctggtttggggtgtactggaaggcataggccccccccaacaccgccttggctacccgcccgggatctcctaagataagcttttcagctatccgaaacatatcagcagccagggcct

SEQ ID NO: 381273 - DNA, 140 bp, Artificial Sequence
  Synthetic
atacgccatgctgggtctcctgtgtggatgccacgtgcttcgacagtagcataactgaagaggacgtggcattggagacggaactatatgctctggcctccgaccatccagagtgggtgccgtacttgggagtcggccat

SEQ ID NO: 381274 - DNA, 140 bp, Artificial Sequence
  Synthetic
atggccgactcccaagtacggcacccactctggatggtcggaggccagagcatatagttccgtctccaatgccacgtcctcttcagttatgctactgtcgaagcacgtggcatccacacaggagacccagcatggcgtat

SEQ ID NO: 381275 - DNA, 140 bp, Artificial Sequence
  Synthetic
aggccctggctgctgatatggggccctggggaaatactatgcttctggtaccatggtgaccccggagggggtgccagtgggagagaggtactgtaggtcctcaggagtcttgaccactaggaccttttgggacagcggtg

SEQ ID NO: 381276 - DNA, 140 bp, Artificial Sequence
  Synthetic
caccgctgtcccaaaaggtcctagtggtcaagactcctgaggacctacagtacctctctcccactggcaccccctccggggtcaccatggtaccagaagcatagtatttccccagggccccatatcagcagccagggcct

SEQ ID NO: 381277 - DNA, 140 bp, Artificial Sequence
  Synthetic
aggccctggctgctgatatgtgcaagcaactgcctgacctgctatattaaggtgaaagccgcctgtgagagggtggggctgaaaaacgtctcactcctcatagctggcgatgactgtttggaccttttgggacagcggtg

SEQ ID NO: 381278 - DNA, 140 bp, Artificial Sequence
  Synthetic
caccgctgtcccaaaaggtccaaacagtcatcgccagctatgaggagtgagacgtttttcagccccaccctctcacaggcggctttcaccttaatatagcaggtcaggcagttgcttgcacatatcagcagccagggcct

SEQ ID NO: 381279 - DNA, 140 bp, Artificial Sequence
  Synthetic
aggccctggctgctgatatgatcatatgcgaacggccagtgtgcgatcctagcgacgccttgggcagagccctggcgagctatgggtatgcgtgcgagccttcgtatcatgcatcattgggaccttttgggacagcggtg

SEQ ID NO: 381280 - DNA, 140 bp, Artificial Sequence
  Synthetic
caccgctgtcccaaaaggtcccaatgatgcatgatacgaaggctcgcacgcatacccatagctcgccagggctctgcccaaggcgtcgctaggatcgcacactggccgttcgcatatgatcatatcagcagccagggcct

SEQ ID NO: 381281 - DNA, 140 bp, Artificial Sequence
  Synthetic
aggccctggctgctgatatgacacggctcccttctgctccacttggcttgctgagtgcaacgcggatgggaaacgccatttcttcctgaccacggactttcggaggccactcgctcgcatgaccttttgggacagcggtg

SEQ ID NO: 381282 - DNA, 140 bp, Artificial Sequence
  Synthetic
caccgctgtcccaaaaggtcatgcgagcgagtggcctccgaaagtccgtggtcaggaagaaatggcgtttcccatccgcgttgcactcagcaagccaagtggagcagaagggagccgtgtcatatcagcagccagggcct

SEQ ID NO: 381283 - DNA, 140 bp, Artificial Sequence
  Synthetic
aggccctggctgctgatatggtcgagtgagtacagtgacccgatggcctcggccatcggttacatcctcctatacccttggcaccccatcacacggtgggtcatcatcccgcacgtgctcgaccttttgggacagcggtg

SEQ ID NO: 381284 - DNA, 140 bp, Artificial Sequence
  Synthetic
caccgctgtcccaaaaggtcgagcacgtgcgggatgatgacccaccgtgtgatggggtgccaagggtataggaggatgtaaccgatggccgaggccatcgggtcactgtactcactcgaccatatcagcagccagggcct

SEQ ID NO: 381285 - DNA, 140 bp, Artificial Sequence
  Synthetic
aggccctggctgctgatatgacatgcgcgtttaggggtggtggcacaccgtctgatcctgtgtggtgtcaagttcatggtaactactacaagtttccactggacaaactgcccaacatcagaccttttgggacagcggtg

SEQ ID NO: 381286 - DNA, 140 bp, Artificial Sequence
  Synthetic
caccgctgtcccaaaaggtctgatgttgggcagtttgtccagtggaaacttgtagtagttaccatgaacttgacaccacacaggatcagacggtgtgccaccacccctaaacgcgcatgtcatatcagcagccagggcct

SEQ ID NO: 381287 - DNA, 140 bp, Artificial Sequence
  Synthetic
aggccctggctgctgatatgtcgtggccctccacggaccagcagcgttgagggttaccgcagacacaactaaaacaaaaatggaggctggtaaggtgctgagcgacctcaagctccctgggaccttttgggacagcggtg

SEQ ID NO: 381288 - DNA, 140 bp, Artificial Sequence
  Synthetic
caccgctgtcccaaaaggtcccagggagcttgaggtcgctcagcaccttaccagcctccatttttgttttagttgtgtctgcggtaaccctcaacgctgctggtccgtggagggccacgacatatcagcagccagggcct

SEQ ID NO: 381289 - DNA, 140 bp, Artificial Sequence
  Synthetic
aggccctggctgctgatatgcctagcggtccaccgaaagaaggctggagcactgcgcacgcgcatgctccggtcgcgcggttgggccgagttggctaggggactgttgtggcatccaggcgaccttttgggacagcggtg

SEQ ID NO: 381290 - DNA, 140 bp, Artificial Sequence
  Synthetic
caccgctgtcccaaaaggtcgcctggatgccacaacagtcccctagccaactcggcccaaccgcgcgaccggagcatgcgcgtgcgcagtgctccagccttctttcggtggaccgctaggcatatcagcagccagggcct

SEQ ID NO: 381291 - DNA, 140 bp, Artificial Sequence
  Synthetic
aggccctggctgctgatatgctgcggcttcctccccccgagattgctggtatcccgggggggtttcccctctcccccccctatatgggggtggttcatcaattggattttacaagccagagaccttttgggacagcggtg

SEQ ID NO: 381292 - DNA, 140 bp, Artificial Sequence
  Synthetic
caccgctgtcccaaaaggtctctggcttgtaaaatccaattgatgaaccacccccatataggggggggagaggggaaacccccccgggataccagcaatctcggggggaggaagccgcagcatatcagcagccagggcct

SEQ ID NO: 381293 - DNA, 140 bp, Artificial Sequence
  Synthetic
aggccctggctgctgatatgaggtggtggatgggtgatgccagggttggtaggtcgtaaatcccggtcatcttggtagccactataggtgggtcttaagagaaggttaagaatcctcttggaccttttgggacagcggtg

SEQ ID NO: 381294 - DNA, 140 bp, Artificial Sequence
  Synthetic
caccgctgtcccaaaaggtccaagaggattcttaaccttctcttaagacccacctatagtggctaccaagatgaccgggatttacgacctaccaaccctggcatcacccatccaccacctcatatcagcagccagggcct

SEQ ID NO: 381295 - DNA, 140 bp, Artificial Sequence
  Synthetic
aggccctggctgctgatatgtccgggataccctacatctggtgaaatgtcccacaccagccattgagcctcccaccgggacgttcgggttcttccctggagtgccacccctcaacaactggaccttttgggacagcggtg

SEQ ID NO: 381296 - DNA, 140 bp, Artificial Sequence
  Synthetic
caccgctgtcccaaaaggtccagttgttgaggggtggcactccagggaagaacccgaacgtcccggtgggaggctcaatggctggtgtgggacatttcaccagatgtagggtatcccggacatatcagcagccagggcct

SEQ ID NO: 381297 - DNA, 140 bp, Artificial Sequence
  Synthetic
  misc_feature (46)..(46): n is a, c, g, or t
aggccctggctgctgatatgtgctgttgggcacggaagtgtctgangcattggggggggctggcctcacgggggggttctacgagcccctggtgcgcaggtgttcggagctgatgggacggaccttttgggacagcggtg

SEQ ID NO: 381298 - DNA, 140 bp, Artificial Sequence
  Synthetic
  misc_feature (95)..(95): n is a, c, g, or t
caccgctgtcccaaaaggtccgtcccatcagctccgaacacctgcgcaccaggggctcgtagaacccccccgtgaggccagccccccccaatgcntcagacacttccgtgcccaacagcacatatcagcagccagggcct

SEQ ID NO: 381299 - DNA, 140 bp, Artificial Sequence
  Synthetic
  misc_feature (119)..(119): n is a, c, g, or t
atacgccatgctgggtctcccacctgcaggaggtcgatgctggcaacttcatccccccaccacgctggttgctcctggattttgtattcgtcctgttatacctgatgaagchggcggangcgtacttgggagtcggccat

SEQ ID NO: 381300 - DNA, 140 bp, Artificial Sequence
  Synthetic
  misc_feature (22)..(22): n is a, c, g, or t
atggccgactcccaagtacgcntccgcchgcttcatcaggtataacaggacgaatacaaaatccaggagcaaccagcgtggtggggggatgaagttgccagcatcgacctcctgcaggtgggagacccagcatggcgtat

SEQ ID NO: 381301 - DNA, 140 bp, Artificial Sequence
  Synthetic
  misc_feature (25)..(25): n is a, c, g, or t
  misc_feature (31)..(31): n is a, c, g, or t
  misc_feature (37)..(37): n is a, c, g, or t
aggccctggctgctgatatgctganctcacngctgcngtggtggtgggtgaaccagctggcggtccttggactgccggctgtggacgccgccgtagcgggtgaggtttttgcgggtcctggaccttttgggacagcggtg

SEQ ID NO: 381302 - DNA, 140 bp, Artificial Sequence
  Synthetic
  misc_feature (104)..(104): n is a, c, g, or t
  misc_feature (110)..(110): n is a, c, g, or t
  misc_feature (116)..(116): n is a, c, g, or t
caccgctgtcccaaaaggtccaggacccgcaaaaacctcacccgctacggcggcgtccacagccggcagtccaaggaccgccagctggttcacccaccaccacngcagcngtgagntcagcatatcagcagccagggcct

SEQ ID NO: 381303 - DNA, 140 bp, Artificial Sequence
  Synthetic
atacgccatgctgggtctccggtggacacttcggtgttgggctgggtggtggccagtgtggtagcttgggccatagctctcctgagctccatgagcgcgggggggtggaagcacaaagcccgtacttgggagtcggccat

SEQ ID NO: 381304 - DNA, 140 bp, Artificial Sequence
  Synthetic
atggccgactcccaagtacgggctttgtgcttccacccccccgcgctcatggagctcaggagagctatggcccaagctaccacactggccaccacccagcccaacaccgaagtgtccaccggagacccagcatggcgtat

SEQ ID NO: 381305 - DNA, 140 bp, Artificial Sequence
  Synthetic
aggccctggctgctgatatggatctatagaacgtggtgtaaggggtatcaggcgatacgtcagcgggtggttcggagccccctcggggaggggcgtcctaccaaacccctaacgttcgctgaccttttgggacagcggtg

SEQ ID NO: 381306 - DNA, 140 bp, Artificial Sequence
  Synthetic
caccgctgtcccaaaaggtcagcgaacgttaggggtttggtaggacgcccctccccgagggggctccgaaccacccgctgacgtatcgcctgataccccttacaccacgttctatagatccatatcagcagccagggcct

SEQ ID NO: 381307 - DNA, 140 bp, Artificial Sequence
  Synthetic
  misc_feature (26)..(26): n is a, c, g, or t
aggccctggctgctgatatgcggagngcgaacgcttggccggccagttttccgcgaggggggtcaatgccatagcctactacaggggtaaggacagttctatcattaaggatggagacctgaccttttgggacagcggtg

SEQ ID NO: 381308 - DNA, 140 bp, Artificial Sequence
  Synthetic
  misc_feature (115)..(115): n is a, c, g, or t
caccgctgtcccaaaaggtcaggtctccatccttaatgatagaactgtccttacccctgtagtaggctatggcattgacccccctcgcggaaaactggccggccaagcgttcgcnctccgcatatcagcagccagggcct

SEQ ID NO: 381309 - DNA, 140 bp, Artificial Sequence
  Synthetic
  misc_feature (111)..(111): n is a, c, g, or t
  misc_feature (118)..(118): n is a, c, g, or t
atacgccatgctgggtctccgcgctataccctgccgcaccaactgcggctcaggaatgtggcgccctctgaggtttcatccgaggtgtccatagacattgggacggagacngaagacncacgtacttgggagtcggccat

SEQ ID NO: 381310 - DNA, 140 bp, Artificial Sequence
  Synthetic
  misc_feature (23)..(23): n is a, c, g, or t
  misc_feature (30)..(30): n is a, c, g, or t
atggccgactcccaagtacgtgngtcttcngtctccgtcccaatgtctatggacacctcggatgaaacctcagagggcgccacattcctgagccgcagttggtgcggcagggtatagcgcggagacccagcatggcgtat

SEQ ID NO: 381311 - DNA, 140 bp, Artificial Sequence
  Synthetic
  misc_feature (22)..(22): n is a, c, g, or t
aggccctggctgctgatatganttgccaccagcggctgcggctctccaggcaattgagaatgctgcgaggattctcgagccacacattgatgtcatcatggaggactgcagtacaccctcgaccttttgggacagcggtg

SEQ ID NO: 381312 - DNA, 140 bp, Artificial Sequence
  Synthetic
  misc_feature (119)..(119): n is a, c, g, or t
caccgctgtcccaaaaggtcgagggtgtactgcagtcctccatgatgacatcaatgtgtggctcgagaatcctcgcagcattctcaattgcctggagagccgcagccgctggtggcaantcatatcagcagccagggcct

SEQ ID NO: 381313 - DNA, 140 bp, Artificial Sequence
  Synthetic
  misc_feature (118)..(118): n is a, c, g, or t
atacgccatgctgggtctccgatcccgggcgggtagccaaggcggtgttggggggggcctatgccttccagtacaccccaaaccagcgcgttagggagatgctcaagctatgggaghnaacgtacttgggagtcggccat

SEQ ID NO: 381314 - DNA, 140 bp, Artificial Sequence
  Synthetic
  misc_feature (23)..(23): n is a, c, g, or t
atggccgactcccaagtacgttnhctcccatagcttgagcatctccctaacgcgctggtttggggtgtactggaaggcataggccccccccaacaccgccttggctacccgcccgggatcggagacccagcatggcgtat

SEQ ID NO: 381315 - DNA, 140 bp, Artificial Sequence
  Synthetic
  misc_feature (22)..(22): n is a, c, g, or t
  misc_feature (24)..(24): n is a, c, g, or t
  misc_feature (31)..(31): n is a, c, g, or t
aggccctggctgctgatatganancaccatncgccatctgtgtggatgccacgtgcttcgacagtagcataactgaagaggacgtggcattggagacggaactatatgctctggcctccggaccttttgggacagcggtg

SEQ ID NO: 381316 - DNA, 140 bp, Artificial Sequence
  Synthetic
  misc_feature (110)..(110): n is a, c, g, or t
  misc_feature (117)..(117): n is a, c, g, or t
  misc_feature (119)..(119): n is a, c, g, or t
caccgctgtcccaaaaggtccggaggccagagcatatagttccgtctccaatgccacgtcctcttcagttatgctactgtcgaagcacgtggcatccacacagatggcgnatggtgntntcatatcagcagccagggcct

SEQ ID NO: 381317 - DNA, 140 bp, Artificial Sequence
  Synthetic
  misc_feature (118)..(118): n is a, c, g, or t
atacgccatgctgggtctccttttacaagccagaggagtcgctggcggtggttggggttcttagccctgctcatcgtagccctcttcgggtgaactaaattcatctgttgcggcaagntccgtacttgggagtcggccat

SEQ ID NO: 381318 - DNA, 140 bp, Artificial Sequence
  Synthetic
  misc_feature (23)..(23): n is a, c, g, or t
atggccgactcccaagtacggancttgccgcaacagatgaatttagttcacccgaagagggctacgatgagcagggctaagaaccccaaccaccgccagcgactcctctggcttgtaaaaggagacccagcatggcgtat

SEQ ID NO: 381319 - DNA, 140 bp, Artificial Sequence
  Synthetic
aggccctggctgctgatatggggtctccccgctgggtaaaaagggcccggccttgggaggcatggtggttactaaccccctggcagggtcaaagcctgatggtgctaatgcactgccactgaccttttgggacagcggtg

SEQ ID NO: 381320 - DNA, 140 bp, Artificial Sequence
  Synthetic
caccgctgtcccaaaaggtcagtggcagtgcattagcaccatcaggctttgaccctgccagggggttagtaaccaccatgcctcccaaggccgggccctttttacccagcggggagaccccatatcagcagccagggcct

SEQ ID NO: 381321 - DNA, 140 bp, Artificial Sequence
  Synthetic
atacgccatgctgggtctcctgctaatgcactgccacttcggtggcgggtcgctaccttatagcgtaatccgtgactacgggctgctcgcagagccctccccggatggggcacagtgcaccgtacttgggagtcggccat

SEQ ID NO: 381322 - DNA, 140 bp, Artificial Sequence
  Synthetic
atggccgactcccaagtacggtgcactgtgccccatccggggagggctctgcgagcagcccgtagtcacggattacgctataaggtagcgacccgccaccgaagtggcagtgcattagcaggagacccagcatggcgtat

SEQ ID NO: 381323 - DNA, 140 bp, Artificial Sequence
  Synthetic
atacgccatgctgggtctcccccccccccggcactgggtgcaagccccagaaaccgacgcctactaaagcaggcattaaggcctcgcgccgaaccggcgaccggccaaaaggtggtggatcgtacttgggagtcggccat

SEQ ID NO: 381324 - DNA, 140 bp, Artificial Sequence
  Synthetic
atggccgactcccaagtacgatccaccaccttttggccggtcgccggttcggcgcgaggccttaatgcctgctttagtaggcgtcggtttctggggcttgcacccagtgccgggggggggggagacccagcatggcgtat

SEQ ID NO: 381325 - DNA, 140 bp, Artificial Sequence
  Synthetic
atacgccatgctgggtctccctataggtgggtcttaaggggaggctacagtccctctattgcccgtggcgggaacgcgcacggtccacaggtgttggccctaccggtgtgaataagggcccgtacttgggagtcggccat

SEQ ID NO: 381326 - DNA, 140 bp, Artificial Sequence
  Synthetic
atggccgactcccaagtacgggcccttattcacaccggtagggccaacacctgtggaccgtgcgcgttcccgccacgggcaatagagggactgtagcctccccttaagacccacctatagggagacccagcatggcgtat

SEQ ID NO: 381327 - DNA, 140 bp, Artificial Sequence
  Synthetic
aggccctggctgctgatatgggaacgcgcacggtccacaggtgttggccctaccggtgtgaataagggcccgacgtcaggctcgtcgtaaaaccgagcccgttgtctccctgggcaaacggaccttttgggacagcggtg

SEQ ID NO: 381328 - DNA, 140 bp, Artificial Sequence
  Synthetic
caccgctgtcccaaaaggtccgtttgcccagggagacaacgggctcggttttacgacgagcctgacgtcgggcccttattcacaccggtagggccaacacctgtggaccgtgcgcgttcccatatcagcagccagggcct

SEQ ID NO: 381329 - DNA, 140 bp, Artificial Sequence
  Synthetic
atacgccatgctgggtctccacgcccacgtacggctcacgtcgcccttcaatgtctctcttgaccaataggcttagccggcgagttgacaagagccagtgggggccgggggtgagggggacgtacttgggagtcggccat

SEQ ID NO: 381330 - DNA, 140 bp, Artificial Sequence
  Synthetic
atggccgactcccaagtacgtccccctcacccccggcccccactggctcttgtcaactcgccggctaagcctattggtcaagagagacattgaagggcgacgtgagccgtacgtgggcgtggagacccagcatggcgtat

SEQ ID NO: 381331 - DNA, 140 bp, Artificial Sequence
  Synthetic
atacgccatgctgggtctcctggaccccccaccctgcccttcccgggagagcgggaaatgcatggggccacccagctccgcggcggcctgcagccggggtagcccaagaaccttcgggtgcgtacttgggagtcggccat

SEQ ID NO: 381332 - DNA, 140 bp, Artificial Sequence
  Synthetic
atggccgactcccaagtacgcacccgaaggttcttgggctaccccggctgcaggccgccgcggagctgggtggccccatgcatttcccgctctcccgggaagggcagggtggggggtccaggagacccagcatggcgtat

SEQ ID NO: 381333 - DNA, 140 bp, Artificial Sequence
  Synthetic
atacgccatgctgggtctccagggcgggtggcattttcttttcctgtaccaatcatggcagtccttctgctccttctcgtggcggaggccggggccattttggccccggccacccacgctcgtacttgggagtcggccat

SEQ ID NO: 381334 - DNA, 140 bp, Artificial Sequence
  Synthetic
atggccgactcccaagtacgagcgtgggtggccggggccaaaatggccccggcctccgccacgagaaggagcagaaggactgccatgattggtacaggaaaagaaaatgccacccgccctggagacccagcatggcgtat

SEQ ID NO: 381335 - DNA, 140 bp, Artificial Sequence
  Synthetic
atacgccatgctgggtctcctgtgaggcgcatgggcaatatttcctcacgaattgctgtgccatggaggacatagggttctgcctcgaaggtggatgccttgtggccttagggtgcacaacgtacttgggagtcggccat

SEQ ID NO: 381336 - DNA, 140 bp, Artificial Sequence
  Synthetic
atggccgactcccaagtacgttgtgcaccctaaggccacaaggcatccaccttcgaggcagaaccctatgtcctccatggcacagcaattcgtgaggaaatattgcccatgcgcctcacaggagacccagcatggcgtat

SEQ ID NO: 381337 - DNA, 140 bp, Artificial Sequence
  Synthetic
atacgccatgctgggtctcctttgtaccgaccgatgctggccactgtatcaggcgggattggccgtgcggcccggcaagtccgctgcccagctggtgggcgaactgggtggcctctacggcgtacttgggagtcggccat

SEQ ID NO: 381338 - DNA, 140 bp, Artificial Sequence
  Synthetic
atggccgactcccaagtacgccgtagaggccacccagttcgcccaccagctgggcagcggacttgccgggccgcacggccaatcccgcctgatacagtggccagcatcggtcggtacaaaggagacccagcatggcgtat

SEQ ID NO: 381339 - DNA, 140 bp, Artificial Sequence
  Synthetic
atacgccatgctgggtctccgcccttatcggtgtcggcctacgtggctggcatcttagggcttggagaggtctactcgggggtccttaccgtgggcgttgcgttgacgcgcagggtctaccgtacttgggagtcggccat

SEQ ID NO: 381340 - DNA, 140 bp, Artificial Sequence
  Synthetic
atggccgactcccaagtacggtagaccctgcgcgtcaacgcaacgcccacggtaaggacccccgagtagacctctccaagccctaagatgccagccacgtaggccgacaccgataagggcggagacccagcatggcgtat

SEQ ID NO: 381341 - DNA, 140 bp, Artificial Sequence
  Synthetic
atacgccatgctgggtctccccggtcccgaatctgacttgcgctgtggagtgtgaattgaagtgggagagtgagttttggagatggactgagcagctggcctccaattactggattctggcgtacttgggagtcggccat

SEQ ID NO: 381342 - DNA, 140 bp, Artificial Sequence
  Synthetic
atggccgactcccaagtacgccagaatccagtaattggaggccagctgctcagtccatctccaaaactcactctcccacttcaattcacactccacagcgcaagtcagattcgggaccggggagacccagcatggcgtat

SEQ ID NO: 381343 - DNA, 140 bp, Artificial Sequence
  Synthetic
atacgccatgctgggtctccaatatctctggaaggttcctttcgacttctggcggggcgtgatgagcctgacccccttgttggtgtgcgtggcggcccttctcctgcttgagcaacggatcgtacttgggagtcggccat

SEQ ID NO: 381344 - DNA, 140 bp, Artificial Sequence
  Synthetic
atggccgactcccaagtacgatccgttgctcaagcaggagaagggccgccacgcacaccaacaagggggtcaggctcatcacgccccgccagaagtcgaaaggaaccttccagagatattggagacccagcatggcgtat

SEQ ID NO: 381345 - DNA, 140 bp, Artificial Sequence
  Synthetic
atacgccatgctgggtctcctgtcatggtcttcctcctggtcactatggcgggcatgtcgcaaggcgcgcccgcttcagtgctggggtcccggccttttgagccggggttgacatggcagcgtacttgggagtcggccat

SEQ ID NO: 381346 - DNA, 140 bp, Artificial Sequence
  Synthetic
atggccgactcccaagtacgctgccatgtcaaccccggctcaaaaggccgggaccccagcactgaagcgggcgcgccttgcgacatgcccgccatagtgaccaggaggaagaccatgacaggagacccagcatggcgtat

SEQ ID NO: 381347 - DNA, 140 bp, Artificial Sequence
  Synthetic
atacgccatgctgggtctcctcctgttcgtgcaggtcgaatgggtcccgcgtgcctacgggggagaaggtttgggagcgtgggaacgtctcactgttgtgtgactgccccaacggtccctcgtacttgggagtcggccat

SEQ ID NO: 381348 - DNA, 140 bp, Artificial Sequence
  Synthetic
atggccgactcccaagtacgagggaccgttggggcagtcacacaacagtgagacgttcccacgctcccaaaccttctcccccgtaggcacgcgggacccattcgacctgcacgaacaggaggagacccagcatggcgtat

SEQ ID NO: 381349 - DNA, 140 bp, Artificial Sequence
  Synthetic
atacgccatgctgggtctccgggtgtggcttccagccttttgccaagcagttggctggggtgaccctatcacgcattggggccacggtcaaaatcagtggcccctatcttgtccccagtacgtacttgggagtcggccat

SEQ ID NO: 381350 - DNA, 140 bp, Artificial Sequence
  Synthetic
atggccgactcccaagtacgtactggggacaagataggggccactgattttgaccgtggccccaatgcgtgatagggtcaccccagccaactgcttggcaaaaggctggaagccacacccggagacccagcatggcgtat

SEQ ID NO: 381351 - DNA, 140 bp, Artificial Sequence
  Synthetic
atacgccatgctgggtctcctgtctatggttccgtttcagtgacttgcgtttggggttccgtgtcttggtttgcctccacgggtggccgcgactccaagatcgacgtgtggagtttggttcgtacttgggagtcggccat

SEQ ID NO: 381352 - DNA, 140 bp, Artificial Sequence
  Synthetic
atggccgactcccaagtacgaaccaaactccacacgtcgatcttggagtcgcggccacccgtggaggcaaaccaagacacggaaccccaaacgcaagtcactgaaacggaaccatagacaggagacccagcatggcgtat

SEQ ID NO: 381353 - DNA, 140 bp, Artificial Sequence
  Synthetic
atacgccatgctgggtctccccagttggctcagccagctgtaccatagccgcactgggatcgtcagatcgcgacgccgtgccggagctttccgagtgggggattccttgcgctacctgcacgtacttgggagtcggccat

SEQ ID NO: 381354 - DNA, 140 bp, Artificial Sequence
  Synthetic
atggccgactcccaagtacgtgcaggtagcgcaaggaatcccccactcggaaagctccggcacggcgtcgcgatctgacgatcccagtgcggctatggtacagctggctgagccaactggggagacccagcatggcgtat

SEQ ID NO: 381355 - DNA, 140 bp, Artificial Sequence
  Synthetic
atacgccatgctgggtctccttctggaccgtcggccttcctcgtgcggcacctgtgtgagggactgctggcccgagaccgggtcggtgaggttcccattccatcggtgtggcgcgggtcccgtacttgggagtcggccat

SEQ ID NO: 381356 - DNA, 140 bp, Artificial Sequence
  Synthetic
atggccgactcccaagtacgggacccgcgccacaccgatggaatgggaacctcaccgacccggtctcgggccagcagtccctcacacaggtgccgcacgaggaaggccgacggtccagaaggagacccagcatggcgtat

SEQ ID NO: 381357 - DNA, 140 bp, Artificial Sequence
  Synthetic
atacgccatgctgggtctcccaggctgacacgggacttggaagctgtgcccttcgtcaacaggaccactcccttcaccattagagggcctctgggcaaccaggggcgggggaacccggtgcgtacttgggagtcggccat

SEQ ID NO: 381358 - DNA, 140 bp, Artificial Sequence
  Synthetic
atggccgactcccaagtacgcaccgggttcccccgcccctggttgcccagaggccctctaatggtgaagggagtggtcctgttgacgaagggcacagcttccaagtcccgtgtcagcctgggagacccagcatggcgtat

SEQ ID NO: 381359 - DNA, 140 bp, Artificial Sequence
  Synthetic
atacgccatgctgggtctcccgctcccccttgggtttcgggtcgtataccatgactaagatccgggactccctccacttggtgaaatgccccactcccgccattgagcctcccaccgggacgtacttgggagtcggccat

SEQ ID NO: 381360 - DNA, 140 bp, Artificial Sequence
  Synthetic
atggccgactcccaagtacgtcccggtgggaggctcaatggcgggagtggggcatttcaccaagtggagggagtcccggatcttagtcatggtatacgacccgaaacccaagggggagcgggagacccagcatggcgtat

SEQ ID NO: 381361 - DNA, 140 bp, Artificial Sequence
  Synthetic
atacgccatgctgggtctcccgtttgggttcttccccggagtccctccccttaacaactgcatgctactggggactgaggtctccgaggcattggggggggctggactcacgggggggttcgtacttgggagtcggccat

SEQ ID NO: 381362 - DNA, 140 bp, Artificial Sequence
  Synthetic
atggccgactcccaagtacgaacccccccgtgagtccagccccccccaatgcctcggagacctcagtccccagtagcatgcagttgttaaggggagggactccggggaagaacccaaacgggagacccagcatggcgtat

SEQ ID NO: 381363 - DNA, 140 bp, Artificial Sequence
  Synthetic
atacgccatgctgggtctccctatgaacccctggtgcggcggtgttcagagctgatggggcgccgaaatccggtttgcccggggtttgcatggctctcctcgggtagacctgacggcttccgtacttgggagtcggccat

SEQ ID NO: 381364 - DNA, 140 bp, Artificial Sequence
  Synthetic
atggccgactcccaagtacggaagccgtcaggtctacccgaggagagccatgcaaaccccgggcaaaccggatttcggcgccccatcagctctgaacaccgccgcaccaggggttcatagggagacccagcatggcgtat

SEQ ID NO: 381365 - DNA, 140 bp, Artificial Sequence
  Synthetic
atacgccatgctgggtctccatacacgtccagggccatctgcaggaggtggatgcgggcaacttcatcccacccccacgctggttgctcttggatttcgtgtttgtcctgttatatctgacgtacttgggagtcggccat

SEQ ID NO: 381366 - DNA, 140 bp, Artificial Sequence
  Synthetic
atggccgactcccaagtacgtcagatataacaggacaaacacgaaatccaagagcaaccagcgtgggggtgggatgaagttgcccgcatccacctcctgcagatggccctggacgtgtatggagacccagcatggcgtat

SEQ ID NO: 381367 - DNA, 140 bp, Artificial Sequence
  Synthetic
atacgccatgctgggtctcctgaagctggcggaggcacggctggtcccgttaatacttctcctactatggtggtgggtcaaccagctcgcagtcttagggctgccggctgttggcgccgccgtacttgggagtcggccat

SEQ ID NO: 381368 - DNA, 140 bp, Artificial Sequence
  Synthetic
atggccgactcccaagtacggcggcgccaacagccggcagccctaagactgcgagctggttgacccaccaccatagtaggagaagtattaacgggaccagccgtgcctccgccagcttcaggagacccagcatggcgtat

SEQ ID NO: 381369 - DNA, 140 bp, Artificial Sequence
  Synthetic
atacgccatgctgggtctcctgtagcgggggaggtgtttgcgggcccggctttgtcctggtgcttgggcctgcccttcgtgagtatgatactgggtttagccaatctggtgttgtacttccgtacttgggagtcggccat

SEQ ID NO: 381370 - DNA, 140 bp, Artificial Sequence
  Synthetic
atggccgactcccaagtacggaagtacaacaccagattggctaaacccagtatcatactcacgaagggcaggcccaagcaccaggacaaagccgggcccgcaaacacctcccccgctacaggagacccagcatggcgtat

SEQ ID NO: 381371 - DNA, 140 bp, Artificial Sequence
  Synthetic
atacgccatgctgggtctcccgttggatgggtcctcaacgcctgatgttcctcgttttgtggaagctcgctcggggagcttttccgcttgcccttctgatgggtatttcggcaacccgtgcgtacttgggagtcggccat

SEQ ID NO: 381372 - DNA, 140 bp, Artificial Sequence
  Synthetic
atggccgactcccaagtacgcacgggttgccgaaatacccatcagaagggcaagcggaaaagctccccgagcgagcttccacaaaacgaggaacatcaggcgttgaggacccatccaacgggagacccagcatggcgtat

SEQ ID NO: 381373 - DNA, 140 bp, Artificial Sequence
  Synthetic
atacgccatgctgggtctccgccgcacctctgtgctcggagctgagttttgctttgacgtcacctttgaagtggatacatcagttttgggatgggtggtagccagtgtcttggcctgggccgtacttgggagtcggccat

SEQ ID NO: 381374 - DNA, 140 bp, Artificial Sequence
  Synthetic
atggccgactcccaagtacggcccaggccaagacactggctaccacccatcccaaaactgatgtatccacttcaaaggtgacgtcaaagcaaaactcagctccgagcacagaggtgcggcggagacccagcatggcgtat

SEQ ID NO: 381375 - DNA, 140 bp, Artificial Sequence
  Synthetic
atacgccatgctgggtctcccattgcgctcctgagctccatgagcgcgggggggtggaggcacaaggccgtgatttacaggacgtggtgcaaggggtaccaggcggtgcgccagagggtgcgtacttgggagtcggccat

SEQ ID NO: 381376 - DNA, 140 bp, Artificial Sequence
  Synthetic
atggccgactcccaagtacgcaccctctggcgcaccgcctggtaccccttgcaccacgtcctgtaaatcacggccttgtgcctccacccccccgcgctcatggagctcaggagcgcaatgggagacccagcatggcgtat

SEQ ID NO: 381377 - DNA, 140 bp, Artificial Sequence
  Synthetic
atacgccatgctgggtctccgttcggagccccctcggggaggggcgacctactaaaccgctgaccattgcctggtgcttggcctcctacatctggccggacgctgttatgttggtggtagcgtacttgggagtcggccat

SEQ ID NO: 381378 - DNA, 140 bp, Artificial Sequence
  Synthetic
atggccgactcccaagtacgctaccaccaacataacagcgtccggccagatgtaggaggccaagcaccaggcaatggtcagcggtttagtaggtcgcccctccccgagggggctccgaacggagacccagcatggcgtat

SEQ ID NO: 381379 - DNA, 140 bp, Artificial Sequence
  Synthetic
atacgccatgctgggtctcctggcgctggttctcctctttggcctgttcgacgcgttggactgggctttggaggagctgctggtgtcccggccctcattgcggcgcctagcacgggtggtcgtacttgggagtcggccat

SEQ ID NO: 381380 - DNA, 140 bp, Artificial Sequence
  Synthetic
atggccgactcccaagtacgaccacccgtgctaggcgccgcaatgagggccgggacaccagcagctcctccaaagcccagtccaacgcgtcgaacaggccaaagaggagaaccagcgccaggagacccagcatggcgtat

SEQ ID NO: 381381 - DNA, 140 bp, Artificial Sequence
  Synthetic
atacgccatgctgggtctccggagtgttgtgtgatggccggtgagaaggcgactaccatccggctggtgtccaagatgtgtgcgaagggggcctatttgttcgaccatatgggctctttccgtacttgggagtcggccat

SEQ ID NO: 381382 - DNA, 140 bp, Artificial Sequence
  Synthetic
atggccgactcccaagtacggaaagagcccatatggtcgaacaaataggcccccttcgcacacatcttggacaccagccggatggtagtcgccttctcaccggccatcacacaacactccggagacccagcatggcgtat

SEQ ID NO: 381383 - DNA, 140 bp, Artificial Sequence
  Synthetic
atacgccatgctgggtctcctcgcgcgctgtcaaggaacgcttgctggaatgggacgctgccttggaaccgctgtcattcactaggacggactgtcgcatcatacgggacgccgctaggacgtacttgggagtcggccat

SEQ ID NO: 381384 - DNA, 140 bp, Artificial Sequence
  Synthetic
atggccgactcccaagtacgtcctagcggcgtcccgtatgatgcgacagtccgtcctagtgaatgacagcggttccaaggcagcgtcccattccagcaagcgttccttgacagcgcgcgaggagacccagcatggcgtat

SEQ ID NO: 381385 - DNA, 140 bp, Artificial Sequence
  Synthetic
atacgccatgctgggtctccctcttagctgtggccagtgcgtcatgggcttgcccgtggtagcgcgacgcggcgaggaggtcttgatcggcgtcttccaggatgtgaaccatttgcctcccgtacttgggagtcggccat

SEQ ID NO: 381386 - DNA, 140 bp, Artificial Sequence
  Synthetic
atggccgactcccaagtacgggaggcaaatggttcacatcctggaagacgccgatcaagacctcctcgccgcgtcgcgctaccacgggcaagcccatgacgcactggccacagctaagagggagacccagcatggcgtat

SEQ ID NO: 381387 - DNA, 140 bp, Artificial Sequence
  Synthetic
atacgccatgctgggtctcccgggtttgtccccaccgcgccagtagtcatccgtcggtgcggcaagggctttctcggagtgacgaaggcggccttgaccggaagggatccagacttgcatcgtacttgggagtcggccat

SEQ ID NO: 381388 - DNA, 140 bp, Artificial Sequence
  Synthetic
atggccgactcccaagtacgatgcaagtctggatcccttccggtcaaggccgccttcgtcactccgagaaagcccttgccgcaccgacggatgactactggcgcggtggggacaaacccgggagacccagcatggcgtat

SEQ ID NO: 381389 - DNA, 140 bp, Artificial Sequence
  Synthetic
atacgccatgctgggtctccccggggaacgtcatggtgttggggacagctacctctcggagcatgggaacgtgcctgaatggcttgctgttcacgactttccatggggcttcatcccgaacgtacttgggagtcggccat

SEQ ID NO: 381390 - DNA, 140 bp, Artificial Sequence
  Synthetic
atggccgactcccaagtacgttcgggatgaagccccatggaaagtcgtgaacagcaagccattcaggcacgttcccatgctccgagaggtagctgtccccaacaccatgacgttccccggggagacccagcatggcgtat

SEQ ID NO: 381391 - DNA, 140 bp, Artificial Sequence
  Synthetic
atacgccatgctgggtctccccattgctacacccgtgggggccctgaacccaaggtggtggtctgccagtgacgacgtcacggtgtacccccttccagacggggcaacctcgttgacgcccgtacttgggagtcggccat

SEQ ID NO: 381392 - DNA, 140 bp, Artificial Sequence
  Synthetic
atggccgactcccaagtacgggcgtcaacgaggttgccccgtctggaagggggtacaccgtgacgtcgtcactggcagaccaccaccttgggttcagggcccccacgggtgtagcaatggggagacccagcatggcgtat

SEQ ID NO: 381393 - DNA, 140 bp, Artificial Sequence
  Synthetic
atacgccatgctgggtctccctgcacttgccaggcagagtcctgttgggtcattcgatccgacggggccctctgccacggcttgtgtaagggggataaggtagaactggatgtggccatgcgtacttgggagtcggccat

SEQ ID NO: 381394 - DNA, 140 bp, Artificial Sequence
  Synthetic
atggccgactcccaagtacgcatggccacatccagttctaccttatcccccttacacaagccgtggcagagggccccgtcggatcgaatgacccaacaggactctgcctggcaagtgcagggagacccagcatggcgtat

SEQ ID NO: 381395 - DNA, 140 bp, Artificial Sequence
  Synthetic
atacgccatgctgggtctccgaggtcgctgacttccgtgggtcatctgggtcgcctgtcctttgcgacgagggacacgcagtaggaatgctcgtgtcagtgctccattctggggggagggcgtacttgggagtcggccat

SEQ ID NO: 381396 - DNA, 140 bp, Artificial Sequence
  Synthetic
atggccgactcccaagtacgccctccccccagaatggagcactgacacgagcattcctactgcgtgtccctcgtcgcaaaggacaggcgacccagatgacccacggaagtcagcgacctcggagacccagcatggcgtat

SEQ ID NO: 381397 - DNA, 140 bp, Artificial Sequence
  Synthetic
atacgccatgctgggtctcctcactgcggcgcggtttactcggccgtggacccaagtcccaacagatgctaaaaccaccactgaacccccgccggtgccggcaaaaggagtcttcaaagacgtacttgggagtcggccat

SEQ ID NO: 381398 - DNA, 140 bp, Artificial Sequence
  Synthetic
atggccgactcccaagtacgtctttgaagactccttttgccggcaccggcgggggttcagtggtggttttagcatctgttgggacttgggtccacggccgagtaaaccgcgccgcagtgaggagacccagcatggcgtat

SEQ ID NO: 381399 - DNA, 140 bp, Artificial Sequence
  Synthetic
atacgccatgctgggtctccggccccacttttcatgcccacgggagccgggaagagcactcgggttcccttggagtatgggaatatggggcacaaggtcctgattttgaatccgtccgtgcgtacttgggagtcggccat

SEQ ID NO: 381400 - DNA, 140 bp, Artificial Sequence
  Synthetic
atggccgactcccaagtacgcacggacggattcaaaatcaggaccttgtgccccatattcccatactccaagggaacccgagtgctcttcccggctcccgtgggcatgaaaagtggggccggagacccagcatggcgtat

SEQ ID NO: 381401 - DNA, 140 bp, Artificial Sequence
  Synthetic
atacgccatgctgggtctccgctacggtgcgtgctatgggcccctacatggagcgcctggctggaaaacacccaagcatctactgcggacatgacaccactgcattcacgcggatcacggcgtacttgggagtcggccat

SEQ ID NO: 381402 - DNA, 140 bp, Artificial Sequence
  Synthetic
atggccgactcccaagtacgccgtgatccgcgtgaatgcagtggtgtcatgtccgcagtagatgcttgggtgttttccagccaggcgctccatgtaggggcccatagcacgcaccgtagcggagacccagcatggcgtat

SEQ ID NO: 381403 - DNA, 140 bp, Artificial Sequence
  Synthetic
atacgccatgctgggtctccactctcctctcacgtactctacctacgggaggttcttggccaaccctaggcagatgctgcggggggtctccgttgtaatctgcgatgagtgccacagccacgtacttgggagtcggccat

SEQ ID NO: 381404 - DNA, 140 bp, Artificial Sequence
  Synthetic
atggccgactcccaagtacgtggctgtggcactcatcgcagattacaacggagaccccccgcagcatctgcctagggttggccaagaacctcccgtaggtagagtacgtgagaggagagtggagacccagcatggcgtat

SEQ ID NO: 381405 - DNA, 140 bp, Artificial Sequence
  Synthetic
atacgccatgctgggtctcctgactcaacggtgctgttggggattgggcgggtccgggaattggcacgcggctgtggggtgcaacttgtgctctacgccacggccactcccccgggctcgcgtacttgggagtcggccat

SEQ ID NO: 381406 - DNA, 140 bp, Artificial Sequence
  Synthetic
atggccgactcccaagtacgcgagcccgggggagtggccgtggcgtagagcacaagttgcaccccacagccgcgtgccaattcccggacccgcccaatccccaacagcaccgttgagtcaggagacccagcatggcgtat

SEQ ID NO: 381407 - DNA, 140 bp, Artificial Sequence
  Synthetic
atacgccatgctgggtctcccccatgacccagcacccttccatcattgagaccaaattggatgtgggtgaaatccccttttatgggcacggcataccccttgagcggatgcggaccggtccgtacttgggagtcggccat

SEQ ID NO: 381408 - DNA, 140 bp, Artificial Sequence
  Synthetic
atggccgactcccaagtacggaccggtccgcatccgctcaaggggtatgccgtgcccataaaaggggatttcacccacatccaatttggtctcaatgatggaagggtgctgggtcatgggggagacccagcatggcgtat

SEQ ID NO: 381409 - DNA, 140 bp, Artificial Sequence
  Synthetic
atacgccatgctgggtctccggcacctcgtgttctgccattcaaaggccgagtgcgagcgtctggctggccagttctctgcaaggggggtcaatgccatagcctattataggggcaaggacgtacttgggagtcggccat

SEQ ID NO: 381410 - DNA, 140 bp, Artificial Sequence
  Synthetic
atggccgactcccaagtacgtccttgcccctataataggctatggcattgaccccccttgcagagaactggccagccagacgctcgcactcggcctttgaatggcagaacacgaggtgccggagacccagcatggcgtat

SEQ ID NO: 381411 - DNA, 140 bp, Artificial Sequence
  Synthetic
atacgccatgctgggtctccctcttcaataatcaaggatggtgacctagtggtctgcgctacagacgcgctctctacgggttacaccggaaacttcgattccgtcactgactgtgggctacgtacttgggagtcggccat

SEQ ID NO: 381412 - DNA, 140 bp, Artificial Sequence
  Synthetic
atggccgactcccaagtacgtagcccacagtcagtgacggaatcgaagtttccggtgtaacccgtagagagcgcgtctgtagcgcagaccactaggtcaccatccttgattattgaagagggagacccagcatggcgtat

SEQ ID NO: 381413 - DNA, 140 bp, Artificial Sequence
  Synthetic
atacgccatgctgggtctccgtggtggaggaggtcgtcgaggtgacccttgatcccaccattaccatctccttgcgaacggtccctgcgtcggctgaactgtcgatgcagcggagaggaccgtacttgggagtcggccat

SEQ ID NO: 381414 - DNA, 140 bp, Artificial Sequence
  Synthetic
atggccgactcccaagtacggtcctctccgctgcatcgacagttcagccgacgcagggaccgttcgcaaggagatggtaatggtgggatcaagggtcacctcgacgacctcctccaccacggagacccagcatggcgtat

SEQ ID NO: 381415 - DNA, 140 bp, Artificial Sequence
  Synthetic
atacgccatgctgggtctccgcacgggccgagggcggtccggacgatactactatgctggggtcggcaaggccccggcgggtgtggtgcgttcgggtcccgtctggtcagcagtggaagccgtacttgggagtcggccat

SEQ ID NO: 381416 - DNA, 140 bp, Artificial Sequence
  Synthetic
atggccgactcccaagtacggcttccactgctgaccagacgggacccgaacgcaccacacccgccggggccttgccgaccccagcatagtagtatcgtccggaccgccctcggcccgtgcggagacccagcatggcgtat

SEQ ID NO: 381417 - DNA, 140 bp, Artificial Sequence
  Synthetic
atacgccatgctgggtctcccggagtgacctggtacggtatggaacctgacttgacagcaaaccttctgagactttacgacgactgcccttacaccgcagccgtcgcggcagacatcgggcgtacttgggagtcggccat

SEQ ID NO: 381418 - DNA, 140 bp, Artificial Sequence
  Synthetic
atggccgactcccaagtacgcccgatgtctgccgcgacggctgcggtgtaagggcagtcgtcgtaaagtctcagaaggtttgctgtcaagtcaggttccataccgtaccaggtcactccgggagacccagcatggcgtat

SEQ ID NO: 381419 - DNA, 140 bp, Artificial Sequence
  Synthetic
atacgccatgctgggtctccgaagccgcagtgttcttctcgggccttgcgcccttgagaatgcatcccgatgtcagctgggcaaaagttcgcggcgtcaattggcctctcctggtgggtgcgtacttgggagtcggccat

SEQ ID NO: 381420 - DNA, 140 bp, Artificial Sequence
  Synthetic
atggccgactcccaagtacgcacccaccaggagaggccaattgacgccgcgaacttttgcccagctgacatcgggatgcattctcaagggcgcaaggcccgagaagaacactgcggcttcggagacccagcatggcgtat

SEQ ID NO: 381421 - DNA, 140 bp, Artificial Sequence
  Synthetic
atacgccatgctgggtctccttcagcggacgatgtgccgggaaacactgtcgcccggcccgtcggatgacccccagtgggccggtctgaagggccccaatcctgtcccgctactgctgagcgtacttgggagtcggccat

SEQ ID NO: 381422 - DNA, 140 bp, Artificial Sequence
  Synthetic
atggccgactcccaagtacgctcagcagtagcgggacaggattggggcccttcagaccggcccactgggggtcatccgacgggccgggcgacagtgtttcccggcacatcgtccgctgaaggagacccagcatggcgtat

SEQ ID NO: 381423 - DNA, 140 bp, Artificial Sequence
  Synthetic
atacgccatgctgggtctccgtggggcaacgatttgccatcaaaagtggccggccaccacatagtagacgacctggtccggcgccttggtgtggcggagggttatgtcagatgtgacgctcgtacttgggagtcggccat

SEQ ID NO: 381424 - DNA, 140 bp, Artificial Sequence
  Synthetic
atggccgactcccaagtacgagcgtcacatctgacataaccctccgccacaccaaggcgccggaccaggtcgtctactatgtggtggccggccacttttgatggcaaatcgttgccccacggagacccagcatggcgtat

SEQ ID NO: 381425 - DNA, 140 bp, Artificial Sequence
  Synthetic
atacgccatgctgggtctccggccccatcttgatggtggggctcgccatcgcgggcggcatgatctacgcgtcttacaccgggtctctagtggtggtaacagactgggatgtgaagggagcgtacttgggagtcggccat

SEQ ID NO: 381426 - DNA, 140 bp, Artificial Sequence
  Synthetic
atggccgactcccaagtacgctcccttcacatcccagtctgttaccaccactagagacccggtgtaagacgcgtagatcatgccgcccgcgatggcgagccccaccatcaagatggggccggagacccagcatggcgtat

SEQ ID NO: 381427 - DNA, 140 bp, Artificial Sequence
  Synthetic
atacgccatgctgggtctccgtggcaatcccctttataggagtggtgaccaggccacccctcaaccagtggtgcaggtccctccggtagaccatcggccggggggggaatctgcgccgtccgtacttgggagtcggccat

SEQ ID NO: 381428 - DNA, 140 bp, Artificial Sequence
  Synthetic
atggccgactcccaagtacggacggcgcagattccccccccggccgatggtctaccggagggacctgcaccactggttgaggggtggcctggtcaccactcctataaaggggattgccacggagacccagcatggcgtat

SEQ ID NO: 381429 - DNA, 140 bp, Artificial Sequence
  Synthetic
atacgccatgctgggtctccggatgccaagacagtgacagatgcggtggcagccattcaggtgaactgcgattggtcagtcatgaccctgtcgatcggggaagtgctgaccttggctcagcgtacttgggagtcggccat

SEQ ID NO: 381430 - DNA, 140 bp, Artificial Sequence
  Synthetic
atggccgactcccaagtacgctgagccaaggtcagcacttccccgatcgacagggtcatgactgaccaatcgcagttcacctgaatggctgccaccgcatctgtcactgtcttggcatccggagacccagcatggcgtat

SEQ ID NO: 381431 - DNA, 140 bp, Artificial Sequence
  Synthetic
atacgccatgctgggtctccgctaagacggccgaggcctacgcagctaccgccaagtggcttgctggctgctacacggggacgcgggccgtccccacagtctcaattgtggacaagctctcgtacttgggagtcggccat

SEQ ID NO: 381432 - DNA, 140 bp, Artificial Sequence
  Synthetic
atggccgactcccaagtacgagagcttgtccacaattgagactgtggggacggcccgcgtccccgtgtagcagccagcaagccacttggcggtagctgcgtaggcctcggccgtcttagcggagacccagcatggcgtat

SEQ ID NO: 381433 - DNA, 140 bp, Artificial Sequence
  Synthetic
atacgccatgctgggtctccttgccggagggtgggccgcggtcgtgggccactgccacagcgtcatagctgcggcggtggcggcctacggggcttcacggagcccgccgttggcagcggccgtacttgggagtcggccat

SEQ ID NO: 381434 - DNA, 140 bp, Artificial Sequence
  Synthetic
atggccgactcccaagtacggccgctgccaacggcgggctccgtgaagccccgtaggccgccaccgccgcagctatgacgctgtggcagtggcccacgaccgcggcccaccctccggcaaggagacccagcatggcgtat

SEQ ID NO: 381435 - DNA, 140 bp, Artificial Sequence
  Synthetic
atacgccatgctgggtctcctgcgtcctatctgatgggattgggcgtcggaggcaacgctcaggcccgcttggcttctgcccttctattgggggccgctggaaccgctctgggcacgccgcgtacttgggagtcggccat

SEQ ID NO: 381436 - DNA, 140 bp, Artificial Sequence
  Synthetic
atggccgactcccaagtacgcggcgtgcccagagcggttccagcggcccccaatagaagggcagaagccaagcgggcctgagcgttgcctccgacgcccaatcccatcagataggacgcaggagacccagcatggcgtat

SEQ ID NO: 381437 - DNA, 140 bp, Artificial Sequence
  Synthetic
atacgccatgctgggtctccgtcgtggggttaaccatggccggcgcgttcatgggtggggccagcgtgtccccgtcgctggtcacggtcctcttgggggccgtgggtggctgggagggcgcgtacttgggagtcggccat

SEQ ID NO: 381438 - DNA, 140 bp, Artificial Sequence
  Synthetic
atggccgactcccaagtacgcgccctcccagccacccacggcccccaagaggaccgtgaccagcgacggggacacgctggccccacccatgaacgcgccggccatggttaaccccacgacggagacccagcatggcgtat

SEQ ID NO: 381439 - DNA, 140 bp, Artificial Sequence
  Synthetic
atacgccatgctgggtctcctggtcaatgcggccagcctcgtcttcgactttatggcagggaaactttcaactgaggacctgtggtatgccatcccggtgctcactagtccaggggctggcgtacttgggagtcggccat

SEQ ID NO: 381440 - DNA, 140 bp, Artificial Sequence
  Synthetic
atggccgactcccaagtacgccagcccctggactagtgagcaccgggatggcataccacaggtcctcagttgaaagtttccctgccataaagtcgaagacgaggctggccgcattgaccaggagacccagcatggcgtat

SEQ ID NO: 381441 - DNA, 140 bp, Artificial Sequence
  Synthetic
atacgccatgctgggtctcccctcgccggcattgcccttgggttggtgttgtactcagctaacaactctggcactaccacttggttgaaccgtctgctgacaactctgccccggtcctcacgtacttgggagtcggccat

SEQ ID NO: 381442 - DNA, 140 bp, Artificial Sequence
  Synthetic
atggccgactcccaagtacgtgaggaccggggcagagttgtcagcagacggttcaaccaagtggtagtgccagagttgttagctgagtacaacaccaacccaagggcaatgccggcgaggggagacccagcatggcgtat

SEQ ID NO: 381443 - DNA, 140 bp, Artificial Sequence
  Synthetic
atacgccatgctgggtctcctgcatcccggacagctatttccaacaggctgactactgcgacaaagtctcggccatgctccgccgtttgagcctcaccagaaccgtggtggccctggttacgtacttgggagtcggccat

SEQ ID NO: 381444 - DNA, 140 bp, Artificial Sequence
  Synthetic
atggccgactcccaagtacgtaaccagggccaccacggttctggtgaggctcaaacggcggagcatggccgagactttgtcgcagtagtcagcctgttggaaatagctgtccgggatgcaggagacccagcatggcgtat

SEQ ID NO: 381445 - DNA, 140 bp, Artificial Sequence
  Synthetic
atacgccatgctgggtctccacagggaacccaaggtggatgaggtccaggtggggtatgtctgggacctgtgggagtgggtcatgcgccagattcgcatggtcatggccaggctccgggccgtacttgggagtcggccat

SEQ ID NO: 381446 - DNA, 140 bp, Artificial Sequence
  Synthetic
atggccgactcccaagtacggcccggagcctggccatgaccatgcgaatctggcgcatgacccactcccacaggtcccagacataccccacctggacctcatccaccttgggttccctgtggagacccagcatggcgtat

SEQ ID NO: 381447 - DNA, 140 bp, Artificial Sequence
  Synthetic
atacgccatgctgggtctcccctctgccccgtagtgtcgctaccactgtggcactgtggggaggggtggtccggagaatggctgttagacggtcatgtggagagtcgctgcctgtgtgggcgtacttgggagtcggccat

SEQ ID NO: 381448 - DNA, 140 bp, Artificial Sequence
  Synthetic
atggccgactcccaagtacgcccacacaggcagcgactctccacatgaccgtctaacagccattctccggaccacccctccccacagtgccacagtggtagcgacactacggggcagaggggagacccagcatggcgtat

SEQ ID NO: 381449 - DNA, 140 bp, Artificial Sequence
  Synthetic
atacgccatgctgggtctcctgtgtgatcactggggacgtgttgaatggccaactcaaagatccagtttactctactaagttgtgccggcactattggatgggaactgtgccagtcaacacgtacttgggagtcggccat

SEQ ID NO: 381450 - DNA, 140 bp, Artificial Sequence
  Synthetic
atggccgactcccaagtacgtgttgactggcacagttcccatccaatagtgccggcacaacttagtagagtaaactggatctttgagttggccattcaacacgtccccagtgatcacacaggagacccagcatggcgtat

SEQ ID NO: 381451 - DNA, 140 bp, Artificial Sequence
  Synthetic
atacgccatgctgggtctcctgctgggctacggggaaacctcgcccctcctagcctccgacaccccaaaggttgtacccttcgggacggcaggctgggcagaggttgtggtgaccccgaccgtacttgggagtcggccat

SEQ ID NO: 381452 - DNA, 140 bp, Artificial Sequence
  Synthetic
atggccgactcccaagtacggtcggggtcaccacaacctctgcccagcctgccgtcccgaagggtacaacctttggggtgtcggaggctaggaggggcgaggtttccccgtagcccagcaggagacccagcatggcgtat

SEQ ID NO: 381453 - DNA, 140 bp, Artificial Sequence
  Synthetic
aggccctggctgctgatatggttgtacccttcgggacggcaggctgggcagaggttgtggtgaccccgacccacgtggtgattaggcgcacctcgtgctacaagttgctgcgccaacaaagaccttttgggacagcggtg

SEQ ID NO: 381454 - DNA, 140 bp, Artificial Sequence
  Synthetic
caccgctgtcccaaaaggtctttgttggcgcagcaacttgtagcacgaggtgcgcctaatcaccacgtgggtcggggtcaccacaacctctgcccagcctgccgtcccgaagggtacaaccatatcagcagccagggcct

SEQ ID NO: 381455 - DNA, 140 bp, Artificial Sequence
  Synthetic
atacgccatgctgggtctcctactttctgctgctgtggctgagccctactacgtcgatggcattccagtttcttgggaggccgacgcgcgagcgccggcaatggtctacggtcctggccacgtacttgggagtcggccat

SEQ ID NO: 381456 - DNA, 140 bp, Artificial Sequence
  Synthetic
atggccgactcccaagtacgtggccaggaccgtagaccattgccggcgctcgcgcgtcggcctcccaagaaactggaatgccatcgacgtagtagggctcagccacagcagcagaaagtaggagacccagcatggcgtat

SEQ ID NO: 381457 - DNA, 140 bp, Artificial Sequence
  Synthetic
atacgccatgctgggtctccaagcgttaccattgacggggagcgctacaccctgccgcaccagttgcggatgaggaatgtggcgccctctgaggtttcgtctgaggtcagcatcgagatccgtacttgggagtcggccat

SEQ ID NO: 381458 - DNA, 140 bp, Artificial Sequence
  Synthetic
atggccgactcccaagtacggatctcgatgctgacctcagacgaaacctcagagggcgccacattcctcatccgcaactggtgcggcagggtgtagcgctccccgtcaatggtaacgcttggagacccagcatggcgtat

SEQ ID NO: 381459 - DNA, 140 bp, Artificial Sequence
  Synthetic
atacgccatgctgggtctccgggacggagactgaggattcagagctgactgaagctgatttgccaccggcggctgcggcccttcaagcgattgagaatgctgcgagaattctcgagccgccgtacttgggagtcggccat

SEQ ID NO: 381460 - DNA, 140 bp, Artificial Sequence
  Synthetic
atggccgactcccaagtacggcggctcgagaattctcgcagcattctcaatcgcttgaagggccgcagccgccggtggcaaatcagcttcagtcagctctgaatcctcagtctccgtcccggagacccagcatggcgtat

SEQ ID NO: 381461 - DNA, 140 bp, Artificial Sequence
  Synthetic
atacgccatgctgggtctccatattgatgtcatcatggaggactgcagtacaccctctctctgtggaagtagccgagagatgcctgtatggggagaagacatcccccgcacaccatcgcccgtacttgggagtcggccat

SEQ ID NO: 381462 - DNA, 140 bp, Artificial Sequence
  Synthetic
atggccgactcccaagtacgggcgatggtgtgcgggggatgtcttctccccatacaggcatctctcggctacttccacagagagagggtgtactgcagtcctccatgatgacatcaatatggagacccagcatggcgtat

SEQ ID NO: 381463 - DNA, 140 bp, Artificial Sequence
  Synthetic
atacgccatgctgggtctcctgcacttatctcggttacagagagcagctcagatgagaagaccccgtcggtgtcctcctcgcaggaggataccccgtcatcggactcatttgaagtcatccgtacttgggagtcggccat

SEQ ID NO: 381464 - DNA, 140 bp, Artificial Sequence
  Synthetic
atggccgactcccaagtacggatgacttcaaatgagtccgatgacggggtatcctcctgcgaggaggacaccgacggggtcttctcatctgagctgctctctgtaaccgagataagtgcaggagacccagcatggcgtat

SEQ ID NO: 381465 - DNA, 140 bp, Artificial Sequence
  Synthetic
atacgccatgctgggtctcccaagagtctgattcagcagaaacagaggaaagtgtcttcaacgtggctctttccgtattaaaagccttatttccacagagcgatgccactcgaaagttgacgtacttgggagtcggccat

SEQ ID NO: 381466 - DNA, 140 bp, Artificial Sequence
  Synthetic
atggccgactcccaagtacgtcaactttcgagtggcatcgctctgtggaaataaggcttttaatacggaaagagccacgttgaagacactttcctctgtttctgctgaatcagactcttgggagacccagcatggcgtat

SEQ ID NO: 381467 - DNA, 140 bp, Artificial Sequence
  Synthetic
atacgccatgctgggtctcccggtcaagatgtcatgctgcgtggagaagagcgtcacgcgctttttctccttggggttgactgtggccgatgtggcaagcctgtgtgagatggaaatccacgtacttgggagtcggccat

SEQ ID NO: 381468 - DNA, 140 bp, Artificial Sequence
  Synthetic
atggccgactcccaagtacgtggatttccatctcacacaggcttgccacatcggccacagtcaaccccaaggagaaaaagcgcgtgacgctcttctccacgcagcatgacatcttgaccgggagacccagcatggcgtat

SEQ ID NO: 381469 - DNA, 140 bp, Artificial Sequence
  Synthetic
aggccctggctgctgatatgttgggtgcttggtgggcaatgaacttacctttgaatgtgataagtgtgaggcacgccaagagacgttggcctccttctcatacatctggtcaggggttccgaccttttgggacagcggtg

SEQ ID NO: 381470 - DNA, 140 bp, Artificial Sequence
  Synthetic
caccgctgtcccaaaaggtcggaacccctgaccagatgtatgagaaggaggccaacgtctcttggcgtgcctcacacttatcacattcaaaggtaagttcattgcccaccaagcacccaacatatcagcagccagggcct

SEQ ID NO: 381471 - DNA, 140 bp, Artificial Sequence
  Synthetic
atacgccatgctgggtctcccctgacgagagccacaccggccaaaccaccagtggtgcggccggttggttctctgttggtggcagacacgaccaaagtgtatgtcactaacccagataaccgtacttgggagtcggccat

SEQ ID NO: 381472 - DNA, 140 bp, Artificial Sequence
  Synthetic
atggccgactcccaagtacggttatctgggttagtgacatacactttggtcgtgtctgccaccaacagagaaccaaccggccgcaccactggtggtttggccggtgtggctctcgtcaggggagacccagcatggcgtat

SEQ ID NO: 381473 - DNA, 140 bp, Artificial Sequence
  Synthetic
atacgccatgctgggtctccgtggggaggcgggttgacaaggtcaccttctggcgggctccgagggttcacgacaaatatctcgtggactctattgaggccgctaggagagccgctcaagcgtacttgggagtcggccat

SEQ ID NO: 381474 - DNA, 140 bp, Artificial Sequence
  Synthetic
atggccgactcccaagtacgcttgagcggctctcctagcggcctcaatagagtccacgagatatttgtcgtgaaccctcggagcccgccagaaggtgaccttgtcaacccgcctccccacggagacccagcatggcgtat

SEQ ID NO: 381475 - DNA, 140 bp, Artificial Sequence
  Synthetic
aggccctggctgctgatatgcgacaaatatctcgtggactctattgaggccgctaggagagccgctcaagggtgccttagcatgggttacacttatgaggaggcaataaggactgttagggaccttttgggacagcggtg

SEQ ID NO: 381476 - DNA, 140 bp, Artificial Sequence
  Synthetic
caccgctgtcccaaaaggtccctaacagtccttattgcctcctcataagtgtaacccatgctaaggcacccttgagcggctctcctagcggcctcaatagagtccacgagatatttgtcgcatatcagcagccagggcct

SEQ ID NO: 381477 - DNA, 140 bp, Artificial Sequence
  Synthetic
aggccctggctgctgatatgccacatgctgccatgggctggggatctaaggtgtcggtcaaggacttggccacccctgcggggaagatggctgtccacgaccgacttcaggagatacttggaccttttgggacagcggtg

SEQ ID NO: 381478 - DNA, 140 bp, Artificial Sequence
  Synthetic
caccgctgtcccaaaaggtccaagtatctcctgaagtcggtcgtggacagccatcttccccgcaggggtggccaagtccttgaccgacaccttagatccccagcccatggcagcatgtggcatatcagcagccagggcct

SEQ ID NO: 381479 - DNA, 140 bp, Artificial Sequence
  Synthetic
aggccctggctgctgatatgaagggactccggtcccctttacattgactgtgaaaaaggaggtgttcttcaaagaccggaaggaggagaaggccccccgcctcattgtgttcccccccctgaccttttgggacagcggtg

SEQ ID NO: 381480 - DNA, 140 bp, Artificial Sequence
  Synthetic
caccgctgtcccaaaaggtcaggggggggaacacaatgaggcggggggccttctcctccttccggtctttgaagaacacctcctttttcacagtcaatgtaaaggggaccggagtcccttcatatcagcagccagggcct

SEQ ID NO: 381481 - DNA, 140 bp, Artificial Sequence
  Synthetic
atacgccatgctgggtctccggacttccggatagccgaaaagctcatcctgggagatccggggagggtggccaaagcggtgttggggggggcgtacgccttccagtacaccccaaaccagcgtacttgggagtcggccat

SEQ ID NO: 381482 - DNA, 140 bp, Artificial Sequence
  Synthetic
atggccgactcccaagtacgctggtttggggtgtactggaaggcgtacgccccccccaacaccgctttggccaccctccccggatctcccaggatgagcttttcggctatccggaagtccggagacccagcatggcgtat

SEQ ID NO: 381483 - DNA, 140 bp, Artificial Sequence
  Synthetic
atacgccatgctgggtctcccgggttagggagatgctcaaactgtgggagtcaaagaaaacaccgtgtgccatctgtgtggacgccacgtgcttcgacagcagcattactgaagaggacgcgtacttgggagtcggccat

SEQ ID NO: 381484 - DNA, 140 bp, Artificial Sequence
  Synthetic
atggccgactcccaagtacgcgtcctcttcagtaatgctgctgtcgaagcacgtggcgtccacacagatggcacacggtgttttctttgactcccacagtttgagcatctccctaacccgggagacccagcatggcgtat

SEQ ID NO: 381485 - DNA, 140 bp, Artificial Sequence
  Synthetic
atacgccatgctgggtctcctggccctagagacagagctatatgctctggcctctgaccacccagaatgggtgcgcgctctggggaaatactatgcctctggcactatggtcaccccggacgtacttgggagtcggccat

SEQ ID NO: 381486 - DNA, 140 bp, Artificial Sequence
  Synthetic
atggccgactcccaagtacgtccggggtgaccatagtgccagaggcatagtatttccccagagcgcgcacccattctgggtggtcagaggccagagcatatagctctgtctctagggccaggagacccagcatggcgtat

SEQ ID NO: 381487 - DNA, 140 bp, Artificial Sequence
  Synthetic
atacgccatgctgggtctccaggggtgcccgtgggggagaggtactgtaggtcctcaggagtcttgaccaccagcgcgagcaattgcttgacctgctacataaaggtgaaagccgcctgccgtacttgggagtcggccat

SEQ ID NO: 381488 - DNA, 140 bp, Artificial Sequence
  Synthetic
atggccgactcccaagtacggcaggcggctttcacctttatgtagcaggtcaagcaattgctcgcgctggtggtcaagactcctgaggacctacagtacctctcccccacgggcacccctggagacccagcatggcgtat

SEQ ID NO: 381489 - DNA, 140 bp, Artificial Sequence
  Synthetic
atacgccatgctgggtctcccagagagtgggacttaagaacgtctcgcttctcattgcaggtgatgactgtctgatcatatgtgagcggcccatgtgcgacccgagtgaggccttgggaccgtacttgggagtcggccat

SEQ ID NO: 381490 - DNA, 140 bp, Artificial Sequence
  Synthetic
atggccgactcccaagtacggtcccaaggcctcactcgggtcgcacatgggccgctcacatatgatcagacagtcatcacctgcaatgagaagcgagacgttcttaagtcccactctctgggagacccagcatggcgtat

SEQ ID NO: 381491 - DNA, 140 bp, Artificial Sequence
  Synthetic
atacgccatgctgggtctccgagccttggcctcgtacgggtacgcgtgtgaaccctcatatcatgcatcactggacaccgcccccttctgctctacttggcttgccgagtgcaatgcagacgtacttgggagtcggccat

SEQ ID NO: 381492 - DNA, 140 bp, Artificial Sequence
  Synthetic
atggccgactcccaagtacgtctgcattgcactcggcaagccaagtagagcagaagggggcggtgtccagtgatgcatgatatgagggttcacacgcgtacccgtacgaggccaaggctcggagacccagcatggcgtat

SEQ ID NO: 381493 - DNA, 140 bp, Artificial Sequence
  Synthetic
atacgccatgctgggtctcctgggaagcgttgcttcttccttaccacggactttcggaggccgcttgctcgcatgtcgagtgagtacagtgacccgatggcttcggccattggttacatccgtacttgggagtcggccat

SEQ ID NO: 381494 - DNA, 140 bp, Artificial Sequence
  Synthetic
atggccgactcccaagtacggatgtaaccaatggccgaagccatcgggtcactgtactcactcgacatgcgagcaagcggcctccgaaagtccgtggtaaggaagaagcaacgcttcccaggagacccagcatggcgtat

SEQ ID NO: 381495 - DNA, 140 bp, Artificial Sequence
  Synthetic
atacgccatgctgggtctccctcctttatccctggcatcccatcacacggtgggtcatcatcccgcatgtgctcacgtgcgcatttaggggtggtgggacaccgtctgatccggtttggtcgtacttgggagtcggccat

SEQ ID NO: 381496 - DNA, 140 bp, Artificial Sequence
  Synthetic
atggccgactcccaagtacgaccaaaccggatcagacggtgtcccaccacccctaaatgcgcacgtgagcacatgcgggatgatgacccaccgtgtgatgggatgccagggataaaggagggagacccagcatggcgtat

SEQ ID NO: 381497 - DNA, 140 bp, Artificial Sequence
  Synthetic
aggccctggctgctgatatggctcacgtgcgcatttaggggtggtgggacaccgtctgatccggtttggtgccaggtgcatggcaattactacaagtttcctctggacaaactgccaaacgaccttttgggacagcggtg

SEQ ID NO: 381498 - DNA, 140 bp, Artificial Sequence
  Synthetic
caccgctgtcccaaaaggtcgtttggcagtttgtccagaggaaacttgtagtaattgccatgcacctggcaccaaaccggatcagacggtgtcccaccacccctaaatgcgcacgtgagccatatcagcagccagggcct

SEQ ID NO: 381499 - DNA, 140 bp, Artificial Sequence
  Synthetic
atacgccatgctgggtctccatcatcgtggccctccacggtccagcagcgttgagggttaccgcagacacaaccaaaacaaaaatggaggccggcaaggtgctgagcgacctcaagctcccgtacttgggagtcggccat

SEQ ID NO: 381500 - DNA, 140 bp, Artificial Sequence
  Synthetic
atggccgactcccaagtacgggagcttgaggtcgctcagcaccttgccggcctccatttttgttttggttgtgtctgcggtaaccctcaacgctgctggaccgtggagggccacgatgatggagacccagcatggcgtat

SEQ ID NO: 381501 - DNA, 140 bp, Artificial Sequence
  Synthetic
atacgccatgctgggtctcccgggcctagctgtccaccgtaagaaggctggggcattgcgaacacgcatgctccggtcgcgcggttgggcggagttggctcggggcctgttgtggcatcccgtacttgggagtcggccat

SEQ ID NO: 381502 - DNA, 140 bp, Artificial Sequence
  Synthetic
atggccgactcccaagtacgggatgccacaacaggccccgagccaactccgcccaaccgcgcgaccggagcatgcgtgttcgcaatgccccagccttcttacggtggacagctaggcccgggagacccagcatggcgtat

SEQ ID NO: 381503 - DNA, 140 bp, Artificial Sequence
  Synthetic
atacgccatgctgggtctccaggcctgcggctcccaccacctgagattgctggaatcccgggtgggttccccctgtcccccccctacatgggggtggttcatcaattggatttcacagcccgtacttgggagtcggccat

SEQ ID NO: 381504 - DNA, 140 bp, Artificial Sequence
  Synthetic
atggccgactcccaagtacgggctgtgaaatccaattgatgaaccacccccatgtaggggggggacagggggaacccacccgggattccagcaatctcaggtggtgggagccgcaggcctggagacccagcatggcgtat

SEQ ID NO: 381505 - DNA, 140 bp, Artificial Sequence
  Synthetic
aggccctggctgctgatatgccctgtcccccccctacatgggggtggttcatcaattggatttcacagcccagcggagtcgctggcggtggttggggttcttagccctgctcatcgtagcgaccttttgggacagcggtg

SEQ ID NO: 381506 - DNA, 140 bp, Artificial Sequence
  Synthetic
caccgctgtcccaaaaggtcgctacgatgagcagggctaagaaccccaaccaccgccagcgactccgctgggctgtgaaatccaattgatgaaccacccccatgtaggggggggacagggcatatcagcagccagggcct

SEQ ID NO: 381507 - DNA, 140 bp, Artificial Sequence
  Synthetic
atacgccatgctgggtctcccagcggagtcgctggcggtggttggggttcttagccctgctcatcgtagcgctctttgggtgaactaaattcatctgttgcggcaaggttgggtgactgacgtacttgggagtcggccat

SEQ ID NO: 381508 - DNA, 140 bp, Artificial Sequence
  Synthetic
atggccgactcccaagtacgtcagtcacccaaccttgccgcaacagatgaatttagttcacccaaagagcgctacgatgagcagggctaagaaccccaaccaccgccagcgactccgctgggagacccagcatggcgtat

SEQ ID NO: 381509 - DNA, 140 bp, Artificial Sequence
  Synthetic
aggccctggctgctgatatggctctttgggtgaactaaattcatctgttgcggcaaggttgggtgactgatcatcacctgaggaggttcccgccctccccgccccaggggtctccccgctgaccttttgggacagcggtg

SEQ ID NO: 381510 - DNA, 140 bp, Artificial Sequence
  Synthetic
caccgctgtcccaaaaggtcagcggggagacccctggggcggggagggcgggaacctcctcaggtgatgatcagtcacccaaccttgccgcaacagatgaatttagttcacccaaagagccatatcagcagccagggcct

SEQ ID NO: 381511 - DNA, 140 bp, Artificial Sequence
  Synthetic
aggccctggctgctgatatgggaacgcgcacggtccacaggtgttggccctaccggtgtgaataagggcccgacgtcaggctcgtcgttaaaccgagcccgttatccccctgggcaaacggaccttttgggacagcggtg

SEQ ID NO: 381512 - DNA, 140 bp, Artificial Sequence
  Synthetic
caccgctgtcccaaaaggtccgtttgcccagggggataacgggctcggtttaacgacgagcctgacgtcgggcccttattcacaccggtagggccaacacctgtggaccgtgcgcgttcccatatcagcagccagggcct

SEQ ID NO: 381513 - DNA, 140 bp, Artificial Sequence
  Synthetic
atacgccatgctgggtctcctggaccccccaccctgcccttcccgggggagcgggaaatgcatggggccacccagctccgcggcggcctgcagccggggtagcccaagagccttcgggtgcgtacttgggagtcggccat

SEQ ID NO: 381514 - DNA, 140 bp, Artificial Sequence
  Synthetic
atggccgactcccaagtacgcacccgaaggctcttgggctaccccggctgcaggccgccgcggagctgggtggccccatgcatttcccgctcccccgggaagggcagggtggggggtccaggagacccagcatggcgtat

SEQ ID NO: 381515 - DNA, 140 bp, Artificial Sequence
  Synthetic
atacgccatgctgggtctccagggcgggtggcattttctcttctgtaccaatcatggcagtccttctgctccttctcgtggcggaggccggggccatcttggccccggccacccacgcttcgtacttgggagtcggccat

SEQ ID NO: 381516 - DNA, 140 bp, Artificial Sequence
  Synthetic
atggccgactcccaagtacgaagcgtgggtggccggggccaagatggccccggcctccgccacgagaaggagcagaaggactgccatgattggtacagaagagaaaatgccacccgccctggagacccagcatggcgtat

SEQ ID NO: 381517 - DNA, 140 bp, Artificial Sequence
  Synthetic
atacgccatgctgggtctccgtgaggcgcatgggcaatatttcctcacaaattgctgtgccatggaggacatagggttctgcctcgagggcggttgccttgtggccctagggtgcacaatcgtacttgggagtcggccat

SEQ ID NO: 381518 - DNA, 140 bp, Artificial Sequence
  Synthetic
atggccgactcccaagtacgattgtgcaccctagggccacaaggcaaccgccctcgaggcagaaccctatgtcctccatggcacagcaatttgtgaggaaatattgcccatgcgcctcacggagacccagcatggcgtat

SEQ ID NO: 381519 - DNA, 140 bp, Artificial Sequence
  Synthetic
atacgccatgctgggtctccttgtactgacagatgctggccgttgtatcaggcgggactggccgtgcggcctggcaagtccgccgcccagctggtgggtgaactgggtagcctctacgggcgtacttgggagtcggccat

SEQ ID NO: 381520 - DNA, 140 bp, Artificial Sequence
  Synthetic
atggccgactcccaagtacgcccgtagaggctacccagttcacccaccagctgggcggcggacttgccaggccgcacggccagtcccgcctgatacaacggccagcatctgtcagtacaaggagacccagcatggcgtat

SEQ ID NO: 381521 - DNA, 140 bp, Artificial Sequence
  Synthetic
atacgccatgctgggtctcccccttatcggtgtcagcctacgtggctggcatcttagggctcggggaggtctattcaggggtactcactgtgggcgttgcgttgacgcgtagggtctacccgtacttgggagtcggccat

SEQ ID NO: 381522 - DNA, 140 bp, Artificial Sequence
  Synthetic
atggccgactcccaagtacgggtagaccctacgcgtcaacgcaacgcccacagtgagtacccctgaatagacctccccgagccctaagatgccagccacgtaggctgacaccgataagggggagacccagcatggcgtat

SEQ ID NO: 381523 - DNA, 140 bp, Artificial Sequence
  Synthetic
atacgccatgctgggtctcccggtcccaaatctgacttgtgcagtggagtgtgaactgaagtgggaaagtgagttttggagatggactgagcaattggcctctaactactggattctggacgtacttgggagtcggccat

SEQ ID NO: 381524 - DNA, 140 bp, Artificial Sequence
  Synthetic
atggccgactcccaagtacgtccagaatccagtagttagaggccaattgctcagtccatctccaaaactcactttcccacttcagttcacactccactgcacaagtcagatttgggaccgggagacccagcatggcgtat

SEQ ID NO: 381525 - DNA, 140 bp, Artificial Sequence
  Synthetic
atacgccatgctgggtctccatatctctggaaggtcccctttgacttctggcggggtgtgatgagcctgacgcccttgttggtgtgcgtggcggcccttctcctgctagagcaacggattcgtacttgggagtcggccat

SEQ ID NO: 381526 - DNA, 140 bp, Artificial Sequence
  Synthetic
atggccgactcccaagtacgaatccgttgctctagcaggagaagggccgccacgcacaccaacaagggcgtcaggctcatcacaccccgccagaagtcaaaggggaccttccagagatatggagacccagcatggcgtat

SEQ ID NO: 381527 - DNA, 140 bp, Artificial Sequence
  Synthetic
atacgccatgctgggtctccgttatggtcttcctcctggttactatggcgggcatgtcgcaaggcgcgcctgcctcggtgctggggtctcggccgtttgagccggggttgacatggcagtcgtacttgggagtcggccat

SEQ ID NO: 381528 - DNA, 140 bp, Artificial Sequence
  Synthetic
atggccgactcccaagtacgactgccatgtcaaccccggctcaaacggccgagaccccagcaccgaggcaggcgcgccttgcgacatgcccgccatagtaaccaggaggaagaccataacggagacccagcatggcgtat

SEQ ID NO: 381529 - DNA, 140 bp, Artificial Sequence
  Synthetic
atacgccatgctgggtctcccctgctcctgtagggcgaatgggtcccgcgtacccacggggcagaaggtttgggagcgtgggaatgtcacactgttgtgtgattgccctaacggtccctgcgtacttgggagtcggccat

SEQ ID NO: 381530 - DNA, 140 bp, Artificial Sequence
  Synthetic
atggccgactcccaagtacgcagggaccgttagggcaatcacacaacagtgtgacattcccacgctcccaaaccttctgccccgtgggtacgcgggacccattcgccctacaggagcaggggagacccagcatggcgtat

SEQ ID NO: 381531 - DNA, 140 bp, Artificial Sequence
  Synthetic
atacgccatgctgggtctccggtatggctgccggccttttgccaagcgatcggctggggcgaccctatcacgcattggggccacgggcaaaatcagtggcctctttcttgcccccagtatcgtacttgggagtcggccat

SEQ ID NO: 381532 - DNA, 140 bp, Artificial Sequence
  Synthetic
atggccgactcccaagtacgatactgggggcaagaaagaggccactgattttgcccgtggccccaatgcgtgatagggtcgccccagccgatcgcttggcaaaaggccggcagccataccggagacccagcatggcgtat

SEQ ID NO: 381533 - DNA, 140 bp, Artificial Sequence
  Synthetic
atacgccatgctgggtctccgtctacgggtccgtttccgtgacttgcgtttggggttccgtctcttggtttgcttccacgggggggcgcgattccaagattgacgtgtggagtttggtgccgtacttgggagtcggccat

SEQ ID NO: 381534 - DNA, 140 bp, Artificial Sequence
  Synthetic
atggccgactcccaagtacggcaccaaactccacacgtcaatcttggaatcgcgcccccccgtggaagcaaaccaagagacggaaccccaaacgcaagtcacggaaacggacccgtagacggagacccagcatggcgtat

SEQ ID NO: 381535 - DNA, 140 bp, Artificial Sequence
  Synthetic
atacgccatgctgggtctcccagttggttcggccagctgcaccatagccgcactgggatcgtcggatcgcgacaccgtgccggagctctccgagtggggggtcccttgcgctacctgtatcgtacttgggagtcggccat

SEQ ID NO: 381536 - DNA, 140 bp, Artificial Sequence
  Synthetic
atggccgactcccaagtacgatacaggtagcgcaagggaccccccactcggagagctccggcacggtgtcgcgatccgacgatcccagtgcggctatggtgcagctggccgaaccaactgggagacccagcatggcgtat

SEQ ID NO: 381537 - DNA, 140 bp, Artificial Sequence
  Synthetic
atacgccatgctgggtctcctctggaccgtcggcctgcctcgtgcggcacctgtgtgagagactgctggcccgagactgggtcggttagattccctttccatcggtgtggcgcgggacctcgtacttgggagtcggccat

SEQ ID NO: 381538 - DNA, 140 bp, Artificial Sequence
  Synthetic
atggccgactcccaagtacgaggtcccgcgccacaccgatggaaagggaatctaaccgacccagtctcgggccagcagtctctcacacaggtgccgcacgaggcaggccgacggtccagaggagacccagcatggcgtat

SEQ ID NO: 381539 - DNA, 140 bp, Artificial Sequence
  Synthetic
atacgccatgctgggtctccaggctgacacgggatttggaggctgtgcccttcgtcaacaggaccactccattcaccattagagggcccctgggcaaccaggggcgggggaacccggtgccgtacttgggagtcggccat

SEQ ID NO: 381540 - DNA, 140 bp, Artificial Sequence
  Synthetic
atggccgactcccaagtacggcaccgggttcccccgcccctggttgcccaggggccctctaatggtgaatggagtggtcctgttgacgaagggcacagcctccaaatcccgtgtcagcctggagacccagcatggcgtat

SEQ ID NO: 381541 - DNA, 140 bp, Artificial Sequence
  Synthetic
atacgccatgctgggtctccgttcccccttgggcttcgggtcgtacaccatgaccatgatccgcggctccctccacttggtgaaatgccccactcccgctattgagcctcccactgggaccgtacttgggagtcggccat

SEQ ID NO: 381542 - DNA, 140 bp, Artificial Sequence
  Synthetic
atggccgactcccaagtacggtcccagtgggaggctcaatagcgggagtggggcatttcaccaagtggagggagccgcggatcatggtcatggtgtacgacccgaagcccaagggggaacggagacccagcatggcgtat

SEQ ID NO: 381543 - DNA, 140 bp, Artificial Sequence
  Synthetic
atacgccatgctgggtctccgtttgggttcttccccgggacccccccccttaacaactgcatgctcttggggaccgaggtctccgaggcattgggaggggctgggctcacgggggggttccgtacttgggagtcggccat

SEQ ID NO: 381544 - DNA, 140 bp, Artificial Sequence
  Synthetic
atggccgactcccaagtacggaacccccccgtgagcccagcccctcccaatgcctcggagacctcggtccccaagagcatgcagttgttaagggggggggtcccggggaagaacccaaacggagacccagcatggcgtat

SEQ ID NO: 381545 - DNA, 140 bp, Artificial Sequence
  Synthetic
atacgccatgctgggtctcctatgaacccctggtgcggcggtgttcagagctgatggggcgccgaaatccggtttgcccggggtttgcatggctctcctcgggcaggcccgacggcttcacgtacttgggagtcggccat

SEQ ID NO: 381546 - DNA, 140 bp, Artificial Sequence
  Synthetic
atggccgactcccaagtacgtgaagccgtcgggcctgcccgaggagagccatgcaaaccccgggcaaaccggatttcggcgccccatcagctctgaacaccgccgcaccaggggttcataggagacccagcatggcgtat

SEQ ID NO: 381547 - DNA, 140 bp, Artificial Sequence
  Synthetic
atacgccatgctgggtctcctacacgtccagggccacctacaggaggtggatgcaggcaacttcatcccgcccccgcgctggttgctcttggatttcgtgtttgtcctgttatatctgatcgtacttgggagtcggccat

SEQ ID NO: 381548 - DNA, 140 bp, Artificial Sequence
  Synthetic
atggccgactcccaagtacgatcagatataacaggacaaacacgaaatccaagagcaaccagcgcgggggcgggatgaagttgcctgcatccacctcctgtaggtggccctggacgtgtaggagacccagcatggcgtat

SEQ ID NO: 381549 - DNA, 140 bp, Artificial Sequence
  Synthetic
atacgccatgctgggtctccgaagctggcggaggcacggttggtccccctgatacttctcttgctatggtggtgggtcaatcagctggcggtccttgggctgccggctgttggcgctgctcgtacttgggagtcggccat

SEQ ID NO: 381550 - DNA, 140 bp, Artificial Sequence
  Synthetic
atggccgactcccaagtacgagcagcgccaacagccggcagcccaaggaccgccagctgattgacccaccaccatagcaagagaagtatcagggggaccaaccgtgcctccgccagcttcggagacccagcatggcgtat

SEQ ID NO: 381551 - DNA, 140 bp, Artificial Sequence
  Synthetic
atacgccatgctgggtctccgtggcgggggaggtgtttgcgggcccggccttgtcctggtgtctgggcctacccttcgtgagcatgatactaggactagcaaacctggtgttgtactttccgtacttgggagtcggccat

SEQ ID NO: 381552 - DNA, 140 bp, Artificial Sequence
  Synthetic
atggccgactcccaagtacggaaagtacaacaccaggtttgctagtcctagtatcatgctcacgaagggtaggcccagacaccaggacaaggccgggcccgcaaacacctcccccgccacggagacccagcatggcgtat

SEQ ID NO: 381553 - DNA, 140 bp, Artificial Sequence
  Synthetic
atacgccatgctgggtctccgctggatgggtccccaacgcttgatgttccttgttttgtggaagctcgctcggggagcttttccgcttgctcttctcatgggtatttcggcaacccgcggcgtacttgggagtcggccat

SEQ ID NO: 381554 - DNA, 140 bp, Artificial Sequence
  Synthetic
atggccgactcccaagtacgccgcgggttgccgaaatacccatgagaagagcaagcggaaaagctccccgagcgagcttccacaaaacaaggaacatcaagcgttggggacccatccagcggagacccagcatggcgtat

SEQ ID NO: 381555 - DNA, 140 bp, Artificial Sequence
  Synthetic
atacgccatgctgggtctccccgcacctctgtgctcggagccgagttctgctttgacgtcacctttgaagtggacacgtcggttttgggttgggtggtggccagtgtcttggcctgggcccgtacttgggagtcggccat

SEQ ID NO: 381556 - DNA, 140 bp, Artificial Sequence
  Synthetic
atggccgactcccaagtacgggcccaggccaagacactggccaccacccaacccaaaaccgacgtgtccacttcaaaggtgacgtcaaagcagaactcggctccgagcacagaggtgcggggagacccagcatggcgtat

SEQ ID NO: 381557 - DNA, 140 bp, Artificial Sequence
  Synthetic
atacgccatgctgggtctccatagcgctcctgagctccatgagcgcgggagggtggaggcacaaggctgtgatttacaggacgtggtgtaaggggtaccaggcggtgcgtcagcgggtggcgtacttgggagtcggccat

SEQ ID NO: 381558 - DNA, 140 bp, Artificial Sequence
  Synthetic
atggccgactcccaagtacgccacccgctgacgcaccgcctggtaccccttacaccacgtcctgtaaatcacagccttgtgcctccaccctcccgcgctcatggagctcaggagcgctatggagacccagcatggcgtat

SEQ ID NO: 381559 - DNA, 140 bp, Artificial Sequence
  Synthetic
atacgccatgctgggtctccttcggagccccctcggggaggggcgacctaccaagcccctgaccatcgcgtggtgcctagcttcctacatctggccggacgctgtcatgctggtggttgtcgtacttgggagtcggccat

SEQ ID NO: 381560 - DNA, 140 bp, Artificial Sequence
  Synthetic
atggccgactcccaagtacgacaaccaccagcatgacagcgtccggccagatgtaggaagctaggcaccacgcgatggtcaggggcttggtaggtcgcccctccccgagggggctccgaaggagacccagcatggcgtat

SEQ ID NO: 381561 - DNA, 140 bp, Artificial Sequence
  Synthetic
atacgccatgctgggtctccggcgctggtgctcctctttggcctgttcgacgcgttggactgggccttggaggagttactagtgtctcggccctctttacggcgcctggcacgggtggtgcgtacttgggagtcggccat

SEQ ID NO: 381562 - DNA, 140 bp, Artificial Sequence
  Synthetic
atggccgactcccaagtacgcaccacccgtgccaggcgccgtaaagagggccgagacactagtaactcctccaaggcccagtccaacgcgtcgaacaggccaaagaggagcaccagcgccggagacccagcatggcgtat

SEQ ID NO: 381563 - DNA, 140 bp, Artificial Sequence
  Synthetic
atacgccatgctgggtctccgaatgctgtgtgatggctggtgagaaggcgactaccgtccggctggtgtccaagatgtgtgcgcggggggcctatttgtttgatcatatgggctctttctcgtacttgggagtcggccat

SEQ ID NO: 381564 - DNA, 140 bp, Artificial Sequence
  Synthetic
atggccgactcccaagtacgagaaagagcccatatgatcaaacaaataggccccccgcgcacacatcttggacaccagccggacggtagtcgccttctcaccagccatcacacagcattcggagacccagcatggcgtat

SEQ ID NO: 381565 - DNA, 140 bp, Artificial Sequence
  Synthetic
atacgccatgctgggtctcccgcgcgccgtcaaggagcgcctgctggagtgggacgccgccttggaaccgttgtcattcaccaggacggattgtcgcatcatacgggatgccgccaggaccgtacttgggagtcggccat

SEQ ID NO: 381566 - DNA, 140 bp, Artificial Sequence
  Synthetic
atggccgactcccaagtacggtcctggcggcatcccgtatgatgcgacaatccgtcctggtgaatgacaacggttccaaggcggcgtcccactccagcaggcgctccttgacggcgcgcgggagacccagcatggcgtat

SEQ ID NO: 381567 - DNA, 140 bp, Artificial Sequence
  Synthetic
atacgccatgctgggtctcccttgagctgcggtcagtgcgtcatgggcttgcccgtggtggcgcgccgcggcgatgaggttttgatcggtgtctttcaagatgtgaaccatttgcctccccgtacttgggagtcggccat

SEQ ID NO: 381568 - DNA, 140 bp, Artificial Sequence
  Synthetic
atggccgactcccaagtacggggaggcaaatggttcacatcttgaaagacaccgatcaaaacctcatcgccgcggcgcgccaccacgggcaagcccatgacgcactgaccgcagctcaagggagacccagcatggcgtat

SEQ ID NO: 381569 - DNA, 140 bp, Artificial Sequence
  Synthetic
atacgccatgctgggtctccgggtttgtccccactgcaccagttgtcatccgtcggtgcggtaagggctttcttggagtgacgaaggcagctttgacaggaagggatccagacctacacccgtacttgggagtcggccat

SEQ ID NO: 381570 - DNA, 140 bp, Artificial Sequence
  Synthetic
atggccgactcccaagtacgggtgtaggtctggatcccttcctgtcaaagctgccttcgtcactccaagaaagcccttaccgcaccgacggatgacaactggtgcagtggggacaaacccggagacccagcatggcgtat

SEQ ID NO: 381571 - DNA, 140 bp, Artificial Sequence
  Synthetic
atacgccatgctgggtctcccggggaacgtcatggtgttggggacggctacctctcggagcatgggcacatgtctgaatgggttgctgttcacaactttccatggggcttcgtcccgaaccgtacttgggagtcggccat

SEQ ID NO: 381572 - DNA, 140 bp, Artificial Sequence
  Synthetic
atggccgactcccaagtacggttcgggacgaagccccatggaaagttgtgaacagcaacccattcagacatgtgcccatgctccgagaggtagccgtccccaacaccatgacgttccccgggagacccagcatggcgtat

SEQ ID NO: 381573 - DNA, 140 bp, Artificial Sequence
  Synthetic
atacgccatgctgggtctcccattgcgacgcccgtgggggccctaaacccaaggtggtggtccgccagtgatgatgtcacggtgtaccccctcccggatggagcaacctcattaacgcctcgtacttgggagtcggccat

SEQ ID NO: 381574 - DNA, 140 bp, Artificial Sequence
  Synthetic
atggccgactcccaagtacgaggcgttaatgaggttgctccatccgggagggggtacaccgtgacatcatcactggcggaccaccaccttgggtttagggcccccacgggcgtcgcaatgggagacccagcatggcgtat

SEQ ID NO: 381575 - DNA, 140 bp, Artificial Sequence
  Synthetic
atacgccatgctgggtctcctgtacttgccaggcggagtcctgttgggtcattcgatcggacggggctctttgccatggtttgtgtaagggggacaaggtagaactggacgtggccatggcgtacttgggagtcggccat

SEQ ID NO: 381576 - DNA, 140 bp, Artificial Sequence
  Synthetic
atggccgactcccaagtacgccatggccacgtccagttctaccttgtcccccttacacaaaccatggcaaagagccccgtccgatcgaatgacccaacaggactccgcctggcaagtacaggagacccagcatggcgtat

SEQ ID NO: 381577 - DNA, 140 bp, Artificial Sequence
  Synthetic
atacgccatgctgggtctccaggtcgctgatttccgtgggtcgtctgggtcacccgtcttgtgtgatgaggggcacgcagtaggaatgctcgtgtcggtgcttcactctggggggagggtcgtacttgggagtcggccat

SEQ ID NO: 381578 - DNA, 140 bp, Artificial Sequence
  Synthetic
atggccgactcccaagtacgaccctccccccagagtgaagcaccgacacgagcattcctactgcgtgcccctcatcacacaagacgggtgacccagacgacccacggaaatcagcgacctggagacccagcatggcgtat

SEQ ID NO: 381579 - DNA, 140 bp, Artificial Sequence
  Synthetic
atacgccatgctgggtctcctactgcggcacgattcactcggccgtggacccaagtccctacagatgccaagaccaccactgaacccccgccggtaccagcaaaaggagtcttcaaggaacgtacttgggagtcggccat

SEQ ID NO: 381580 - DNA, 140 bp, Artificial Sequence
  Synthetic
atggccgactcccaagtacgttccttgaagactccttttgctggtaccggcgggggttcagtggtggtcttggcatctgtagggacttgggtccacggccgagtgaatcgtgccgcagtaggagacccagcatggcgtat

SEQ ID NO: 381581 - DNA, 140 bp, Artificial Sequence
  Synthetic
atacgccatgctgggtctccgccccgttattcatgcctacgggggccggcaagagcacgcgggtccccttggagtatggaaatatggggcacaaggtcctgattctgaacccgtccgtggcgtacttgggagtcggccat

SEQ ID NO: 381582 - DNA, 140 bp, Artificial Sequence
  Synthetic
atggccgactcccaagtacgccacggacgggttcagaatcaggaccttgtgccccatatttccatactccaaggggacccgcgtgctcttgccggcccccgtaggcatgaataacggggcggagacccagcatggcgtat

SEQ ID NO: 381583 - DNA, 140 bp, Artificial Sequence
  Synthetic
atacgccatgctgggtctccctacggtgcgtgccatgggcccctatatggagcgcctggctggcaaacatcctagcatctactgcggacatgacaccactgcgttcacacggatcacggacgtacttgggagtcggccat

SEQ ID NO: 381584 - DNA, 140 bp, Artificial Sequence
  Synthetic
atggccgactcccaagtacgtccgtgatccgtgtgaacgcagtggtgtcatgtccgcagtagatgctaggatgtttgccagccaggcgctccatataggggcccatggcacgcaccgtagggagacccagcatggcgtat

SEQ ID NO: 381585 - DNA, 140 bp, Artificial Sequence
  Synthetic
atacgccatgctgggtctccttcccccctaacgtattctacctatggtcggttcttagccaaccctaggcagatgctacggggggtctctgttgtaatctgtgatgagtgccacagccatcgtacttgggagtcggccat

SEQ ID NO: 381586 - DNA, 140 bp, Artificial Sequence
  Synthetic
atggccgactcccaagtacgatggctgtggcactcatcacagattacaacagagaccccccgtagcatctgcctagggttggctaagaaccgaccataggtagaatacgttaggggggaaggagacccagcatggcgtat

SEQ ID NO: 381587 - DNA, 140 bp, Artificial Sequence
  Synthetic
atacgccatgctgggtctccgactcaactgtgttgttggggattgggcgggtccgggagctggctcgcggttgtggggtacaacttgtgctttacgccacggccactcccccggggtcgccgtacttgggagtcggccat

SEQ ID NO: 381588 - DNA, 140 bp, Artificial Sequence
  Synthetic
atggccgactcccaagtacggcgaccccgggggagtggccgtggcgtaaagcacaagttgtaccccacaaccgcgagccagctcccggacccgcccaatccccaacaacacagttgagtcggagacccagcatggcgtat

SEQ ID NO: 381589 - DNA, 140 bp, Artificial Sequence
  Synthetic
atacgccatgctgggtctccccatgacccagcatccttccatcattgagaccaaactggatgtgggtgagattcccttttatgggcatggtatacctctggagcggatgcgaaccggccgcgtacttgggagtcggccat

SEQ ID NO: 381590 - DNA, 140 bp, Artificial Sequence
  Synthetic
atggccgactcccaagtacgcggccggttcgcatccgctccagaggtataccatgcccataaaagggaatctcacccacatccagtttggtctcaatgatggaaggatgctgggtcatggggagacccagcatggcgtat

SEQ ID NO: 381591 - DNA, 140 bp, Artificial Sequence
  Synthetic
atacgccatgctgggtctccgcatctcgtattttgccactcgaaggctgagtgcgagaggctggctggccagttctccgcgagaggggttaacgccatagcctattataggggaaaagaccgtacttgggagtcggccat

SEQ ID NO: 381592 - DNA, 140 bp, Artificial Sequence
  Synthetic
atggccgactcccaagtacggtcttttcccctataataggctatggcgttaacccctctcgcggagaactggccagccagcctctcgcactcagccttcgagtggcaaaatacgagatgcggagacccagcatggcgtat

SEQ ID NO: 381593 - DNA, 140 bp, Artificial Sequence
  Synthetic
atacgccatgctgggtctccagttcaataatcaaggatggtgacctagtggtctgcgctacagacgcgctttccacgggttacactgggaacttcgattctgtgactgactgtggtttggcgtacttgggagtcggccat

SEQ ID NO: 381594 - DNA, 140 bp, Artificial Sequence
  Synthetic
atggccgactcccaagtacgccaaaccacagtcagtcacagaatcgaagttcccagtgtaacccgtggaaagcgcgtctgtagcgcagaccactaggtcaccatccttgattattgaactggagacccagcatggcgtat

SEQ ID NO: 381595 - DNA, 140 bp, Artificial Sequence
  Synthetic
atacgccatgctgggtctcctggtggaggaggtcgtcgaggtgacccttgatcccaccatcaccatctccttgcgaacggtccctgcatcggctgaactgtcgatgcagcggagaggacgcgtacttgggagtcggccat

SEQ ID NO: 381596 - DNA, 140 bp, Artificial Sequence
  Synthetic
atggccgactcccaagtacgcgtcctctccgctgcatcgacagttcagccgatgcagggaccgttcgcaaggagatggtgatggtgggatcaagggtcacctcgacgacctcctccaccaggagacccagcatggcgtat

SEQ ID NO: 381597 - DNA, 140 bp, Artificial Sequence
  Synthetic
atacgccatgctgggtctcccacgggtcgtgggcggtctgggcggtactactacgctggggtcggcaaggccccggcgggtgtggtccgctcaggtcccgtctggtcagcagtggaagcccgtacttgggagtcggccat

SEQ ID NO: 381598 - DNA, 140 bp, Artificial Sequence
  Synthetic
atggccgactcccaagtacgggcttccactgctgaccagacgggacctgagcggaccacacccgccggggccttgccgaccccagcgtagtagtaccgcccagaccgcccacgacccgtgggagacccagcatggcgtat

SEQ ID NO: 381599 - DNA, 140 bp, Artificial Sequence
  Synthetic
atacgccatgctgggtctccggagtgacctggtatggaatggaacctgacttgacagcaaaccttctgaggctttacgacgactgcccttacaccgcagccgtcgcagcagacattggggcgtacttgggagtcggccat

SEQ ID NO: 381600 - DNA, 140 bp, Artificial Sequence
  Synthetic
atggccgactcccaagtacgccccaatgtctgctgcgacggctgcggtgtaagggcagtcgtcgtaaagcctcagaaggtttgctgtcaagtcaggttccattccataccaggtcactccggagacccagcatggcgtat

SEQ ID NO: 381601 - DNA, 140 bp, Artificial Sequence
  Synthetic
atacgccatgctgggtctccaagccgctgtgttcttctcgggcctcgcgcctttgaggatgcatcctgatgtcagctgggcaaaagttcgcggcgtcaattggcccctcctggtgggtgtcgtacttgggagtcggccat

SEQ ID NO: 381602 - DNA, 140 bp, Artificial Sequence
  Synthetic
atggccgactcccaagtacgacacccaccaggaggggccaattgacgccgcgaacttttgcccagctgacatcaggatgcatcctcaaaggcgcgaggcccgagaagaacacagcggcttggagacccagcatggcgtat

SEQ ID NO: 381603 - DNA, 140 bp, Artificial Sequence
  Synthetic
atacgccatgctgggtctcctcagcggacgatgtgtcgggaaacactgtcgcccggcccgtcggatgacccccagtgggccggtctgaaagggcccaatcctgtcccactactgctgaggcgtacttgggagtcggccat

SEQ ID NO: 381604 - DNA, 140 bp, Artificial Sequence
  Synthetic
atggccgactcccaagtacgcctcagcagtagtgggacaggattgggccctttcagaccggcccactgggggtcatccgacgggccgggcgacagtgtttcccgacacatcgtccgctgaggagacccagcatggcgtat

SEQ ID NO: 381605 - DNA, 140 bp, Artificial Sequence
  Synthetic
atacgccatgctgggtctcctggggcaacgatttgccatccaaagtggccggccaccacatagtagacgacctggtccggcgtctcggtgtggcggagggttatgtcaggtgtgacgcggcgtacttgggagtcggccat

SEQ ID NO: 381606 - DNA, 140 bp, Artificial Sequence
  Synthetic
atggccgactcccaagtacgccgcgtcacacctgacataaccctccgccacaccgagacgccggaccaggtcgtctactatgtggtggccggccactttggatggcaaatcgttgccccaggagacccagcatggcgtat

SEQ ID NO: 381607 - DNA, 140 bp, Artificial Sequence
  Synthetic
atacgccatgctgggtctccggcctatcttaatggtgggcctcgctatcgcaggtggcatgatctacgcgtcttacaccgggtccctagtggtggtttcagactgggatgtgaaggggggcgtacttgggagtcggccat

SEQ ID NO: 381608 - DNA, 140 bp, Artificial Sequence
  Synthetic
atggccgactcccaagtacgccccccttcacatcccagtctgaaaccaccactagggacccggtgtaagacgcgtagatcatgccacctgcgatagcgaggcccaccattaagataggccggagacccagcatggcgtat

SEQ ID NO: 381609 - DNA, 140 bp, Artificial Sequence
  Synthetic
atacgccatgctgggtctcccggcaaccctctttataggagcggtgaccaggctactcctcaaccagtggtgcaggtccccccggtagaccatcggccggggggggagtctgcgccatcgcgtacttgggagtcggccat

SEQ ID NO: 381610 - DNA, 140 bp, Artificial Sequence
  Synthetic
atggccgactcccaagtacgcgatggcgcagactccccccccggccgatggtctaccggggggacctgcaccactggttgaggagtagcctggtcaccgctcctataaagagggttgccgggagacccagcatggcgtat

SEQ ID NO: 381611 - DNA, 140 bp, Artificial Sequence
  Synthetic
atacgccatgctgggtctccgatgccaagacagtgacagatgcggtggcagccatccaggtgaactgcgattggtcggtcatgaccctgtcgatcggggaagtgctgaccttggctcaggcgtacttgggagtcggccat

SEQ ID NO: 381612 - DNA, 140 bp, Artificial Sequence
  Synthetic
atggccgactcccaagtacgcctgagccaaggtcagcacttccccgatcgacagggtcatgaccgaccaatcgcagttcacctggatggctgccaccgcatctgtcactgtcttggcatcggagacccagcatggcgtat

SEQ ID NO: 381613 - DNA, 140 bp, Artificial Sequence
  Synthetic
atacgccatgctgggtctccctaagacagccgaggcctacgcagctaccaccaagtggctcgctggctgctacacggggacgcgggccgtccccactgtttcaattgtggacaagctcttcgtacttgggagtcggccat

SEQ ID NO: 381614 - DNA, 140 bp, Artificial Sequence
  Synthetic
atggccgactcccaagtacgaagagcttgtccacaattgaaacagtggggacggcccgcgtccccgtgtagcagccagcgagccacttggtggtagctgcgtaggcctcggctgtcttagggagacccagcatggcgtat

SEQ ID NO: 381615 - DNA, 140 bp, Artificial Sequence
  Synthetic
atacgccatgctgggtctcctgccggagggtgggctgcggtcgtaggtcactgccacagtgtaatagctgcggctgtggcggcctacggggcttctcggagtcccccgttggcggcggctcgtacttgggagtcggccat

SEQ ID NO: 381616 - DNA, 140 bp, Artificial Sequence
  Synthetic
atggccgactcccaagtacgagccgccgccaacgggggactccgagaagccccgtaggccgccacagccgcagctattacactgtggcagtgacctacgaccgcagcccaccctccggcaggagacccagcatggcgtat

SEQ ID NO: 381617 - DNA, 140 bp, Artificial Sequence
  Synthetic
atacgccatgctgggtctccgcgtcctacctgatgggattgggcgtcggaggcaacgcacaggcccgcctggcttctgctctcctgttgggggccgcgggtactgccctgggtacgccggcgtacttgggagtcggccat

SEQ ID NO: 381618 - DNA, 140 bp, Artificial Sequence
  Synthetic
atggccgactcccaagtacgccggcgtacccagggcagtacccgcggcccccaacaggagagcagaagccaggcgggcctgtgcgttgcctccgacgcccaatcccatcaggtaggacgcggagacccagcatggcgtat

SEQ ID NO: 381619 - DNA, 140 bp, Artificial Sequence
  Synthetic
atacgccatgctgggtctcctggtgggtctaaccatggccggcgcgttcatgggcggcgctagcgtgtccccctcactggtcacggtcctcttgggggctgtgggtggttgggagggagtcgtacttgggagtcggccat

SEQ ID NO: 381620 - DNA, 140 bp, Artificial Sequence
  Synthetic
atggccgactcccaagtacgactccctcccaaccacccacagcccccaagaggaccgtgaccagtgagggggacacgctagcgccgcccatgaacgcgccggccatggttagacccaccaggagacccagcatggcgtat

SEQ ID NO: 381621 - DNA, 140 bp, Artificial Sequence
  Synthetic
atacgccatgctgggtctccggtcaatgcggccagtcttgtcttcgacttcatggcagggaagctatcaactgaagacctgtggtatgccatcccggtgctcactagtccaggagccggccgtacttgggagtcggccat

SEQ ID NO: 381622 - DNA, 140 bp, Artificial Sequence
  Synthetic
atggccgactcccaagtacggccggctcctggactagtgagcaccgggatggcataccacaggtcttcagttgatagcttccctgccatgaagtcgaagacaagactggccgcattgaccggagacccagcatggcgtat

SEQ ID NO: 381623 - DNA, 140 bp, Artificial Sequence
  Synthetic
atacgccatgctgggtctccctggccggcatcgccttagggctggtgctgtactcagctaacaactctggcactactacatggttgaatcgtctgctgacgacactgccccgatcttcatcgtacttgggagtcggccat

SEQ ID NO: 381624 - DNA, 140 bp, Artificial Sequence
  Synthetic
atggccgactcccaagtacgatgaagatcggggcagtgtcgtcagcagacgattcaaccatgtagtagtgccagagttgttagctgagtacagcaccagccctaaggcgatgccggccagggagacccagcatggcgtat

SEQ ID NO: 381625 - DNA, 140 bp, Artificial Sequence
  Synthetic
atacgccatgctgggtctccgcatcccggacagctatttccaacaggccgactactgtgacaaagtctcagccatgctccgacgcttgagcctcactaggactgtggttgccctggtcaacgtacttgggagtcggccat

SEQ ID NO: 381626 - DNA, 140 bp, Artificial Sequence
  Synthetic
atggccgactcccaagtacgttgaccagggcaaccacagtcctagtgaggctcaagcgtcggagcatggctgagactttgtcacagtagtcggcctgttggaaatagctgtccgggatgcggagacccagcatggcgtat

SEQ ID NO: 381627 - DNA, 140 bp, Artificial Sequence
  Synthetic
atacgccatgctgggtctcccagggagccaaaggtggatgaggttcaggtggggtatgtctgggacctgtgggagtgggtcatgcgtcagatacgcatggtcatggctagacttcgggcccgtacttgggagtcggccat

SEQ ID NO: 381628 - DNA, 140 bp, Artificial Sequence
  Synthetic
atggccgactcccaagtacgggcccgaagtctagccatgaccatgcgtatctgacgcatgacccactcccacaggtcccagacataccccacctgaacctcatccacctttggctccctgggagacccagcatggcgtat

SEQ ID NO: 381629 - DNA, 140 bp, Artificial Sequence
  Synthetic
atacgccatgctgggtctccctctgccccgtggtgtcactgcctttgtggcactgcggggaggggtggtccggagaatggctgttggacggtcatgtggagagccgctgtctgtgcgggtcgtacttgggagtcggccat

SEQ ID NO: 381630 - DNA, 140 bp, Artificial Sequence
  Synthetic
atggccgactcccaagtacgacccgcacagacagcggctctccacatgaccgtccaacagccattctccggaccacccctccccgcagtgccacaaaggcagtgacaccacggggcagagggagacccagcatggcgtat

SEQ ID NO: 381631 - DNA, 140 bp, Artificial Sequence
  Synthetic
atacgccatgctgggtctccgtgtgattactggggacgtgttgaatggccaactcaaagatccagtttactccacaaagttgtgccggcactattggatggggacagtacctgtcaacatcgtacttgggagtcggccat

SEQ ID NO: 381632 - DNA, 140 bp, Artificial Sequence
  Synthetic
atggccgactcccaagtacgatgttgacaggtactgtccccatccaatagtgccggcacaactttgtggagtaaactggatctttgagttggccattcaacacgtccccagtaatcacacggagacccagcatggcgtat

SEQ ID NO: 381633 - DNA, 140 bp, Artificial Sequence
  Synthetic
atacgccatgctgggtctccgctgggatacggggaaacttcacctctcctggcctccgataccccaaaggttgtaccgtttgggacggcaggctgggcggaggttgtcgtgacccctacccgtacttgggagtcggccat

SEQ ID NO: 381634 - DNA, 140 bp, Artificial Sequence
  Synthetic
atggccgactcccaagtacgggtaggggtcacgacaacctccgcccagcctgccgtcccaaacggtacaacctttggggtatcggaggccaggagaggtgaagtttccccgtatcccagcggagacccagcatggcgtat

SEQ ID NO: 381635 - DNA, 140 bp, Artificial Sequence
  Synthetic
aggccctggctgctgatatgttgtaccgtttgggacggcaggctgggcggaggttgtcgtgacccctacccacgtggtggtcaggcgcacctcgtgctacaagctgctgcgccaacaaatgaccttttgggacagcggtg

SEQ ID NO: 381636 - DNA, 140 bp, Artificial Sequence
  Synthetic
caccgctgtcccaaaaggtcatttgttggcgcagcagcttgtagcacgaggtgcgcctgaccaccacgtgggtaggggtcacgacaacctccgcccagcctgccgtcccaaacggtacaacatatcagcagccagggcct

SEQ ID NO: 381637 - DNA, 140 bp, Artificial Sequence
  Synthetic
aggccctggctgctgatatgactttctgctgctgtggctgagccctattacgtcgatggcattccagtttcttgggaggccgacgcgcgagcgccggcaatggtctacggtcctggccaagaccttttgggacagcggtg

SEQ ID NO: 381638 - DNA, 140 bp, Artificial Sequence
  Synthetic
caccgctgtcccaaaaggtcttggccaggaccgtagaccattgccggcgctcgcgcgtcggcctcccaagaaactggaatgccatcgacgtaatagggctcagccacagcagcagaaagtcatatcagcagccagggcct

SEQ ID NO: 381639 - DNA, 140 bp, Artificial Sequence
  Synthetic
atacgccatgctgggtctccagcgttaccattgacggggagcgctacaccctcccgcaccagctgcggatgaggaatgttgcgccctctgaggtttcgtctgaggtcagcatcgagatcgcgtacttgggagtcggccat

SEQ ID NO: 381640 - DNA, 140 bp, Artificial Sequence
  Synthetic
atggccgactcccaagtacgcgatctcgatgctgacctcagacgaaacctcagagggcgcaacattcctcatccgcagctggtgcgggagggtgtagcgctccccgtcaatggtaacgctggagacccagcatggcgtat

SEQ ID NO: 381641 - DNA, 140 bp, Artificial Sequence
  Synthetic
atacgccatgctgggtctccggacggagactgaggattcagaactgactgaagctgatctgccaccggcggctgcggccctccaagcgatagagaatgctgcgaggattctcgaaccgcacgtacttgggagtcggccat

SEQ ID NO: 381642 - DNA, 140 bp, Artificial Sequence
  Synthetic
atggccgactcccaagtacgtgcggttcgagaatcctcgcagcattctctatcgcttggagggccgcagccgccggtggcagatcagcttcagtcagttctgaatcctcagtctccgtccggagacccagcatggcgtat

SEQ ID NO: 381643 - DNA, 140 bp, Artificial Sequence
  Synthetic
aggccctggctgctgatatggctgcggccctccaagcgatagagaatgctgcgaggattctcgaaccgcatattgatgtaatcatggaggactgcagtacaccctctctctgtggaagtagaccttttgggacagcggtg

SEQ ID NO: 381644 - DNA, 140 bp, Artificial Sequence
  Synthetic
caccgctgtcccaaaaggtctacttccacagagagagggtgtactgcagtcctccatgattacatcaatatgcggttcgagaatcctcgcagcattctctatcgcttggagggccgcagccatatcagcagccagggcct

SEQ ID NO: 381645 - DNA, 140 bp, Artificial Sequence
  Synthetic
aggccctggctgctgatatggccgagagatgcctgtgtggggagaagacatcccccgcactccatcgcctgcacttatctcggttacggagagcagctcagatgagaagaccccgtcggtgaccttttgggacagcggtg

SEQ ID NO: 381646 - DNA, 140 bp, Artificial Sequence
  Synthetic
caccgctgtcccaaaaggtcaccgacggggtcttctcatctgagctgctctccgtaaccgagataagtgcaggcgatggagtgcgggggatgtcttctccccacacaggcatctctcggccatatcagcagccagggcct

SEQ ID NO: 381647 - DNA, 140 bp, Artificial Sequence
  Synthetic
atacgccatgctgggtctccgacctcctcgcaggaggacaccccgtcatctgactcatttgaagtcatccaagagtctgattcagcaggaggggaggacaatgtcttcaacgtggctcttcgtacttgggagtcggccat

SEQ ID NO: 381648 - DNA, 140 bp, Artificial Sequence
  Synthetic
atggccgactcccaagtacgaagagccacgttgaagacattgtcctcccctcctgctgaatcagactcttggatgacttcaaatgagtcagatgacggggtgtcctcctgcgaggaggtcggagacccagcatggcgtat

SEQ ID NO: 381649 - DNA, 140 bp, Artificial Sequence
  Synthetic
atacgccatgctgggtctcctccgtactaaaagccttattcccgcagagcgacgccacccgcaagctaacggtcaagatgtcatgctgcgtggagaaaagcgtaacacgcttcttttcctcgtacttgggagtcggccat

SEQ ID NO: 381650 - DNA, 140 bp, Artificial Sequence
  Synthetic
atggccgactcccaagtacgaggaaaagaagcgtgttacgcttttctccacgcagcatgacatcttgaccgttagcttgcgggtggcgtcgctctgcgggaataaggcttttagtacggaggagacccagcatggcgtat

SEQ ID NO: 381651 - DNA, 140 bp, Artificial Sequence
  Synthetic
aggccctggctgctgatatgggtcaagatgtcatgctgcgtggagaaaagcgtaacacgcttcttttccttggggttgaccgtggctgacgtggcaagcctgtgtgaaatggaaatccaggaccttttgggacagcggtg

SEQ ID NO: 381652 - DNA, 140 bp, Artificial Sequence
  Synthetic
caccgctgtcccaaaaggtcctggatttccatttcacacaggcttgccacgtcagccacggtcaaccccaaggaaaagaagcgtgttacgcttttctccacgcagcatgacatcttgacccatatcagcagccagggcct

SEQ ID NO: 381653 - DNA, 140 bp, Artificial Sequence
  Synthetic
aggccctggctgctgatatgaaccatacagcctattgtgacaaggtgcgcactccgcttgaattgcaggttgggtgcttggtgggcaatgaacttacctttgaatgtgacaagtgtgagggaccttttgggacagcggtg

SEQ ID NO: 381654 - DNA, 140 bp, Artificial Sequence
  Synthetic
caccgctgtcccaaaaggtccctcacacttgtcacattcaaaggtaagttcattgcccaccaagcacccaacctgcaattcaagcggagtgcgcaccttgtcacaataggctgtatggttcatatcagcagccagggcct

SEQ ID NO: 381655 - DNA, 140 bp, Artificial Sequence
  Synthetic
atacgccatgctgggtctcccacgccaggagacgttggcctccttctcatacatctggtcaggggttcccctgacgagagctactccggctaagccacctgtggtgaggccggtgggttccgtacttgggagtcggccat

SEQ ID NO: 381656 - DNA, 140 bp, Artificial Sequence
  Synthetic
atggccgactcccaagtacggaacccaccggcctcaccacaggtggcttagccggagtagctctcgtcaggggaacccctgaccagatgtatgagaaggaggccaacgtctcctggcgtgggagacccagcatggcgtat

SEQ ID NO: 381657 - DNA, 140 bp, Artificial Sequence
  Synthetic
atacgccatgctgggtctcctctgttggtggcggacactactaaggtgtacgtcactaacccagacaatgtggggaggagggtcgacaaggttaccttttggcgggctcctagggtccatcgtacttgggagtcggccat

SEQ ID NO: 381658 - DNA, 140 bp, Artificial Sequence
  Synthetic
atggccgactcccaagtacgatggaccctaggagcccgccaaaaggtaaccttgtcgaccctcctccccacattgtctgggttagtgacgtacaccttagtagtgtccgccaccaacagaggagacccagcatggcgtat

SEQ ID NO: 381659 - DNA, 140 bp, Artificial Sequence
  Synthetic
atacgccatgctgggtctccgacaaatatctcgtggattctatcgaggccgcccggagggccgctcagggctgcctaagcatgggttacacttatgaggaggcaataaggactgttaggccgtacttgggagtcggccat

SEQ ID NO: 381660 - DNA, 140 bp, Artificial Sequence
  Synthetic
atggccgactcccaagtacggcctaacagtccttattgcctcctcataagtgtaacccatgcttaggcagccctgagcggccctccgggcggcctcgatagaatccacgagatatttgtcggagacccagcatggcgtat

SEQ ID NO: 381661 - DNA, 140 bp, Artificial Sequence
  Synthetic
atacgccatgctgggtctcccacatgctgccatgggctggggatctaaggtgtcggtcaaggatctagccacccccgcggggaagatggctgtccacgaccggcttcaggagatacttgacgtacttgggagtcggccat

SEQ ID NO: 381662 - DNA, 140 bp, Artificial Sequence
  Synthetic
atggccgactcccaagtacgtcaagtatctcctgaagccggtcgtggacagccatcttccccgcgggggtggctagatccttgaccgacaccttagatccccagcccatggcagcatgtgggagacccagcatggcgtat

SEQ ID NO: 381663 - DNA, 140 bp, Artificial Sequence
  Synthetic
atacgccatgctgggtctccagggactccggtcccctttacattgactgtgaaaaaggaggtgttcttcaaagaccgaaaggaggagaaagccccccgcctcattgtgttcccccccctgcgtacttgggagtcggccat

SEQ ID NO: 381664 - DNA, 140 bp, Artificial Sequence
  Synthetic
atggccgactcccaagtacgcaggggggggaacacaatgaggcggggggctttctcctcctttcggtctttgaagaacacctcctttttcacagtcaatgtaaaggggaccggagtccctggagacccagcatggcgtat

SEQ ID NO: 381665 - DNA, 140 bp, Artificial Sequence
  Synthetic
atacgccatgctgggtctccgacttcaggatagctgaaaagctcattctgggagacccggggcgggtggccaaggcggtgttggggggggcctatgccttccagtacaccccaaaccagccgtacttgggagtcggccat

SEQ ID NO: 381666 - DNA, 140 bp, Artificial Sequence
  Synthetic
atggccgactcccaagtacggctggtttggggtgtactggaaggcataggccccccccaacaccgccttggccacccgccccgggtctcccagaatgagcttttcagctatcctgaagtcggagacccagcatggcgtat

SEQ ID NO: 381667 - DNA, 140 bp, Artificial Sequence
  Synthetic
atacgccatgctgggtctccgagttaaggagatgctcaagctatgggagtcaaagaaaacaccgtgcgccatctgtgtggacgctacgtgcttcgacagttctataactgaagaggacgtcgtacttgggagtcggccat

SEQ ID NO: 381668 - DNA, 140 bp, Artificial Sequence
  Synthetic
atggccgactcccaagtacgacgtcctcttcagttatagaactgtcgaagcacgtagcgtccacacagatggcgcacggtgttttctttgactcccatagcttgagcatctccttaactcggagacccagcatggcgtat

SEQ ID NO: 381669 - DNA, 140 bp, Artificial Sequence
  Synthetic
atacgccatgctgggtctccggctttggagacagagctatatgctcttgcctccgaccatccagagtgggtgcgcgccctggggaagtactatgcttctggtaccatggttaccccggaacgtacttgggagtcggccat

SEQ ID NO: 381670 - DNA, 140 bp, Artificial Sequence
  Synthetic
atggccgactcccaagtacgttccggggtaaccatggtaccagaagcatagtacttccccagggcgcgcacccactctggatggtcggaggcaagagcatatagctctgtctccaaagccggagacccagcatggcgtat

SEQ ID NO: 381671 - DNA, 140 bp, Artificial Sequence
  Synthetic
atacgccatgctgggtctccggggtacccgtgggagagaggtattgtaggtcctcgggcgttttgactaccagtgccagcaactgcttgacttgctacatcaaggtgaaagccgcttgcccgtacttgggagtcggccat

SEQ ID NO: 381672 - DNA, 140 bp, Artificial Sequence
  Synthetic
atggccgactcccaagtacgggcaagcggctttcaccttgatgtagcaagtcaagcagttgctggcactggtagtcaaaacgcccgaggacctacaatacctctctcccacgggtaccccggagacccagcatggcgtat

SEQ ID NO: 381673 - DNA, 140 bp, Artificial Sequence
  Synthetic
atacgccatgctgggtctccagagagtgggactcaagaacgtctcgctgctcatagcaggtgatgactgtctgatcatatgtgagcggcctatgtgcgatccgagcgaggccctgggcagcgtacttgggagtcggccat

SEQ ID NO: 381674 - DNA, 140 bp, Artificial Sequence
  Synthetic
atggccgactcccaagtacgctgcccagggcctcgctcggatcgcacataggccgctcacatatgatcagacagtcatcacctgctatgagcagcgagacgttcttgagtcccactctctggagacccagcatggcgtat

SEQ ID NO: 381675 - DNA, 140 bp, Artificial Sequence
  Synthetic
atacgccatgctgggtctccagccctggcctcttacgggtacgcatgtgagccctcatatcatgcatcattggacacggcccccttctgctccacttggcttgctgagtgtaatgcagaccgtacttgggagtcggccat

SEQ ID NO: 381676 - DNA, 140 bp, Artificial Sequence
  Synthetic
atggccgactcccaagtacggtctgcattacactcagcaagccaagtggagcagaagggggccgtgtccaatgatgcatgatatgagggctcacatgcgtacccgtaagaggccagggctggagacccagcatggcgtat

SEQ ID NO: 381677 - DNA, 140 bp, Artificial Sequence
  Synthetic
atacgccatgctgggtctccgggaaacgctgtttcttccttaccacggacttccggaggccgctcgctcgcatgtcgagtgagtacagtgacccgatggcttcggccattggttacatcccgtacttgggagtcggccat

SEQ ID NO: 381678 - DNA, 140 bp, Artificial Sequence
  Synthetic
atggccgactcccaagtacgggatgtaaccaatggccgaagccatcgggtcactgtactcactcgacatgcgagcgagcggcctccggaagtccgtggtaaggaagaaacagcgtttcccggagacccagcatggcgtat

SEQ ID NO: 381679 - DNA, 140 bp, Artificial Sequence
  Synthetic
atacgccatgctgggtctcctcctttatccctggcaccccataacacggtgggtcatcatccctcacgtgctaacctgcgcgtttaggggtggcggaacaccgtcggacccggtttggtgcgtacttgggagtcggccat

SEQ ID NO: 381680 - DNA, 140 bp, Artificial Sequence
  Synthetic
atggccgactcccaagtacgcaccaaaccgggtccgacggtgttccgccacccctaaacgcgcaggttagcacgtgagggatgatgacccaccgtgttatggggtgccagggataaaggaggagacccagcatggcgtat

SEQ ID NO: 381681 - DNA, 140 bp, Artificial Sequence
  Synthetic
atacgccatgctgggtctcctcaggttcacggcaattactacaagtttccactggacaaactgccaaacataatcgtggccctccatggtccagcagcattgagggttaccgcagacacacgtacttgggagtcggccat

SEQ ID NO: 381682 - DNA, 140 bp, Artificial Sequence
  Synthetic
atggccgactcccaagtacgtgtgtctgcggtaaccctcaatgctgctggaccatggagggccacgattatgtttggcagtttgtccagtggaaacttgtagtaattgccgtgaacctgaggagacccagcatggcgtat

SEQ ID NO: 381683 - DNA, 140 bp, Artificial Sequence
  Synthetic
atacgccatgctgggtctccaccaaaacaaaaatggaggccggcaaggtgctgagcgatctcaagctcccgggcttagccgtccaccgcaagaaggccggagcactgcggacgcgcatgccgtacttgggagtcggccat

SEQ ID NO: 381684 - DNA, 140 bp, Artificial Sequence
  Synthetic
atggccgactcccaagtacggcatgcgcgtccgcagtgctccggccttcttgcggtggacggctaagcccgggagcttgagatcgctcagcaccttgccggcctccatttttgttttggtggagacccagcatggcgtat

SEQ ID NO: 381685 - DNA, 140 bp, Artificial Sequence
  Synthetic
aggccctggctgctgatatggggcttagccgtccaccgcaagaaggccggagcactgcggacgcgcatgcttcggtcgcgtggttgggcggagttggctcggggcctgttgtggcatccagaccttttgggacagcggtg

SEQ ID NO: 381686 - DNA, 140 bp, Artificial Sequence
  Synthetic
caccgctgtcccaaaaggtctggatgccacaacaggccccgagccaactccgcccaaccacgcgaccgaagcatgcgcgtccgcagtgctccggccttcttgcggtggacggctaagccccatatcagcagccagggcct

SEQ ID NO: 381687 - DNA, 140 bp, Artificial Sequence
  Synthetic
aggccctggctgctgatatggggcccggccttgggaggcatggtggttactaaccccctggcagggtcaaagcctgatggtgctaatgcactgccgcttcggcggcgggtcgctaccttagaccttttgggacagcggtg

SEQ ID NO: 381688 - DNA, 140 bp, Artificial Sequence
  Synthetic
caccgctgtcccaaaaggtctaaggtagcgacccgccgccgaagcggcagtgcattagcaccatcaggctttgaccctgccagggggttagtaaccaccatgcctcccaaggccgggccccatatcagcagccagggcct

SEQ ID NO: 381689 - DNA, 140 bp, Artificial Sequence
  Synthetic
atacgccatgctgggtctccccccccggcactgggtgcaagccccagaaaccgacgcctactgaagtagacgtgatggccccgcgccgaaccggcgaccggccaaaaggtggtggatgggcgtacttgggagtcggccat

SEQ ID NO: 381690 - DNA, 140 bp, Artificial Sequence
  Synthetic
atggccgactcccaagtacgcccatccaccaccttttggccggtcgccggttcggcgcggggccatcacgtctacttcagtaggcgtcggtttctggggcttgcacccagtgccggggggggagacccagcatggcgtat

SEQ ID NO: 381691 - DNA, 140 bp, Artificial Sequence
  Synthetic
atacgccatgctgggtctcctgatgccagggttggtaggtcgtaaatcccggtcatcttggtagccactataggtgggtcttaaggggaggtaacggtccctctcgcgcttatggaggaacgtacttgggagtcggccat

SEQ ID NO: 381692 - DNA, 140 bp, Artificial Sequence
  Synthetic
atggccgactcccaagtacgttcctccataagcgcgagagggaccgttacctccccttaagacccacctatagtggctaccaagatgaccgggatttacgacctaccaaccctggcatcaggagacccagcatggcgtat

SEQ ID NO: 381693 - DNA, 140 bp, Artificial Sequence
  Synthetic
atacgccatgctgggtctccaagcgcacggtccacaggtgttggtcctaccggtgtaataaggacccggcgctaggcacgccgttaaaccgagcccgttatccccctgggcaaacgacgccgtacttgggagtcggccat

SEQ ID NO: 381694 - DNA, 140 bp, Artificial Sequence
  Synthetic
atggccgactcccaagtacggcgtcgtttgcccagggggataacgggctcggtttaacggcgtgcctagcgccgggtccttattacaccggtaggaccaacacctgtggaccgtgcgcttggagacccagcatggcgtat

SEQ ID NO: 381695 - DNA, 140 bp, Artificial Sequence
  Synthetic
atacgccatgctgggtctccccatgtacggtccacgtcgcccttcaatgtctctcttgaccaataggcgtagccggcgagttgacaaggaccagtgggggccgggcggagggggaaggaccgtacttgggagtcggccat

SEQ ID NO: 381696 - DNA, 140 bp, Artificial Sequence
  Synthetic
atggccgactcccaagtacggtccttccccctccgcccggcccccactggtccttgtcaactcgccggctacgcctattggtcaagagagacattgaagggcgacgtggaccgtacatggggagacccagcatggcgtat

SEQ ID NO: 381697 - DNA, 140 bp, Artificial Sequence
  Synthetic
atacgccatgctgggtctccctcctccgctgcccttcccgggggagcgggaaatgcatggggccacccagctccgcggcggcctacagccggggtagcccaagagccttcgggtgagggccgtacttgggagtcggccat

SEQ ID NO: 381698 - DNA, 140 bp, Artificial Sequence
  Synthetic
atggccgactcccaagtacggccctcacccgaaggctcttgggctaccccggctgtaggccgccgcggagctgggtggccccatgcatttcccgctcccccgggaagggcagcggaggagggagacccagcatggcgtat

SEQ ID NO: 381699 - DNA, 140 bp, Artificial Sequence
  Synthetic
atacgccatgctgggtctccgggtggcatttttctttcctgtaccgatcatggcagtccttctgctcttactcgtggtggaggccggggccatcctggccccggccacccatgcttgtagcgtacttgggagtcggccat

SEQ ID NO: 381700 - DNA, 140 bp, Artificial Sequence
  Synthetic
atggccgactcccaagtacgctacaagcatgggtggccggggccaggatggccccggcctccaccacgagtaagagcagaaggactgccatgatcggtacaggaaagaaaaatgccacccggagacccagcatggcgtat

SEQ ID NO: 381701 - DNA, 140 bp, Artificial Sequence
  Synthetic
atacgccatgctgggtctcccgcaaaggggcaatatttcctcacaaattgttgcgcccttgaggacataggcttctgcctggagggtggttgtcttgtggccctcgggtgtacagtttgtcgtacttgggagtcggccat

SEQ ID NO: 381702 - DNA, 140 bp, Artificial Sequence
  Synthetic
atggccgactcccaagtacgacaaactgtacacccgagggccacaagacaaccaccctccaggcagaagcctatgtcctcaagggcgcaacaatttgtgaggaaatattgcccctttgcgggagacccagcatggcgtat

SEQ ID NO: 381703 - DNA, 140 bp, Artificial Sequence
  Synthetic
atacgccatgctgggtctccaccgaccattgctggccgctgtatcaggcgggtttggccgtgcgacctggcaagtccgccgcccagctggtgggggaactcgggagcctttacggaccctcgtacttgggagtcggccat

SEQ ID NO: 381704 - DNA, 140 bp, Artificial Sequence
  Synthetic
atggccgactcccaagtacgagggtccgtaaaggctcccgagttcccccaccagctgggcggcggacttgccaggtcgcacggccaaacccgcctgatacagcggccagcaatggtcggtggagacccagcatggcgtat

SEQ ID NO: 381705 - DNA, 140 bp, Artificial Sequence
  Synthetic
atacgccatgctgggtctcctgtcggtctcagcttacgtggctgggatccttgggctcggggaggtttacgcgggagtcctcacggttggggtggcgttgacgcgcagggtctacccggtcgtacttgggagtcggccat

SEQ ID NO: 381706 - DNA, 140 bp, Artificial Sequence
  Synthetic
atggccgactcccaagtacgaccgggtagaccctgcgcgtcaacgccaccccaaccgtgaggactcccgcgtaaacctccccgagcccaaggatcccagccacgtaagctgagaccgacaggagacccagcatggcgtat

SEQ ID NO: 381707 - DNA, 140 bp, Artificial Sequence
  Synthetic
atacgccatgctgggtctcctcctaacctgacgtgtgcagttgaatgtgagttaaagtgggaaagtgagttttggagatggactgaacagctggcctccaattactggattctggaataccgtacttgggagtcggccat

SEQ ID NO: 381708 - DNA, 140 bp, Artificial Sequence
  Synthetic
atggccgactcccaagtacggtattccagaatccagtaattggaggccagctgttcagtccatctccaaaactcactttcccactttaactcacattcaactgcacacgtcaggttaggaggagacccagcatggcgtat

SEQ ID NO: 381709 - DNA, 140 bp, Artificial Sequence
  Synthetic
atacgccatgctgggtctccctctggaaggtgccttttgacttctggcgtggagtgatgagcctgacacccttgctggtgtgcgtggcggccctactcctgcttgagcagaggattgtcacgtacttgggagtcggccat

SEQ ID NO: 381710 - DNA, 140 bp, Artificial Sequence
  Synthetic
atggccgactcccaagtacgtgacaatcctctgctcaagcaggagtagggccgccacgcacaccagcaagggtgtcaggctcatcactccacgccagaagtcaaaaggcaccttccagagggagacccagcatggcgtat

SEQ ID NO: 381711 - DNA, 140 bp, Artificial Sequence
  Synthetic
atacgccatgctgggtctcctggtggtcctcctggttaccatggccggcatgtcgcaaggcgcgccggccgtggagctaggttcccggcctttcgaggctgggctaacgtggcagtcctgcgtacttgggagtcggccat

SEQ ID NO: 381712 - DNA, 140 bp, Artificial Sequence
  Synthetic
atggccgactcccaagtacgcaggactgccacgttagcccagcctcgaaaggccgggaacctagctccacggccggcgcgccttgcgacatgccggccatggtaaccaggaggaccaccaggagacccagcatggcgtat

SEQ ID NO: 381713 - DNA, 140 bp, Artificial Sequence
  Synthetic
atacgccatgctgggtctccttcttgtaggtcaaatgggtctcgcgtgcccactggggagaaggtttgggaacgtgggaacgtctcactgttgtgtgactgccccaacgggccctgggtccgtacttgggagtcggccat

SEQ ID NO: 381714 - DNA, 140 bp, Artificial Sequence
  Synthetic
atggccgactcccaagtacggacccagggcccgttggggcagtcacacaacagtgagacgttcccacgttcccaaaccttctccccagtgggcacgcgagacccatttgacctacaagaaggagacccagcatggcgtat

SEQ ID NO: 381715 - DNA, 140 bp, Artificial Sequence
  Synthetic
atacgccatgctgggtctcctggcagccggccttttgccaagcaatcggctggggcgacccaatcacacactggagccacggacaaaatcagtggcccctgtcgtgcccccagtatgtttcgtacttgggagtcggccat

SEQ ID NO: 381716 - DNA, 140 bp, Artificial Sequence
  Synthetic
atggccgactcccaagtacgaaacatactgggggcacgacaggggccactgattttgtccgtggctccagtgtgtgattgggtcgccccagccgattgcttggcaaaaggccggctgccaggagacccagcatggcgtat

SEQ ID NO: 381717 - DNA, 140 bp, Artificial Sequence
  Synthetic
atacgccatgctgggtctccacggtgccgtttcagtgacctgcgtgtggggttccgtgtcttggtttgcttccaccggcggtcgcgattccaagatcgatgtgtggagtttggttccagtcgtacttgggagtcggccat

SEQ ID NO: 381718 - DNA, 140 bp, Artificial Sequence
  Synthetic
atggccgactcccaagtacgactggaaccaaactccacacatcgatcttggaatcgcgaccgccggtggaagcaaaccaagacacggaaccccacacgcaggtcactgaaacggcaccgtggagacccagcatggcgtat

SEQ ID NO: 381719 - DNA, 140 bp, Artificial Sequence
  Synthetic
atacgccatgctgggtctcctggatcagccagctgcaccatagccgcactcggatcgtcggatcgcgacgtggtggtggagctctccgaatggggagtcccctgcgccacatgcattctgcgtacttgggagtcggccat

SEQ ID NO: 381720 - DNA, 140 bp, Artificial Sequence
  Synthetic
atggccgactcccaagtacgcagaatgcatgtggcgcaggggactccccattcggagagctccaccaccacgtcgcgatccgacgatccgagtgcggctatggtgcagctggctgatccaggagacccagcatggcgtat

SEQ ID NO: 381721 - DNA, 140 bp, Artificial Sequence
  Synthetic
atacgccatgctgggtctccgacaggcggcctgtctcgtgcggtacctgtgtgagggactgctggcccgaaaccgggtcggttagattccctttccatcggtgcggcgcgggccccaggccgtacttgggagtcggccat

SEQ ID NO: 381722 - DNA, 140 bp, Artificial Sequence
  Synthetic
atggccgactcccaagtacggcctggggcccgcgccgcaccgatggaaagggaatctaaccgacccggtttcgggccagcagtccctcacacaggtaccgcacgagacaggccgcctgtcggagacccagcatggcgtat

SEQ ID NO: 381723 - DNA, 140 bp, Artificial Sequence
  Synthetic
atacgccatgctgggtctcctgaccagggacttggaggctgtgcccttcgtcaataggacgactcccttcaccataaggggacccctgggcaaccaggggagaggcaacccggtgcggtccgtacttgggagtcggccat

SEQ ID NO: 381724 - DNA, 140 bp, Artificial Sequence
  Synthetic
atggccgactcccaagtacggaccgcaccgggttgcctctcccctggttgcccaggggtccccttatggtgaagggagtcgtcctattgacgaagggcacagcctccaagtccctggtcaggagacccagcatggcgtat

SEQ ID NO: 381725 - DNA, 140 bp, Artificial Sequence
  Synthetic
atacgccatgctgggtctccgcccctgggttttgggtcctacaccatgaccaagatccgggactccttacatttggtgaaatgtcccaccccagccattgagcctcccaccggaacgtttcgtacttgggagtcggccat

SEQ ID NO: 381726 - DNA, 140 bp, Artificial Sequence
  Synthetic
atggccgactcccaagtacgaaacgttccggtgggaggctcaatggctggggtgggacatttcaccaaatgtaaggagtcccggatcttggtcatggtgtaggacccaaaacccaggggcggagacccagcatggcgtat

SEQ ID NO: 381727 - DNA, 140 bp, Artificial Sequence
  Synthetic
atacgccatgctgggtctccggtttcttcccgggagtccctccgcttaacaactgcatgcttctcggcacggaagtgtcagaggcattgggcggagctggcctcaccggggggttctacgcgtacttgggagtcggccat

SEQ ID NO: 381728 - DNA, 140 bp, Artificial Sequence
  Synthetic
atggccgactcccaagtacgcgtagaaccccccggtgaggccagctccgcccaatgcctctgacacttccgtgccgagaagcatgcagttgttaagcggagggactcccgggaagaaaccggagacccagcatggcgtat

SEQ ID NO: 381729 - DNA, 140 bp, Artificial Sequence
  Synthetic
atacgccatgctgggtctccaacctctggtgcggcggtgttcggagctgatgggtaggcgaaatcccgtctgtccggggtttgcatggctctcctctggcaggccggacgggttcatacacgtacttgggagtcggccat

SEQ ID NO: 381730 - DNA, 140 bp, Artificial Sequence
  Synthetic
atggccgactcccaagtacgtgtatgaacccgtccggcctgccagaggagagccatgcaaaccccggacagacgggatttcgcctacccatcagctccgaacaccgccgcaccagaggttggagacccagcatggcgtat

SEQ ID NO: 381731 - DNA, 140 bp, Artificial Sequence
  Synthetic
atacgccatgctgggtctcctgttcagggccacttacaggaggtggatgcaggcaacttcataccgccccctcggtggcttcttctggactttgtgtttgtcctgttatatctgatgaagcgtacttgggagtcggccat

SEQ ID NO: 381732 - DNA, 140 bp, Artificial Sequence
  Synthetic
atggccgactcccaagtacgcttcatcagatataacaggacaaacacaaagtccagaagaagccaccgagggggcggtatgaagttgcctgcatccacctcctgtaagtggccctgaacaggagacccagcatggcgtat

SEQ ID NO: 381733 - DNA, 140 bp, Artificial Sequence
  Synthetic
atacgccatgctgggtctccctggcagaggcacggttggtcccgcttatacttctcctgctatggtggtgggtgaatcagctcgcggtcttaggactgcctgctgcgcacgctgctgtggcgtacttgggagtcggccat

SEQ ID NO: 381734 - DNA, 140 bp, Artificial Sequence
  Synthetic
atggccgactcccaagtacgccacagcagcgtgcgcagcaggcagtcctaagaccgcgagctgattcacccaccaccatagcaggagaagtataagcgggaccaaccgtgcctctgccagggagacccagcatggcgtat

SEQ ID NO: 381735 - DNA, 140 bp, Artificial Sequence
  Synthetic
atacgccatgctgggtctcccgggggaggtgtttgcgggcccggccttgtcctggtgtctgggcctgcccttcgtgagcatgatactgggactagcaaacctggtgttgtactttcgttgcgtacttgggagtcggccat

SEQ ID NO: 381736 - DNA, 140 bp, Artificial Sequence
  Synthetic
atggccgactcccaagtacgcaacgaaagtacaacaccaggtttgctagtcccagtatcatgctcacgaagggcaggcccagacaccaggacaaggccgggcccgcaaacacctcccccgggagacccagcatggcgtat

SEQ ID NO: 381737 - DNA, 140 bp, Artificial Sequence
  Synthetic
atacgccatgctgggtctccgatgggccctcagcgcctgatgttcctggtgttgtggaagctcgctcggggagcttttccgctggctttgttgatggggatttccgcctcccgcggacgccgtacttgggagtcggccat

SEQ ID NO: 381738 - DNA, 140 bp, Artificial Sequence
  Synthetic
atggccgactcccaagtacggcgtccgcgggaggcggaaatccccatcaacaaagccagcggaaaagctccccgagcgagcttccacaacaccaggaacatcaggcgctgagggcccatcggagacccagcatggcgtat

SEQ ID NO: 381739 - DNA, 140 bp, Artificial Sequence
  Synthetic
atacgccatgctgggtctccacctcggtgctcggagccgaattttgcttcgatgtcacgtttgaagtggacacatcagttttaggatgggttgtggccagcgtggtggcatgggccatagcgtacttgggagtcggccat

SEQ ID NO: 381740 - DNA, 140 bp, Artificial Sequence
  Synthetic
atggccgactcccaagtacgctatggcccatgccaccacgctggccacaacccatcctaaaactgatgtgtccacttcaaacgtgacatcgaagcaaaattcggctccgagcaccgaggtggagacccagcatggcgtat

SEQ ID NO: 381741 - DNA, 140 bp, Artificial Sequence
  Synthetic
atacgccatgctgggtctcccgctcctgagctctatgagcgcgggggggtggaggcacaaagccatcatctacaggacgtggtgtaaagggtaccaggcggtgcgccagcgggtggttcgcgtacttgggagtcggccat

SEQ ID NO: 381742 - DNA, 140 bp, Artificial Sequence
  Synthetic
atggccgactcccaagtacgcgaaccacccgctggcgcaccgcctggtaccctttacaccacgtcctgtagatgatggctttgtgcctccacccccccgcgctcatagagctcaggagcgggagacccagcatggcgtat

SEQ ID NO: 381743 - DNA, 140 bp, Artificial Sequence
  Synthetic
atacgccatgctgggtctccgagccccctcggggaggggcgtcctaccaagccgctgaccattgcttggtgcttggcctcctacatttggcctgacgctgtgatgttggtggtggtggcccgtacttgggagtcggccat

SEQ ID NO: 381744 - DNA, 140 bp, Artificial Sequence
  Synthetic
atggccgactcccaagtacgggccaccaccaccaacatcacagcgtcaggccaaatgtaggaggccaagcaccaagcaatggtcagcggcttggtaggacgcccctccccgagggggctcggagacccagcatggcgtat

SEQ ID NO: 381745 - DNA, 140 bp, Artificial Sequence
  Synthetic
atacgccatgctgggtctccatggtcctcctgtttggtctcttcgacgcgctcgattgggccttagaggagctcctagtgtcgcggccttcgttgcggcggctggctcgagtggtggagtcgtacttgggagtcggccat

SEQ ID NO: 381746 - DNA, 140 bp, Artificial Sequence
  Synthetic
atggccgactcccaagtacgactccaccactcgagccagccgccgcaacgaaggccgcgacactaggagctcctctaaggcccaatcgagcgcgtcgaagagaccaaacaggaggaccatggagacccagcatggcgtat

SEQ ID NO: 381747 - DNA, 140 bp, Artificial Sequence
  Synthetic
atacgccatgctgggtctccgttgtgtgatggctggggagcgggccactaccattcggctggtctccaagatgtgtgcgagaggtgcctacttgttcgaccatatgggttctttctcgcgcgtacttgggagtcggccat

SEQ ID NO: 381748 - DNA, 140 bp, Artificial Sequence
  Synthetic
atggccgactcccaagtacgcgcgagaaagaacccatatggtcgaacaagtaggcacctctcgcacacatcttggagaccagccgaatggtagtggcccgctccccagccatcacacaacggagacccagcatggcgtat

SEQ ID NO: 381749 - DNA, 140 bp, Artificial Sequence
  Synthetic
atacgccatgctgggtctcccgccgtcaaggagcgcttgcttgagtgggatgcagcccttgagccactgtcattcaccaggacggactgtcgcatcatacgagatgctgccaggacactgcgtacttgggagtcggccat

SEQ ID NO: 381750 - DNA, 140 bp, Artificial Sequence
  Synthetic
atggccgactcccaagtacgcagtgtcctggcagcatctcgtatgatgcgacagtccgtcctggtgaatgacagtggctcaagggctgcatcccactcaagcaagcgctccttgacggcgggagacccagcatggcgtat

SEQ ID NO: 381751 - DNA, 140 bp, Artificial Sequence
  Synthetic
atacgccatgctgggtctccagctgcggccaatgcgtcatggggttacccgtggtggctaggcgtggcgacgaggttctgataggcgttttccaagatgtgaaccatttgcctccggggtcgtacttgggagtcggccat

SEQ ID NO: 381752 - DNA, 140 bp, Artificial Sequence
  Synthetic
atggccgactcccaagtacgaccccggaggcaaatggttcacatcttggaaaacgcctatcagaacctcgtcgccacgcctagccaccacgggtaaccccatgacgcattggccgcagctggagacccagcatggcgtat

SEQ ID NO: 381753 - DNA, 140 bp, Artificial Sequence
  Synthetic
atacgccatgctgggtctcctcgtccctaccgcgcctgttgtcatccgccggtgcgggaaaggcttcctcggtgtcacaaaggctgccttgactggtcgggatcctgatctacatccaggcgtacttgggagtcggccat

SEQ ID NO: 381754 - DNA, 140 bp, Artificial Sequence
  Synthetic
atggccgactcccaagtacgcctggatgtagatcaggatcccgaccagtcaaggcagcctttgtgacaccgaggaagcctttcccgcaccggcggatgacaacaggcgcggtagggacgaggagacccagcatggcgtat

SEQ ID NO: 381755 - DNA, 140 bp, Artificial Sequence
  Synthetic
atacgccatgctgggtctccaaacgtcatggtgttggggacggcgacttcgcgcagcatgggaacatgcctgaacgggttgctgttcacgacgttccatggggcttcttcccgaaccattcgtacttgggagtcggccat

SEQ ID NO: 381756 - DNA, 140 bp, Artificial Sequence
  Synthetic
atggccgactcccaagtacgaatggttcgggaagaagccccatggaacgtcgtgaacagcaacccgttcaggcatgttcccatgctgcgcgaagtcgccgtccccaacaccatgacgtttggagacccagcatggcgtat

SEQ ID NO: 381757 - DNA, 140 bp, Artificial Sequence
  Synthetic
atacgccatgctgggtctccgcgactcctgtgggggccctaaacccaaggtggtggtcggccagtgatgacgtaacggtgtacccactcccggatggggccaactcgttgacgccgtgcacgtacttgggagtcggccat

SEQ ID NO: 381758 - DNA, 140 bp, Artificial Sequence
  Synthetic
atggccgactcccaagtacgtgcacggcgtcaacgagttggccccatccgggagtgggtacaccgttacgtcatcactggccgaccaccaccttgggtttagggcccccacaggagtcgcggagacccagcatggcgtat

SEQ ID NO: 381759 - DNA, 140 bp, Artificial Sequence
  Synthetic
atacgccatgctgggtctcccatgccaagcggagtcctgctgggtcatacgatccgacggggccctctgccatggactgtgcaagggggacaaggttgaactggatgtggccatggaggtcgtacttgggagtcggccat

SEQ ID NO: 381760 - DNA, 140 bp, Artificial Sequence
  Synthetic
atggccgactcccaagtacgacctccatggccacatccagttcaaccttgtcccccttgcacagtccatggcagagggccccgtcggatcgtatgacccagcaggactccgcttggcatgggagacccagcatggcgtat

SEQ ID NO: 381761 - DNA, 140 bp, Artificial Sequence
  Synthetic
atacgccatgctgggtctcccgctgacttccgtgggtcatctgggtcacccgtcctatgcgacgaggggcacgcagtaggaatgctcgtgtctgtgctccattctgggggtcgggtcacccgtacttgggagtcggccat

SEQ ID NO: 381762 - DNA, 140 bp, Artificial Sequence
  Synthetic
atggccgactcccaagtacgggtgacccgacccccagaatggagcacagacacgagcattcctactgcgtgcccctcgtcgcataggacgggtgacccagatgacccacggaagtcagcgggagacccagcatggcgtat

SEQ ID NO: 381763 - DNA, 140 bp, Artificial Sequence
  Synthetic
atacgccatgctgggtctccgcagcccgattcactcggccgtggacccaagtaccaactgatgccaagaccaccactgagccccccccagtgccagctaaaggggttttcaaggaggctccgtacttgggagtcggccat

SEQ ID NO: 381764 - DNA, 140 bp, Artificial Sequence
  Synthetic
atggccgactcccaagtacggagcctccttgaaaacccctttagctggcactggggggggctcagtggtggtcttggcatcagttggtacttgggtccacggccgagtgaatcgggctgcggagacccagcatggcgtat

SEQ ID NO: 381765 - DNA, 140 bp, Artificial Sequence
  Synthetic
atacgccatgctgggtctcccacttttcatgccaacgggggcgggaaagagcacccgcgtcccccttgagtatgggaatatggggcacaaggtcttaatcctcaacccgtcagtcgccaccgtacttgggagtcggccat

SEQ ID NO: 381766 - DNA, 140 bp, Artificial Sequence
  Synthetic
atggccgactcccaagtacggtggcgactgacgggttgaggattaagaccttgtgccccatattcccatactcaagggggacgcgggtgctctttcccgcccccgttggcatgaaaagtgggagacccagcatggcgtat

SEQ ID NO: 381767 - DNA, 140 bp, Artificial Sequence
  Synthetic
atacgccatgctgggtctccagtgagggccatgggcccttacatggaacggctggctgggaaacatccaagcgtctactgtgggcatgatacaacagctttcactcggatcacggactctcgtacttgggagtcggccat

SEQ ID NO: 381768 - DNA, 140 bp, Artificial Sequence
  Synthetic
atggccgactcccaagtacgagagtccgtgatccgagtgaaagctgttgtatcatgcccacagtagacgcttggatgtttcccagccagccgttccatgtaagggcccatggccctcactggagacccagcatggcgtat

SEQ ID NO: 381769 - DNA, 140 bp, Artificial Sequence
  Synthetic
atacgccatgctgggtctccccattgacgtattcgacctatgggaggtttctagccaaccctaggcagatgctgaggggagtctccgtggttatttgtgatgaatgccacagccatgacccgtacttgggagtcggccat

SEQ ID NO: 381770 - DNA, 140 bp, Artificial Sequence
  Synthetic
atggccgactcccaagtacgggtcatggctgtggcattcatcacaaataaccacggagactcccctcagcatctgcctagggttggctagaaacctcccataggtcgaatacgtcaatggggagacccagcatggcgtat

SEQ ID NO: 381771 - DNA, 140 bp, Artificial Sequence
  Synthetic
atacgccatgctgggtctccccacggttctgttggggatcgggcgagtcagggagctggcgcgtggttgtggggtccaactggtactctacgctacggcgacgccccctggctcgcccatcgtacttgggagtcggccat

SEQ ID NO: 381772 - DNA, 140 bp, Artificial Sequence
  Synthetic
atggccgactcccaagtacgatgggcgagccagggggcgtcgccgtagcgtagagtaccagttggaccccacaaccacgcgccagctccctgactcgcccgatccccaacagaaccgtggggagacccagcatggcgtat

SEQ ID NO: 381773 - DNA, 140 bp, Artificial Sequence
  Synthetic
atacgccatgctgggtctccgactcagcacccgtcaatcattgagaccaagctggatgtgggtgagattcccttttatgggcatggtataccccttgagcggatgaggacgggtcggcaccgtacttgggagtcggccat

SEQ ID NO: 381774 - DNA, 140 bp, Artificial Sequence
  Synthetic
atggccgactcccaagtacggtgccgacccgtcctcatccgctcaaggggtataccatgcccataaaagggaatctcacccacatccagcttggtctcaatgattgacgggtgctgagtcggagacccagcatggcgtat

SEQ ID NO: 381775 - DNA, 140 bp, Artificial Sequence
  Synthetic
atacgccatgctgggtctccctcgtattctgccattcaaaggcggagtgcgagaggctggctggtcagttctccgctcgaggagtcaatgctgtagcctattataggggaaaagacacttcgtacttgggagtcggccat

SEQ ID NO: 381776 - DNA, 140 bp, Artificial Sequence
  Synthetic
atggccgactcccaagtacgaagtgtcttttcccctataataggctacagcattgactcctcgagcggagaactgaccagccagcctctcgcactccgcctttgaatggcagaatacgagggagacccagcatggcgtat

SEQ ID NO: 381777 - DNA, 140 bp, Artificial Sequence
  Synthetic
atacgccatgctgggtctcccaatcatcaaagatggggacctcgtcgtctgcgccacagacgcattgtcgacggggtatactgggaacttcgattctgtcactgactgtgggcttgtggtcgtacttgggagtcggccat

SEQ ID NO: 381778 - DNA, 140 bp, Artificial Sequence
  Synthetic
atggccgactcccaagtacgaccacaagcccacagtcagtgacagaatcgaagttcccagtataccccgtcgacaatgcgtctgtggcgcagacgacgaggtccccatctttgatgattgggagacccagcatggcgtat

SEQ ID NO: 381779 - DNA, 140 bp, Artificial Sequence
  Synthetic
atacgccatgctgggtctccggaggaggtcgtcgaggtgacccttgatcccaccattaccatctccttgcggaccgtgccggcgtcggctgaattgtcgatgcagcgccgaggacgcacacgtacttgggagtcggccat

SEQ ID NO: 381780 - DNA, 140 bp, Artificial Sequence
  Synthetic
atggccgactcccaagtacgtgtgcgtcctcggcgctgcatcgacaattcagccgacgccggcacggtccgcaaggagatggtaatggtgggatcaagggtcacctcgacgacctcctccggagacccagcatggcgtat

SEQ ID NO: 381781 - DNA, 140 bp, Artificial Sequence
  Synthetic
atacgccatgctgggtctccggtagaggcagatcgggccggtactactacgcgggggtcggtaaggcccccgccggggtggtccggtccggacctgtctggtcagcagtggaagctggagcgtacttgggagtcggccat

SEQ ID NO: 381782 - DNA, 140 bp, Artificial Sequence
  Synthetic
atggccgactcccaagtacgctccagcttccactgctgaccagacaggtccggaccggaccaccccggcgggggccttaccgacccccgcgtagtagtaccggcccgatctgcctctaccggagacccagcatggcgtat

SEQ ID NO: 381783 - DNA, 140 bp, Artificial Sequence
  Synthetic
atacgccatgctgggtctcctgacctggtacggaatggaacctgacttgacagcaaaccttctgagactatacgacgactgcccttacaccgcagccgtcgcagctgacatcggggaagccgtacttgggagtcggccat

SEQ ID NO: 381784 - DNA, 140 bp, Artificial Sequence
  Synthetic
atggccgactcccaagtacggcttccccgatgtcagctgcgacggctgcggtgtaagggcagtcgtcgtatagtctcagaaggtttgctgtcaagtcaggttccattccgtaccaggtcaggagacccagcatggcgtat

SEQ ID NO: 381785 - DNA, 140 bp, Artificial Sequence
  Synthetic
atacgccatgctgggtctcccgcggtgttcttctcgggccttgcgcccttgaggatgcatcctgacgtcagctgggcaaaagtgcgcggcgtcaactggcccctcttggtgggcgttcagcgtacttgggagtcggccat

SEQ ID NO: 381786 - DNA, 140 bp, Artificial Sequence
  Synthetic
atggccgactcccaagtacgctgaacgcccaccaagaggggccagttgacgccgcgcacttttgcccagctgacgtcaggatgcatcctcaagggcgcaaggcccgagaagaacaccgcgggagacccagcatggcgtat

SEQ ID NO: 381787 - DNA, 140 bp, Artificial Sequence
  Synthetic
atacgccatgctgggtctcccggacgatgtgccgggaaacactgtcacccggcccatcggacgacccccaatgggcaggtctgaaaggcccgaatcctgtcccgctactgctgaggtgggcgtacttgggagtcggccat

SEQ ID NO: 381788 - DNA, 140 bp, Artificial Sequence
  Synthetic
atggccgactcccaagtacgcccacctcagcagtagcgggacaggattcgggcctttcagacctgcccattgggggtcgtccgatgggccgggtgacagtgtttcccggcacatcgtccgggagacccagcatggcgtat

SEQ ID NO: 381789 - DNA, 140 bp, Artificial Sequence
  Synthetic
atacgccatgctgggtctccgcaacgatttgccatccaaagtggccggccatcacatagtagacgacttggtccgtcggctcggtgtggcggagggatacgtccgatgtgacgccgggcccgtacttgggagtcggccat

SEQ ID NO: 381790 - DNA, 140 bp, Artificial Sequence
  Synthetic
atggccgactcccaagtacgggcccggcgtcacatcggacgtatccctccgccacaccgagccgacggaccaagtcgtctactatgtgatggccggccactttggatggcaaatcgttgcggagacccagcatggcgtat

SEQ ID NO: 381791 - DNA, 140 bp, Artificial Sequence
  Synthetic
atacgccatgctgggtctcccatcttaatggtgggcttggccatagcgggcggcatgatctacgcctcatacactgggtcactagtggtggtaacagactgggatgtgaagggaggtggccgtacttgggagtcggccat

SEQ ID NO: 381792 - DNA, 140 bp, Artificial Sequence
  Synthetic
atggccgactcccaagtacggccacctcccttcacatcccagtctgttaccaccactagtgacccagtgtatgaggcgtagatcatgccgcccgctatggccaagcccaccattaagatgggagacccagcatggcgtat

SEQ ID NO: 381793 - DNA, 140 bp, Artificial Sequence
  Synthetic
atacgccatgctgggtctccaaccccctttaccggagtggtgaccaagccacgccgcaacccgtggtgcaggtgcccccggtagaccaccggccgggggctgaatctgcgcctgcggatgcgtacttgggagtcggccat

SEQ ID NO: 381794 - DNA, 140 bp, Artificial Sequence
  Synthetic
atggccgactcccaagtacgcatccgcaggcgcagattcagcccccggccggtggtctaccgggggcacctgcaccacgggttgcggcgtggcttggtcaccactccggtaaagggggttggagacccagcatggcgtat

SEQ ID NO: 381795 - DNA, 140 bp, Artificial Sequence
  Synthetic
atacgccatgctgggtctccccaagacagtgacagatgcggtggcggccatccaggtgaactgcgattggtcggtgatgaccctgtcgatcggggaagtcctgaccttggcacaggctaacgtacttgggagtcggccat

SEQ ID NO: 381796 - DNA, 140 bp, Artificial Sequence
  Synthetic
atggccgactcccaagtacgttagcctgtgccaaggtcaggacttccccgatcgacagggtcatcaccgaccaatcgcagttcacctggatggccgccaccgcatctgtcactgtcttggggagacccagcatggcgtat

SEQ ID NO: 381797 - DNA, 140 bp, Artificial Sequence
  Synthetic
atacgccatgctgggtctccgacagccgaggcctacgcagctaccaccaagtggctcgctggctgctacacagggacgcgggccgtcccgactgtatccattgttgacaagctcttcgcccgtacttgggagtcggccat

SEQ ID NO: 381798 - DNA, 140 bp, Artificial Sequence
  Synthetic
atggccgactcccaagtacgggcgaagagcttgtcaacaatggatacagtcgggacggcccgcgtccctgtgtagcagccagcgagccacttggtggtagctgcgtaggcctcggctgtcggagacccagcatggcgtat

SEQ ID NO: 381799 - DNA, 140 bp, Artificial Sequence
  Synthetic
atacgccatgctgggtctccgggggttgggccgcggtggttggtcactgtcacagcgtgatagctgcggcggtggccgcgtacggggcttctcggagccctccactggccgccgcggcctcgtacttgggagtcggccat

SEQ ID NO: 381800 - DNA, 140 bp, Artificial Sequence
  Synthetic
atggccgactcccaagtacgaggccgcggcggccagtggagggctccgagaagccccgtacgcggccaccgccgcagctatcacgctgtgacagtgaccaaccaccgcggcccaacccccggagacccagcatggcgtat

SEQ ID NO: 381801 - DNA, 140 bp, Artificial Sequence
  Synthetic
atacgccatgctgggtctcccatacctcatggggttgggcgtcggaggcaacgcgcaggctcgcttggcttccgccctcctgttgggagcagctggtaccgccctgggcactccggtcgtcgtacttgggagtcggccat

SEQ ID NO: 381802 - DNA, 140 bp, Artificial Sequence
  Synthetic
atggccgactcccaagtacgacgaccggagtgcccagggcggtaccagctgctcccaacaggagggcggaagccaagcgagcctgcgcgttgcctccgacgcccaaccccatgaggtatgggagacccagcatggcgtat

SEQ ID NO: 381803 - DNA, 140 bp, Artificial Sequence
  Synthetic
atacgccatgctgggtctccgggtctcaccatggccggggcgttcatggggggcgccagcgtgtctccctcgctcgtcaccgtcctgttgggggcggtgggcggctgggagggcgtggtccgtacttgggagtcggccat

SEQ ID NO: 381804 - DNA, 140 bp, Artificial Sequence
  Synthetic
atggccgactcccaagtacggaccacgccctcccagccgcccaccgcccccaacaggacggtgacgagcgagggagacacgctggcgccccccatgaacgccccggccatggtgagacccggagacccagcatggcgtat

SEQ ID NO: 381805 - DNA, 140 bp, Artificial Sequence
  Synthetic
atacgccatgctgggtctccaatgctgccagccttgtcttcgacttcatgtcagggaaactttcaactgaggacctgtggtatgccatcccggtgctcactagtcctggggcgggccttgcgtacttgggagtcggccat

SEQ ID NO: 381806 - DNA, 140 bp, Artificial Sequence
  Synthetic
atggccgactcccaagtacgcaaggcccgccccaggactagtgagcaccgggatggcataccacaggtcctcagttgaaagtttccctgacatgaagtcgaagacaaggctggcagcattggagacccagcatggcgtat

SEQ ID NO: 381807 - DNA, 140 bp, Artificial Sequence
  Synthetic
atacgccatgctgggtctcccggggatcgccctgggcctggtgttgtactcagcaaacaactcaggcacaaccacgtggttaaaccgtctgctgacaacgttgccgaggtcatcgtgcatcgtacttgggagtcggccat

SEQ ID NO: 381808 - DNA, 140 bp, Artificial Sequence
  Synthetic
atggccgactcccaagtacgatgcacgatgacctcggcaacgttgtcagcagacggtttaaccacgtggttgtgcctgagttgtttgctgagtacaacaccaggcccagggcgatccccgggagacccagcatggcgtat

SEQ ID NO: 381809 - DNA, 140 bp, Artificial Sequence
  Synthetic
atacgccatgctgggtctcccccagacagctatttccaacaggctgactactgtgacagagtgtcctccatgttgcgccgcctgagcctcactcggactgtggtggcccttgtcaacaagcgtacttgggagtcggccat

SEQ ID NO: 381810 - DNA, 140 bp, Artificial Sequence
  Synthetic
atggccgactcccaagtacgcttgttgacaagggccaccacagtccgagtgaggctcaggcggcgcaacatggaggacactctgtcacagtagtcagcctgttggaaatagctgtctgggggagacccagcatggcgtat

SEQ ID NO: 381811 - DNA, 140 bp, Artificial Sequence
  Synthetic
atacgccatgctgggtctccgagcccaaggtggatgaggtgcaggtggggtacgtgtgggacctttgggaatggatcatgcgccaggtgcggatggtggtgtcaagactccgggccctctcgtacttgggagtcggccat

SEQ ID NO: 381812 - DNA, 140 bp, Artificial Sequence
  Synthetic
atggccgactcccaagtacgagagggcccggagtcttgacaccaccatccgcacctggcgcatgatccattcccaaaggtcccacacgtaccccacctgcacctcatccaccttgggctcggagacccagcatggcgtat

SEQ ID NO: 381813 - DNA, 140 bp, Artificial Sequence
  Synthetic
atacgccatgctgggtctccgccccgtggtgtcactgcctttgtggcactgcggggaggggtggtccggggaatggctcctggacggtcatgtggagagtcgctgcttgtgtggttgcgtcgtacttgggagtcggccat

SEQ ID NO: 381814 - DNA, 140 bp, Artificial Sequence
  Synthetic
atggccgactcccaagtacgacgcaaccacacaagcagcgactctccacatgaccgtccaggagccattccccggaccacccctccccgcagtgccacaaaggcagtgacaccacggggcggagacccagcatggcgtat

SEQ ID NO: 381815 - DNA, 140 bp, Artificial Sequence
  Synthetic
atacgccatgctgggtctccgatcactggtgatgttttgaatgggcaactcaaagaaccagtttactctaccaagctgtgcaggcattactggatggggactgtgcccgtcaacatgttgcgtacttgggagtcggccat

SEQ ID NO: 381816 - DNA, 140 bp, Artificial Sequence
  Synthetic
atggccgactcccaagtacgcaacatgttgacgggcacagtccccatccagtaatgcctgcacagcttggtagagtaaactggttctttgagttgcccattcaaaacatcaccagtgatcggagacccagcatggcgtat

SEQ ID NO: 381817 - DNA, 140 bp, Artificial Sequence
  Synthetic
atacgccatgctgggtctccggttacggcgagacctcccctctcctagcctccgacacccctaaggtggtaccttttgggacgtccggctgggcggaggtggtggtcacgcccacccacgcgtacttgggagtcggccat

SEQ ID NO: 381818 - DNA, 140 bp, Artificial Sequence
  Synthetic
atggccgactcccaagtacgcgtgggtgggcgtgaccaccacctccgcccagccggacgtcccaaaaggtaccaccttaggggtgtcggaggctaggagaggggaggtctcgccgtaaccggagacccagcatggcgtat

SEQ ID NO: 381819 - DNA, 140 bp, Artificial Sequence
  Synthetic
atacgccatgctgggtctcctggtgattaggcgcacttcctgttacaaattgcttcgccagcaaatcctatcagctgctgtagctgagccctactacgtcgatggcataccggtctcgtgcgtacttgggagtcggccat

SEQ ID NO: 381820 - DNA, 140 bp, Artificial Sequence
  Synthetic
atggccgactcccaagtacgcacgagaccggtatgccatcgacgtagtagggctcagctacagcagctgataggatttgctggcgaagcaatttgtaacaggaagtgcgcctaatcaccaggagacccagcatggcgtat

SEQ ID NO: 381821 - DNA, 140 bp, Artificial Sequence
  Synthetic
atacgccatgctgggtctccggaagccgacgcgagagcgccggcgatggtctacggtcctggccaaagcgtgaccattgacggggagcgctacacccttccgcaccagttgcggatgcggcgtacttgggagtcggccat

SEQ ID NO: 381822 - DNA, 140 bp, Artificial Sequence
  Synthetic
atggccgactcccaagtacgccgcatccgcaactggtgcggaagggtgtagcgctccccgtcaatggtcacgctttggccaggaccgtagaccatcgccggcgctctcgcgtcggcttccggagacccagcatggcgtat

SEQ ID NO: 381823 - DNA, 140 bp, Artificial Sequence
  Synthetic
atacgccatgctgggtctccaacgtggcgccctctgaggtttcgtctgaggtcagcatcgagattgggacggagactgaagactcagaactgactgaggccgatttgccaccggcggctgcgtacttgggagtcggccat

SEQ ID NO: 381824 - DNA, 140 bp, Artificial Sequence
  Synthetic
atggccgactcccaagtacgcagccgccggtggcaaatcggcctcagtcagttctgagtcttcagtctccgtcccaatctcgatgctgacctcagacgaaacctcagagggcgccacgttggagacccagcatggcgtat

SEQ ID NO: 381825 - DNA, 140 bp, Artificial Sequence
  Synthetic
atacgccatgctgggtctcccggccctccaagcgatcgagaatgctgcgagaattcttgagccgcatattgatgtcatcatggaggactgtagtacaccctctctctgtggcagtagccgcgtacttgggagtcggccat

SEQ ID NO: 381826 - DNA, 140 bp, Artificial Sequence
  Synthetic
atggccgactcccaagtacgcggctactgccacagagagagggtgtactacagtcctccatgatgacatcaatatgcggctcaagaattctcgcagcattctcgatcgcttggagggccgggagacccagcatggcgtat

SEQ ID NO: 381827 - DNA, 140 bp, Artificial Sequence
  Synthetic
aggccctggctgctgatatgtcctcgcaggaggacaccccgtcctcagactcatttgaagtcatccaagagtctgatccagctgaaggagaggataacgtcttcaacgtggctctttctggaccttttgggacagcggtg

SEQ ID NO: 381828 - DNA, 140 bp, Artificial Sequence
  Synthetic
caccgctgtcccaaaaggtccagaaagagccacgttgaagacgttatcctctccttcagctggatcagactcttggatgacttcaaatgagtctgaggacggggtgtcctcctgcgaggacatatcagcagccagggcct

SEQ ID NO: 381829 - DNA, 140 bp, Artificial Sequence
  Synthetic
atacgccatgctgggtctcctactaaaagccttattcccacagagcgatgcaacgcggaagctaacggtcaaaatgtcttgctgtgtggagaagagcgtcacgcgcttcttttccttaggcgtacttgggagtcggccat

SEQ ID NO: 381830 - DNA, 140 bp, Artificial Sequence
  Synthetic
atggccgactcccaagtacgcctaaggaaaagaagcgcgtgacgctcttctccacacagcaagacattttgaccgttagcttccgcgttgcatcgctctgtgggaataaggcttttagtaggagacccagcatggcgtat

SEQ ID NO: 381831 - DNA, 140 bp, Artificial Sequence
  Synthetic
atacgccatgctgggtctccgttgactgtggctgacgtggctagcctgtgtgaaatggaaatccagaaccatacagcctattgtgacaaggtgcgcactccgctcgaattgcaagttgggcgtacttgggagtcggccat

SEQ ID NO: 381832 - DNA, 140 bp, Artificial Sequence
  Synthetic
atggccgactcccaagtacgcccaacttgcaattcgagcggagtgcgcaccttgtcacaataggctgtatggttctggatttccatttcacacaggctagccacgtcagccacagtcaacggagacccagcatggcgtat

SEQ ID NO: 381833 - DNA, 140 bp, Artificial Sequence
  Synthetic
atacgccatgctgggtctcctgcttagtgggcaatgaacttacctttgaatgtgacaaatgtgaagctcgccaagagaccttggcttctttctcctacatctggtctggagtgccgctaacgtacttgggagtcggccat

SEQ ID NO: 381834 - DNA, 140 bp, Artificial Sequence
  Synthetic
atggccgactcccaagtacgttagcggcactccagaccagatgtaggagaaagaagccaaggtctcttggcgagcttcacatttgtcacattcaaaggtaagttcattgcccactaagcaggagacccagcatggcgtat

SEQ ID NO: 381835 - DNA, 140 bp, Artificial Sequence
  Synthetic
atacgccatgctgggtctccccagggctacccctgccaagcccccagtggtgaggccggtgggttccctgttggtggccgacacaaccaaggtctacgtgaccaatccagacaatgtgggcgtacttgggagtcggccat

SEQ ID NO: 381836 - DNA, 140 bp, Artificial Sequence
  Synthetic
atggccgactcccaagtacgcccacattgtctggattggtcacgtagaccttggttgtgtcggccaccaacagggaacccaccggcctcaccactgggggcttggcaggggtagccctggggagacccagcatggcgtat

SEQ ID NO: 381837 - DNA, 140 bp, Artificial Sequence
  Synthetic
atacgccatgctgggtctccgaggagagttgacaaggtgaccttctggcgcgcccctcgggtgcacgataagtttctcgtggactcgatcgagcgtgctaggagggcggctcaaggctgccgtacttgggagtcggccat

SEQ ID NO: 381838 - DNA, 140 bp, Artificial Sequence
  Synthetic
atggccgactcccaagtacggcagccttgagccgccctcctagcacgctcgatcgagtccacgagaaacttatcgtgcacccgaggggcgcgccagaaggtcaccttgtcaactctcctcggagacccagcatggcgtat

SEQ ID NO: 381839 - DNA, 140 bp, Artificial Sequence
  Synthetic
atacgccatgctgggtctccttaagcatgggttacacttatgaggaggcaataaggactgtcaggccgcatgctgccatgggctggggatctaaggtgtcggttaaggacctggccaccccgtacttgggagtcggccat

SEQ ID NO: 381840 - DNA, 140 bp, Artificial Sequence
  Synthetic
atggccgactcccaagtacggggtggccaggtccttaaccgacaccttagatccccagcccatggcagcatgcggcctgacagtccttattgcctcctcataagtgtaacccatgcttaaggagacccagcatggcgtat

SEQ ID NO: 381841 - DNA, 140 bp, Artificial Sequence
  Synthetic
atacgccatgctgggtctccctgcggggaagatggccgtccatgaccgacttcaggagatacttgaagggactccggtcccctttacattgactgtgaaaaaggaggtgttcttcaaagacgtacttgggagtcggccat

SEQ ID NO: 381842 - DNA, 140 bp, Artificial Sequence
  Synthetic
atggccgactcccaagtacgtctttgaagaacacctcctttttcacagtcaatgtaaaggggaccggagtcccttcaagtatctcctgaagtcggtcatggacggccatcttccccgcagggagacccagcatggcgtat

SEQ ID NO: 381843 - DNA, 140 bp, Artificial Sequence
  Synthetic
atacgccatgctgggtctccccggaaggaggagaaggccccccgcctcattgtcttcccgcccttggacttccggatagctgaaaagctcatcttgggagaccctgggcgggttgccaagcgtacttgggagtcggccat

SEQ ID NO: 381844 - DNA, 140 bp, Artificial Sequence
  Synthetic
atggccgactcccaagtacgcttggcaacccgcccagggtctcccaagatgagcttttcagctatccggaagtccaagggcgggaagacaatgaggcggggggccttctcctccttccggggagacccagcatggcgtat

SEQ ID NO: 381845 - DNA, 140 bp, Artificial Sequence
  Synthetic
atacgccatgctgggtctccgcggtgctggggggggcttacgccttccagtacaccccaaatcagcgcgttagggagatgcttaagctgtgggagtcaaagaaaacaccgtgcgccatctcgtacttgggagtcggccat

SEQ ID NO: 381846 - DNA, 140 bp, Artificial Sequence
  Synthetic
atggccgactcccaagtacgagatggcgcacggtgttttctttgactcccacagcttaagcatctccctaacgcgctgatttggggtgtactggaaggcgtaagccccccccagcaccgcggagacccagcatggcgtat

SEQ ID NO: 381847 - DNA, 140 bp, Artificial Sequence
  Synthetic
atacgccatgctgggtctccgcgtggacgccacttgcttcgacagtagcattactgaagaggatgtggcattggagacagagctttatgccctggcttcagaccacccagagtgggtgcgcgtacttgggagtcggccat

SEQ ID NO: 381848 - DNA, 140 bp, Artificial Sequence
  Synthetic
atggccgactcccaagtacgcgcacccactctgggtggtctgaagccagggcataaagctctgtctccaatgccacatcctcttcagtaatgctactgtcgaagcaagtggcgtccacgcggagacccagcatggcgtat

SEQ ID NO: 381849 - DNA, 140 bp, Artificial Sequence
  Synthetic
atacgccatgctgggtctcccgccctagggaagtactatgcctctggcacaatggttaccccggaaggggtgccagtgggcgagaggtattgtaggtcctcgggggtgctgactaccagccgtacttgggagtcggccat

SEQ ID NO: 381850 - DNA, 140 bp, Artificial Sequence
  Synthetic
atggccgactcccaagtacggctggtagtcagcacccccgaggacctacaatacctctcgcccactggcaccccttccggggtaaccattgtgccagaggcatagtacttccctagggcgggagacccagcatggcgtat

SEQ ID NO: 381851 - DNA, 140 bp, Artificial Sequence
  Synthetic
atacgccatgctgggtctccgccagcaactgtctgacctgctacattaaggtgaaagccgcctgcgagagagtgggtctgaaaaatgtctcactattgatcgcgggcgatgactgtctgacgtacttgggagtcggccat

SEQ ID NO: 381852 - DNA, 140 bp, Artificial Sequence
  Synthetic
atggccgactcccaagtacgtcagacagtcatcgcccgcgatcaatagtgagacatttttcagacccactctctcgcaggcggctttcaccttaatgtagcaggtcagacagttgctggcggagacccagcatggcgtat

SEQ ID NO: 381853 - DNA, 140 bp, Artificial Sequence
  Synthetic
atacgccatgctgggtctcctcatatgtgagaggcccatatgcgaccctagcgaggccttgggacgagccttggcttcgtacgggtacgcgtgtgagccctcatatcatgcatcactggacgtacttgggagtcggccat

SEQ ID NO: 381854 - DNA, 140 bp, Artificial Sequence
  Synthetic
atggccgactcccaagtacgtccagtgatgcatgatatgagggctcacacgcgtacccgtacgaagccaaggctcgtcccaaggcctcgctagggtcgcatatgggcctctcacatatgaggagacccagcatggcgtat

SEQ ID NO: 381855 - DNA, 140 bp, Artificial Sequence
  Synthetic
atacgccatgctgggtctcccacggcccccttctgctccacttggttagccgagtgcaatgcagatgggaagcgccatttcttccttaccacggactttcggaggcctctcgctcgcatgcgtacttgggagtcggccat

SEQ ID NO: 381856 - DNA, 140 bp, Artificial Sequence
  Synthetic
atggccgactcccaagtacgcatgcgagcgagaggcctccgaaagtccgtggtaaggaagaaatggcgcttcccatctgcattgcactcggctaaccaagtggagcagaagggggccgtgggagacccagcatggcgtat

SEQ ID NO: 381857 - DNA, 140 bp, Artificial Sequence
  Synthetic
atacgccatgctgggtctcctcgagcgagtatagtgacccaatggcttcggccatcggttacatcctcctttacccctggcaccccatcacacggtgggtcatcatcccgcacgtactaacgtacttgggagtcggccat

SEQ ID NO: 381858 - DNA, 140 bp, Artificial Sequence
  Synthetic
atggccgactcccaagtacgttagtacgtgcgggatgatgacccaccgtgtgatggggtgccaggggtaaaggaggatgtaaccgatggccgaagccattgggtcactatactcgctcgaggagacccagcatggcgtat

SEQ ID NO: 381859 - DNA, 140 bp, Artificial Sequence
  Synthetic
atacgccatgctgggtctcccctgtgcgttccggggtggtggtacaccgtctgatccggtttggtgccaggttcatggcaattactacaagtttcctctggacaaactgcctaacatcatcgtacttgggagtcggccat

SEQ ID NO: 381860 - DNA, 140 bp, Artificial Sequence
  Synthetic
atggccgactcccaagtacgatgatgttaggcagtttgtccagaggaaacttgtagtaattgccatgaacctggcaccaaaccggatcagacggtgtaccaccaccccggaacgcacaggggagacccagcatggcgtat

SEQ ID NO: 381861 - DNA, 140 bp, Artificial Sequence
  Synthetic
atacgccatgctgggtctcccgtggccctccacggaccagcagcgttgagggttaccgcagacacaactaaaacaaagatggaggccggtaaggttttgagtgacttaaagctcccgggccgtacttgggagtcggccat

SEQ ID NO: 381862 - DNA, 140 bp, Artificial Sequence
  Synthetic
atggccgactcccaagtacggcccgggagctttaagtcactcaaaaccttaccggcctccatctttgttttagttgtgtctgcggtaaccctcaacgctgctggtccgtggagggccacgggagacccagcatggcgtat

SEQ ID NO: 381863 - DNA, 140 bp, Artificial Sequence
  Synthetic
atacgccatgctgggtctccttagccgtccaccgcaagaaggctggggcattgcggactcgcatgctccggtcgcgcggttgggcggagttggctcgggggctgttgtggcatccaggcccgtacttgggagtcggccat

SEQ ID NO: 381864 - DNA, 140 bp, Artificial Sequence
  Synthetic
atggccgactcccaagtacgggcctggatgccacaacagcccccgagccaactccgcccaaccgcgcgaccggagcatgcgagtccgcaatgccccagccttcttgcggtggacggctaaggagacccagcatggcgtat

SEQ ID NO: 381865 - DNA, 140 bp, Artificial Sequence
  Synthetic
atacgccatgctgggtctcctacggctccctccccctgagattgctggtatcccagggggtttccctctgtcccccccctacatgggggtggttcatcaattggatttcacagcccagcgcgtacttgggagtcggccat

SEQ ID NO: 381866 - DNA, 140 bp, Artificial Sequence
  Synthetic
atggccgactcccaagtacgcgctgggctgtgaaatccaattgatgaaccacccccatgtaggggggggacagagggaaaccccctgggataccagcaatctcagggggagggagccgtaggagacccagcatggcgtat

SEQ ID NO: 381867 - DNA, 140 bp, Artificial Sequence
  Synthetic
atacgccatgctgggtctccgagtcgctggcggtggctggggttctttgccctgctcatcgtagcgctctttgggtgaactaaattcatctgttgcggcaaggttgggtgactgatcatccgtacttgggagtcggccat

SEQ ID NO: 381868 - DNA, 140 bp, Artificial Sequence
  Synthetic
atggccgactcccaagtacggatgatcagtcacccaaccttgccgcaacagatgaatttagttcacccaaagagcgctacgatgagcagggcaaagaaccccagccaccgccagcgactcggagacccagcatggcgtat

SEQ ID NO: 381869 - DNA, 140 bp, Artificial Sequence
  Synthetic
aggccctggctgctgatatgttgggtgaactaaattcatctgttgcggcaaggttgggtgactgatcatcactcaaggaggttcccgccctccccgccccaggggtctccccgctgggtagaccttttgggacagcggtg

SEQ ID NO: 381870 - DNA, 140 bp, Artificial Sequence
  Synthetic
caccgctgtcccaaaaggtctacccagcggggagacccctggggcggggagggcgggaacctccttgagtgatgatcagtcacccaaccttgccgcaacagatgaatttagttcacccaacatatcagcagccagggcct

SEQ ID NO: 381871 - DNA, 140 bp, Artificial Sequence
  Synthetic
aggccctggctgctgatatgcccggccttgggaggcatggtggttactaaccccctggcagggtcaaagcctgatggtgctaatgcactgccgcttcggcggcgggtcgctaccttataggaccttttgggacagcggtg

SEQ ID NO: 381872 - DNA, 140 bp, Artificial Sequence
  Synthetic
caccgctgtcccaaaaggtcctataaggtagcgacccgccgccgaagcggcagtgcattagcaccatcaggctttgaccctgccagggggttagtaaccaccatgcctcccaaggccgggcatatcagcagccagggcct

SEQ ID NO: 381873 - DNA, 140 bp, Artificial Sequence
  Synthetic
atacgccatgctgggtctcccccccccacggcactgggtgcaagccccagaaaccgacgcctatctaagcaggcaataaggcctcgcgccaaaccggcgaccggccaaaaggtggtggatcgtacttgggagtcggccat

SEQ ID NO: 381874 - DNA, 140 bp, Artificial Sequence
  Synthetic
atggccgactcccaagtacgatccaccaccttttggccggtcgccggtttggcgcgaggccttattgcctgcttagataggcgtcggtttctggggcttgcacccagtgccgtgggggggggagacccagcatggcgtat

SEQ ID NO: 381875 - DNA, 140 bp, Artificial Sequence
  Synthetic
atacgccatgctgggtctccgggtgatgccagggttggtaggtcgtaaatcccggtcatcttggtagccactataggtgggtcttaaggggaggctacagtccctctgtcgcccgtggcgcgtacttgggagtcggccat

SEQ ID NO: 381876 - DNA, 140 bp, Artificial Sequence
  Synthetic
atggccgactcccaagtacgcgccacgggcgacagagggactgtagcctccccttaagacccacctatagtggctaccaagatgaccgggatttacgacctaccaaccctggcatcacccggagacccagcatggcgtat

SEQ ID NO: 381877 - DNA, 140 bp, Artificial Sequence
  Synthetic
atacgccatgctgggtctccagaacgcgcacggtccacaggtgttgaccctaccggtgtgaataagggtccgacgtcaggctcgtcgttaaaccgagcccattatccccctgggcaaacgcgtacttgggagtcggccat

SEQ ID NO: 381878 - DNA, 140 bp, Artificial Sequence
  Synthetic
atggccgactcccaagtacgcgtttgcccagggggataatgggctcggtttaacgacgagcctgacgtcggacccttattcacaccggtagggtcaacacctgtggaccgtgcgcgttctggagacccagcatggcgtat

SEQ ID NO: 381879 - DNA, 140 bp, Artificial Sequence
  Synthetic
atacgccatgctgggtctccacgcccacgtacggtctacgtcgcccttcaatgtctctcttgaccaataggcaatgccggcgagttgacaaagaccagtgggggccgggggtgagggagacgtacttgggagtcggccat

SEQ ID NO: 381880 - DNA, 140 bp, Artificial Sequence
  Synthetic
atggccgactcccaagtacgtctccctcacccccggcccccactggtctttgtcaactcgccggcattgcctattggtcaagagagacattgaagggcgacgtagaccgtacgtgggcgtggagacccagcatggcgtat

SEQ ID NO: 381881 - DNA, 140 bp, Artificial Sequence
  Synthetic
atacgccatgctgggtctccaggactccccaccctgcccttcccgggggagtgggaaatgcatggggccacccagctccgcggcggcctgcagccggggtagcccaagagccttcgggtgcgtacttgggagtcggccat

SEQ ID NO: 381882 - DNA, 140 bp, Artificial Sequence
  Synthetic
atggccgactcccaagtacgcacccgaaggctcttgggctaccccggctgcaggccgccgcggagctgggtggccccatgcatttcccactcccccgggaagggcagggtggggagtcctggagacccagcatggcgtat

SEQ ID NO: 381883 - DNA, 140 bp, Artificial Sequence
  Synthetic
atacgccatgctgggtctccagggcgggtggcattttctttcttataccgatcatggcagtcctgctgcttcttctcgtggtggaggccggggccattctggccccggccacacacgcttcgtacttgggagtcggccat

SEQ ID NO: 381884 - DNA, 140 bp, Artificial Sequence
  Synthetic
atggccgactcccaagtacgaagcgtgtgtggccggggccagaatggccccggcctccaccacgagaagaagcagcaggactgccatgatcggtataagaaagaaaatgccacccgccctggagacccagcatggcgtat

SEQ ID NO: 381885 - DNA, 140 bp, Artificial Sequence
  Synthetic
atacgccatgctgggtctccgtggagctaacgggcaatatttcctcacgaactgttgtgccctggaggacatagggttctgccttgaaggtgggtgccttgtggccctcgggtgcacagtcgtacttgggagtcggccat

SEQ ID NO: 381886 - DNA, 140 bp, Artificial Sequence
  Synthetic
atggccgactcccaagtacgactgtgcacccgagggccacaaggcacccaccttcaaggcagaaccctatgtcctccagggcacaacagttcgtgaggaaatattgcccgttagctccacggagacccagcatggcgtat

SEQ ID NO: 381887 - DNA, 140 bp, Artificial Sequence
  Synthetic
atacgccatgctgggtctccttgtactgacaaatgctggccattgtatcaggcgggtctggccgtgcggcccggcaagtccgctgcccagctggtgggtgaactgggtagcctttacgggcgtacttgggagtcggccat

SEQ ID NO: 381888 - DNA, 140 bp, Artificial Sequence
  Synthetic
atggccgactcccaagtacgcccgtaaaggctacccagttcacccaccagctgggcagcggacttgccgggccgcacggccagacccgcctgatacaatggccagcatttgtcagtacaaggagacccagcatggcgtat

SEQ ID NO: 381889 - DNA, 140 bp, Artificial Sequence
  Synthetic
atacgccatgctgggtctcccccctgtcggtgtccgcgtatgtcgcgggcatcttggggctcggggaggtctattccggggtgctcacggttggggtggcgttgacgcgccgggtctacccgtacttgggagtcggccat

SEQ ID NO: 381890 - DNA, 140 bp, Artificial Sequence
  Synthetic
atggccgactcccaagtacgggtagacccggcgcgtcaacgccaccccaaccgtgagcaccccggaatagacctccccgagccccaagatgcccgcgacatacgcggacaccgacaggggggagacccagcatggcgtat

SEQ ID NO: 381891 - DNA, 140 bp, Artificial Sequence
  Synthetic
atacgccatgctgggtctcccggtccccaatctgacgtgtgctgtagaatgtgagttgaggtgggagagtgagttttggagatggactgagcaattggcctccaactactggattttggacgtacttgggagtcggccat

SEQ ID NO: 381892 - DNA, 140 bp, Artificial Sequence
  Synthetic
atggccgactcccaagtacgtccaaaatccagtagttggaggccaattgctcagtccatctccaaaactcactctcccacctcaactcacattctacagcacacgtcagattggggaccgggagacccagcatggcgtat

SEQ ID NO: 381893 - DNA, 140 bp, Artificial Sequence
  Synthetic
atacgccatgctgggtctccatatctctggaaggttccttttgacttctggcggggtgtgatgagcctgactccacttttggtgtgcgtggcggccctcctcttgctagagcaaaggatacgtacttgggagtcggccat

SEQ ID NO: 381894 - DNA, 140 bp, Artificial Sequence
  Synthetic
atggccgactcccaagtacgtatcctttgctctagcaagaggagggccgccacgcacaccaaaagtggagtcaggctcatcacaccccgccagaagtcaaaaggaaccttccagagatatggagacccagcatggcgtat

SEQ ID NO: 381895 - DNA, 140 bp, Artificial Sequence
  Synthetic
atacgccatgctgggtctccgtcatggtcatactcctggttaccatggcggggatgtctcagggcgcccccgctacggtgctgggatctcggccctttgagccggggttgacgtggcagtcgtacttgggagtcggccat

SEQ ID NO: 381896 - DNA, 140 bp, Artificial Sequence
  Synthetic
atggccgactcccaagtacgactgccacgtcaaccccggctcaaagggccgagatcccagcaccgtagcgggggcgccctgagacatccccgccatggtaaccaggagtatgaccatgacggagacccagcatggcgtat

SEQ ID NO: 381897 - DNA, 140 bp, Artificial Sequence
  Synthetic
atacgccatgctgggtctcccctgctcgtgcaggtcgaacgggtcccgcgtgcccactggggagcgggtttgggaccgtgggaatgtcacactgttgtgtgactgccccaacgggccctgcgtacttgggagtcggccat

SEQ ID NO: 381898 - DNA, 140 bp, Artificial Sequence
  Synthetic
atggccgactcccaagtacgcagggcccgttggggcagtcacacaacagtgtgacattcccacggtcccaaacccgctccccagtgggcacgcgggacccgttcgacctgcacgagcaggggagacccagcatggcgtat

SEQ ID NO: 381899 - DNA, 140 bp, Artificial Sequence
  Synthetic
atacgccatgctgggtctccggtctggctgccagctttttgccaagcaattggctggggcgaccctatcacacattggagccacggacaaaatcagtggcccctgtcatgcccccagtaccgtacttgggagtcggccat

SEQ ID NO: 381900 - DNA, 140 bp, Artificial Sequence
  Synthetic
atggccgactcccaagtacggtactgggggcatgacaggggccactgattttgtccgtggctccaatgtgtgatagggtcgccccagccaattgcttggcaaaaagctggcagccagaccggagacccagcatggcgtat

SEQ ID NO: 381901 - DNA, 140 bp, Artificial Sequence
  Synthetic
atacgccatgctgggtctccgtctacggagctgtttcagtgacttgcgtgtggggttccgcgtcttggtttgcctccactgggggacgtgattccaagatcgatgtgtggagtttggtgccgtacttgggagtcggccat

SEQ ID NO: 381902 - DNA, 140 bp, Artificial Sequence
  Synthetic
atggccgactcccaagtacggcaccaaactccacacatcgatcttggaatcacgtcccccagtggaggcaaaccaagacgcggaaccccacacgcaagtcactgaaacagctccgtagacggagacccagcatggcgtat

SEQ ID NO: 381903 - DNA, 140 bp, Artificial Sequence
  Synthetic
atacgccatgctgggtctcccggttggatcagccagctgcaccatagccgcactcggtagttcggatcgcgacaccgtggtggagctctccgagtggggagtcccctgcgctacctgtatcgtacttgggagtcggccat

SEQ ID NO: 381904 - DNA, 140 bp, Artificial Sequence
  Synthetic
atggccgactcccaagtacgatacaggtagcgcaggggactccccactcggagagctccaccacggtgtcgcgatccgaactaccgagtgcggctatggtgcagctggctgatccaaccgggagacccagcatggcgtat

SEQ ID NO: 381905 - DNA, 140 bp, Artificial Sequence
  Synthetic
atacgccatgctgggtctcctctggatcgtcggccttcctcgtgtggcacctgtgtgagggactgctggcccgaaaccgggtcggtacgtttccctttccatcggtgtggcgcgggtccccgtacttgggagtcggccat

SEQ ID NO: 381906 - DNA, 140 bp, Artificial Sequence
  Synthetic
atggccgactcccaagtacggggacccgcgccacaccgatggaaagggaaacgtaccgacccggtttcgggccagcagtccctcacacaggtgccacacgaggaaggccgacgatccagaggagacccagcatggcgtat

SEQ ID NO: 381907 - DNA, 140 bp, Artificial Sequence
  Synthetic
atacgccatgctgggtctccaggctgacacgggacttggaagcagtgcccttcgtcaacaggaccaccccattcactattagagggcccctgggcaaccaggggagggggaacccggtgccgtacttgggagtcggccat

SEQ ID NO: 381908 - DNA, 140 bp, Artificial Sequence
  Synthetic
atggccgactcccaagtacggcaccgggttccccctcccctggttgcccaggggccctctaatagtgaatggggtggtcctgttgacgaagggcactgcttccaagtcccgtgtcagcctggagacccagcatggcgtat

SEQ ID NO: 381909 - DNA, 140 bp, Artificial Sequence
  Synthetic
atacgccatgctgggtctccgttcccctctgggttttgggagttacaccatgaccaagatccgggacaccctccacttagtgaagtgccccacccccgccatagagcctcctaccgggaccgtacttgggagtcggccat

SEQ ID NO: 381910 - DNA, 140 bp, Artificial Sequence
  Synthetic
atggccgactcccaagtacggtcccggtaggaggctctatggcgggggtggggcacttcactaagtggagggtgtcccggatcttggtcatggtgtaactcccaaaacccagaggggaacggagacccagcatggcgtat

SEQ ID NO: 381911 - DNA, 140 bp, Artificial Sequence
  Synthetic
atacgccatgctgggtctccgtttgggttcttccctgggaccccccccttgaacaactgcatgctattggggaccgaggtctccgaggcattgggtggggcgggcctcacgggaggtttccgtacttgggagtcggccat

SEQ ID NO: 381912 - DNA, 140 bp, Artificial Sequence
  Synthetic
atggccgactcccaagtacggaaacctcccgtgaggcccgccccacccaatgcctcggagacctcggtccccaatagcatgcagttgttcaaggggggggtcccagggaagaacccaaacggagacccagcatggcgtat

SEQ ID NO: 381913 - DNA, 140 bp, Artificial Sequence
  Synthetic
atacgccatgctgggtctcctatgaacccctggttaggcggtgttcagagctgatggggcgccgaaatccggtttgcccggggtttgcatggctctcctcgggtaggcctgatgggttcacgtacttgggagtcggccat

SEQ ID NO: 381914 - DNA, 140 bp, Artificial Sequence
  Synthetic
atggccgactcccaagtacgtgaacccatcaggcctacccgaggagagccatgcaaaccccgggcaaaccggatttcggcgccccatcagctctgaacaccgcctaaccaggggttcataggagacccagcatggcgtat

SEQ ID NO: 381915 - DNA, 140 bp, Artificial Sequence
  Synthetic
atacgccatgctgggtctcctacacgttcagggtcacttgcaggaggtggatgcaggcaacttcattccgccccctcgctggttgctcttggactttgtgtttgtccttctctatctgatcgtacttgggagtcggccat

SEQ ID NO: 381916 - DNA, 140 bp, Artificial Sequence
  Synthetic
atggccgactcccaagtacgatcagatagagaaggacaaacacaaagtccaagagcaaccagcgagggggcggaatgaagttgcctgcatccacctcctgcaagtgaccctgaacgtgtaggagacccagcatggcgtat

SEQ ID NO: 381917 - DNA, 140 bp, Artificial Sequence
  Synthetic
atacgccatgctgggtctccgaagctggcggaggcacggttggtcccgctgatcctcctcctgctatggtggtgggtgaaccagctggcggtcctaggactgccggcggcgcacgctgcccgtacttgggagtcggccat

SEQ ID NO: 381918 - DNA, 140 bp, Artificial Sequence
  Synthetic
atggccgactcccaagtacgggcagcgtgcgccgccggcagtcctaggaccgccagctggttcacccaccaccatagcaggaggaggatcagcgggaccaaccgtgcctccgccagcttcggagacccagcatggcgtat

SEQ ID NO: 381919 - DNA, 140 bp, Artificial Sequence
  Synthetic
atacgccatgctgggtctccgtggcgggtgaagtgttcgcgggaccggccctgtcatggtgcctgggcttgcccttcgtaagtatgatcctgggactcgcaaacctggtgttgtactttccgtacttgggagtcggccat

SEQ ID NO: 381920 - DNA, 140 bp, Artificial Sequence
  Synthetic
atggccgactcccaagtacggaaagtacaacaccaggtttgcgagtcccaggatcatacttacgaagggcaagcccaggcaccatgacagggccggtcccgcgaacacttcacccgccacggagacccagcatggcgtat

SEQ ID NO: 381921 - DNA, 140 bp, Artificial Sequence
  Synthetic
atacgccatgctgggtctccgttggatgggccctcagcgcctgatgttcctcgtgttgtggaagctcgctcggggagctttcccactggctcttctgatggggatttcagctagccgtggcgtacttgggagtcggccat

SEQ ID NO: 381922 - DNA, 140 bp, Artificial Sequence
  Synthetic
atggccgactcccaagtacgccacggctagctgaaatccccatcagaagagccagtgggaaagctccccgagcgagcttccacaacacgaggaacatcaggcgctgagggcccatccaacggagacccagcatggcgtat

SEQ ID NO: 381923 - DNA, 140 bp, Artificial Sequence
  Synthetic
atacgccatgctgggtctccccgcacctcagtgctcggagccgagttctgctttgacgtcaccttcgaagtagacacgtcggttttgggatgggtggtggccagtgttgtggcttgggcccgtacttgggagtcggccat

SEQ ID NO: 381924 - DNA, 140 bp, Artificial Sequence
  Synthetic
atggccgactcccaagtacgggcccaagccacaacactggccaccacccatcccaaaaccgacgtgtctacttcgaaggtgacgtcaaagcagaactcggctccgagcactgaggtgcggggagacccagcatggcgtat

SEQ ID NO: 381925 - DNA, 140 bp, Artificial Sequence
  Synthetic
atacgccatgctgggtctccatagcgctcttgagctccatgagcgcaggaggctggaggcataaggctgtcatctatcggacgtggtgcaaggggtatcaggcaatacggcagcgggtggcgtacttgggagtcggccat

SEQ ID NO: 381926 - DNA, 140 bp, Artificial Sequence
  Synthetic
atggccgactcccaagtacgccacccgctgccgtattgcctgataccccttgcaccacgtccgatagatgacagccttatgcctccagcctcctgcgctcatggagctcaagagcgctatggagacccagcatggcgtat

SEQ ID NO: 381927 - DNA, 140 bp, Artificial Sequence
  Synthetic
atacgccatgctgggtctccttcgcagccccctcggggaggggcggcctaccaaacccctgacgtttgcttggtgcttggcctcctacatctggcctgatgccgtgatgttggtggtggtcgtacttgggagtcggccat

SEQ ID NO: 381928 - DNA, 140 bp, Artificial Sequence
  Synthetic
atggccgactcccaagtacgaccaccaccaacatcacggcatcaggccagatgtaggaggccaagcaccaagcaaacgtcaggggtttggtaggccgcccctccccgagggggctgcgaaggagacccagcatggcgtat

SEQ ID NO: 381929 - DNA, 140 bp, Artificial Sequence
  Synthetic
atacgccatgctgggtctccggctctggtgctcctgtttggtctgttcgacgcgttggactgggccttggaggagctactagtgtcgcggccctcattgcggcgccttgcccgggtggtgcgtacttgggagtcggccat

SEQ ID NO: 381930 - DNA, 140 bp, Artificial Sequence
  Synthetic
atggccgactcccaagtacgcaccacccgggcaaggcgccgcaatgagggccgcgacactagtagctcctccaaggcccagtccaacgcgtcgaacagaccaaacaggagcaccagagccggagacccagcatggcgtat

SEQ ID NO: 381931 - DNA, 140 bp, Artificial Sequence
  Synthetic
atacgccatgctgggtctccgagtgttgtgtgatggcaggcgagagggcgactaccgttcggttggtgtccaagatgtgcgcgaggggggcctatctgttcgaccatatgggctctttttcgtacttgggagtcggccat

SEQ ID NO: 381932 - DNA, 140 bp, Artificial Sequence
  Synthetic
atggccgactcccaagtacgaaaaagagcccatatggtcgaacagataggcccccctcgcgcacatcttggacaccaaccgaacggtagtcgccctctcgcctgccatcacacaacactcggagacccagcatggcgtat

SEQ ID NO: 381933 - DNA, 140 bp, Artificial Sequence
  Synthetic
atacgccatgctgggtctcccgcgcgcggtcaaggaacgcttgctggagtgggacgccgcccttgaacctctatcattcactaggacggattgtcgcatcatacgagacgctgcacgaaccgtacttgggagtcggccat

SEQ ID NO: 381934 - DNA, 140 bp, Artificial Sequence
  Synthetic
atggccgactcccaagtacggttcgtgcagcgtctcgtatgatgcgacaatccgtcctagtgaatgatagaggttcaagggcggcgtcccactccagcaagcgttccttgaccgcgcgcgggagacccagcatggcgtat

SEQ ID NO: 381935 - DNA, 140 bp, Artificial Sequence
  Synthetic
atacgccatgctgggtctccgctgagctgcggccagtgcgtcatgggactacccgtggttgcgcgccgtggcgatgaggtgttgatcggcgttttccaagatgtgaaccatttgcctccgcgtacttgggagtcggccat

SEQ ID NO: 381936 - DNA, 140 bp, Artificial Sequence
  Synthetic
atggccgactcccaagtacgcggaggcaaatggttcacatcttggaaaacgccgatcaacacctcatcgccacggcgcgcaaccacgggtagtcccatgacgcactggccgcagctcagcggagacccagcatggcgtat

SEQ ID NO: 381937 - DNA, 140 bp, Artificial Sequence
  Synthetic
atacgccatgctgggtctccgggtttgtcccgaccgcgccagtagtcatccggcggtgcggaaagggcttcctcggggtcacaaaggctgccttgacaggaagagatccagacctacacccgtacttgggagtcggccat

SEQ ID NO: 381938 - DNA, 140 bp, Artificial Sequence
  Synthetic
atggccgactcccaagtacgggtgtaggtctggatctcttcctgtcaaggcagcctttgtgaccccgaggaagccctttccgcaccgccggatgactactggcgcggtcgggacaaacccggagacccagcatggcgtat

SEQ ID NO: 381939 - DNA, 140 bp, Artificial Sequence
  Synthetic
atacgccatgctgggtctcccagggaacgtcatggtgttggggacggctacctctcggagcatgggaacatgtctgaatggtttgctgttcaccactttccatggggcttcttcccgaaccgtacttgggagtcggccat

SEQ ID NO: 381940 - DNA, 140 bp, Artificial Sequence
  Synthetic
atggccgactcccaagtacggttcgggaagaagccccatggaaagtggtgaacagcaaaccattcagacatgttcccatgctccgagaggtagccgtccccaacaccatgacgttccctgggagacccagcatggcgtat

SEQ ID NO: 381941 - DNA, 140 bp, Artificial Sequence
  Synthetic
atacgccatgctgggtctcccatagcgacacctgtgggggccctaaacccaaggtggtggtctgccagtgatgacgtgacggtgtaccccctccctgatggagccacctcactcgcgccccgtacttgggagtcggccat

SEQ ID NO: 381942 - DNA, 140 bp, Artificial Sequence
  Synthetic
atggccgactcccaagtacggggcgcgagtgaggtggctccatcagggagggggtacaccgtcacgtcatcactggcagaccaccaccttgggtttagggcccccacaggtgtcgctatgggagacccagcatggcgtat

SEQ ID NO: 381943 - DNA, 140 bp, Artificial Sequence
  Synthetic
atacgccatgctgggtctcctgcacttgccaggcggagtcctgttgggtcatacgatctgacggggctctttgccatggtttgtgtaagggggacaaggttgaactggacgtggccatggcgtacttgggagtcggccat

SEQ ID NO: 381944 - DNA, 140 bp, Artificial Sequence
  Synthetic
atggccgactcccaagtacgccatggccacgtccagttcaaccttgtcccccttacacaaaccatggcaaagagccccgtcagatcgtatgacccaacaggactccgcctggcaagtgcaggagacccagcatggcgtat

SEQ ID NO: 381945 - DNA, 140 bp, Artificial Sequence
  Synthetic
atacgccatgctgggtctccaggtcgcagacttccgtgggtcgtctgggtcacctgtcttgtgcgatgagggacacgcagtaggaatgctcgtgtcagtgctccactcgggtggccgagtcgtacttgggagtcggccat

SEQ ID NO: 381946 - DNA, 140 bp, Artificial Sequence
  Synthetic
atggccgactcccaagtacgactcggccacccgagtggagcactgacacgagcattcctactgcgtgtccctcatcgcacaagacaggtgacccagacgacccacggaagtctgcgacctggagacccagcatggcgtat

SEQ ID NO: 381947 - DNA, 140 bp, Artificial Sequence
  Synthetic
atacgccatgctgggtctcccaccgctgcgagattcacgcggccgtggacccaggtcccgactgacgccaaaaccactactgagcctcctccagtaccagctaaaggtgtcttcaaggaacgtacttgggagtcggccat

SEQ ID NO: 381948 - DNA, 140 bp, Artificial Sequence
  Synthetic
atggccgactcccaagtacgttccttgaagacacctttagctggtactggaggaggctcagtagtggttttggcgtcagtcgggacctgggtccacggccgcgtgaatctcgcagcggtgggagacccagcatggcgtat

SEQ ID NO: 381949 - DNA, 140 bp, Artificial Sequence
  Synthetic
atacgccatgctgggtctccgctccgcttttcatgccgacaggggccggtaagagcactcgggtccctcttgagtatgggaatatggggcacaaggtcttgattctgaacccgtccgtggcgtacttgggagtcggccat

SEQ ID NO: 381950 - DNA, 140 bp, Artificial Sequence
  Synthetic
atggccgactcccaagtacgccacggacgggttcagaatcaagaccttgtgccccatattcccatactcaagagggacccgagtgctcttaccggcccctgtcggcatgaaaagcggagcggagacccagcatggcgtat

SEQ ID NO: 381951 - DNA, 140 bp, Artificial Sequence
  Synthetic
atacgccatgctgggtctccctacagtgcgtgcaatggggccctacatggagcgccttgcggggaaacatccaagcatttactgcggacatgacaccacggcattcacacgtgttactgacgtacttgggagtcggccat

SEQ ID NO: 381952 - DNA, 140 bp, Artificial Sequence
  Synthetic
atggccgactcccaagtacgtcagtaacacgtgtgaatgccgtggtgtcatgtccgcagtaaatgcttggatgtttccccgcaaggcgctccatgtagggccccattgcacgcactgtagggagacccagcatggcgtat

SEQ ID NO: 381953 - DNA, 140 bp, Artificial Sequence
  Synthetic
atacgccatgctgggtctccctccccccttacgtactctacctacggtcggttcctcgccaaccctaggcagatgctacggggggtctcggtggtcatctgtgatgagtgccacagccatcgtacttgggagtcggccat

SEQ ID NO: 381954 - DNA, 140 bp, Artificial Sequence
  Synthetic
atggccgactcccaagtacgatggctgtggcactcatcacagatgaccaccgagaccccccgtagcatctgcctagggttggcgaggaaccgaccgtaggtagagtacgtaaggggggagggagacccagcatggcgtat

SEQ ID NO: 381955 - DNA, 140 bp, Artificial Sequence
  Synthetic
atacgccatgctgggtctccgactcaacagtgttgttgggcatcggtcgggtcagggagttggctcgtggctgtggagtgcaacttgtgctctacgccaccgctacaccccccggctcaccgtacttgggagtcggccat

SEQ ID NO: 381956 - DNA, 140 bp, Artificial Sequence
  Synthetic
atggccgactcccaagtacggtgagccggggggtgtagcggtggcgtagagcacaagttgcactccacagccacgagccaactccctgacccgaccgatgcccaacaacactgttgagtcggagacccagcatggcgtat

SEQ ID NO: 381957 - DNA, 140 bp, Artificial Sequence
  Synthetic
atacgccatgctgggtctcccgatgacccagcacccttccatcattgagacaaagctggatgtgggtgagatccccttttatgggcatggcatacccttggagaggatgcgcaccggccgcgtacttgggagtcggccat

SEQ ID NO: 381958 - DNA, 140 bp, Artificial Sequence
  Synthetic
atggccgactcccaagtacgcggccggtgcgcatcctctccaagggtatgccatgcccataaaaggggatctcacccacatccagctttgtctcaatgatggaagggtgctgggtcatcgggagacccagcatggcgtat

SEQ ID NO: 381959 - DNA, 140 bp, Artificial Sequence
  Synthetic
atacgccatgctgggtctccgcacctcgtattctgccattccaaggcggagtgcgagcgccttgccgggcagttctcggccaggggtgtcaatgccgtcgcctattacaggggcaaggaccgtacttgggagtcggccat

SEQ ID NO: 381960 - DNA, 140 bp, Artificial Sequence
  Synthetic
atggccgactcccaagtacggtccttgcccctgtaataggcgacggcattgacacccctggccgagaactgcccggcaaggcgctcgcactccgccttggaatggcagaatacgaggtgcggagacccagcatggcgtat

SEQ ID NO: 381961 - DNA, 140 bp, Artificial Sequence
  Synthetic
atacgccatgctgggtctccagttcaatcatcaaggacggagacctcgtggtgtgcgctacagacgcgctatccacggggtattcaggcaactttgactcggtcactgattgtgggctagcgtacttgggagtcggccat

SEQ ID NO: 381962 - DNA, 140 bp, Artificial Sequence
  Synthetic
atggccgactcccaagtacgctagcccacaatcagtgaccgagtcaaagttgcctgaataccccgtggatagcgcgtctgtagcgcacaccacgaggtctccgtccttgatgattgaactggagacccagcatggcgtat

SEQ ID NO: 381963 - DNA, 140 bp, Artificial Sequence
  Synthetic
atacgccatgctgggtctcctggtggaggaggtcgtggaagtgacccttgatcccaccattaccatctccttgcgcacggtgcctgcgtcggcagaattgtcgatgcaacgcagaggacgcgtacttgggagtcggccat

SEQ ID NO: 381964 - DNA, 140 bp, Artificial Sequence
  Synthetic
atggccgactcccaagtacgcgtcctctgcgttgcatcgacaattctgccgacgcaggcaccgtgcgcaaggagatggtaatggtgggatcaagggtcacttccacgacctcctccaccaggagacccagcatggcgtat

SEQ ID NO: 381965 - DNA, 140 bp, Artificial Sequence
  Synthetic
atacgccatgctgggtctcccacagggagaggaaggtccgggcggtactactacgccggggttggcaaagccccggcgggggtggttcgctcgggcccagtctggtcagctgtggaagctcgtacttgggagtcggccat

SEQ ID NO: 381966 - DNA, 140 bp, Artificial Sequence
  Synthetic
atggccgactcccaagtacgagcttccacagctgaccagactgggcccgagcgaaccacccccgccggggctttgccaaccccggcgtagtagtaccgcccggaccttcctctccctgtgggagacccagcatggcgtat

SEQ ID NO: 381967 - DNA, 140 bp, Artificial Sequence
  Synthetic
atacgccatgctgggtctccggagtgacctggtatgggatggaacctgacctgacagcaaacctactgagactttacgacgactgcccttacaccgcagccgtcgcggctgacatcggagcgtacttgggagtcggccat

SEQ ID NO: 381968 - DNA, 140 bp, Artificial Sequence
  Synthetic
atggccgactcccaagtacgctccgatgtcagccgcgacggctgcggtgtaagggcagtcgtcgtaaagtctcagtaggtttgctgtcaggtcaggttccatcccataccaggtcactccggagacccagcatggcgtat

SEQ ID NO: 381969 - DNA, 140 bp, Artificial Sequence
  Synthetic
atacgccatgctgggtctccaagccgcggtgttcttctcgggtctcgcgcccttgaggatgcatcctgatgtcagctgggcaaaagttcgcggcgtcaactggccccttttggtgggcgtcgtacttgggagtcggccat

SEQ ID NO: 381970 - DNA, 140 bp, Artificial Sequence
  Synthetic
atggccgactcccaagtacgacgcccaccaaaaggggccagttgacgccgcgaacttttgcccagctgacatcaggatgcatcctcaagggcgcgagacccgagaagaacaccgcggcttggagacccagcatggcgtat

SEQ ID NO: 381971 - DNA, 140 bp, Artificial Sequence
  Synthetic
atacgccatgctgggtctccgcagcggacgatgtgccgggaaacactgtcacccgggccttcggacgacccccaatgggcaggccttaaagggccaaatcctgtcccactcctgctgcggcgtacttgggagtcggccat

SEQ ID NO: 381972 - DNA, 140 bp, Artificial Sequence
  Synthetic
atggccgactcccaagtacgccgcagcaggagtgggacaggatttggccctttaaggcctgcccattgggggtcgtccgaaggcccgggtgacagtgtttcccggcacatcgtccgctgcggagacccagcatggcgtat

SEQ ID NO: 381973 - DNA, 140 bp, Artificial Sequence
  Synthetic
atacgccatgctgggtctcctggggcaatgacttaccaactaaggtggccggccatcacatagttgacgatctggttcgtcggctcggtgtggcggagggttatgttcgctgcgacgcggcgtacttgggagtcggccat

SEQ ID NO: 381974 - DNA, 140 bp, Artificial Sequence
  Synthetic
atggccgactcccaagtacgccgcgtcgcagcgaacataaccctccgccacaccgagccgacgaaccagatcgtcaactatgtgatggccggccaccttagttggtaagtcattgccccaggagacccagcatggcgtat

SEQ ID NO: 381975 - DNA, 140 bp, Artificial Sequence
  Synthetic
atacgccatgctgggtctccgacccatcttgatggtggggctcgctatcgcgggggggatgatctacgcctcatacactgggtcactagtggtggtgacagactgggatgtgaaggggggcgtacttgggagtcggccat

SEQ ID NO: 381976 - DNA, 140 bp, Artificial Sequence
  Synthetic
atggccgactcccaagtacgccccccttcacatcccagtctgtcaccaccactagtgacccagtgtatgaggcgtagatcatcccccccgcgatagcgagccccaccatcaagatgggtcggagacccagcatggcgtat

SEQ ID NO: 381977 - DNA, 140 bp, Artificial Sequence
  Synthetic
atacgccatgctgggtctcctggcaaccccctttacaggagtggagaccaggccacacctcaacctgtggtgcaggtccccccggtagaccatcggccggggggggaatctgcgccatcgcgtacttgggagtcggccat

SEQ ID NO: 381978 - DNA, 140 bp, Artificial Sequence
  Synthetic
atggccgactcccaagtacgcgatggcgcagattccccccccggccgatggtctaccggggggacctgcaccacaggttgaggtgtggcctggtctccactcctgtaaagggggttgccaggagacccagcatggcgtat

SEQ ID NO: 381979 - DNA, 140 bp, Artificial Sequence
  Synthetic
atacgccatgctgggtctccgatgccaagacagtgacagatgcggtggcagccatccaggtcaactgcgattggtcggtaatgaccctgtcgatcggggaagtgctgaccctggcacaggcgtacttgggagtcggccat

SEQ ID NO: 381980 - DNA, 140 bp, Artificial Sequence
  Synthetic
atggccgactcccaagtacgcctgtgccagggtcagcacttccccgatcgacagggtcattaccgaccaatcgcagttgacctggatggctgccaccgcatctgtcactgtcttggcatcggagacccagcatggcgtat

SEQ ID NO: 381981 - DNA, 140 bp, Artificial Sequence
  Synthetic
atacgccatgctgggtctccccaagacagccgaggcctacgcagcgaccgccaagtggctcgctggctgctatacggggacgcgggccgtccccactgtatccattgtggacaagctcttcgtacttgggagtcggccat

SEQ ID NO: 381982 - DNA, 140 bp, Artificial Sequence
  Synthetic
atggccgactcccaagtacgaagagcttgtccacaatggatacagtggggacggcccgcgtccccgtatagcagccagcgagccacttggcggtcgctgcgtaggcctcggctgtcttggggagacccagcatggcgtat

SEQ ID NO: 381983 - DNA, 140 bp, Artificial Sequence
  Synthetic
atacgccatgctgggtctcccgccgggggttgggcggccgtggtaggccactgtcacagtgtaatagctgcggcggtggccgcctacggggcttctcggagccctccgctagctgcggcccgtacttgggagtcggccat

SEQ ID NO: 381984 - DNA, 140 bp, Artificial Sequence
  Synthetic
atggccgactcccaagtacgggccgcagctagcggagggctccgagaagccccgtaggcggccaccgccgcagctattacactgtgacagtggcctaccacggccgcccaacccccggcgggagacccagcatggcgtat

SEQ ID NO: 381985 - DNA, 140 bp, Artificial Sequence
  Synthetic
atacgccatgctgggtctccgcttcatacctcatggggttgggcgtcgggggcaacgctcaggcgcgactggcttccgccctccttttgggggccgctgggactgccctgggcactccggcgtacttgggagtcggccat

SEQ ID NO: 381986 - DNA, 140 bp, Artificial Sequence
  Synthetic
atggccgactcccaagtacgccggagtgcccagggcagtcccagcggcccccaaaaggagggcggaagccagtcgcgcctgagcgttgcccccgacgcccaaccccatgaggtatgaagcggagacccagcatggcgtat

SEQ ID NO: 381987 - DNA, 140 bp, Artificial Sequence
  Synthetic
atacgccatgctgggtctcctcgtgggtctaaccatggccggagcgttcatgggcggtgccagtgtgtctccctcactcgtcacggtcctcctaggggccgtggggggttgggagggcgtcgtacttgggagtcggccat

SEQ ID NO: 381988 - DNA, 140 bp, Artificial Sequence
  Synthetic
atggccgactcccaagtacgacgccctcccaaccccccacggcccctaggaggaccgtgacgagtgagggagacacactggcaccgcccatgaacgctccggccatggttagacccacgaggagacccagcatggcgtat

SEQ ID NO: 381989 - DNA, 140 bp, Artificial Sequence
  Synthetic
atacgccatgctgggtctccggtcaacgccgccagcttagtcttcgacttcatggcagggaagctttcaactgaagacctgtggtatgccatcccagtgctcaccagcccgggggccggccgtacttgggagtcggccat

SEQ ID NO: 381990 - DNA, 140 bp, Artificial Sequence
  Synthetic
atggccgactcccaagtacggccggcccccgggctggtgagcactgggatggcataccacaggtcttcagttgaaagcttccctgccatgaagtcgaagactaagctggcggcgttgaccggagacccagcatggcgtat

SEQ ID NO: 381991 - DNA, 140 bp, Artificial Sequence
  Synthetic
atacgccatgctgggtctcccttgcggggatagccctaggattggtgttgtactcagctaacaactctggcactaccacttggttgaacagactgctgaccacgttgcctcgttcatcatcgtacttgggagtcggccat

SEQ ID NO: 381992 - DNA, 140 bp, Artificial Sequence
  Synthetic
atggccgactcccaagtacgatgatgaacgaggcaacgtggtcagcagtctgttcaaccaagtggtagtgccagagttgttagctgagtacaacaccaatcctagggctatccccgcaagggagacccagcatggcgtat

SEQ ID NO: 381993 - DNA, 140 bp, Artificial Sequence
  Synthetic
atacgccatgctgggtctccgcattccagacagctatttccaacaggctgactactgtgacaaagtctcggccatgctccgacgcctgagcctcaccaggacggtggttgccctggtcaacgtacttgggagtcggccat

SEQ ID NO: 381994 - DNA, 140 bp, Artificial Sequence
  Synthetic
atggccgactcccaagtacgttgaccagggcaaccaccgtcctggtgaggctcaggcgtcggagcatggccgagactttgtcacagtagtcagcctgttggaaatagctgtctggaatgcggagacccagcatggcgtat

SEQ ID NO: 381995 - DNA, 140 bp, Artificial Sequence
  Synthetic
atacgccatgctgggtctcccagggagcctaaggtggatgaggtacaggtaggatatgtctgggacctgtgggagtgggtcatgcgccaagtgcgcatggtcatggccaggctccgggcccgtacttgggagtcggccat

SEQ ID NO: 381996 - DNA, 140 bp, Artificial Sequence
  Synthetic
atggccgactcccaagtacgggcccggagcctggccatgaccatgcgcacttggcgcatgacccactcccacaggtcccagacatatcctacctgtacctcatccaccttaggctccctgggagacccagcatggcgtat

SEQ ID NO: 381997 - DNA, 140 bp, Artificial Sequence
  Synthetic
atacgccatgctgggtctccctctgtcccgtggtgtcactccctttgtggcactgcggtgaggggtggtccggggaatggctgttggacggtcatgtggagagtcgctgtctttgtgggtcgtacttgggagtcggccat

SEQ ID NO: 381998 - DNA, 140 bp, Artificial Sequence
  Synthetic
atggccgactcccaagtacgacccacaaagacagcgactctccacatgaccgtccaacagccattccccggaccacccctcaccgcagtgccacaaagggagtgacaccacgggacagagggagacccagcatggcgtat

SEQ ID NO: 381999 - DNA, 140 bp, Artificial Sequence
  Synthetic
atacgccatgctgggtctccgcgtcataacaggcgacgtgctcaatgggcaactcaaagatccagtttactctaccaagttgtgccggcactattggatgggcactgtgcctgtgaacatcgtacttgggagtcggccat

SEQ ID NO: 382000 - DNA, 140 bp, Artificial Sequence
  Synthetic
atggccgactcccaagtacgatgttcacaggcacagtgcccatccaatagtgccggcacaacttggtagagtaaactggatctttgagttgcccattgagcacgtcgcctgttatgacgcggagacccagcatggcgtat

SEQ ID NO: 382001 - DNA, 140 bp, Artificial Sequence
  Synthetic
atacgccatgctgggtctccgctgggttacggggaaacgtcgcctctcctggcctccgacacgcctaaggtcgtcccttttggcacgtcaggctgggctgaggtggtcgtgacccccacccgtacttgggagtcggccat

SEQ ID NO: 382002 - DNA, 140 bp, Artificial Sequence
  Synthetic
atggccgactcccaagtacgggtgggggtcacgaccacctcagcccagcctgacgtgccaaaagggacgaccttaggcgtgtcggaggccaggagaggcgacgtttccccgtaacccagcggagacccagcatggcgtat

SEQ ID NO: 382003 - DNA, 140 bp, Artificial Sequence
  Synthetic
atacgccatgctgggtctcccacgtggtgatcaggcgcacctcatgctacaagttgctgcgccaacaaattctttctgctgctgtggctgagccctactacgtcgacggcattcctgtctcgtacttgggagtcggccat

SEQ ID NO: 382004 - DNA, 140 bp, Artificial Sequence
  Synthetic
atggccgactcccaagtacgagacaggaatgccgtcgacgtagtagggctcagccacagcagcagaaagaatttgttggcgcagcaacttgtagcatgaggtgcgcctgatcaccacgtgggagacccagcatggcgtat

SEQ ID NO: 382005 - DNA, 140 bp, Artificial Sequence
  Synthetic
atacgccatgctgggtctcccgtgggacgcggacgcgcgagcgcccgcgatggtctacggtcctggccaaagcgtcaccattgatggggagcggtacactcttccgcatcaactgcggatcgtacttgggagtcggccat

SEQ ID NO: 382006 - DNA, 140 bp, Artificial Sequence
  Synthetic
atggccgactcccaagtacgatccgcagttgatgcggaagagtgtaccgctccccatcaatggtgacgctttggccaggaccgtagaccatcgcgggcgctcgcgcgtccgcgtcccacgggagacccagcatggcgtat

SEQ ID NO: 382007 - DNA, 140 bp, Artificial Sequence
  Synthetic
atacgccatgctgggtctccgaggaatatcgcgccctcggaggtttcgtctgaggtcagtatcgagattgggacggagactgaggattcagaactgacagaggccgatttgccgccggcgcgtacttgggagtcggccat

SEQ ID NO: 382008 - DNA, 140 bp, Artificial Sequence
  Synthetic
atggccgactcccaagtacgcgccggcggcaaatcggcctctgtcagttctgaatcctcagtctccgtcccaatctcgatactgacctcagacgaaacctccgagggcgcgatattcctcggagacccagcatggcgtat

SEQ ID NO: 382009 - DNA, 140 bp, Artificial Sequence
  Synthetic
atacgccatgctgggtctccgctgctgccctccaggctattgagaatgctgcgagaattctcgagcctcatatcgatgtcatcatggaggactgcagtacaccctctctctgtggtagtacgtacttgggagtcggccat

SEQ ID NO: 382010 - DNA, 140 bp, Artificial Sequence
  Synthetic
atggccgactcccaagtacgtactaccacagagagagggtgtactgcagtcctccatgatgacatcgatatgaggctcgagaattctcgcagcattctcaatagcctggagggcagcagcggagacccagcatggcgtat

SEQ ID NO: 382011 - DNA, 140 bp, Artificial Sequence
  Synthetic
atacgccatgctgggtctccgccgagagatgcctgtttggggtgaagacatcccccgaactccatcgcctgcacttatctcggttacggagagcagctcagatgagaagaccccgtcggtcgtacttgggagtcggccat

SEQ ID NO: 382012 - DNA, 140 bp, Artificial Sequence
  Synthetic
atggccgactcccaagtacgaccgacggggtcttctcatctgagctgctctccgtaaccgagataagtgcaggcgatggagttcgggggatgtcttcaccccaaacaggcatctctcggcggagacccagcatggcgtat

SEQ ID NO: 382013 - DNA, 140 bp, Artificial Sequence
  Synthetic
atacgccatgctgggtctccgtcttcctcgcaggaggacactccgtcgtcggactcatttgaagtcatccaagagtctgatacagcagaaggggaggaaagtgtcttcaacgtggctcttcgtacttgggagtcggccat

SEQ ID NO: 382014 - DNA, 140 bp, Artificial Sequence
  Synthetic
atggccgactcccaagtacgaagagccacgttgaagacactttcctccccttctgctgtatcagactcttggatgacttcaaatgagtccgacgacggagtgtcctcctgcgaggaagacggagacccagcatggcgtat

SEQ ID NO: 382015 - DNA, 140 bp, Artificial Sequence
  Synthetic
atacgccatgctgggtctcctccgtactaaaagccttatttccacagagcgacgccactagaaagttgacagtgaagatgtcctgctgcgtggagaagagcgtcacacgcttcttttcaccgtacttgggagtcggccat

SEQ ID NO: 382016 - DNA, 140 bp, Artificial Sequence
  Synthetic
atggccgactcccaagtacggtgaaaagaagcgtgtgacgctcttctccacgcagcaggacatcttcactgtcaactttctagtggcgtcgctctgtggaaataaggcttttagtacggaggagacccagcatggcgtat

SEQ ID NO: 382017 - DNA, 140 bp, Artificial Sequence
  Synthetic
aggccctggctgctgatatgagtgaagatgtcctgctgcgtggagaagagcgtcacacgcttcttttcactgggattgactgtagcagatgtggctagcctgtgtgagatggaaatccaggaccttttgggacagcggtg

SEQ ID NO: 382018 - DNA, 140 bp, Artificial Sequence
  Synthetic
caccgctgtcccaaaaggtcctggatttccatctcacacaggctagccacatctgctacagtcaatcccagtgaaaagaagcgtgtgacgctcttctccacgcagcaggacatcttcactcatatcagcagccagggcct

SEQ ID NO: 382019 - DNA, 140 bp, Artificial Sequence
  Synthetic
aggccctggctgctgatatgaaccatacagcctattgtgacaaggtgcgcactccgctcgaattgcaagttgggtgcttggtgggcaatgaacttacctttgaatgtgataagtgtgaaggaccttttgggacagcggtg

SEQ ID NO: 382020 - DNA, 140 bp, Artificial Sequence
  Synthetic
caccgctgtcccaaaaggtccttcacacttatcacattcaaaggtaagttcattgcccaccaagcacccaacttgcaattcgagcggagtgcgcaccttgtcacaataggctgtatggttcatatcagcagccagggcct

SEQ ID NO: 382021 - DNA, 140 bp, Artificial Sequence
  Synthetic
atacgccatgctgggtctcccaaggcaagagaccttggcctccttctcatatatctggtctggtgttccgctgacacgtgccacgccggctaaaccacctgtggtgaggcccgtggggtccgtacttgggagtcggccat

SEQ ID NO: 382022 - DNA, 140 bp, Artificial Sequence
  Synthetic
atggccgactcccaagtacggaccccacgggcctcaccacaggtggtttagccggcgtggcacgtgtcagcggaacaccagaccagatatatgagaaggaggccaaggtctcttgccttgggagacccagcatggcgtat

SEQ ID NO: 382023 - DNA, 140 bp, Artificial Sequence
  Synthetic
atacgccatgctgggtctccgctgttagtggcagacactaccaaagtgtatgtcaccaatccagacaatgtggggagacgagttgacaaggttaccttctggcgtgcccctcgggtccatcgtacttgggagtcggccat

SEQ ID NO: 382024 - DNA, 140 bp, Artificial Sequence
  Synthetic
atggccgactcccaagtacgatggacccgaggggcacgccagaaggtaaccttgtcaactcgtctccccacattgtctggattggtgacatacactttggtagtgtctgccactaacagcggagacccagcatggcgtat

SEQ ID NO: 382025 - DNA, 140 bp, Artificial Sequence
  Synthetic
atacgccatgctgggtctccgacaaatttctcgtggactcgattgaggctgccaggaggtctgctcaagcctgcgtaagcatgggttacacttatgaggaggcaataaggactgttaggccgtacttgggagtcggccat

SEQ ID NO: 382026 - DNA, 140 bp, Artificial Sequence
  Synthetic
atggccgactcccaagtacggcctaacagtccttattgcctcctcataagtgtaacccatgcttacgcaggcttgagcagacctcctggcagcctcaatcgagtccacgagaaatttgtcggagacccagcatggcgtat

SEQ ID NO: 382027 - DNA, 140 bp, Artificial Sequence
  Synthetic
atacgccatgctgggtctcccgcatgctgccatgggctggggatctaaggtgtcagtcaaggacctcgccacccctgcggggaagatggccgtccatgaccggctccaggagatacttgacgtacttgggagtcggccat

SEQ ID NO: 382028 - DNA, 140 bp, Artificial Sequence
  Synthetic
atggccgactcccaagtacgtcaagtatctcctggagccggtcatggacggccatcttccccgcaggggtggcgaggtccttgactgacaccttagatccccagcccatggcagcatgcgggagacccagcatggcgtat

SEQ ID NO: 382029 - DNA, 140 bp, Artificial Sequence
  Synthetic
aggccctggctgctgatatgagggactccggtcccctttacattgactgtgaaaaaggaggtgttcttcaaagaccgtaaggaggagaaggccccccgcctcattgtgttcccccccctggaccttttgggacagcggtg

SEQ ID NO: 382030 - DNA, 140 bp, Artificial Sequence
  Synthetic
caccgctgtcccaaaaggtccaggggggggaacacaatgaggcggggggccttctcctccttacggtctttgaagaacacctcctttttcacagtcaatgtaaaggggaccggagtccctcatatcagcagccagggcct

SEQ ID NO: 382031 - DNA, 140 bp, Artificial Sequence
  Synthetic
atacgccatgctgggtctccgacttccggatagctgaaaagctcattttgggagacccgggtagggtagccaaggcggtgttggggggggcttacgccttccagtacaccccaaaccagccgtacttgggagtcggccat

SEQ ID NO: 382032 - DNA, 140 bp, Artificial Sequence
  Synthetic
atggccgactcccaagtacggctggtttggggtgtactggaaggcgtaagccccccccaacaccgccttggctaccctacccgggtctcccaaaatgagcttttcagctatccggaagtcggagacccagcatggcgtat

SEQ ID NO: 382033 - DNA, 140 bp, Artificial Sequence
  Synthetic
atacgccatgctgggtctccgagtcaaggagatgctcaagctgtgggagtcaaagaagaccccttgcgccatttgcgtggatgccacttgcttcgacagtagtataactgaagaggacgtcgtacttgggagtcggccat

SEQ ID NO: 382034 - DNA, 140 bp, Artificial Sequence
  Synthetic
atggccgactcccaagtacgacgtcctcttcagttatactactgtcgaagcaagtggcatccacgcaaatggcgcaaggggtcttctttgactcccacagcttgagcatctccttgactcggagacccagcatggcgtat

SEQ ID NO: 382035 - DNA, 140 bp, Artificial Sequence
  Synthetic
atacgccatgctgggtctccggctttggagacagagctatatgctttggcctccgaccatcccgaatgggtgcgagccttggggaaatactatgcctcaggtaccatggttaccccggaacgtacttgggagtcggccat

SEQ ID NO: 382036 - DNA, 140 bp, Artificial Sequence
  Synthetic
atggccgactcccaagtacgttccggggtaaccatggtacctgaggcatagtatttccccaaggctcgcacccattcgggatggtcggaggccaaagcatatagctctgtctccaaagccggagacccagcatggcgtat

SEQ ID NO: 382037 - DNA, 140 bp, Artificial Sequence
  Synthetic
atacgccatgctgggtctccggggttcccgtgggagagaggtactgtaggtcctcaggggtactcaccacaagcgcgagcaattgcttgacctgctacattaaggtgaaagccgcctgcccgtacttgggagtcggccat

SEQ ID NO: 382038 - DNA, 140 bp, Artificial Sequence
  Synthetic
atggccgactcccaagtacgggcaggcggctttcaccttaatgtagcaggtcaagcaattgctcgcgcttgtggtgagtacccctgaggacctacagtacctctctcccacgggaaccccggagacccagcatggcgtat

SEQ ID NO: 382039 - DNA, 140 bp, Artificial Sequence
  Synthetic
atacgccatgctgggtctccagagggtggggctgaaaaacgtctcacttctcatagcgggcgatgactgtctgatcatatgcgagaggcccatgtgcgacccgagcgaggccctgggtagcgtacttgggagtcggccat

SEQ ID NO: 382040 - DNA, 140 bp, Artificial Sequence
  Synthetic
atggccgactcccaagtacgctacccagggcctcgctcgggtcgcacatgggcctctcgcatatgatcagacagtcatcgcccgctatgagaagtgagacgtttttcagccccaccctctggagacccagcatggcgtat

SEQ ID NO: 382041 - DNA, 140 bp, Artificial Sequence
  Synthetic
atacgccatgctgggtctccagccctggcttcgtacgggtacgcgtgtgagccctcgtatcatgcatcattggatacagctcccttttgctccacctggcttgcggaatgcaacgccgatcgtacttgggagtcggccat

SEQ ID NO: 382042 - DNA, 140 bp, Artificial Sequence
  Synthetic
atggccgactcccaagtacgatcggcgttgcattccgcaagccaggtggagcaaaagggagctgtatccaatgatgcatgatacgagggctcacacgcgtacccgtacgaagccagggctggagacccagcatggcgtat

SEQ ID NO: 382043 - DNA, 140 bp, Artificial Sequence
  Synthetic
atacgccatgctgggtctccgggaagcgctgtttcttcctgaccacggactttcggaggccgctcgctcgcatgtcgagcgagtacagtgaccctatggcttcggccattgggtacatcccgtacttgggagtcggccat

SEQ ID NO: 382044 - DNA, 140 bp, Artificial Sequence
  Synthetic
atggccgactcccaagtacgggatgtacccaatggccgaagccatagggtcactgtactcgctcgacatgcgagcgagcggcctccgaaagtccgtggtcaggaagaaacagcgcttcccggagacccagcatggcgtat

SEQ ID NO: 382045 - DNA, 140 bp, Artificial Sequence
  Synthetic
atacgccatgctgggtctcctcctttacccctggcaccccatcacacggtgggtcatcatccctcacgtgctaacttgcgcgtttaggggtggcggcacaccgtctgatccggtttggtgcgtacttgggagtcggccat

SEQ ID NO: 382046 - DNA, 140 bp, Artificial Sequence
  Synthetic
atggccgactcccaagtacgcaccaaaccggatcagacggtgtgccgccacccctaaacgcgcaagttagcacgtgagggatgatgacccaccgtgtgatggggtgccaggggtaaaggaggagacccagcatggcgtat

SEQ ID NO: 382047 - DNA, 140 bp, Artificial Sequence
  Synthetic
atacgccatgctgggtctccccaggttcatggcaattactacaagtttcctctggacaaactgcccaacattatcgtggccctccatggtccagcagcattgagggttaccgcagacactcgtacttgggagtcggccat

SEQ ID NO: 382048 - DNA, 140 bp, Artificial Sequence
  Synthetic
atggccgactcccaagtacgagtgtctgcggtaaccctcaatgctgctggaccatggagggccacgataatgttgggcagtttgtccagaggaaacttgtagtaattgccatgaacctggggagacccagcatggcgtat

SEQ ID NO: 382049 - DNA, 140 bp, Artificial Sequence
  Synthetic
atacgccatgctgggtctccactaaaaccaaattggaggctgggagggtcctgagcgacctcaagctccctggcctagccgtccaccgcaagaaggctggtgcactgcgcacgcgcatgccgtacttgggagtcggccat

SEQ ID NO: 382050 - DNA, 140 bp, Artificial Sequence
  Synthetic
atggccgactcccaagtacggcatgcgcgtgcgcagtgcaccagccttcttgcggtggacggctaggccagggagcttgaggtcgctcaggaccctcccagcctccaatttggttttagtggagacccagcatggcgtat

SEQ ID NO: 382051 - DNA, 140 bp, Artificial Sequence
  Synthetic
atacgccatgctgggtctcctccggtcgcgcggttgggcggagttggctaggggcctgttgtggcatccaggtctccggcttcccccccccgagattgctggaatcccgggtggcttccccgtacttgggagtcggccat

SEQ ID NO: 382052 - DNA, 140 bp, Artificial Sequence
  Synthetic
atggccgactcccaagtacggggaagccacccgggattccagcaatctcgggggggggaagccggagacctggatgccacaacaggcccctagccaactccgcccaaccgcgcgaccggaggagacccagcatggcgtat

SEQ ID NO: 382053 - DNA, 140 bp, Artificial Sequence
  Synthetic
atacgccatgctgggtctcctctgtcccccccctacatgggggtggttcatcaattggatttcacagcccagaggagtcgctggcggtggttggggttcttagccctgctcatcgtggctcgtacttgggagtcggccat

SEQ ID NO: 382054 - DNA, 140 bp, Artificial Sequence
  Synthetic
atggccgactcccaagtacgagccacgatgagcagggctaagaaccccaaccaccgccagcgactcctctgggctgtgaaatccaattgatgaaccacccccatgtaggggggggacagaggagacccagcatggcgtat

SEQ ID NO: 382055 - DNA, 140 bp, Artificial Sequence
  Synthetic
aggccctggctgctgatatgctcttcgggtgaactaaattcatctgttgcggcaaggttgggtgactgatcatcacctgaggaggttcccgccctccccgccccaggggtctccccgctggaccttttgggacagcggtg

SEQ ID NO: 382056 - DNA, 140 bp, Artificial Sequence
  Synthetic
caccgctgtcccaaaaggtccagcggggagacccctggggcggggagggcgggaacctcctcaggtgatgatcagtcacccaaccttgccgcaacagatgaatttagttcacccgaagagcatatcagcagccagggcct

SEQ ID NO: 382057 - DNA, 140 bp, Artificial Sequence
  Synthetic
atacgccatgctgggtctccgttggtaggtcgtaaatcccggtcatcttggtagccactataggtgggtcttaagggtgggtcaaggttcctcttacgcctgtggcgggacagcgcacggcgtacttgggagtcggccat

SEQ ID NO: 382058 - DNA, 140 bp, Artificial Sequence
  Synthetic
atggccgactcccaagtacgccgtgcgctgtcccgccacaggcgtaagaggaaccttgacccacccttaagacccacctatagtggctaccaagatgaccgggatttacgacctaccaacggagacccagcatggcgtat

SEQ ID NO: 382059 - DNA, 140 bp, Artificial Sequence
  Synthetic
atacgccatgctgggtctcctccacaggtgttggccctaccggtgtgaataagggcccgacgtcaggttcgtcgttaaaccgagaccattactcacctgggcgaacgacgcccatgtacgcgtacttgggagtcggccat

SEQ ID NO: 382060 - DNA, 140 bp, Artificial Sequence
  Synthetic
atggccgactcccaagtacgcgtacatgggcgtcgttcgcccaggtgagtaatggtctcggtttaacgacgaacctgacgtcgggcccttattcacaccggtagggccaacacctgtggaggagacccagcatggcgtat

SEQ ID NO: 382061 - DNA, 140 bp, Artificial Sequence
  Synthetic
atacgccatgctgggtctccgtccacgtcgcccttcaatgtctctcttgaccaataggcttagccggcgagttgacaaggaccagtgggggccgggtgtagggggaaggaccccctgcaccgtacttgggagtcggccat

SEQ ID NO: 382062 - DNA, 140 bp, Artificial Sequence
  Synthetic
atggccgactcccaagtacggtgcagggggtccttccccctacacccggcccccactggtccttgtcaactcgccggctaagcctattggtcaagagagacattgaagggcgacgtggacggagacccagcatggcgtat

SEQ ID NO: 382063 - DNA, 140 bp, Artificial Sequence
  Synthetic
atacgccatgctgggtctcctgcccttcccggtggggtgggaaatgcatggggccacccagctccgcggcgacctgcagccggggtagcccaagaacccttcgggtgaggacgggtggcacgtacttgggagtcggccat

SEQ ID NO: 382064 - DNA, 140 bp, Artificial Sequence
  Synthetic
atggccgactcccaagtacgtgccacccgtcctcacccgaagggttcttgggctaccccggctgcaggtcgccgcggagctgggtggccccatgcatttcccaccccaccgggaagggcaggagacccagcatggcgtat

SEQ ID NO: 382065 - DNA, 140 bp, Artificial Sequence
  Synthetic
atacgccatgctgggtctccttttattttctgtaccaatcatggcagtcctcctgcttctcttcgtggttgaggccggggccatcttggccccggccacccatgcttgcggagctaagggcgtacttgggagtcggccat

SEQ ID NO: 382066 - DNA, 140 bp, Artificial Sequence
  Synthetic
atggccgactcccaagtacgcccttagctccgcaagcatgggtggccggggccaagatggccccggcctcaaccacgaagagaagcaggaggactgccatgattggtacagaaaataaaaggagacccagcatggcgtat

SEQ ID NO: 382067 - DNA, 140 bp, Artificial Sequence
  Synthetic
atacgccatgctgggtctccgcaatatttcctcacaaattgctgcgccatggaggatattgggttctgcctggaaggcgggtgcctggtagccctcgggtgcactatttgtactgaccgacgtacttgggagtcggccat

SEQ ID NO: 382068 - DNA, 140 bp, Artificial Sequence
  Synthetic
atggccgactcccaagtacgtcggtcagtacaaatagtgcacccgagggctaccaggcacccgccttccaggcagaacccaatatcctccatggcgcagcaatttgtgaggaaatattgcggagacccagcatggcgtat

SEQ ID NO: 382069 - DNA, 140 bp, Artificial Sequence
  Synthetic
atacgccatgctgggtctcctgctggccactgtatcaggcgggattggctgtgcgtcccggcaagtccgccgctcaactcgtgggggagctggggagcctttacgcgcccttgtctgtctcgtacttgggagtcggccat

SEQ ID NO: 382070 - DNA, 140 bp, Artificial Sequence
  Synthetic
atggccgactcccaagtacgagacagacaagggcgcgtaaaggctccccagctcccccacgagttgagcggcggacttgccgggacgcacagccaatcccgcctgatacagtggccagcaggagacccagcatggcgtat

SEQ ID NO: 382071 - DNA, 140 bp, Artificial Sequence
  Synthetic
atacgccatgctgggtctcccagcctacgtggctgggatactagggctaggggaggtttactctggcgtcctcacggtgggcgttgcgttgacgcgtcgggtctacccggtcccgaacttcgtacttgggagtcggccat

SEQ ID NO: 382072 - DNA, 140 bp, Artificial Sequence
  Synthetic
atggccgactcccaagtacgaagttcgggaccgggtagacccgacgcgtcaacgcaacgcccaccgtgaggacgccagagtaaacctcccctagccctagtatcccagccacgtaggctgggagacccagcatggcgtat

SEQ ID NO: 382073 - DNA, 140 bp, Artificial Sequence
  Synthetic
atacgccatgctgggtctccgacctgcacagttgagtgtgacttgaagtgggagagtgagttttggagatggactgagcagttggcctccaattactggattttggaatatctctggaaacgtacttgggagtcggccat

SEQ ID NO: 382074 - DNA, 140 bp, Artificial Sequence
  Synthetic
atggccgactcccaagtacgtttccagagatattccaaaatccagtaattggaggccaactgctcagtccatctccaaaactcactctcccacttcaagtcacactcaactgtgcaggtcggagacccagcatggcgtat

SEQ ID NO: 382075 - DNA, 140 bp, Artificial Sequence
  Synthetic
atacgccatgctgggtctccgtgccttttgatttctggcgtggagtgatgagcctgacacccctgttggtgtgcgtggcggccctcctcctgctggagcagcgtgtgatcatggtctttccgtacttgggagtcggccat

SEQ ID NO: 382076 - DNA, 140 bp, Artificial Sequence
  Synthetic
atggccgactcccaagtacggaaagaccatgatcacacgctgctccagcaggaggagggccgccacgcacaccaacaggggtgtcaggctcatcactccacgccagaaatcaaaaggcacggagacccagcatggcgtat

SEQ ID NO: 382077 - DNA, 140 bp, Artificial Sequence
  Synthetic
atacgccatgctgggtctcctcctggtgaccatggccgggatgtcgcaaggcgccccggcctcggtgctaggttcccggccctttgaggtgggactgacctgggacacctgctcctgtagcgtacttgggagtcggccat

SEQ ID NO: 382078 - DNA, 140 bp, Artificial Sequence
  Synthetic
atggccgactcccaagtacgctacaggagcaggtgtcccaggtcagtcccacctcaaagggccgggaacctagcaccgaggccggggcgccttgcgacatcccggccatggtcaccaggaggagacccagcatggcgtat

SEQ ID NO: 382079 - DNA, 140 bp, Artificial Sequence
  Synthetic
atacgccatgctgggtctccggcgaacggctcacgtgtgcctactggggaaaaggtttgggatcgtgggaatgtctcactgttgtgtgattgccccaacggcccctgggtttggctcccacgtacttgggagtcggccat

SEQ ID NO: 382080 - DNA, 140 bp, Artificial Sequence
  Synthetic
atggccgactcccaagtacgtgggagccaaacccaggggccgttggggcaatcacacaacagtgagacattcccacgatcccaaaccttttccccagtaggcacacgtgagccgttcgccggagacccagcatggcgtat

SEQ ID NO: 382081 - DNA, 140 bp, Artificial Sequence
  Synthetic
atacgccatgctgggtctccgccttttgcgctgcgattggttggggcgaccctatcactcactggagccacggacaaaatcagtggcccctgtcatgtccccagtatgtctatggtgctgcgtacttgggagtcggccat

SEQ ID NO: 382082 - DNA, 140 bp, Artificial Sequence
  Synthetic
atggccgactcccaagtacgcagcaccatagacatactggggacatgacaggggccactgattttgtccgtggctccagtgagtgatagggtcgccccaaccaatcgcagcgcaaaaggcggagacccagcatggcgtat

SEQ ID NO: 382083 - DNA, 140 bp, Artificial Sequence
  Synthetic
atacgccatgctgggtctcctttcagtgaattgcgtatggggttccgtgtcttggtttgcctccacgggggggcgcgactccaagctcgatgtgtggagtttggtgcctactggctcagccgtacttgggagtcggccat

SEQ ID NO: 382084 - DNA, 140 bp, Artificial Sequence
  Synthetic
atggccgactcccaagtacggctgagccagtaggcaccaaactccacacatcgagcttggagtcgcgcccccccgtggaggcaaaccaagacacggaaccccatacgcaattcactgaaaggagacccagcatggcgtat

SEQ ID NO: 382085 - DNA, 140 bp, Artificial Sequence
  Synthetic
atacgccatgctgggtctcctagttgcaccatagccgcactcgggtcttcggaccgcgacaccgtggtggagctctctgagtggggaattccctgcgcgacctgcatcctggaccgtcggcgtacttgggagtcggccat

SEQ ID NO: 382086 - DNA, 140 bp, Artificial Sequence
  Synthetic
atggccgactcccaagtacgccgacggtccaggatgcaggtcgcgcagggaattccccactcagagagctccaccacggtgtcgcggtccgaagacccgagtgcggctatggtgcaactaggagacccagcatggcgtat

SEQ ID NO: 382087 - DNA, 140 bp, Artificial Sequence
  Synthetic
atacgccatgctgggtctccccagcctcgtgcggcacctgtgtgcgggactgctggcccgagaccgggtcagtgagattcccattccatcggtgcggtgctgggcctaggctgacacgtgcgtacttgggagtcggccat

SEQ ID NO: 382088 - DNA, 140 bp, Artificial Sequence
  Synthetic
atggccgactcccaagtacgcacgtgtcagcctaggcccagcaccgcaccgatggaatgggaatctcactgacccggtctcgggccagcagtcccgcacacaggtgccgcacgaggctggggagacccagcatggcgtat

SEQ ID NO: 382089 - DNA, 140 bp, Artificial Sequence
  Synthetic
atacgccatgctgggtctccatttggaggctgtgcccttcgtcaacaggacaactcccttcaccatacgagggcccctgggcaaccagggccggggcaatccggtgcggtcccctctgggcgtacttgggagtcggccat

SEQ ID NO: 382090 - DNA, 140 bp, Artificial Sequence
  Synthetic
atggccgactcccaagtacgcccagaggggaccgcaccggattgccccggccctggttgcccaggggccctcgtatggtgaagggagttgtcctgttgacgaagggcacagcctccaaatggagacccagcatggcgtat

SEQ ID NO: 382091 - DNA, 140 bp, Artificial Sequence
  Synthetic
atacgccatgctgggtctccttttgggtcctacaccatgaccaaaatccgtgattcgttacatctggtgaagtgtcccactcctgccattgagcctcctaccgggacgttcgggttcttccgtacttgggagtcggccat

SEQ ID NO: 382092 - DNA, 140 bp, Artificial Sequence
  Synthetic
atggccgactcccaagtacggaagaacccgaacgtcccggtaggaggctcaatggcaggagtgggacacttcaccagatgtaacgaatcacggattttggtcatggtgtaggacccaaaaggagacccagcatggcgtat

SEQ ID NO: 382093 - DNA, 140 bp, Artificial Sequence
  Synthetic
atacgccatgctgggtctcccccggagtgcccccgcttaacaactgcatgctcttgggcacagaggtgtccgaggcattgggcggagcgggcctcacgggggggttctacgagcccctggcgtacttgggagtcggccat

SEQ ID NO: 382094 - DNA, 140 bp, Artificial Sequence
  Synthetic
atggccgactcccaagtacgccaggggctcgtagaacccccccgtgaggcccgctccgcccaatgcctcggacacctctgtgcccaagagcatgcagttgttaagcgggggcactccgggggagacccagcatggcgtat

SEQ ID NO: 382095 - DNA, 140 bp, Artificial Sequence
  Synthetic
atacgccatgctgggtctccttcggcggtgttcagagttgatgggtcggcggaatccggtttgtccggggttcgcatggctctcctcgggcaggcctgatgggtttatacacgtgcagggcgtacttgggagtcggccat

SEQ ID NO: 382096 - DNA, 140 bp, Artificial Sequence
  Synthetic
atggccgactcccaagtacgccctgcacgtgtataaacccatcaggcctgcccgaggagagccatgcgaaccccggacaaaccggattccgccgacccatcaactctgaacaccgccgaaggagacccagcatggcgtat

SEQ ID NO: 382097 - DNA, 140 bp, Artificial Sequence
  Synthetic
atacgccatgctgggtctccgcacctgcaggaggtggatgcgggcaacttcatcccgcccccgcgctggctgctcctggactttgtatttgtcctgttatacctgatgaagctggcggagcgtacttgggagtcggccat

SEQ ID NO: 382098 - DNA, 140 bp, Artificial Sequence
  Synthetic
atggccgactcccaagtacgctccgccagcttcatcaggtataacaggacaaatacaaagtccaggagcagccagcgcgggggcgggatgaagttgcccgcatccacctcctgcaggtgcggagacccagcatggcgtat

SEQ ID NO: 382099 - DNA, 140 bp, Artificial Sequence
  Synthetic
atacgccatgctgggtctccgcacggctggtccctcttatacttctcctgctgtggtggtgggttaaccagttggccgtcttgggcgtgccatcggttcaagccgccgtggctggggaggcgtacttgggagtcggccat

SEQ ID NO: 382100 - DNA, 140 bp, Artificial Sequence
  Synthetic
atggccgactcccaagtacgcctccccagccacggcggcttgaaccgatggcacgcccaagacggccaactggttaacccaccaccacagcaggagaagtataagagggaccagccgtgcggagacccagcatggcgtat

SEQ ID NO: 382101 - DNA, 140 bp, Artificial Sequence
  Synthetic
atacgccatgctgggtctcctgtttgcggggccggccttgtcatggtgcctgggccttcccttcgtgagtatgatcttggggttggcaaacctcgtgctctactttcgatggatgggtcccgtacttgggagtcggccat

SEQ ID NO: 382102 - DNA, 140 bp, Artificial Sequence
  Synthetic
atggccgactcccaagtacgggacccatccatcgaaagtagagcacgaggtttgccaaccccaagatcatactcacgaagggaaggcccaggcaccatgacaaggccggccccgcaaacaggagacccagcatggcgtat

SEQ ID NO: 382103 - DNA, 140 bp, Artificial Sequence
  Synthetic
atacgccatgctgggtctccacagcgcctaatgttccttgtgttgtggaagctcgctcggggagcattcccgctggccttactgatggggatttctgccacccgcggccgcacctcagtgcgtacttgggagtcggccat

SEQ ID NO: 382104 - DNA, 140 bp, Artificial Sequence
  Synthetic
atggccgactcccaagtacgcactgaggtgcggccgcgggtggcagaaatccccatcagtaaggccagcgggaatgctccccgagcgagcttccacaacacaaggaacattaggcgctgtggagacccagcatggcgtat

SEQ ID NO: 382105 - DNA, 140 bp, Artificial Sequence
  Synthetic
atacgccatgctgggtctccctcggagccgaattctgctttgatgtcacctttgaagtggacacgtcagttctgggatgggtggtggccagtgtcatcgcatgggcgatagccctcctcacgtacttgggagtcggccat

SEQ ID NO: 382106 - DNA, 140 bp, Artificial Sequence
  Synthetic
atggccgactcccaagtacgtgaggagggctatcgcccatgcgatgacactggccaccacccatcccagaactgacgtgtccacttcaaaggtgacatcaaagcagaattcggctccgagggagacccagcatggcgtat

SEQ ID NO: 382107 - DNA, 140 bp, Artificial Sequence
  Synthetic
atacgccatgctgggtctccgttccatgagcgcggggggctggaggcacaaagctgtgatttacagaacgtggtgtaaggggtaccaggcgctgcgtcaacgggtggtgcggagccccctcgtacttgggagtcggccat

SEQ ID NO: 382108 - DNA, 140 bp, Artificial Sequence
  Synthetic
atggccgactcccaagtacgagggggctccgcaccacccgttgacgcagcgcctggtaccccttacaccacgttctgtaaatcacagctttgtgcctccagccccccgcgctcatggaacggagacccagcatggcgtat

SEQ ID NO: 382109 - DNA, 140 bp, Artificial Sequence
  Synthetic
atacgccatgctgggtctcccggggaggggcgtcccaccaagcctctgacaatcgcttggtgcttggcctcgtacatctggcctgatgctgtgatgttggtggtggtggggctggtgctccgtacttgggagtcggccat

SEQ ID NO: 382110 - DNA, 140 bp, Artificial Sequence
  Synthetic
atggccgactcccaagtacggagcaccagccccaccaccaccaacatcacagcatcaggccagatgtacgaggccaagcaccaagcgattgtcagaggcttggtgggacgcccctccccgggagacccagcatggcgtat

SEQ ID NO: 382111 - DNA, 140 bp, Artificial Sequence
  Synthetic
atacgccatgctgggtctccctctttggcctgttcgatgcgttggactgggctttggaggagttgctggtctcacggccttcgttgcggcgtttggctcgggtggttgagtgttgtgtgacgtacttgggagtcggccat

SEQ ID NO: 382112 - DNA, 140 bp, Artificial Sequence
  Synthetic
atggccgactcccaagtacgtcacacaacactcaaccacccgagccaaacgccgcaacgaaggccgtgagaccagcaactcctccaaagcccagtccaacgcatcgaacaggccaaagagggagacccagcatggcgtat

SEQ ID NO: 382113 - DNA, 140 bp, Artificial Sequence
  Synthetic
atacgccatgctgggtctcctggcgggtgagagggctactactattcgccttgtgtccaagatgtgtgcgaggggggcttatttgttcgaccatatgggctctttttcgcgcgccgtcaacgtacttgggagtcggccat

SEQ ID NO: 382114 - DNA, 140 bp, Artificial Sequence
  Synthetic
atggccgactcccaagtacgttgacggcgcgcgaaaaagagcccatatggtcgaacaaataagcccccctcgcacacatcttggacacaaggcgaatagtagtagccctctcacccgccaggagacccagcatggcgtat

SEQ ID NO: 382115 - DNA, 140 bp, Artificial Sequence
  Synthetic
atacgccatgctgggtctccggaacgcttggttgagtgggacgcggctctcgaacctctgtcattcactaggacggactgtcgcatcattagagatgctgccaggaccttgagctgcgggcgtacttgggagtcggccat

SEQ ID NO: 382116 - DNA, 140 bp, Artificial Sequence
  Synthetic
atggccgactcccaagtacgcccgcagctcaaggtcctggcagcatctctaatgatgcgacagtccgtcctagtgaatgacagaggttcgagagccgcgtcccactcaaccaagcgttccggagacccagcatggcgtat

SEQ ID NO: 382117 - DNA, 140 bp, Artificial Sequence
  Synthetic
atacgccatgctgggtctcccagtgcgtcatggggttacccgtggtggcgcgccgcggcgacgaggttttgatcggcgtctttcaagatgtgaaccacttgcctcccgggtttgtcccgacgtacttgggagtcggccat

SEQ ID NO: 382118 - DNA, 140 bp, Artificial Sequence
  Synthetic
atggccgactcccaagtacgtcgggacaaacccgggaggcaagtggttcacatcttgaaagacgccgatcaaaacctcgtcgccgcggcgcgccaccacgggtaaccccatgacgcactgggagacccagcatggcgtat

SEQ ID NO: 382119 - DNA, 140 bp, Artificial Sequence
  Synthetic
atacgccatgctgggtctccccgcgcccgttgttatccggcggtgcggaaagggcttcctcggagtcacaaaggctgccttgacaggtcgggatcctgacttacatccaggaaacgtcatcgtacttgggagtcggccat

SEQ ID NO: 382120 - DNA, 140 bp, Artificial Sequence
  Synthetic
atggccgactcccaagtacgatgacgtttcctggatgtaagtcaggatcccgacctgtcaaggcagcctttgtgactccgaggaagccctttccgcaccgccggataacaacgggcgcggggagacccagcatggcgtat

SEQ ID NO: 382121 - DNA, 140 bp, Artificial Sequence
  Synthetic
atacgccatgctgggtctccggtgcttggtacagctacatcccgcagcatggggacatgtcttaacgggctgttgtttaccacgttccatggggcctcttcccgaaccatagctacacctcgtacttgggagtcggccat

SEQ ID NO: 382122 - DNA, 140 bp, Artificial Sequence
  Synthetic
atggccgactcccaagtacgaggtgtagctatggttcgggaagaggccccatggaacgtggtaaacaacagcccgttaagacatgtccccatgctgcgggatgtagctgtaccaagcaccggagacccagcatggcgtat

SEQ ID NO: 382123 - DNA, 140 bp, Artificial Sequence
  Synthetic
atacgccatgctgggtctccgtgggagccctaaatccaaggtggtggtcggccagtgacgatgtgacggtgtaccccctgcctgatggagccacctcgctgacgccttgtacatgccaggcgtacttgggagtcggccat

SEQ ID NO: 382124 - DNA, 140 bp, Artificial Sequence
  Synthetic
atggccgactcccaagtacgcctggcatgtacaaggcgtcagcgaggtggctccatcaggcagggggtacaccgtcacatcgtcactggccgaccaccaccttggatttagggctcccacggagacccagcatggcgtat

SEQ ID NO: 382125 - DNA, 140 bp, Artificial Sequence
  Synthetic
atacgccatgctgggtctccccgagtcctgttgggtcatcagatccgatggggcgctttgccatggcttgtcgaagggggacaaggtagagctggacgtggccatggaggtctctgatttcgtacttgggagtcggccat

SEQ ID NO: 382126 - DNA, 140 bp, Artificial Sequence
  Synthetic
atggccgactcccaagtacgaaatcagagacctccatggccacgtccagctctaccttgtcccccttcgacaagccatggcaaagcgccccatcggatctgatgacccaacaggactcggggagacccagcatggcgtat

SEQ ID NO: 382127 - DNA, 140 bp, Artificial Sequence
  Synthetic
atacgccatgctgggtctccccgtgggtcgtctggatcgccagtcctgtgcgacgagggacacgcagtaggaatgctcgtgtcggtgcttcactcgggcggcagagtcaccgctgctcgccgtacttgggagtcggccat

SEQ ID NO: 382128 - DNA, 140 bp, Artificial Sequence
  Synthetic
atggccgactcccaagtacggcgagcagcggtgactctgccgcccgagtgaagcaccgacacgagcattcctactgcgtgtccctcgtcgcacaggactggcgatccagacgacccacggggagacccagcatggcgtat

SEQ ID NO: 382129 - DNA, 140 bp, Artificial Sequence
  Synthetic
atacgccatgctgggtctcctttacgcggccgtggacccaggtaccaactgatgccaagaccactaccgagcccccgccagtaccggcgaaaggtgtctttaaggaggccccgttgtttacgtacttgggagtcggccat

SEQ ID NO: 382130 - DNA, 140 bp, Artificial Sequence
  Synthetic
atggccgactcccaagtacgtaaacaacggggcctccttaaagacacctttcgccggtactggcgggggctcggtagtggtcttggcatcagttggtacctgggtccacggccgcgtaaaggagacccagcatggcgtat

SEQ ID NO: 382131 - DNA, 140 bp, Artificial Sequence
  Synthetic
atacgccatgctgggtctcctgcctacgggggccgggaagagcacccgggtcccgctggagtacggcaacatgggccacaaggttctgattctcaacccgtcggtcgccactgtgagggccgtacttgggagtcggccat

SEQ ID NO: 382132 - DNA, 140 bp, Artificial Sequence
  Synthetic
atggccgactcccaagtacggccctcacagtggcgaccgacgggttgagaatcagaaccttgtggcccatgttgccgtactccagcgggacccgggtgctcttcccggcccccgtaggcaggagacccagcatggcgtat

SEQ ID NO: 382133 - DNA, 140 bp, Artificial Sequence
  Synthetic
atacgccatgctgggtctcccatgggcccttatatggagaaactggcgggcaagcatcccagcatttactgtgggcacgatacaacagctttcactcgaatcactgattctccgctgacgcgtacttgggagtcggccat

SEQ ID NO: 382134 - DNA, 140 bp, Artificial Sequence
  Synthetic
atggccgactcccaagtacgcgtcagcggagaatcagtgattcgagtgaaagctgttgtatcgtgcccacagtaaatgctgggatgcttgcccgccagtttctccatataagggcccatgggagacccagcatggcgtat

SEQ ID NO: 382135 - DNA, 140 bp, Artificial Sequence
  Synthetic
atacgccatgctgggtctcctactctacctatgggcgctttctggccaaccctaggcagatgctacgcggcgtttcggtggtcatttgtgatgagtgccacagtcatgactcaacggtttcgtacttgggagtcggccat

SEQ ID NO: 382136 - DNA, 140 bp, Artificial Sequence
  Synthetic
atggccgactcccaagtacgaaaccgttgagtcatgactgtggcactcatcacaaatgaccaccgaaacgccgcgtagcatctgcctagggttggccagaaagcgcccataggtagagtaggagacccagcatggcgtat

SEQ ID NO: 382137 - DNA, 140 bp, Artificial Sequence
  Synthetic
atacgccatgctgggtctcctgctgggcattgggcgggtccgggagctggcgcgtgggtgtggggtgcaactcgtgctctacgctaccgccacgcctcccgggtccccgatgacccagcacgtacttgggagtcggccat

SEQ ID NO: 382138 - DNA, 140 bp, Artificial Sequence
  Synthetic
atggccgactcccaagtacgtgctgggtcatcggggacccgggaggcgtggcggtagcgtagagcacgagttgcaccccacacccacgcgccagctcccggacccgcccaatgcccagcaggagacccagcatggcgtat

SEQ ID NO: 382139 - DNA, 140 bp, Artificial Sequence
  Synthetic
atacgccatgctgggtctcctccatcaatcattgagaccaaactggatgtgggtgagatccccttctatgggcatggtatcccccttgagcgaatgcggactggcaggcatctcgtattccgtacttgggagtcggccat

SEQ ID NO: 382140 - DNA, 140 bp, Artificial Sequence
  Synthetic
atggccgactcccaagtacggaatacgagatgcctgccagtccgcattcgctcaagggggataccatgcccatagaaggggatctcacccacatccagtttggtctcaatgattgatggaggagacccagcatggcgtat

SEQ ID NO: 382141 - DNA, 140 bp, Artificial Sequence
  Synthetic
atacgccatgctgggtctcctgccactcaaaggctgagtgcgaacgcctggcgggccagttttccgcccgaggggttaatgccattgcttattatcgggggaaggacagttccatcattacgtacttgggagtcggccat

SEQ ID NO: 382142 - DNA, 140 bp, Artificial Sequence
  Synthetic
atggccgactcccaagtacgtaatgatggaactgtccttcccccgataataagcaatggcattaacccctcgggcggaaaactggcccgccaggcgttcgcactcagcctttgagtggcaggagacccagcatggcgtat

SEQ ID NO: 382143 - DNA, 140 bp, Artificial Sequence
  Synthetic
atacgccatgctgggtctccaagacggagacttagtggtgtgcgctacagacgcgctatccactgggtacaccggaaactttgactccgtgactgactgtgggttggtggtggaggaggtcgtacttgggagtcggccat

SEQ ID NO: 382144 - DNA, 140 bp, Artificial Sequence
  Synthetic
atggccgactcccaagtacgacctcctccaccaccaacccacagtcagtcacggagtcaaagtttccggtgtacccagtggatagcgcgtctgtagcgcacaccactaagtctccgtcttggagacccagcatggcgtat

SEQ ID NO: 382145 - DNA, 140 bp, Artificial Sequence
  Synthetic
atacgccatgctgggtctcctgtcgaggtaacccttgatcccaccattaccatctccttgaggacagtgcccgcttcggcagaactgtcgatgcagcggcgaggtcgcacagggagaggacgtacttgggagtcggccat

SEQ ID NO: 382146 - DNA, 140 bp, Artificial Sequence
  Synthetic
atggccgactcccaagtacgtcctctccctgtgcgacctcgccgctgcatcgacagttctgccgaagcgggcactgtcctcaaggagatggtaatggtgggatcaagggttacctcgacaggagacccagcatggcgtat

SEQ ID NO: 382147 - DNA, 140 bp, Artificial Sequence
  Synthetic
atacgccatgctgggtctcccggtctgggcggtactactacgcgggggtgggcaaagcccccgccgggagtgtgcggtccgggcctgtctggtcagcagtggaggccggagtgacctggtcgtacttgggagtcggccat

SEQ ID NO: 382148 - DNA, 140 bp, Artificial Sequence
  Synthetic
atggccgactcccaagtacgaccaggtcactccggcctccactgctgaccagacaggcccggaccgcacactcccggcgggggctttgcccacccccgcgtagtagtaccgcccagaccgggagacccagcatggcgtat

SEQ ID NO: 382149 - DNA, 140 bp, Artificial Sequence
  Synthetic
atacgccatgctgggtctccacggaatggagcctgatttgacagcaaacctactgagactttacgacgactgcccttacaccgcagccgtcgcagcagatattggggaagccgcggtgttcgtacttgggagtcggccat

SEQ ID NO: 382150 - DNA, 140 bp, Artificial Sequence
  Synthetic
atggccgactcccaagtacgaacaccgcggcttccccaatatctgctgcgacggctgcggtgtaagggcagtcgtcgtaaagtctcagtaggtttgctgtcaaatcaggctccattccgtggagacccagcatggcgtat

SEQ ID NO: 382151 - DNA, 140 bp, Artificial Sequence
  Synthetic
atacgccatgctgggtctcccttctcgggcctcgcgcccttgaggatgcatcctgatgtcagctgggcaaaagttcgcggcgtgaactggcccctacttgtgggtgttcagcggacgatgcgtacttgggagtcggccat

SEQ ID NO: 382152 - DNA, 140 bp, Artificial Sequence
  Synthetic
atggccgactcccaagtacgcatcgtccgctgaacacccacaagtaggggccagttcacgccgcgaacttttgcccagctgacatcaggatgcatcctcaagggcgcgaggcccgagaagggagacccagcatggcgtat

SEQ ID NO: 382153 - DNA, 140 bp, Artificial Sequence
  Synthetic
atacgccatgctgggtctcctgcagggagacactgtcgcccgggccgtcggatgacccgcagtgggcaggccttaaaggcccaaatcctgttccactcctgctgaggtggggcaatgattcgtacttgggagtcggccat

SEQ ID NO: 382154 - DNA, 140 bp, Artificial Sequence
  Synthetic
atggccgactcccaagtacgaatcattgccccacctcagcaggagtggaacaggatttgggcctttaaggcctgcccactgcgggtcatccgacggcccgggcgacagtgtctccctgcaggagacccagcatggcgtat

SEQ ID NO: 382155 - DNA, 140 bp, Artificial Sequence
  Synthetic
atacgccatgctgggtctcctaccaacaaaggtggccggccaccacattgtggacgacctggtccggaggctcggtgtggcggagggttatgtacgctgcgatgcgggccccatcttgatcgtacttgggagtcggccat

SEQ ID NO: 382156 - DNA, 140 bp, Artificial Sequence
  Synthetic
atggccgactcccaagtacgatcaagatggggcccgcatcgcagcgtacataaccctccgccacaccgagcctccggaccaggtcgtccacaatgtggtggccggccacctttgttggtaggagacccagcatggcgtat

SEQ ID NO: 382157 - DNA, 140 bp, Artificial Sequence
  Synthetic
atacgccatgctgggtctccggtggggctcgctattgcgggcgggatgatctatgcgtcctacaccgggtccctagtggtggttacagattgggatgtgaaggggggtggcaacccccttcgtacttgggagtcggccat

SEQ ID NO: 382158 - DNA, 140 bp, Artificial Sequence
  Synthetic
atggccgactcccaagtacgaagggggttgccaccccccttcacatcccaatctgtaaccaccactagggacccggtgtaggacgcatagatcatcccgcccgcaatagcgagccccaccggagacccagcatggcgtat

SEQ ID NO: 382159 - DNA, 140 bp, Artificial Sequence
  Synthetic
atacgccatgctgggtctcctataggaatggagaccaggccactcctcaacctgtggtgcaggtccccccggtagaccaccggccggggggggaatctgcgcctttagatgccaggacagcgtacttgggagtcggccat

SEQ ID NO: 382160 - DNA, 140 bp, Artificial Sequence
  Synthetic
atggccgactcccaagtacgctgtcctggcatctaaaggcgcagattccccccccggccggtggtctaccggggggacctgcaccacaggttgaggagtggcctggtctccattcctataggagacccagcatggcgtat

SEQ ID NO: 382161 - DNA, 140 bp, Artificial Sequence
  Synthetic
atacgccatgctgggtctcctgacagatgcggtggcggccatccaggtgaactgcgattggtcaatcatgaccctgtcgatcggggacgtgctgacctttgggcaggctaaggcagccgacgtacttgggagtcggccat

SEQ ID NO: 382162 - DNA, 140 bp, Artificial Sequence
  Synthetic
atggccgactcccaagtacgtcggctgccttagcctgcccaaaggtcagcacgtccccgatcgacagggtcatgattgaccaatcgcagttcacctggatggccgccaccgcatctgtcaggagacccagcatggcgtat

SEQ ID NO: 382163 - DNA, 140 bp, Artificial Sequence
  Synthetic
atacgccatgctgggtctccggcctacgcagctaccaccaagtggcttgctggctgctacacggggacgcgggccgttcctactgtttcaattgtggacaagctcttcgcagggggttggcgtacttgggagtcggccat

SEQ ID NO: 382164 - DNA, 140 bp, Artificial Sequence
  Synthetic
atggccgactcccaagtacgccaaccccctgcgaagagcttgtccacaattgaaacagtaggaacggcccgcgtccccgtgtagcagccagcaagccacttggtggtagctgcgtaggccggagacccagcatggcgtat

SEQ ID NO: 382165 - DNA, 140 bp, Artificial Sequence
  Synthetic
atacgccatgctgggtctccgcggcggtcgtcggtcattgtcacagcgttatagctgcggcagtggcagcctacggggcttcacgaagccctccattggcggcggccgcctcctacctcacgtacttgggagtcggccat

SEQ ID NO: 382166 - DNA, 140 bp, Artificial Sequence
  Synthetic
atggccgactcccaagtacgtgaggtaggaggcggccgccgccaatggagggcttcgtgaagccccgtaggctgccactgccgcagctataacgctgtgacaatgaccgacgaccgccgcggagacccagcatggcgtat

SEQ ID NO: 382167 - DNA, 140 bp, Artificial Sequence
  Synthetic
atacgccatgctgggtctcctgggactgggcgtcggaggcaatacgcaggtgcgcttggcttccgctctcctgttgggggccgctggtaccgccctggggacgcctgtcgtggggttaaccgtacttgggagtcggccat

SEQ ID NO: 382168 - DNA, 140 bp, Artificial Sequence
  Synthetic
atggccgactcccaagtacggttaaccccacgacaggcgtccccagggcggtaccagcggcccccaacaggagagcggaagccaagcgcacctgcgtattgcctccgacgcccagtcccaggagacccagcatggcgtat

SEQ ID NO: 382169 - DNA, 140 bp, Artificial Sequence
  Synthetic
atacgccatgctgggtctcccatggcgggcgccttcatgggcggcgctagcgtgtccccctctctagtcacgatcctcttgggggccgtgggtggttgggagggcgtggtcaatgcggcccgtacttgggagtcggccat

SEQ ID NO: 382170 - DNA, 140 bp, Artificial Sequence
  Synthetic
atggccgactcccaagtacgggccgcattgaccacgccctcccaaccacccacggcccccaagaggatcgtgactagagagggggacacgctagcgccgcccatgaaggcgcccgccatgggagacccagcatggcgtat

SEQ ID NO: 382171 - DNA, 140 bp, Artificial Sequence
  Synthetic
atacgccatgctgggtctccagccttgtcttcgatttcatgtcagggaagttatcaactgaagacctgtggtatgccatcccggtactgactagtccgggggcgggccttgcggggatcgcgtacttgggagtcggccat

SEQ ID NO: 382172 - DNA, 140 bp, Artificial Sequence
  Synthetic
atggccgactcccaagtacgcgatccccgcaaggcccgcccccggactagtcagtaccgggatggcataccacaggtcttcagttgataacttccctgacatgaaatcgaagacaaggctggagacccagcatggcgtat

SEQ ID NO: 382173 - DNA, 140 bp, Artificial Sequence
  Synthetic
atacgccatgctgggtctccccttgggacttgttctgtactcagccaacaactctgggactaccacttggttgaaccgtctgttgaccacactgccccggtcttcttgtattccggacagcgtacttgggagtcggccat

SEQ ID NO: 382174 - DNA, 140 bp, Artificial Sequence
  Synthetic
atggccgactcccaagtacgctgtccggaatacaagaagaccggggcagtgtggtcaacagacggttcaaccaagtggtagtcccagagttgttggctgagtacagaacaagtcccaaggggagacccagcatggcgtat

SEQ ID NO: 382175 - DNA, 140 bp, Artificial Sequence
  Synthetic
atacgccatgctgggtctccctatttccaacaggccgactactgtgacagggtctcagccatgctcaggcgcctgagcctcactcgtaccgtggttgctctcgtcaacagggagcccaagcgtacttgggagtcggccat

SEQ ID NO: 382176 - DNA, 140 bp, Artificial Sequence
  Synthetic
atggccgactcccaagtacgcttgggctccctgttgacgagagcaaccacggtacgagtgaggctcaggcgcctgagcatggctgagaccctgtcacagtagtcggcctgttggaaatagggagacccagcatggcgtat

SEQ ID NO: 382177 - DNA, 140 bp, Artificial Sequence
  Synthetic
atacgccatgctgggtctccgtagatgaggtccaggttgggtatgtgtgggacctgtatgagtggatcatgcgtcaaattcgcgtggtcacagctaggctccgggccctctgccccgtagcgtacttgggagtcggccat

SEQ ID NO: 382178 - DNA, 140 bp, Artificial Sequence
  Synthetic
atggccgactcccaagtacgctacggggcagagggcccggagcctagctgtgaccacgcgaatttgacgcatgatccactcatacaggtcccacacatacccaacctggacctcatctacggagacccagcatggcgtat

SEQ ID NO: 382179 - DNA, 140 bp, Artificial Sequence
  Synthetic
atacgccatgctgggtctcctgtcactacccttgtggcattgcggggaggggtggtccggagaatggttgcttgacggtcatgtggagagtcgctgtctgtgcgggtgcgtgatcactggcgtacttgggagtcggccat

SEQ ID NO: 382180 - DNA, 140 bp, Artificial Sequence
  Synthetic
atggccgactcccaagtacgccagtgatcacgcacccgcacagacagcgactctccacatgaccgtcaagcaaccattctccggaccacccctccccgcaatgccacaagggtagtgacaggagacccagcatggcgtat

SEQ ID NO: 382181 - DNA, 140 bp, Artificial Sequence
  Synthetic
atacgccatgctgggtctccggacgtgctgaatgggcaactcaaagaaccagtttactctaccaagctgtgcaggcattactggatggggactgtgccggtgaacatgcttggttacgggcgtacttgggagtcggccat

SEQ ID NO: 382182 - DNA, 140 bp, Artificial Sequence
  Synthetic
atggccgactcccaagtacgcccgtaaccaagcatgttcaccggcacagtccccatccagtaatgcctgcacagcttggtagagtaaactggttctttgagttgcccattcagcacgtccggagacccagcatggcgtat

SEQ ID NO: 382183 - DNA, 140 bp, Artificial Sequence
  Synthetic
atacgccatgctgggtctccgagacgtcgcctctgctggcctcggacaccctaaaggtggttccctttgggacgtccgggtgggcggaggtggtggtgacccctacccatgttgtgatcccgtacttgggagtcggccat

SEQ ID NO: 382184 - DNA, 140 bp, Artificial Sequence
  Synthetic
atggccgactcccaagtacgggatcacaacatgggtaggggtcaccaccacctccgcccacccggacgtcccaaagggaaccacctttagggtgtccgaggccagcagaggcgacgtctcggagacccagcatggcgtat

SEQ ID NO: 382185 - DNA, 140 bp, Artificial Sequence
  Synthetic
atacgccatgctgggtctccggcgcacttcctgttacaagttgctgcgccagcaaatactttcagctgctgttgctgagccctactacgtcgacggcatcccggtctcatgggaggcggacgtacttgggagtcggccat

SEQ ID NO: 382186 - DNA, 140 bp, Artificial Sequence
  Synthetic
atggccgactcccaagtacgtccgcctcccatgagaccgggatgccgtcgacgtagtagggctcagcaacagcagctgaaagtatttgctggcgcagcaacttgtaacaggaagtgcgccggagacccagcatggcgtat

SEQ ID NO: 382187 - DNA, 140 bp, Artificial Sequence
  Synthetic
atacgccatgctgggtctcccgcccgtgcgcccgctatggtctatgggcctggccaaagcgtcaccattgacggggaacgctacaccctcccgcatcagctgcggttgaggaacgtggcgcgtacttgggagtcggccat

SEQ ID NO: 382188 - DNA, 140 bp, Artificial Sequence
  Synthetic
atggccgactcccaagtacgcgccacgttcctcaaccgcagctgatgcgggagggtgtagcgttccccgtcaatggtgacgctttggccaggcccatagaccatagcgggcgcacgggcgggagacccagcatggcgtat

SEQ ID NO: 382189 - DNA, 140 bp, Artificial Sequence
  Synthetic
atacgccatgctgggtctccccctctgaggtttcgtctgaggtcagtatcgagatcgggacggagtcggaagacaccgagctgacagaggccgatttgccgccggcagctgcagccctcccgtacttgggagtcggccat

SEQ ID NO: 382190 - DNA, 140 bp, Artificial Sequence
  Synthetic
atggccgactcccaagtacgggagggctgcagctgccggcggcaaatcggcctctgtcagctcggtgtcttccgactccgtcccgatctcgatactgacctcagacgaaacctcagagggggagacccagcatggcgtat

SEQ ID NO: 382191 - DNA, 140 bp, Artificial Sequence
  Synthetic
aggccctggctgctgatatgagacaccgagctgacagaggccgatttgccgccggcagctgcagccctccaagcgatcgagaatgctgcgagaattcttgagccgcacattgatgtcatcgaccttttgggacagcggtg

SEQ ID NO: 382192 - DNA, 140 bp, Artificial Sequence
  Synthetic
caccgctgtcccaaaaggtcgatgacatcaatgtgcggctcaagaattctcgcagcattctcgatcgcttggagggctgcagctgccggcggcaaatcggcctctgtcagctcggtgtctcatatcagcagccagggcct

SEQ ID NO: 382193 - DNA, 140 bp, Artificial Sequence
  Synthetic
atacgccatgctgggtctccatggaggactgcagtacaccctctctctgtggtagtagccgagagatgccagtgtggggagaagacataccccgcactccatcgcctgcacttatctcggcgtacttgggagtcggccat

SEQ ID NO: 382194 - DNA, 140 bp, Artificial Sequence
  Synthetic
atggccgactcccaagtacgccgagataagtgcaggcgatggagtgcggggtatgtcttctccccacactggcatctctcggctactaccacagagagagggtgtactgcagtcctccatggagacccagcatggcgtat

SEQ ID NO: 382195 - DNA, 140 bp, Artificial Sequence
  Synthetic
atacgccatgctgggtctccccttatttccacagagcgacgccacccggaagcttaccgttaagatgtcatgctgcgtggagaaaagcgtaacgcgcttcttctccttggggttgacggtcgtacttgggagtcggccat

SEQ ID NO: 382196 - DNA, 140 bp, Artificial Sequence
  Synthetic
atggccgactcccaagtacgaccgtcaaccccaaggagaagaagcgcgttacgcttttctccacgcagcatgacatcttaacggtaagcttccgggtggcgtcgctctgtggaaataaggggagacccagcatggcgtat

SEQ ID NO: 382197 - DNA, 140 bp, Artificial Sequence
  Synthetic
atacgccatgctgggtctccggctgacgtggctagcctgtgtgagatggaaatccagaaccatacagcctattgtgacaaggtgcgcactccgctcgaattgcaagttgggtgcttggtgcgtacttgggagtcggccat

SEQ ID NO: 382198 - DNA, 140 bp, Artificial Sequence
  Synthetic
atggccgactcccaagtacgcaccaagcacccaacttgcaattcgagcggagtgcgcaccttgtcacaataggctgtatggttctggatttccatctcacacaggctagccacgtcagccggagacccagcatggcgtat

SEQ ID NO: 382199 - DNA, 140 bp, Artificial Sequence
  Synthetic
aggccctggctgctgatatgattgtgacaaggtgcgcactccgctcgaattgcaagttgggtgcttggtgggcaatgaacttacctttgaatgtgataagtgtgaggcacggcaagagacgaccttttgggacagcggtg

SEQ ID NO: 382200 - DNA, 140 bp, Artificial Sequence
  Synthetic
caccgctgtcccaaaaggtcgtctcttgccgtgcctcacacttatcacattcaaaggtaagttcattgcccaccaagcacccaacttgcaattcgagcggagtgcgcaccttgtcacaatcatatcagcagccagggcct

SEQ ID NO: 382201 - DNA, 140 bp, Artificial Sequence
  Synthetic
atacgccatgctgggtctcccttggcatccttctcctacatctggtctggggtgccgctaactcgggccacaccggccaaaccccctgtggtgaggccggtggggtccttgttggtggcccgtacttgggagtcggccat

SEQ ID NO: 382202 - DNA, 140 bp, Artificial Sequence
  Synthetic
atggccgactcccaagtacgggccaccaacaaggaccccaccggcctcaccacagggggtttggccggtgtggcccgagttagcggcaccccagaccagatgtaggagaaggatgccaagggagacccagcatggcgtat

SEQ ID NO: 382203 - DNA, 140 bp, Artificial Sequence
  Synthetic
atacgccatgctgggtctccgacactaccaaagtgtacgtgaccaatccggataacgtgggaaggagggttgacaaggtgaccttctggcgtgctcctagggtccatgacaagttcctcgcgtacttgggagtcggccat

SEQ ID NO: 382204 - DNA, 140 bp, Artificial Sequence
  Synthetic
atggccgactcccaagtacgcgaggaacttgtcatggaccctaggagcacgccagaaggtcaccttgtcaaccctccttcccacgttatccggattggtcacgtacactttggtagtgtcggagacccagcatggcgtat

SEQ ID NO: 382205 - DNA, 140 bp, Artificial Sequence
  Synthetic
aggccctggctgctgatatgtgacaaggtgaccttctggcgtgctcctagggtccatgacaagttcctcgtggactctattgagcgtgcaaggagggcggctcaagcctgccaaagcatggaccttttgggacagcggtg

SEQ ID NO: 382206 - DNA, 140 bp, Artificial Sequence
  Synthetic
caccgctgtcccaaaaggtccatgctttggcaggcttgagccgccctccttgcacgctcaatagagtccacgaggaacttgtcatggaccctaggagcacgccagaaggtcaccttgtcacatatcagcagccagggcct

SEQ ID NO: 382207 - DNA, 140 bp, Artificial Sequence
  Synthetic
atacgccatgctgggtctccggttacacttatgaggaggcaataaggactgttaggccacatgctgccatgggctggggatctaaggtgtcggtcaaggacttagccacccctgcggggacgtacttgggagtcggccat

SEQ ID NO: 382208 - DNA, 140 bp, Artificial Sequence
  Synthetic
atggccgactcccaagtacgtccccgcaggggtggctaagtccttgaccgacaccttagatccccagcccatggcagcatgtggcctaacagtccttattgcctcctcataagtgtaaccggagacccagcatggcgtat

SEQ ID NO: 382209 - DNA, 140 bp, Artificial Sequence
  Synthetic
atacgccatgctgggtctccagatggctgtccacgaccgtctccaggaaatacttgaagggactccggtcccctttacattgactgtgaaaaaggaggtgttcttcaaagaccgaaaggacgtacttgggagtcggccat

SEQ ID NO: 382210 - DNA, 140 bp, Artificial Sequence
  Synthetic
atggccgactcccaagtacgtcctttcggtctttgaagaacacctcctttttcacagtcaatgtaaaggggaccggagtcccttcaagtatttcctggagacggtcgtggacagccatctggagacccagcatggcgtat

SEQ ID NO: 382211 - DNA, 140 bp, Artificial Sequence
  Synthetic
atacgccatgctgggtctccggaaaaggccccccgcctcattgtgttcccgcccctggacttccggatagctgaaaagctcatcctgggagatccgggacgcgtggccaaggcggtgttgcgtacttgggagtcggccat

SEQ ID NO: 382212 - DNA, 140 bp, Artificial Sequence
  Synthetic
atggccgactcccaagtacgcaacaccgccttggccacgcgtcccggatctcccaggatgagcttttcagctatccggaagtccaggggcgggaacacaatgaggcggggggccttttccggagacccagcatggcgtat

SEQ ID NO: 382213 - DNA, 140 bp, Artificial Sequence
  Synthetic
atacgccatgctgggtctccgggggggcctatgccttccagtacaccccaaatcagcgggtacgggagatgctcaaactgtgggagtcaaagaaaaccccgtgcgcaatctgtgtggatgcgtacttgggagtcggccat

SEQ ID NO: 382214 - DNA, 140 bp, Artificial Sequence
  Synthetic
atggccgactcccaagtacgcatccacacagattgcgcacggggttttctttgactcccacagtttgagcatctcccgtacccgctgatttggggtgtactggaaggcataggcccccccggagacccagcatggcgtat

SEQ ID NO: 382215 - DNA, 140 bp, Artificial Sequence
  Synthetic
atacgccatgctgggtctccctacgtgcttcgacagttccatcactgaagaggacgtggccttggagacagagctatatgccctggcttctgaccgcccagagtgggtgcgggccctgggcgtacttgggagtcggccat

SEQ ID NO: 382216 - DNA, 140 bp, Artificial Sequence
  Synthetic
atggccgactcccaagtacgcccagggcccgcacccactctgggcggtcagaagccagggcatatagctctgtctccaaggccacgtcctcttcagtgatggaactgtcgaagcacgtagggagacccagcatggcgtat

SEQ ID NO: 382217 - DNA, 140 bp, Artificial Sequence
  Synthetic
atacgccatgctgggtctccgaaatactatgcctctggtacgatggtcaccccggaaggggtgcccgttggagagaggtactgtaggtcctcgggggtcttgaccaccagtgcgagcaaccgtacttgggagtcggccat

SEQ ID NO: 382218 - DNA, 140 bp, Artificial Sequence
  Synthetic
atggccgactcccaagtacggttgctcgcactggtggtcaagacccccgaggacctacagtacctctctccaacgggcaccccttccggggtgaccatcgtaccagaggcatagtatttcggagacccagcatggcgtat

SEQ ID NO: 382219 - DNA, 140 bp, Artificial Sequence
  Synthetic
atacgccatgctgggtctcctgcttaacctgctacattaaggtgaaagccgcgtgcgagagggttggccttaaaaacgtctcccttctcatcgctggcgatgactgtttgatcatatgtgcgtacttgggagtcggccat

SEQ ID NO: 382220 - DNA, 140 bp, Artificial Sequence
  Synthetic
atggccgactcccaagtacgcacatatgatcaaacagtcatcgccagcgatgagaagggagacgtttttaaggccaaccctctcgcacgcggctttcaccttaatgtagcaggttaagcaggagacccagcatggcgtat

SEQ ID NO: 382221 - DNA, 140 bp, Artificial Sequence
  Synthetic
atacgccatgctgggtctccagaggcccatatgtgacccgagtgaggccttgggcagagccctggcttcatacggttacgcgtgtgagccctcatatcatgcatcactggacacggcccccgtacttgggagtcggccat

SEQ ID NO: 382222 - DNA, 140 bp, Artificial Sequence
  Synthetic
atggccgactcccaagtacgggggccgtgtccagtgatgcatgatatgagggctcacacgcgtaaccgtatgaagccagggctctgcccaaggcctcactcgggtcacatatgggcctctggagacccagcatggcgtat

SEQ ID NO: 382223 - DNA, 140 bp, Artificial Sequence
  Synthetic
atacgccatgctgggtctcccttctgctccacttggctcgccgagtgcaatgcggacgggaagcgccatttcttccttaccacggactttcggaggccgctagcacgcatgtctagcgagcgtacttgggagtcggccat

SEQ ID NO: 382224 - DNA, 140 bp, Artificial Sequence
  Synthetic
atggccgactcccaagtacgctcgctagacatgcgtgctagcggcctccgaaagtccgtggtaaggaagaaatggcgcttcccgtccgcattgcactcggcgagccaagtggagcagaagggagacccagcatggcgtat

SEQ ID NO: 382225 - DNA, 140 bp, Artificial Sequence
  Synthetic
atacgccatgctgggtctcctacagtgaccctatggcctcggccattggttacatccttctttacccctggcaccccatcacacggtgggtcatcattccgcacgtgctcacttgcgcgtcgtacttgggagtcggccat

SEQ ID NO: 382226 - DNA, 140 bp, Artificial Sequence
  Synthetic
atggccgactcccaagtacgacgcgcaagtgagcacgtgcggaatgatgacccaccgtgtgatggggtgccaggggtaaagaaggatgtaaccaatggccgaggccatagggtcactgtaggagacccagcatggcgtat

SEQ ID NO: 382227 - DNA, 140 bp, Artificial Sequence
  Synthetic
aggccctggctgctgatatggcaccccatcacacggtgggtcatcattccgcacgtgctcacttgcgcgtttaggggtggtggcacaccgtctgatccggtttggtgccaggtgcatggcgaccttttgggacagcggtg

SEQ ID NO: 382228 - DNA, 140 bp, Artificial Sequence
  Synthetic
caccgctgtcccaaaaggtcgccatgcacctggcaccaaaccggatcagacggtgtgccaccacccctaaacgcgcaagtgagcacgtgcggaatgatgacccaccgtgtgatggggtgccatatcagcagccagggcct

SEQ ID NO: 382229 - DNA, 140 bp, Artificial Sequence
  Synthetic
aggccctggctgctgatatgccacggaccagcagcgttgagggttaccgcagacacaactaagacaaaaatggaagccggcaaggtgctgagcgacttgaagctccctggcctggccgtcgaccttttgggacagcggtg

SEQ ID NO: 382230 - DNA, 140 bp, Artificial Sequence
  Synthetic
caccgctgtcccaaaaggtcgacggccaggccagggagcttcaagtcgctcagcaccttgccggcttccatttttgtcttagttgtgtctgcggtaaccctcaacgctgctggtccgtggcatatcagcagccagggcct

SEQ ID NO: 382231 - DNA, 140 bp, Artificial Sequence
  Synthetic
atacgccatgctgggtctcccaccgtaagaaggctggagcattgcgcacgcgcatgcttcggtcgcgcggttgggcggagctggctaggggcttgttgtggcatcctggcctccggctcccgtacttgggagtcggccat

SEQ ID NO: 382232 - DNA, 140 bp, Artificial Sequence
  Synthetic
atggccgactcccaagtacgggagccggaggccaggatgccacaacaagcccctagccagctccgcccaaccgcgcgaccgaagcatgcgcgtgcgcaatgctccagccttcttacggtgggagacccagcatggcgtat

SEQ ID NO: 382233 - DNA, 140 bp, Artificial Sequence
  Synthetic
atacgccatgctgggtctccctccccccgagattgctggtatcccgggtggattccctttgtcccctccctatatgggagtggtacaccaattggatttcacagcccagcggagtcgctgcgtacttgggagtcggccat

SEQ ID NO: 382234 - DNA, 140 bp, Artificial Sequence
  Synthetic
atggccgactcccaagtacgcagcgactccgctgggctgtgaaatccaattggtgtaccactcccatatagggaggggacaaagggaatccacccgggataccagcaatctcggggggagggagacccagcatggcgtat

SEQ ID NO: 382235 - DNA, 140 bp, Artificial Sequence
  Synthetic
aggccctggctgctgatatgggttcccgccctccccgccccaggggtctccccgctgggtaaaaagggcccggccttgggaggcatggtggttactaaccccctggcagggtcaaagcctgaccttttgggacagcggtg

SEQ ID NO: 382236 - DNA, 140 bp, Artificial Sequence
  Synthetic
caccgctgtcccaaaaggtcaggctttgaccctgccagggggttagtaaccaccatgcctcccaaggccgggccctttttacccagcggggagacccctggggcggggagggcgggaacccatatcagcagccagggcct

SEQ ID NO: 382237 - DNA, 140 bp, Artificial Sequence
  Synthetic
aggccctggctgctgatatgcggccttgggaggcatggtggttactaaccccctggcagggtcaaagcctgatggtgctaatgcactgccgcttcggcggcgggtcgctaccttatagcggaccttttgggacagcggtg

SEQ ID NO: 382238 - DNA, 140 bp, Artificial Sequence
  Synthetic
caccgctgtcccaaaaggtccgctataaggtagcgacccgccgccgaagcggcagtgcattagcaccatcaggctttgaccctgccagggggttagtaaccaccatgcctcccaaggccgcatatcagcagccagggcct

SEQ ID NO: 382239 - DNA, 140 bp, Artificial Sequence
  Synthetic
atacgccatgctgggtctcctaatccgtgactacgggctcctcgcagaggcctccccggatggggcacagtgcactgtgatctaaaggggtgcaccccggtaagagctcggcccaaaggccgtacttgggagtcggccat

SEQ ID NO: 382240 - DNA, 140 bp, Artificial Sequence
  Synthetic
atggccgactcccaagtacggcctttgggccgagctcttaccggggtgcacccctttagatcacagtgcactgtgccccatccggggaggcctctgcgaggagcccgtagtcacggattaggagacccagcatggcgtat

SEQ ID NO: 382241 - DNA, 140 bp, Artificial Sequence
  Synthetic
aggccctggctgctgatatggggctcctcgcagaggcctccccggatggggcacagtgcactgtgatctaaaggggtgcaccccggtaagagctcggcccaaaggccgggttctacttttgaccttttgggacagcggtg

SEQ ID NO: 382242 - DNA, 140 bp, Artificial Sequence
  Synthetic
caccgctgtcccaaaaggtcaaaagtagaacccggcctttgggccgagctcttaccggggtgcacccctttagatcacagtgcactgtgccccatccggggaggcctctgcgaggagccccatatcagcagccagggcct

SEQ ID NO: 382243 - DNA, 140 bp, Artificial Sequence
  Synthetic
atacgccatgctgggtctcctccacaggtgttggccctaccggtgtgaataagggcccgacgtcaggctcgtcgttaaaccgagaccattacccgcctgggcaaacgacgcccacgtacgcgtacttgggagtcggccat

SEQ ID NO: 382244 - DNA, 140 bp, Artificial Sequence
  Synthetic
atggccgactcccaagtacgcgtacgtgggcgtcgtttgcccaggcgggtaatggtctcggtttaacgacgagcctgacgtcgggcccttattcacaccggtagggccaacacctgtggaggagacccagcatggcgtat

SEQ ID NO: 382245 - DNA, 140 bp, Artificial Sequence
  Synthetic
atacgccatgctgggtctccgtccacgtcgcccttcaatgtctctcttgaccaataggctttgccggcgagttgacaaggaccagtgggggccgggtgcagggggaaggaccccctgtaccgtacttgggagtcggccat

SEQ ID NO: 382246 - DNA, 140 bp, Artificial Sequence
  Synthetic
atggccgactcccaagtacggtacagggggtccttccccctgcacccggcccccactggtccttgtcaactcgccggcaaagcctattggtcaagagagacattgaagggcgacgtggacggagacccagcatggcgtat

SEQ ID NO: 382247 - DNA, 140 bp, Artificial Sequence
  Synthetic
atacgccatgctgggtctcctgcccattccggcggggtgggaaatgcatggggccacccagctccgcggcggcctgcagccggggtagcccaagaatccttcgggtgagggcgggtggcacgtacttgggagtcggccat

SEQ ID NO: 382248 - DNA, 140 bp, Artificial Sequence
  Synthetic
atggccgactcccaagtacgtgccacccgccctcacccgaaggattcttgggctaccccggctgcaggccgccgcggagctgggtggccccatgcatttcccaccccgccggaatgggcaggagacccagcatggcgtat

SEQ ID NO: 382249 - DNA, 140 bp, Artificial Sequence
  Synthetic
atacgccatgctgggtctcctttttctttctgtaccaatcatggcagtccttctgcttctcttcgtggtggaggccggggccatcttggccccggccacccatgcttgtggagctaatggcgtacttgggagtcggccat

SEQ ID NO: 382250 - DNA, 140 bp, Artificial Sequence
  Synthetic
atggccgactcccaagtacgccattagctccacaagcatgggtggccggggccaagatggccccggcctccaccacgaagagaagcagaaggactgccatgattggtacagaaagaaaaaggagacccagcatggcgtat

SEQ ID NO: 382251 - DNA, 140 bp, Artificial Sequence
  Synthetic
atacgccatgctgggtctccgcaatacttcctcacaaattgttgcgctatggaggatatcgggttctgcctggaaggtgggtgcctggtagccctcgggtgcactatttgtactgaccgacgtacttgggagtcggccat

SEQ ID NO: 382252 - DNA, 140 bp, Artificial Sequence
  Synthetic
atggccgactcccaagtacgtcggtcagtacaaatagtgcacccgagggctaccaggcacccaccttccaggcagaacccgatatcctccatagcgcaacaatttgtgaggaagtattgcggagacccagcatggcgtat

SEQ ID NO: 382253 - DNA, 140 bp, Artificial Sequence
  Synthetic
atacgccatgctgggtctcctgctggccactgtatcaggcgggattggctgtgcgacccggcaagtccgccgctcagctcgtgggggaactggggagccttttcggacccttgtcagtttcgtacttgggagtcggccat

SEQ ID NO: 382254 - DNA, 140 bp, Artificial Sequence
  Synthetic
atggccgactcccaagtacgaaactgacaagggtccgaaaaggctccccagttcccccacgagctgagcggcggacttgccgggtcgcacagccaatcccgcctgatacagtggccagcaggagacccagcatggcgtat

SEQ ID NO: 382255 - DNA, 140 bp, Artificial Sequence
  Synthetic
atacgccatgctgggtctcccggcctacgtggccgggatactggggctcggggaggtttactccggcgtcctcacggtgggtgttgcgttgacgcggcgggtctacccggtcccgaacttcgtacttgggagtcggccat

SEQ ID NO: 382256 - DNA, 140 bp, Artificial Sequence
  Synthetic
atggccgactcccaagtacgaagttcgggaccgggtagacccgccgcgtcaacgcaacacccaccgtgaggacgccggagtaaacctccccgagccccagtatcccggccacgtaggccgggagacccagcatggcgtat

SEQ ID NO: 382257 - DNA, 140 bp, Artificial Sequence
  Synthetic
atacgccatgctgggtctccgacgtgcacagtagaatgtgagttgaggtgggagagtgagttttggagatggactgagcagttggcctccaattactggattctggaatacctctggaaacgtacttgggagtcggccat

SEQ ID NO: 382258 - DNA, 140 bp, Artificial Sequence
  Synthetic
atggccgactcccaagtacgtttccagaggtattccagaatccagtaattggaggccaactgctcagtccatctccaaaactcactctcccacctcaactcacattctactgtgcacgtcggagacccagcatggcgtat

SEQ ID NO: 382259 - DNA, 140 bp, Artificial Sequence
  Synthetic
atacgccatgctgggtctccgtgccttttgacttctggcgtggagtgatgagcctgacccctctgttggtgtgcgtggcggccctcctcctgctggagcaacggatagtcatggtcttcccgtacttgggagtcggccat

SEQ ID NO: 382260 - DNA, 140 bp, Artificial Sequence
  Synthetic
atggccgactcccaagtacgggaagaccatgactatccgttgctccagcaggaggagggccgccacgcacaccaacagaggggtcaggctcatcactccacgccagaagtcaaaaggcacggagacccagcatggcgtat

SEQ ID NO: 382261 - DNA, 140 bp, Artificial Sequence
  Synthetic
atacgccatgctgggtctcctcctggttaccatggctgggatgtcgcaaggcgccccggcctcggtgctagggtcccgcccttttgaggcggggttgacgtgggattcgtgctcctgcagcgtacttgggagtcggccat

SEQ ID NO: 382262 - DNA, 140 bp, Artificial Sequence
  Synthetic
atggccgactcccaagtacgctgcaggagcacgaatcccacgtcaaccccgcctcaaaagggcgggaccctagcaccgaggccggggcgccttgcgacatcccagccatggtaaccaggaggagacccagcatggcgtat

SEQ ID NO: 382263 - DNA, 140 bp, Artificial Sequence
  Synthetic
aggccctggctgctgatatggggtcccgcccttttgaggcggggttgacgtgggattcgtgctcctgcaggtcgaacggctcgcgtgtgcctacgggggagaaggtttggaaccgtgggagaccttttgggacagcggtg

SEQ ID NO: 382264 - DNA, 140 bp, Artificial Sequence
  Synthetic
caccgctgtcccaaaaggtctcccacggttccaaaccttctcccccgtaggcacacgcgagccgttcgacctgcaggagcacgaatcccacgtcaaccccgcctcaaaagggcgggaccccatatcagcagccagggcct

SEQ ID NO: 382265 - DNA, 140 bp, Artificial Sequence
  Synthetic
atacgccatgctgggtctccatgtcacacttctgtgtgattgccccaacggcccctgggtctggctcccggccttttgcgcagcgatcggttggggagatcctatcactcattggagccacgtacttgggagtcggccat

SEQ ID NO: 382266 - DNA, 140 bp, Artificial Sequence
  Synthetic
atggccgactcccaagtacgtggctccaatgagtgataggatctccccaaccgatcgctgcgcaaaaggccgggagccagacccaggggccgttggggcaatcacacagaagtgtgacatggagacccagcatggcgtat

SEQ ID NO: 382267 - DNA, 140 bp, Artificial Sequence
  Synthetic
atacgccatgctgggtctcccggacaaaatcagtggcccctctcatgcccccagtatgtctatggcgctgtttcagtgacctgcgtgtggggatccgtgtcttggtttgcttccacggggcgtacttgggagtcggccat

SEQ ID NO: 382268 - DNA, 140 bp, Artificial Sequence
  Synthetic
atggccgactcccaagtacgccccgtggaagcaaaccaagacacggatccccacacgcaggtcactgaaacagcgccatagacatactgggggcatgagaggggccactgattttgtccgggagacccagcatggcgtat

SEQ ID NO: 382269 - DNA, 140 bp, Artificial Sequence
  Synthetic
aggccctggctgctgatatgtttcagtgacctgcgtgtggggatccgtgtcttggtttgcttccacgggggggcgcgattccaagctcgatgtgtggagtttggtgccgactggttccgcgaccttttgggacagcggtg

SEQ ID NO: 382270 - DNA, 140 bp, Artificial Sequence
  Synthetic
caccgctgtcccaaaaggtcgcggaaccagtcggcaccaaactccacacatcgagcttggaatcgcgcccccccgtggaagcaaaccaagacacggatccccacacgcaggtcactgaaacatatcagcagccagggcct

SEQ ID NO: 382271 - DNA, 140 bp, Artificial Sequence
  Synthetic
atacgccatgctgggtctccgggcgcgattccaagctcgatgtgtggagtttggtgccgactggttccgctagttgcaccatagccgccctcgggacatcggatcgtgacaccgtggttgcgtacttgggagtcggccat

SEQ ID NO: 382272 - DNA, 140 bp, Artificial Sequence
  Synthetic
atggccgactcccaagtacgcaaccacggtgtcacgatccgatgtcccgagggcggctatggtgcaactagcggaaccagtcggcaccaaactccacacatcgagcttggaatcgcgcccggagacccagcatggcgtat

SEQ ID NO: 382273 - DNA, 140 bp, Artificial Sequence
  Synthetic
atacgccatgctgggtctccagctctccgagtggggagttccctgcgctacctgcattctggaccgtcggccggcctcgtgtggcacctgtgtgcgggactgctggcccgagacagggtccgtacttgggagtcggccat

SEQ ID NO: 382274 - DNA, 140 bp, Artificial Sequence
  Synthetic
atggccgactcccaagtacggaccctgtctcgggccagcagtcccgcacacaggtgccacacgaggccggccgacggtccagaatgcaggtagcgcagggaactccccactcggagagctggagacccagcatggcgtat

SEQ ID NO: 382275 - DNA, 140 bp, Artificial Sequence
  Synthetic
atacgccatgctgggtctccggtcagattcccattccatcggtgcggcgcggggcctaggctgacacgcgacttggaggcggtgcccttcgtcaataggacaactccattcaccatacgacgtacttgggagtcggccat

SEQ ID NO: 382276 - DNA, 140 bp, Artificial Sequence
  Synthetic
atggccgactcccaagtacgtcgtatggtgaatggagttgtcctattgacgaagggcaccgcctccaagtcgcgtgtcagcctaggccccgcgccgcaccgatggaatgggaatctgaccggagacccagcatggcgtat

SEQ ID NO: 382277 - DNA, 140 bp, Artificial Sequence
  Synthetic
atacgccatgctgggtctccggacccctgggcaaccagggccggggcaatccggtgcggtcccccctgggttttgggtcctacaccatgaccaagatccgggactcgttacatctggtgacgtacttgggagtcggccat

SEQ ID NO: 382278 - DNA, 140 bp, Artificial Sequence
  Synthetic
atggccgactcccaagtacgtcaccagatgtaacgagtcccggatcttggtcatggtgtaggacccaaaacccaggggggaccgcaccggattgccccggccctggttgcccaggggtccggagacccagcatggcgtat

SEQ ID NO: 382279 - DNA, 140 bp, Artificial Sequence
  Synthetic
atacgccatgctgggtctccaatgtcccacccctgccattgagcctccgaccggaacgttcgggttcttccccggggtgcccccgctcaacaactgcatgcttttgggcactgaggtgtccgtacttgggagtcggccat

SEQ ID NO: 382280 - DNA, 140 bp, Artificial Sequence
  Synthetic
atggccgactcccaagtacggacacctcagtgcccaaaagcatgcagttgttgagcgggggcaccccggggaagaacccgaacgttccggtcggaggctcaatggcaggggtgggacattggagacccagcatggcgtat

SEQ ID NO: 382281 - DNA, 140 bp, Artificial Sequence
  Synthetic
atacgccatgctgggtctcccgaggcactagggggagcgggcctcacgggggggttctacgagcctctggtacggcggtgctcagagttgatgggtcggcggaatccggtgtgtccggggcgtacttgggagtcggccat

SEQ ID NO: 382282 - DNA, 140 bp, Artificial Sequence
  Synthetic
atggccgactcccaagtacgccccggacacaccggattccgccgacccatcaactctgagcaccgccgtaccagaggctcgtagaacccccccgtgaggcccgctccccctagtgcctcgggagacccagcatggcgtat

SEQ ID NO: 382283 - DNA, 140 bp, Artificial Sequence
  Synthetic
atacgccatgctgggtctccttcgcatggctctcctcgggcaggcctgatgggtttatacatgtgcaggggcacctgcaggaggtggatgctggcaacttcattccgccgcctcgctggccgtacttgggagtcggccat

SEQ ID NO: 382284 - DNA, 140 bp, Artificial Sequence
  Synthetic
atggccgactcccaagtacggccagcgaggcggcggaatgaagttgccagcatccacctcctgcaggtgcccctgcacatgtataaacccatcaggcctgcccgaggagagccatgcgaaggagacccagcatggcgtat

SEQ ID NO: 382285 - DNA, 140 bp, Artificial Sequence
  Synthetic
atacgccatgctgggtctcctgctcttggactttgtgtttgtcctgttctacctgatgaagctggcggaggcacggttggtcccgcttatacttctcttgctgtggtggtgggtgaaccacgtacttgggagtcggccat

SEQ ID NO: 382286 - DNA, 140 bp, Artificial Sequence
  Synthetic
atggccgactcccaagtacgtggttcacccaccaccacagcaagagaagtataagcgggaccaaccgtgcctccgccagcttcatcaggtagaacaggacaaacacaaagtccaagagcaggagacccagcatggcgtat

SEQ ID NO: 382287 - DNA, 140 bp, Artificial Sequence
  Synthetic
aggccctggctgctgatatggcacggttggtcccgcttatacttctcttgctgtggtggtgggtgaaccagttggctgtcttaggcatgcctgcggcgcacgctgctgtggcgggggagggaccttttgggacagcggtg

SEQ ID NO: 382288 - DNA, 140 bp, Artificial Sequence
  Synthetic
caccgctgtcccaaaaggtccctcccccgccacagcagcgtgcgccgcaggcatgcctaagacagccaactggttcacccaccaccacagcaagagaagtataagcgggaccaaccgtgccatatcagcagccagggcct

SEQ ID NO: 382289 - DNA, 140 bp, Artificial Sequence
  Synthetic
atacgccatgctgggtctcctgtttgctggcccagccttgtcgtggtgcctgggtttgcccttcgttagtatgattttggggttagcaaacctcattctctactttcgttggatgggccccgtacttgggagtcggccat

SEQ ID NO: 382290 - DNA, 140 bp, Artificial Sequence
  Synthetic
atggccgactcccaagtacggggcccatccaacgaaagtagagaatgaggtttgctaaccccaaaatcatactaacgaagggcaaacccaggcaccacgacaaggctgggccagcaaacaggagacccagcatggcgtat

SEQ ID NO: 382291 - DNA, 140 bp, Artificial Sequence
  Synthetic
atacgccatgctgggtctccacagcgcctcatgttccttgtgttgtggaagctcgctcggggagcttttccgctagccttactgatggggatttcagccacccgcggccgcacctcagtgcgtacttgggagtcggccat

SEQ ID NO: 382292 - DNA, 140 bp, Artificial Sequence
  Synthetic
atggccgactcccaagtacgcactgaggtgcggccgcgggtggctgaaatccccatcagtaaggctagcggaaaagctccccgagcgagcttccacaacacaaggaacatgaggcgctgtggagacccagcatggcgtat

SEQ ID NO: 382293 - DNA, 140 bp, Artificial Sequence
  Synthetic
atacgccatgctgggtctccctcggagccgagttctgctttgatgtcactttcgaagtggacacgtcggttttgggatgggtggtggccagcgtccttgcatgggcaattgccctcctgacgtacttgggagtcggccat

SEQ ID NO: 382294 - DNA, 140 bp, Artificial Sequence
  Synthetic
atggccgactcccaagtacgtcaggagggcaattgcccatgcaaggacgctggccaccacccatcccaaaaccgacgtgtccacttcgaaagtgacatcaaagcagaactcggctccgagggagacccagcatggcgtat

SEQ ID NO: 382295 - DNA, 140 bp, Artificial Sequence
  Synthetic
atacgccatgctgggtctccgctctatgagcgcagggggttggaggcacaaagctgtgatctacagaacgtggtgtaaggggtaccaggcgttgcgtcaacgggtggtgcggagccccctcgtacttgggagtcggccat

SEQ ID NO: 382296 - DNA, 140 bp, Artificial Sequence
  Synthetic
atggccgactcccaagtacgagggggctccgcaccacccgttgacgcaacgcctggtaccccttacaccacgttctgtagatcacagctttgtgcctccaaccccctgcgctcatagagcggagacccagcatggcgtat

SEQ ID NO: 382297 - DNA, 140 bp, Artificial Sequence
  Synthetic
atacgccatgctgggtctcccggggagggacggccgaccaaacccttgaccatcgcttggtgcctggcctcgtacatctggcctgacgctgtgatgctggtggtggtggggctggttctgcgtacttgggagtcggccat

SEQ ID NO: 382298 - DNA, 140 bp, Artificial Sequence
  Synthetic
atggccgactcccaagtacgcagaaccagccccaccaccaccagcatcacagcgtcaggccagatgtacgaggccaggcaccaagcgatggtcaagggtttggtcggccgtccctccccgggagacccagcatggcgtat

SEQ ID NO: 382299 - DNA, 140 bp, Artificial Sequence
  Synthetic
atacgccatgctgggtctccctctttggcctgttcgacgcgttggactgggccttggaggagctactagtctcacggccttcgttgcggcgcttggctcgggtggtcgagtgctgtgtgacgtacttgggagtcggccat

SEQ ID NO: 382300 - DNA, 140 bp, Artificial Sequence
  Synthetic
atggccgactcccaagtacgtcacacagcactcgaccacccgagccaagcgccgcaacgaaggccgtgagactagtagctcctccaaggcccagtccaacgcgtcgaacaggccaaagagggagacccagcatggcgtat

SEQ ID NO: 382301 - DNA, 140 bp, Artificial Sequence
  Synthetic
atacgccatgctgggtctcctggctggtgagaaggccactaccatgcggctggtatccaagatgtgtgcgaggggggcctatttgtttgaccatatgggctctttttcgcgcgcagtcaacgtacttgggagtcggccat

SEQ ID NO: 382302 - DNA, 140 bp, Artificial Sequence
  Synthetic
atggccgactcccaagtacgttgactgcgcgcgaaaaagagcccatatggtcaaacaaataggcccccctcgcacacatcttggataccagccgcatggtagtggccttctcaccagccaggagacccagcatggcgtat

SEQ ID NO: 382303 - DNA, 140 bp, Artificial Sequence
  Synthetic
atacgccatgctgggtctccggaacgcctgcttgaatgggacgcggctttggaacctttgtcattcaccaggacggactgtcgcatcattagagatgctgccaggaccctgagctgcggccgtacttgggagtcggccat

SEQ ID NO: 382304 - DNA, 140 bp, Artificial Sequence
  Synthetic
atggccgactcccaagtacggccgcagctcagggtcctggcagcatctctaatgatgcgacagtccgtcctggtgaatgacaaaggttccaaagccgcgtcccattcaagcaggcgttccggagacccagcatggcgtat

SEQ ID NO: 382305 - DNA, 140 bp, Artificial Sequence
  Synthetic
atacgccatgctgggtctcccagtgtgtcatgggcttgcccgtggtagctcgccgtggcgacgaggtcttgatcggcgtctttcaggatgtgaaccatttgcctccggggtttgtccccacgtacttgggagtcggccat

SEQ ID NO: 382306 - DNA, 140 bp, Artificial Sequence
  Synthetic
atggccgactcccaagtacgtggggacaaaccccggaggcaaatggttcacatcctgaaagacgccgatcaagacctcgtcgccacggcgagctaccacgggcaagcccatgacacactgggagacccagcatggcgtat

SEQ ID NO: 382307 - DNA, 140 bp, Artificial Sequence
  Synthetic
atacgccatgctgggtctccctgcgccagttgtcatccgacggtgcggaaagggtttcctcggagtcacaaaggctgccttgacaggtcgggatcctgacttacatccaggaaacgtcatcgtacttgggagtcggccat

SEQ ID NO: 382308 - DNA, 140 bp, Artificial Sequence
  Synthetic
atggccgactcccaagtacgatgacgtttcctggatgtaagtcaggatcccgacctgtcaaggcagcctttgtgactccgaggaaaccctttccgcaccgtcggatgacaactggcgcagggagacccagcatggcgtat

SEQ ID NO: 382309 - DNA, 140 bp, Artificial Sequence
  Synthetic
atacgccatgctgggtctccggtacttggtacggcgacctcccgtagcatgggaacatgccttaacgggctgttgtttaccacgttccatggggcctcttcccgaaccatagccacaccccgtacttgggagtcggccat

SEQ ID NO: 382310 - DNA, 140 bp, Artificial Sequence
  Synthetic
atggccgactcccaagtacggggtgtggctatggttcgggaagaggccccatggaacgtggtaaacaacagcccgttaaggcatgttcccatgctacgggaggtcgccgtaccaagtaccggagacccagcatggcgtat

SEQ ID NO: 382311 - DNA, 140 bp, Artificial Sequence
  Synthetic
atacgccatgctgggtctccgtgggagccctaaatcctaggtggtggtcggccagtgatgatgtaacggtgtacccattgcctgatggggccaactcgttgacgccttgcacttgccaggcgtacttgggagtcggccat

SEQ ID NO: 382312 - DNA, 140 bp, Artificial Sequence
  Synthetic
atggccgactcccaagtacgcctggcaagtgcaaggcgtcaacgagttggccccatcaggcaatgggtacaccgttacatcatcactggccgaccaccacctaggatttagggctcccacggagacccagcatggcgtat

SEQ ID NO: 382313 - DNA, 140 bp, Artificial Sequence
  Synthetic
atacgccatgctgggtctccctgagtcatgttgggtcattcgatctgatggggctctttgccatggcctgtgtaagggggacaaggttgaactggacgtggccatggaggtctctgacttcgtacttgggagtcggccat

SEQ ID NO: 382314 - DNA, 140 bp, Artificial Sequence
  Synthetic
atggccgactcccaagtacgaagtcagagacctccatggccacgtccagttcaaccttgtcccccttacacaggccatggcaaagagccccatcagatcgaatgacccaacatgactcagggagacccagcatggcgtat

SEQ ID NO: 382315 - DNA, 140 bp, Artificial Sequence
  Synthetic
atacgccatgctgggtctcctcgtgggtcgtctgggtcaccagtcctgtgcgacgagggacacgcagtaggaatgctcgtgtcggtgctccactctggaggcagagtcaccgcggcaagacgtacttgggagtcggccat

SEQ ID NO: 382316 - DNA, 140 bp, Artificial Sequence
  Synthetic
atggccgactcccaagtacgtcttgccgcggtgactctgcctccagagtggagcaccgacacgagcattcctactgcgtgtccctcgtcgcacaggactggtgacccagacgacccacgaggagacccagcatggcgtat

SEQ ID NO: 382317 - DNA, 140 bp, Artificial Sequence
  Synthetic
aggccctggctgctgatatggaatgctcgtgtcggtgctccactctggaggcagagtcaccgcggcaagattcactcggccgtggacccaagttccaacggacgccaaaaccactaccgagaccttttgggacagcggtg

SEQ ID NO: 382318 - DNA, 140 bp, Artificial Sequence
  Synthetic
caccgctgtcccaaaaggtctcggtagtggttttggcgtccgttggaacttgggtccacggccgagtgaatcttgccgcggtgactctgcctccagagtggagcaccgacacgagcattccatatcagcagccagggcct

SEQ ID NO: 382319 - DNA, 140 bp, Artificial Sequence
  Synthetic
atacgccatgctgggtctccgcccccaccggttccggcgaagggtgtctttaaggaagctccgttgttcatgccgacgggggccgggaagagcacccgggtcccgttggagtacggcaaccgtacttgggagtcggccat

SEQ ID NO: 382320 - DNA, 140 bp, Artificial Sequence
  Synthetic
atggccgactcccaagtacggttgccgtactccaacgggacccgggtgctcttcccggcccccgtcggcatgaacaacggagcttccttaaagacacccttcgccggaaccggtgggggcggagacccagcatggcgtat

SEQ ID NO: 382321 - DNA, 140 bp, Artificial Sequence
  Synthetic
atacgccatgctgggtctccatggggcacaaggttctgattctcaacccgtcagttgcgacagtgcgggccatgggtccgtacatggagaagctggcgggcaaacaccctagcatctactcgtacttgggagtcggccat

SEQ ID NO: 382322 - DNA, 140 bp, Artificial Sequence
  Synthetic
atggccgactcccaagtacgagtagatgctagggtgtttgcccgccagcttctccatgtacggacccatggcccgcactgtcgcaactgacgggttgagaatcagaaccttgtgccccatggagacccagcatggcgtat

SEQ ID NO: 382323 - DNA, 140 bp, Artificial Sequence
  Synthetic
atacgccatgctgggtctccgtggacatgacaccactgctttcactcggattactgactcgccgttgacgtattcgacctatgggcggttcttagccaaccctaggcagatgctacgcggcgtacttgggagtcggccat

SEQ ID NO: 382324 - DNA, 140 bp, Artificial Sequence
  Synthetic
atggccgactcccaagtacgccgcgtagcatctgcctagggttggctaagaaccgcccataggtcgaatacgtcaacggcgagtcagtaatccgagtgaaagcagtggtgtcatgtccacggagacccagcatggcgtat

SEQ ID NO: 382325 - DNA, 140 bp, Artificial Sequence
  Synthetic
atacgccatgctgggtctcccgtctcggtggtcatttgtgacgagtgccacagtcatgattcgacggttttgttgggtattggacgggtccgggagttggcgcgtggttgtggggtgcaacgtacttgggagtcggccat

SEQ ID NO: 382326 - DNA, 140 bp, Artificial Sequence
  Synthetic
atggccgactcccaagtacgttgcaccccacaaccacgcgccaactcccggacccgtccaatacccaacaaaaccgtcgaatcatgactgtggcactcgtcacaaatgaccaccgagacgggagacccagcatggcgtat

SEQ ID NO: 382327 - DNA, 140 bp, Artificial Sequence
  Synthetic
atacgccatgctgggtctccctagtgctctacgccacggccactccccccggatcccccatgactcagcatccgtctatcattgagacaaaactggatgtgggtgagatccccttctatgcgtacttgggagtcggccat

SEQ ID NO: 382328 - DNA, 140 bp, Artificial Sequence
  Synthetic
atggccgactcccaagtacgcatagaaggggatctcacccacatccagttttgtctcaatgatagacggatgctgagtcatgggggatccggggggagtggccgtggcgtagagcactagggagacccagcatggcgtat

SEQ ID NO: 382329 - DNA, 140 bp, Artificial Sequence
  Synthetic
atacgccatgctgggtctccggcatggcattcccttggaacggatgcggaccggtaggcatctcgtgttctgccattcaaaggcggagtgcgagcgcctggcgggccaattctcggctcgcgtacttgggagtcggccat

SEQ ID NO: 382330 - DNA, 140 bp, Artificial Sequence
  Synthetic
atggccgactcccaagtacgcgagccgagaattggcccgccaggcgctcgcactccgcctttgaatggcagaacacgagatgcctaccggtccgcatccgttccaagggaatgccatgccggagacccagcatggcgtat

SEQ ID NO: 382331 - DNA, 140 bp, Artificial Sequence
  Synthetic
atacgccatgctgggtctccgggagtcaacgccattgcctattacagggggaaggacagttccatcattaaggacggagacttggtggtttgcgctacagacgcgctgtccactgggtaccgtacttgggagtcggccat

SEQ ID NO: 382332 - DNA, 140 bp, Artificial Sequence
  Synthetic
atggccgactcccaagtacggtacccagtggacagcgcgtctgtagcgcaaaccaccaagtctccgtccttaatgatggaactgtccttccccctgtaataggcaatggcgttgactcccggagacccagcatggcgtat

SEQ ID NO: 382333 - DNA, 140 bp, Artificial Sequence
  Synthetic
atacgccatgctgggtctccactgggaacttcgattccgtgaccgattgtgggctggtggtggaggaggtcgtcgaggtgacccttgatcccaccattaccatctccttgcggacagtgccgtacttgggagtcggccat

SEQ ID NO: 382334 - DNA, 140 bp, Artificial Sequence
  Synthetic
atggccgactcccaagtacggcactgtccgcaaggagatggtaatggtgggatcaagggtcacctcgacgacctcctccaccaccagcccacaatcggtcacggaatcgaagttcccagtggagacccagcatggcgtat

SEQ ID NO: 382335 - DNA, 140 bp, Artificial Sequence
  Synthetic
atacgccatgctgggtctcccggcgtcggctgaattgtcgatgcaacggcgaggtcgcacggggagaggtcggtccgggcggtactactacgcgggggtgggcaaagcccccgcgggtgtcgtacttgggagtcggccat

SEQ ID NO: 382336 - DNA, 140 bp, Artificial Sequence
  Synthetic
atggccgactcccaagtacgacacccgcgggggctttgcccacccccgcgtagtagtaccgcccggaccgacctctccccgtgcgacctcgccgttgcatcgacaattcagccgacgccgggagacccagcatggcgtat

SEQ ID NO: 382337 - DNA, 140 bp, Artificial Sequence
  Synthetic
atacgccatgctgggtctccggtgcggtccgggccggtctggtcggctgtggaggctggagtgacctggtatggaatggaacctgatttgacagctaacctattgagactttacgacgaccgtacttgggagtcggccat

SEQ ID NO: 382338 - DNA, 140 bp, Artificial Sequence
  Synthetic
atggccgactcccaagtacggtcgtcgtaaagtctcaataggttagctgtcaaatcaggttccattccataccaggtcactccagcctccacagccgaccagaccggcccggaccgcaccggagacccagcatggcgtat

SEQ ID NO: 382339 - DNA, 140 bp, Artificial Sequence
  Synthetic
atacgccatgctgggtctcctgcccttacaccgcagccgtcgctgcagacattggagaagccgcggtgttcttctcgggcctcgcgcccttgaggatgcatcctgatgtcagctgggcaacgtacttgggagtcggccat

SEQ ID NO: 382340 - DNA, 140 bp, Artificial Sequence
  Synthetic
atggccgactcccaagtacgttgcccagctgacatcaggatgcatcctcaagggcgcgaggcccgagaagaacaccgcggcttctccaatgtctgcagcgacggctgcggtgtaagggcaggagacccagcatggcgtat

SEQ ID NO: 382341 - DNA, 140 bp, Artificial Sequence
  Synthetic
atacgccatgctgggtctccaagtccgcggcgtaaactggcccctgctcgtgggcgttcagcggacgatgtgccgggagacactgtcgccagggccatcggacgacccacagtgggcaggcgtacttgggagtcggccat

SEQ ID NO: 382342 - DNA, 140 bp, Artificial Sequence
  Synthetic
atggccgactcccaagtacgcctgcccactgtgggtcgtccgatggccctggcgacagtgtctcccggcacatcgtccgctgaacgcccacgagcaggggccagtttacgccgcggacttggagacccagcatggcgtat

SEQ ID NO: 382343 - DNA, 140 bp, Artificial Sequence
  Synthetic
atacgccatgctgggtctccccttaaaggaccaaatcctgtcccgctactgctgaggtggggcaatgatttaccatcaaaggtggccggccaccacattgtagatgacctggtaaggaggcgtacttgggagtcggccat

SEQ ID NO: 382344 - DNA, 140 bp, Artificial Sequence
  Synthetic
atggccgactcccaagtacgcctccttaccaggtcatctacaatgtggtggccggccacctttgatggtaaatcattgccccacctcagcagtagcgggacaggatttggtcctttaaggggagacccagcatggcgtat

SEQ ID NO: 382345 - DNA, 140 bp, Artificial Sequence
  Synthetic
atacgccatgctgggtctccctcggtgtggcggagggttacgtccgctgcgatgcggggcccatcttgatggtgggcctggctattgcggggggcatgatctatgcgtcttacaccgggtcgtacttgggagtcggccat

SEQ ID NO: 382346 - DNA, 140 bp, Artificial Sequence
  Synthetic
atggccgactcccaagtacgacccggtgtaagacgcatagatcatgccccccgcaatagccaggcccaccatcaagatgggccccgcatcgcagcggacgtaaccctccgccacaccgagggagacccagcatggcgtat

SEQ ID NO: 382347 - DNA, 140 bp, Artificial Sequence
  Synthetic
atacgccatgctgggtctccctattgtggtggttacagactgggatgtgaaggggagtggcaaccccctttataggaatggagaccaggccactcctcaacctgtggtgcaggtcccccccgtacttgggagtcggccat

SEQ ID NO: 382348 - DNA, 140 bp, Artificial Sequence
  Synthetic
atggccgactcccaagtacgggggggacctgcaccacaggttgaggagtggcctggtctccattcctataaagggggttgccactccccttcacatcccagtctgtaaccaccacaatagggagacccagcatggcgtat

SEQ ID NO: 382349 - DNA, 140 bp, Artificial Sequence
  Synthetic
aggccctggctgctgatatgtataggaatggagaccaggccactcctcaacctgtggtgcaggtccccccggtagaccatcggccggggggggagtccgcgccatcagatgccaagacaggaccttttgggacagcggtg

SEQ ID NO: 382350 - DNA, 140 bp, Artificial Sequence
  Synthetic
caccgctgtcccaaaaggtcctgtcttggcatctgatggcgcggactccccccccggccgatggtctaccggggggacctgcaccacaggttgaggagtggcctggtctccattcctatacatatcagcagccagggcct

SEQ ID NO: 382351 - DNA, 140 bp, Artificial Sequence
  Synthetic
atacgccatgctgggtctcctgacagatgcggtggcggccattcaggtgaactgcgattggtcagtcatgaccctgtcgatcggggaagtgctggcgctggcccaggctaagacagtcgacgtacttgggagtcggccat

SEQ ID NO: 382352 - DNA, 140 bp, Artificial Sequence
  Synthetic
atggccgactcccaagtacgtcgactgtcttagcctgggccagcgccagcacttccccgatcgacagggtcatgactgaccaatcgcagttcacctgaatggccgccaccgcatctgtcaggagacccagcatggcgtat

SEQ ID NO: 382353 - DNA, 140 bp, Artificial Sequence
  Synthetic
atacgccatgctgggtctccggcctacgcagctaccaccaagtggctcgctggctgctacacggggacgcgggccgtccctactgtatccattgtggacaagctcttcgcagggggttggcgtacttgggagtcggccat

SEQ ID NO: 382354 - DNA, 140 bp, Artificial Sequence
  Synthetic
atggccgactcccaagtacgccaaccccctgcgaagagcttgtccacaatggatacagtagggacggcccgcgtccccgtgtagcagccagcgagccacttggtggtagctgcgtaggccggagacccagcatggcgtat

SEQ ID NO: 382355 - DNA, 140 bp, Artificial Sequence
  Synthetic
atacgccatgctgggtctccgcggctgtggttggtcattgtcacaacgtcatagctgcggcggtggctgcatacggggcttctcggagtcccccgttagctgcagccgcttcctacctcacgtacttgggagtcggccat

SEQ ID NO: 382356 - DNA, 140 bp, Artificial Sequence
  Synthetic
atggccgactcccaagtacgtgaggtaggaagcggctgcagctaacgggggactccgagaagccccgtatgcagccaccgccgcagctatgacgttgtgacaatgaccaaccacagccgcggagacccagcatggcgtat

SEQ ID NO: 382357 - DNA, 140 bp, Artificial Sequence
  Synthetic
aggccctggctgctgatatgatacggggcttctcggagtcccccgttagctgcagccgcttcctacctcatgggattgggcgtcgcaggcaacgcgcaggcgagactggcctcggctctcgaccttttgggacagcggtg

SEQ ID NO: 382358 - DNA, 140 bp, Artificial Sequence
  Synthetic
caccgctgtcccaaaaggtcgagagccgaggccagtctcgcctgcgcgttgcctgcgacgcccaatcccatgaggtaggaagcggctgcagctaacgggggactccgagaagccccgtatcatatcagcagccagggcct

SEQ ID NO: 382359 - DNA, 140 bp, Artificial Sequence
  Synthetic
atacgccatgctgggtctccctgttgggggccgctgggactgccctggggactcccgtcgtgggtttaaccatggcgggggccttcatgggcggagcgagcgtgtccccttctctagtcacgtacttgggagtcggccat

SEQ ID NO: 382360 - DNA, 140 bp, Artificial Sequence
  Synthetic
atggccgactcccaagtacgtgactagagaaggggacacgctcgctccgcccatgaaggcccccgccatggttaaacccacgacgggagtccccagggcagtcccagcggcccccaacagggagacccagcatggcgtat

SEQ ID NO: 382361 - DNA, 140 bp, Artificial Sequence
  Synthetic
atacgccatgctgggtctcccggttcttctcggagccgtgggtggttgggagggcgtggtcaatgccgccagccttgtcttcgacttcatgtcaggaaagttatcaactgaggacctgtgcgtacttgggagtcggccat

SEQ ID NO: 382362 - DNA, 140 bp, Artificial Sequence
  Synthetic
atggccgactcccaagtacgcacaggtcctcagttgataactttcctgacatgaagtcgaagacaaggctggcggcattgaccacgccctcccaaccacccacggctccgagaagaaccgggagacccagcatggcgtat

SEQ ID NO: 382363 - DNA, 140 bp, Artificial Sequence
  Synthetic
atacgccatgctgggtctccgtatgccatcccggtgctgactagccctggggcgggccttgcggggatcgctctgggactggttttgtactcagcaaacaactcagggactaccacttggcgtacttgggagtcggccat

SEQ ID NO: 382364 - DNA, 140 bp, Artificial Sequence
  Synthetic
atggccgactcccaagtacgccaagtggtagtccctgagttgtttgctgagtacaaaaccagtcccagagcgatccccgcaaggcccgccccagggctagtcagcaccgggatggcatacggagacccagcatggcgtat

SEQ ID NO: 382365 - DNA, 140 bp, Artificial Sequence
  Synthetic
atacgccatgctgggtctccttaaatcgtctgttgaccacgcttccgcggtcctcatgcatcccggatagttatttccaacaggccgactactgtgacaaggtctcagccatgttgcgtccgtacttgggagtcggccat

SEQ ID NO: 382366 - DNA, 140 bp, Artificial Sequence
  Synthetic
atggccgactcccaagtacggacgcaacatggctgagaccttgtcacagtagtcggcctgttggaaataactatccgggatgcatgaggaccgcggaagcgtggtcaacagacgatttaaggagacccagcatggcgtat

SEQ ID NO: 382367 - DNA, 140 bp, Artificial Sequence
  Synthetic
atacgccatgctgggtctccgtctgagcctcactcgcactgtggttgccctggttaacagggagcctaaagtggatgaggttcaggtgggctatgtctgggacttgtgggagtggatcatcgtacttgggagtcggccat

SEQ ID NO: 382368 - DNA, 140 bp, Artificial Sequence
  Synthetic
atggccgactcccaagtacgatgatccactcccacaagtcccagacatagcccacctgaacctcatccactttaggctccctgttaaccagggcaaccacagtgcgagtgaggctcagacggagacccagcatggcgtat

SEQ ID NO: 382369 - DNA, 140 bp, Artificial Sequence
  Synthetic
atacgccatgctgggtctccgcgccagattcgcatggtcatggccagactgcgggccctctgccccgtggtgtcactaccgttgtggcactgcggggaggggtggtccggagaatggttgcgtacttgggagtcggccat

SEQ ID NO: 382370 - DNA, 140 bp, Artificial Sequence
  Synthetic
atggccgactcccaagtacgcaaccattctccggaccacccctccccgcagtgccacaacggtagtgacaccacggggcagagggcccgcagtctggccatgaccatgcgaatctggcgcggagacccagcatggcgtat

SEQ ID NO: 382371 - DNA, 140 bp, Artificial Sequence
  Synthetic
atacgccatgctgggtctccttagacggtcatgtggagagtcgctgtctgtgtgggtgtgtgatcactggggatgtgttgaatgggcaactcaaagatccagtttactcaaccaagctgtcgtacttgggagtcggccat

SEQ ID NO: 382372 - DNA, 140 bp, Artificial Sequence
  Synthetic
atggccgactcccaagtacgacagcttggttgagtaaactggatctttgagttgcccattcaacacatccccagtgatcacacacccacacagacagcgactctccacatgaccgtctaaggagacccagcatggcgtat

SEQ ID NO: 382373 - DNA, 140 bp, Artificial Sequence
  Synthetic
aggccctggctgctgatatgggatgtgttgaatgggcaactcaaagatccagtttactcaaccaagctgtgcaggcactactggatggggaccgtgccggttaacatgcttgggtacggggaccttttgggacagcggtg

SEQ ID NO: 382374 - DNA, 140 bp, Artificial Sequence
  Synthetic
caccgctgtcccaaaaggtccccgtacccaagcatgttaaccggcacggtccccatccagtagtgcctgcacagcttggttgagtaaactggatctttgagttgcccattcaacacatcccatatcagcagccagggcct

SEQ ID NO: 382375 - DNA, 140 bp, Artificial Sequence
  Synthetic
atacgccatgctgggtctccgcaggcactactggatggggaccgtgccggttaacatgcttgggtacggggaaacctcgcctctcctagcttcggatacccccaaggtagtaccttttggcgtacttgggagtcggccat

SEQ ID NO: 382376 - DNA, 140 bp, Artificial Sequence
  Synthetic
atggccgactcccaagtacgccaaaaggtactaccttgggggtatccgaagctaggagaggcgaggtttccccgtacccaagcatgttaaccggcacggtccccatccagtagtgcctgcggagacccagcatggcgtat

SEQ ID NO: 382377 - DNA, 140 bp, Artificial Sequence
  Synthetic
atacgccatgctgggtctccgacatccggctgggcagaggtggtggtgacccccacccatgtggtggtccggcgcacttcctgttacaagttgcttcgccagcaaatactctctgctgctcgtacttgggagtcggccat

SEQ ID NO: 382378 - DNA, 140 bp, Artificial Sequence
  Synthetic
atggccgactcccaagtacgagcagcagagagtatttgctggcgaagcaacttgtaacaggaagtgcgccggaccaccacatgggtgggggtcaccaccacctctgcccagccggatgtcggagacccagcatggcgtat

SEQ ID NO: 382379 - DNA, 140 bp, Artificial Sequence
  Synthetic
atacgccatgctgggtctccgtagctgagccctactacgtcgatggcattccggtctcatgggaggcggacgctcgcgcgcccgcgatggtctacgggcctggccaaagcgtgaccattgcgtacttgggagtcggccat

SEQ ID NO: 382380 - DNA, 140 bp, Artificial Sequence
  Synthetic
atggccgactcccaagtacgcaatggtcacgctttggccaggcccgtagaccatcgcgggcgcgcgagcgtccgcctcccatgagaccggaatgccatcgacgtagtagggctcagctacggagacccagcatggcgtat

SEQ ID NO: 382381 - DNA, 140 bp, Artificial Sequence
  Synthetic
atacgccatgctgggtctccacggggaacgctacaccctcccgcaccagttgcggatgaggaatgttgcgccctctgaggtttcgtctgaggtcagtatcgagatcgggacggagtcggacgtacttgggagtcggccat

SEQ ID NO: 382382 - DNA, 140 bp, Artificial Sequence
  Synthetic
atggccgactcccaagtacgtccgactccgtcccgatctcgatactgacctcagacgaaacctcagagggcgcaacattcctcatccgcaactggtgcgggagggtgtagcgttccccgtggagacccagcatggcgtat

SEQ ID NO: 382383 - DNA, 140 bp, Artificial Sequence
  Synthetic
atacgccatgctgggtctccagacaccgaactgacagaggccgatttgccgccggcggctgctgcactccaagcgatcgagaatgctgcgagaatactcgaaccgcacattgatgtcatccgtacttgggagtcggccat

SEQ ID NO: 382384 - DNA, 140 bp, Artificial Sequence
  Synthetic
atggccgactcccaagtacggatgacatcaatgtgcggttcgagtattctcgcagcattctcgatcgcttggagtgcagcagccgccggcggcaaatcggcctctgtcagttcggtgtctggagacccagcatggcgtat

SEQ ID NO: 382385 - DNA, 140 bp, Artificial Sequence
  Synthetic
aggccctggctgctgatatgtgtgtggggagaagacataccccgcactccatcgcctgcacttatctcggttacggagagcagctcagatgagaagaccccgtcggtgtcctcctcgcaggaccttttgggacagcggtg

SEQ ID NO: 382386 - DNA, 140 bp, Artificial Sequence
  Synthetic
caccgctgtcccaaaaggtcctgcgaggaggacaccgacggggtcttctcatctgagctgctctccgtaaccgagataagtgcaggcgatggagtgcggggtatgtcttctccccacacacatatcagcagccagggcct

SEQ ID NO: 382387 - DNA, 140 bp, Artificial Sequence
  Synthetic
atacgccatgctgggtctccccttatctccacagagcgatgccacaaggaaactgaccgttaagatgtcatgctgtgtggagaagagcgtcacgcgctttttctccttgggattgacggtcgtacttgggagtcggccat

SEQ ID NO: 382388 - DNA, 140 bp, Artificial Sequence
  Synthetic
atggccgactcccaagtacgaccgtcaatcccaaggagaaaaagcgcgtgacgctcttctccacacagcatgacatcttaacggtcagtttccttgtggcatcgctctgtggagataaggggagacccagcatggcgtat

SEQ ID NO: 382389 - DNA, 140 bp, Artificial Sequence
  Synthetic
aggccctggctgctgatatgattgtgacaaggtgcgcactccgctcgaattgcaagttgggtgcttggtgggcaatgaacttacttttgaatgtgacaagtgtgaggcaagacaagagacgaccttttgggacagcggtg

SEQ ID NO: 382390 - DNA, 140 bp, Artificial Sequence
  Synthetic
caccgctgtcccaaaaggtcgtctcttgtcttgcctcacacttgtcacattcaaaagtaagttcattgcccaccaagcacccaacttgcaattcgagcggagtgcgcaccttgtcacaatcatatcagcagccagggcct

SEQ ID NO: 382391 - DNA, 140 bp, Artificial Sequence
  Synthetic
atacgccatgctgggtctcccttggcttccttctcctacatctggtcgggggtgccgctgacacgggctacaccggctaaaccaccagtggtgaggccggtggggtccctgttagtggcgcgtacttgggagtcggccat

SEQ ID NO: 382392 - DNA, 140 bp, Artificial Sequence
  Synthetic
atggccgactcccaagtacgcgccactaacagggaccccaccggcctcaccactggtggtttagccggtgtagcccgtgtcagcggcacccccgaccagatgtaggagaaggaagccaagggagacccagcatggcgtat

SEQ ID NO: 382393 - DNA, 140 bp, Artificial Sequence
  Synthetic
atacgccatgctgggtctccgacactaccaaagtgtacgtgacaaaccctgacaatgtggggaggcgggtcgacaaggtgactttctggcgtgctcccagggttcacgataagtttctcgcgtacttgggagtcggccat

SEQ ID NO: 382394 - DNA, 140 bp, Artificial Sequence
  Synthetic
atggccgactcccaagtacgcgagaaacttatcgtgaaccctgggagcacgccagaaagtcaccttgtcgacccgcctccccacattgtcagggtttgtcacgtacactttggtagtgtcggagacccagcatggcgtat

SEQ ID NO: 382395 - DNA, 140 bp, Artificial Sequence
  Synthetic
atacgccatgctgggtctcctggactctattgagcgcgccaggaaggcagctcaagcttgcctaagcatgggttacacttatgaggaggcaataaggactgttaggccgcatgctgccatcgtacttgggagtcggccat

SEQ ID NO: 382396 - DNA, 140 bp, Artificial Sequence
  Synthetic
atggccgactcccaagtacgatggcagcatgcggcctaacagtccttattgcctcctcataagtgtaacccatgcttaggcaagcttgagctgccttcctggcgcgctcaatagagtccaggagacccagcatggcgtat

SEQ ID NO: 382397 - DNA, 140 bp, Artificial Sequence
  Synthetic
aggccctggctgctgatatgggttacacttatgaggaggcaataaggactgttaggccgcatgctgccatgggctggggatctaaggtgtcggttaaggatctggccacccctgcggggagaccttttgggacagcggtg

SEQ ID NO: 382398 - DNA, 140 bp, Artificial Sequence
  Synthetic
caccgctgtcccaaaaggtctccccgcaggggtggccagatccttaaccgacaccttagatccccagcccatggcagcatgcggcctaacagtccttattgcctcctcataagtgtaacccatatcagcagccagggcct

SEQ ID NO: 382399 - DNA, 140 bp, Artificial Sequence
  Synthetic
atacgccatgctgggtctccagatggccgtccacgaccggctccaagagatacttgaagggactccggtcccctttacattgactgtgaaaaaggaggtgttcttcaaagaccgtaaggacgtacttgggagtcggccat

SEQ ID NO: 382400 - DNA, 140 bp, Artificial Sequence
  Synthetic
atggccgactcccaagtacgtccttacggtctttgaagaacacctcctttttcacagtcaatgtaaaggggaccggagtcccttcaagtatctcttggagccggtcgtggacggccatctggagacccagcatggcgtat

SEQ ID NO: 382401 - DNA, 140 bp, Artificial Sequence
  Synthetic
atacgccatgctgggtctccggagaaggccccccgcctcattgtgttcccgcccctcgacttccggatagctgaaaagctcatcttgggggatccggggcgtgtggccaaggcggtgttgcgtacttgggagtcggccat

SEQ ID NO: 382402 - DNA, 140 bp, Artificial Sequence
  Synthetic
atggccgactcccaagtacgcaacaccgccttggccacacgccccggatcccccaagatgagcttttcagctatccggaagtcgaggggcgggaacacaatgaggcggggggccttctccggagacccagcatggcgtat

SEQ ID NO: 382403 - DNA, 140 bp, Artificial Sequence
  Synthetic
atacgccatgctgggtctccgggggggcttacgccttccagtacaccccaaatcagcgggttagggagatgctgaagctgtgggagtcaaagaaaaccccgtgcgctatctgtgtggatgcgtacttgggagtcggccat

SEQ ID NO: 382404 - DNA, 140 bp, Artificial Sequence
  Synthetic
atggccgactcccaagtacgcatccacacagatagcgcacggggttttctttgactcccacagcttcagcatctccctaacccgctgatttggggtgtactggaaggcgtaagcccccccggagacccagcatggcgtat

SEQ ID NO: 382405 - DNA, 140 bp, Artificial Sequence
  Synthetic
atacgccatgctgggtctccccacgtgcttcgacagttccataactgaagaggacgtggcactggagaccgagctatacgctctggcttccgaccgcccggagtgggtgcgggccttgggcgtacttgggagtcggccat

SEQ ID NO: 382406 - DNA, 140 bp, Artificial Sequence
  Synthetic
atggccgactcccaagtacgcccaaggcccgcacccactccgggcggtcggaagccagagcgtatagctcggtctccagtgccacgtcctcttcagttatggaactgtcgaagcacgtggggagacccagcatggcgtat

SEQ ID NO: 382407 - DNA, 140 bp, Artificial Sequence
  Synthetic
atacgccatgctgggtctccgaaatactatgcctctggtaccatggttaccccggaaggggtgcccgtgggcgagaggtactgtagatcctcaggggtcttgaccaccagtgcaagcaaccgtacttgggagtcggccat

SEQ ID NO: 382408 - DNA, 140 bp, Artificial Sequence
  Synthetic
atggccgactcccaagtacggttgcttgcactggtggtcaagacccctgaggatctacagtacctctcgcccacgggcaccccttccggggtaaccatggtaccagaggcatagtatttcggagacccagcatggcgtat

SEQ ID NO: 382409 - DNA, 140 bp, Artificial Sequence
  Synthetic
atacgccatgctgggtctcctgcttgacctgctacattaaggtgaaagccgcatgtgagagggtgggccttaaaaacgtctcccttctcattgctggcgatgactgtctgatcatatgcgcgtacttgggagtcggccat

SEQ ID NO: 382410 - DNA, 140 bp, Artificial Sequence
  Synthetic
atggccgactcccaagtacgcgcatatgatcagacagtcatcgccagcaatgagaagggagacgtttttaaggcccaccctctcacatgcggctttcaccttaatgtagcaggtcaagcaggagacccagcatggcgtat

SEQ ID NO: 382411 - DNA, 140 bp, Artificial Sequence
  Synthetic
atacgccatgctgggtctccagaggcctatatgcgacccgagcgaggccctgggcagagccctggcttcgtacgggtatgcgtgtgagccctcgtatcatgcatcattggacacggcccccgtacttgggagtcggccat

SEQ ID NO: 382412 - DNA, 140 bp, Artificial Sequence
  Synthetic
atggccgactcccaagtacgggggccgtgtccaatgatgcatgatacgagggctcacacgcatacccgtacgaagccagggctctgcccagggcctcgctcgggtcgcatataggcctctggagacccagcatggcgtat

SEQ ID NO: 382413 - DNA, 140 bp, Artificial Sequence
  Synthetic
atacgccatgctgggtctcccttctgctccacttggcttgctgagtgtaatgcagatgggaagcgccatttcttccttaccacggactttcggagaccgctggcacgtatgtccagcgagcgtacttgggagtcggccat

SEQ ID NO: 382414 - DNA, 140 bp, Artificial Sequence
  Synthetic
atggccgactcccaagtacgctcgctggacatacgtgccagcggtctccgaaagtccgtggtaaggaagaaatggcgcttcccatctgcattacactcagcaagccaagtggagcagaagggagacccagcatggcgtat

SEQ ID NO: 382415 - DNA, 140 bp, Artificial Sequence
  Synthetic
atacgccatgctgggtctcctacagtgaccctatggcttcggccattggttacattctcctctacccctggcatcccatcacacggtgggtcatcatccctcacgtgctaacgtgcgcgtcgtacttgggagtcggccat

SEQ ID NO: 382416 - DNA, 140 bp, Artificial Sequence
  Synthetic
atggccgactcccaagtacgacgcgcacgttagcacgtgagggatgatgacccaccgtgtgatgggatgccaggggtagaggagaatgtaaccaatggccgaagccatagggtcactgtaggagacccagcatggcgtat

SEQ ID NO: 382417 - DNA, 140 bp, Artificial Sequence
  Synthetic
atacgccatgctgggtctccttaggggtggtggaacaccgtctgatccggtttggtgtcaggtgcatggcaattactacaagtttcccttggacaaactgcccaacatcatcgtggccctcgtacttgggagtcggccat

SEQ ID NO: 382418 - DNA, 140 bp, Artificial Sequence
  Synthetic
atggccgactcccaagtacgagggccacgatgatgttgggcagtttgtccaagggaaacttgtagtaattgccatgcacctgacaccaaaccggatcagacggtgttccaccacccctaaggagacccagcatggcgtat

SEQ ID NO: 382419 - DNA, 140 bp, Artificial Sequence
  Synthetic
aggccctggctgctgatatgaattactacaagtttcccttggacaaactgcccaacatcatcgtggccctccacggaccagcagcgttgagggttaccgcagacactaccaaaaccaaaagaccttttgggacagcggtg

SEQ ID NO: 382420 - DNA, 140 bp, Artificial Sequence
  Synthetic
caccgctgtcccaaaaggtcttttggttttggtagtgtctgcggtaaccctcaacgctgctggtccgtggagggccacgatgatgttgggcagtttgtccaagggaaacttgtagtaattcatatcagcagccagggcct

SEQ ID NO: 382421 - DNA, 140 bp, Artificial Sequence
  Synthetic
atacgccatgctgggtctcctggaagccggcagggtgctgagcgacttaaagctcccaggcctggctgtccaccgcaagaaggccggagcactacggacacgtatgcttcggtcgcgcggcgtacttgggagtcggccat

SEQ ID NO: 382422 - DNA, 140 bp, Artificial Sequence
  Synthetic
atggccgactcccaagtacgccgcgcgaccgaagcatacgtgtccgtagtgctccggccttcttgcggtggacagccaggcctgggagctttaagtcgctcagcaccctgccggcttccaggagacccagcatggcgtat

SEQ ID NO: 382423 - DNA, 140 bp, Artificial Sequence
  Synthetic
aggccctggctgctgatatgcaccgcaagaaggccggagcactacggacacgtatgcttcggtcgcgcggttgggcagagctggccaggggcctgttgtggcatccaggcctccggctccgaccttttgggacagcggtg

SEQ ID NO: 382424 - DNA, 140 bp, Artificial Sequence
  Synthetic
caccgctgtcccaaaaggtcggagccggaggcctggatgccacaacaggcccctggccagctctgcccaaccgcgcgaccgaagcatacgtgtccgtagtgctccggccttcttgcggtgcatatcagcagccagggcct

SEQ ID NO: 382425 - DNA, 140 bp, Artificial Sequence
  Synthetic
atacgccatgctgggtctccccccccccgagattgctggtatcccgggtggcttccctttgtcccctccctacatgggagtggtacaccaattggatttcacagcccagcggagtccctgcgtacttgggagtcggccat

SEQ ID NO: 382426 - DNA, 140 bp, Artificial Sequence
  Synthetic
atggccgactcccaagtacgcagggactccgctgggctgtgaaatccaattggtgtaccactcccatgtagggaggggacaaagggaagccacccgggataccagcaatctcggggggggggagacccagcatggcgtat

SEQ ID NO: 382427 - DNA, 140 bp, Artificial Sequence
  Synthetic
atacgccatgctgggtctccgcggtggctggggttcttagccctgctcatcgtagcgctctttgggtgaactaaattcatctgttgcggcaaggttgggtgactgatcatcacctgaggacgtacttgggagtcggccat

SEQ ID NO: 382428 - DNA, 140 bp, Artificial Sequence
  Synthetic
atggccgactcccaagtacgtcctcaggtgatgatcagtcacccaaccttgccgcaacagatgaatttagttcacccaaagagcgctacgatgagcagggctaagaaccccagccaccgcggagacccagcatggcgtat

SEQ ID NO: 382429 - DNA, 140 bp, Artificial Sequence
  Synthetic
aggccctggctgctgatatgtaatccgtgactacgggctgctcgcagagccctccccggatggggcacagtgcactgtgatctgaaggggtgcaccccggtaagagctcggcccaaaggcgaccttttgggacagcggtg

SEQ ID NO: 382430 - DNA, 140 bp, Artificial Sequence
  Synthetic
caccgctgtcccaaaaggtcgcctttgggccgagctcttaccggggtgcaccccttcagatcacagtgcactgtgccccatccggggagggctctgcgagcagcccgtagtcacggattacatatcagcagccagggcct

SEQ ID NO: 382431 - DNA, 140 bp, Artificial Sequence
  Synthetic
atacgccatgctgggtctccgggcgcgattccaagctcgatgtgtggagtttggtgccgactggttctgctagttgcaccatagccgccctcgggacttcggaccgtgacaccgtggttgcgtacttgggagtcggccat

SEQ ID NO: 382432 - DNA, 140 bp, Artificial Sequence
  Synthetic
atggccgactcccaagtacgcaaccacggtgtcacggtccgaagtcccgagggcggctatggtgcaactagcagaaccagtcggcaccaaactccacacatcgagcttggaatcgcgcccggagacccagcatggcgtat

SEQ ID NO: 382433 - DNA, 140 bp, Artificial Sequence
  Synthetic
atacgccatgctgggtctcctgacagatgcggtggcagccattcaggtgaactgcgattggtcagtcatgaccctgtcgatcggggaagtgctgacgctggcccaggctaagacagccgacgtacttgggagtcggccat

SEQ ID NO: 382434 - DNA, 140 bp, Artificial Sequence
  Synthetic
atggccgactcccaagtacgtcggctgtcttagcctgggccagcgtcagcacttccccgatcgacagggtcatgactgaccaatcgcagttcacctgaatggctgccaccgcatctgtcaggagacccagcatggcgtat

SEQ ID NO: 382435 - DNA, 140 bp, Artificial Sequence
  Synthetic
atacgccatgctgggtctccgcggctgtggttggccattgtcacagcgtcatagctgcggcggtggctgcatacggggcttctcggagtcccccgttagctgcagccgcttcctacctcacgtacttgggagtcggccat

SEQ ID NO: 382436 - DNA, 140 bp, Artificial Sequence
  Synthetic
atggccgactcccaagtacgtgaggtaggaagcggctgcagctaacgggggactccgagaagccccgtatgcagccaccgccgcagctatgacgctgtgacaatggccaaccacagccgcggagacccagcatggcgtat

SEQ ID NO: 382437 - DNA, 140 bp, Artificial Sequence
  Synthetic
aggccctggctgctgatatgatacggggcttctcggagtcccccgttagctgcagccgcttcctacctcatgggattgggcgttggaggcaacgcgcaggcgagactggcctcggctctcgaccttttgggacagcggtg

SEQ ID NO: 382438 - DNA, 140 bp, Artificial Sequence
  Synthetic
caccgctgtcccaaaaggtcgagagccgaggccagtctcgcctgcgcgttgcctccaacgcccaatcccatgaggtaggaagcggctgcagctaacgggggactccgagaagccccgtatcatatcagcagccagggcct

SEQ ID NO: 382439 - DNA, 140 bp, Artificial Sequence
  Synthetic
atacgccatgctgggtctccgcaggcactactggatggggactgtgccggttaacatgcttgggtacggggaaacctcgcctctcctagcttcggatactcccaaggtagtaccttttggcgtacttgggagtcggccat

SEQ ID NO: 382440 - DNA, 140 bp, Artificial Sequence
  Synthetic
atggccgactcccaagtacgccaaaaggtactaccttgggagtatccgaagctaggagaggcgaggtttccccgtacccaagcatgttaaccggcacagtccccatccagtagtgcctgcggagacccagcatggcgtat

SEQ ID NO: 382441 - DNA, 140 bp, Artificial Sequence
  Synthetic
atacgccatgctgggtctccgaggacaccccgtcctcggactcatttgaagtcatccaagagtctgatacagctgagagtgaggaaagcgtcttcaacgtggctctttccgtactaaaagcgtacttgggagtcggccat

SEQ ID NO: 382442 - DNA, 140 bp, Artificial Sequence
  Synthetic
atggccgactcccaagtacgcttttagtacggaaagagccacgttgaagacgctttcctcactctcagctgtatcagactcttggatgacttcaaatgagtccgaggacggggtgtcctcggagacccagcatggcgtat

SEQ ID NO: 382443 - DNA, 140 bp, Artificial Sequence
  Synthetic
aggccctggctgctgatatgattgtgacaaggtgcgcactccgctcgaattgcaagttgggtgcttggtgggcaatgaacttacctttgaatgcgacaagtgtgaggcaagacaagggacgaccttttgggacagcggtg

SEQ ID NO: 382444 - DNA, 140 bp, Artificial Sequence
  Synthetic
caccgctgtcccaaaaggtcgtcccttgtcttgcctcacacttgtcgcattcaaaggtaagttcattgcccaccaagcacccaacttgcaattcgagcggagtgcgcaccttgtcacaatcatatcagcagccagggcct

SEQ ID NO: 382445 - DNA, 140 bp, Artificial Sequence
  Synthetic
atacgccatgctgggtctcctggactctatcgagcgcgccaggaaggctgctcaagcttgcctaagcatgggttacacttatgaggaggcaataaggactgttaggccgcatgctgccatcgtacttgggagtcggccat

SEQ ID NO: 382446 - DNA, 140 bp, Artificial Sequence
  Synthetic
atggccgactcccaagtacgatggcagcatgcggcctaacagtccttattgcctcctcataagtgtaacccatgcttaggcaagcttgagcagccttcctggcgcgctcgatagagtccaggagacccagcatggcgtat

SEQ ID NO: 382447 - DNA, 140 bp, Artificial Sequence
  Synthetic
aggccctggctgctgatatgggttacacttatgaggaggcaataaggactgttaggccgcatgctgccatgggctggggatctaaagtgtcagttaaggatctggccacccctgcggggagaccttttgggacagcggtg

SEQ ID NO: 382448 - DNA, 140 bp, Artificial Sequence
  Synthetic
caccgctgtcccaaaaggtctccccgcaggggtggccagatccttaactgacactttagatccccagcccatggcagcatgcggcctaacagtccttattgcctcctcataagtgtaacccatatcagcagccagggcct

SEQ ID NO: 382449 - DNA, 140 bp, Artificial Sequence
  Synthetic
atacgccatgctgggtctccccccccccgaaattgctggtatcccgggtggcttccctttgtcccctccctacatgggagtggtacaccaattggatttcacagcccagcggagtcgctgcgtacttgggagtcggccat

SEQ ID NO: 382450 - DNA, 140 bp, Artificial Sequence
  Synthetic
atggccgactcccaagtacgcagcgactccgctgggctgtgaaatccaattggtgtaccactcccatgtagggaggggacaaagggaagccacccgggataccagcaatttcggggggggggagacccagcatggcgtat

SEQ ID NO: 382451 - DNA, 140 bp, Artificial Sequence
  Synthetic
atacgccatgctgggtctccaagccccagaaaccgacgcctatctaagtagacgcaatgactcggcgccgactcggcgaccggccaaaaggtggtggatgggtgatgacagggttggtagcgtacttgggagtcggccat

SEQ ID NO: 382452 - DNA, 140 bp, Artificial Sequence
  Synthetic
atggccgactcccaagtacgctaccaaccctgtcatcacccatccaccaccttttggccggtcgccgagtcggcgccgagtcattgcgtctacttagataggcgtcggtttctggggcttggagacccagcatggcgtat

SEQ ID NO: 382453 - DNA, 140 bp, Artificial Sequence
  Synthetic
aggccctggctgctgatatgactcggcgaccggccaaaaggtggtggatgggtgatgacagggttggtaggtcgtaaatcccggtcatcctggtagccactataggtgggtcttaagagagaccttttgggacagcggtg

SEQ ID NO: 382454 - DNA, 140 bp, Artificial Sequence
  Synthetic
caccgctgtcccaaaaggtctctcttaagacccacctatagtggctaccaggatgaccgggatttacgacctaccaaccctgtcatcacccatccaccaccttttggccggtcgccgagtcatatcagcagccagggcct

SEQ ID NO: 382455 - DNA, 140 bp, Artificial Sequence
  Synthetic
atacgccatgctgggtctccaggttaagattcctcttgtgcctgcggcgagaccgcgcacggtccacaggtgttggccctaccggtgtgaataagggcccgacgtcaggctcgtcgttaacgtacttgggagtcggccat

SEQ ID NO: 382456 - DNA, 140 bp, Artificial Sequence
  Synthetic
atggccgactcccaagtacgttaacgacgagcctgacgtcgggcccttattcacaccggtagggccaacacctgtggaccgtgcgcggtctcgccgcaggcacaagaggaatcttaacctggagacccagcatggcgtat

SEQ ID NO: 382457 - DNA, 140 bp, Artificial Sequence
  Synthetic
atacgccatgctgggtctccaccgagcccgttacccacctgggcaaacgacgcccacgtacggtccacgtcgcccttcaatgtctctcttgaccaataggcttagccggcgagttgacaacgtacttgggagtcggccat

SEQ ID NO: 382458 - DNA, 140 bp, Artificial Sequence
  Synthetic
atggccgactcccaagtacgttgtcaactcgccggctaagcctattggtcaagagagacattgaagggcgacgtggaccgtacgtgggcgtcgtttgcccaggtgggtaacgggctcggtggagacccagcatggcgtat

SEQ ID NO: 382459 - DNA, 140 bp, Artificial Sequence
  Synthetic
atacgccatgctgggtctccggaccagtgggggccgggggctatggagatggactccaagtcctgcccttcccggtggggcgggaaatgcatggggccacccagctccgcggcggcctgccgtacttgggagtcggccat

SEQ ID NO: 382460 - DNA, 140 bp, Artificial Sequence
  Synthetic
atggccgactcccaagtacggcaggccgccgcggagctgggtggccccatgcatttcccgccccaccgggaagggcaggacttggagtccatctccatagcccccggcccccactggtccggagacccagcatggcgtat

SEQ ID NO: 382461 - DNA, 140 bp, Artificial Sequence
  Synthetic
atacgccatgctgggtctccagccggggtagcccaagaacccttcgggtgagggcgggtggcatttttcttttctataccatcatggcagtccttctgctccttctcgtggttgaggccgcgtacttgggagtcggccat

SEQ ID NO: 382462 - DNA, 140 bp, Artificial Sequence
  Synthetic
atggccgactcccaagtacgcggcctcaaccacgagaaggagcagaaggactgccatgatggtatagaaaagaaaaatgccacccgccctcacccgaagggttcttgggctaccccggctggagacccagcatggcgtat

SEQ ID NO: 382463 - DNA, 140 bp, Artificial Sequence
  Synthetic
atacgccatgctgggtctccgggccattttagccccggccacccacgcttgtcgagcgaatgggcaatacttccttacaaattgttgcgccccggaggacatcgggttctgcctggaaggcgtacttgggagtcggccat

SEQ ID NO: 382464 - DNA, 140 bp, Artificial Sequence
  Synthetic
atggccgactcccaagtacgccttccaggcagaacccgatgtcctccggggcgcaacaatttgtaaggaagtattgcccattcgctcgacaagcgtgggtggccggggctaaaatggcccggagacccagcatggcgtat

SEQ ID NO: 382465 - DNA, 140 bp, Artificial Sequence
  Synthetic
aggccctggctgctgatatgttccttacaaattgttgcgccccggaggacatcgggttctgcctggaaggtggatgcctggtggccttgggatgcacagtttgcactgaccaatgctggcgaccttttgggacagcggtg

SEQ ID NO: 382466 - DNA, 140 bp, Artificial Sequence
  Synthetic
caccgctgtcccaaaaggtcgccagcattggtcagtgcaaactgtgcatcccaaggccaccaggcatccaccttccaggcagaacccgatgtcctccggggcgcaacaatttgtaaggaacatatcagcagccagggcct

SEQ ID NO: 382467 - DNA, 140 bp, Artificial Sequence
  Synthetic
atacgccatgctgggtctcccactgtatcaggcgggtttggctgtgcggcctggcaagtccgcggcccaactggtgggggagctgggtagcctatacgggcccttgtcggtctcggcctacgtacttgggagtcggccat

SEQ ID NO: 382468 - DNA, 140 bp, Artificial Sequence
  Synthetic
atggccgactcccaagtacgtaggccgagaccgacaagggcccgtataggctacccagctcccccaccagttgggccgcggacttgccaggccgcacagccaaacccgcctgatacagtgggagacccagcatggcgtat

SEQ ID NO: 382469 - DNA, 140 bp, Artificial Sequence
  Synthetic
atacgccatgctgggtctcccgtggctgggatcctgggcctgggcgaggtttactcgggtgtcctaacggtgggcgtcgcgttgacgcgtcgggtctacccggtgcccaacctgacgtgtcgtacttgggagtcggccat

SEQ ID NO: 382470 - DNA, 140 bp, Artificial Sequence
  Synthetic
atggccgactcccaagtacgacacgtcaggttgggcaccgggtagacccgacgcgtcaacgcgacgcccaccgttaggacacccgagtaaacctcgcccaggcccaggatcccagccacgggagacccagcatggcgtat

SEQ ID NO: 382471 - DNA, 140 bp, Artificial Sequence
  Synthetic
atacgccatgctgggtctccgcagtagagtgtgagcttaagtgggaaagtgagttttggagatggactgaacagttggcctccaattactggattctggaatacctttggaaggtcccatcgtacttgggagtcggccat

SEQ ID NO: 382472 - DNA, 140 bp, Artificial Sequence
  Synthetic
atggccgactcccaagtacgatgggaccttccaaaggtattccagaatccagtaattggaggccaactgttcagtccatctccaaaactcactttcccacttaagctcacactctactgcggagacccagcatggcgtat

SEQ ID NO: 382473 - DNA, 140 bp, Artificial Sequence
  Synthetic
atacgccatgctgggtctccttgacttctggaggggcgtgatgagcctgacccctctgttggtctgtgtggccgctctgctgctgcttgagcaaaggattgttatggtcttcctgctggtcgtacttgggagtcggccat

SEQ ID NO: 382474 - DNA, 140 bp, Artificial Sequence
  Synthetic
atggccgactcccaagtacgaccagcaggaagaccataacaatcctttgctcaagcagcagcagagcggccacacagaccaacagaggggtcaggctcatcacgcccctccagaagtcaaggagacccagcatggcgtat

SEQ ID NO: 382475 - DNA, 140 bp, Artificial Sequence
  Synthetic
atacgccatgctgggtctccgaccatggccgggatgtcgcaaggcgcccctgcttcggttttggggtcacgcccctttgactacgggttgacttggcagacctgctcttgcaaggcgaaccgtacttgggagtcggccat

SEQ ID NO: 382476 - DNA, 140 bp, Artificial Sequence
  Synthetic
atggccgactcccaagtacggttcgccttgcaagagcaggtctgccaagtcaacccgtagtcaaaggggcgtgaccccaaaaccgaagcaggggcgccttgcgacatcccggccatggtcggagacccagcatggcgtat

SEQ ID NO: 382477 - DNA, 140 bp, Artificial Sequence
  Synthetic
atacgccatgctgggtctccggctcacgcattccgactggggaaaaggtgtgggaccgcgggaatgtcacgcttctgtgtgattgccccaacggaccatgggtgtggttaccggctttctcgtacttgggagtcggccat

SEQ ID NO: 382478 - DNA, 140 bp, Artificial Sequence
  Synthetic
atggccgactcccaagtacgagaaagccggtaaccacacccatggtccgttggggcaatcacacagaagcgtgacattcccgcggtcccacaccttttccccagtcggaatgcgtgagccggagacccagcatggcgtat

SEQ ID NO: 382479 - DNA, 140 bp, Artificial Sequence
  Synthetic
atacgccatgctgggtctccgccaagcagttggctggggtgatcctatcacccattggagccacggacaaaatcggtggcccctctcatgccctcagtatgtctatgggtctgtttcagtcgtacttgggagtcggccat

SEQ ID NO: 382480 - DNA, 140 bp, Artificial Sequence
  Synthetic
atggccgactcccaagtacgactgaaacagacccatagacatactgagggcatgagaggggccaccgattttgtccgtggctccaatgggtgataggatcaccccagccaactgcttggcggagacccagcatggcgtat

SEQ ID NO: 382481 - DNA, 140 bp, Artificial Sequence
  Synthetic
atacgccatgctgggtctcccacttgcgtgtggggctccgcgtcttggtttgcctccactggtggacgcgattcgaagatcgatgtgtggagtttggtgccagttggttctgccacttgccgtacttgggagtcggccat

SEQ ID NO: 382482 - DNA, 140 bp, Artificial Sequence
  Synthetic
atggccgactcccaagtacggcaagtggcagaaccaactggcaccaaactccacacatcgatcttcgaatcgcgtccaccagtggaggcaaaccaagacgcggagccccacacgcaagtgggagacccagcatggcgtat

SEQ ID NO: 382483 - DNA, 140 bp, Artificial Sequence
  Synthetic
atacgccatgctgggtctccaccatagccgctctcgggtcgtcggaccgcgatacggtggtggagctctccgagtggggggtcccgtgcgtgacgtgcattctggatcgtcggcctgcctcgtacttgggagtcggccat

SEQ ID NO: 382484 - DNA, 140 bp, Artificial Sequence
  Synthetic
atggccgactcccaagtacgaggcaggccgacgatccagaatgcacgtcacgcacgggaccccccactcggagagctccaccaccgtatcgcggtccgacgacccgagagcggctatggtggagacccagcatggcgtat

SEQ ID NO: 382485 - DNA, 140 bp, Artificial Sequence
  Synthetic
atacgccatgctgggtctcccctgcggcacctgtgtgagggactgctggcccgagactgggtcggtcagattcccattccataggtgtggcacggggcctcggctgacaaaggacttggacgtacttgggagtcggccat

SEQ ID NO: 382486 - DNA, 140 bp, Artificial Sequence
  Synthetic
atggccgactcccaagtacgtccaagtcctttgtcagccgaggccccgtgccacacctatggaatgggaatctgaccgacccagtctcgggccagcagtccctcacacaggtgccgcaggggagacccagcatggcgtat

SEQ ID NO: 382487 - DNA, 140 bp, Artificial Sequence
  Synthetic
atacgccatgctgggtctccagctgtgcccttcgtcaataggacaactcccttcaccattagggggcctctgggcaaccagggccgaggcaacccggtgcggtcgcccttgggttttgggcgtacttgggagtcggccat

SEQ ID NO: 382488 - DNA, 140 bp, Artificial Sequence
  Synthetic
atggccgactcccaagtacgcccaaaacccaagggcgaccgcaccgggttgcctcggccctggttgcccagaggccccctaatggtgaagggagttgtcctattgacgaagggcacagctggagacccagcatggcgtat

SEQ ID NO: 382489 - DNA, 140 bp, Artificial Sequence
  Synthetic
atacgccatgctgggtctcctcctacaccatgaccaagatccgagacaccctacatttggtgaaatgtcccacaccagccattgagcctcccaccgggacgtttgggttcttccccgggacgtacttgggagtcggccat

SEQ ID NO: 382490 - DNA, 140 bp, Artificial Sequence
  Synthetic
atggccgactcccaagtacgtcccggggaagaacccaaacgtcccggtgggaggctcaatggctggtgtgggacatttcaccaaatgtagggtgtctcggatcttggtcatggtgtaggaggagacccagcatggcgtat

SEQ ID NO: 382491 - DNA, 140 bp, Artificial Sequence
  Synthetic
atacgccatgctgggtctcccgccgcccctcaacaactgcatgcttctaggcacggaagtgtctgaggcactcggcggggctggtctcacggggggtttctatgaacccctggtgcgcagcgtacttgggagtcggccat

SEQ ID NO: 382492 - DNA, 140 bp, Artificial Sequence
  Synthetic
atggccgactcccaagtacgctgcgcaccaggggttcatagaaaccccccgtgagaccagccccgccgagtgcctcagacacttccgtgcctagaagcatgcagttgttgaggggcggcgggagacccagcatggcgtat

SEQ ID NO: 382493 - DNA, 140 bp, Artificial Sequence
  Synthetic
atacgccatgctgggtctccgtgttcggagctgatgggacgccgaaatccggtttgtccggggtttgcatggctctcctcgggcaggcctgatgggttcatacatgtccagggccacttgcgtacttgggagtcggccat

SEQ ID NO: 382494 - DNA, 140 bp, Artificial Sequence
  Synthetic
atggccgactcccaagtacgcaagtggccctggacatgtatgaacccatcaggcctgcccgaggagagccatgcaaaccccggacaaaccggatttcggcgtcccatcagctccgaacacggagacccagcatggcgtat

SEQ ID NO: 382495 - DNA, 140 bp, Artificial Sequence
  Synthetic
atacgccatgctgggtctcccaggaggtggatgcaggcaacttcattccgcccccgcgctggctgctcttggactttgtatttgtcctgttatacctgatgaagctggctgaggctcggtcgtacttgggagtcggccat

SEQ ID NO: 382496 - DNA, 140 bp, Artificial Sequence
  Synthetic
atggccgactcccaagtacgaccgagcctcagccagcttcatcaggtataacaggacaaatacaaagtccaagagcagccagcgcgggggcggaatgaagttgcctgcatccacctcctgggagacccagcatggcgtat

SEQ ID NO: 382497 - DNA, 140 bp, Artificial Sequence
  Synthetic
atacgccatgctgggtctcctggtcccgctgatcttgcttctgctgtggtggtgggtgaaccagctggcggttttaggactgccggctgtggacgccgccgtagcaggtgaggtctttgccgtacttgggagtcggccat

SEQ ID NO: 382498 - DNA, 140 bp, Artificial Sequence
  Synthetic
atggccgactcccaagtacggcaaagacctcacctgctacggcggcgtccacagccggcagtcctaaaaccgccagctggttcacccaccaccacagcagaagcaagatcagcgggaccaggagacccagcatggcgtat

SEQ ID NO: 382499 - DNA, 140 bp, Artificial Sequence
  Synthetic
atacgccatgctgggtctccgggccctgccctgtcctggtgtctgggactcccgactgtcagtatgatactgggtctagcaaacctggtgttgtactttagatggctgggaccccaacgccgtacttgggagtcggccat

SEQ ID NO: 382500 - DNA, 140 bp, Artificial Sequence
  Synthetic
atggccgactcccaagtacggcgttggggtcccagccatctaaagtacaacaccaggtttgctagacccagtatcatactgacagtcgggagtcccagacaccaggacagggcagggcccggagacccagcatggcgtat

SEQ ID NO: 382501 - DNA, 140 bp, Artificial Sequence
  Synthetic
atacgccatgctgggtctcccttatgttccttgtgttgtggaagctcgctcggggagctttcccgctggcacttctgatggggatttcggcgactcgcgggcgcacctccgtgctcggggcgtacttgggagtcggccat

SEQ ID NO: 382502 - DNA, 140 bp, Artificial Sequence
  Synthetic
atggccgactcccaagtacgccccgagcacggaggtgcgcccgcgagtcgccgaaatccccatcagaagtgccagcgggaaagctccccgagcgagcttccacaacacaaggaacataagggagacccagcatggcgtat

SEQ ID NO: 382503 - DNA, 140 bp, Artificial Sequence
  Synthetic
atacgccatgctgggtctccccgagttctgcttcgatgctacattcgaggtggacacttcggtgttgggctgggtggtggccagcgtggtggcttgggccatagcgctcctgagctcgatcgtacttgggagtcggccat

SEQ ID NO: 382504 - DNA, 140 bp, Artificial Sequence
  Synthetic
atggccgactcccaagtacgatcgagctcaggagcgctatggcccaagccaccacgctggccaccacccagcccaacaccgaagtgtccacctcgaatgtagcatcgaagcagaactcggggagacccagcatggcgtat

SEQ ID NO: 382505 - DNA, 140 bp, Artificial Sequence
  Synthetic
atacgccatgctgggtctccgagcgcaggggggtggaggcacaaagccgtgatctataggacgtggtgtaaagggtaccaggctatacgccagagagtggttcggagccccttcggggagcgtacttgggagtcggccat

SEQ ID NO: 382506 - DNA, 140 bp, Artificial Sequence
  Synthetic
atggccgactcccaagtacgctccccgaaggggctccgaaccactctctggcgtatagcctggtaccctttacaccacgtcctatagatcacggctttgtgcctccacccccctgcgctcggagacccagcatggcgtat

SEQ ID NO: 382507 - DNA, 140 bp, Artificial Sequence
  Synthetic
atacgccatgctgggtctccgggcgacctactaagcctctgactttcgcttggtgcttggcctcgtacatctggccggatgctgtgatgatggtggtggtcgccttggtcttactctttgcgtacttgggagtcggccat

SEQ ID NO: 382508 - DNA, 140 bp, Artificial Sequence
  Synthetic
atggccgactcccaagtacgcaaagagtaagaccaaggcgaccaccaccatcatcacagcatccggccagatgtacgaggccaagcaccaagcgaaagtcagaggcttagtaggtcgcccggagacccagcatggcgtat

SEQ ID NO: 382509 - DNA, 140 bp, Artificial Sequence
  Synthetic
atacgccatgctgggtctccgcctgttcgatgcgttggactgggctttggaggagatcttggtgtcccggccctcgttgcgccgtttggctcgggtgatcgagtgctgtgtgatggcgggcgtacttgggagtcggccat

SEQ ID NO: 382510 - DNA, 140 bp, Artificial Sequence
  Synthetic
atggccgactcccaagtacgcccgccatcacacagcactcgatcacccgagccaaacggcgcaacgagggccgggacaccaagatctcctccaaagcccagtccaacgcatcgaacaggcggagacccagcatggcgtat

SEQ ID NO: 382511 - DNA, 140 bp, Artificial Sequence
  Synthetic
atacgccatgctgggtctcctgagaaggccacaactgtccggctggtctccaagatgtgcgcgagaggggcctacttgttcgatcatatgggctcattttcgcgcgctgtcaaggagcgccgtacttgggagtcggccat

SEQ ID NO: 382512 - DNA, 140 bp, Artificial Sequence
  Synthetic
atggccgactcccaagtacggcgctccttgacagcgcgcgaaaatgagcccatatgatcgaacaagtaggcccctctcgcgcacatcttggagaccagccggacagttgtggccttctcaggagacccagcatggcgtat

SEQ ID NO: 382513 - DNA, 140 bp, Artificial Sequence
  Synthetic
atacgccatgctgggtctccctgttggagtgggacgcggctcttgaacctctgtcattcactaggacggactgtcgcattataagagatgccgctaggactttgtcttgcggacagtgcgcgtacttgggagtcggccat

SEQ ID NO: 382514 - DNA, 140 bp, Artificial Sequence
  Synthetic
atggccgactcccaagtacgcgcactgtccgcaagacaaagtcctagcggcatctcttataatgcgacagtccgtcctagtgaatgacagaggttcaagagccgcgtcccactccaacagggagacccagcatggcgtat

SEQ ID NO: 382515 - DNA, 140 bp, Artificial Sequence
  Synthetic
atacgccatgctgggtctcctcatgggcttgcccgtggtagcgcgccgtggagatgaggttctcatcggcgtcttccaggatgtgaatcatttgcctcctgggtttgtcccaaccgcacccgtacttgggagtcggccat

SEQ ID NO: 382516 - DNA, 140 bp, Artificial Sequence
  Synthetic
atggccgactcccaagtacgggtgcggttgggacaaacccaggaggcaaatgattcacatcctggaagacgccgatgagaacctcatctccacggcgcgctaccacgggcaagcccatgaggagacccagcatggcgtat

SEQ ID NO: 382517 - DNA, 140 bp, Artificial Sequence
  Synthetic
atacgccatgctgggtctccagttgtcatccggcggtgcggaaagggtttcctaggggtcacaaaggctgccttgacgggtcgggatcctgacttacatccaggaaacgtcatggtgttgcgtacttgggagtcggccat

SEQ ID NO: 382518 - DNA, 140 bp, Artificial Sequence
  Synthetic
atggccgactcccaagtacgcaacaccatgacgtttcctggatgtaagtcaggatcccgacccgtcaaggcagcctttgtgacccctaggaaaccctttccgcaccgccggatgacaactggagacccagcatggcgtat

SEQ ID NO: 382519 - DNA, 140 bp, Artificial Sequence
  Synthetic
atacgccatgctgggtctccgggacggcaacgtcgcgaagcatgggaacatgtctgaacggcctgttgttcacgaccttccatggggcttcatcccgaaccatcgccacgcccgtgggggcgtacttgggagtcggccat

SEQ ID NO: 382520 - DNA, 140 bp, Artificial Sequence
  Synthetic
atggccgactcccaagtacgcccccacgggcgtggcgatggttcgggatgaagccccatggaaggtcgtgaacaacaggccgttcagacatgttcccatgcttcgcgacgttgccgtcccggagacccagcatggcgtat

SEQ ID NO: 382521 - DNA, 140 bp, Artificial Sequence
  Synthetic
atacgccatgctgggtctcccccttaaccctaggtggtggtccgccagtgatgacgtcacggtgtatccgcttccagatggggcgacttcgttgacaccttgcacttgccaagctgagtccgtacttgggagtcggccat

SEQ ID NO: 382522 - DNA, 140 bp, Artificial Sequence
  Synthetic
atggccgactcccaagtacggactcagcttggcaagtgcaaggtgtcaacgaagtcgccccatctggaagcggatacaccgtgacgtcatcactggcggaccaccacctagggttaagggggagacccagcatggcgtat

SEQ ID NO: 382523 - DNA, 140 bp, Artificial Sequence
  Synthetic
atacgccatgctgggtctccctgttgggtcatcagatctgacggggctttatgccatggcttgagcaagggggacaaggtagagctggatgtagctatggaggtctctgacttccgtggtcgtacttgggagtcggccat

SEQ ID NO: 382524 - DNA, 140 bp, Artificial Sequence
  Synthetic
atggccgactcccaagtacgaccacggaagtcagagacctccatagctacatccagctctaccttgtcccccttgctcaagccatggcataaagccccgtcagatctgatgacccaacagggagacccagcatggcgtat

SEQ ID NO: 382525 - DNA, 140 bp, Artificial Sequence
  Synthetic
atacgccatgctgggtctcctcgtccggctcgccggtcctgtgcgacgaagggcacgcagtaggaatgctcgtgtcagtgctccattcggcgggagaagtcaccgcggctcgatttactacgtacttgggagtcggccat

SEQ ID NO: 382526 - DNA, 140 bp, Artificial Sequence
  Synthetic
atggccgactcccaagtacgtagtaaatcgagccgcggtgacttctcccgccgaatggagcactgacacgagcattcctactgcgtgcccttcgtcgcacaggaccggcgagccggacgaggagacccagcatggcgtat

SEQ ID NO: 382527 - DNA, 140 bp, Artificial Sequence
  Synthetic
atacgccatgctgggtctccgggcgtggacccaagttccaactgacgccaaaaccaccactgacccccctccggtgccggcaaaaggagttttcaaagaggccccgttgtttatgcctaccgtacttgggagtcggccat

SEQ ID NO: 382528 - DNA, 140 bp, Artificial Sequence
  Synthetic
atggccgactcccaagtacggtaggcataaacaacggggcctctttgaaaactccttttgccggcaccggaggggggtcagtggtggttttggcgtcagttggaacttgggtccacgcccggagacccagcatggcgtat

SEQ ID NO: 382529 - DNA, 140 bp, Artificial Sequence
  Synthetic
atacgccatgctgggtctccgggagcgggaaagagcactcgcgtcccgttggagtacggcaacatggggcacaaggtcttgattttgaacccctcggtcgctactgtgcgggccatgggccgtacttgggagtcggccat

SEQ ID NO: 382530 - DNA, 140 bp, Artificial Sequence
  Synthetic
atggccgactcccaagtacggcccatggcccgcacagtagcgaccgaggggttcaaaatcaagaccttgtgccccatgttgccgtactccaacgggacgcgagtgctctttcccgctcccggagacccagcatggcgtat

SEQ ID NO: 382531 - DNA, 140 bp, Artificial Sequence
  Synthetic
atacgccatgctgggtctccccctacatggagcggctggcgggcaaacatccaagcatttactgtggacatgacaccactgctttcacgaggatcactgactcccccctaacgtattctacgtacttgggagtcggccat

SEQ ID NO: 382532 - DNA, 140 bp, Artificial Sequence
  Synthetic
atggccgactcccaagtacgtagaatacgttaggggggagtcagtgatcctcgtgaaagcagtggtgtcatgtccacagtaaatgcttggatgtttgcccgccagccgctccatgtagggggagacccagcatggcgtat

SEQ ID NO: 382533 - DNA, 140 bp, Artificial Sequence
  Synthetic
atacgccatgctgggtctcccctatgggaggtttttagccaaccctaggcagatgctacggggtgtatcggtggtcatctgtgatgagtgccacagccatgactcaaccgtgctgctgggcgtacttgggagtcggccat

SEQ ID NO: 382534 - DNA, 140 bp, Artificial Sequence
  Synthetic
atggccgactcccaagtacgcccagcagcacggttgagtcatggctgtggcactcatcacagatgaccaccgatacaccccgtagcatctgcctagggttggctaaaaacctcccataggggagacccagcatggcgtat

SEQ ID NO: 382535 - DNA, 140 bp, Artificial Sequence
  Synthetic
atacgccatgctgggtctcccattgggagggtccgggagctggcgcgtgggtgtggagtgcaactggtgctctacgctaccgccacgcctcctggttcccccatgacacagcacccttctcgtacttgggagtcggccat

SEQ ID NO: 382536 - DNA, 140 bp, Artificial Sequence
  Synthetic
atggccgactcccaagtacgagaagggtgctgtgtcatgggggaaccaggaggcgtggcggtagcgtagagcaccagttgcactccacacccacgcgccagctcccggaccctcccaatgggagacccagcatggcgtat

SEQ ID NO: 382537 - DNA, 140 bp, Artificial Sequence
  Synthetic
atacgccatgctgggtctccataattgagacaaagctggatgtgggtgagatccccttttatgggcatggcatacccctcgaacggatgcgaaccgggaggcatctcgtattctgccattcgtacttgggagtcggccat

SEQ ID NO: 382538 - DNA, 140 bp, Artificial Sequence
  Synthetic
atggccgactcccaagtacgaatggcagaatacgagatgcctcccggttcgcatccgttcgaggggtatgccatgcccataaaaggggatctcacccacatccagctttgtctcaattatggagacccagcatggcgtat

SEQ ID NO: 382539 - DNA, 140 bp, Artificial Sequence
  Synthetic
atacgccatgctgggtctccccaaggctgagtgtgagcgccttgccggccagttctccgcgaggggggtaaatgctattgcttattatagggggaaagacagttccatcattcaggacggcgtacttgggagtcggccat

SEQ ID NO: 382540 - DNA, 140 bp, Artificial Sequence
  Synthetic
atggccgactcccaagtacgccgtcctgaatgatggaactgtctttccccctataataagcaatagcatttacccccctcgcggagaactggccggcaaggcgctcacactcagccttggggagacccagcatggcgtat

SEQ ID NO: 382541 - DNA, 140 bp, Artificial Sequence
  Synthetic
atacgccatgctgggtctccagacctagtggtgtgcgccactgacgcactttccaccgggtatactgggaattttgattctgtcaccgattgtgggttggtggtggaggaggtcgttgagcgtacttgggagtcggccat

SEQ ID NO: 382542 - DNA, 140 bp, Artificial Sequence
  Synthetic
atggccgactcccaagtacgctcaacgacctcctccaccaccaacccacaatcggtgacagaatcaaaattcccagtatacccggtggaaagtgcgtcagtggcgcacaccactaggtctggagacccagcatggcgtat

SEQ ID NO: 382543 - DNA, 140 bp, Artificial Sequence
  Synthetic
atacgccatgctgggtctccgtgacccttgatcccaccattaccatctccctgcgaacagtgcctgcttcggctgaattgtcgatgcagagacgaggacgcacgggtaggggcaggtctgcgtacttgggagtcggccat

SEQ ID NO: 382544 - DNA, 140 bp, Artificial Sequence
  Synthetic
atggccgactcccaagtacgcagacctgcccctacccgtgcgtcctcgtctctgcatcgacaattcagccgaagcaggcactgttcgcagggagatggtaatggtgggatcaagggtcacggagacccagcatggcgtat

SEQ ID NO: 382545 - DNA, 140 bp, Artificial Sequence
  Synthetic
atacgccatgctgggtctccggcgctactactacgcgggggtgggcaaagcccccgctggggtggtgcgctcaggtcctgtctggtcggcggtggaagccggagtgacctggtacggaatcgtacttgggagtcggccat

SEQ ID NO: 382546 - DNA, 140 bp, Artificial Sequence
  Synthetic
atggccgactcccaagtacgattccgtaccaggtcactccggcttccaccgccgaccagacaggacctgagcgcaccaccccagcgggggctttgcccacccccgcgtagtagtagcgccggagacccagcatggcgtat

SEQ ID NO: 382547 - DNA, 140 bp, Artificial Sequence
  Synthetic
atacgccatgctgggtctccggaacctgacctgacagctaacctattgagactttacgacgactgcccttacaccgcagccgtcgcagctgacattggagaggccgcggtgttcttctcccgtacttgggagtcggccat

SEQ ID NO: 382548 - DNA, 140 bp, Artificial Sequence
  Synthetic
atggccgactcccaagtacgggagaagaacaccgcggcctctccaatgtcagctgcgacggctgcggtgtaagggcagtcgtcgtaaagtctcaataggttagctgtcaggtcaggttccggagacccagcatggcgtat

SEQ ID NO: 382549 - DNA, 140 bp, Artificial Sequence
  Synthetic
aggccctggctgctgatatgacaccgcagccgtcgcagctgacattggagaggccgcggtgttcttctccgggctcgccccgttgaggatgcaccccgatgttagctgggcaaaagttcggaccttttgggacagcggtg

SEQ ID NO: 382550 - DNA, 140 bp, Artificial Sequence
  Synthetic
caccgctgtcccaaaaggtccgaacttttgcccagctaacatcggggtgcatcctcaacggggcgagcccggagaagaacaccgcggcctctccaatgtcagctgcgacggctgcggtgtcatatcagcagccagggcct

SEQ ID NO: 382551 - DNA, 140 bp, Artificial Sequence
  Synthetic
atacgccatgctgggtctcccggcgtcaactggcccctcttggtgggtgttcagcggaccatgtgccgggaaacactgtctcctggtccatcggatgacccccaatgggcaggtctgaagcgtacttgggagtcggccat

SEQ ID NO: 382552 - DNA, 140 bp, Artificial Sequence
  Synthetic
atggccgactcccaagtacgcttcagacctgcccattgggggtcatccgatggaccaggagacagtgtttcccggcacatggtccgctgaacacccaccaagaggggccagttgacgccgggagacccagcatggcgtat

SEQ ID NO: 382553 - DNA, 140 bp, Artificial Sequence
  Synthetic
atacgccatgctgggtctccggcccgaatcctgtcccactactgctgaggtggggcaatgatttaccatctaaagtggccggccatcacatagtggacgacctggtccgtagactcggtgcgtacttgggagtcggccat

SEQ ID NO: 382554 - DNA, 140 bp, Artificial Sequence
  Synthetic
atggccgactcccaagtacgcaccgagtctacggaccaggtcgtccactatgtgatggccggccactttagatggtaaatcattgccccacctcagcagtagtgggacaggattcgggccggagacccagcatggcgtat

SEQ ID NO: 382555 - DNA, 140 bp, Artificial Sequence
  Synthetic
atacgccatgctgggtctcctggcggagggttatgtccgctgcgatgcggggccgatcttgatggtcggtctcgctatcgcgggggggatgatctacgcgtcatacaccgggtccatagtcgtacttgggagtcggccat

SEQ ID NO: 382556 - DNA, 140 bp, Artificial Sequence
  Synthetic
atggccgactcccaagtacgactatggacccggtgtatgacgcgtagatcatcccccccgcgatagcgagaccgaccatcaagatcggccccgcatcgcagcggacataaccctccgccaggagacccagcatggcgtat

SEQ ID NO: 382557 - DNA, 140 bp, Artificial Sequence
  Synthetic
aggccctggctgctgatatgggtggtgacagactgggatgtgaaggggggtggcgcccccctttatcggcatggagaccaggccacgccacaaccggtggtgcaggtccccccggtagacgaccttttgggacagcggtg

SEQ ID NO: 382558 - DNA, 140 bp, Artificial Sequence
  Synthetic
caccgctgtcccaaaaggtcgtctaccggggggacctgcaccaccggttgtggcgtggcctggtctccatgccgataaaggggggcgccaccccccttcacatcccagtctgtcaccacccatatcagcagccagggcct

SEQ ID NO: 382559 - DNA, 140 bp, Artificial Sequence
  Synthetic
atacgccatgctgggtctcccatcggccggggggggagtctgcgccatcggacgccaagacagtgacagatgcggtggcagccatccaggtggattgcgattggtcagttatgactctgtcgtacttgggagtcggccat

SEQ ID NO: 382560 - DNA, 140 bp, Artificial Sequence
  Synthetic
atggccgactcccaagtacgacagagtcataactgaccaatcgcaatccacctggatggctgccaccgcatctgtcactgtcttggcgtccgatggcgcagactccccccccggccgatgggagacccagcatggcgtat

SEQ ID NO: 382561 - DNA, 140 bp, Artificial Sequence
  Synthetic
atacgccatgctgggtctcccgatcggagaagtactgtccttggctcaggctaagacggccgaggcctacacagcaaccgccaagtggcttgctggctgctatacggggacgcgggccgtcgtacttgggagtcggccat

SEQ ID NO: 382562 - DNA, 140 bp, Artificial Sequence
  Synthetic
atggccgactcccaagtacgacggcccgcgtccccgtatagcagccagcaagccacttggcggttgctgtgtaggcctcggccgtcttagcctgagccaaggacagtacttctccgatcgggagacccagcatggcgtat

SEQ ID NO: 382563 - DNA, 140 bp, Artificial Sequence
  Synthetic
atacgccatgctgggtctccccccactgtttcaattgttgacaagctcttcgccggagggtgggcggccgtggtgggccattgccacagcgtaatagctgcggcggtggcggcctacgggcgtacttgggagtcggccat

SEQ ID NO: 382564 - DNA, 140 bp, Artificial Sequence
  Synthetic
atggccgactcccaagtacgcccgtaggccgccaccgccgcagctattacgctgtggcaatggcccaccacggccgcccaccctccggcgaagagcttgtcaacaattgaaacagtggggggagacccagcatggcgtat

SEQ ID NO: 382565 - DNA, 140 bp, Artificial Sequence
  Synthetic
atacgccatgctgggtctccgcttctaggagcccgccgttggcagccgcggcttcctacctgatggggttgggcgtcggaggcaacgcccaaacgcgtttggcatctgccctcctattggcgtacttgggagtcggccat

SEQ ID NO: 382566 - DNA, 140 bp, Artificial Sequence
  Synthetic
atggccgactcccaagtacgccaataggagggcagatgccaaacgcgtttgggcgttgcctccgacgcccaaccccatcaggtaggaagccgcggctgccaacggcgggctcctagaagcggagacccagcatggcgtat

SEQ ID NO: 382567 - DNA, 140 bp, Artificial Sequence
  Synthetic
atacgccatgctgggtctccgggctgctgggaccgccctgggtactccggttgtgggtttgaccatggctggggcattcatggggggtgctagcgtctccccctctctggtcaccatcctcgtacttgggagtcggccat

SEQ ID NO: 382568 - DNA, 140 bp, Artificial Sequence
  Synthetic
atggccgactcccaagtacgaggatggtgaccagagagggggagacgctagcaccccccatgaatgccccagccatggtcaaacccacaaccggagtacccagggcggtcccagcagcccggagacccagcatggcgtat

SEQ ID NO: 382569 - DNA, 140 bp, Artificial Sequence
  Synthetic
atacgccatgctgggtctccgttgggggccgtgggaggctgggagggcgttgtcaatgcggcaagccttgtctttgacttcatggcggggaaactttcatcagaagatttgtggtatgctcgtacttgggagtcggccat

SEQ ID NO: 382570 - DNA, 140 bp, Artificial Sequence
  Synthetic
atggccgactcccaagtacgagcataccacaaatcttctgatgaaagtttccccgccatgaagtcaaagacaaggcttgccgcattgacaacgccctcccagcctcccacggcccccaacggagacccagcatggcgtat

SEQ ID NO: 382571 - DNA, 140 bp, Artificial Sequence
  Synthetic
atacgccatgctgggtctccatcccggtgctgaccagtccgggggcgggcctcgcggggatcgcccttggactggttctgtactcagctaacaactctggcactaccacttggctgaacccgtacttgggagtcggccat

SEQ ID NO: 382572 - DNA, 140 bp, Artificial Sequence
  Synthetic
atggccgactcccaagtacgggttcagccaagtggtagtgccagagttgttagctgagtacagaaccagtccaagggcgatccccgcgaggcccgcccccggactggtcagcaccgggatggagacccagcatggcgtat

SEQ ID NO: 382573 - DNA, 140 bp, Artificial Sequence
  Synthetic
atacgccatgctgggtctccgtctgctgacgacgttgccaaggtcttcatgcatccctgacagttactttcagcaggccgactactgtgacaaagtctcagctgtgctccgccgtttgagcgtacttgggagtcggccat

SEQ ID NO: 382574 - DNA, 140 bp, Artificial Sequence
  Synthetic
atggccgactcccaagtacgctcaaacggcggagcacagctgagactttgtcacagtagtcggcctgctgaaagtaactgtcagggatgcatgaagaccttggcaacgtcgtcagcagacggagacccagcatggcgtat

SEQ ID NO: 382575 - DNA, 140 bp, Artificial Sequence
  Synthetic
atacgccatgctgggtctccccttacccgcactgtggttgccctggtcaacagggagcccaaggtggatgaggttcaggtggggtacgtctgggacctgtgggagtggatcatgcgccagcgtacttgggagtcggccat

SEQ ID NO: 382576 - DNA, 140 bp, Artificial Sequence
  Synthetic
atggccgactcccaagtacgctggcgcatgatccactcccacaggtcccagacgtaccccacctgaacctcatccaccttgggctccctgttgaccagggcaaccacagtgcgggtaaggggagacccagcatggcgtat

SEQ ID NO: 382577 - DNA, 140 bp, Artificial Sequence
  Synthetic
atacgccatgctgggtctccgtgcgcatggtcatggctagactcagggccctctgccccgtggtgtcgctgcctttgtggcactgcggggaggggtggtctggggaatggctgttggacgcgtacttgggagtcggccat

SEQ ID NO: 382578 - DNA, 140 bp, Artificial Sequence
  Synthetic
atggccgactcccaagtacgcgtccaacagccattccccagaccacccctccccgcagtgccacaaaggcagcgacaccacggggcagagggccctgagtctagccatgaccatgcgcacggagacccagcatggcgtat

SEQ ID NO: 382579 - DNA, 140 bp, Artificial Sequence
  Synthetic
atacgccatgctgggtctccgccatgttgagagtcgctgcctttgtggctgcgtgatcaccggcgatgttctgaatgggcaactcaaagaaccagtttactctaccaagctgtgccggcacgtacttgggagtcggccat

SEQ ID NO: 382580 - DNA, 140 bp, Artificial Sequence
  Synthetic
atggccgactcccaagtacgtgccggcacagcttggtagagtaaactggttctttgagttgcccattcagaacatcgccggtgatcacgcagccacaaaggcagcgactctcaacatggcggagacccagcatggcgtat

SEQ ID NO: 382581 - DNA, 140 bp, Artificial Sequence
  Synthetic
atacgccatgctgggtctccctattggatggggactgttcctgtgaacatgctgggctatggtgagacgtcgcctctcttggcttctgacaccccgaaggtggtacctttcgggacgtctcgtacttgggagtcggccat

SEQ ID NO: 382582 - DNA, 140 bp, Artificial Sequence
  Synthetic
atggccgactcccaagtacgagacgtcccgaaaggtaccaccttcggggtgtcagaagccaagagaggcgacgtctcaccatagcccagcatgttcacaggaacagtccccatccaatagggagacccagcatggcgtat

SEQ ID NO: 382583 - DNA, 140 bp, Artificial Sequence
  Synthetic
atacgccatgctgggtctccggctgggctgaggtggtggtgacccctacccacgtagtgatcaggaggacctccgcctataagttgctgcgccagcaaatcctatcggctgctgtagctgcgtacttgggagtcggccat

SEQ ID NO: 382584 - DNA, 140 bp, Artificial Sequence
  Synthetic
atggccgactcccaagtacgcagctacagcagccgataggatttgctggcgcagcaacttataggcggaggtcctcctgatcactacgtgggtaggggtcaccaccacctcagcccagccggagacccagcatggcgtat

SEQ ID NO: 382585 - DNA, 140 bp, Artificial Sequence
  Synthetic
atacgccatgctgggtctccagccctattacgtcgacggcattccggtctcgtgggacgcggacgcgcgagcgcccgccatggtctatggccctgggcaaagtgttaccattgacggggacgtacttgggagtcggccat

SEQ ID NO: 382586 - DNA, 140 bp, Artificial Sequence
  Synthetic
atggccgactcccaagtacgtccccgtcaatggtaacactttgcccagggccatagaccatggcgggcgctcgcgcgtccgcgtcccacgagaccggaatgccgtcgacgtaatagggctggagacccagcatggcgtat

SEQ ID NO: 382587 - DNA, 140 bp, Artificial Sequence
  Synthetic
atacgccatgctgggtctccgcgctacaccttgcctcaccagttgaggcttaggaacgtggcgccctctgaggtttcatccgagatgaccattgaccttgggacggagactgaagattcacgtacttgggagtcggccat

SEQ ID NO: 382588 - DNA, 140 bp, Artificial Sequence
  Synthetic
atggccgactcccaagtacgtgaatcttcagtctccgtcccaaggtcaatggtcatctcggatgaaacctcagagggcgccacgttcctaagcctcaactggtgaggcaaggtgtagcgcggagacccagcatggcgtat

SEQ ID NO: 382589 - DNA, 140 bp, Artificial Sequence
  Synthetic
atacgccatgctgggtctccgaactgactgaagccgatctgccgccggcggctgcagccctccaggcgatcgagaatgctgcgaggattctcgagccgctcattgatgtcatcatggaggcgtacttgggagtcggccat

SEQ ID NO: 382590 - DNA, 140 bp, Artificial Sequence
  Synthetic
atggccgactcccaagtacgcctccatgatgacatcaatgagcggctcgagaatcctcgcagcattctcgatcgcctggagggctgcagccgccggcggcagatcggcttcagtcagttcggagacccagcatggcgtat

SEQ ID NO: 382591 - DNA, 140 bp, Artificial Sequence
  Synthetic
aggccctggctgctgatatgcgagaatgctgcgaggattctcgagccgctcattgatgtcatcatggaggactgtagtacaccctctctttgtggtagtagccgagagatgcctgtgtgggaccttttgggacagcggtg

SEQ ID NO: 382592 - DNA, 140 bp, Artificial Sequence
  Synthetic
caccgctgtcccaaaaggtcccacacaggcatctctcggctactaccacaaagagagggtgtactacagtcctccatgatgacatcaatgagcggctcgagaatcctcgcagcattctcgcatatcagcagccagggcct

SEQ ID NO: 382593 - DNA, 140 bp, Artificial Sequence
  Synthetic
aggccctggctgctgatatggagcagctcagatgagaagaccccgtcggtgtcctcttcgcaggaggataccccgtcctcagactcattcgaggtcatccaagagtccgagacagccgaggaccttttgggacagcggtg

SEQ ID NO: 382594 - DNA, 140 bp, Artificial Sequence
  Synthetic
caccgctgtcccaaaaggtcctcggctgtctcggactcttggatgacctcgaatgagtctgaggacggggtatcctcctgcgaagaggacaccgacggggtcttctcatctgagctgctccatatcagcagccagggcct

SEQ ID NO: 382595 - DNA, 140 bp, Artificial Sequence
  Synthetic
atacgccatgctgggtctccggggaggaaagtgtcttcaacgtggctctttccgtactaaaagccttatttccacagagcgacgcgaccaggaagctcaccgtcaagatgtcatgctgtgcgtacttgggagtcggccat

SEQ ID NO: 382596 - DNA, 140 bp, Artificial Sequence
  Synthetic
atggccgactcccaagtacgcacagcatgacatcttgacggtgagcttcctggtcgcgtcgctctgtggaaataaggcttttagtacggaaagagccacgttgaagacactttcctccccggagacccagcatggcgtat

SEQ ID NO: 382597 - DNA, 140 bp, Artificial Sequence
  Synthetic
atacgccatgctgggtctccctgaaaagagcgtcacacgttttttttcattagggctgacggtggctgatgttgctagcctgtgtgagatggagattcagaaccatacagcctattgtgacgtacttgggagtcggccat

SEQ ID NO: 382598 - DNA, 140 bp, Artificial Sequence
  Synthetic
atggccgactcccaagtacgtcacaataggctgtatggttctgaatctccatctcacacaggctagcaacatcagccaccgtcagccctaatgaaaaaaaacgtgtgacgctcttttcagggagacccagcatggcgtat

SEQ ID NO: 382599 - DNA, 140 bp, Artificial Sequence
  Synthetic
atacgccatgctgggtctcccaaggtgcgcactccgcttgaattgcaggttgggtgcttggtgggcaatgaacttacctttgaatgtgacaagtgtgaggctaggcaagagactttggcccgtacttgggagtcggccat

SEQ ID NO: 382600 - DNA, 140 bp, Artificial Sequence
  Synthetic
atggccgactcccaagtacgggccaaagtctcttgcctagcctcacacttgtcacattcaaaggtaagttcattgcccaccaagcacccaacctgcaattcaagcggagtgcgcaccttgggagacccagcatggcgtat

SEQ ID NO: 382601 - DNA, 140 bp, Artificial Sequence
  Synthetic
atacgccatgctgggtctcctccttctcctacatctggtctggtgtgccgctaacgcgggccacgccggccaagccccctgtggtgaggccggttggttctttgttggtggccgacactacgtacttgggagtcggccat

SEQ ID NO: 382602 - DNA, 140 bp, Artificial Sequence
  Synthetic
atggccgactcccaagtacgtagtgtcggccaccaacaaagaaccaaccggcctcaccacagggggcttggccggcgtggcccgcgttagcggcacaccagaccagatgtaggagaaggaggagacccagcatggcgtat

SEQ ID NO: 382603 - DNA, 140 bp, Artificial Sequence
  Synthetic
atacgccatgctgggtctccccaaagtgtatgttaccaatccggacaatgtgggaaggagggtggacaaggtgaccttctggcgcgctcctagggttcatgacaaatatcttgtggactccgtacttgggagtcggccat

SEQ ID NO: 382604 - DNA, 140 bp, Artificial Sequence
  Synthetic
atggccgactcccaagtacggagtccacaagatatttgtcatgaaccctaggagcgcgccagaaggtcaccttgtccaccctccttcccacattgtccggattggtaacatacactttggggagacccagcatggcgtat

SEQ ID NO: 382605 - DNA, 140 bp, Artificial Sequence
  Synthetic
aggccctggctgctgatatggtgaccttctggcgcgctcctagggttcatgacaaatatcttgtggactctatcgagcgggctaagagggctgctcaagcctgcctaagcatgggttacagaccttttgggacagcggtg

SEQ ID NO: 382606 - DNA, 140 bp, Artificial Sequence
  Synthetic
caccgctgtcccaaaaggtctgtaacccatgcttaggcaggcttgagcagccctcttagcccgctcgatagagtccacaagatatttgtcatgaaccctaggagcgcgccagaaggtcaccatatcagcagccagggcct

SEQ ID NO: 382607 - DNA, 140 bp, Artificial Sequence
  Synthetic
aggccctggctgctgatatgcttatgaggaagcaataaggactgtaaggccacatgctgccatgggctggggatctaaggtgtcggtcaaagacttggccacccctgcggggaagatggcgaccttttgggacagcggtg

SEQ ID NO: 382608 - DNA, 140 bp, Artificial Sequence
  Synthetic
caccgctgtcccaaaaggtcgccatcttccccgcaggggtggccaagtctttgaccgacaccttagatccccagcccatggcagcatgtggccttacagtccttattgcttcctcataagcatatcagcagccagggcct

SEQ ID NO: 382609 - DNA, 140 bp, Artificial Sequence
  Synthetic
atacgccatgctgggtctcctgtccacgatcgacttcaggagatacttgaagggactccggtcccctttacccttactgtgaaaaaggaggtgttcttcaaagaccgaaaggaggagaagcgtacttgggagtcggccat

SEQ ID NO: 382610 - DNA, 140 bp, Artificial Sequence
  Synthetic
atggccgactcccaagtacgcttctcctcctttcggtctttgaagaacacctcctttttcacagtaagggtaaaggggaccggagtcccttcaagtatctcctgaagtcgatcgtggacaggagacccagcatggcgtat

SEQ ID NO: 382611 - DNA, 140 bp, Artificial Sequence
  Synthetic
atacgccatgctgggtctccgcccctcgcctcattgtgttcccccccctggacttccggatagctgaaaagcttatcctgggagacccggggcgggtagccaaggcggtgttggggggggcgtacttgggagtcggccat

SEQ ID NO: 382612 - DNA, 140 bp, Artificial Sequence
  Synthetic
atggccgactcccaagtacgccccccccaacaccgccttggctacccgccccgggtctcccaggataagcttttcagctatccggaagtccaggggggggaacacaatgaggcgaggggcggagacccagcatggcgtat

SEQ ID NO: 382613 - DNA, 140 bp, Artificial Sequence
  Synthetic
atacgccatgctgggtctcccttacgccttccagtacaccccaaaccagcgagttaaggagatgctcaaactgtgggagtccaaaaaaacaccttgcgccatctgcgtggacgccacgtgcgtacttgggagtcggccat

SEQ ID NO: 382614 - DNA, 140 bp, Artificial Sequence
  Synthetic
atggccgactcccaagtacgcacgtggcgtccacgcagatggcgcaaggtgtttttttggactcccacagtttgagcatctccttaactcgctggtttggggtgtactggaaggcgtaagggagacccagcatggcgtat

SEQ ID NO: 382615 - DNA, 140 bp, Artificial Sequence
  Synthetic
atacgccatgctgggtctcccttcgacagtagcattactgaagaggacgtggccttagagacagagctatatgctctggcctctgaccatccagaatgggtgcgagcccttgggaaataccgtacttgggagtcggccat

SEQ ID NO: 382616 - DNA, 140 bp, Artificial Sequence
  Synthetic
atggccgactcccaagtacggtatttcccaagggctcgcacccattctggatggtcagaggccagagcatatagctctgtctctaaggccacgtcctcttcagtaatgctactgtcgaagggagacccagcatggcgtat

SEQ ID NO: 382617 - DNA, 140 bp, Artificial Sequence
  Synthetic
atacgccatgctgggtctcctatgcttcaggcaccatggtcaccccagaaggggtgcccgttggtgagaggtattgtagatcctcaggggtcttgacaaccagtgcgagcaattgcttgacgtacttgggagtcggccat

SEQ ID NO: 382618 - DNA, 140 bp, Artificial Sequence
  Synthetic
atggccgactcccaagtacgtcaagcaattgctcgcactggttgtcaagacccctgaggatctacaatacctctcaccaacgggcaccccttctggggtgaccatggtgcctgaagcataggagacccagcatggcgtat

SEQ ID NO: 382619 - DNA, 140 bp, Artificial Sequence
  Synthetic
atacgccatgctgggtctcccatgctacatcaaggtggaagccgcctgtgagagggtgggtctgaaaaatgtctcactcctcattgctggcgatgactgtttgatcatatgtgagcggcccgtacttgggagtcggccat

SEQ ID NO: 382620 - DNA, 140 bp, Artificial Sequence
  Synthetic
atggccgactcccaagtacgggccgctcacatatgatcaaacagtcatcgccagcaatgaggagtgagacatttttcagacccaccctctcacaggcggcttccaccttgatgtagcatgggagacccagcatggcgtat

SEQ ID NO: 382621 - DNA, 140 bp, Artificial Sequence
  Synthetic
atacgccatgctgggtctccagtttgcgaccctagcgacgctctgggcagagccctggctagctatgggtacgcatgcgagccctcatatcatgcatcattggacacggcccccttctgccgtacttgggagtcggccat

SEQ ID NO: 382622 - DNA, 140 bp, Artificial Sequence
  Synthetic
atggccgactcccaagtacggcagaagggggccgtgtccaatgatgcatgatatgagggctcgcatgcgtacccatagctagccagggctctgcccagagcgtcgctagggtcgcaaactggagacccagcatggcgtat

SEQ ID NO: 382623 - DNA, 140 bp, Artificial Sequence
  Synthetic
atacgccatgctgggtctcctccacttggcttgccgagtgtaatgcagatgggaagcgccatttcttcctgacaacggacttccggagggcgctcgctcgcatgtcgagcgagtatagtgcgtacttgggagtcggccat

SEQ ID NO: 382624 - DNA, 140 bp, Artificial Sequence
  Synthetic
atggccgactcccaagtacgcactatactcgctcgacatgcgagcgagcgccctccggaagtccgttgtcaggaagaaatggcgcttcccatctgcattacactcggcaagccaagtggaggagacccagcatggcgtat

SEQ ID NO: 382625 - DNA, 140 bp, Artificial Sequence
  Synthetic
atacgccatgctgggtctccacccgatggcttcggccatcggttacatcctcctttatccttggcatcccatcacacggtgggtcatcatcccccacgtgctaacatgcgcgtttaggggcgtacttgggagtcggccat

SEQ ID NO: 382626 - DNA, 140 bp, Artificial Sequence
  Synthetic
atggccgactcccaagtacgcccctaaacgcgcatgttagcacgtgggggatgatgacccaccgtgtgatgggatgccaaggataaaggaggatgtaaccgatggccgaagccatcgggtggagacccagcatggcgtat

SEQ ID NO: 382627 - DNA, 140 bp, Artificial Sequence
  Synthetic
aggccctggctgctgatatgatcacacggtgggtcatcatcccccacgtgctaacatgcgcgtttaggggtggtggtacaccgtctgatccggtttggtgccaagtacatggtaattactgaccttttgggacagcggtg

SEQ ID NO: 382628 - DNA, 140 bp, Artificial Sequence
  Synthetic
caccgctgtcccaaaaggtcagtaattaccatgtacttggcaccaaaccggatcagacggtgtaccaccacccctaaacgcgcatgttagcacgtgggggatgatgacccaccgtgtgatcatatcagcagccagggcct

SEQ ID NO: 382629 - DNA, 140 bp, Artificial Sequence
  Synthetic
aggccctggctgctgatatgacaagtttccactggacaaactgcctaacatcatcgtggccctccacggaccagcagcgttgagggttaccgcagacacaactaagacaaaaatggaggcgaccttttgggacagcggtg

SEQ ID NO: 382630 - DNA, 140 bp, Artificial Sequence
  Synthetic
caccgctgtcccaaaaggtcgcctccatttttgtcttagttgtgtctgcggtaaccctcaacgctgctggtccgtggagggccacgatgatgttaggcagtttgtccagtggaaacttgtcatatcagcagccagggcct

SEQ ID NO: 382631 - DNA, 140 bp, Artificial Sequence
  Synthetic
atacgccatgctgggtctcccggtaaggtcttaagcgacctcaagctccctggcttagcggtccaccgtaagaaggccggggcactgcgtacgcgcatgctccgttcgcgcggttgggcccgtacttgggagtcggccat

SEQ ID NO: 382632 - DNA, 140 bp, Artificial Sequence
  Synthetic
atggccgactcccaagtacgggcccaaccgcgcgaacggagcatgcgcgtacgcagtgccccggccttcttacggtggaccgctaagccagggagcttgaggtcgcttaagaccttaccgggagacccagcatggcgtat

SEQ ID NO: 382633 - DNA, 140 bp, Artificial Sequence
  Synthetic
atacgccatgctgggtctccgagttggctaggggcctgttgtggcatccaggcctacggctccctccccctgagattgctggtatccccgggggtttcccctctccccccccctttatggcgtacttgggagtcggccat

SEQ ID NO: 382634 - DNA, 140 bp, Artificial Sequence
  Synthetic
atggccgactcccaagtacgccataaagggggggggagaggggaaacccccggggataccagcaatctcagggggagggagccgtaggcctggatgccacaacaggcccctagccaactcggagacccagcatggcgtat

SEQ ID NO: 382635 - DNA, 140 bp, Artificial Sequence
  Synthetic
atacgccatgctgggtctccgggtggttcatcaattggatttcacaagccagaggagtcgctggcgggggttgggggtcttagccctgctcatcgtggccctcttcgggtgaactaaattcgtacttgggagtcggccat

SEQ ID NO: 382636 - DNA, 140 bp, Artificial Sequence
  Synthetic
atggccgactcccaagtacgaatttagttcacccgaagagggccacgatgagcagggctaagacccccaacccccgccagcgactcctctggcttgtgaaatccaattgatgaaccacccggagacccagcatggcgtat

SEQ ID NO: 382637 - DNA, 140 bp, Artificial Sequence
  Synthetic
aggccctggctgctgatatgtgccacttcggtggcgggtcgctaccttatagcgtaatccgtgactacgggctgctcgcagagccctccccggatggggcacagtgcactgtgatctgaagaccttttgggacagcggtg

SEQ ID NO: 382638 - DNA, 140 bp, Artificial Sequence
  Synthetic
caccgctgtcccaaaaggtcttcagatcacagtgcactgtgccccatccggggagggctctgcgagcagcccgtagtcacggattacgctataaggtagcgacccgccaccgaagtggcacatatcagcagccagggcct

SEQ ID NO: 382639 - DNA, 140 bp, Artificial Sequence
  Synthetic
atacgccatgctgggtctccaccgacgcccacggaatagtgggactaaggcccaatcaaagccaggaattccggccgaaagggtgtggatggtggtgacagggttggcaggtcgtaaatccgtacttgggagtcggccat

SEQ ID NO: 382640 - DNA, 140 bp, Artificial Sequence
  Synthetic
atggccgactcccaagtacggatttacgacctgccaaccctgtcaccaccatccacaccctttcggccggaattcctggctttgattgggccttagtcccactattccgtgggcgtcggtggagacccagcatggcgtat

SEQ ID NO: 382641 - DNA, 140 bp, Artificial Sequence
  Synthetic
atacgccatgctgggtctccccggccattctggtagcacctataggtgggttgaactggcggcgagaagtccctaatacctcttgcacgtgatgcgcacggtccacaggattggtctctccgtacttgggagtcggccat

SEQ ID NO: 382642 - DNA, 140 bp, Artificial Sequence
  Synthetic
atggccgactcccaagtacggagagaccaatcctgtggaccgtgcgcatcacgtgcaagaggtattagggacttctcgccgccagttcaacccacctataggtgctaccagaatggccggggagacccagcatggcgtat

SEQ ID NO: 382643 - DNA, 140 bp, Artificial Sequence
  Synthetic
atacgccatgctgggtctcccggtgtgaatagagacccgacgccagtcacgtcgttaaacagagtgcctttccccatcgcaacgccggccctcgtacgggaacgtcgcccttttaatacccgtacttgggagtcggccat

SEQ ID NO: 382644 - DNA, 140 bp, Artificial Sequence
  Synthetic
atggccgactcccaagtacgggtattaaaagggcgacgttcccgtacgagggccggcgttgcgatggggaaaggcactctgtttaacgacgtgactggcgtcgggtctctattcacaccgggagacccagcatggcgtat

SEQ ID NO: 382645 - DNA, 140 bp, Artificial Sequence
  Synthetic
atacgccatgctgggtctccactctggtcagtagcatgtgcggcgagttggcaatcccagagggcgggcggggcgtacacggtaggaccgtgccgcctgcgttgtcggggtctggtattacgtacttgggagtcggccat

SEQ ID NO: 382646 - DNA, 140 bp, Artificial Sequence
  Synthetic
atggccgactcccaagtacgtaataccagaccccgacaacgcaggcggcacggtcctaccgtgtacgccccgcccgccctctgggattgccaactcgccgcacatgctactgaccagagtggagacccagcatggcgtat

SEQ ID NO: 382647 - DNA, 140 bp, Artificial Sequence
  Synthetic
atacgccatgctgggtctccatgcatggggccacccagctccgcggcggactgcagccggggtagaccaaaatccttcgggtgaggtcgggtggcatctttctttctttgacatcatgatcgtacttgggagtcggccat

SEQ ID NO: 382648 - DNA, 140 bp, Artificial Sequence
  Synthetic
atggccgactcccaagtacgatcatgatgtcaaagaaagaaagatgccacccgacctcacccgaaggattttggtctaccccggctgcagtccgccgcggagctgggtggccccatgcatggagacccagcatggcgtat

SEQ ID NO: 382649 - DNA, 140 bp, Artificial Sequence
  Synthetic
atacgccatgctgggtctccgatcgccctgctgtttctaatcatcaatggggccgggggtctgttgaccccggcctcacatgcttgcagggttgggtcttcttatttcctcacaaactgtcgtacttgggagtcggccat

SEQ ID NO: 382650 - DNA, 140 bp, Artificial Sequence
  Synthetic
atggccgactcccaagtacgacagtttgtgaggaaataagaagacccaaccctgcaagcatgtgaggccggggtcaacagacccccggccccattgatgattagaaacagcagggcgatcggagacccagcatggcgtat

SEQ ID NO: 382651 - DNA, 140 bp, Artificial Sequence
  Synthetic
atacgccatgctgggtctcctgcgcagcgagggacgtcgcattctgccttgaaggtgggtgtgtggtggcccttggctgtacagtttgtacggatgtttgctggcctatcctacgcccagcgtacttgggagtcggccat

SEQ ID NO: 382652 - DNA, 140 bp, Artificial Sequence
  Synthetic
atggccgactcccaagtacgctgggcgtaggataggccagcaaacatccgtacaaactgtacagccaagggccaccacacacccaccttcaaggcagaatgcgacgtccctcgctgcgcaggagacccagcatggcgtat

SEQ ID NO: 382653 - DNA, 140 bp, Artificial Sequence
  Synthetic
atacgccatgctgggtctccgtatatccatcaggcctggggtggactcttcagcgctagtgggccaactaggagctctctatagccctttggctgtcggtagctacgctgccagcgtcctcgtacttgggagtcggccat

SEQ ID NO: 382654 - DNA, 140 bp, Artificial Sequence
  Synthetic
atggccgactcccaagtacgaggacgctggcagcgtagctaccgacagccaaagggctatagagagctcctagttggcccactagcgctgaagagtccaccccaggcctgatggatatacggagacccagcatggcgtat

SEQ ID NO: 382655 - DNA, 140 bp, Artificial Sequence
  Synthetic
atacgccatgctgggtctccggggttaggggaggtctatagtggagcactggcgttaggcgtgctggtcacccggcacgcctatcccctccccaacctgacatgtgctgttgagtgtgagcgtacttgggagtcggccat

SEQ ID NO: 382656 - DNA, 140 bp, Artificial Sequence
  Synthetic
atggccgactcccaagtacgctcacactcaacagcacatgtcaggttggggaggggataggcgtgccgggtgaccagcacgcctaacgccagtgctccactatagacctcccctaaccccggagacccagcatggcgtat

SEQ ID NO: 382657 - DNA, 140 bp, Artificial Sequence
  Synthetic
atacgccatgctgggtctccatggagtgggggactgagttctggcgttggacacaggaggtggcctcacagtactggatactggagtatctttggcgccttccctttgacttttggaaggcgtacttgggagtcggccat

SEQ ID NO: 382658 - DNA, 140 bp, Artificial Sequence
  Synthetic
atggccgactcccaagtacgccttccaaaagtcaaagggaaggcgccaaagatactccagtatccagtactgtgaggccacctcctgtgtccaacgccagaactcagtcccccactccatggagacccagcatggcgtat

SEQ ID NO: 382659 - DNA, 140 bp, Artificial Sequence
  Synthetic
atacgccatgctgggtctccgggtgatggccctagacgtcctgttggcctttgtggcggccttactcctcttggagcagcgcctggttatgctgttcctgcttgttacgacagcagggatcgtacttgggagtcggccat

SEQ ID NO: 382660 - DNA, 140 bp, Artificial Sequence
  Synthetic
atggccgactcccaagtacgatccctgctgtcgtaacaagcaggaacagcataaccaggcgctgctccaagaggagtaaggccgccacaaaggccaacaggacgtctagggccatcacccggagacccagcatggcgtat

SEQ ID NO: 382661 - DNA, 140 bp, Artificial Sequence
  Synthetic
atacgccatgctgggtctccggctgcctctcgacccactggggacctcggggctcgcccctttgttcctggtccgggttggggttgcacatgctatgaggatgggtcgcgggtgccaacgcgtacttgggagtcggccat

SEQ ID NO: 382662 - DNA, 140 bp, Artificial Sequence
  Synthetic
atggccgactcccaagtacgcgttggcacccgcgacccatcctcatagcatgtgcaaccccaacccggaccaggaacaaaggggcgagccccgaggtccccagtgggtcgagaggcagccggagacccagcatggcgtat

SEQ ID NO: 382663 - DNA, 140 bp, Artificial Sequence
  Synthetic
atacgccatgctgggtctccgacaaacaagtctgggagcggggtaacaagaccctgctttgcgattgccccaacgggccgtgggtgtggctccctagcatttgcggtggtgttgcttgggcgtacttgggagtcggccat

SEQ ID NO: 382664 - DNA, 140 bp, Artificial Sequence
  Synthetic
atggccgactcccaagtacgcccaagcaacaccaccgcaaatgctagggagccacacccacggcccgttggggcaatcgcaaagcagggtcttgttaccccgctcccagacttgtttgtcggagacccagcatggcgtat

SEQ ID NO: 382665 - DNA, 140 bp, Artificial Sequence
  Synthetic
atacgccatgctgggtctccgtagtggcgtggtcaagacttggtcacatggccaaaaccagtggccgctgtctcgcccgcgctacgtccacgggcatatcaccgcgacttgcgtttggggcgtacttgggagtcggccat

SEQ ID NO: 382666 - DNA, 140 bp, Artificial Sequence
  Synthetic
atggccgactcccaagtacgccccaaacgcaagtcgcggtgatatgcccgtggacgtagcgcgggcgagacagcggccactggttttggccatgtgaccaagtcttgaccacgccactacggagacccagcatggcgtat

SEQ ID NO: 382667 - DNA, 140 bp, Artificial Sequence
  Synthetic
atacgccatgctgggtctccgtcgcgctcttggttctcttccacaaggggggatggcactatcgacctctggtccctggtgtcaacggggtcagccttatgcaccatagcggtcctaggacgtacttgggagtcggccat

SEQ ID NO: 382668 - DNA, 140 bp, Artificial Sequence
  Synthetic
atggccgactcccaagtacgtcctaggaccgctatggtgcataaggctgaccccgttgacaccagggaccagaggtcgatagtgccatccccccttgtggaagagaaccaagagcgcgacggagacccagcatggcgtat

SEQ ID NO: 382669 - DNA, 140 bp, Artificial Sequence
  Synthetic
atacgccatgctgggtctccacatcggaccgcgacgtggtgccaggtttgtcaaccttcggcataccctgtgtgtcttgtgttgtggatcgtcgaccaccgagttgtggcggctgcgtgacgtacttgggagtcggccat

SEQ ID NO: 382670 - DNA, 140 bp, Artificial Sequence
  Synthetic
atggccgactcccaagtacgtcacgcagccgccacaactcggtggtcgacgatccacaacacaagacacacagggtatgccgaaggttgacaaacctggcaccacgtcgcggtccgatgtggagacccagcatggcgtat

SEQ ID NO: 382671 - DNA, 140 bp, Artificial Sequence
  Synthetic
atacgccatgctgggtctccgagactgctggccggagaccggtgagtttgggaccccattcgctaaatgcgggctgggccccaggctgactgaacatctgatggctgttcctttcgtcaacgtacttgggagtcggccat

SEQ ID NO: 382672 - DNA, 140 bp, Artificial Sequence
  Synthetic
atggccgactcccaagtacgttgacgaaaggaacagccatcagatgttcagtcagcctggggcccagcccgcatttagcgaatggggtcccaaactcaccggtctccggccagcagtctcggagacccagcatggcgtat

SEQ ID NO: 382673 - DNA, 140 bp, Artificial Sequence
  Synthetic
atacgccatgctgggtctcctcgctctgtccccttccagatcagggggcccctcggttttcagggttctggtaacccgctccgcaacccgttgcggggtggaacctttaccatgactttgcgtacttgggagtcggccat

SEQ ID NO: 382674 - DNA, 140 bp, Artificial Sequence
  Synthetic
atggccgactcccaagtacgcaaagtcatggtaaaggttccaccccgcaacgggttgcggagcgggttaccagaaccctgaaaaccgaggggccccctgatctggaaggggacagagcgaggagacccagcatggcgtat

SEQ ID NO: 382675 - DNA, 140 bp, Artificial Sequence
  Synthetic
atacgccatgctgggtctccatcgatggttcgttacatcttgtggagtgtccgactcccccaccatcccatcctgaaggcacatatggtttcttcccaggagcgcctccagttaacaactcgtacttgggagtcggccat

SEQ ID NO: 382676 - DNA, 140 bp, Artificial Sequence
  Synthetic
atggccgactcccaagtacgagttgttaactggaggcgctcctgggaagaaaccatatgtgccttcaggatgggatggtgggggagtcggacactccacaagatgtaacgaaccatcgatggagacccagcatggcgtat

SEQ ID NO: 382677 - DNA, 140 bp, Artificial Sequence
  Synthetic
atacgccatgctgggtctccgcttcttgctgggcactgaggtcagtgaggagttagggggcgccggcatgacagggggcgccttcgaaccattggtccggaggtgttcactcttgagcggcgtacttgggagtcggccat

SEQ ID NO: 382678 - DNA, 140 bp, Artificial Sequence
  Synthetic
atggccgactcccaagtacgccgctcaagagtgaacacctccggaccaatggttcgaaggcgccccctgtcatgccggcgccccctaactcctcactgacctcagtgcccagcaagaagcggagacccagcatggcgtat

SEQ ID NO: 382679 - DNA, 140 bp, Artificial Sequence
  Synthetic
atacgccatgctgggtctcctaagcggcacacggtctgccccggctttgcctgggtcagttcatcacgcccggatggatttatccatgtgaagggcggtgttcaggaggtcgatgaccatcgtacttgggagtcggccat

SEQ ID NO: 382680 - DNA, 140 bp, Artificial Sequence
  Synthetic
atggccgactcccaagtacgatggtcatcgacctcctgaacaccgcccttcacatggataaatccatccgggcgtgatgaactgacccaggcaaagccggggcagaccgtgtgccgcttaggagacccagcatggcgtat

SEQ ID NO: 382681 - DNA, 140 bp, Artificial Sequence
  Synthetic
atacgccatgctgggtctcctcttgggcgccaccaccgcggtggctgctcttggatttcgtcttcgtccttctttacctgatgaaactggccgaggctcgcctggtaccattgatcctgccgtacttgggagtcggccat

SEQ ID NO: 382682 - DNA, 140 bp, Artificial Sequence
  Synthetic
atggccgactcccaagtacggcaggatcaatggtaccaggcgagcctcggccagtttcatcaggtaaagaaggacgaagacgaaatccaagagcagccaccgcggtggtggcgcccaagaggagacccagcatggcgtat

SEQ ID NO: 382683 - DNA, 140 bp, Artificial Sequence
  Synthetic
atacgccatgctgggtctccttttgttgtggtggtggctaaatcaactggctgccctcggagcagttgtgggggaggtatttgcagcacccttggcttcctggtgtttgaccctcccttgcgtacttgggagtcggccat

SEQ ID NO: 382684 - DNA, 140 bp, Artificial Sequence
  Synthetic
atggccgactcccaagtacgcaagggagggtcaaacaccaggaagccaagggtgctgcaaatacctcccccacaactgctccgagggcagccagttgatttagccaccaccacaacaaaaggagacccagcatggcgtat

SEQ ID NO: 382685 - DNA, 140 bp, Artificial Sequence
  Synthetic
atacgccatgctgggtctccggtggcgatgatcctgggtttagtcaatttggtgttgtatctcaggtggctagggacaaccagactagtcctcctcctggcttggaaactcgctagggggcgtacttgggagtcggccat

SEQ ID NO: 382686 - DNA, 140 bp, Artificial Sequence
  Synthetic
atggccgactcccaagtacgccccctagcgagtttccaagccaggaggaggactagtctggttgtccctagccacctgagatacaacaccaaattgactaaacccaggatcatcgccaccggagacccagcatggcgtat

SEQ ID NO: 382687 - DNA, 140 bp, Artificial Sequence
  Synthetic
atacgccatgctgggtctccgcttttccgctcgcattattgatgggcatctcggcaaccagggggaggacttctgtcctaggagcccagttttgcttagatgtggccgttgatatggagccgtacttgggagtcggccat

SEQ ID NO: 382688 - DNA, 140 bp, Artificial Sequence
  Synthetic
atggccgactcccaagtacggctccatatcaacggccacatctaagcaaaactgggctcctaggacagaagtcctccccctggttgccgagatgcccatcaataatgcgagcggaaaagcggagacccagcatggcgtat

SEQ ID NO: 382689 - DNA, 140 bp, Artificial Sequence
  Synthetic
atacgccatgctgggtctcccgaccatcctgggttgggtattggcctcgctgatagcctggtcgattgcccttctcgcaaccatgagcgctggtggatggagacacaaggcagcggtctacgtacttgggagtcggccat

SEQ ID NO: 382690 - DNA, 140 bp, Artificial Sequence
  Synthetic
atggccgactcccaagtacgtagaccgctgccttgtgtctccatccaccagcgctcatggttgcgagaagggcaatcgaccaggctatcagcgaggccaatacccaacccaggatggtcgggagacccagcatggcgtat

SEQ ID NO: 382691 - DNA, 140 bp, Artificial Sequence
  Synthetic
atacgccatgctgggtctcctcggctatggtgtaagggacaccaatggctgagacgcaggattgtcgactcccctattggggaggggagaccgaccacacccgccgtcgcagcttggtgccgtacttgggagtcggccat

SEQ ID NO: 382692 - DNA, 140 bp, Artificial Sequence
  Synthetic
atggccgactcccaagtacggcaccaagctgcgacggcgggtgtggtcggtctcccctccccaataggggagtcgacaatcctgcgtctcagccattggtgtcccttacaccatagccgaggagacccagcatggcgtat

SEQ ID NO: 382693 - DNA, 140 bp, Artificial Sequence
  Synthetic
atacgccatgctgggtctccttggctgcgtacttctggcctgacgcggtgatgtgggtggtggtggctctggtggttgtcctcggcctagttgacgccctcgactgggccttggaagagccgtacttgggagtcggccat

SEQ ID NO: 382694 - DNA, 140 bp, Artificial Sequence
  Synthetic
atggccgactcccaagtacggctcttccaaggcccagtcgagggcgtcaactaggccgaggacaaccaccagagccaccaccacccacatcaccgcgtcaggccagaagtacgcagccaaggagacccagcatggcgtat

SEQ ID NO: 382695 - DNA, 140 bp, Artificial Sequence
  Synthetic
atacgccatgctgggtctcctacttgtgtcacggccctcattgaagcgccttgccagggtactagaggcatgtgtgacagctggtgagaaggctactactgtgcgcctggtgaacaagctcgtacttgggagtcggccat

SEQ ID NO: 382696 - DNA, 140 bp, Artificial Sequence
  Synthetic
atggccgactcccaagtacgagcttgttcaccaggcgcacagtagtagccttctcaccagctgtcacacatgcctctagtaccctggcaaggcgcttcaatgagggccgtgacacaagtaggagacccagcatggcgtat

SEQ ID NO: 382697 - DNA, 140 bp, Artificial Sequence
  Synthetic
atacgccatgctgggtctccaacctcccgcaatctgttcctgtatgagcatatgggggctttttgcgggcgagtggctcagcaactgcgcgcatgggacgctgctttggaacctctgtctcgtacttgggagtcggccat

SEQ ID NO: 382698 - DNA, 140 bp, Artificial Sequence
  Synthetic
atggccgactcccaagtacgagacagaggttccaaagcagcgtcccatgcgcgcagttgctgagccactcgcccgcaaaaagcccccatatgctcatacaggaacagattgcgggaggttggagacccagcatggcgtat

SEQ ID NO: 382699 - DNA, 140 bp, Artificial Sequence
  Synthetic
atacgccatgctgggtctccttctcccggaccgactgccgcatcatcagagacgcccaaaggactttgtcttgtggtcagtgcgtcatgggcttgcctgtggtagcgcgccgcggagatgcgtacttgggagtcggccat

SEQ ID NO: 382700 - DNA, 140 bp, Artificial Sequence
  Synthetic
atggccgactcccaagtacgcatctccgcggcgcgctaccacaggcaagcccatgacgcactgaccacaagacaaagtcctttgggcgtctctgatgatgcggcagtcggtccgggagaaggagacccagcatggcgtat

SEQ ID NO: 382701 - DNA, 140 bp, Artificial Sequence
  Synthetic
atacgccatgctgggtctccaggttttgatcggcgttttcggatctgtcaatgatttgcctcccgggttcgtccccactgcacctgtggtcatcaggcggtgcggtaagggcttcctgggcgtacttgggagtcggccat

SEQ ID NO: 382702 - DNA, 140 bp, Artificial Sequence
  Synthetic
atggccgactcccaagtacgcccaggaagcccttaccgcaccgcctgatgaccacaggtgcagtggggacgaacccgggaggcaaatcattgacagatccgaaaacgccgatcaaaacctggagacccagcatggcgtat

SEQ ID NO: 382703 - DNA, 140 bp, Artificial Sequence
  Synthetic
atacgccatgctgggtctcctgttaccaaaagtgccttaactgggagggatccagaccaacatcctggcaacgtgatggtcctgggaaccactacctcacggagtatggggacttgtctccgtacttgggagtcggccat

SEQ ID NO: 382704 - DNA, 140 bp, Artificial Sequence
  Synthetic
atggccgactcccaagtacggagacaagtccccatactccgtgaggtagtggttcccaggaccatcacgttgccaggatgttggtctggatccctcccagttaaggcacttttggtaacaggagacccagcatggcgtat

SEQ ID NO: 382705 - DNA, 140 bp, Artificial Sequence
  Synthetic
atacgccatgctgggtctccaacggcatgctcttcactacgtaccatggggcaacctccaggaccatcgccactcctgttggggctttaaacccaagatggtggtcccctagtgatgatgcgtacttgggagtcggccat

SEQ ID NO: 382706 - DNA, 140 bp, Artificial Sequence
  Synthetic
atggccgactcccaagtacgcatcatcactaggggaccaccatcttgggtttaaagccccaacaggagtggcgatggtcctggaggttgccccatggtacgtagtgaagagcatgccgttggagacccagcatggcgtat

SEQ ID NO: 382707 - DNA, 140 bp, Artificial Sequence
  Synthetic
atacgccatgctgggtctcctgacggtctaccctctcccggatggggctacgtcattagcaccctgcacatgccaaccctcatcggtttgggtcatccgagctgatggggcgctgtgccacgtacttgggagtcggccat

SEQ ID NO: 382708 - DNA, 140 bp, Artificial Sequence
  Synthetic
atggccgactcccaagtacgtggcacagcgccccatcagctcggatgacccaaaccgatgagggttggcatgtgcagggtgctaatgacgtagccccatccgggagagggtagaccgtcaggagacccagcatggcgtat

SEQ ID NO: 382709 - DNA, 140 bp, Artificial Sequence
  Synthetic
atacgccatgctgggtctcctggctcctgtcatggggataaggtggaactggatgtagccatggaggtcgctgacttccgtggctcttctggttccccggttctctgtgatgagggtcatcgtacttgggagtcggccat

SEQ ID NO: 382710 - DNA, 140 bp, Artificial Sequence
  Synthetic
atggccgactcccaagtacgatgaccctcatcacagagaaccggggaaccagaagagccacggaagtcagcgacctccatggctacatccagttccaccttatccccatgacaggagccaggagacccagcatggcgtat

SEQ ID NO: 382711 - DNA, 140 bp, Artificial Sequence
  Synthetic
atacgccatgctgggtctccgctgtggggatgttggtggccgtgctccatgtgggaaatagggttaccgctgcaagattcactagaccttggaaccaagttccttcggacgccaagactacgtacttgggagtcggccat

SEQ ID NO: 382712 - DNA, 140 bp, Artificial Sequence
  Synthetic
atggccgactcccaagtacgtagtcttggcgtccgaaggaacttggttccaaggtctagtgaatcttgcagcggtaaccctatttcccacatggagcacggccaccaacatccccacagcggagacccagcatggcgtat

SEQ ID NO: 382713 - DNA, 140 bp, Artificial Sequence
  Synthetic
atacgccatgctgggtctccccaccgagccccctcctgtccctgcgaagggccagttcaaggaggctcctctgtttctaccgacaggttctgggaaaagtactaggatacctttggaatacgtacttgggagtcggccat

SEQ ID NO: 382714 - DNA, 140 bp, Artificial Sequence
  Synthetic
atggccgactcccaagtacgtattccaaaggtatcctagtacttttcccagaacctgtcggtagaaacagaggagcctccttgaactggcccttcgcagggacaggagggggctcggtggggagacccagcatggcgtat

SEQ ID NO: 382715 - DNA, 140 bp, Artificial Sequence
  Synthetic
atacgccatgctgggtctccttccaacatggggcacaaggttttgattctcaatccctcagtggccactgtacggaagatgggaccctacatggagaagatgtccggcaaacatccatcgcgtacttgggagtcggccat

SEQ ID NO: 382716 - DNA, 140 bp, Artificial Sequence
  Synthetic
atggccgactcccaagtacgcgatggatgtttgccggacatcttctccatgtagggtcccatcttccgtacagtggccactgagggattgagaatcaaaaccttgtgccccatgttggaaggagacccagcatggcgtat

SEQ ID NO: 382717 - DNA, 140 bp, Artificial Sequence
  Synthetic
atacgccatgctgggtctccgtgtattgtgggcatgatacaacggcatacaccagagccactgactcagccttgacgtactgtacctacgggaggtttcttgccaatcctaggtccttcccgtacttgggagtcggccat

SEQ ID NO: 382718 - DNA, 140 bp, Artificial Sequence
  Synthetic
atggccgactcccaagtacgggaaggacctaggattggcaagaaacctcccgtaggtacagtacgtcaaggctgagtcagtggctctggtgtatgccgttgtatcatgcccacaatacacggagacccagcatggcgtat

SEQ ID NO: 382719 - DNA, 140 bp, Artificial Sequence
  Synthetic
atacgccatgctgggtctcctgcgaggcgtgagcgtggttatctgtgatgagtgccactcccacgatcccactgtcttgctgggcataggacgcgtaagggagctggccaaggctgcgggcgtacttgggagtcggccat

SEQ ID NO: 382720 - DNA, 140 bp, Artificial Sequence
  Synthetic
atggccgactcccaagtacgcccgcagccttggccagctcccttacgcgtcctatgcccagcaagacagtgggatcgtgggagtggcactcatcacagataaccacgctcacgcctcgcaggagacccagcatggcgtat

SEQ ID NO: 382721 - DNA, 140 bp, Artificial Sequence
  Synthetic
atacgccatgctgggtctccggtcactttggtcctctacgccacagctacgccccctggcgctccgatgacaccccatccaagcatcatcgagcaaaaactagatgtgggcgagatcccccgtacttgggagtcggccat

SEQ ID NO: 382722 - DNA, 140 bp, Artificial Sequence
  Synthetic
atggccgactcccaagtacgggggatctcgcccacatctagtttttgctcgatgatgcttggatggggtgtcatcggagcgccagggggcgtagctgtggcgtagaggaccaaagtgaccggagacccagcatggcgtat

SEQ ID NO: 382723 - DNA, 140 bp, Artificial Sequence
  Synthetic
atacgccatgctgggtctccttttatgggcatggtatccccctcgagcggatgcggaccggccggcacttagtgttctgccattcaaaggcggaatgcgatcggctggctggtcagttttcgtacttgggagtcggccat

SEQ ID NO: 382724 - DNA, 140 bp, Artificial Sequence
  Synthetic
atggccgactcccaagtacgaaaactgaccagccagccgatcgcattccgcctttgaatggcagaacactaagtgccggccggtccgcatccgctcgagggggataccatgcccataaaaggagacccagcatggcgtat

SEQ ID NO: 382725 - DNA, 140 bp, Artificial Sequence
  Synthetic
atacgccatgctgggtctcccctcacggggggttaactctgtgtcctattatcgggggaaagactcgtcctgcatcgtagatggtgacttggtggtatgtgccactgatgccctttccaccgtacttgggagtcggccat

SEQ ID NO: 382726 - DNA, 140 bp, Artificial Sequence
  Synthetic
atggccgactcccaagtacggtggaaagggcatcagtggcacataccaccaagtcaccatctacgatgcaggacgagtctttcccccgataataggacacagagttaaccccccgtgaggggagacccagcatggcgtat

SEQ ID NO: 382727 - DNA, 140 bp, Artificial Sequence
  Synthetic
atacgccatgctgggtctcctggttattctggcaacttcgattcggtgactgactgtggattggtggtggaggaacgcgttgaagtgacgcttgatcccaccatcaccctgtcgctgcaccgtacttgggagtcggccat

SEQ ID NO: 382728 - DNA, 140 bp, Artificial Sequence
  Synthetic
atggccgactcccaagtacggtgcagcgacagggtgatggtgggatcaagcgtcacttcaacgcgttcctccaccaccaatccacagtcagtcaccgaatcgaagttgccagaataaccaggagacccagcatggcgtat

SEQ ID NO: 382729 - DNA, 140 bp, Artificial Sequence
  Synthetic
atacgccatgctgggtctccacagttccggcttcggctgagcttagcatgcagcgacggggccggacggggagaggaagatcaggtcgttactactatgcaggggttgggaaagctcctgcgtacttgggagtcggccat

SEQ ID NO: 382730 - DNA, 140 bp, Artificial Sequence
  Synthetic
atggccgactcccaagtacgcaggagctttcccaacccctgcatagtagtaacgacctgatcttcctctccccgtccggccccgtcgctgcatgctaagctcagccgaagccggaactgtggagacccagcatggcgtat

SEQ ID NO: 382731 - DNA, 140 bp, Artificial Sequence
  Synthetic
atacgccatgctgggtctccctggtgtggtgcgaaccggacccgtctgggccgcaatagagactggcattgcctggtatggaatggaaccggacttgacagcttcacttttgagactttacgtacttgggagtcggccat

SEQ ID NO: 382732 - DNA, 140 bp, Artificial Sequence
  Synthetic
atggccgactcccaagtacgtaaagtctcaaaagtgaagctgtcaagtccggttccattccataccaggcaatgccagtctctattgcggcccagacgggtccggttcgcaccacaccagggagacccagcatggcgtat

SEQ ID NO: 382733 - DNA, 140 bp, Artificial Sequence
  Synthetic
atacgccatgctgggtctcccgacgactgcccatacaccgcagccgttgcagctgacattggtgaagccgcggtgtttttctcaggtctcacccctctgagaatgcatcctgatgtcagccgtacttgggagtcggccat

SEQ ID NO: 382734 - DNA, 140 bp, Artificial Sequence
  Synthetic
atggccgactcccaagtacggctgacatcaggatgcattctcagaggggtgagacctgagaaaaacaccgcggcttcaccaatgtcagctgcaacggctgcggtgtatgggcagtcgtcgggagacccagcatggcgtat

SEQ ID NO: 382735 - DNA, 140 bp, Artificial Sequence
  Synthetic
atacgccatgctgggtctcctgggcaaaaacacgcggttgcaactggccactcctcgtgggcgtccaacggactatgtgccgggaagcactgtcgcccggcccatccgatgacccccaatcgtacttgggagtcggccat

SEQ ID NO: 382736 - DNA, 140 bp, Artificial Sequence
  Synthetic
atggccgactcccaagtacgattgggggtcatcggatgggccgggcgacagtgcttcccggcacatagtccgttggacgcccacgaggagtggccagttgcaaccgcgtgtttttgcccaggagacccagcatggcgtat

SEQ ID NO: 382737 - DNA, 140 bp, Artificial Sequence
  Synthetic
atacgccatgctgggtctccgggctggccttaagggcccaaaccctgtgcccctccttctccggtggggcgcagagtgtccatccagagttgcaggccaccacctggtcgatgacctggtcgtacttgggagtcggccat

SEQ ID NO: 382738 - DNA, 140 bp, Artificial Sequence
  Synthetic
atggccgactcccaagtacgaccaggtcatcgaccaggtggtggcctgcaactctggatggacactctgcgccccaccggagaaggaggggcacagggtttgggcccttaaggccagcccggagacccagcatggcgtat

SEQ ID NO: 382739 - DNA, 140 bp, Artificial Sequence
  Synthetic
atacgccatgctgggtctcctcgtcgtctgggcgtcgctgagggatatgcccactgcgatgcagggccgatcttaatggtcggccttgctattgcaggtgggatgatctatgcgtcgtaccgtacttgggagtcggccat

SEQ ID NO: 382740 - DNA, 140 bp, Artificial Sequence
  Synthetic
atggccgactcccaagtacggtacgacgcatagatcatcccacctgcaatagcaaggccgaccattaagatcggccctgcatcgcagtgggcatatccctcagcgacgcccagacgacgaggagacccagcatggcgtat

SEQ ID NO: 382741 - DNA, 140 bp, Artificial Sequence
  Synthetic
atacgccatgctgggtctccacaggatccttggtggtggttactgattgggaagtgcgaggggggggaaaccccctcatgcgccatggtgaccaggcaactccattaccagtcgtgcaggcgtacttgggagtcggccat

SEQ ID NO: 382742 - DNA, 140 bp, Artificial Sequence
  Synthetic
atggccgactcccaagtacgcctgcacgactggtaatggagttgcctggtcaccatggcgcatgagggggtttcccccccctcgcacttcccaatcagtaaccaccaccaaggatcctgtggagacccagcatggcgtat

SEQ ID NO: 382743 - DNA, 140 bp, Artificial Sequence
  Synthetic
atacgccatgctgggtctccttcccccggaagaacaccgccccggggcagagagtgctcctgccgacgcaaagacagtgactgaggcggtgctggccgtccaaacagcgtgcgattggtccgtacttgggagtcggccat

SEQ ID NO: 382744 - DNA, 140 bp, Artificial Sequence
  Synthetic
atggccgactcccaagtacggaccaatcgcacgctgtttggacggccagcaccgcctcagtcactgtctttgcgtcggcaggagcactctctgccccggggcggtgttcttccgggggaaggagacccagcatggcgtat

SEQ ID NO: 382745 - DNA, 140 bp, Artificial Sequence
  Synthetic
atacgccatgctgggtctcctatattgaccctctccatcggggatgtgttggctgcagtgcaagctaaggccacgacagcgcacgcttggctggctgggtgttacaccggaacccgtgcccgtacttgggagtcggccat

SEQ ID NO: 382746 - DNA, 140 bp, Artificial Sequence
  Synthetic
atggccgactcccaagtacgggcacgggttccggtgtaacacccagccagccaagcgtgcgctgtcgtggccttagcttgcactgcagccaacacatccccgatggagagggtcaatataggagacccagcatggcgtat

SEQ ID NO: 382747 - DNA, 140 bp, Artificial Sequence
  Synthetic
atacgccatgctgggtctccgtccccacggtgtcaattgtggacaagcttttggcggggggctgggctaccatcgtgggccactgtcatagtgtcatagcagcggccgtggccgcttatgcgtacttgggagtcggccat

SEQ ID NO: 382748 - DNA, 140 bp, Artificial Sequence
  Synthetic
atggccgactcccaagtacgcataagcggccacggccgctgctatgacactatgacagtggcccacgatggtagcccagccccccgccaaaagcttgtccacaattgacaccgtggggacggagacccagcatggcgtat

SEQ ID NO: 382749 - DNA, 140 bp, Artificial Sequence
  Synthetic
atacgccatgctgggtctccgcgctaacaggagcccgcctttggctgctgctgcttcctacctaatggggctaggagtgggcggaaacgcacaggtgcgcctagcgtcggctcttttgctcgtacttgggagtcggccat

SEQ ID NO: 382750 - DNA, 140 bp, Artificial Sequence
  Synthetic
atggccgactcccaagtacgagcaaaagagccgacgctaggcgcacctgtgcgtttccgcccactcctagccccattaggtaggaagcagcagcagccaaaggcgggctcctgttagcgcggagacccagcatggcgtat

SEQ ID NO: 382751 - DNA, 140 bp, Artificial Sequence
  Synthetic
atacgccatgctgggtctccgggggctgccggcactgcccttggaacaccggtcgtgggtctaaccatggccggtgctttcatgggcggttcgtcggtgtccccctccttggtcacaatgcgtacttgggagtcggccat

SEQ ID NO: 382752 - DNA, 140 bp, Artificial Sequence
  Synthetic
atggccgactcccaagtacgcattgtgaccaaggagggggacaccgacgaaccgcccatgaaagcaccggccatggttagacccacgaccggtgttccaagggcagtgccggcagcccccggagacccagcatggcgtat

SEQ ID NO: 382753 - DNA, 140 bp, Artificial Sequence
  Synthetic
atacgccatgctgggtctccctcctaggagcaattggtggctgggaaggggtcgttagtgcggcgagcctcgttttcgacttcatggcgggaaagttaacaccagaggacctatggtatgcgtacttgggagtcggccat

SEQ ID NO: 382754 - DNA, 140 bp, Artificial Sequence
  Synthetic
atggccgactcccaagtacgcataccataggtcctctggtgttaactttcccgccatgaagtcgaaaacgaggctcgccgcactaacgaccccttcccagccaccaattgctcctaggagggagacccagcatggcgtat

SEQ ID NO: 382755 - DNA, 140 bp, Artificial Sequence
  Synthetic
atacgccatgctgggtctccgcatcccgatactaacgagtcccggggctggcctagccggctttgccttggggcttgtattgtattcgggtaacactgctggggcaacgacatggcttaacgtacttgggagtcggccat

SEQ ID NO: 382756 - DNA, 140 bp, Artificial Sequence
  Synthetic
atggccgactcccaagtacgttaagccatgtcgttgccccagcagtgttacccgaatacaatacaagccccaaggcaaagccggctaggccagccccgggactcgttagtatcgggatgcggagacccagcatggcgtat

SEQ ID NO: 382757 - DNA, 140 bp, Artificial Sequence
  Synthetic
atacgccatgctgggtctcctcgactgttgactaccctcccgagatccaatgtcatcccagacacgtacttccaggaggctgactattgtgacagagtatctgccctactgcgacgcctccgtacttgggagtcggccat

SEQ ID NO: 382758 - DNA, 140 bp, Artificial Sequence
  Synthetic
atggccgactcccaagtacggaggcgtcgcagtagggcagatactctgtcacaatagtcagcctcctggaagtacgtgtctgggatgacattggatctcgggagggtagtcaacagtcgaggagacccagcatggcgtat

SEQ ID NO: 382759 - DNA, 140 bp, Artificial Sequence
  Synthetic
atacgccatgctgggtctccagtttaactaggctcatagtgggggcagtgacccatcagcctagggtggacgaaatccaggtgggctatgtatgggatctctgggaatgggtgatgcgcccgtacttgggagtcggccat

SEQ ID NO: 382760 - DNA, 140 bp, Artificial Sequence
  Synthetic
atggccgactcccaagtacgggcgcatcacccattcccagagatcccatacatagcccacctggatttcgtccaccctaggctgatgggtcactgcccccactatgagcctagttaaactggagacccagcatggcgtat

SEQ ID NO: 382761 - DNA, 140 bp, Artificial Sequence
  Synthetic
atacgccatgctgggtctcctcctgcgtcgatgcgtgaataggctgcgggccctctgccccgtcgtgtcactaccactgtggcattgcggggaggggtggtccggagaatggttattggacgtacttgggagtcggccat

SEQ ID NO: 382762 - DNA, 140 bp, Artificial Sequence
  Synthetic
atggccgactcccaagtacgtccaataaccattctccggaccacccctccccgcaatgccacagtggtagtgacacgacggggcagagggcccgcagcctattcacgcatcgacgcaggaggagacccagcatggcgtat

SEQ ID NO: 382763 - DNA, 140 bp, Artificial Sequence
  Synthetic
atacgccatgctgggtctccgggccatattgaggcacgatgtctctgtggctgtgtgatcactggagaggttctcaatgggaaattgcaggacgtcatttactctacaaaaatgtgccgtcgtacttgggagtcggccat

SEQ ID NO: 382764 - DNA, 140 bp, Artificial Sequence
  Synthetic
atggccgactcccaagtacgacggcacatttttgtagagtaaatgacgtcctgcaatttcccattgagaacctctccagtgatcacacagccacagagacatcgtgcctcaatatggcccggagacccagcatggcgtat

SEQ ID NO: 382765 - DNA, 140 bp, Artificial Sequence
  Synthetic
atacgccatgctgggtctcccactattggatggggacggtgccggtcaacatgttggggtatggggaaactagtcccctgctgtgtaccgacgcccctaaggttgtccctattgggacctcgtacttgggagtcggccat

SEQ ID NO: 382766 - DNA, 140 bp, Artificial Sequence
  Synthetic
atggccgactcccaagtacgaggtcccaatagggacaaccttaggggcgtcggtacacagcaggggactagtttccccataccccaacatgttgaccggcaccgtccccatccaatagtgggagacccagcatggcgtat

SEQ ID NO: 382767 - DNA, 140 bp, Artificial Sequence
  Synthetic
atacgccatgctgggtctccccggatgggtagaggttgtggtgacccccactcatgtgatcgtgcgtcgctcctcttcttataagttgatgcgccaacaagttctctccgcagcggtgtccgtacttgggagtcggccat

SEQ ID NO: 382768 - DNA, 140 bp, Artificial Sequence
  Synthetic
atggccgactcccaagtacggacaccgctgcggagagaacttgttggcgcatcaacttataagaagaggagcgacgcacgatcacatgagtgggggtcaccacaacctctacccatccggggagacccagcatggcgtat

SEQ ID NO: 382769 - DNA, 140 bp, Artificial Sequence
  Synthetic
atacgccatgctgggtctccagaaccctactttgtggatggcattcctgtctcatgggaggctgatgctaaggctccggccttggtgtatggcccaggacaaggtgtgaccatagacggtcgtacttgggagtcggccat

SEQ ID NO: 382770 - DNA, 140 bp, Artificial Sequence
  Synthetic
atggccgactcccaagtacgaccgtctatggtcacaccttgtcctgggccatacaccaaggccggagccttagcatcagcctcccatgagacaggaatgccatccacaaagtagggttctggagacccagcatggcgtat

SEQ ID NO: 382771 - DNA, 140 bp, Artificial Sequence
  Synthetic
atacgccatgctgggtctccgagaagtatacactcccgcatcaattgcgggtgaggaacttcgcaccgtctgaggtaagttcggtttcgatcgatgtcagctgtgaggagtctgaggacacgtacttgggagtcggccat

SEQ ID NO: 382772 - DNA, 140 bp, Artificial Sequence
  Synthetic
atggccgactcccaagtacgtgtcctcagactcctcacagctgacatcgatcgaaaccgaacttacctcagacggtgcgaagttcctcacccgcaattgatgcgggagtgtatacttctcggagacccagcatggcgtat

SEQ ID NO: 382773 - DNA, 140 bp, Artificial Sequence
  Synthetic
atacgccatgctgggtctccctgaactgactgagacggatttgccacctgcagcggcggccctccaggctattgaggatgctgcgaggatccttgagcctcacatagacgtgatcatggacgtacttgggagtcggccat

SEQ ID NO: 382774 - DNA, 140 bp, Artificial Sequence
  Synthetic
atggccgactcccaagtacgtccatgatcacgtctatgtgaggctcaaggatcctcgcagcatcctcaatagcctggagggccgccgctgcaggtggcaaatccgtctcagtcagttcagggagacccagcatggcgtat

SEQ ID NO: 382775 - DNA, 140 bp, Artificial Sequence
  Synthetic
atacgccatgctgggtctccggactgttcaacaccctctctctgtggtagcagtcgagagatgcctgtatggggtgacgacattccccgtacgccatcgcctgcgcgaatttctgtaacacgtacttgggagtcggccat

SEQ ID NO: 382776 - DNA, 140 bp, Artificial Sequence
  Synthetic
atggccgactcccaagtacgtgttacagaaattcgcgcaggcgatggcgtacggggaatgtcgtcaccccatacaggcatctctcgactgctaccacagagagagggtgttgaacagtccggagacccagcatggcgtat

SEQ ID NO: 382777 - DNA, 140 bp, Artificial Sequence
  Synthetic
atacgccatgctgggtctccgagagcaccgacgggcctgaaacatcgtcagagccatcctcgcaggatgactgtccatcatcagactcgtttgaagtgataccctcaacatcatctgtaacgtacttgggagtcggccat

SEQ ID NO: 382778 - DNA, 140 bp, Artificial Sequence
  Synthetic
atggccgactcccaagtacgttacagatgatgttgagggtatcacttcaaacgagtctgatgatggacagtcatcctgcgaggatggctctgacgatgtttcaggcccgtcggtgctctcggagacccagcatggcgtat

SEQ ID NO: 382779 - DNA, 140 bp, Artificial Sequence
  Synthetic
atacgccatgctgggtctccctgaggaggaaggggagaatgtctttaatgtcgctctgtcaatactgaagtctctgtttccacaaagcgacgctactaggaagcttacggtgaaaaagcccgtacttgggagtcggccat

SEQ ID NO: 382780 - DNA, 140 bp, Artificial Sequence
  Synthetic
atggccgactcccaagtacgggctttttcaccgtaagcttcctagtagcgtcgctttgtggaaacagagacttcagtattgacagagcgacattaaagacattctccccttcctcctcagggagacccagcatggcgtat

SEQ ID NO: 382781 - DNA, 140 bp, Artificial Sequence
  Synthetic
atacgccatgctgggtctccatgcgaggataaatcggtcacccggttcttctcgcttggcctcaccgttgctgatgtggcgagcttgtgtgagatgcagattaccaaccacacagcctatcgtacttgggagtcggccat

SEQ ID NO: 382782 - DNA, 140 bp, Artificial Sequence
  Synthetic
atggccgactcccaagtacgataggctgtgtggttggtaatctgcatctcacacaagctcgccacatcagcaacggtgaggccaagcgagaagaaccgggtgaccgatttatcctcgcatggagacccagcatggcgtat

SEQ ID NO: 382783 - DNA, 140 bp, Artificial Sequence
  Synthetic
atacgccatgctgggtctcctgtgacaaggttcgcacacctctggagctccagatcgggtgcttggtaggtaatgagcttatttttgtatgtgatgaagatgacaagcgctgtgaaacgccgtacttgggagtcggccat

SEQ ID NO: 382784 - DNA, 140 bp, Artificial Sequence
  Synthetic
atggccgactcccaagtacggcgtttcacagcgcttgtcatcttcatcacatacaaaaataagctcattacctaccaagcacccgatctggagctccagaggtgtgcgaaccttgtcacaggagacccagcatggcgtat

SEQ ID NO: 382785 - DNA, 140 bp, Artificial Sequence
  Synthetic
atacgccatgctgggtctcctgacctccttctcatattgttggtcgggagtgcccttaacacgggcgttgccgtccaaaccaccggtcacccgaccggtgggggccatgttggtgacggacgtacttgggagtcggccat

SEQ ID NO: 382786 - DNA, 140 bp, Artificial Sequence
  Synthetic
atggccgactcccaagtacgtccgtcaccaacatggcccccaccggtcgggtgaccggtggtttggacggcaacgcccgtgttaagggcactcccgaccaacaatatgagaaggaggtcaggagacccagcatggcgtat

SEQ ID NO: 382787 - DNA, 140 bp, Artificial Sequence
  Synthetic
atacgccatgctgggtctcctaccaccaaggtgtacgttaccaatccggacaatgtggggagaagggttgacagtgtgaccttttggcgtggaccccgggttcacgacaagttcttggtccgtacttgggagtcggccat

SEQ ID NO: 382788 - DNA, 140 bp, Artificial Sequence
  Synthetic
atggccgactcccaagtacggaccaagaacttgtcgtgaacccggggtccacgccaaaaggtcacactgtcaacccttctccccacattgtccggattggtaacgtacaccttggtggtaggagacccagcatggcgtat

SEQ ID NO: 382789 - DNA, 140 bp, Artificial Sequence
  Synthetic
atacgccatgctgggtctccaacgcgatcgagaaggccaaaatggcagcacagcgtattgacagcaagggttacacatatgaggaagcaatcaagacggtgaggccgcatgcagccatggcgtacttgggagtcggccat

SEQ ID NO: 382790 - DNA, 140 bp, Artificial Sequence
  Synthetic
atggccgactcccaagtacgccatggctgcatgcggcctcaccgtcttgattgcttcctcatatgtgtaacccttgctgtcaatacgctgtgctgccattttggccttctcgatcgcgttggagacccagcatggcgtat

SEQ ID NO: 382791 - DNA, 140 bp, Artificial Sequence
  Synthetic
atacgccatgctgggtctccgctggggatctaagacttcagttaaaggccttgaaacacctgaagggaaaatggcggtacatgaccgtctcctggacattcaaaaggggactccggtccccgtacttgggagtcggccat

SEQ ID NO: 382792 - DNA, 140 bp, Artificial Sequence
  Synthetic
atggccgactcccaagtacggggaccggagtccccttttgaatgtccaggagacggtcatgtaccgccattttcccttcaggtgtttcaaggcctttaactgaagtcttagatccccagcggagacccagcatggcgtat

SEQ ID NO: 382793 - DNA, 140 bp, Artificial Sequence
  Synthetic
atacgccatgctgggtctcccttcactctaactgtgaaaaaggaggtcttctaccgagatcggaaggaggagaaagctccaaggctcattgtcttcccccccctggacttccgggtcgctcgtacttgggagtcggccat

SEQ ID NO: 382794 - DNA, 140 bp, Artificial Sequence
  Synthetic
atggccgactcccaagtacgagcgacccggaagtccaggggggggaagacaatgagccttggagctttctcctccttccgatctcggtagaagacctcctttttcacagttagagtgaagggagacccagcatggcgtat

SEQ ID NO: 382795 - DNA, 140 bp, Artificial Sequence
  Synthetic
atacgccatgctgggtctccgaaaagatgatcatgggggatccagggagggtggcgaagggtatccttggggacgcctatgctttccagtacactccgaaccagcgggtgaaaaagatggcgtacttgggagtcggccat

SEQ ID NO: 382796 - DNA, 140 bp, Artificial Sequence
  Synthetic
atggccgactcccaagtacgccatctttttcacccgctggttcggagtgtactggaaagcataggcgtccccaaggatacccttcgccaccctccctggatcccccatgatcatcttttcggagacccagcatggcgtat

SEQ ID NO: 382797 - DNA, 140 bp, Artificial Sequence
  Synthetic
atacgccatgctgggtctcctggagatgtgggggagcaagaagacaccctgtgccatatgtgtagacgccaaatgtttcgatagctccatcaacctcgaagatgttgagcttgagactgacgtacttgggagtcggccat

SEQ ID NO: 382798 - DNA, 140 bp, Artificial Sequence
  Synthetic
atggccgactcccaagtacgtcagtctcaagctcaacatcttcgaggttgatggagctatcgaaacatttggcgtctacacatatggcacagggtgtcttcttgctcccccacatctccaggagacccagcatggcgtat

SEQ ID NO: 382799 - DNA, 140 bp, Artificial Sequence
  Synthetic
atacgccatgctgggtctccgctctatgctttggcatcagataatcctgaacaagtcagagcccttggtcggtattacgcggaaggtcctatggtttcccctgagggggttcccttgggccgtacttgggagtcggccat

SEQ ID NO: 382800 - DNA, 140 bp, Artificial Sequence
  Synthetic
atggccgactcccaagtacggcccaagggaaccccctcaggggaaaccataggaccttccgcgtaataccgaccaagggctctgacttgttcaggattatctgatgccaaagcatagagcggagacccagcatggcgtat

SEQ ID NO: 382801 - DNA, 140 bp, Artificial Sequence
  Synthetic
atacgccatgctgggtctcccaccggttctgccgatcttctggggttttaactacaagttctagcaattgcatcacatgctacattaaggtcagtgctgcttgtgcacgcattggcctgacgtacttgggagtcggccat

SEQ ID NO: 382802 - DNA, 140 bp, Artificial Sequence
  Synthetic
atggccgactcccaagtacgtcaggccaatgcgtgcacaagcagcactgaccttaatgtagcatgtgatgcaattgctagaacttgtagttaaaaccccagaagatcggcagaaccggtgggagacccagcatggcgtat

SEQ ID NO: 382803 - DNA, 140 bp, Artificial Sequence
  Synthetic
atacgccatgctgggtctccagggcgtgtcgctgcttattgctggtgatgactgtcttatcatttgtgaaagaccgatttgtgacccgtgcgaggcgttgggcgcggccctccgctcgtacgtacttgggagtcggccat

SEQ ID NO: 382804 - DNA, 140 bp, Artificial Sequence
  Synthetic
atggccgactcccaagtacgtacgagcggagggccgcgcccaacgcctcgcacgggtcacaaatcggtctttcacaaatgataagacagtcatcaccagcaataagcagcgacacgccctggagacccagcatggcgtat

SEQ ID NO: 382805 - DNA, 140 bp, Artificial Sequence
  Synthetic
atacgccatgctgggtctcccgggtacaattgtgaaccatcctatcatgcctcccttgacactgctccgttttgctcgacctggctggcagagtgtaatgccaatggtagtaggcactttcgtacttgggagtcggccat

SEQ ID NO: 382806 - DNA, 140 bp, Artificial Sequence
  Synthetic
atggccgactcccaagtacgaaagtgcctactaccattggcattacactctgccagccaggtcgagcaaaacggagcagtgtcaagggaggcatgataggatggttcacaattgtacccgggagacccagcatggcgtat

SEQ ID NO: 382807 - DNA, 140 bp, Artificial Sequence
  Synthetic
atacgccatgctgggtctccttcttgactactgactttaggagacctttggcaagaatgtccagtgagtattcagacccaatggcttcggcaattgggtattgtttgctctacccttggccgtacttgggagtcggccat

SEQ ID NO: 382808 - DNA, 140 bp, Artificial Sequence
  Synthetic
atggccgactcccaagtacggccaagggtagagcaaacaatacccaattgccgaagccattgggtctgaatactcactggacattcttgccaaaggtctcctaaagtcagtagtcaagaaggagacccagcatggcgtat

SEQ ID NO: 382809 - DNA, 140 bp, Artificial Sequence
  Synthetic
atacgccatgctgggtctccacccgatagtcaggtgggttgccataccccatgttttgcaagtcgctttccgtgggggtggcacacccgctgatcctgtctggtgccaagtgcacgggaacgtacttgggagtcggccat

SEQ ID NO: 382810 - DNA, 140 bp, Artificial Sequence
  Synthetic
atggccgactcccaagtacgttcccgtgcacttggcaccagacaggatcagcgggtgtgccacccccacggaaagcgacttgcaaaacatggggtatggcaacccacctgactatcgggtggagacccagcatggcgtat

SEQ ID NO: 382811 - DNA, 140 bp, Artificial Sequence
  Synthetic
atacgccatgctgggtctccttactatctgttccctttgaacaagttgcctaacatcatagtggccctgcacggtccagcagcgttaagggtcactgcagacacaaccaaaaccaaaatgcgtacttgggagtcggccat

SEQ ID NO: 382812 - DNA, 140 bp, Artificial Sequence
  Synthetic
atggccgactcccaagtacgcattttggttttggttgtgtctgcagtgacccttaacgctgctggaccgtgcagggccactatgatgttaggcaacttgttcaaagggaacagatagtaaggagacccagcatggcgtat

SEQ ID NO: 382813 - DNA, 140 bp, Artificial Sequence
  Synthetic
atacgccatgctgggtctccgaggctgggaaggtgctatccgacatgaaactcccgggcctctctgtctaccggaaaaaggctggtgcgcttcgaacgcgcatgctcaaatcctccggttcgtacttgggagtcggccat

SEQ ID NO: 382814 - DNA, 140 bp, Artificial Sequence
  Synthetic
atggccgactcccaagtacgaaccggaggatttgagcatgcgcgttcgaagcgcaccagcctttttccggtagacagagaggcccgggagtttcatgtcggatagcaccttcccagcctcggagacccagcatggcgtat

SEQ ID NO: 382815 - DNA, 140 bp, Artificial Sequence
  Synthetic
atacgccatgctgggtctccgggcggagttggctcggggcctgttgtggcaccctggtcttcgactaaggccacctgaaattgctggaatcccgggtggctttcctctggctcccccctacgtacttgggagtcggccat

SEQ ID NO: 382816 - DNA, 140 bp, Artificial Sequence
  Synthetic
atggccgactcccaagtacgtaggggggagccagaggaaagccacccgggattccagcaatttcaggtggccttagtcgaagaccagggtgccacaacaggccccgagccaactccgcccggagacccagcatggcgtat

SEQ ID NO: 382817 - DNA, 140 bp, Artificial Sequence
  Synthetic
atacgccatgctgggtctcctatgggggtagtccacacattggatttcactcagccaaggagtcggtggcgactgttatttgggctattagcccttgtagtggttgccatctttggttgacgtacttgggagtcggccat

SEQ ID NO: 382818 - DNA, 140 bp, Artificial Sequence
  Synthetic
atggccgactcccaagtacgtcaaccaaagatggcaaccactacaagggctaatagcccaaataacagtcgccaccgactccttggctgagtgaaatccaatgtgtggactacccccataggagacccagcatggcgtat

SEQ ID NO: 382819 - DNA, 140 bp, Artificial Sequence
  Synthetic
atacgccatgctgggtctccgctaaaactcaggtacgggcaaggagcgcaagctggggctttccgacccccccccccaggacgattccccgcttggtaaaaagggccaggccatgggatccgtacttgggagtcggccat

SEQ ID NO: 382820 - DNA, 140 bp, Artificial Sequence
  Synthetic
atggccgactcccaagtacggatcccatggcctggccctttttaccaagcggggaatcgtcctgggggggggggtcggaaagccccagcttgcgctccttgcccgtacctgagttttagcggagacccagcatggcgtat

SEQ ID NO: 382821 - DNA, 140 bp, Artificial Sequence
  Synthetic
atacgccatgctgggtctccgacgattgtggaatcgtaaaatccacccctggcagggttatagcctgatggtggtaatccaccgctgccgcaggccggtcgctacgttatagcgtaatcccgtacttgggagtcggccat

SEQ ID NO: 382822 - DNA, 140 bp, Artificial Sequence
  Synthetic
atggccgactcccaagtacgggattacgctataacgtagcgaccggcctgcggcagcggtggattaccaccatcaggctataaccctgccaggggtggattttacgattccacaatcgtcggagacccagcatggcgtat

SEQ ID NO: 382823 - DNA, 140 bp, Artificial Sequence
  Synthetic
aggccctggctgctgatatggtggtaatccaccgctgccgcaggccggtcgctacgttatagcgtaatccgtgactacgggctgctcgcagagccctcctcggatgaggcgcagtgcactgaccttttgggacagcggtg

SEQ ID NO: 382824 - DNA, 140 bp, Artificial Sequence
  Synthetic
caccgctgtcccaaaaggtcagtgcactgcgcctcatccgaggagggctctgcgagcagcccgtagtcacggattacgctataacgtagcgaccggcctgcggcagcggtggattaccaccatatcagcagccagggcct

SEQ ID NO: 382825 - DNA, 140 bp, Artificial Sequence
  Synthetic
atacgccatgctgggtctcctgacgtgggggggttgatcccccccccccggcactgggtgcaagccccataaaccgacgcctatctaagtagacgcaatgactcggcgccgactcggcgacgtacttgggagtcggccat

SEQ ID NO: 382826 - DNA, 140 bp, Artificial Sequence
  Synthetic
atggccgactcccaagtacgtcgccgagtcggcgccgagtcattgcgtctacttagataggcgtcggtttatggggcttgcacccagtgccgggggggggggatcaacccccccacgtcaggagacccagcatggcgtat

SEQ ID NO: 382827 - DNA, 140 bp, Artificial Sequence
  Synthetic
aggccctggctgctgatatgaaaccgacgcctatctaagtagacgcaatgactcggcgccgactcggcgaccggccaaaaggtggtggatgggtggtgacagggttggtaggtcgtaaatgaccttttgggacagcggtg

SEQ ID NO: 382828 - DNA, 140 bp, Artificial Sequence
  Synthetic
caccgctgtcccaaaaggtcatttacgacctaccaaccctgtcaccacccatccaccaccttttggccggtcgccgagtcggcgccgagtcattgcgtctacttagataggcgtcggtttcatatcagcagccagggcct

SEQ ID NO: 382829 - DNA, 140 bp, Artificial Sequence
  Synthetic
atacgccatgctgggtctcccccggtcatcctggtagccactataggtgggtcttaagagaaggtcaagactcctcttgtgcctgcggcgagaccgcgcacggtccacaggtgctggccccgtacttgggagtcggccat

SEQ ID NO: 382830 - DNA, 140 bp, Artificial Sequence
  Synthetic
atggccgactcccaagtacggggccagcacctgtggaccgtgcgcggtctcgccgcaggcacaagaggagtcttgaccttctcttaagacccacctatagtggctaccaggatgaccgggggagacccagcatggcgtat

SEQ ID NO: 382831 - DNA, 140 bp, Artificial Sequence
  Synthetic
aggccctggctgctgatatgatgtctctcttgaccaataggtttatccggcgagttgacaaggaccagtgggggccgggggttatggggaaggaccccaaaccctgcccttcccggtggggaccttttgggacagcggtg

SEQ ID NO: 382832 - DNA, 140 bp, Artificial Sequence
  Synthetic
caccgctgtcccaaaaggtccccaccgggaagggcagggtttggggtccttccccataacccccggcccccactggtccttgtcaactcgccggataaacctattggtcaagagagacatcatatcagcagccagggcct

SEQ ID NO: 382833 - DNA, 140 bp, Artificial Sequence
  Synthetic
atacgccatgctgggtctccggggccgggggttatggggaaggaccccaaaccctgcccttcccggtgggccgggaaatgcatggggccacccagctccgcggcggcctgcagccggggtcgtacttgggagtcggccat

SEQ ID NO: 382834 - DNA, 140 bp, Artificial Sequence
  Synthetic
atggccgactcccaagtacgaccccggctgcaggccgccgcggagctgggtggccccatgcatttcccggcccaccgggaagggcagggtttggggtccttccccataacccccggccccggagacccagcatggcgtat

SEQ ID NO: 382835 - DNA, 140 bp, Artificial Sequence
  Synthetic
aggccctggctgctgatatgtggccccggccacccacgcttgtcgagcgaatgggcaatatttcctcacaaattgctgtgccccggaagacatcgggttctgcctggaaggcggatgcctgaccttttgggacagcggtg

SEQ ID NO: 382836 - DNA, 140 bp, Artificial Sequence
  Synthetic
caccgctgtcccaaaaggtcaggcatccgccttccaggcagaacccgatgtcttccggggcacagcaatttgtgaggaaatattgcccattcgctcgacaagcgtgggtggccggggccacatatcagcagccagggcct

SEQ ID NO: 382837 - DNA, 140 bp, Artificial Sequence
  Synthetic
atacgccatgctgggtctccggtggccctggggtgcacggtttgcaccgaccgttgctggccactgtatcaggcgggtttggctgtgcggcctggcaagtccgcggcccagctcgttgggcgtacttgggagtcggccat

SEQ ID NO: 382838 - DNA, 140 bp, Artificial Sequence
  Synthetic
atggccgactcccaagtacgcccaacgagctgggccgcggacttgccaggccgcacagccaaacccgcctgatacagtggccagcaacggtcggtgcaaaccgtgcaccccagggccaccggagacccagcatggcgtat

SEQ ID NO: 382839 - DNA, 140 bp, Artificial Sequence
  Synthetic
atacgccatgctgggtctccgaactggggagcctgtacgggcccttgtcggtctcggcttacgtagccgggatcctgggtctgggcgaggtttactccggggtcctgacagttggtgttgcgtacttgggagtcggccat

SEQ ID NO: 382840 - DNA, 140 bp, Artificial Sequence
  Synthetic
atggccgactcccaagtacgcaacaccaactgtcaggaccccggagtaaacctcgcccagacccaggatcccggctacgtaagccgagaccgacaagggcccgtacaggctccccagttcggagacccagcatggcgtat

SEQ ID NO: 382841 - DNA, 140 bp, Artificial Sequence
  Synthetic
atacgccatgctgggtctcccgttgaggcgccgggtctacctgatgcccaacctgaagtgtgcagtagaatgtgacgttaagtggggaagtgagttttggagatggactgagcagttggccgtacttgggagtcggccat

SEQ ID NO: 382842 - DNA, 140 bp, Artificial Sequence
  Synthetic
atggccgactcccaagtacggccaactgctcagtccatctccaaaactcacttccccacttaacgtcacattctactgcacacttcaggttgggcatcaggtagacccggcgcctcaacgggagacccagcatggcgtat

SEQ ID NO: 382843 - DNA, 140 bp, Artificial Sequence
  Synthetic
atacgccatgctgggtctccctccaattactggattttggaatacctttggaaagtcccatttgaattttggagaggagtgatgagcctgacccctctgttggtttgggtggccgcattgcgtacttgggagtcggccat

SEQ ID NO: 382844 - DNA, 140 bp, Artificial Sequence
  Synthetic
atggccgactcccaagtacgcaatgcggccacccaaaccaacagaggggtcaggctcatcactcctctccaaaattcaaatgggactttccaaaggtattccaaaatccagtaattggagggagacccagcatggcgtat

SEQ ID NO: 382845 - DNA, 140 bp, Artificial Sequence
  Synthetic
atacgccatgctgggtctcccttttgctggagcaacggattgtcatggttttcctgctggtgacgatggcggggatgttgcaaggcgcccccgcctccgttttggggtcccgcccctttgcgtacttgggagtcggccat

SEQ ID NO: 382846 - DNA, 140 bp, Artificial Sequence
  Synthetic
atggccgactcccaagtacgcaaaggggcgggaccccaaaacggaggcgggggcgccttgcaacatccccgccatcgtcaccagcaggaaaaccatgacaatccgttgctccagcaaaagggagacccagcatggcgtat

SEQ ID NO: 382847 - DNA, 140 bp, Artificial Sequence
  Synthetic
atacgccatgctgggtctccactacgggttgaagtggcagtcatgctcctgcagggctaacgggtcgcgtattcccactggggagagggtgtgggatcgagggaatgtcacgctcttgtgcgtacttgggagtcggccat

SEQ ID NO: 382848 - DNA, 140 bp, Artificial Sequence
  Synthetic
atggccgactcccaagtacgcacaagagcgtgacattccctcgatcccacaccctctccccagtgggaatacgcgacccgttagccctgcaggagcatgactgccacttcaacccgtagtggagacccagcatggcgtat

SEQ ID NO: 382849 - DNA, 140 bp, Artificial Sequence
  Synthetic
atacgccatgctgggtctcctgactgccccaacggcccctgggtttgggtcccggccttttgccaggcggttgggtggggcgaccccatcacccattggagccacggacaaaaccagtggcgtacttgggagtcggccat

SEQ ID NO: 382850 - DNA, 140 bp, Artificial Sequence
  Synthetic
atggccgactcccaagtacgccactggttttgtccgtggctccaatgggtgatggggtcgccccacccaaccgcctggcaaaaggccgggacccaaacccaggggccgttggggcagtcaggagacccagcatggcgtat

SEQ ID NO: 382851 - DNA, 140 bp, Artificial Sequence
  Synthetic
atacgccatgctgggtctcccccctatcatgcccccaatatgtctatgggtctgtgtccgtaacgtgcgtgtggggttccgtgtcttggtttgcctcgaccggcggtcgtgattcgaagacgtacttgggagtcggccat

SEQ ID NO: 382852 - DNA, 140 bp, Artificial Sequence
  Synthetic
atggccgactcccaagtacgtcttcgaatcacgaccgccggtcgaggcaaaccaagacacggaaccccacacgcacgttacggacacagacccatagacatattgggggcatgataggggggagacccagcatggcgtat

SEQ ID NO: 382853 - DNA, 140 bp, Artificial Sequence
  Synthetic
atacgccatgctgggtctcctcgatgtgtggagtttggtgccggttggatctgccagctgcaccatagccgctctagggtcatcggatcgcgacacggtggttgagctctccgagtggggcgtacttgggagtcggccat

SEQ ID NO: 382854 - DNA, 140 bp, Artificial Sequence
  Synthetic
atggccgactcccaagtacgccccactcggagagctcaaccaccgtgtcgcgatccgatgaccctagagcggctatggtgcagctggcagatccaaccggcaccaaactccacacatcgaggagacccagcatggcgtat

SEQ ID NO: 382855 - DNA, 140 bp, Artificial Sequence
  Synthetic
atacgccatgctgggtctccagtcccgtgcgtaacgtgtattctggaccgtcggcctgcttcatgtggcacctgtgtgcgggactgctggcccgaaaccgggtcggttagattccctttccgtacttgggagtcggccat

SEQ ID NO: 382856 - DNA, 140 bp, Artificial Sequence
  Synthetic
atggccgactcccaagtacggaaagggaatctaaccgacccggtttcgggccagcagtcccgcacacaggtgccacatgaagcaggccgacggtccagaatacacgttacgcacgggactggagacccagcatggcgtat

SEQ ID NO: 382857 - DNA, 140 bp, Artificial Sequence
  Synthetic
aggccctggctgctgatatgcctgtgtgcgggactgctggcccgaaaccgggtcggttagattccctttccatcggtgcggcacggggcctcggctgacaaaggacttggaagctgtgccgaccttttgggacagcggtg

SEQ ID NO: 382858 - DNA, 140 bp, Artificial Sequence
  Synthetic
caccgctgtcccaaaaggtcggcacagcttccaagtcctttgtcagccgaggccccgtgccgcaccgatggaaagggaatctaaccgacccggtttcgggccagcagtcccgcacacaggcatatcagcagccagggcct

SEQ ID NO: 382859 - DNA, 140 bp, Artificial Sequence
  Synthetic
aggccctggctgctgatatgcttcgtcaacaggacaactcccttcaccataaggggccccctgggcaaccaggggagaggcaacccggtgcggtcgcccctgggttttgggtcctacaccgaccttttgggacagcggtg

SEQ ID NO: 382860 - DNA, 140 bp, Artificial Sequence
  Synthetic
caccgctgtcccaaaaggtcggtgtaggacccaaaacccaggggcgaccgcaccgggttgcctctcccctggttgcccagggggccccttatggtgaagggagttgtcctgttgacgaagcatatcagcagccagggcct

SEQ ID NO: 382861 - DNA, 140 bp, Artificial Sequence
  Synthetic
atacgccatgctgggtctccatgaccaagatccgggattccctgcatttggtgaaatgtcccacaccagccatagagcctccgactggaacgttcgggttcttccccggagtcccgcccacgtacttgggagtcggccat

SEQ ID NO: 382862 - DNA, 140 bp, Artificial Sequence
  Synthetic
atggccgactcccaagtacgtgggcgggactccggggaagaacccgaacgttccagtcggaggctctatggctggtgtgggacatttcaccaaatgcagggaatcccggatcttggtcatggagacccagcatggcgtat

SEQ ID NO: 382863 - DNA, 140 bp, Artificial Sequence
  Synthetic
atacgccatgctgggtctccttaacaactgcatgccgctaggcacggaagtgtctgaggcattgggcggagctgggcttacgggggggttctacgagcctctggttcgcaggtgttcggacgtacttgggagtcggccat

SEQ ID NO: 382864 - DNA, 140 bp, Artificial Sequence
  Synthetic
atggccgactcccaagtacgtccgaacacctgcgaaccagaggctcgtagaacccccccgtaagcccagctccgcccaatgcctcagacacttccgtgcctagcggcatgcagttgttaaggagacccagcatggcgtat

SEQ ID NO: 382865 - DNA, 140 bp, Artificial Sequence
  Synthetic
atacgccatgctgggtctccgctgatgggacgccgaaatccggtttgcccggggtacgcatggctgtcctctggtagacctgacgggttcatacacgtccaggggcacctgcaggaggtgcgtacttgggagtcggccat

SEQ ID NO: 382866 - DNA, 140 bp, Artificial Sequence
  Synthetic
atggccgactcccaagtacgcacctcctgcaggtgcccctggacgtgtatgaacccgtcaggtctaccagaggacagccatgcgtaccccgggcaaaccggatttcggcgtcccatcagcggagacccagcatggcgtat

SEQ ID NO: 382867 - DNA, 140 bp, Artificial Sequence
  Synthetic
atacgccatgctgggtctccgatgcgggcaacttcatccctcctccacgctggttgctcttggattttgtatttgtcctgctctatctgatgaagctggctgaggcacggttggtcccgtcgtacttgggagtcggccat

SEQ ID NO: 382868 - DNA, 140 bp, Artificial Sequence
  Synthetic
atggccgactcccaagtacgacgggaccaaccgtgcctcagccagcttcatcagatagagcaggacaaatacaaaatccaagagcaaccagcgtggaggagggatgaagttgcccgcatcggagacccagcatggcgtat

SEQ ID NO: 382869 - DNA, 140 bp, Artificial Sequence
  Synthetic
atacgccatgctgggtctcctgatcttgcttctgctgtggtggtgggtgaaccagttggcggttctaggactgccggctgtggacgctgccgtggcgggtgaagtttttgcgggccctgccgtacttgggagtcggccat

SEQ ID NO: 382870 - DNA, 140 bp, Artificial Sequence
  Synthetic
atggccgactcccaagtacggcagggcccgcaaaaacttcacccgccacggcagcgtccacagccggcagtcctagaaccgccaactggttcacccaccaccacagcagaagcaagatcaggagacccagcatggcgtat

SEQ ID NO: 382871 - DNA, 140 bp, Artificial Sequence
  Synthetic
atacgccatgctgggtctcccttgtcatggtgtttgggccttcccactgtcagtatgatactaggtctagcaaacctggtgttgtactttcggtggatgggccctcagcgcctcatgttccgtacttgggagtcggccat

SEQ ID NO: 382872 - DNA, 140 bp, Artificial Sequence
  Synthetic
atggccgactcccaagtacggaacatgaggcgctgagggcccatccaccgaaagtacaacaccaggtttgctagacctagtatcatactgacagtgggaaggcccaaacaccatgacaagggagacccagcatggcgtat

SEQ ID NO: 382873 - DNA, 140 bp, Artificial Sequence
  Synthetic
atacgccatgctgggtctccctcgtgttgtggaagctcgctcggggagctttcccgctggcacttttgatggggatttcggcgacccgcgggcgcacctctgtgctcggggccgagttctcgtacttgggagtcggccat

SEQ ID NO: 382874 - DNA, 140 bp, Artificial Sequence
  Synthetic
atggccgactcccaagtacgagaactcggccccgagcacagaggtgcgcccgcgggtcgccgaaatccccatcaaaagtgccagcgggaaagctccccgagcgagcttccacaacacgagggagacccagcatggcgtat

SEQ ID NO: 382875 - DNA, 140 bp, Artificial Sequence
  Synthetic
atacgccatgctgggtctccgcttcgatgtcacattcgaggtggacacttcggtgttgggctgggtggtggccagcgtggtggcttgggccatagcgctcctgagctcaatgagcgcaggcgtacttgggagtcggccat

SEQ ID NO: 382876 - DNA, 140 bp, Artificial Sequence
  Synthetic
atggccgactcccaagtacgcctgcgctcattgagctcaggagcgctatggcccaagccaccacgctggccaccacccagcccaacaccgaagtgtccacctcgaatgtgacatcgaagcggagacccagcatggcgtat

SEQ ID NO: 382877 - DNA, 140 bp, Artificial Sequence
  Synthetic
atacgccatgctgggtctccggggtggaagcacaaggccgtgatctataggacgtggtgtaaagggtaccaggctgtgcgccagagggtggtgcggagccccctcggggaggggcgtcctcgtacttgggagtcggccat

SEQ ID NO: 382878 - DNA, 140 bp, Artificial Sequence
  Synthetic
atggccgactcccaagtacgaggacgcccctccccgagggggctccgcaccaccctctggcgcacagcctggtaccctttacaccacgtcctatagatcacggccttgtgcttccaccccggagacccagcatggcgtat

SEQ ID NO: 382879 - DNA, 140 bp, Artificial Sequence
  Synthetic
atacgccatgctgggtctccaccaagcttctgacgttcgcctggtgcttggcctcatacatctggccggatgctgtgatgatggtggtggtggccttggtcctcctcttcggcctgttcgcgtacttgggagtcggccat

SEQ ID NO: 382880 - DNA, 140 bp, Artificial Sequence
  Synthetic
atggccgactcccaagtacgcgaacaggccgaagaggaggaccaaggccaccaccaccatcatcacagcatccggccagatgtatgaggccaagcaccaggcgaacgtcagaagcttggtggagacccagcatggcgtat

SEQ ID NO: 382881 - DNA, 140 bp, Artificial Sequence
  Synthetic
atacgccatgctgggtctccacgcactggactgggccctggaggagctcctggtctcccggccctcgttacggcgactggcacgggtggttgagtgctgtgtgatggcgggcgagaaggccgtacttgggagtcggccat

SEQ ID NO: 382882 - DNA, 140 bp, Artificial Sequence
  Synthetic
atggccgactcccaagtacggccttctcgcccgccatcacacagcactcaaccacccgtgccagtcgccgtaacgagggccgggagaccaggagctcctccagggcccagtccagtgcgtggagacccagcatggcgtat

SEQ ID NO: 382883 - DNA, 140 bp, Artificial Sequence
  Synthetic
atacgccatgctgggtctcccaccaccatccgactggtctccaagatgtgcgcaagaggggcctacctgtttgaccacatgggctctttctcgcgcgctgtcaaggagcgcttgttggaacgtacttgggagtcggccat

SEQ ID NO: 382884 - DNA, 140 bp, Artificial Sequence
  Synthetic
atggccgactcccaagtacgttccaacaagcgctccttgacagcgcgcgagaaagagcccatgtggtcaaacaggtaggcccctcttgcgcacatcttggagaccagtcggatggtggtgggagacccagcatggcgtat

SEQ ID NO: 382885 - DNA, 140 bp, Artificial Sequence
  Synthetic
atacgccatgctgggtctcctgggacgcggctttggagcccttgtcattcactaggacggactgtcgcatcatcagagatgccgcgaggaccctgtcctgcggacagtgcgtcatgggttcgtacttgggagtcggccat

SEQ ID NO: 382886 - DNA, 140 bp, Artificial Sequence
  Synthetic
atggccgactcccaagtacgaacccatgacgcactgtccgcaggacagggtcctcgcggcatctctgatgatgcgacagtccgtcctagtgaatgacaagggctccaaagccgcgtcccaggagacccagcatggcgtat

SEQ ID NO: 382887 - DNA, 140 bp, Artificial Sequence
  Synthetic
atacgccatgctgggtctcctacccgtggtagcacggcgcggtgatgaggttctcatcggcgtctttcaggatgtgaatcatttgcctcccgggtttgtcccgactgcaccagttgtcatcgtacttgggagtcggccat

SEQ ID NO: 382888 - DNA, 140 bp, Artificial Sequence
  Synthetic
atggccgactcccaagtacgatgacaactggtgcagtcgggacaaacccgggaggcaaatgattcacatcctgaaagacgccgatgagaacctcatcaccgcgccgtgctaccacgggtaggagacccagcatggcgtat

SEQ ID NO: 382889 - DNA, 140 bp, Artificial Sequence
  Synthetic
atacgccatgctgggtctccccgtcggtgcggaaagggcttcctgggggtcacgaaggcagccttgacaggtagggatcctgacttacatccagggaacgtcatggtgttggggacggctcgtacttgggagtcggccat

SEQ ID NO: 382890 - DNA, 140 bp, Artificial Sequence
  Synthetic
atggccgactcccaagtacgagccgtccccaacaccatgacgttccctggatgtaagtcaggatccctacctgtcaaggctgccttcgtgacccccaggaagccctttccgcaccgacggggagacccagcatggcgtat

SEQ ID NO: 382891 - DNA, 140 bp, Artificial Sequence
  Synthetic
atacgccatgctgggtctccacgtcacgaagcatgggcacatgtctgaatggcctgctgttcacaactttccatggggcttcatcccgaaccatcgccacgcccgtgggggcccttaatccgtacttgggagtcggccat

SEQ ID NO: 382892 - DNA, 140 bp, Artificial Sequence
  Synthetic
atggccgactcccaagtacggattaagggcccccacgggcgtggcgatggttcgggatgaagccccatggaaagttgtgaacagcaggccattcagacatgtgcccatgcttcgtgacgtggagacccagcatggcgtat

SEQ ID NO: 382893 - DNA, 140 bp, Artificial Sequence
  Synthetic
atacgccatgctgggtctccccaggtggtggtcagccagtgatgacgtcacggtgtacccgcttccagatggggcaacttcgttgacgccctgcacttgccaggcggagtcctgttgggtcgtacttgggagtcggccat

SEQ ID NO: 382894 - DNA, 140 bp, Artificial Sequence
  Synthetic
atggccgactcccaagtacgacccaacaggactccgcctggcaagtgcagggcgtcaacgaagttgccccatctggaagcgggtacaccgtgacgtcatcactggctgaccaccacctggggagacccagcatggcgtat

SEQ ID NO: 382895 - DNA, 140 bp, Artificial Sequence
  Synthetic
atacgccatgctgggtctcctattagatccgacggggctttgtgccatggcttgagcaagggggacaaggttgagctggatgtggccatggaggtctctgacttccgtggttcgtctggtcgtacttgggagtcggccat

SEQ ID NO: 382896 - DNA, 140 bp, Artificial Sequence
  Synthetic
atggccgactcccaagtacgaccagacgaaccacggaagtcagagacctccatggccacatccagctcaaccttgtcccccttgctcaagccatggcacaaagccccgtcggatctaataggagacccagcatggcgtat

SEQ ID NO: 382897 - DNA, 140 bp, Artificial Sequence
  Synthetic
atacgccatgctgggtctcctcaccggtcctttgcgacaaagggcacgcagtaagaatgctcgtgtcagtgctccactctggcggcagggttactgcggcgcgattcactaggccgtggacgtacttgggagtcggccat

SEQ ID NO: 382898 - DNA, 140 bp, Artificial Sequence
  Synthetic
atggccgactcccaagtacgtccacggcctagtgaatcgcgccgcagtaaccctgccgccagagtggagcactgacacgagcattcttactgcgtgccctttgtcgcaaaggaccggtgaggagacccagcatggcgtat

SEQ ID NO: 382899 - DNA, 140 bp, Artificial Sequence
  Synthetic
atacgccatgctgggtctccctcaagtaccaacagatgccaagactaccacagaaccccctccggtgccggcaaaaggagttttcaaggaggccccgttgtttatgcctacgggggcgggcgtacttgggagtcggccat

SEQ ID NO: 382900 - DNA, 140 bp, Artificial Sequence
  Synthetic
atggccgactcccaagtacgcccgcccccgtaggcataaacaacggggcctccttgaaaactccttttgccggcaccggagggggttctgtggtagtcttggcatctgttggtacttgagggagacccagcatggcgtat

SEQ ID NO: 382901 - DNA, 140 bp, Artificial Sequence
  Synthetic
atacgccatgctgggtctccaaagagcacccgcgtaccgttggagtacggcaacatgggccacaaggtcttgatcttgaacccgtcggtagctaccgtgagggccatgggcccatacatgcgtacttgggagtcggccat

SEQ ID NO: 382902 - DNA, 140 bp, Artificial Sequence
  Synthetic
atggccgactcccaagtacgcatgtatgggcccatggccctcacggtagctaccgacgggttcaagatcaagaccttgtggcccatgttgccgtactccaacggtacgcgggtgctctttggagacccagcatggcgtat

SEQ ID NO: 382903 - DNA, 140 bp, Artificial Sequence
  Synthetic
atacgccatgctgggtctccgagcggctggcggggaaacaccccagtatttactgtggccatgacaccactgctttcacaaggatcactgactcgccccttacgtattccacttacggaacgtacttgggagtcggccat

SEQ ID NO: 382904 - DNA, 140 bp, Artificial Sequence
  Synthetic
atggccgactcccaagtacgttccgtaagtggaatacgtaaggggcgagtcagtgatccttgtgaaagcagtggtgtcatggccacagtaaatactggggtgtttccccgccagccgctcggagacccagcatggcgtat

SEQ ID NO: 382905 - DNA, 140 bp, Artificial Sequence
  Synthetic
atacgccatgctgggtctccggtttttggccaaccctaggcagatgctgaggggtgtgtcggtggtcatttgtgacgagtgccacagtcatgactcaactgtgttgttgggcattgggcgcgtacttgggagtcggccat

SEQ ID NO: 382906 - DNA, 140 bp, Artificial Sequence
  Synthetic
atggccgactcccaagtacgcgcccaatgcccaacaacacagttgagtcatgactgtggcactcgtcacaaatgaccaccgacacacccctcagcatctgcctagggttggccaaaaaccggagacccagcatggcgtat

SEQ ID NO: 382907 - DNA, 140 bp, Artificial Sequence
  Synthetic
atacgccatgctgggtctcctgtcagggagctggcgcgaggatgtggagtgcaattggtgctctacgccactgccacccctcccggatccccgatgacccagcacccatcaatcattgagcgtacttgggagtcggccat

SEQ ID NO: 382908 - DNA, 140 bp, Artificial Sequence
  Synthetic
atggccgactcccaagtacgctcaatgattgatgggtgctgggtcatcggggatccgggaggggtggcagtggcgtagagcaccaattgcactccacatcctcgcgccagctccctgacaggagacccagcatggcgtat

SEQ ID NO: 382909 - DNA, 140 bp, Artificial Sequence
  Synthetic
atacgccatgctgggtctccacaaaactggacgtgggagagatccccttctatgggcatggcatacctcttgagcggatgcggaccggaaggcatctcgtattctgccactccaaggctgcgtacttgggagtcggccat

SEQ ID NO: 382910 - DNA, 140 bp, Artificial Sequence
  Synthetic
atggccgactcccaagtacgcagccttggagtggcagaatacgagatgccttccggtccgcatccgctcaagaggtatgccatgcccatagaaggggatctctcccacgtccagttttgtggagacccagcatggcgtat

SEQ ID NO: 382911 - DNA, 140 bp, Artificial Sequence
  Synthetic
atacgccatgctgggtctccagtgcgagcgcctggcgggccagttttcggctaggggggtaaatgccatcgcctattacagggggaaagacagttctatcatcaaagatggagacctggtcgtacttgggagtcggccat

SEQ ID NO: 382912 - DNA, 140 bp, Artificial Sequence
  Synthetic
atggccgactcccaagtacgaccaggtctccatctttgatgatagaactgtctttccccctgtaataggcgatggcatttacccccctagccgaaaactggcccgccaggcgctcgcactggagacccagcatggcgtat

SEQ ID NO: 382913 - DNA, 140 bp, Artificial Sequence
  Synthetic
atacgccatgctgggtctccggtgtgtgctacagacgcactatccactgggtacactgggaacttcgattctgtcaccgattgtgggttagtggtggaggaggtcgtcgaggtgacccttcgtacttgggagtcggccat

SEQ ID NO: 382914 - DNA, 140 bp, Artificial Sequence
  Synthetic
atggccgactcccaagtacgaagggtcacctcgacgacctcctccaccactaacccacaatcggtgacagaatcgaagttcccagtgtacccagtggatagtgcgtctgtagcacacaccggagacccagcatggcgtat

SEQ ID NO: 382915 - DNA, 140 bp, Artificial Sequence
  Synthetic
atacgccatgctgggtctccgatcccaccattaccatctccctgcgcacggtgcccgcgtcggctgaactgtcgatgcagcggcgaggacgcacgggtaggggcaggtctgggcgctactcgtacttgggagtcggccat

SEQ ID NO: 382916 - DNA, 140 bp, Artificial Sequence
  Synthetic
atggccgactcccaagtacgagtagcgcccagacctgcccctacccgtgcgtcctcgccgctgcatcgacagttcagccgacgcgggcaccgtgcgcagggagatggtaatggtgggatcggagacccagcatggcgtat

SEQ ID NO: 382917 - DNA, 140 bp, Artificial Sequence
  Synthetic
atacgccatgctgggtctccactacgcgggggtcggcaaggcccctgctggtgtggtgcgctcaggtcctgtctggtcggcggtggaagccggtgtgacctggtacggaatggaacctgacgtacttgggagtcggccat

SEQ ID NO: 382918 - DNA, 140 bp, Artificial Sequence
  Synthetic
atggccgactcccaagtacgtcaggttccattccgtaccaggtcacaccggcttccaccgccgaccagacaggacctgagcgcaccacaccagcaggggccttgccgacccccgcgtagtggagacccagcatggcgtat

SEQ ID NO: 382919 - DNA, 140 bp, Artificial Sequence
  Synthetic
atacgccatgctgggtctcccctgacagcaaacctactgagactttacgacaactgcccttacaccgcagccgtcgcagctgacattggggaagccgcggtgttcttttcggggcttgcccgtacttgggagtcggccat

SEQ ID NO: 382920 - DNA, 140 bp, Artificial Sequence
  Synthetic
atggccgactcccaagtacgggcaagccccgaaaagaacaccgcggcttccccaatgtcagctgcgacggctgcggtgtaagggcagttgtcgtaaagtctcagtaggtttgctgtcaggggagacccagcatggcgtat

SEQ ID NO: 382921 - DNA, 140 bp, Artificial Sequence
  Synthetic
atacgccatgctgggtctccccgttgaggatgcatcccgatgttagctgggcaaaagttcgcggcgtcaactggcccttcctggtgggtgttcagcggaccatgtgccgggaaacactgtcgtacttgggagtcggccat

SEQ ID NO: 382922 - DNA, 140 bp, Artificial Sequence
  Synthetic
atggccgactcccaagtacgacagtgtttcccggcacatggtccgctgaacacccaccaggaagggccagttgacgccgcgaacttttgcccagctaacatcgggatgcatcctcaacggggagacccagcatggcgtat

SEQ ID NO: 382923 - DNA, 140 bp, Artificial Sequence
  Synthetic
atacgccatgctgggtctccctcccggcccatcggatgacccccagtgggcaggtctgaagggcccgaatcctgtcccactcctgctgaggtggggcaatgatttaccatctaaagtggccgtacttgggagtcggccat

SEQ ID NO: 382924 - DNA, 140 bp, Artificial Sequence
  Synthetic
atggccgactcccaagtacggccactttagatggtaaatcattgccccacctcagcaggagtgggacaggattcgggcccttcagacctgcccactgggggtcatccgatgggccgggagggagacccagcatggcgtat

SEQ ID NO: 382925 - DNA, 140 bp, Artificial Sequence
  Synthetic
atacgccatgctgggtctcccggccatcacatcgtggacgacctggtccgtaggctcggggtggcggagggttacgtccgctgcgatgcgggacccatcttgatggtgggcctcgctattcgtacttgggagtcggccat

SEQ ID NO: 382926 - DNA, 140 bp, Artificial Sequence
  Synthetic
atggccgactcccaagtacgaatagcgaggcccaccatcaagatgggtcccgcatcgcagcggacgtaaccctccgccaccccgagcctacggaccaggtcgtccacgatgtgatggccgggagacccagcatggcgtat

SEQ ID NO: 382927 - DNA, 140 bp, Artificial Sequence
  Synthetic
atacgccatgctgggtctccgcggggggcatgatctatgcgtcatacaccgggtctctcgtggtggttacagactgggatgtgaaggggggtggcagccccctttatcggcatggagacccgtacttgggagtcggccat

SEQ ID NO: 382928 - DNA, 140 bp, Artificial Sequence
  Synthetic
atggccgactcccaagtacgggtctccatgccgataaagggggctgccaccccccttcacatcccagtctgtaaccaccacgagagacccggtgtatgacgcatagatcatgccccccgcggagacccagcatggcgtat

SEQ ID NO: 382929 - DNA, 140 bp, Artificial Sequence
  Synthetic
atacgccatgctgggtctccaggccacgccccagccggttgtgcaggtccccccggtagaccatcggccggggggagagtctgcgccatcggatgccaacacagtgacagatgcggtggccgtacttgggagtcggccat

SEQ ID NO: 382930 - DNA, 140 bp, Artificial Sequence
  Synthetic
atggccgactcccaagtacggccaccgcatctgtcactgtgttggcatccgatggcgcagactctccccccggccgatggtctaccggggggacctgcacaaccggctggggcgtggcctggagacccagcatggcgtat

SEQ ID NO: 382931 - DNA, 140 bp, Artificial Sequence
  Synthetic
atacgccatgctgggtctccggccatccaggtggattgcgattggtcagtcatgaccctgtcgatcggggaagtgctgtccttggcccaggctaagacggccgaggcctacgcagctacccgtacttgggagtcggccat

SEQ ID NO: 382932 - DNA, 140 bp, Artificial Sequence
  Synthetic
atggccgactcccaagtacgggtagctgcgtaggcctcggccgtcttagcctgggccaaggacagcacttccccgatcgacagggtcatgactgaccaatcgcaatccacctggatggccggagacccagcatggcgtat

SEQ ID NO: 382933 - DNA, 140 bp, Artificial Sequence
  Synthetic
atacgccatgctgggtctccaccaagtggcttgctggctgctacacggggacgcgggccgtccccactgtttcaattgttgacaagctcttcgccgggggctgggcggcggtggtaggcccgtacttgggagtcggccat

SEQ ID NO: 382934 - DNA, 140 bp, Artificial Sequence
  Synthetic
atggccgactcccaagtacgggcctaccaccgccgcccagcccccggcgaagagcttgtcaacaattgaaacagtggggacggcccgcgtccccgtgtagcagccagcaagccacttggtggagacccagcatggcgtat

SEQ ID NO: 382935 - DNA, 140 bp, Artificial Sequence
  Synthetic
atacgccatgctgggtctccattgccacagtgtaatagctgcggcagtggcggcctatggggcttctaggagccctccattggctgctgccgcttcctacctcatggggttgggcgtcggcgtacttgggagtcggccat

SEQ ID NO: 382936 - DNA, 140 bp, Artificial Sequence
  Synthetic
atggccgactcccaagtacgccgacgcccaaccccatgaggtaggaagcggcagcagccaatggagggctcctagaagccccataggccgccactgccgcagctattacactgtggcaatggagacccagcatggcgtat

SEQ ID NO: 382937 - DNA, 140 bp, Artificial Sequence
  Synthetic
atacgccatgctgggtctccaggcaacgcgcaaacccgcttagcctccgctctcctactaggggccgctgggaccgctctgggcacgcctgtcgtggggttaaccatggcgggcgcgttccgtacttgggagtcggccat

SEQ ID NO: 382938 - DNA, 140 bp, Artificial Sequence
  Synthetic
atggccgactcccaagtacggaacgcgcccgccatggttaaccccacgacaggcgtgcccagagcggtcccagcggcccctagtaggagagcggaggctaagcgggtttgcgcgttgcctggagacccagcatggcgtat

SEQ ID NO: 382939 - DNA, 140 bp, Artificial Sequence
  Synthetic
atacgccatgctgggtctccatgggaagtgctagcgtctccccctccttggtcaccattttactgggggccgtggggggctgggagggcgtggtgaatgcggctagccttgtcttcgactcgtacttgggagtcggccat

SEQ ID NO: 382940 - DNA, 140 bp, Artificial Sequence
  Synthetic
atggccgactcccaagtacgagtcgaagacaaggctagccgcattcaccacgccctcccagccccccacggcccccagtaaaatggtgaccaaggagggggagacgctagcacttcccatggagacccagcatggcgtat

SEQ ID NO: 382941 - DNA, 140 bp, Artificial Sequence
  Synthetic
atacgccatgctgggtctccttatggcggggaaactatcatcagaagatctgtggtatgccatcccagtgctaaccagtccgggggcaggacttgcggggatcgccctcgggttggtgttcgtacttgggagtcggccat

SEQ ID NO: 382942 - DNA, 140 bp, Artificial Sequence
  Synthetic
atggccgactcccaagtacgaacaccaacccgagggcgatccccgcaagtcctgcccccggactggttagcactgggatggcataccacagatcttctgatgatagtttccccgccataaggagacccagcatggcgtat

SEQ ID NO: 382943 - DNA, 140 bp, Artificial Sequence
  Synthetic
atacgccatgctgggtctccgtactcagctaacaactctggcactaccacttggttgaaccgtctgctgactacattgccaaggtcctcatgcatccctgacagttactttcagcaggcccgtacttgggagtcggccat

SEQ ID NO: 382944 - DNA, 140 bp, Artificial Sequence
  Synthetic
atggccgactcccaagtacgggcctgctgaaagtaactgtcagggatgcatgaggaccttggcaatgtagtcagcagacggttcaaccaagtggtagtgccagagttgttagctgagtacggagacccagcatggcgtat

SEQ ID NO: 382945 - DNA, 140 bp, Artificial Sequence
  Synthetic
atacgccatgctgggtctccgattactgtgacaaggtctcagctgtgctccgacgcttgagcctcactcgcaccgtggttgccctggtcaacagggagcctaaggtggatgaggttcaggcgtacttgggagtcggccat

SEQ ID NO: 382946 - DNA, 140 bp, Artificial Sequence
  Synthetic
atggccgactcccaagtacgcctgaacctcatccaccttaggctccctgttgaccagggcaaccacggtgcgagtgaggctcaagcgtcggagcacagctgagaccttgtcacagtaatcggagacccagcatggcgtat

SEQ ID NO: 382947 - DNA, 140 bp, Artificial Sequence
  Synthetic
atacgccatgctgggtctcctggggtacgtctgggacttgtgggagtggatcatgcgtcaagtgcgcatggtgatggccagacttcgggccctctgccccgtggtgtcattacccttatgcgtacttgggagtcggccat

SEQ ID NO: 382948 - DNA, 140 bp, Artificial Sequence
  Synthetic
atggccgactcccaagtacgcataagggtaatgacaccacggggcagagggcccgaagtctggccatcaccatgcgcacttgacgcatgatccactcccacaagtcccagacgtaccccaggagacccagcatggcgtat

SEQ ID NO: 382949 - DNA, 140 bp, Artificial Sequence
  Synthetic
atacgccatgctgggtctccgcactgcggggaggggtggtccggagaatggttgttggacggccatgttgagagtcgttgtctttgtggttgcgtgatcaccggtgatgttttgaatgggcgtacttgggagtcggccat

SEQ ID NO: 382950 - DNA, 140 bp, Artificial Sequence
  Synthetic
atggccgactcccaagtacgcccattcaaaacatcaccggtgatcacgcaaccacaaagacaacgactctcaacatggccgtccaacaaccattctccggaccacccctccccgcagtgcggagacccagcatggcgtat

SEQ ID NO: 382951 - DNA, 140 bp, Artificial Sequence
  Synthetic
atacgccatgctgggtctcccaactcaaagatccagtttactctaccaagctgtgcaggcattattggatggggacagtccctgtgaacatgctgggctatggcgagacgtcgcctttgccgtacttgggagtcggccat

SEQ ID NO: 382952 - DNA, 140 bp, Artificial Sequence
  Synthetic
atggccgactcccaagtacggcaaaggcgacgtctcgccatagcccagcatgttcacagggactgtccccatccaataatgcctgcacagcttggtagagtaaactggatctttgagttgggagacccagcatggcgtat

SEQ ID NO: 382953 - DNA, 140 bp, Artificial Sequence
  Synthetic
atacgccatgctgggtctcctcgcctcagacaccccgaaggtggtaccattcgggacgtctgggtgggctgaggtggtggtgacccctacccacgttgtgatcaggcgaacatccgcctacgtacttgggagtcggccat

SEQ ID NO: 382954 - DNA, 140 bp, Artificial Sequence
  Synthetic
atggccgactcccaagtacgtaggcggatgttcgcctgatcacaacgtgggtaggggtcaccaccacctcagcccacccagacgtcccgaatggtaccaccttcggggtgtctgaggcgaggagacccagcatggcgtat

SEQ ID NO: 382955 - DNA, 140 bp, Artificial Sequence
  Synthetic
atacgccatgctgggtctcccaaactgctgcgccagcaaatcctgtcggctgctgttgctgagccctattacgtcgacggcataccggtctcatgggacgcggacgcgcgagcgcctgcccgtacttgggagtcggccat

SEQ ID NO: 382956 - DNA, 140 bp, Artificial Sequence
  Synthetic
atggccgactcccaagtacgggcaggcgctcgcgcgtccgcgtcccatgagaccggtatgccgtcgacgtaatagggctcagcaacagcagccgacaggatttgctggcgcagcagtttgggagacccagcatggcgtat

SEQ ID NO: 382957 - DNA, 140 bp, Artificial Sequence
  Synthetic
atacgccatgctgggtctccatggtctatggccctgggcaaagtgtcaccattgacggggaacgctacacccttccgcatcaactgcggcttaggaatgtggcgccctctgaggtgtcatcgtacttgggagtcggccat

SEQ ID NO: 382958 - DNA, 140 bp, Artificial Sequence
  Synthetic
atggccgactcccaagtacgatgacacctcagagggcgccacattcctaagccgcagttgatgcggaagggtgtagcgttccccgtcaatggtgacactttgcccagggccatagaccatggagacccagcatggcgtat

SEQ ID NO: 382959 - DNA, 140 bp, Artificial Sequence
  Synthetic
atacgccatgctgggtctccccgaggtgtccattgacattgggacggagactgaagactcagaactgactgaggccgacctgccgccggcggctgcagcccttcaggctatcgagaatgccgtacttgggagtcggccat

SEQ ID NO: 382960 - DNA, 140 bp, Artificial Sequence
  Synthetic
atggccgactcccaagtacggcattctcgatagcctgaagggctgcagccgccggcggcaggtcggcctcagtcagttctgagtcttcagtctccgtcccaatgtcaatggacacctcggggagacccagcatggcgtat

SEQ ID NO: 382961 - DNA, 140 bp, Artificial Sequence
  Synthetic
atacgccatgctgggtctcctgcgagaattcttgaacctcacatagatgtcatcatggaagattgcagtacaccctctctttgtgggagtagccgagagatgcctgtgtggggagaagaccgtacttgggagtcggccat

SEQ ID NO: 382962 - DNA, 140 bp, Artificial Sequence
  Synthetic
atggccgactcccaagtacggtcttctccccacacaggcatctctcggctactcccacaaagagagggtgtactgcaatcttccatgatgacatctatgtgaggttcaagaattctcgcaggagacccagcatggcgtat

SEQ ID NO: 382963 - DNA, 140 bp, Artificial Sequence
  Synthetic
atacgccatgctgggtctccataccccgcactccatcgccagcacttatctcggttactgagagcagcccagatgagaagaccccgtcggtgtcttcctcgcaggaggataccccgtcttcgtacttgggagtcggccat

SEQ ID NO: 382964 - DNA, 140 bp, Artificial Sequence
  Synthetic
atggccgactcccaagtacgaagacggggtatcctcctgcgaggaagacaccgacggggtcttctcatctgggctgctctcagtaaccgagataagtgctggcgatggagtgcggggtatggagacccagcatggcgtat

SEQ ID NO: 382965 - DNA, 140 bp, Artificial Sequence
  Synthetic
atacgccatgctgggtctccctgactcattcgaggtcatccaagagtccgagacagccgaaggggaggaaagcgtcttcaacgtggctctttccgtactaaaagccttgtttccacagagcgtacttgggagtcggccat

SEQ ID NO: 382966 - DNA, 140 bp, Artificial Sequence
  Synthetic
atggccgactcccaagtacgctctgtggaaacaaggcttttagtacggaaagagccacgttgaagacgctttcctccccttcggctgtctcggactcttggatgacctcgaatgagtcagggagacccagcatggcgtat

SEQ ID NO: 382967 - DNA, 140 bp, Artificial Sequence
  Synthetic
atacgccatgctgggtctcccgatgccacaagaaagcttaccgttaagatgtcatgctgtgttgagaagagcgtaacacgcttcttttcattgggattgacggtcgctgacgtggcaagccgtacttgggagtcggccat

SEQ ID NO: 382968 - DNA, 140 bp, Artificial Sequence
  Synthetic
atggccgactcccaagtacggcttgccacgtcagcgaccgtcaatcccaatgaaaagaagcgtgttacgctcttctcaacacagcatgacatcttaacggtaagctttcttgtggcatcgggagacccagcatggcgtat

SEQ ID NO: 382969 - DNA, 140 bp, Artificial Sequence
  Synthetic
aggccctggctgctgatatgctgtgtgagatggaaatccagaaccatacagcctattgtgacaaggtgcgcactccgcttgaattgcaggttgggtgcttggtgggcaatgaacttacctgaccttttgggacagcggtg

SEQ ID NO: 382970 - DNA, 140 bp, Artificial Sequence
  Synthetic
caccgctgtcccaaaaggtcaggtaagttcattgcccaccaagcacccaacctgcaattcaagcggagtgcgcaccttgtcacaataggctgtatggttctggatttccatctcacacagcatatcagcagccagggcct

SEQ ID NO: 382971 - DNA, 140 bp, Artificial Sequence
  Synthetic
aggccctggctgctgatatgcactccgcttgaattgcaggttgggtgcttggtgggcaatgaacttacctttgaatgtgacaagtgtgaggctaggcaagagaccttggcttccttctctgaccttttgggacagcggtg

SEQ ID NO: 382972 - DNA, 140 bp, Artificial Sequence
  Synthetic
caccgctgtcccaaaaggtcagagaaggaagccaaggtctcttgcctagcctcacacttgtcacattcaaaggtaagttcattgcccaccaagcacccaacctgcaattcaagcggagtgcatatcagcagccagggcct

SEQ ID NO: 382973 - DNA, 140 bp, Artificial Sequence
  Synthetic
atacgccatgctgggtctcctacatttggtctggggtgccactgacgagggccactccggccaagccccctgtggtgaggccggttggctccttgctggtggccgacaccaccaaggtgtcgtacttgggagtcggccat

SEQ ID NO: 382974 - DNA, 140 bp, Artificial Sequence
  Synthetic
atggccgactcccaagtacgacaccttggtggtgtcggccaccagcaaggagccaaccggcctcaccacagggggcttggccggagtggccctcgtcagtggcaccccagaccaaatgtaggagacccagcatggcgtat

SEQ ID NO: 382975 - DNA, 140 bp, Artificial Sequence
  Synthetic
atacgccatgctgggtctccatgtcaccaacccggacaatgttgggagaagagttgacaaggttaccttctggcgtgcccctagggttcatgacaaattcctcgtggactccatagagcgcgtacttgggagtcggccat

SEQ ID NO: 382976 - DNA, 140 bp, Artificial Sequence
  Synthetic
atggccgactcccaagtacgcgctctatggagtccacgaggaatttgtcatgaaccctaggggcacgccagaaggtaaccttgtcaactcttctcccaacattgtccgggttggtgacatggagacccagcatggcgtat

SEQ ID NO: 382977 - DNA, 140 bp, Artificial Sequence
  Synthetic
atacgccatgctgggtctcccgctaagagggcagctcaagcctgcctaagcatgggttacacttatgaggaggcaataaggactgtaaggccacatgctgccatgggctggggatctaagcgtacttgggagtcggccat

SEQ ID NO: 382978 - DNA, 140 bp, Artificial Sequence
  Synthetic
atggccgactcccaagtacgcttagatccccagcccatggcagcatgtggccttacagtccttattgcctcctcataagtgtaacccatgcttaggcaggcttgagctgccctcttagcgggagacccagcatggcgtat

SEQ ID NO: 382979 - DNA, 140 bp, Artificial Sequence
  Synthetic
atacgccatgctgggtctccgtgtcggtcaaggacctcgccacccctgcggggaagatggctgtccatgaccggctccaggagatacttgaagggacgccagtcccctttactcttactgcgtacttgggagtcggccat

SEQ ID NO: 382980 - DNA, 140 bp, Artificial Sequence
  Synthetic
atggccgactcccaagtacgcagtaagagtaaaggggactggcgtcccttcaagtatctcctggagccggtcatggacagccatcttccccgcaggggtggcgaggtccttgaccgacacggagacccagcatggcgtat

SEQ ID NO: 382981 - DNA, 140 bp, Artificial Sequence
  Synthetic
atacgccatgctgggtctcctgaaaaaggaagtgttcttcaaagaccgaaaggaagagaaggccccccgcctcattgtgttcccccccctggacttccggatagctgaaaagcttattctcgtacttgggagtcggccat

SEQ ID NO: 382982 - DNA, 140 bp, Artificial Sequence
  Synthetic
atggccgactcccaagtacgagaataagcttttcagctatccggaagtccaggggggggaacacaatgaggcggggggccttctcttcctttcggtctttgaagaacacttcctttttcaggagacccagcatggcgtat

SEQ ID NO: 382983 - DNA, 140 bp, Artificial Sequence
  Synthetic
atacgccatgctgggtctccgggagaccctggacgggtagccaaggcggtgttggggggggcctacgccttccagtacaccccaaatcagcgaattagggagatgctcaaactgtgggaacgtacttgggagtcggccat

SEQ ID NO: 382984 - DNA, 140 bp, Artificial Sequence
  Synthetic
atggccgactcccaagtacgttcccacagtttgagcatctccctaattcgctgatttggggtgtactggaaggcgtaggccccccccaacaccgccttggctacccgtccagggtctcccggagacccagcatggcgtat

SEQ ID NO: 382985 - DNA, 140 bp, Artificial Sequence
  Synthetic
atacgccatgctgggtctcctcaaagaagacaccatgcgccatctgtgtggacgccacatgcttcgacagtagcataactgaagaggacgtggcgctggagacagagctttatgccctggcgtacttgggagtcggccat

SEQ ID NO: 382986 - DNA, 140 bp, Artificial Sequence
  Synthetic
atggccgactcccaagtacgccagggcataaagctctgtctccagcgccacgtcctcttcagttatgctactgtcgaagcatgtggcgtccacacagatggcgcatggtgtcttctttgaggagacccagcatggcgtat

SEQ ID NO: 382987 - DNA, 140 bp, Artificial Sequence
  Synthetic
atacgccatgctgggtctcccttcagaccatccagaatgggtgcgtgccctggggaaatactatgcctctggcacaatggtaacccccgagggggtgccagtgggtgagaggtattgtagcgtacttgggagtcggccat

SEQ ID NO: 382988 - DNA, 140 bp, Artificial Sequence
  Synthetic
atggccgactcccaagtacgctacaatacctctcacccactggcaccccctcgggggttaccattgtgccagaggcatagtatttccccagggcacgcacccattctggatggtctgaagggagacccagcatggcgtat

SEQ ID NO: 382989 - DNA, 140 bp, Artificial Sequence
  Synthetic
atacgccatgctgggtctccatcctcaggggtcttgaccaccagtgcgagcaactgcttgacttgctatatcaaggtgaaagccgcctgtgagagggtggggctgaaaaatgtctcgctccgtacttgggagtcggccat

SEQ ID NO: 382990 - DNA, 140 bp, Artificial Sequence
  Synthetic
atggccgactcccaagtacggagcgagacatttttcagccccaccctctcacaggcggctttcaccttgatatagcaagtcaagcagttgctcgcactggtggtcaagacccctgaggatggagacccagcatggcgtat

SEQ ID NO: 382991 - DNA, 140 bp, Artificial Sequence
  Synthetic
atacgccatgctgggtctccctcatcgctggcgatgactgtttgatcatatgcgaacggcctgtgtgcgatcctagcgacgctttgggcagagccctggcgagctacgggtacgcatgcgcgtacttgggagtcggccat

SEQ ID NO: 382992 - DNA, 140 bp, Artificial Sequence
  Synthetic
atggccgactcccaagtacgcgcatgcgtacccgtagctcgccagggctctgcccaaagcgtcgctaggatcgcacacaggccgttcgcatatgatcaaacagtcatcgccagcgatgagggagacccagcatggcgtat

SEQ ID NO: 382993 - DNA, 140 bp, Artificial Sequence
  Synthetic
atacgccatgctgggtctccagccttcgtatcatgcatcactggacacggcccccttctgctccacttggctagctgagtgcaatgcagatgggaaacgccatttcttcctgaccacggacgtacttgggagtcggccat

SEQ ID NO: 382994 - DNA, 140 bp, Artificial Sequence
  Synthetic
atggccgactcccaagtacgtccgtggtcaggaagaaatggcgtttcccatctgcattgcactcagctagccaagtggagcagaagggggccgtgtccagtgatgcatgatacgaaggctggagacccagcatggcgtat

SEQ ID NO: 382995 - DNA, 140 bp, Artificial Sequence
  Synthetic
atacgccatgctgggtctccctttcggaggcccctcgctcgcatgtcgagcgagtacagtgacccaatggcttcggccatcggttacatcctcctatacccttggcatcctatcacacggcgtacttgggagtcggccat

SEQ ID NO: 382996 - DNA, 140 bp, Artificial Sequence
  Synthetic
atggccgactcccaagtacgccgtgtgataggatgccaagggtataggaggatgtaaccgatggccgaagccattgggtcactgtactcgctcgacatgcgagcgaggggcctccgaaagggagacccagcatggcgtat

SEQ ID NO: 382997 - DNA, 140 bp, Artificial Sequence
  Synthetic
atacgccatgctgggtctcctgggtcatcatccctcacgtgctcacctgcgcgtttaggggtggtggcacaccgtctgatcctgtgtggtgccaggtacatggtaattactacaagtttccgtacttgggagtcggccat

SEQ ID NO: 382998 - DNA, 140 bp, Artificial Sequence
  Synthetic
atggccgactcccaagtacggaaacttgtagtaattaccatgtacctggcaccacacaggatcagacggtgtgccaccacccctaaacgcgcaggtgagcacgtgagggatgatgacccaggagacccagcatggcgtat

SEQ ID NO: 382999 - DNA, 140 bp, Artificial Sequence
  Synthetic
atacgccatgctgggtctcccactggacaaactgcctaacatcatcgtggccctccacggaccagcagcgttgagggttaccgcagacacaactaagacaaaaatggaggctggcaaggtcgtacttgggagtcggccat

SEQ ID NO: 383000 - DNA, 140 bp, Artificial Sequence
  Synthetic
atggccgactcccaagtacgaccttgccagcctccatttttgtcttagttgtgtctgcggtaaccctcaacgctgctggtccgtggagggccacgatgatgttaggcagtttgtccagtgggagacccagcatggcgtat

SEQ ID NO: 383001 - DNA, 140 bp, Artificial Sequence
  Synthetic
atacgccatgctgggtctccgctgagcgacctcaagctccctggcctagcagtccaccggaagaaggccggggcattgcgaacgcgtatgctccggtcgcgcggttgggctgagttggctcgtacttgggagtcggccat

SEQ ID NO: 383002 - DNA, 140 bp, Artificial Sequence
  Synthetic
atggccgactcccaagtacgagccaactcagcccaaccgcgcgaccggagcatacgcgttcgcaatgccccggccttcttccggtggactgctaggccagggagcttgaggtcgctcagcggagacccagcatggcgtat

SEQ ID NO: 383003 - DNA, 140 bp, Artificial Sequence
  Synthetic
atacgccatgctgggtctccagggggctgttgtggcgtccaggcctgcggcttccccctccggagattgctggtatccccgggggtttccccctttcccccccctatatgggggtggttccgtacttgggagtcggccat

SEQ ID NO: 383004 - DNA, 140 bp, Artificial Sequence
  Synthetic
atggccgactcccaagtacggaaccacccccatataggggggggaaagggggaaacccccggggataccagcaatctccggagggggaagccgcaggcctggacgccacaacagccccctggagacccagcatggcgtat

SEQ ID NO: 383005 - DNA, 140 bp, Artificial Sequence
  Synthetic
atacgccatgctgggtctccatcaattggatttcacaagccagaggagtcgctggcggtggttggggttcttagccctgctcatcgtagccctcttcgggtgaactaaattcatctgttgcgtacttgggagtcggccat

SEQ ID NO: 383006 - DNA, 140 bp, Artificial Sequence
  Synthetic
atggccgactcccaagtacgcaacagatgaatttagttcacccgaagagggctacgatgagcagggctaagaaccccaaccaccgccagcgactcctctggcttgtgaaatccaattgatggagacccagcatggcgtat

SEQ ID NO: 383007 - DNA, 140 bp, Artificial Sequence
  Synthetic
aggccctggctgctgatatgttagccctgctcatcgtagccctcttcgggtgaactaaattcatctgttgcggcaaggtccggtgactgatcatcactggaggaggttcccgccctccccgaccttttgggacagcggtg

SEQ ID NO: 383008 - DNA, 140 bp, Artificial Sequence
  Synthetic
caccgctgtcccaaaaggtcggggagggcgggaacctcctccagtgatgatcagtcaccggaccttgccgcaacagatgaatttagttcacccgaagagggctacgatgagcagggctaacatatcagcagccagggcct

SEQ ID NO: 383009 - DNA, 140 bp, Artificial Sequence
  Synthetic
aggccctggctgctgatatgtacgggctgctcgcagagccctccccggatggggcacagtgcactgtgatctgaaggggtgcaccccggtaagagctcggcccaaaggccgggttctactgaccttttgggacagcggtg

SEQ ID NO: 383010 - DNA, 140 bp, Artificial Sequence
  Synthetic
caccgctgtcccaaaaggtcagtagaacccggcctttgggccgagctcttaccggggtgcaccccttcagatcacagtgcactgtgccccatccggggagggctctgcgagcagcccgtacatatcagcagccagggcct

SEQ ID NO: 383011 - DNA, 140 bp, Artificial Sequence
  Synthetic
atacgccatgctgggtctccccccccccccggcctgggtgcagccccagaaaccgacgcctatctaagtagacgcaatgactcggcgccgactcggcgaccggccaaaaggtggtggatgcgtacttgggagtcggccat

SEQ ID NO: 383012 - DNA, 140 bp, Artificial Sequence
  Synthetic
atggccgactcccaagtacgcatccaccaccttttggccggtcgccgagtcggcgccgagtcattgcgtctacttagataggcgtcggtttctggggctgcacccaggccggggggggggggagacccagcatggcgtat

SEQ ID NO: 383013 - DNA, 140 bp, Artificial Sequence
  Synthetic
aggccctggctgctgatatggaccgcgcacggtccacaggtgttggccctaccggtgtgaataagggcccgacgtcaggctcgtcgttaaaccgagcccgtcacccacctgggcaaacgagaccttttgggacagcggtg

SEQ ID NO: 383014 - DNA, 140 bp, Artificial Sequence
  Synthetic
caccgctgtcccaaaaggtctcgtttgcccaggtgggtgacgggctcggtttaacgacgagcctgacgtcgggcccttattcacaccggtagggccaacacctgtggaccgtgcgcggtccatatcagcagccagggcct

SEQ ID NO: 383015 - DNA, 140 bp, Artificial Sequence
  Synthetic
aggccctggctgctgatatggacgtcaggctcgtcgttaaaccgagcccgtcacccacctgggcaaacgacgcccacgtacggtccacgtcgcccttcaatgtctctcttgaccaatagggaccttttgggacagcggtg

SEQ ID NO: 383016 - DNA, 140 bp, Artificial Sequence
  Synthetic
caccgctgtcccaaaaggtccctattggtcaagagagacattgaagggcgacgtggaccgtacgtgggcgtcgtttgcccaggtgggtgacgggctcggtttaacgacgagcctgacgtccatatcagcagccagggcct

SEQ ID NO: 383017 - DNA, 140 bp, Artificial Sequence
  Synthetic
atacgccatgctgggtctccctaagccggcgagttgacaaggaccagtgggggccgggggcttggagagggactccaagccctgcccttcccggtgggccgggaaatgcatggggccactcgtacttgggagtcggccat

SEQ ID NO: 383018 - DNA, 140 bp, Artificial Sequence
  Synthetic
atggccgactcccaagtacgagtggccccatgcatttcccggcccaccgggaagggcagggcttggagtccctctccaagcccccggcccccactggtccttgtcaactcgccggcttagggagacccagcatggcgtat

SEQ ID NO: 383019 - DNA, 140 bp, Artificial Sequence
  Synthetic
atacgccatgctgggtctcccagctccgcggcggcctgcagccggggtagcccaagaatccttcgggtgagggcgggtggcatttcttttttctataccatcatggcagtccttctgctccgtacttgggagtcggccat

SEQ ID NO: 383020 - DNA, 140 bp, Artificial Sequence
  Synthetic
atggccgactcccaagtacggagcagaaggactgccatgatggtatagaaaaaagaaatgccacccgccctcacccgaaggattcttgggctaccccggctgcaggccgccgcggagctgggagacccagcatggcgtat

SEQ ID NO: 383021 - DNA, 140 bp, Artificial Sequence
  Synthetic
atacgccatgctgggtctcccttctcgtggttgaggccggggccatcttggccccggccacccacgcttgtcgagcgaatgggcaatatttcctcacaaattgttgcgccccggaggatacgtacttgggagtcggccat

SEQ ID NO: 383022 - DNA, 140 bp, Artificial Sequence
  Synthetic
atggccgactcccaagtacgtatcctccggggcgcaacaatttgtgaggaaatattgcccattcgctcgacaagcgtgggtggccggggccaagatggccccggcctcaaccacgagaagggagacccagcatggcgtat

SEQ ID NO: 383023 - DNA, 140 bp, Artificial Sequence
  Synthetic
atacgccatgctgggtctccttgggttctgcctggaaggtggatgcctggtagccttagggtgcacgatttgcactgaccgatgttggccactgtatcaggcgggtttggctgtgcggcccgtacttgggagtcggccat

SEQ ID NO: 383024 - DNA, 140 bp, Artificial Sequence
  Synthetic
atggccgactcccaagtacgggccgcacagccaaacccgcctgatacagtggccaacatcggtcagtgcaaatcgtgcaccctaaggctaccaggcatccaccttccaggcagaacccaaggagacccagcatggcgtat

SEQ ID NO: 383025 - DNA, 140 bp, Artificial Sequence
  Synthetic
atacgccatgctgggtctcctggcaagtccgcggcccagctggtgggggagctggggagcctttacgggcccttgtcggtctcggcctacgtggctgggatcttgggtctgggagaggtgcgtacttgggagtcggccat

SEQ ID NO: 383026 - DNA, 140 bp, Artificial Sequence
  Synthetic
atggccgactcccaagtacgcacctctcccagacccaagatcccagccacgtaggccgagaccgacaagggcccgtaaaggctccccagctcccccaccagctgggccgcggacttgccaggagacccagcatggcgtat

SEQ ID NO: 383027 - DNA, 140 bp, Artificial Sequence
  Synthetic
atacgccatgctgggtctcctactcgggtgtcctaacggtcggggtcgcgttgacgcgccgggtctacccggtgcccaacctgacgtgtgctgtcgagtgtgagcttaagtgggaaagtgcgtacttgggagtcggccat

SEQ ID NO: 383028 - DNA, 140 bp, Artificial Sequence
  Synthetic
atggccgactcccaagtacgcactttcccacttaagctcacactcgacagcacacgtcaggttgggcaccgggtagacccggcgcgtcaacgcgaccccgaccgttaggacacccgagtaggagacccagcatggcgtat

SEQ ID NO: 383029 - DNA, 140 bp, Artificial Sequence
  Synthetic
atacgccatgctgggtctccagttttggagatggactgagcagctggcctccaattactggatcttggaatacctttggaaagtcccgtttgatttctggaggggtgtgatgagcttgaccgtacttgggagtcggccat

SEQ ID NO: 383030 - DNA, 140 bp, Artificial Sequence
  Synthetic
atggccgactcccaagtacggtcaagctcatcacacccctccagaaatcaaacgggactttccaaaggtattccaagatccagtaattggaggccagctgctcagtccatctccaaaactggagacccagcatggcgtat

SEQ ID NO: 383031 - DNA, 140 bp, Artificial Sequence
  Synthetic
atacgccatgctgggtctccccccttgttggtttgcgtggccgcattgctgctgcttgagcaacggattgtcatggtcttcctgttggtgacaatggcggggatgtcgcaaggcgctccccgtacttgggagtcggccat

SEQ ID NO: 383032 - DNA, 140 bp, Artificial Sequence
  Synthetic
atggccgactcccaagtacggggagcgccttgcgacatccccgccattgtcaccaacaggaagaccatgacaatccgttgctcaagcagcagcaatgcggccacgcaaaccaacaaggggggagacccagcatggcgtat

SEQ ID NO: 383033 - DNA, 140 bp, Artificial Sequence
  Synthetic
atacgccatgctgggtctccgcctctgtcttggggtctcgcccctttgaccgtgggttgacttggcagtcttgctcttgtagggctaacggttcgcgtattccgaccggggagaaggtgtcgtacttgggagtcggccat

SEQ ID NO: 383034 - DNA, 140 bp, Artificial Sequence
  Synthetic
atggccgactcccaagtacgacaccttctccccggtcggaatacgcgaaccgttagccctacaagagcaagactgccaagtcaacccacggtcaaaggggcgagaccccaagacagaggcggagacccagcatggcgtat

SEQ ID NO: 383035 - DNA, 140 bp, Artificial Sequence
  Synthetic
atacgccatgctgggtctccgggatcgagggaatgccacgctcttgtgtgattgccccaacggtccctgggtgtggttaccggccttttgccaggcgattggctggggtgatcccatcaccgtacttgggagtcggccat

SEQ ID NO: 383036 - DNA, 140 bp, Artificial Sequence
  Synthetic
atggccgactcccaagtacggtgatgggatcaccccagccaatcgcctggcaaaaggccggtaaccacacccagggaccgttggggcaatcacacaagagcgtggcattccctcgatcccggagacccagcatggcgtat

SEQ ID NO: 383037 - DNA, 140 bp, Artificial Sequence
  Synthetic
atacgccatgctgggtctccccattggagccacggacaaaatcagtggcccctttcatgcccccagtttgtctacgggtctgtctcagtcacttgcgtgtggggctccgcttcttggtttcgtacttgggagtcggccat

SEQ ID NO: 383038 - DNA, 140 bp, Artificial Sequence
  Synthetic
atggccgactcccaagtacgaaaccaagaagcggagccccacacgcaagtgactgagacagacccgtagacaaactgggggcatgaaaggggccactgattttgtccgtggctccaatggggagacccagcatggcgtat

SEQ ID NO: 383039 - DNA, 140 bp, Artificial Sequence
  Synthetic
atacgccatgctgggtctccgcctcgactggtggtcgtgactcgaagatcgatgtgtggagtttggtgccagttggctctgccacctgcaccatagccgccctcgggtcttcggatcgcgcgtacttgggagtcggccat

SEQ ID NO: 383040 - DNA, 140 bp, Artificial Sequence
  Synthetic
atggccgactcccaagtacgcgcgatccgaagacccgagggcggctatggtgcaggtggcagagccaactggcaccaaactccacacatcgatcttcgagtcacgaccaccagtcgaggcggagacccagcatggcgtat

SEQ ID NO: 383041 - DNA, 140 bp, Artificial Sequence
  Synthetic
atacgccatgctgggtctccacacagtggtcgagctctccgagtggggggtcccgtgcgtgacgtgcattctggatcgtcggcctgcctcctgcggcacctgtgtgagggactgctggcccgtacttgggagtcggccat

SEQ ID NO: 383042 - DNA, 140 bp, Artificial Sequence
  Synthetic
atggccgactcccaagtacgggccagcagtccctcacacaggtgccgcaggaggcaggccgacgatccagaatgcacgtcacgcacgggaccccccactcggagagctcgaccactgtgtggagacccagcatggcgtat

SEQ ID NO: 383043 - DNA, 140 bp, Artificial Sequence
  Synthetic
atacgccatgctgggtctcccgagaccgggtcggttagattcccgttccatcggtgtggcacggggcctcggctgacaaaggacttggaagctgtgcccttcgtcaataggacaactccccgtacttgggagtcggccat

SEQ ID NO: 383044 - DNA, 140 bp, Artificial Sequence
  Synthetic
atggccgactcccaagtacggggagttgtcctattgacgaagggcacagcttccaagtcctttgtcagccgaggccccgtgccacaccgatggaacgggaatctaaccgacccggtctcgggagacccagcatggcgtat

SEQ ID NO: 383045 - DNA, 140 bp, Artificial Sequence
  Synthetic
atacgccatgctgggtctccctcaccattagggggcccctgggcaaccagggtcgaggcaacccggtgcggtcgcccctgggttttgggtcctacaccatgaccaagatccgggacaccccgtacttgggagtcggccat

SEQ ID NO: 383046 - DNA, 140 bp, Artificial Sequence
  Synthetic
atggccgactcccaagtacggggtgtcccggatcttggtcatggtgtaggacccaaaacccaggggcgaccgcaccgggttgcctcgaccctggttgcccaggggccccctaatggtgagggagacccagcatggcgtat

SEQ ID NO: 383047 - DNA, 140 bp, Artificial Sequence
  Synthetic
atacgccatgctgggtctcctacacttggtgaaatgtcccacaccagccattgagcctcccactgggacgtttgggttcttccctgggacgccgccccttaacaactgtatgctgttgggcgtacttgggagtcggccat

SEQ ID NO: 383048 - DNA, 140 bp, Artificial Sequence
  Synthetic
atggccgactcccaagtacgcccaacagcatacagttgttaaggggcggcgtcccagggaagaacccaaacgtcccagtgggaggctcaatggctggtgtgggacatttcaccaagtgtaggagacccagcatggcgtat

SEQ ID NO: 383049 - DNA, 140 bp, Artificial Sequence
  Synthetic
atacgccatgctgggtctcccacggaagtgtccgaggcactcggcggggctggcctcacgggggggttctatgaacccctggtgcgcaggtgttcggagctgatgggacgccgaaatccacgtacttgggagtcggccat

SEQ ID NO: 383050 - DNA, 140 bp, Artificial Sequence
  Synthetic
atggccgactcccaagtacgtggatttcggcgtcccatcagctccgaacacctgcgcaccaggggttcatagaacccccccgtgaggccagccccgccgagtgcctcggacacttccgtgggagacccagcatggcgtat

SEQ ID NO: 383051 - DNA, 140 bp, Artificial Sequence
  Synthetic
atacgccatgctgggtctccgtctgtccggggtttgcatggctctcttcgggcagacctgatgggttcatacatgttcagggccacttgcaggaggtggatgcgggcaacttcattccgccgtacttgggagtcggccat

SEQ ID NO: 383052 - DNA, 140 bp, Artificial Sequence
  Synthetic
atggccgactcccaagtacggcggaatgaagttgcccgcatccacctcctgcaagtggccctgaacatgtatgaacccatcaggtctgcccgaagagagccatgcaaaccccggacagacggagacccagcatggcgtat

SEQ ID NO: 383053 - DNA, 140 bp, Artificial Sequence
  Synthetic
atacgccatgctgggtctccccccgcgctggttgctcttggactttgtatttgtcctgttatacctgatgaagctggctgaggcacggttggtcccgctgatcttgctattgctatggtgcgtacttgggagtcggccat

SEQ ID NO: 383054 - DNA, 140 bp, Artificial Sequence
  Synthetic
atggccgactcccaagtacgcaccatagcaatagcaagatcagcgggaccaaccgtgcctcagccagcttcatcaggtataacaggacaaatacaaagtccaagagcaaccagcgcggggggagacccagcatggcgtat

SEQ ID NO: 383055 - DNA, 140 bp, Artificial Sequence
  Synthetic
atacgccatgctgggtctccgtgggtgaaccagctagcagttttaggactgcctgctgtggacgccgctgtagctggtgaggtttttgcgggccctgccctgtcctggtgtctggggctccgtacttgggagtcggccat

SEQ ID NO: 383056 - DNA, 140 bp, Artificial Sequence
  Synthetic
atggccgactcccaagtacggagccccagacaccaggacagggcagggcccgcaaaaacctcaccagctacagcggcgtccacagcaggcagtcctaaaactgctagctggttcacccacggagacccagcatggcgtat

SEQ ID NO: 383057 - DNA, 140 bp, Artificial Sequence
  Synthetic
atacgccatgctgggtctccccggtcgtcagtatgatactagggttagcaaacctggtgttgtactttagatggttgggtccccaacgcctcatgctccttgtgttgtggaagctcgctccgtacttgggagtcggccat

SEQ ID NO: 383058 - DNA, 140 bp, Artificial Sequence
  Synthetic
atggccgactcccaagtacggagcgagcttccacaacacaaggagcatgaggcgttggggacccaaccatctaaagtacaacaccaggtttgctaaccctagtatcatactgacgaccggggagacccagcatggcgtat

SEQ ID NO: 383059 - DNA, 140 bp, Artificial Sequence
  Synthetic
aggccctggctgctgatatgatggttgggtccccaacgcctcatgctccttgtgttgtggaagctcgctcggggagctttcccgctggctcttctgatggggatttcggcgacccgcggggaccttttgggacagcggtg

SEQ ID NO: 383060 - DNA, 140 bp, Artificial Sequence
  Synthetic
caccgctgtcccaaaaggtccccgcgggtcgccgaaatccccatcagaagagccagcgggaaagctccccgagcgagcttccacaacacaaggagcatgaggcgttggggacccaaccatcatatcagcagccagggcct

SEQ ID NO: 383061 - DNA, 140 bp, Artificial Sequence
  Synthetic
atacgccatgctgggtctcccgcacctcagtgctcggggccgagttctgcttcgatgctacattcgaggtggacacttcggtgttgggctgggtggtggccagtgtggtagcttgggccacgtacttgggagtcggccat

SEQ ID NO: 383062 - DNA, 140 bp, Artificial Sequence
  Synthetic
atggccgactcccaagtacgtggcccaagctaccacactggccaccacccagcccaacaccgaagtgtccacctcgaatgtagcatcgaagcagaactcggccccgagcactgaggtgcgggagacccagcatggcgtat

SEQ ID NO: 383063 - DNA, 140 bp, Artificial Sequence
  Synthetic
atacgccatgctgggtctccttgcgctcctgagctcaatgagcgcgggggggtggaggcacaaagccgtgatctataggacgtggtgtaaggggtaccaggcggtgcgccagagggtggtcgtacttgggagtcggccat

SEQ ID NO: 383064 - DNA, 140 bp, Artificial Sequence
  Synthetic
atggccgactcccaagtacgaccaccctctggcgcaccgcctggtaccccttacaccacgtcctatagatcacggctttgtgcctccacccccccgcgctcattgagctcaggagcgcaaggagacccagcatggcgtat

SEQ ID NO: 383065 - DNA, 140 bp, Artificial Sequence
  Synthetic
atacgccatgctgggtctccgaggagtcccctcggggagggacggcccaccaaacccctgacgttcgcttggtgcttggcctcgtacatctggccggatgctgtgatgatggtgatggttcgtacttgggagtcggccat

SEQ ID NO: 383066 - DNA, 140 bp, Artificial Sequence
  Synthetic
atggccgactcccaagtacgaaccatcaccatcatcacagcatccggccagatgtacgaggccaagcaccaagcgaacgtcaggggtttggtgggccgtccctccccgaggggactcctcggagacccagcatggcgtat

SEQ ID NO: 383067 - DNA, 140 bp, Artificial Sequence
  Synthetic
atacgccatgctgggtctccgccttggtcttgctctttggtctgttcgacgcgttggactgggctttggaggagatcttggtatcccggccctcgttgcggcgtctggctcgggtgatcgcgtacttgggagtcggccat

SEQ ID NO: 383068 - DNA, 140 bp, Artificial Sequence
  Synthetic
atggccgactcccaagtacgcgatcacccgagccagacgccgcaacgagggccgggataccaagatctcctccaaagcccagtccaacgcgtcgaacagaccaaagagcaagaccaaggcggagacccagcatggcgtat

SEQ ID NO: 383069 - DNA, 140 bp, Artificial Sequence
  Synthetic
atacgccatgctgggtctccagtgctgtgtgatggcgggtgagaaggccacaacggtccggttggtctccaagatgtgtgcgaggggagcctatttgttcgatcatatgggttccttctccgtacttgggagtcggccat

SEQ ID NO: 383070 - DNA, 140 bp, Artificial Sequence
  Synthetic
atggccgactcccaagtacggagaaggaacccatatgatcgaacaaataggctcccctcgcacacatcttggagaccaaccggaccgttgtggccttctcacccgccatcacacagcactggagacccagcatggcgtat

SEQ ID NO: 383071 - DNA, 140 bp, Artificial Sequence
  Synthetic
atacgccatgctgggtctccgcgcgccgttaaggagcgcctgctggagtgggacgcggcccttgagcccttgtcattcactaggacggactgtcgcatcatacgagacgccgcgaggacccgtacttgggagtcggccat

SEQ ID NO: 383072 - DNA, 140 bp, Artificial Sequence
  Synthetic
atggccgactcccaagtacgggtcctcgcggcgtctcgtatgatgcgacagtccgtcctagtgaatgacaagggctcaagggccgcgtcccactccagcaggcgctccttaacggcgcgcggagacccagcatggcgtat

SEQ ID NO: 383073 - DNA, 140 bp, Artificial Sequence
  Synthetic
atacgccatgctgggtctccctgtcctgcgggcagtgcgtcatgggcttacccgtggtggcgcgccgcggtgatgaggtcctcatcggcgttttccaagatgtgaaccatttgcctcccgcgtacttgggagtcggccat

SEQ ID NO: 383074 - DNA, 140 bp, Artificial Sequence
  Synthetic
atggccgactcccaagtacgcgggaggcaaatggttcacatcttggaaaacgccgatgaggacctcatcaccgcggcgcgccaccacgggtaagcccatgacgcactgcccgcaggacagggagacccagcatggcgtat

SEQ ID NO: 383075 - DNA, 140 bp, Artificial Sequence
  Synthetic
atacgccatgctgggtctccggttcgtcccgactgcgccagttgtcatccggcggtgcggaaagggcttcctgggggttacaaaggctgccttgacgggtcgggatcctgacttacatcccgtacttgggagtcggccat

SEQ ID NO: 383076 - DNA, 140 bp, Artificial Sequence
  Synthetic
atggccgactcccaagtacgggatgtaagtcaggatcccgacccgtcaaggcagcctttgtaacccccaggaagccctttccgcaccgccggatgacaactggcgcagtcgggacgaaccggagacccagcatggcgtat

SEQ ID NO: 383077 - DNA, 140 bp, Artificial Sequence
  Synthetic
atacgccatgctgggtctccagggaacgtcatggtgttggggacggctacgtcgcgaagcatgggaacatgcttgaacggcttgctgttcacgactttccatggggcttcatcccgaacccgtacttgggagtcggccat

SEQ ID NO: 383078 - DNA, 140 bp, Artificial Sequence
  Synthetic
atggccgactcccaagtacgggttcgggatgaagccccatggaaagtcgtgaacagcaagccgttcaagcatgttcccatgcttcgcgacgtagccgtccccaacaccatgacgttccctggagacccagcatggcgtat

SEQ ID NO: 383079 - DNA, 140 bp, Artificial Sequence
  Synthetic
atacgccatgctgggtctccatcgccacgcccgtgggggcccttaatcctaggtggtggtcagccagtgacgacgtcacggtgtacccgcttccagatggggcaacttcgttgacgccttcgtacttgggagtcggccat

SEQ ID NO: 383080 - DNA, 140 bp, Artificial Sequence
  Synthetic
atggccgactcccaagtacgaaggcgtcaacgaagttgccccatctggaagcgggtacaccgtgacgtcgtcactggctgaccaccacctaggattaagggcccccacgggcgtggcgatggagacccagcatggcgtat

SEQ ID NO: 383081 - DNA, 140 bp, Artificial Sequence
  Synthetic
atacgccatgctgggtctccgcacctgccaggctgagtcttgttgggtcatcagatccgacggggctttgtgccatggcttgagtaagggagacaaggtggagctggatgtggccatggacgtacttgggagtcggccat

SEQ ID NO: 383082 - DNA, 140 bp, Artificial Sequence
  Synthetic
atggccgactcccaagtacgtccatggccacatccagctccaccttgtctcccttactcaagccatggcacaaagccccgtcggatctgatgacccaacaagactcagcctggcaggtgcggagacccagcatggcgtat

SEQ ID NO: 383083 - DNA, 140 bp, Artificial Sequence
  Synthetic
atacgccatgctgggtctccggtctctgacttccgtggctcgtctggctcaccggtcttgtgcgacgaagggcacgcggtaggaatgctcgtgtccgtgctccactctggtggtagggttcgtacttgggagtcggccat

SEQ ID NO: 383084 - DNA, 140 bp, Artificial Sequence
  Synthetic
atggccgactcccaagtacgaaccctaccaccagagtggagcacggacacgagcattcctaccgcgtgcccttcgtcgcacaagaccggtgagccagacgagccacggaagtcagagaccggagacccagcatggcgtat

SEQ ID NO: 383085 - DNA, 140 bp, Artificial Sequence
  Synthetic
atacgccatgctgggtctccaccgcagctcggttcactaggccgtggacccaagttccaacagatgccaagactaccacagaaccccctccggtgccggcaaaaggagttttcaaagaggcgtacttgggagtcggccat

SEQ ID NO: 383086 - DNA, 140 bp, Artificial Sequence
  Synthetic
atggccgactcccaagtacgcctctttgaaaactccttttgccggcaccggagggggttctgtggtagtcttggcatctgttggaacttgggtccacggcctagtgaaccgagctgcggtggagacccagcatggcgtat

SEQ ID NO: 383087 - DNA, 140 bp, Artificial Sequence
  Synthetic
atacgccatgctgggtctccccccgttgtttatgcctacgggagcgggaaagagcacccgcgtcccgttggagtacggcaacatgggccacaaggtcttaatcctgaacccctcggtggccgtacttgggagtcggccat

SEQ ID NO: 383088 - DNA, 140 bp, Artificial Sequence
  Synthetic
atggccgactcccaagtacggccaccgaggggttcaggattaagaccttgtggcccatgttgccgtactccaacgggacgcgggtgctctttcccgctcccgtaggcataaacaacggggggagacccagcatggcgtat

SEQ ID NO: 383089 - DNA, 140 bp, Artificial Sequence
  Synthetic
atacgccatgctgggtctcccactgtgagagccatgggcccttacatggagcgccttgcggggaaacatccaagcatatactgtggccatgacaccactgctttcacgaggatcactgaccgtacttgggagtcggccat

SEQ ID NO: 383090 - DNA, 140 bp, Artificial Sequence
  Synthetic
atggccgactcccaagtacggtcagtgatcctcgtgaaagcagtggtgtcatggccacagtatatgcttggatgtttccccgcaaggcgctccatgtaagggcccatggctctcacagtgggagacccagcatggcgtat

SEQ ID NO: 383091 - DNA, 140 bp, Artificial Sequence
  Synthetic
atacgccatgctgggtctcctcccccctgacgtactcaacctacggaaggtttctcgccaaccctaggcagatgttgaggggggtctcggtggtcatttgtgatgaatgccacagtcatgcgtacttgggagtcggccat

SEQ ID NO: 383092 - DNA, 140 bp, Artificial Sequence
  Synthetic
atggccgactcccaagtacgcatgactgtggcattcatcacaaatgaccaccgagacccccctcaacatctgcctagggttggcgagaaaccttccgtaggttgagtacgtcaggggggaggagacccagcatggcgtat

SEQ ID NO: 383093 - DNA, 140 bp, Artificial Sequence
  Synthetic
atacgccatgctgggtctccactcaactgtgctgttgggcattgggagggtccgggagctggcacgtgggtgcggggtgcaacttgtgctctacgctactgccactcccccgggctcccccgtacttgggagtcggccat

SEQ ID NO: 383094 - DNA, 140 bp, Artificial Sequence
  Synthetic
atggccgactcccaagtacgggggagcccgggggagtggcagtagcgtagagcacaagttgcaccccgcacccacgtgccagctcccggaccctcccaatgcccaacagcacagttgagtggagacccagcatggcgtat

SEQ ID NO: 383095 - DNA, 140 bp, Artificial Sequence
  Synthetic
atacgccatgctgggtctcccatgacacagcacccatctatcattgagactaagctggatgtgggagagatccccttttatgggcatggcataccccttgagcggatgcggaccgggaggcgtacttgggagtcggccat

SEQ ID NO: 383096 - DNA, 140 bp, Artificial Sequence
  Synthetic
atggccgactcccaagtacgcctcccggtccgcatccgctcaaggggtatgccatgcccataaaaggggatctctcccacatccagcttagtctcaatgatagatgggtgctgtgtcatgggagacccagcatggcgtat

SEQ ID NO: 383097 - DNA, 140 bp, Artificial Sequence
  Synthetic
atacgccatgctgggtctcccacctcgtattttgccattccaaggctgagtgcgagcgtctggccggccagttttctgctagaggggtgaacgccattgcctattataggggcaaagacacgtacttgggagtcggccat

SEQ ID NO: 383098 - DNA, 140 bp, Artificial Sequence
  Synthetic
atggccgactcccaagtacgtgtctttgcccctataataggcaatggcgttcacccctctagcagaaaactggccggccagacgctcgcactcagccttggaatggcaaaatacgaggtgggagacccagcatggcgtat

SEQ ID NO: 383099 - DNA, 140 bp, Artificial Sequence
  Synthetic
atacgccatgctgggtctccgttccatcatcaaagacggagacttagtggtgtgcgctacagacgcgctatccactgggtacactgggaatttcgattctgtcaccgactgcgggttagtcgtacttgggagtcggccat

SEQ ID NO: 383100 - DNA, 140 bp, Artificial Sequence
  Synthetic
atggccgactcccaagtacgactaacccgcagtcggtgacagaatcgaaattcccagtgtacccagtggatagcgcgtctgtagcgcacaccactaagtctccgtctttgatgatggaacggagacccagcatggcgtat

SEQ ID NO: 383101 - DNA, 140 bp, Artificial Sequence
  Synthetic
aggccctggctgctgatatgtccactgggtacactgggaatttcgattctgtcaccgactgcgggttagtggtggaggaggtcgtcgaggtgacccttgatcccaccattaccatctcccgaccttttgggacagcggtg

SEQ ID NO: 383102 - DNA, 140 bp, Artificial Sequence
  Synthetic
caccgctgtcccaaaaggtcgggagatggtaatggtgggatcaagggtcacctcgacgacctcctccaccactaacccgcagtcggtgacagaatcgaaattcccagtgtacccagtggacatatcagcagccagggcct

SEQ ID NO: 383103 - DNA, 140 bp, Artificial Sequence
  Synthetic
aggccctggctgctgatatgtgcggacagtgcctgcttcggctgaattgtcgatgcagagacgaggacgcacgggtaggggcaggtctgggcgctactactacgcgggggtgggcaaagcgaccttttgggacagcggtg

SEQ ID NO: 383104 - DNA, 140 bp, Artificial Sequence
  Synthetic
caccgctgtcccaaaaggtcgctttgcccacccccgcgtagtagtagcgcccagacctgcccctacccgtgcgtcctcgtctctgcatcgacaattcagccgaagcaggcactgtccgcacatatcagcagccagggcct

SEQ ID NO: 383105 - DNA, 140 bp, Artificial Sequence
  Synthetic
atacgccatgctgggtctcctcccgctggtgtggttcgctcgggtcctgtctggtcggcggtggaagccggagtgacctggtatggaatggaacctgacttgacagctaacctactgagacgtacttgggagtcggccat

SEQ ID NO: 383106 - DNA, 140 bp, Artificial Sequence
  Synthetic
atggccgactcccaagtacgtctcagtaggttagctgtcaagtcaggttccattccataccaggtcactccggcttccaccgccgaccagacaggacccgagcgaaccacaccagcgggaggagacccagcatggcgtat

SEQ ID NO: 383107 - DNA, 140 bp, Artificial Sequence
  Synthetic
atacgccatgctgggtctccctttacgacgactgcccttacaccgcagccgtcgcagctgacatcggagaagccgcggtgttcttctctgggctcgccccattgaggatgcaccccgacgcgtacttgggagtcggccat

SEQ ID NO: 383108 - DNA, 140 bp, Artificial Sequence
  Synthetic
atggccgactcccaagtacgcgtcggggtgcatcctcaatggggcgagcccagagaagaacaccgcggcttctccgatgtcagctgcgacggctgcggtgtaagggcagtcgtcgtaaagggagacccagcatggcgtat

SEQ ID NO: 383109 - DNA, 140 bp, Artificial Sequence
  Synthetic
aggccctggctgctgatatgagccgcggtgttcttctctgggctcgccccattgaggatgcaccccgacgttagctgggcaaaagttcgcggcgtcaactggcccctcttggtgggtgttgaccttttgggacagcggtg

SEQ ID NO: 383110 - DNA, 140 bp, Artificial Sequence
  Synthetic
caccgctgtcccaaaaggtcaacacccaccaagaggggccagttgacgccgcgaacttttgcccagctaacgtcggggtgcatcctcaatggggcgagcccagagaagaacaccgcggctcatatcagcagccagggcct

SEQ ID NO: 383111 - DNA, 140 bp, Artificial Sequence
  Synthetic
aggccctggctgctgatatgcagcggaccatgtgccgggaaacactgtctcccggtccatcggatgacccccaatgggcaggtctgaagggcccaaatcctgtcccactgctgctgaggtgaccttttgggacagcggtg

SEQ ID NO: 383112 - DNA, 140 bp, Artificial Sequence
  Synthetic
caccgctgtcccaaaaggtcacctcagcagcagtgggacaggatttgggcccttcagacctgcccattgggggtcatccgatggaccgggagacagtgtttcccggcacatggtccgctgcatatcagcagccagggcct

SEQ ID NO: 383113 - DNA, 140 bp, Artificial Sequence
  Synthetic
atacgccatgctgggtctccggggcaacgatttaccatctaaagtggccggccatcacatagtggacgacctggtccggaggctcggtgtggcggagggttatgtccgctgcgatgctggcgtacttgggagtcggccat

SEQ ID NO: 383114 - DNA, 140 bp, Artificial Sequence
  Synthetic
atggccgactcccaagtacgccagcatcgcagcggacataaccctccgccacaccgagcctccggaccaggtcgtccactatgtgatggccggccactttagatggtaaatcgttgccccggagacccagcatggcgtat

SEQ ID NO: 383115 - DNA, 140 bp, Artificial Sequence
  Synthetic
atacgccatgctgggtctccccccatcttaatggtgggtctcgctatcgcgggggggatgatctacgcgtcttacaccgggtcaatagtggtggtgacagactgggatgtgaaggggggtcgtacttgggagtcggccat

SEQ ID NO: 383116 - DNA, 140 bp, Artificial Sequence
  Synthetic
atggccgactcccaagtacgaccccccttcacatcccagtctgtcaccaccactattgacccggtgtaagacgcgtagatcatcccccccgcgatagcgagacccaccattaagatggggggagacccagcatggcgtat

SEQ ID NO: 383117 - DNA, 140 bp, Artificial Sequence
  Synthetic
atacgccatgctgggtctccggcgcccccctttataggcatggagaccaggccacgccacaaccggtggtgcaggtccccccggtagaccatcggccggggggagagtccgcgccatcggcgtacttgggagtcggccat

SEQ ID NO: 383118 - DNA, 140 bp, Artificial Sequence
  Synthetic
atggccgactcccaagtacgccgatggcgcggactctccccccggccgatggtctaccggggggacctgcaccaccggttgtggcgtggcctggtctccatgcctataaaggggggcgccggagacccagcatggcgtat

SEQ ID NO: 383119 - DNA, 140 bp, Artificial Sequence
  Synthetic
atacgccatgctgggtctccacgccaagacagtgacagatgcggtggcagccattcaggtggattgcgattggtcagtcatgactctgtcgatcggagaagtgctgtccttggctcaggccgtacttgggagtcggccat

SEQ ID NO: 383120 - DNA, 140 bp, Artificial Sequence
  Synthetic
atggccgactcccaagtacggcctgagccaaggacagcacttctccgatcgacagagtcatgactgaccaatcgcaatccacctgaatggctgccaccgcatctgtcactgtcttggcgtggagacccagcatggcgtat

SEQ ID NO: 383121 - DNA, 140 bp, Artificial Sequence
  Synthetic
atacgccatgctgggtctcctaagacggccgaggcctacacagcgaccgccaagtggcttgctggctgctacacggggacgcgggccgttcccactgtttcaattgttgacaagctcttccgtacttgggagtcggccat

SEQ ID NO: 383122 - DNA, 140 bp, Artificial Sequence
  Synthetic
atggccgactcccaagtacggaagagcttgtcaacaattgaaacagtgggaacggcccgcgtccccgtgtagcagccagcaagccacttggcggtcgctgtgtaggcctcggccgtcttaggagacccagcatggcgtat

SEQ ID NO: 383123 - DNA, 140 bp, Artificial Sequence
  Synthetic
atacgccatgctgggtctccgccggagggtgggcggctgtggtaggccattgtcacagcgtgatcgctgcagcagtggcagcctacggggcttcaaggagccctccgttggcagctgcggcgtacttgggagtcggccat

SEQ ID NO: 383124 - DNA, 140 bp, Artificial Sequence
  Synthetic
atggccgactcccaagtacgccgcagctgccaacggagggctccttgaagccccgtaggctgccactgctgcagcgatcacgctgtgacaatggcctaccacagccgcccaccctccggcggagacccagcatggcgtat

SEQ ID NO: 383125 - DNA, 140 bp, Artificial Sequence
  Synthetic
atacgccatgctgggtctcccctcctacctgatggggttgggcgtcgggggcaacgctcaaacgcgtctggcatccgccctcctattgggggctgctgggaccgccctgggcactcctgtcgtacttgggagtcggccat

SEQ ID NO: 383126 - DNA, 140 bp, Artificial Sequence
  Synthetic
atggccgactcccaagtacgacaggagtgcccagggcggtcccagcagcccccaataggagggcggatgccagacgcgtttgagcgttgcccccgacgcccaaccccatcaggtaggaggggagacccagcatggcgtat

SEQ ID NO: 383127 - DNA, 140 bp, Artificial Sequence
  Synthetic
atacgccatgctgggtctcccgtgggtttaaccatggcgggggcgtttatgggaggtgctagcgtctctccctccttggtcaccatcttactgggggctgtaggaggttgggagggcgtccgtacttgggagtcggccat

SEQ ID NO: 383128 - DNA, 140 bp, Artificial Sequence
  Synthetic
atggccgactcccaagtacggacgccctcccaacctcctacagcccccagtaagatggtgaccaaggagggagagacgctagcacctcccataaacgcccccgccatggttaaacccacgggagacccagcatggcgtat

SEQ ID NO: 383129 - DNA, 140 bp, Artificial Sequence
  Synthetic
atacgccatgctgggtctccgtcaacgcggcgagccttgtctttgacttcatggcggggaaactttcatcagaagatctgtggtatgctatcccagtgctgactagtccgggggcgggcccgtacttgggagtcggccat

SEQ ID NO: 383130 - DNA, 140 bp, Artificial Sequence
  Synthetic
atggccgactcccaagtacgggcccgcccccggactagtcagcactgggatagcataccacagatcttctgatgaaagtttccccgccatgaagtcaaagacaaggctcgccgcgttgacggagacccagcatggcgtat

SEQ ID NO: 383131 - DNA, 140 bp, Artificial Sequence
  Synthetic
atacgccatgctgggtctccttgcggggatcgctctcgggttggttttgtactcagctaacaactctggcactaccacttggttgaaccgtctgctgactacattacctaggtcttcatgcgtacttgggagtcggccat

SEQ ID NO: 383132 - DNA, 140 bp, Artificial Sequence
  Synthetic
atggccgactcccaagtacgcatgaagacctaggtaatgtagtcagcagacggttcaaccaagtggtagtgccagagttgttagctgagtacaaaaccaacccgagagcgatccccgcaaggagacccagcatggcgtat

SEQ ID NO: 383133 - DNA, 140 bp, Artificial Sequence
  Synthetic
atacgccatgctgggtctcccatcccagacagttacttccagcaggctgactactgtgacaaagtctcagccgtgctccgccgattgagccttacccgcactgtggttgccctggtcaaccgtacttgggagtcggccat

SEQ ID NO: 383134 - DNA, 140 bp, Artificial Sequence
  Synthetic
atggccgactcccaagtacggttgaccagggcaaccacagtgcgggtaaggctcaatcggcggagcacggctgagactttgtcacagtagtcagcctgctggaagtaactgtctgggatgggagacccagcatggcgtat

SEQ ID NO: 383135 - DNA, 140 bp, Artificial Sequence
  Synthetic
atacgccatgctgggtctccagggagcctaaggtggacgaggttcaggtggggtacgtctgggacctgtgggagtggatcatgcgtcaagtgcgcatggtcatggccagactcagggccccgtacttgggagtcggccat

SEQ ID NO: 383136 - DNA, 140 bp, Artificial Sequence
  Synthetic
atggccgactcccaagtacggggccctgagtctggccatgaccatgcgcacttgacgcatgatccactcccacaggtcccagacgtaccccacctgaacctcgtccaccttaggctccctggagacccagcatggcgtat

SEQ ID NO: 383137 - DNA, 140 bp, Artificial Sequence
  Synthetic
atacgccatgctgggtctcctctgccccgtggtgtcactacctttgtggcactgtggggaggggtggtccggagaatggttgttggacggtcatgttgagagtcgctgtctctgtgggtgcgtacttgggagtcggccat

SEQ ID NO: 383138 - DNA, 140 bp, Artificial Sequence
  Synthetic
atggccgactcccaagtacgcacccacagagacagcgactctcaacatgaccgtccaacaaccattctccggaccacccctccccacagtgccacaaaggtagtgacaccacggggcagaggagacccagcatggcgtat

SEQ ID NO: 383139 - DNA, 140 bp, Artificial Sequence
  Synthetic
atacgccatgctgggtctcctgtgatcaccggtgatgttctaaatgggcaactcaaagaaccagtttactctaccaagctgtgccggcactattggatggggacagtccctgtgaacatgcgtacttgggagtcggccat

SEQ ID NO: 383140 - DNA, 140 bp, Artificial Sequence
  Synthetic
atggccgactcccaagtacgcatgttcacagggactgtccccatccaatagtgccggcacagcttggtagagtaaactggttctttgagttgcccatttagaacatcaccggtgatcacaggagacccagcatggcgtat

SEQ ID NO: 383141 - DNA, 140 bp, Artificial Sequence
  Synthetic
atacgccatgctgggtctccctgggttacggtgaaacatcgcccctcctggcccctgacaccccgaaggttgtacccttcgggacgtctggctgggctgaggtggtggtgacccccaccccgtacttgggagtcggccat

SEQ ID NO: 383142 - DNA, 140 bp, Artificial Sequence
  Synthetic
atggccgactcccaagtacggggtgggggtcaccaccacctcagcccagccagacgtcccgaagggtacaaccttcggggtgtcaggggccaggaggggcgatgtttcaccgtaacccagggagacccagcatggcgtat

SEQ ID NO: 383143 - DNA, 140 bp, Artificial Sequence
  Synthetic
atacgccatgctgggtctccacgtagtgatcaggagaacctccgcctacaagttgctgcgccagcaaatcctatcggctgctgtagctgagccctactacgtcgacggcattccggtctccgtacttgggagtcggccat

SEQ ID NO: 383144 - DNA, 140 bp, Artificial Sequence
  Synthetic
atggccgactcccaagtacggagaccggaatgccgtcgacgtagtagggctcagctacagcagccgataggatttgctggcgcagcaacttgtaggcggaggttctcctgatcactacgtggagacccagcatggcgtat

SEQ ID NO: 383145 - DNA, 140 bp, Artificial Sequence
  Synthetic
atacgccatgctgggtctccgtgggacgcggacgctcgcgcgcccgccatggtctatggccctgggcaaagtgttaccattgacggggagcgctacaccctgcctcaccaactgaggctccgtacttgggagtcggccat

SEQ ID NO: 383146 - DNA, 140 bp, Artificial Sequence
  Synthetic
atggccgactcccaagtacggagcctcagttggtgaggcagggtgtagcgctccccgtcaatggtaacactttgcccagggccatagaccatggcgggcgcgcgagcgtccgcgtcccacggagacccagcatggcgtat

SEQ ID NO: 383147 - DNA, 140 bp, Artificial Sequence
  Synthetic
atacgccatgctgggtctccaggaatgtggcgccctctgaggtttcatccgaggtgtccattgacattgggacggagactgaagactcagaactgactgaggctgacttgccgccggcggcgtacttgggagtcggccat

SEQ ID NO: 383148 - DNA, 140 bp, Artificial Sequence
  Synthetic
atggccgactcccaagtacgccgccggcggcaagtcagcctcagtcagttctgagtcttcagtctccgtcccaatgtcaatggacacctcggatgaaacctcagagggcgccacattcctggagacccagcatggcgtat

SEQ ID NO: 383149 - DNA, 140 bp, Artificial Sequence
  Synthetic
aggccctggctgctgatatggacggagactgaagactcagaactgactgaggctgacttgccgccggcggctgctgctctccaagcgatcgagaatgctgcgagaattcttgaaccgcatgaccttttgggacagcggtg

SEQ ID NO: 383150 - DNA, 140 bp, Artificial Sequence
  Synthetic
caccgctgtcccaaaaggtcatgcggttcaagaattctcgcagcattctcgatcgcttggagagcagcagccgccggcggcaagtcagcctcagtcagttctgagtcttcagtctccgtccatatcagcagccagggcct

SEQ ID NO: 383151 - DNA, 140 bp, Artificial Sequence
  Synthetic
atacgccatgctgggtctccattgatgtcatcatggaggactgcagtacaccctctctttgtggtagtagccgagagatgcctgtgtggggagaagacatcccccgcactccatcgccagcgtacttgggagtcggccat

SEQ ID NO: 383152 - DNA, 140 bp, Artificial Sequence
  Synthetic
atggccgactcccaagtacgctggcgatggagtgcgggggatgtcttctccccacacaggcatctctcggctactaccacaaagagagggtgtactgcagtcctccatgatgacatcaatggagacccagcatggcgtat

SEQ ID NO: 383153 - DNA, 140 bp, Artificial Sequence
  Synthetic
aggccctggctgctgatatgccgagagatgcctgtgtggggagaagacatcccccgcactccatcgccagcacttatctcggttactgagagcagctcagatgagaagaccccgtcggtggaccttttgggacagcggtg

SEQ ID NO: 383154 - DNA, 140 bp, Artificial Sequence
  Synthetic
caccgctgtcccaaaaggtccaccgacggggtcttctcatctgagctgctctcagtaaccgagataagtgctggcgatggagtgcgggggatgtcttctccccacacaggcatctctcggcatatcagcagccagggcct

SEQ ID NO: 383155 - DNA, 140 bp, Artificial Sequence
  Synthetic
aggccctggctgctgatatgcacttatctcggttactgagagcagctcagatgagaagaccccgtcggtgtcctcttcgcaggaggataccccgtcctctgactcattcgaggtcatccagaccttttgggacagcggtg

SEQ ID NO: 383156 - DNA, 140 bp, Artificial Sequence
  Synthetic
caccgctgtcccaaaaggtctggatgacctcgaatgagtcagaggacggggtatcctcctgcgaagaggacaccgacggggtcttctcatctgagctgctctcagtaaccgagataagtgcatatcagcagccagggcct

SEQ ID NO: 383157 - DNA, 140 bp, Artificial Sequence
  Synthetic
atacgccatgctgggtctccagagtccgagacagccgagggggaggaaagtgtcttcaacgtggctctttccgtacaaaaagccttatttccacagagcgatgcgacccggaagcttacccgtacttgggagtcggccat

SEQ ID NO: 383158 - DNA, 140 bp, Artificial Sequence
  Synthetic
atggccgactcccaagtacgggtaagcttccgggtcgcatcgctctgtggaaataaggctttttgtacggaaagagccacgttgaagacactttcctccccctcggctgtctcggactctggagacccagcatggcgtat

SEQ ID NO: 383159 - DNA, 140 bp, Artificial Sequence
  Synthetic
atacgccatgctgggtctccgtcaagatgtcatgctgtgttgagaagagcgtcacacgcttcttttcgctggggttgacggttgctgacgtcgctagcctgtgtgagatggaaatccagacgtacttgggagtcggccat

SEQ ID NO: 383160 - DNA, 140 bp, Artificial Sequence
  Synthetic
atggccgactcccaagtacgtctggatttccatctcacacaggctagcgacgtcagcaaccgtcaaccccagcgaaaagaagcgtgtgacgctcttctcaacacagcatgacatcttgacggagacccagcatggcgtat

SEQ ID NO: 383161 - DNA, 140 bp, Artificial Sequence
  Synthetic
aggccctggctgctgatatgaccatacagcctattgtgacaaggtgcgcactccgcttgaattgcaggttgggtgcttggtgggcaatgaacttacctttgaatgtgacaagtgtgaggcgaccttttgggacagcggtg

SEQ ID NO: 383162 - DNA, 140 bp, Artificial Sequence
  Synthetic
caccgctgtcccaaaaggtcgcctcacacttgtcacattcaaaggtaagttcattgcccaccaagcacccaacctgcaattcaagcggagtgcgcaccttgtcacaataggctgtatggtcatatcagcagccagggcct

SEQ ID NO: 383163 - DNA, 140 bp, Artificial Sequence
  Synthetic
atacgccatgctgggtctcccaggcaagaaaccttggcctccttctcctacatttggtctggcgtgccactgactagggctactccggccaagccccctgtggtaaggccggttggctctcgtacttgggagtcggccat

SEQ ID NO: 383164 - DNA, 140 bp, Artificial Sequence
  Synthetic
atggccgactcccaagtacgagagccaaccggccttaccacagggggcttggccggagtagccctagtcagtggcacgccagaccaaatgtaggagaaggaggccaaggtttcttgcctgggagacccagcatggcgtat

SEQ ID NO: 383165 - DNA, 140 bp, Artificial Sequence
  Synthetic
atacgccatgctgggtctccttgttggtggcagacaccaccaaggtgtatgttaccaacccagacaatgtgggaaggagggtggacaaggtgaccttctggcgtgctccgagggttcatgcgtacttgggagtcggccat

SEQ ID NO: 383166 - DNA, 140 bp, Artificial Sequence
  Synthetic
atggccgactcccaagtacgcatgaaccctcggagcacgccagaaggtcaccttgtccaccctccttcccacattgtctgggttggtaacatacaccttggtggtgtctgccaccaacaaggagacccagcatggcgtat

SEQ ID NO: 383167 - DNA, 140 bp, Artificial Sequence
  Synthetic
atacgccatgctgggtctccacaaatacctcgtggactcgatcgagcgcgctaagagggccgctcaagcctgcctgagcatgggttacacttatgaggaggcaataaggactgtaaggcccgtacttgggagtcggccat

SEQ ID NO: 383168 - DNA, 140 bp, Artificial Sequence
  Synthetic
atggccgactcccaagtacgggccttacagtccttattgcctcctcataagtgtaacccatgctcaggcaggcttgagcggccctcttagcgcgctcgatcgagtccacgaggtatttgtggagacccagcatggcgtat

SEQ ID NO: 383169 - DNA, 140 bp, Artificial Sequence
  Synthetic
atacgccatgctgggtctccacatgctgccatgggctggggatctaaggtgtcagtcaaggatcttgccacccctgcggggaagatggctgtccacgaccggctccaggagatacttgaacgtacttgggagtcggccat

SEQ ID NO: 383170 - DNA, 140 bp, Artificial Sequence
  Synthetic
atggccgactcccaagtacgttcaagtatctcctggagccggtcgtggacagccatcttccccgcaggggtggcaagatccttgactgacaccttagatccccagcccatggcagcatgtggagacccagcatggcgtat

SEQ ID NO: 383171 - DNA, 140 bp, Artificial Sequence
  Synthetic
atacgccatgctgggtctccgggactccggtcccctttactcttactgtgaaaaaggaggtgttcttcaaagatcgcaaggaggagaaggccccccgcctcattgtgttcccccccctggcgtacttgggagtcggccat

SEQ ID NO: 383172 - DNA, 140 bp, Artificial Sequence
  Synthetic
atggccgactcccaagtacgccaggggggggaacacaatgaggcggggggccttctcctccttgcgatctttgaagaacacctcctttttcacagtaagagtaaaggggaccggagtcccggagacccagcatggcgtat

SEQ ID NO: 383173 - DNA, 140 bp, Artificial Sequence
  Synthetic
atacgccatgctgggtctccacttccggatagctgaaaagctcatcctgggagacccgggtcgggtagccaaggcggtgttggggggggcctatgccttccagtacaccccaaaccagcgcgtacttgggagtcggccat

SEQ ID NO: 383174 - DNA, 140 bp, Artificial Sequence
  Synthetic
atggccgactcccaagtacgcgctggtttggggtgtactggaaggcataggccccccccaacaccgccttggctacccgacccgggtctcccaggatgagcttttcagctatccggaagtggagacccagcatggcgtat

SEQ ID NO: 383175 - DNA, 140 bp, Artificial Sequence
  Synthetic
atacgccatgctgggtctccagttagggagatgctcaagctatgggagtcaaagaaaacaccttgcgccatctgcgtggatgcgacgtgcttcgacagtagtataactgaagaggacgtccgtacttgggagtcggccat

SEQ ID NO: 383176 - DNA, 140 bp, Artificial Sequence
  Synthetic
atggccgactcccaagtacggacgtcctcttcagttatactactgtcgaagcacgtcgcatccacgcagatggcgcaaggtgttttctttgactcccatagcttgagcatctccctaactggagacccagcatggcgtat

SEQ ID NO: 383177 - DNA, 140 bp, Artificial Sequence
  Synthetic
atacgccatgctgggtctccgctttggagacagagctgtatgctctggcctctgaccacccagaatgggtgcgagccctggggaaatactatgcttcaggcaccatggtcaccccggaagcgtacttgggagtcggccat

SEQ ID NO: 383178 - DNA, 140 bp, Artificial Sequence
  Synthetic
atggccgactcccaagtacgcttccggggtgaccatggtgcctgaagcatagtatttccccagggctcgcacccattctgggtggtcagaggccagagcatacagctctgtctccaaagcggagacccagcatggcgtat

SEQ ID NO: 383179 - DNA, 140 bp, Artificial Sequence
  Synthetic
atacgccatgctgggtctccgggttcccgttggtgagaggtattgtagatcctcaggcgtcttgacgactagcgcgagtaactgcctgacctgctacattaaggtgaaagccgcttgtgacgtacttgggagtcggccat

SEQ ID NO: 383180 - DNA, 140 bp, Artificial Sequence
  Synthetic
atggccgactcccaagtacgtcacaagcggctttcaccttaatgtagcaggtcaggcagttactcgcgctagtcgtcaagacgcctgaggatctacaatacctctcaccaacgggaacccggagacccagcatggcgtat

SEQ ID NO: 383181 - DNA, 140 bp, Artificial Sequence
  Synthetic
atacgccatgctgggtctccgagggtggggctgaaaaatgtctcactcctcatagctggcgatgatggtctgatcatatgtgaacggccagtgtgcgacccaagcgacgctctgggcaaacgtacttgggagtcggccat

SEQ ID NO: 383182 - DNA, 140 bp, Artificial Sequence
  Synthetic
atggccgactcccaagtacgtttgcccagagcgtcgcttgggtcgcacactggccgttcacatatgatcagaccatcatcgccagctatgaggagtgagacatttttcagccccaccctcggagacccagcatggcgtat

SEQ ID NO: 383183 - DNA, 140 bp, Artificial Sequence
  Synthetic
atacgccatgctgggtctccgcgctatcaagctatgggtacgcgtgcgagccttcatatcatgcatcattggacacggcccccttctgctccacttggctcgctgagtgtaatgcagatgcgtacttgggagtcggccat

SEQ ID NO: 383184 - DNA, 140 bp, Artificial Sequence
  Synthetic
atggccgactcccaagtacgcatctgcattacactcagcgagccaagtggagcagaagggggccgtgtccaatgatgcatgatatgaaggctcgcacgcgtacccatagcttgatagcgcggagacccagcatggcgtat

SEQ ID NO: 383185 - DNA, 140 bp, Artificial Sequence
  Synthetic
atacgccatgctgggtctccggaagcgccatttcttcctgactacggactttcggaggccgctcgctcgcatgtcgagcgagtacagtgacccgatggcttcggccattggttacatcctcgtacttgggagtcggccat

SEQ ID NO: 383186 - DNA, 140 bp, Artificial Sequence
  Synthetic
atggccgactcccaagtacgaggatgtaaccaatggccgaagccatcgggtcactgtactcgctcgacatgcgagcgagcggcctccgaaagtccgtagtcaggaagaaatggcgcttccggagacccagcatggcgtat

SEQ ID NO: 383187 - DNA, 140 bp, Artificial Sequence
  Synthetic
atacgccatgctgggtctcccctttatccatggcaccccatcacacggtgggtcatcatccctcatgtgctaacatgcgcattcaggggtggtggcacaccgtctgatccggtctggtgccgtacttgggagtcggccat

SEQ ID NO: 383188 - DNA, 140 bp, Artificial Sequence
  Synthetic
atggccgactcccaagtacggcaccagaccggatcagacggtgtgccaccacccctgaatgcgcatgttagcacatgagggatgatgacccaccgtgtgatggggtgccatggataaaggggagacccagcatggcgtat

SEQ ID NO: 383189 - DNA, 140 bp, Artificial Sequence
  Synthetic
aggccctggctgctgatatgcaggtgcatggtaattactacaagtttccactggacaaactgcctaacatcatcgtggccctccacggaccagcagcgttgagggttaccgcagacacaagaccttttgggacagcggtg

SEQ ID NO: 383190 - DNA, 140 bp, Artificial Sequence
  Synthetic
caccgctgtcccaaaaggtcttgtgtctgcggtaaccctcaacgctgctggtccgtggagggccacgatgatgttaggcagtttgtccagtggaaacttgtagtaattaccatgcacctgcatatcagcagccagggcct

SEQ ID NO: 383191 - DNA, 140 bp, Artificial Sequence
  Synthetic
atacgccatgctgggtctccccaaaacaaaaatggaggctggcaaggtcctgagcgacctcaagctccctggcttagcggtccaccgcaagaaggccggggcattgcggactcgcatgctcgtacttgggagtcggccat

SEQ ID NO: 383192 - DNA, 140 bp, Artificial Sequence
  Synthetic
atggccgactcccaagtacgagcatgcgagtccgcaatgccccggccttcttgcggtggaccgctaagccagggagcttgaggtcgctcaggaccttgccagcctccatttttgttttggggagacccagcatggcgtat

SEQ ID NO: 383193 - DNA, 140 bp, Artificial Sequence
  Synthetic
atacgccatgctgggtctccccgttcgcgcggttgggccgagttggccaggggcctgttgtggcatccaggcctgcggcttcccccccccgagattgctggtatcccggggggtttcccccgtacttgggagtcggccat

SEQ ID NO: 383194 - DNA, 140 bp, Artificial Sequence
  Synthetic
atggccgactcccaagtacgggggaaaccccccgggataccagcaatctcgggggggggaagccgcaggcctggatgccacaacaggcccctggccaactcggcccaaccgcgcgaacggggagacccagcatggcgtat

SEQ ID NO: 383195 - DNA, 140 bp, Artificial Sequence
  Synthetic
atacgccatgctgggtctccctttcccccccctacatgggggtggttcatcaattggatttaacaagccagaggagtcgctggcggtggctggggttcttagccctgctcatcgtagccccgtacttgggagtcggccat

SEQ ID NO: 383196 - DNA, 140 bp, Artificial Sequence
  Synthetic
atggccgactcccaagtacggggctacgatgagcagggctaagaaccccagccaccgccagcgactcctctggcttgttaaatccaattgatgaaccacccccatgtaggggggggaaagggagacccagcatggcgtat

SEQ ID NO: 383197 - DNA, 140 bp, Artificial Sequence
  Synthetic
aggccctggctgctgatatgtacgggctgctcgcagagccctccccggatggggcacagtgcactgtgatctgaaggggtgcaccccggtaagagcccggcccaaaggccgggttttattgaccttttgggacagcggtg

SEQ ID NO: 383198 - DNA, 140 bp, Artificial Sequence
  Synthetic
caccgctgtcccaaaaggtcaataaaacccggcctttgggccgggctcttaccggggtgcaccccttcagatcacagtgcactgtgccccatccggggagggctctgcgagcagcccgtacatatcagcagccagggcct

SEQ ID NO: 383199 - DNA, 140 bp, Artificial Sequence
  Synthetic
atacgccatgctgggtctcccaatgactcggcgccgactcggcgaccggccaaaaggtggtggatgggtgatgacagggttggtaggtcgtaaatcccggtcaccttggtagccactatacgtacttgggagtcggccat

SEQ ID NO: 383200 - DNA, 140 bp, Artificial Sequence
  Synthetic
atggccgactcccaagtacgtatagtggctaccaaggtgaccgggatttacgacctaccaaccctgtcatcacccatccaccaccttttggccggtcgccgagtcggcgccgagtcattgggagacccagcatggcgtat

SEQ ID NO: 383201 - DNA, 140 bp, Artificial Sequence
  Synthetic
aggccctggctgctgatatggcgcacggtccacaggtgttggccctaccggtgggaataagggcccgacgtcaggctcgtcgttaaaccgagcccgtaacccgcctgggcaaacgacgccgaccttttgggacagcggtg

SEQ ID NO: 383202 - DNA, 140 bp, Artificial Sequence
  Synthetic
caccgctgtcccaaaaggtcggcgtcgtttgcccaggcgggttacgggctcggtttaacgacgagcctgacgtcgggcccttattcccaccggtagggccaacacctgtggaccgtgcgccatatcagcagccagggcct

SEQ ID NO: 383203 - DNA, 140 bp, Artificial Sequence
  Synthetic
aggccctggctgctgatatgcacgtacggtccacgtcgcccttcaatgtcgctcttgaccaataggcttagccggcgagttgacaaggaccagtgggggccggggtttatggggaaggacgaccttttgggacagcggtg

SEQ ID NO: 383204 - DNA, 140 bp, Artificial Sequence
  Synthetic
caccgctgtcccaaaaggtcgtccttccccataaaccccggcccccactggtccttgtcaactcgccggctaagcctattggtcaagagcgacattgaagggcgacgtggaccgtacgtgcatatcagcagccagggcct

SEQ ID NO: 383205 - DNA, 140 bp, Artificial Sequence
  Synthetic
aggccctggctgctgatatgcccaaaccctgcccttcccggcggaccgggaaatgcatggggccacccagctccgcggcggcctgcagccggggtagcccaagaatccttcgggtgaggggaccttttgggacagcggtg

SEQ ID NO: 383206 - DNA, 140 bp, Artificial Sequence
  Synthetic
caccgctgtcccaaaaggtcccctcacccgaaggattcttgggctaccccggctgcaggccgccgcggagctgggtggccccatgcatttcccggtccgccgggaagggcagggtttgggcatatcagcagccagggcct

SEQ ID NO: 383207 - DNA, 140 bp, Artificial Sequence
  Synthetic
atacgccatgctgggtctcccgggtggcatttctcttccttataccatcatggaagccctcctgttcctcctcggggtggaggccggggccattctggccccggccacccacgcttgtcgcgtacttgggagtcggccat

SEQ ID NO: 383208 - DNA, 140 bp, Artificial Sequence
  Synthetic
atggccgactcccaagtacgcgacaagcgtgggtggccggggccagaatggccccggcctccaccccgaggaggaacaggagggcttccatgatggtataaggaagagaaatgccacccgggagacccagcatggcgtat

SEQ ID NO: 383209 - DNA, 140 bp, Artificial Sequence
  Synthetic
atacgccatgctgggtctccagcgaatgggcaatatttcctcacaaactgttgtgctccagaggacattgggttctgcctcgaaggcggttgccttgtggccctggggtgcacagtttgccgtacttgggagtcggccat

SEQ ID NO: 383210 - DNA, 140 bp, Artificial Sequence
  Synthetic
atggccgactcccaagtacggcaaactgtgcaccccagggccacaaggcaaccgccttcgaggcagaacccaatgtcctctggagcacaacagtttgtgaggaaatattgcccattcgctggagacccagcatggcgtat

SEQ ID NO: 383211 - DNA, 140 bp, Artificial Sequence
  Synthetic
atacgccatgctgggtctccactgaccgatgctggccgctgtatcaggcgggcttggctgtgcggcctggcaagtccgcagcccagctggtggggcaactgggtggcctctacgggccctcgtacttgggagtcggccat

SEQ ID NO: 383212 - DNA, 140 bp, Artificial Sequence
  Synthetic
atggccgactcccaagtacgagggcccgtagaggccacccagttgccccaccagctgggctgcggacttgccaggccgcacagccaagcccgcctgatacagcggccagcatcggtcagtggagacccagcatggcgtat

SEQ ID NO: 383213 - DNA, 140 bp, Artificial Sequence
  Synthetic
atacgccatgctgggtctcctgtcggtgtcggcctacgtggccggcatcctgggcctgggtgaggtgtactcgggtgtcctaacagttggtgttgcgttgacgcgccgggtctacccgatcgtacttgggagtcggccat

SEQ ID NO: 383214 - DNA, 140 bp, Artificial Sequence
  Synthetic
atggccgactcccaagtacgatcgggtagacccggcgcgtcaacgcaacaccaactgttaggacacccgagtacacctcacccaggcccaggatgccggccacgtaggccgacaccgacaggagacccagcatggcgtat

SEQ ID NO: 383215 - DNA, 140 bp, Artificial Sequence
  Synthetic
atacgccatgctgggtctccgcccaacctgacgtgtgcagtagagtgtgagcttaagtgggaaagtgagttttggagatggactgagcagctggcctccaattactggattctggaataccgtacttgggagtcggccat

SEQ ID NO: 383216 - DNA, 140 bp, Artificial Sequence
  Synthetic
atggccgactcccaagtacggtattccagaatccagtaattggaggccagctgctcagtccatctccaaaactcactttcccacttaagctcacactctactgcacacgtcaggttgggcggagacccagcatggcgtat

SEQ ID NO: 383217 - DNA, 140 bp, Artificial Sequence
  Synthetic
atacgccatgctgggtctccctttggaaggtcccgtttgacttctggagaggcgtgctaagcctgactcccttgctggtttgcgtggccgcgttgctgctgctggagcaacggattgtcacgtacttgggagtcggccat

SEQ ID NO: 383218 - DNA, 140 bp, Artificial Sequence
  Synthetic
atggccgactcccaagtacgtgacaatccgttgctccagcagcagcaacgcggccacgcaaaccagcaagggagtcaggcttagcacgcctctccagaagtcaaacgggaccttccaaagggagacccagcatggcgtat

SEQ ID NO: 383219 - DNA, 140 bp, Artificial Sequence
  Synthetic
atacgccatgctgggtctcctggtcttcctgttggtgacgatggccgggatgtcgcaaggcgctccggcctccgttttggggtctcgcccctttgactacgggttgacatggcagtcttgcgtacttgggagtcggccat

SEQ ID NO: 383220 - DNA, 140 bp, Artificial Sequence
  Synthetic
atggccgactcccaagtacgcaagactgccatgtcaacccgtagtcaaaggggcgagaccccaaaacggaggccggagcgccttgcgacatcccggccatcgtcaccaacaggaagaccaggagacccagcatggcgtat

SEQ ID NO: 383221 - DNA, 140 bp, Artificial Sequence
  Synthetic
atacgccatgctgggtctccttcctgcagggctaatgggtcgcgctatactactggggagaaggtgtgggaccgtgggaacgtcacgctcctgtgtgactgccccaacggcccctgggtgcgtacttgggagtcggccat

SEQ ID NO: 383222 - DNA, 140 bp, Artificial Sequence
  Synthetic
atggccgactcccaagtacgcacccaggggccgttggggcagtcacacaggagcgtgacgttcccacggtcccacaccttctccccagtagtatagcgcgacccattagccctgcaggaaggagacccagcatggcgtat

SEQ ID NO: 383223 - DNA, 140 bp, Artificial Sequence
  Synthetic
atacgccatgctgggtctcctggttgccggccttttgccaagcaatcggctggggcgatcccatcactcattggagccacggccaaaatcggtggcccctctcatgcccccagtatgtctcgtacttgggagtcggccat

SEQ ID NO: 383224 - DNA, 140 bp, Artificial Sequence
  Synthetic
atggccgactcccaagtacgagacatactgggggcatgagaggggccaccgattttggccgtggctccaatgagtgatgggatcgccccagccgattgcttggcaaaaggccggcaaccaggagacccagcatggcgtat

SEQ ID NO: 383225 - DNA, 140 bp, Artificial Sequence
  Synthetic
atacgccatgctgggtctccatgggtctgtttcagtcacttgcgtgtggggttccgtctcttggtttgcctcgactggcggtcgcgactcgaagatcgatgtgtggagtctggtgccggtcgtacttgggagtcggccat

SEQ ID NO: 383226 - DNA, 140 bp, Artificial Sequence
  Synthetic
atggccgactcccaagtacgaccggcaccagactccacacatcgatcttcgagtcgcgaccgccagtcgaggcaaaccaagagacggaaccccacacgcaagtgactgaaacagacccatggagacccagcatggcgtat

SEQ ID NO: 383227 - DNA, 140 bp, Artificial Sequence
  Synthetic
atacgccatgctgggtctcctggttccgccagctgcaccatagccgctcttggatcgtcggatcgggacacggtagttgagctctccgagtggggagtcccgtgcgcaacgtgcattctgcgtacttgggagtcggccat

SEQ ID NO: 383228 - DNA, 140 bp, Artificial Sequence
  Synthetic
atggccgactcccaagtacgcagaatgcacgttgcgcacgggactccccactcggagagctcaactaccgtgtcccgatccgacgatccaagagcggctatggtgcagctggcggaaccaggagacccagcatggcgtat

SEQ ID NO: 383229 - DNA, 140 bp, Artificial Sequence
  Synthetic
atacgccatgctgggtctccgatcgtcggccggcctcgtgcggcacctgtgtgagagactgctggcccgaaaccgggtcggttaggtttccattccatcggtgcggcgcggggcctaagccgtacttgggagtcggccat

SEQ ID NO: 383230 - DNA, 140 bp, Artificial Sequence
  Synthetic
atggccgactcccaagtacggcttaggccccgcgccgcaccgatggaatggaaacctaaccgacccggtttcgggccagcagtctctcacacaggtgccgcacgaggccggccgacgatcggagacccagcatggcgtat

SEQ ID NO: 383231 - DNA, 140 bp, Artificial Sequence
  Synthetic
atacgccatgctgggtctcctgacaaaggacttggaagctgtgcccttcgtcaataggacaactcccttcaccataaggggccccctgggcaaccaggggagaggcaacccggtgcggtccgtacttgggagtcggccat

SEQ ID NO: 383232 - DNA, 140 bp, Artificial Sequence
  Synthetic
atggccgactcccaagtacggaccgcaccgggttgcctctcccctggttgcccagggggccccttatggtgaagggagttgtcctattgacgaagggcacagcttccaagtcctttgtcaggagacccagcatggcgtat

SEQ ID NO: 383233 - DNA, 140 bp, Artificial Sequence
  Synthetic
atacgccatgctgggtctccgcccttgggttttgggtcctacgccatgaccaagatccgagactccttacatttggtgaaatgtcccacaccagccattgagcctcccaccgggacgtttcgtacttgggagtcggccat

SEQ ID NO: 383234 - DNA, 140 bp, Artificial Sequence
  Synthetic
atggccgactcccaagtacgaaacgtcccggtgggaggctcaatggctggtgtgggacatttcaccaaatgtaaggagtctcggatcttggtcatggcgtaggacccaaaacccaagggcggagacccagcatggcgtat

SEQ ID NO: 383235 - DNA, 140 bp, Artificial Sequence
  Synthetic
atacgccatgctgggtctccgggttcttccccggagtgccgcctcttaacaactgcctgctgttgggcacggaagtgtccgaagcgctgggcggggccggcctcacgggggggttctatgcgtacttgggagtcggccat

SEQ ID NO: 383236 - DNA, 140 bp, Artificial Sequence
  Synthetic
atggccgactcccaagtacgcatagaacccccccgtgaggccggccccgcccagcgcttcggacacttccgtgcccaacagcaggcagttgttaagaggcggcactccggggaagaacccggagacccagcatggcgtat

SEQ ID NO: 383237 - DNA, 140 bp, Artificial Sequence
  Synthetic
atacgccatgctgggtctccaacccctggtgcgcaggcgttcggagctgatggggcgccgaaatccggtttgcccggggtttgcatggctgtcctcgggtcgacctgacgggtttatacacgtacttgggagtcggccat

SEQ ID NO: 383238 - DNA, 140 bp, Artificial Sequence
  Synthetic
atggccgactcccaagtacgtgtataaacccgtcaggtcgacccgaggacagccatgcaaaccccgggcaaaccggatttcggcgccccatcagctccgaacgcctgcgcaccaggggttggagacccagcatggcgtat

SEQ ID NO: 383239 - DNA, 140 bp, Artificial Sequence
  Synthetic
atacgccatgctgggtctcccgtccagggccacttgcaggaggtcgatgctggcaacttcatccctccacctcgctggttgctcttggactttgtgtttgtcctgttatacctgatgaagcgtacttgggagtcggccat

SEQ ID NO: 383240 - DNA, 140 bp, Artificial Sequence
  Synthetic
atggccgactcccaagtacgcttcatcaggtataacaggacaaacacaaagtccaagagcaaccagcgaggtggagggatgaagttgccagcatcgacctcctgcaagtggccctggacgggagacccagcatggcgtat

SEQ ID NO: 383241 - DNA, 140 bp, Artificial Sequence
  Synthetic
atacgccatgctgggtctccctggctgaggcacggctggtcccgttgatcttgcttctgctgtggtggtgggtgaaccagttggcagtccttggactgccggctgtggacgccgccgtggcgtacttgggagtcggccat

SEQ ID NO: 383242 - DNA, 140 bp, Artificial Sequence
  Synthetic
atggccgactcccaagtacgccacggcggcgtccacagccggcagtccaaggactgccaactggttcacccaccaccacagcagaagcaagatcaacgggaccagccgtgcctcagccagggagacccagcatggcgtat

SEQ ID NO: 383243 - DNA, 140 bp, Artificial Sequence
  Synthetic
atacgccatgctgggtctccctggtgaggtcttcgcgggcccggccctgtcgtggtgtctgggcctccccaccgttagtatgatcctgggcttagcaaacctggtgttgtatttccggtgcgtacttgggagtcggccat

SEQ ID NO: 383244 - DNA, 140 bp, Artificial Sequence
  Synthetic
atggccgactcccaagtacgcaccggaaatacaacaccaggtttgctaagcccaggatcatactaacggtggggaggcccagacaccacgacagggccgggcccgcgaagacctcaccagggagacccagcatggcgtat

SEQ ID NO: 383245 - DNA, 140 bp, Artificial Sequence
  Synthetic
atacgccatgctgggtctccgatgggtccccaacgcctcatgttcctcgtgttgtggaagctcgctcggggagccttcccgctggcacttctgatggggatctcggcaacccgcgggcgccgtacttgggagtcggccat

SEQ ID NO: 383246 - DNA, 140 bp, Artificial Sequence
  Synthetic
atggccgactcccaagtacggcgcccgcgggttgccgagatccccatcagaagtgccagcgggaaggctccccgagcgagcttccacaacacgaggaacatgaggcgttggggacccatcggagacccagcatggcgtat

SEQ ID NO: 383247 - DNA, 140 bp, Artificial Sequence
  Synthetic
atacgccatgctgggtctccacctcggtgctcggggccgagttctgcttcgatgtcacattcgaggtggacacgtcggttttgggctgggtggtggccagtgtggtagcctgggccattgcgtacttgggagtcggccat

SEQ ID NO: 383248 - DNA, 140 bp, Artificial Sequence
  Synthetic
atggccgactcccaagtacgcaatggcccaggctaccacactggccaccacccagcccaaaaccgacgtgtccacctcgaatgtgacatcgaagcagaactcggccccgagcaccgaggtggagacccagcatggcgtat

SEQ ID NO: 383249 - DNA, 140 bp, Artificial Sequence
  Synthetic
atacgccatgctgggtctcccgctcctgagctcgatgagcgcgggagggtggaggcacaaggccgtgatctataggacgtggtgtaaggggtaccaggcaatacgccaacgggtggtgcgcgtacttgggagtcggccat

SEQ ID NO: 383250 - DNA, 140 bp, Artificial Sequence
  Synthetic
atggccgactcccaagtacgcgcaccacccgttggcgtattgcctggtaccccttacaccacgtcctatagatcacggccttgtgcctccaccctcccgcgctcatcgagctcaggagcgggagacccagcatggcgtat

SEQ ID NO: 383251 - DNA, 140 bp, Artificial Sequence
  Synthetic
atacgccatgctgggtctccgagccccctcggggaggggcggcccaccaaacccttgacgtttgcttggtgcttggcctcatacatctggccggatgctgtgatgatggtggtggtagcccgtacttgggagtcggccat

SEQ ID NO: 383252 - DNA, 140 bp, Artificial Sequence
  Synthetic
atggccgactcccaagtacgggctaccaccaccatcatcacagcatccggccagatgtatgaggccaagcaccaagcaaacgtcaagggtttggtgggccgcccctccccgagggggctcggagacccagcatggcgtat

SEQ ID NO: 383253 - DNA, 140 bp, Artificial Sequence
  Synthetic
atacgccatgctgggtctccttggtgctcctctttggcctgttcgacgcgttggactgggctttggaggagctcttggtgtcccggccctcgttacggcgtctggcccgggtggttgagtcgtacttgggagtcggccat

SEQ ID NO: 383254 - DNA, 140 bp, Artificial Sequence
  Synthetic
atggccgactcccaagtacgactcaaccacccgggccagacgccgtaacgagggccgggacaccaagagctcctccaaagcccagtccaacgcgtcgaacaggccaaagaggagcaccaaggagacccagcatggcgtat

SEQ ID NO: 383255 - DNA, 140 bp, Artificial Sequence
  Synthetic
atacgccatgctgggtctccgctgtgtgatggcgggagagaaggccacaaccgtccggctggtctccaagatgtgcgcgagaggggcctatttgtttgaccatatgggctctttttcgcgcgtacttgggagtcggccat

SEQ ID NO: 383256 - DNA, 140 bp, Artificial Sequence
  Synthetic
atggccgactcccaagtacgcgcgaaaaagagcccatatggtcaaacaaataggcccctctcgcgcacatcttggagaccagccggacggttgtggccttctctcccgccatcacacagcggagacccagcatggcgtat

SEQ ID NO: 383257 - DNA, 140 bp, Artificial Sequence
  Synthetic
atacgccatgctgggtctcccgctgtcaaggagcgcctgctggagtgggacgcggctttggaacccctgtcattcactaggacggactgtcgcatcattagagatgctgcgaggaccttgcgtacttgggagtcggccat

SEQ ID NO: 383258 - DNA, 140 bp, Artificial Sequence
  Synthetic
atggccgactcccaagtacgcaaggtcctcgcagcatctctaatgatgcgacagtccgtcctagtgaatgacaggggttccaaagccgcgtcccactccagcaggcgctccttgacagcgggagacccagcatggcgtat

SEQ ID NO: 383259 - DNA, 140 bp, Artificial Sequence
  Synthetic
atacgccatgctgggtctccgcctgcgggcagtgcgtcatgggcttgcctgtggtagcgcgccgtggtgacgaggttcttatcggtgtctttcaggatgtgaaccatttgcctcccggatcgtacttgggagtcggccat

SEQ ID NO: 383260 - DNA, 140 bp, Artificial Sequence
  Synthetic
atggccgactcccaagtacgatccgggaggcaaatggttcacatcctgaaagacaccgataagaacctcgtcaccacggcgcgctaccacaggcaagcccatgacgcactgcccgcaggcggagacccagcatggcgtat

SEQ ID NO: 383261 - DNA, 140 bp, Artificial Sequence
  Synthetic
atacgccatgctgggtctcctcgtcccgaccgcacccgttgtcatccggcggtgcgggaaggggtttctgggggtcactaaggctgccttgactggtcgggatcctgacttacatccaggcgtacttgggagtcggccat

SEQ ID NO: 383262 - DNA, 140 bp, Artificial Sequence
  Synthetic
atggccgactcccaagtacgcctggatgtaagtcaggatcccgaccagtcaaggcagccttagtgacccccagaaaccccttcccgcaccgccggatgacaacgggtgcggtcgggacgaggagacccagcatggcgtat

SEQ ID NO: 383263 - DNA, 140 bp, Artificial Sequence
  Synthetic
atacgccatgctgggtctccgaacgtcatggtgttggggacggctacgtcgcgaagcatggggacatgcctgaacggcctgctgttcacgactttccatggggcttcatcccgaaccatccgtacttgggagtcggccat

SEQ ID NO: 383264 - DNA, 140 bp, Artificial Sequence
  Synthetic
atggccgactcccaagtacggatggttcgggatgaagccccatggaaagtcgtgaacagcaggccgttcaggcatgtccccatgcttcgcgacgtagccgtccccaacaccatgacgttcggagacccagcatggcgtat

SEQ ID NO: 383265 - DNA, 140 bp, Artificial Sequence
  Synthetic
atacgccatgctgggtctccgccacgcccgtgggggcccttaatcccaggtggtggtccgccagtgatgacgtcacggtgtacccgctcccggatggggcaacctcgttgacgccctgcacgtacttgggagtcggccat

SEQ ID NO: 383266 - DNA, 140 bp, Artificial Sequence
  Synthetic
atggccgactcccaagtacgtgcagggcgtcaacgaggttgccccatccgggagcgggtacaccgtgacgtcatcactggcggaccaccacctgggattaagggcccccacgggcgtggcggagacccagcatggcgtat

SEQ ID NO: 383267 - DNA, 140 bp, Artificial Sequence
  Synthetic
atacgccatgctgggtctcccttgccaggctgagtcctgttgggtcatacggtccgacggggctttgtgccatggcttgagtaagggagacaaggtggagctagatgtggccatggaggtcgtacttgggagtcggccat

SEQ ID NO: 383268 - DNA, 140 bp, Artificial Sequence
  Synthetic
atggccgactcccaagtacgacctccatggccacatctagctccaccttgtctcccttactcaagccatggcacaaagccccgtcggaccgtatgacccaacaggactcagcctggcaagggagacccagcatggcgtat

SEQ ID NO: 383269 - DNA, 140 bp, Artificial Sequence
  Synthetic
atacgccatgctgggtctccctcagatttccgtggctcgtccggctcacctgtcctgtgcgacgaggggcacgcagtaggaatgctcgtgtcggtgctccactcgggtggtcgggtcacccgtacttgggagtcggccat

SEQ ID NO: 383270 - DNA, 140 bp, Artificial Sequence
  Synthetic
atggccgactcccaagtacgggtgacccgaccacccgagtggagcaccgacacgagcattcctactgcgtgcccctcgtcgcacaggacaggtgagccggacgagccacggaaatctgagggagacccagcatggcgtat

SEQ ID NO: 383271 - DNA, 140 bp, Artificial Sequence
  Synthetic
atacgccatgctgggtctccgcggctcgattcaccaggccgtggacccaggtcccaacagatgctaagaccaccactgaaccccctccggtgccggcaaagggagttttcaaggaagccccgtacttgggagtcggccat

SEQ ID NO: 383272 - DNA, 140 bp, Artificial Sequence
  Synthetic
atggccgactcccaagtacggggcttccttgaaaactccctttgccggcaccggagggggttcagtggtggtcttagcatctgttgggacctgggtccacggcctggtgaatcgagccgcggagacccagcatggcgtat

SEQ ID NO: 383273 - DNA, 140 bp, Artificial Sequence
  Synthetic
atacgccatgctgggtctcccactgtttatgcccacgggcgcaggaaagagcacgcgcgtcccgttggagtatggcaacatggggcacaaggtcctgattttgaacccctcggtggcgaccgtacttgggagtcggccat

SEQ ID NO: 383274 - DNA, 140 bp, Artificial Sequence
  Synthetic
atggccgactcccaagtacggtcgccaccgaggggttcaaaatcaggaccttgtgccccatgttgccatactccaacgggacgcgcgtgctctttcctgcgcccgtgggcataaacagtgggagacccagcatggcgtat

SEQ ID NO: 383275 - DNA, 140 bp, Artificial Sequence
  Synthetic
atacgccatgctgggtctccagtgagggccatgggcccttacatggagcgactggcgggaaaacatccaagtatctactgtggccatgacaccactgccttcacaaggatcactgattcccgtacttgggagtcggccat

SEQ ID NO: 383276 - DNA, 140 bp, Artificial Sequence
  Synthetic
atggccgactcccaagtacgggaatcagtgatccttgtgaaggcagtggtgtcatggccacagtagatacttggatgttttcccgccagtcgctccatgtaagggcccatggccctcactggagacccagcatggcgtat

SEQ ID NO: 383277 - DNA, 140 bp, Artificial Sequence
  Synthetic
atacgccatgctgggtctcccccttaacgtactctacctatgggaggtttctggccaaccctaggcagatgctgcgaggtgtgtcggtggtcatttgcgatgaatgccacagtcatgattcgtacttgggagtcggccat

SEQ ID NO: 383278 - DNA, 140 bp, Artificial Sequence
  Synthetic
atggccgactcccaagtacgaatcatgactgtggcattcatcgcaaatgaccaccgacacacctcgcagcatctgcctagggttggccagaaacctcccataggtagagtacgttaagggggagacccagcatggcgtat

SEQ ID NO: 383279 - DNA, 140 bp, Artificial Sequence
  Synthetic
atacgccatgctgggtctccccactgtgttgttggggattggacgggtccgggagctggcacgagagtgtggggtgcagcttgtgctctacgccactgccacgcctcctgggtcccccatcgtacttgggagtcggccat

SEQ ID NO: 383280 - DNA, 140 bp, Artificial Sequence
  Synthetic
atggccgactcccaagtacgatgggggacccaggaggcgtggcagtggcgtagagcacaagctgcaccccacactctcgtgccagctcccggacccgtccaatccccaacaacacagtggggagacccagcatggcgtat

SEQ ID NO: 383281 - DNA, 140 bp, Artificial Sequence
  Synthetic
atacgccatgctgggtctccgactcagcatccgtcaatcattgagaccaaattggatgtgggtgagattcccttctatgggcatggcatacccctcgagcggatgcggaccggtaggcaccgtacttgggagtcggccat

SEQ ID NO: 383282 - DNA, 140 bp, Artificial Sequence
  Synthetic
atggccgactcccaagtacggtgcctaccggtccgcatccgctcgaggggtatgccatgcccatagaagggaatctcacccacatccaatttggtctcaatgattgacggatgctgagtcggagacccagcatggcgtat

SEQ ID NO: 383283 - DNA, 140 bp, Artificial Sequence
  Synthetic
atacgccatgctgggtctccctcgtattctgctactctaaggcagagtgtgagcggctagccggtcagttttctgctaggggagttaacgccatagcctattacaggggaaaagacagttcgtacttgggagtcggccat

SEQ ID NO: 383284 - DNA, 140 bp, Artificial Sequence
  Synthetic
atggccgactcccaagtacgaactgtcttttcccctgtaataggctatggcgttaactcccctagcagaaaactgaccggctagccgctcacactctgccttagagtagcagaatacgagggagacccagcatggcgtat

SEQ ID NO: 383285 - DNA, 140 bp, Artificial Sequence
  Synthetic
atacgccatgctgggtctccctatcatcaaggacggagatctggtggtgtgcgcgaccgacgcgctatccactggatacactgggaacttcgattctgtcaccgactgtgggttagtggtcgtacttgggagtcggccat

SEQ ID NO: 383286 - DNA, 140 bp, Artificial Sequence
  Synthetic
atggccgactcccaagtacgaccactaacccacagtcggtgacagaatcgaagttcccagtgtatccagtggatagcgcgtcggtcgcgcacaccaccagatctccgtccttgatgatagggagacccagcatggcgtat

SEQ ID NO: 383287 - DNA, 140 bp, Artificial Sequence
  Synthetic
atacgccatgctgggtctccggaggaggtcgtcgaggtgacccttgatcccaccattaccatctccctgcggacagtgcccgcgtcggcagaactgtcgatgcagagacgaggacgcacgcgtacttgggagtcggccat

SEQ ID NO: 383288 - DNA, 140 bp, Artificial Sequence
  Synthetic
atggccgactcccaagtacgcgtgcgtcctcgtctctgcatcgacagttctgccgacgcgggcactgtccgcagggagatggtaatggtgggatcaagggtcacctcgacgacctcctccggagacccagcatggcgtat

SEQ ID NO: 383289 - DNA, 140 bp, Artificial Sequence
  Synthetic
atacgccatgctgggtctccggtagaggcaggtctgggcgctactactacgccggggtcggaaaggcccccgcgggtgtggtgcgctcgggtcctgtctggtcggcggtggaggccggagcgtacttgggagtcggccat

SEQ ID NO: 383290 - DNA, 140 bp, Artificial Sequence
  Synthetic
atggccgactcccaagtacgctccggcctccaccgccgaccagacaggacccgagcgcaccacacccgcgggggcctttccgaccccggcgtagtagtagcgcccagacctgcctctaccggagacccagcatggcgtat

SEQ ID NO: 383291 - DNA, 140 bp, Artificial Sequence
  Synthetic
atacgccatgctgggtctcctgacctggtatggaatggaacctgacttgacagctaacctattgagactttacgacgactgcccttacaccgcagccgtcgcagctgacatcggtgaagccgtacttgggagtcggccat

SEQ ID NO: 383292 - DNA, 140 bp, Artificial Sequence
  Synthetic
atggccgactcccaagtacggcttcaccgatgtcagctgcgacggctgcggtgtaagggcagtcgtcgtaaagtctcaataggttagctgtcaagtcaggttccattccataccaggtcaggagacccagcatggcgtat

SEQ ID NO: 383293 - DNA, 140 bp, Artificial Sequence
  Synthetic
atacgccatgctgggtctcccgcggtgtttttctccgggctagccccgttgaggatgcatcccgatgttagctgggcaaaagtgcgcggcgtcaactggcccctcttggtgggtgttcagcgtacttgggagtcggccat

SEQ ID NO: 383294 - DNA, 140 bp, Artificial Sequence
  Synthetic
atggccgactcccaagtacgctgaacacccaccaagaggggccagttgacgccgcgcacttttgcccagctaacatcgggatgcatcctcaacggggctagcccggagaaaaacaccgcgggagacccagcatggcgtat

SEQ ID NO: 383295 - DNA, 140 bp, Artificial Sequence
  Synthetic
atacgccatgctgggtctcccggaccatgtgccgggaaacactgtctcccggaccatcggacgacccccaatgggcaggtctgaagggcccgaatcctgttccactactgctgaggtgggcgtacttgggagtcggccat

SEQ ID NO: 383296 - DNA, 140 bp, Artificial Sequence
  Synthetic
atggccgactcccaagtacgcccacctcagcagtagtggaacaggattcgggcccttcagacctgcccattgggggtcgtccgatggtccgggagacagtgtttcccggcacatggtccgggagacccagcatggcgtat

SEQ ID NO: 383297 - DNA, 140 bp, Artificial Sequence
  Synthetic
atacgccatgctgggtctccgcaatgatttaccatcaaaagtggccggccaccacattgttgacgacctggttcgtaggcttggtgtggcggagggttatgtccgctgcgatgcggggcccgtacttgggagtcggccat

SEQ ID NO: 383298 - DNA, 140 bp, Artificial Sequence
  Synthetic
atggccgactcccaagtacgggccccgcatcgcagcggacataaccctccgccacaccaagcctacgaaccaggtcgtcaacaatgtggtggccggccacttttgatggtaaatcattgcggagacccagcatggcgtat

SEQ ID NO: 383299 - DNA, 140 bp, Artificial Sequence
  Synthetic
atacgccatgctgggtctccgatcttaatggtcggcctcgctatcgcgggggggatgatctacgcatcttacaccgggtctttagtggtggtgacagactgggatgtaaaggggggtggccgtacttgggagtcggccat

SEQ ID NO: 383300 - DNA, 140 bp, Artificial Sequence
  Synthetic
atggccgactcccaagtacggccacccccctttacatcccagtctgtcaccaccactaaagacccggtgtaagatgcgtagatcatcccccccgcgatagcgaggccgaccattaagatcggagacccagcatggcgtat

SEQ ID NO: 383301 - DNA, 140 bp, Artificial Sequence
  Synthetic
atacgccatgctgggtctccagccctctttatcggcatggagaccaggccacgccacagccggttgtgcaggtccccccggtagaccatcggccggggggggagtctgcgccttcggatgcgtacttgggagtcggccat

SEQ ID NO: 383302 - DNA, 140 bp, Artificial Sequence
  Synthetic
atggccgactcccaagtacgcatccgaaggcgcagactccccccccggccgatggtctaccggggggacctgcacaaccggctgtggcgtggcctggtctccatgccgataaagagggctggagacccagcatggcgtat

SEQ ID NO: 383303 - DNA, 140 bp, Artificial Sequence
  Synthetic
atacgccatgctgggtctccccaagacagtgacagatgcggtggcggccatccaggtggattgcgattggtcagtcatgaccctgtcgatcggggaagtgctgtccttggctcaggctaacgtacttgggagtcggccat

SEQ ID NO: 383304 - DNA, 140 bp, Artificial Sequence
  Synthetic
atggccgactcccaagtacgttagcctgagccaaggacagcacttccccgatcgacagggtcatgactgaccaatcgcaatccacctggatggccgccaccgcatctgtcactgtcttggggagacccagcatggcgtat

SEQ ID NO: 383305 - DNA, 140 bp, Artificial Sequence
  Synthetic
atacgccatgctgggtctccaacagctgaggcctacacggcaaccgccaagtggctcgctggctgctacacggggacgcgggccgttcccactgtttcaattgttgacaagctctttgcccgtacttgggagtcggccat

SEQ ID NO: 383306 - DNA, 140 bp, Artificial Sequence
  Synthetic
atggccgactcccaagtacgggcaaagagcttgtcaacaattgaaacagtgggaacggcccgcgtccccgtgtagcagccagcgagccacttggcggttgccgtgtaggcctcagctgttggagacccagcatggcgtat

SEQ ID NO: 383307 - DNA, 140 bp, Artificial Sequence
  Synthetic
atacgccatgctgggtctccggagggtgggcggctgtggttggccactgtcacagcgtcatagctgcggcggtggctgcctacggggcttccaggagtccgccgttggcagccgcggcttcgtacttgggagtcggccat

SEQ ID NO: 383308 - DNA, 140 bp, Artificial Sequence
  Synthetic
atggccgactcccaagtacgaagccgcggctgccaacggcggactcctggaagccccgtaggcagccaccgccgcagctatgacgctgtgacagtggccaaccacagccgcccaccctccggagacccagcatggcgtat

SEQ ID NO: 383309 - DNA, 140 bp, Artificial Sequence
  Synthetic
atacgccatgctgggtctcccctacctgatgggactgggcgtcggaggcaacgctcagacgcgtttggcgtctgccctcctgttgggggccgctggcaccgccctgggcactcccgtcgtcgtacttgggagtcggccat

SEQ ID NO: 383310 - DNA, 140 bp, Artificial Sequence
  Synthetic
atggccgactcccaagtacgacgacgggagtgcccagggcggtgccagcggcccccaacaggagggcagacgccaaacgcgtctgagcgttgcctccgacgcccagtcccatcaggtaggggagacccagcatggcgtat

SEQ ID NO: 383311 - DNA, 140 bp, Artificial Sequence
  Synthetic
atacgccatgctgggtctccgggtttaaccatggcgggggcgttcatggggggtgctagcgtctctccctccttggtcaccatcttgttgggggccgtgggaggctgggagggcgtcgtccgtacttgggagtcggccat

SEQ ID NO: 383312 - DNA, 140 bp, Artificial Sequence
  Synthetic
atggccgactcccaagtacggacgacgccctcccagcctcccacggcccccaacaagatggtgaccaaggagggagagacgctagcaccccccatgaacgcccccgccatggttaaacccggagacccagcatggcgtat

SEQ ID NO: 383313 - DNA, 140 bp, Artificial Sequence
  Synthetic
aggccctggctgctgatatgccttggtcaccatcttgttgggggccgtgggaggctgggagggcgtcgtcaacgctgctagccttgtctttgacttcatggcggggaaactatcgtcagagaccttttgggacagcggtg

SEQ ID NO: 383314 - DNA, 140 bp, Artificial Sequence
  Synthetic
caccgctgtcccaaaaggtctctgacgatagtttccccgccatgaagtcaaagacaaggctagcagcgttgacgacgccctcccagcctcccacggcccccaacaagatggtgaccaaggcatatcagcagccagggcct

SEQ ID NO: 383315 - DNA, 140 bp, Artificial Sequence
  Synthetic
atacgccatgctgggtctccagatctgtggtacgccatcccagtgctcaccagcccgggggcgggccttgcggggatcgcccttgggttggtgctgtactcagctaacaactctggtactcgtacttgggagtcggccat

SEQ ID NO: 383316 - DNA, 140 bp, Artificial Sequence
  Synthetic
atggccgactcccaagtacgagtaccagagttgttagctgagtacagcaccaacccaagggcgatccccgcaaggcccgcccccgggctggtgagcactgggatggcgtaccacagatctggagacccagcatggcgtat

SEQ ID NO: 383317 - DNA, 140 bp, Artificial Sequence
  Synthetic
atacgccatgctgggtctccaccacttggttgaaccgtctgctgactacgttacctaggtcttcttgcatccctgacagctatttccaacaggccgattactgtgacaaggtctcggccgcgtacttgggagtcggccat

SEQ ID NO: 383318 - DNA, 140 bp, Artificial Sequence
  Synthetic
atggccgactcccaagtacgcggccgagaccttgtcacagtaatcggcctgttggaaatagctgtcagggatgcaagaagacctaggtaacgtagtcagcagacggttcaaccaagtggtggagacccagcatggcgtat

SEQ ID NO: 383319 - DNA, 140 bp, Artificial Sequence
  Synthetic
atacgccatgctgggtctcctgcttcgccgactgagcctcacccgcactgtggtggccctagtcaatagggaacccaaggtggacgaggtacaggtggggtacgtctgggatctctgggacgtacttgggagtcggccat

SEQ ID NO: 383320 - DNA, 140 bp, Artificial Sequence
  Synthetic
atggccgactcccaagtacgtcccagagatcccagacgtaccccacctgtacctcgtccaccttgggttccctattgactagggccaccacagtgcgggtgaggctcagtcggcgaagcaggagacccagcatggcgtat

SEQ ID NO: 383321 - DNA, 140 bp, Artificial Sequence
  Synthetic
atacgccatgctgggtctccgtggatcatgcgtcaagtgcgcatggtcatggccaggctccgggctctctgccccgtggtgtcactgcctttgtggcactgcggggaggggtggtccggacgtacttgggagtcggccat

SEQ ID NO: 383322 - DNA, 140 bp, Artificial Sequence
  Synthetic
atggccgactcccaagtacgtccggaccacccctccccgcagtgccacaaaggcagtgacaccacggggcagagagcccggagcctggccatgaccatgcgcacttgacgcatgatccacggagacccagcatggcgtat

SEQ ID NO: 383323 - DNA, 140 bp, Artificial Sequence
  Synthetic
atacgccatgctgggtctccgagtggttgttggacggccatgtggagagtcgctgtctttgcgggtgcgtgatcaccggcgatgttttcaatgggcaactcaaagagccagtttactctacgtacttgggagtcggccat

SEQ ID NO: 383324 - DNA, 140 bp, Artificial Sequence
  Synthetic
atggccgactcccaagtacgtagagtaaactggctctttgagttgcccattgaaaacatcgccggtgatcacgcacccgcaaagacagcgactctccacatggccgtccaacaaccactcggagacccagcatggcgtat

SEQ ID NO: 383325 - DNA, 140 bp, Artificial Sequence
  Synthetic
atacgccatgctgggtctcccaaagttgtgccggcactattggatggggaccgttcctgtgaacatgctgggttacggcgaaacatcacccctcttggcctctgacaccccgaaggtggtcgtacttgggagtcggccat

SEQ ID NO: 383326 - DNA, 140 bp, Artificial Sequence
  Synthetic
atggccgactcccaagtacgaccaccttcggggtgtcagaggccaagaggggtgatgtttcgccgtaacccagcatgttcacaggaacggtccccatccaatagtgccggcacaactttgggagacccagcatggcgtat

SEQ ID NO: 383327 - DNA, 140 bp, Artificial Sequence
  Synthetic
atacgccatgctgggtctccgccttttgggacgtcgggctgggctgaggtggtggtgacccctacccacgtggtgatcaggagaacctctccctacgagttgctgcgccaacaaatcctacgtacttgggagtcggccat

SEQ ID NO: 383328 - DNA, 140 bp, Artificial Sequence
  Synthetic
atggccgactcccaagtacgtaggatttgttggcgcagcaactcgtagggagaggttctcctgatcaccacgtgggtaggggtcaccaccacctcagcccagcccgacgtcccaaaaggcggagacccagcatggcgtat

SEQ ID NO: 383329 - DNA, 140 bp, Artificial Sequence
  Synthetic
atacgccatgctgggtctcctcagctgcagttgctgagccctattatgtcgacggcataccggtctcatgggacgcggacgctcgtgcgcctgctatggtttatggccctgggcaaagtgcgtacttgggagtcggccat

SEQ ID NO: 383330 - DNA, 140 bp, Artificial Sequence
  Synthetic
atggccgactcccaagtacgcactttgcccagggccataaaccatagcaggcgcacgagcgtccgcgtcccatgagaccggtatgccgtcgacataatagggctcagcaactgcagctgaggagacccagcatggcgtat

SEQ ID NO: 383331 - DNA, 140 bp, Artificial Sequence
  Synthetic
atacgccatgctgggtctccttaccattgacggggagcgctacaccctgccgcatcaactgcggctcaggaatgtagcgccctctgaggtttcatccgaggtgtccatagacattgggaccgtacttgggagtcggccat

SEQ ID NO: 383332 - DNA, 140 bp, Artificial Sequence
  Synthetic
atggccgactcccaagtacggtcccaatgtctatggacacctcggatgaaacctcagagggcgctacattcctgagccgcagttgatgcggcagggtgtagcgctccccgtcaatggtaaggagacccagcatggcgtat

SEQ ID NO: 383333 - DNA, 140 bp, Artificial Sequence
  Synthetic
atacgccatgctgggtctccggagactgaagactcagaactgactgaggccgacctgccgccggcagctgcagccctccaggctatcgagaatgctgcgaggattcttgagcctcatattcgtacttgggagtcggccat

SEQ ID NO: 383334 - DNA, 140 bp, Artificial Sequence
  Synthetic
atggccgactcccaagtacgaatatgaggctcaagaatcctcgcagcattctcgatagcctggagggctgcagctgccggcggcaggtcggcctcagtcagttctgagtcttcagtctccggagacccagcatggcgtat

SEQ ID NO: 383335 - DNA, 140 bp, Artificial Sequence
  Synthetic
aggccctggctgctgatatgagagatgcctgtgtggggagaagacatcccccgcactccatcgccagcacttatctcggttaccgagagcagctcagatgagaagaccccgtcggtgtccgaccttttgggacagcggtg

SEQ ID NO: 383336 - DNA, 140 bp, Artificial Sequence
  Synthetic
caccgctgtcccaaaaggtcggacaccgacggggtcttctcatctgagctgctctcggtaaccgagataagtgctggcgatggagtgcgggggatgtcttctccccacacaggcatctctcatatcagcagccagggcct

SEQ ID NO: 383337 - DNA, 140 bp, Artificial Sequence
  Synthetic
atacgccatgctgggtctcctcctcgcaggaggataccccgtcctctgactcattcgaagtcatccaagagtctgagacagctgaaggagaggaaagtgtcttcaacgtggctctttccgcgtacttgggagtcggccat

SEQ ID NO: 383338 - DNA, 140 bp, Artificial Sequence
  Synthetic
atggccgactcccaagtacgcggaaagagccacgttgaagacactttcctctccttcagctgtctcagactcttggatgacttcgaatgagtcagaggacggggtatcctcctgcgaggaggagacccagcatggcgtat

SEQ ID NO: 383339 - DNA, 140 bp, Artificial Sequence
  Synthetic
atacgccatgctgggtctcctactagaagccttgtttccacagagtgatgccactagaaagcttaccgtcaggatgaattgctgcgttgagaagagcgtcacgcgcttcttttctttgggcgtacttgggagtcggccat

SEQ ID NO: 383340 - DNA, 140 bp, Artificial Sequence
  Synthetic
atggccgactcccaagtacgcccaaagaaaagaagcgcgtgacgctcttctcaacgcagcaattcatcctgacggtaagctttctagtggcatcactctgtggaaacaaggcttctagtaggagacccagcatggcgtat

SEQ ID NO: 383341 - DNA, 140 bp, Artificial Sequence
  Synthetic
aggccctggctgctgatatgaggatgaattgctgcgttgagaagagcgtcacgcgcttcttttctttggggctgacggtggctgatgtggccagtctgtgtgagatggagatccagaaccgaccttttgggacagcggtg

SEQ ID NO: 383342 - DNA, 140 bp, Artificial Sequence
  Synthetic
caccgctgtcccaaaaggtcggttctggatctccatctcacacagactggccacatcagccaccgtcagccccaaagaaaagaagcgcgtgacgctcttctcaacgcagcaattcatcctcatatcagcagccagggcct

SEQ ID NO: 383343 - DNA, 140 bp, Artificial Sequence
  Synthetic
aggccctggctgctgatatgatacagcctattgtgacaaggtgcgcactccgctcgaattgcaagttgggtgcttggtgggcaatgaacttacctttgaatgtgataagtgtgaggctaggaccttttgggacagcggtg

SEQ ID NO: 383344 - DNA, 140 bp, Artificial Sequence
  Synthetic
caccgctgtcccaaaaggtcctagcctcacacttatcacattcaaaggtaagttcattgcccaccaagcacccaacttgcaattcgagcggagtgcgcaccttgtcacaataggctgtatcatatcagcagccagggcct

SEQ ID NO: 383345 - DNA, 140 bp, Artificial Sequence
  Synthetic
atacgccatgctgggtctccgcaagagactttggcctccttctcctatatttggtctggggtgccattgactagggccacaccggctaaaccacctgtggtgaggccggtggggtccttgcgtacttgggagtcggccat

SEQ ID NO: 383346 - DNA, 140 bp, Artificial Sequence
  Synthetic
atggccgactcccaagtacgcaaggaccccaccggcctcaccacaggtggtttagccggtgtggccctagtcaatggcaccccagaccaaatataggagaaggaggccaaagtctcttgcggagacccagcatggcgtat

SEQ ID NO: 383347 - DNA, 140 bp, Artificial Sequence
  Synthetic
atacgccatgctgggtctccttggtggctgacaccacgaaagtgtatgtcacaaacccggacaatgttgggagaagagtggacaaggtgaccttctggcgcgcccccagggtccatgacacgtacttgggagtcggccat

SEQ ID NO: 383348 - DNA, 140 bp, Artificial Sequence
  Synthetic
atggccgactcccaagtacgtgtcatggaccctgggggcgcgccagaaggtcaccttgtccactcttctcccaacattgtccgggtttgtgacatacactttcgtggtgtcagccaccaaggagacccagcatggcgtat

SEQ ID NO: 383349 - DNA, 140 bp, Artificial Sequence
  Synthetic
atacgccatgctgggtctccaatatctcgtggactccatcgagcgtgccaggagggcggctcaagcctgccaaagcatgggttacacttatgaggaagcaataaggactgttaggccacacgtacttgggagtcggccat

SEQ ID NO: 383350 - DNA, 140 bp, Artificial Sequence
  Synthetic
atggccgactcccaagtacgtgtggcctaacagtccttattgcttcctcataagtgtaacccatgctttggcaggcttgagccgccctcctggcacgctcgatggagtccacgagatattggagacccagcatggcgtat

SEQ ID NO: 383351 - DNA, 140 bp, Artificial Sequence
  Synthetic
atacgccatgctgggtctcctgctgccatgggctggggatctaaggtgtcggtcaaggacttggccacccctgcggggaagatggccgtccacgaccgacttcaggagatacttgaggggcgtacttgggagtcggccat

SEQ ID NO: 383352 - DNA, 140 bp, Artificial Sequence
  Synthetic
atggccgactcccaagtacgcccctcaagtatctcctgaagtcggtcgtggacggccatcttccccgcaggggtggccaagtccttgaccgacaccttagatccccagcccatggcagcaggagacccagcatggcgtat

SEQ ID NO: 383353 - DNA, 140 bp, Artificial Sequence
  Synthetic
atacgccatgctgggtctccactccggtcccttttactcttactgtgaaaaaggaggtgttcttcaaagaccgtaaggaggagaaggccccccgcctcattgtgttcccccccctggactcgtacttgggagtcggccat

SEQ ID NO: 383354 - DNA, 140 bp, Artificial Sequence
  Synthetic
atggccgactcccaagtacgagtccaggggggggaacacaatgaggcggggggccttctcctccttacggtctttgaagaacacctcctttttcacagtaagagtaaaagggaccggagtggagacccagcatggcgtat

SEQ ID NO: 383355 - DNA, 140 bp, Artificial Sequence
  Synthetic
atacgccatgctgggtctcctccggatagctgagaagcttatcctgggagacccggggcgggtggccaaggcggtgttggggggggcttacgccttccagtacaccccaaatcagcgagtcgtacttgggagtcggccat

SEQ ID NO: 383356 - DNA, 140 bp, Artificial Sequence
  Synthetic
atggccgactcccaagtacgactcgctgatttggggtgtactggaaggcgtaagccccccccaacaccgccttggccacccgccccgggtctcccaggataagcttctcagctatccggaggagacccagcatggcgtat

SEQ ID NO: 383357 - DNA, 140 bp, Artificial Sequence
  Synthetic
atacgccatgctgggtctcctaaggagatgctcaaactgtgggagtcaaagaaaacaccttgcgccatctgtgtggacgccacttgcttcgacagtagcattactgaagaggacgtggcgcgtacttgggagtcggccat

SEQ ID NO: 383358 - DNA, 140 bp, Artificial Sequence
  Synthetic
atggccgactcccaagtacgcgccacgtcctcttcagtaatgctactgtcgaagcaagtggcgtccacacagatggcgcaaggtgttttctttgactcccacagtttgagcatctccttaggagacccagcatggcgtat

SEQ ID NO: 383359 - DNA, 140 bp, Artificial Sequence
  Synthetic
atacgccatgctgggtctccctggagacagagctgtacgctctggcctctgaccatccagagtgggtgcgagctttggggaagtactatgcctcaggaaccatggtcacccctgagggggcgtacttgggagtcggccat

SEQ ID NO: 383360 - DNA, 140 bp, Artificial Sequence
  Synthetic
atggccgactcccaagtacgccccctcaggggtgaccatggttcctgaggcatagtacttccccaaagctcgcacccactctggatggtcagaggccagagcgtacagctctgtctccagggagacccagcatggcgtat

SEQ ID NO: 383361 - DNA, 140 bp, Artificial Sequence
  Synthetic
atacgccatgctgggtctccttcccgtaggtgagaggtattgtagatcctcaggcgttttgactaccagcgcgagtaactgcctgacctgctacatcaaggtgaaagccgcttgtgagagcgtacttgggagtcggccat

SEQ ID NO: 383362 - DNA, 140 bp, Artificial Sequence
  Synthetic
atggccgactcccaagtacgctctcacaagcggctttcaccttgatgtagcaggtcaggcagttactcgcgctggtagtcaaaacgcctgaggatctacaatacctctcacctacgggaaggagacccagcatggcgtat

SEQ ID NO: 383363 - DNA, 140 bp, Artificial Sequence
  Synthetic
atacgccatgctgggtctccagtggggctgaaaaatgtctcgcttctcatagccggcgatgactgtttgatcatatgcgaacggccagtgtgcgacccttgtgacgccttgggcagagcccgtacttgggagtcggccat

SEQ ID NO: 383364 - DNA, 140 bp, Artificial Sequence
  Synthetic
atggccgactcccaagtacgggctctgcccaaggcgtcacaagggtcgcacactggccgttcgcatatgatcaaacagtcatcgccggctatgagaagcgagacatttttcagccccactggagacccagcatggcgtat

SEQ ID NO: 383365 - DNA, 140 bp, Artificial Sequence
  Synthetic
atacgccatgctgggtctccctggcgagctatgggtatgcttgcgagccttcgtatcatgcatcactggacacggcccccttctgctccacttggctcgctgagtgcaacgcagatgggacgtacttgggagtcggccat

SEQ ID NO: 383366 - DNA, 140 bp, Artificial Sequence
  Synthetic
atggccgactcccaagtacgtcccatctgcgttgcactcagcgagccaagtggagcagaagggggccgtgtccagtgatgcatgatacgaaggctcgcaagcatacccatagctcgccagggagacccagcatggcgtat

SEQ ID NO: 383367 - DNA, 140 bp, Artificial Sequence
  Synthetic
atacgccatgctgggtctccaacgccatttcttcctgaccacggactttcggaggccgcttgctcgcatgtcgagcgagtatagtgacccaatggcttcggccataggttacatcctcctcgtacttgggagtcggccat

SEQ ID NO: 383368 - DNA, 140 bp, Artificial Sequence
  Synthetic
atggccgactcccaagtacgaggaggatgtaacctatggccgaagccattgggtcactatactcgctcgacatgcgagcaagcggcctccgaaagtccgtggtcaggaagaaatggcgttggagacccagcatggcgtat

SEQ ID NO: 383369 - DNA, 140 bp, Artificial Sequence
  Synthetic
atacgccatgctgggtctccgtatccctggcatcccatcacacggtgggtcatcatccctcatgtgctaacgtgcgcattcaggggtggtggtacaccgtctgatccggtttggtgtcagcgtacttgggagtcggccat

SEQ ID NO: 383370 - DNA, 140 bp, Artificial Sequence
  Synthetic
atggccgactcccaagtacgctgacaccaaaccggatcagacggtgtaccaccacccctgaatgcgcacgttagcacatgagggatgatgacccaccgtgtgatgggatgccagggatacggagacccagcatggcgtat

SEQ ID NO: 383371 - DNA, 140 bp, Artificial Sequence
  Synthetic
aggccctggctgctgatatgcgtggccctccacggaccagcagcgttgagggttaccgcagacacaactaagacaaaaatggaagctgggaaggtgctgagtgacctcaagctccctggcgaccttttgggacagcggtg

SEQ ID NO: 383372 - DNA, 140 bp, Artificial Sequence
  Synthetic
caccgctgtcccaaaaggtcgccagggagcttgaggtcactcagcaccttcccagcttccatttttgtcttagttgtgtctgcggtaaccctcaacgctgctggtccgtggagggccacgcatatcagcagccagggcct

SEQ ID NO: 383373 - DNA, 140 bp, Artificial Sequence
  Synthetic
atacgccatgctgggtctccctagcggtccaccgaaagaaggccggagcactgcgaacacgcatgcttcggtcgcgcggttgggccgagttggcgaggggcctgttgtggcatccaggcccgtacttgggagtcggccat

SEQ ID NO: 383374 - DNA, 140 bp, Artificial Sequence
  Synthetic
atggccgactcccaagtacgggcctggatgccacaacaggcccctcgccaactcggcccaaccgcgcgaccgaagcatgcgtgttcgcagtgctccggccttctttcggtggaccgctagggagacccagcatggcgtat

SEQ ID NO: 383375 - DNA, 140 bp, Artificial Sequence
  Synthetic
atacgccatgctgggtctcctccggctccctccccctgagattgctggtatcccggggggtttccccctctcccccccctacatgggggtggtgcatcaattggattttacaagccagagcgtacttgggagtcggccat

SEQ ID NO: 383376 - DNA, 140 bp, Artificial Sequence
  Synthetic
atggccgactcccaagtacgctctggcttgtaaaatccaattgatgcaccacccccatgtaggggggggagagggggaaaccccccgggataccagcaatctcagggggagggagccggaggagacccagcatggcgtat

SEQ ID NO: 383377 - DNA, 140 bp, Artificial Sequence
  Synthetic
aggccctggctgctgatatgtcccccccctacatgggggtggtgcatcaattggattttacaagccagaggagtcgctggcggtggctggggttcttagccctgctcatcgtagccctctgaccttttgggacagcggtg

SEQ ID NO: 383378 - DNA, 140 bp, Artificial Sequence
  Synthetic
caccgctgtcccaaaaggtcagagggctacgatgagcagggctaagaaccccagccaccgccagcgactcctctggcttgtaaaatccaattgatgcaccacccccatgtaggggggggacatatcagcagccagggcct

SEQ ID NO: 383379 - DNA, 140 bp, Artificial Sequence
  Synthetic
aggccctggctgctgatatgggtgaactaaattcatctgttgcggcaaggtccagtgactgatcatcactggaggaggttcccgccctccccgccccaggggtctccccgctgggtaaaagaccttttgggacagcggtg

SEQ ID NO: 383380 - DNA, 140 bp, Artificial Sequence
  Synthetic
caccgctgtcccaaaaggtcttttacccagcggggagacccctggggcggggagggcgggaacctcctccagtgatgatcagtcactggaccttgccgcaacagatgaatttagttcacccatatcagcagccagggcct

SEQ ID NO: 383381 - DNA, 140 bp, Artificial Sequence
  Synthetic
aggccctggctgctgatatgacgtgggggagttgatcccccccccccggcactgggtgcaagccccagaaaccgacgcctatctaagtagacgcaatgactcggcgccgactcggcgaccgaccttttgggacagcggtg

SEQ ID NO: 383382 - DNA, 140 bp, Artificial Sequence
  Synthetic
caccgctgtcccaaaaggtcggtcgccgagtcggcgccgagtcattgcgtctacttagataggcgtcggtttctggggcttgcacccagtgccgggggggggggatcaactcccccacgtcatatcagcagccagggcct

SEQ ID NO: 383383 - DNA, 140 bp, Artificial Sequence
  Synthetic
aggccctggctgctgatatgggccaaaaggtggtggatgggtgatgacagggttggtaggtcgtaaatcccggtcaccttggtagccactataggtgggtcttaagagaaggttaagattgaccttttgggacagcggtg

SEQ ID NO: 383384 - DNA, 140 bp, Artificial Sequence
  Synthetic
caccgctgtcccaaaaggtcaatcttaaccttctcttaagacccacctatagtggctaccaaggtgaccgggatttacgacctaccaaccctgtcatcacccatccaccaccttttggcccatatcagcagccagggcct

SEQ ID NO: 383385 - DNA, 140 bp, Artificial Sequence
  Synthetic
atacgccatgctgggtctccgtctctcttgaccaataggcgtagccggcgagttgacaaggaccagtgggggccgggggcttggagagggactccaagtcccgcccttcccggtgggccgcgtacttgggagtcggccat

SEQ ID NO: 383386 - DNA, 140 bp, Artificial Sequence
  Synthetic
atggccgactcccaagtacgcggcccaccgggaagggcgggacttggagtccctctccaagcccccggcccccactggtccttgtcaactcgccggctacgcctattggtcaagagagacggagacccagcatggcgtat

SEQ ID NO: 383387 - DNA, 140 bp, Artificial Sequence
  Synthetic
aggccctggctgctgatatgggccgggggcttggagagggactccaagtcccgcccttcccggtgggccgggaaatgcatggggccacccagctccgcggcggcctgcagccggggtagcgaccttttgggacagcggtg

SEQ ID NO: 383388 - DNA, 140 bp, Artificial Sequence
  Synthetic
caccgctgtcccaaaaggtcgctaccccggctgcaggccgccgcggagctgggtggccccatgcatttcccggcccaccgggaagggcgggacttggagtccctctccaagcccccggcccatatcagcagccagggcct

SEQ ID NO: 383389 - DNA, 140 bp, Artificial Sequence
  Synthetic
aggccctggctgctgatatgcatggcagtccttctgctccttctcgtggttgaggccggggccattctggccccggccacccacgcttgtcgagcgaatgggcaatatttcctcacaaatgaccttttgggacagcggtg

SEQ ID NO: 383390 - DNA, 140 bp, Artificial Sequence
  Synthetic
caccgctgtcccaaaaggtcatttgtgaggaaatattgcccattcgctcgacaagcgtgggtggccggggccagaatggccccggcctcaaccacgagaaggagcagaaggactgccatgcatatcagcagccagggcct

SEQ ID NO: 383391 - DNA, 140 bp, Artificial Sequence
  Synthetic
aggccctggctgctgatatgtgttgtgccccggaggacatcgggttctgcctggagggtggatgcctggtggccctggggtgcacgatttgcactgaccaatgctggccactgtatcagggaccttttgggacagcggtg

SEQ ID NO: 383392 - DNA, 140 bp, Artificial Sequence
  Synthetic
caccgctgtcccaaaaggtccctgatacagtggccagcattggtcagtgcaaatcgtgcaccccagggccaccaggcatccaccctccaggcagaacccgatgtcctccggggcacaacacatatcagcagccagggcct

SEQ ID NO: 383393 - DNA, 140 bp, Artificial Sequence
  Synthetic
aggccctggctgctgatatgcgggtttggctgtgcggcctggcaagtccgcggcccaactggtgggggagctgggtagcctatacgggcccctgtcggtctcggcctatgtggctgggatgaccttttgggacagcggtg

SEQ ID NO: 383394 - DNA, 140 bp, Artificial Sequence
  Synthetic
caccgctgtcccaaaaggtcatcccagccacataggccgagaccgacaggggcccgtataggctacccagctcccccaccagttgggccgcggacttgccaggccgcacagccaaacccgcatatcagcagccagggcct

SEQ ID NO: 383395 - DNA, 140 bp, Artificial Sequence
  Synthetic
aggccctggctgctgatatgcctgggcctgggtgaggtgtactcgggtgtcctaacggtgggagtcgcgttgacgcgccgggtctacccggtgcctaacctgacgtgtgcagtcgcgtgtgaccttttgggacagcggtg

SEQ ID NO: 383396 - DNA, 140 bp, Artificial Sequence
  Synthetic
caccgctgtcccaaaaggtcacacgcgactgcacacgtcaggttaggcaccgggtagacccggcgcgtcaacgcgactcccaccgttaggacacccgagtacacctcacccaggcccaggcatatcagcagccagggcct

SEQ ID NO: 383397 - DNA, 140 bp, Artificial Sequence
  Synthetic
aggccctggctgctgatatggagctaaagtgggaaagtgagttttggagatggactgaacagctggcctccaactactggattctggaatacctctggaaggtcccatttgatttctggagaccttttgggacagcggtg

SEQ ID NO: 383398 - DNA, 140 bp, Artificial Sequence
  Synthetic
caccgctgtcccaaaaggtctccagaaatcaaatgggaccttccagaggtattccagaatccagtagttggaggccagctgttcagtccatctccaaaactcactttcccactttagctccatatcagcagccagggcct

SEQ ID NO: 383399 - DNA, 140 bp, Artificial Sequence
  Synthetic
aggccctggctgctgatatggaggcgtgataagcctgacccccttgttggtttgcgtggccgcattgctgctgcttgagcaacggattgtcatggtcttcctgttggtgacgatggccgggaccttttgggacagcggtg

SEQ ID NO: 383400 - DNA, 140 bp, Artificial Sequence
  Synthetic
caccgctgtcccaaaaggtcccggccatcgtcaccaacaggaagaccatgacaatccgttgctcaagcagcagcaatgcggccacgcaaaccaacaagggggtcaggcttatcacgcctccatatcagcagccagggcct

SEQ ID NO: 383401 - DNA, 140 bp, Artificial Sequence
  Synthetic
aggccctggctgctgatatggatgtcgcaaggcgcccctgcctccgttttggggtcacgcccctttgactacgggttgacttggcagacctgctcttgcagggccaacggttcgcgttttgaccttttgggacagcggtg

SEQ ID NO: 383402 - DNA, 140 bp, Artificial Sequence
  Synthetic
caccgctgtcccaaaaggtcaaaacgcgaaccgttggccctgcaagagcaggtctgccaagtcaacccgtagtcaaaggggcgtgaccccaaaacggaggcaggggcgccttgcgacatccatatcagcagccagggcct

SEQ ID NO: 383403 - DNA, 140 bp, Artificial Sequence
  Synthetic
aggccctggctgctgatatgtcgactggggagaaggtgtgggaccgtgggaacgttacgcttcagtgtgactgccctaacggcccctgggtgtggttgccagccttttgccaagcaatcggaccttttgggacagcggtg

SEQ ID NO: 383404 - DNA, 140 bp, Artificial Sequence
  Synthetic
caccgctgtcccaaaaggtccgattgcttggcaaaaggctggcaaccacacccaggggccgttagggcagtcacactgaagcgtaacgttcccacggtcccacaccttctccccagtcgacatatcagcagccagggcct

SEQ ID NO: 383405 - DNA, 140 bp, Artificial Sequence
  Synthetic
aggccctggctgctgatatggctggggtgaccccatcacttattggagccacgggcaaaatcagtggcccctttcatgcccccagtatgtctatgggtctgctacagtcacttgcgtgtggaccttttgggacagcggtg

SEQ ID NO: 383406 - DNA, 140 bp, Artificial Sequence
  Synthetic
caccgctgtcccaaaaggtccacacgcaagtgactgtagcagacccatagacatactgggggcatgaaaggggccactgattttgcccgtggctccaataagtgatggggtcaccccagccatatcagcagccagggcct

SEQ ID NO: 383407 - DNA, 140 bp, Artificial Sequence
  Synthetic
aggccctggctgctgatatggggttccgcttcttggtttgcctccaccagtggtcgcgactcgaagatagatgtgtggagtttagtgccagttggctctgccacctgcaccatagccgcagaccttttgggacagcggtg

SEQ ID NO: 383408 - DNA, 140 bp, Artificial Sequence
  Synthetic
caccgctgtcccaaaaggtctgcggctatggtgcaggtggcagagccaactggcactaaactccacacatctatcttcgagtcgcgaccactggtggaggcaaaccaagaagcggaaccccatatcagcagccagggcct

SEQ ID NO: 383409 - DNA, 140 bp, Artificial Sequence
  Synthetic
aggccctggctgctgatatgcttggatcatcggatcgcgacacggtgcctgggctctccgagtggggaatcccgtgcgtgacgtgtgttctggaccgtcggcctgcctcctgcggcacctgaccttttgggacagcggtg

SEQ ID NO: 383410 - DNA, 140 bp, Artificial Sequence
  Synthetic
caccgctgtcccaaaaggtcaggtgccgcaggaggcaggccgacggtccagaacacacgtcacgcacgggattccccactcggagagcccaggcaccgtgtcgcgatccgatgatccaagcatatcagcagccagggcct

SEQ ID NO: 383411 - DNA, 140 bp, Artificial Sequence
  Synthetic
aggccctggctgctgatatggtgtgagggactgctggcccgagaccgggtcggttaggttcccattccatcggtgcggcgtggggcctcggctgacaaaggacttggaagctgtgcccttgaccttttgggacagcggtg

SEQ ID NO: 383412 - DNA, 140 bp, Artificial Sequence
  Synthetic
caccgctgtcccaaaaggtcaagggcacagcttccaagtcctttgtcagccgaggccccacgccgcaccgatggaatgggaacctaaccgacccggtctcgggccagcagtccctcacaccatatcagcagccagggcct

SEQ ID NO: 383413 - DNA, 140 bp, Artificial Sequence
  Synthetic
aggccctggctgctgatatgcgtcaacaggacaactcccttcaccattagggggcccctgggcaaccagggccgaggcaacccggtgcggtcgcccttgggttttgggtcctacgccatggaccttttgggacagcggtg

SEQ ID NO: 383414 - DNA, 140 bp, Artificial Sequence
  Synthetic
caccgctgtcccaaaaggtccatggcgtaggacccaaaacccaagggcgaccgcaccgggttgcctcggccctggttgcccaggggccccctaatggtgaagggagttgtcctgttgacgcatatcagcagccagggcct

SEQ ID NO: 383415 - DNA, 140 bp, Artificial Sequence
  Synthetic
aggccctggctgctgatatgaccaggatccgagataccctacatctggtggagtgtcccacaccagccattgagcctcccaccgggacgtttgggttcttccccgggacgccgcctctcagaccttttgggacagcggtg

SEQ ID NO: 383416 - DNA, 140 bp, Artificial Sequence
  Synthetic
caccgctgtcccaaaaggtctgagaggcggcgtcccggggaagaacccaaacgtcccggtgggaggctcaatggctggtgtgggacactccaccagatgtagggtatctcggatcctggtcatatcagcagccagggcct

SEQ ID NO: 383417 - DNA, 140 bp, Artificial Sequence
  Synthetic
aggccctggctgctgatatgacaactgcatgctcttgggcacggaagtgtccgaggcacttgggggggctggcctcacgggggggttctatgaacccctggtgcgcaggtgttcgaagctgaccttttgggacagcggtg

SEQ ID NO: 383418 - DNA, 140 bp, Artificial Sequence
  Synthetic
caccgctgtcccaaaaggtcagcttcgaacacctgcgcaccaggggttcatagaacccccccgtgaggccagcccccccaagtgcctcggacacttccgtgcccaagagcatgcagttgtcatatcagcagccagggcct

SEQ ID NO: 383419 - DNA, 140 bp, Artificial Sequence
  Synthetic
aggccctggctgctgatatggatgggaagccgaaatccggtttgtccggggtttgcatggctctcttcgggcaggcctgatgggtttatacatgtccagggtcacttgcaggaggtggatgaccttttgggacagcggtg

SEQ ID NO: 383420 - DNA, 140 bp, Artificial Sequence
  Synthetic
caccgctgtcccaaaaggtcatccacctcctgcaagtgaccctggacatgtataaacccatcaggcctgcccgaagagagccatgcaaaccccggacaaaccggatttcggcttcccatccatatcagcagccagggcct

SEQ ID NO: 383421 - DNA, 140 bp, Artificial Sequence
  Synthetic
aggccctggctgctgatatggcaggcaacttcatcccgcccccgcgctggttgctcttggactttgtatttgtcctgttatacctgatgaagctggctgaggcacggttggtcccgctgagaccttttgggacagcggtg

SEQ ID NO: 383422 - DNA, 140 bp, Artificial Sequence
  Synthetic
caccgctgtcccaaaaggtctcagcgggaccaaccgtgcctcagccagcttcatcaggtataacaggacaaatacaaagtccaagagcaaccagcgcgggggcgggatgaagttgcctgccatatcagcagccagggcct

SEQ ID NO: 383423 - DNA, 140 bp, Artificial Sequence
  Synthetic
aggccctggctgctgatatgtcttgctgctgctatggtggtgggtgaaccagctggcagtcctagggctgccggctgtggaagccgccgtggcaggtgaggtcttcgcgggccctgccctgaccttttgggacagcggtg

SEQ ID NO: 383424 - DNA, 140 bp, Artificial Sequence
  Synthetic
caccgctgtcccaaaaggtcagggcagggcccgcgaagacctcacctgccacggcggcttccacagccggcagccctaggactgccagctggttcacccaccaccatagcagcagcaagacatatcagcagccagggcct

SEQ ID NO: 383425 - DNA, 140 bp, Artificial Sequence
  Synthetic
aggccctggctgctgatatggtcctggtgtctgggactcccggtcgtcagtatgatattgggtttggcaaacctggtgctgtactttagatggttgggaccccaacgcctgatgttcctcgaccttttgggacagcggtg

SEQ ID NO: 383426 - DNA, 140 bp, Artificial Sequence
  Synthetic
caccgctgtcccaaaaggtcgaggaacatcaggcgttggggtcccaaccatctaaagtacagcaccaggtttgccaaacccaatatcatactgacgaccgggagtcccagacaccaggaccatatcagcagccagggcct

SEQ ID NO: 383427 - DNA, 140 bp, Artificial Sequence
  Synthetic
aggccctggctgctgatatggtgttgtggaagcttgctcggggagctttcccgctggccctcttgatggggatttcggcgacccgcgggcgcacctcagtgctcggggccgagttctgctgaccttttgggacagcggtg

SEQ ID NO: 383428 - DNA, 140 bp, Artificial Sequence
  Synthetic
caccgctgtcccaaaaggtcagcagaactcggccccgagcactgaggtgcgcccgcgggtcgccgaaatccccatcaagagggccagcgggaaagctccccgagcaagcttccacaacaccatatcagcagccagggcct

SEQ ID NO: 383429 - DNA, 140 bp, Artificial Sequence
  Synthetic
aggccctggctgctgatatgtcgatgctacattcgaggtggacacttcggtgttgggctgggtggtggccagtgtggtagcttgggccattgcgctcctgagctcgatgagcgcaggggggaccttttgggacagcggtg

SEQ ID NO: 383430 - DNA, 140 bp, Artificial Sequence
  Synthetic
caccgctgtcccaaaaggtcccccctgcgctcatcgagctcaggagcgcaatggcccaagctaccacactggccaccacccagcccaacaccgaagtgtccacctcgaatgtagcatcgacatatcagcagccagggcct

SEQ ID NO: 383431 - DNA, 140 bp, Artificial Sequence
  Synthetic
aggccctggctgctgatatggtggaggcacaaagccgtgatctataggacgtggtgtaaggggtaccaggcaatccgtcaaagggtggtgaggagccccctcggggaggggcggcctgccgaccttttgggacagcggtg

SEQ ID NO: 383432 - DNA, 140 bp, Artificial Sequence
  Synthetic
caccgctgtcccaaaaggtcggcaggccgcccctccccgagggggctcctcaccaccctttgacggattgcctggtaccccttacaccacgtcctatagatcacggctttgtgcctccaccatatcagcagccagggcct

SEQ ID NO: 383433 - DNA, 140 bp, Artificial Sequence
  Synthetic
aggccctggctgctgatatgaaacccctgacctttgcctggtgcttggcctcgtacatctggccagatgctgtgatgatggtggtggttgccttggtccttctctttggcctgttcgacggaccttttgggacagcggtg

SEQ ID NO: 383434 - DNA, 140 bp, Artificial Sequence
  Synthetic
caccgctgtcccaaaaggtccgtcgaacaggccaaagagaaggaccaaggcaaccaccaccatcatcacagcatctggccagatgtacgaggccaagcaccaggcaaaggtcaggggtttcatatcagcagccagggcct

SEQ ID NO: 383435 - DNA, 140 bp, Artificial Sequence
  Synthetic
aggccctggctgctgatatgcgttggattgggccttggaggagatcttggtgtcccggccctcgttgcggcgtttggctcgggtggttgagtgctgtgtgatggcgggtgagaaggccacgaccttttgggacagcggtg

SEQ ID NO: 383436 - DNA, 140 bp, Artificial Sequence
  Synthetic
caccgctgtcccaaaaggtcgtggccttctcacccgccatcacacagcactcaaccacccgagccaaacgccgcaacgagggccgggacaccaagatctcctccaaggcccaatccaacgcatatcagcagccagggcct

SEQ ID NO: 383437 - DNA, 140 bp, Artificial Sequence
  Synthetic
aggccctggctgctgatatgaaccgtccggctggtctccaagatgtgtgcgagaggagcttatttgttcgatcatatgggctctttttcgcgtgctgtcaaggagcgcctgttggaatgggaccttttgggacagcggtg

SEQ ID NO: 383438 - DNA, 140 bp, Artificial Sequence
  Synthetic
caccgctgtcccaaaaggtcccattccaacaggcgctccttgacagcacgcgaaaaagagcccatatgatcgaacaaataagctcctctcgcacacatcttggagaccagccggacggttcatatcagcagccagggcct

SEQ ID NO: 383439 - DNA, 140 bp, Artificial Sequence
  Synthetic
aggccctggctgctgatatggacgcagctcttgaacctctgtcattcactaggacggactgtcgcatcatacgggatgccgcgaggactttgtcctgcgggcagtgcgtcatgggtttacgaccttttgggacagcggtg

SEQ ID NO: 383440 - DNA, 140 bp, Artificial Sequence
  Synthetic
caccgctgtcccaaaaggtcgtaaacccatgacgcactgcccgcaggacaaagtcctcgcggcatcccgtatgatgcgacagtccgtcctagtgaatgacagaggttcaagagctgcgtccatatcagcagccagggcct

SEQ ID NO: 383441 - DNA, 140 bp, Artificial Sequence
  Synthetic
aggccctggctgctgatatgccgtggttgcgcgccgtggtgatgaggttctcatcggcgtcttccaggatgtgaatcatttgcctcccgggtttgttccgaccgcgcctgttgtcatccggaccttttgggacagcggtg

SEQ ID NO: 383442 - DNA, 140 bp, Artificial Sequence
  Synthetic
caccgctgtcccaaaaggtccggatgacaacaggcgcggtcggaacaaacccgggaggcaaatgattcacatcctggaagacgccgatgagaacctcatcaccacggcgcgcaaccacggcatatcagcagccagggcct

SEQ ID NO: 383443 - DNA, 140 bp, Artificial Sequence
  Synthetic
aggccctggctgctgatatgacggtgcggaaagggcttcttgggggtcacaaaggctgccttgacaggtcgggatcctgacttacatccagggaacgtcatggtgttggggacggctacggaccttttgggacagcggtg

SEQ ID NO: 383444 - DNA, 140 bp, Artificial Sequence
  Synthetic
caccgctgtcccaaaaggtccgtagccgtccccaacaccatgacgttccctggatgtaagtcaggatcccgacctgtcaaggcagcctttgtgacccccaagaagccctttccgcaccgtcatatcagcagccagggcct

SEQ ID NO: 383445 - DNA, 140 bp, Artificial Sequence
  Synthetic
aggccctggctgctgatatgtcgcgaagcatgggaacatgcttgaacggcctgctgttcacgaccttccatggggcttcatcccgaaccatcgccacacccgtgggggcccttaatcccagaccttttgggacagcggtg

SEQ ID NO: 383446 - DNA, 140 bp, Artificial Sequence
  Synthetic
caccgctgtcccaaaaggtctgggattaagggcccccacgggtgtggcgatggttcgggatgaagccccatggaaggtcgtgaacagcaggccgttcaagcatgttcccatgcttcgcgacatatcagcagccagggcct

SEQ ID NO: 383447 - DNA, 140 bp, Artificial Sequence
  Synthetic
aggccctggctgctgatatggatggtggtcagccagtgatgatgtcacggtgtatccactcccggatggggctacttcgttaacaccttgtacttgccaggctgagtcctgttgggtcatgaccttttgggacagcggtg

SEQ ID NO: 383448 - DNA, 140 bp, Artificial Sequence
  Synthetic
caccgctgtcccaaaaggtcatgacccaacaggactcagcctggcaagtacaaggtgttaacgaagtagccccatccgggagtggatacaccgtgacatcatcactggctgaccaccatccatatcagcagccagggcct

SEQ ID NO: 383449 - DNA, 140 bp, Artificial Sequence
  Synthetic
aggccctggctgctgatatgcagatccgacggggccctatgccatggcttgagcaagggggacaaggtggagctggatgtggccatggaggtctctgacttccgtggctcgtctggctcagaccttttgggacagcggtg

SEQ ID NO: 383450 - DNA, 140 bp, Artificial Sequence
  Synthetic
caccgctgtcccaaaaggtctgagccagacgagccacggaagtcagagacctccatggccacatccagctccaccttgtcccccttgctcaagccatggcatagggccccgtcggatctgcatatcagcagccagggcct

SEQ ID NO: 383451 - DNA, 140 bp, Artificial Sequence
  Synthetic
aggccctggctgctgatatgagctggatgtggccatggaggtctctgacttccgtggctcgtctggctcaccggtcctatgtgacgaagggcacgcagtaggaatgctcgtgtctgtgctgaccttttgggacagcggtg

SEQ ID NO: 383452 - DNA, 140 bp, Artificial Sequence
  Synthetic
caccgctgtcccaaaaggtcagcacagacacgagcattcctactgcgtgcccttcgtcacataggaccggtgagccagacgagccacggaagtcagagacctccatggccacatccagctcatatcagcagccagggcct

SEQ ID NO: 383453 - DNA, 140 bp, Artificial Sequence
  Synthetic
aggccctggctgctgatatgtcactccggtggtagggtcaccgcggcacggttcactaggccgtggacccaagtgccaacagatgccaaaaccactactgaaccccctccggtgccggccgaccttttgggacagcggtg

SEQ ID NO: 383454 - DNA, 140 bp, Artificial Sequence
  Synthetic
caccgctgtcccaaaaggtcggccggcaccggagggggttcagtagtggttttggcatctgttggcacttgggtccacggcctagtgaaccgtgccgcggtgaccctaccaccggagtgacatatcagcagccagggcct

SEQ ID NO: 383455 - DNA, 140 bp, Artificial Sequence
  Synthetic
aggccctggctgctgatatgaaaggagttttcaaagaggccccgttgtttatgcctacgggagcgggaaagagcactcgcgtcccgttggagtacgataacatggggcacaaggtcttaagaccttttgggacagcggtg

SEQ ID NO: 383456 - DNA, 140 bp, Artificial Sequence
  Synthetic
caccgctgtcccaaaaggtcttaagaccttgtgccccatgttatcgtactccaacgggacgcgagtgctctttcccgctcccgtaggcataaacaacggggcctctttgaaaactcctttcatatcagcagccagggcct

SEQ ID NO: 383457 - DNA, 140 bp, Artificial Sequence
  Synthetic
aggccctggctgctgatatgtcttgaacccctcagtggccactgtgcgggccatgggcccgtacatggagcggctggcgggtaaacatccaagtatatactgtgggcatgatacaactgcgaccttttgggacagcggtg

SEQ ID NO: 383458 - DNA, 140 bp, Artificial Sequence
  Synthetic
caccgctgtcccaaaaggtcgcagttgtatcatgcccacagtatatacttggatgtttacccgccagccgctccatgtacgggcccatggcccgcacagtggccactgaggggttcaagacatatcagcagccagggcct

SEQ ID NO: 383459 - DNA, 140 bp, Artificial Sequence
  Synthetic
aggccctggctgctgatatgtttcacaaggatcactgactcccccctgacgtattcaacctatgggaggtttttggccaaccctaggcagatgctacggggcgtttcggtggtcatttgtgaccttttgggacagcggtg

SEQ ID NO: 383460 - DNA, 140 bp, Artificial Sequence
  Synthetic
caccgctgtcccaaaaggtcacaaatgaccaccgaaacgccccgtagcatctgcctagggttggccaaaaacctcccataggttgaatacgtcaggggggagtcagtgatccttgtgaaacatatcagcagccagggcct

SEQ ID NO: 383461 - DNA, 140 bp, Artificial Sequence
  Synthetic
aggccctggctgctgatatggatgagtgccacagtcatgactcaaccgtgctgttaggcattgggagagtccgggagctggcgcgtgggtgcggggtgcaactagtgctctacgccaccggaccttttgggacagcggtg

SEQ ID NO: 383462 - DNA, 140 bp, Artificial Sequence
  Synthetic
caccgctgtcccaaaaggtccggtggcgtagagcactagttgcaccccgcacccacgcgccagctcccggactctcccaatgcctaacagcacggttgagtcatgactgtggcactcatccatatcagcagccagggcct

SEQ ID NO: 383463 - DNA, 140 bp, Artificial Sequence
  Synthetic
aggccctggctgctgatatgctacacctcccggatcccctatgacgcagcacccttccataattgagacaaaattggacgtgggcgagattcccttttatgggcatggaatacccctcgagaccttttgggacagcggtg

SEQ ID NO: 383464 - DNA, 140 bp, Artificial Sequence
  Synthetic
caccgctgtcccaaaaggtctcgaggggtattccatgcccataaaagggaatctcgcccacgtccaattttgtctcaattatggaagggtgctgcgtcataggggatccgggaggtgtagcatatcagcagccagggcct

SEQ ID NO: 383465 - DNA, 140 bp, Artificial Sequence
  Synthetic
aggccctggctgctgatatggcggatgcgaaccggaaggcacctcgtgttctgccattctaaggctgagtgcgagcgccttgctggccagttctccgctaggggggtcaatgccattgccgaccttttgggacagcggtg

SEQ ID NO: 383466 - DNA, 140 bp, Artificial Sequence
  Synthetic
caccgctgtcccaaaaggtcggcaatggcattgacccccctagcggagaactggccagcaaggcgctcgcactcagccttagaatggcagaacacgaggtgccttccggttcgcatccgccatatcagcagccagggcct

SEQ ID NO: 383467 - DNA, 140 bp, Artificial Sequence
  Synthetic
aggccctggctgctgatatgtattataggggtaaagacagttctatcatcaaggatggggacctggtggtctgtgctacagacgcgctttccactgggtacactggaaatttcgactccggaccttttgggacagcggtg

SEQ ID NO: 383468 - DNA, 140 bp, Artificial Sequence
  Synthetic
caccgctgtcccaaaaggtccggagtcgaaatttccagtgtacccagtggaaagcgcgtctgtagcacagaccaccaggtccccatccttgatgatagaactgtctttacccctataatacatatcagcagccagggcct

SEQ ID NO: 383469 - DNA, 140 bp, Artificial Sequence
  Synthetic
aggccctggctgctgatatgtcaccgactgtggattagtggtggaggaggtcgttgaggtgacccttgatcccaccattaccatctccctgcggacagtgcctgcgtcggctgaactgtcgaccttttgggacagcggtg

SEQ ID NO: 383470 - DNA, 140 bp, Artificial Sequence
  Synthetic
caccgctgtcccaaaaggtcgacagttcagccgacgcaggcactgtccgcagggagatggtaatggtgggatcaagggtcacctcaacgacctcctccaccactaatccacagtcggtgacatatcagcagccagggcct

SEQ ID NO: 383471 - DNA, 140 bp, Artificial Sequence
  Synthetic
aggccctggctgctgatatggatgcaaagacgaggacgcacgggtaggggcaggtctggacgctactactacgcgggggtgggcaaagcccctgcgggtgtggtgcgctcaggtcctgtcgaccttttgggacagcggtg

SEQ ID NO: 383472 - DNA, 140 bp, Artificial Sequence
  Synthetic
caccgctgtcccaaaaggtcgacaggacctgagcgcaccacacccgcaggggctttgcccacccccgcgtagtagtagcgtccagacctgcccctacccgtgcgtcctcgtctttgcatccatatcagcagccagggcct

SEQ ID NO: 383473 - DNA, 140 bp, Artificial Sequence
  Synthetic
aggccctggctgctgatatgtggtcggcggtggaagctggagtgacctggtacggaatggaacctgacttgacagctaacctactgagactttacgacgactgcccttacaccgcagccggaccttttgggacagcggtg

SEQ ID NO: 383474 - DNA, 140 bp, Artificial Sequence
  Synthetic
caccgctgtcccaaaaggtccggctgcggtgtaagggcagtcgtcgtaaagtctcagtaggttagctgtcaagtcaggttccattccgtaccaggtcactccagcttccaccgccgaccacatatcagcagccagggcct

SEQ ID NO: 383475 - DNA, 140 bp, Artificial Sequence
  Synthetic
aggccctggctgctgatatgtcgcggctgatatcggagaagccgcggtgttcttctctgggctcgccccattgaggatgcaccctgatgtcagctgggcaaaagttcgcggcgtcaactggaccttttgggacagcggtg

SEQ ID NO: 383476 - DNA, 140 bp, Artificial Sequence
  Synthetic
caccgctgtcccaaaaggtccagttgacgccgcgaacttttgcccagctgacatcagggtgcatcctcaatggggcgagcccagagaagaacaccgcggcttctccgatatcagccgcgacatatcagcagccagggcct

SEQ ID NO: 383477 - DNA, 140 bp, Artificial Sequence
  Synthetic
aggccctggctgctgatatggcccctcttggtgggtgttcagcggaccatgtgtcgggaaacactgtctcccggcccatcggatgacccccaatgggcaggtctgaagggcccaaatcctgaccttttgggacagcggtg

SEQ ID NO: 383478 - DNA, 140 bp, Artificial Sequence
  Synthetic
caccgctgtcccaaaaggtcaggatttgggcccttcagacctgcccattgggggtcatccgatgggccgggagacagtgtttcccgacacatggtccgctgaacacccaccaagaggggccatatcagcagccagggcct

SEQ ID NO: 383479 - DNA, 140 bp, Artificial Sequence
  Synthetic
aggccctggctgctgatatggtcccactcctgctgaggtggggcaatgatttaccatctaaagtggccggccaccacatagtggacgacctggtccggagactcggtgtggcggagggttgaccttttgggacagcggtg

SEQ ID NO: 383480 - DNA, 140 bp, Artificial Sequence
  Synthetic
caccgctgtcccaaaaggtcaaccctccgccacaccgagtctccggaccaggtcgtccactatgtggtggccggccactttagatggtaaatcattgccccacctcagcaggagtgggaccatatcagcagccagggcct

SEQ ID NO: 383481 - DNA, 140 bp, Artificial Sequence
  Synthetic
aggccctggctgctgatatgacgtccgctgcgacgctgggccgatcttgatgatcggtctagctatcgcggggggaatgatctacgcgtcatacaccgggtcgctagtggtggtgacagagaccttttgggacagcggtg

SEQ ID NO: 383482 - DNA, 140 bp, Artificial Sequence
  Synthetic
caccgctgtcccaaaaggtctctgtcaccaccactagcgacccggtgtatgacgcgtagatcattccccccgcgatagctagaccgatcatcaagatcggcccagcgtcgcagcggacgtcatatcagcagccagggcct

SEQ ID NO: 383483 - DNA, 140 bp, Artificial Sequence
  Synthetic
aggccctggctgctgatatgctgggatgtgaaggggggtggcgcccccctttatcggcatggagaccaggccacgcctcagccggtggtgcaggttcctccggtagaccatcggccgggggaccttttgggacagcggtg

SEQ ID NO: 383484 - DNA, 140 bp, Artificial Sequence
  Synthetic
caccgctgtcccaaaaggtcccccggccgatggtctaccggaggaacctgcaccaccggctgaggcgtggcctggtctccatgccgataaaggggggcgccaccccccttcacatcccagcatatcagcagccagggcct

SEQ ID NO: 383485 - DNA, 140 bp, Artificial Sequence
  Synthetic
aggccctggctgctgatatgggtgaatcagcaccatcggatgccaagacagtgacagatgcggtggcagccatccaggtggactgcgattggactatcatgactctgtcgatcggagaaggaccttttgggacagcggtg

SEQ ID NO: 383486 - DNA, 140 bp, Artificial Sequence
  Synthetic
caccgctgtcccaaaaggtccttctccgatcgacagagtcatgatagtccaatcgcagtccacctggatggctgccaccgcatctgtcactgtcttggcatccgatggtgctgattcacccatatcagcagccagggcct

SEQ ID NO: 383487 - DNA, 140 bp, Artificial Sequence
  Synthetic
aggccctggctgctgatatgtgttgtccttggctcaggctaagacggccgaggcctacacagcaaccgccaagtggctcgctggctgctatacggggacgcgggccgttcccactgtatcgaccttttgggacagcggtg

SEQ ID NO: 383488 - DNA, 140 bp, Artificial Sequence
  Synthetic
caccgctgtcccaaaaggtcgatacagtgggaacggcccgcgtccccgtatagcagccagcgagccacttggcggttgctgtgtaggcctcggccgtcttagcctgagccaaggacaacacatatcagcagccagggcct

SEQ ID NO: 383489 - DNA, 140 bp, Artificial Sequence
  Synthetic
aggccctggctgctgatatgcattgttgacaagctcttcgccggagggtgggcggctgtggtgggccattgccacagcgtgattgctgcggcggtggcggcctacggggcttcaaggagcgaccttttgggacagcggtg

SEQ ID NO: 383490 - DNA, 140 bp, Artificial Sequence
  Synthetic
caccgctgtcccaaaaggtcgctccttgaagccccgtaggccgccaccgccgcagcaatcacgctgtggcaatggcccaccacagccgcccaccctccggcgaagagcttgtcaacaatgcatatcagcagccagggcct

SEQ ID NO: 383491 - DNA, 140 bp, Artificial Sequence
  Synthetic
aggccctggctgctgatatgccgccgttggcagccgcggcttcctacctgatggggttgggcgttggaggcaacgctcagacgcgcctggcgtctgccctcctattgggggctgctggaagaccttttgggacagcggtg

SEQ ID NO: 383492 - DNA, 140 bp, Artificial Sequence
  Synthetic
caccgctgtcccaaaaggtcttccagcagcccccaataggagggcagacgccaggcgcgtctgagcgttgcctccaacgcccaaccccatcaggtaggaagccgcggctgccaacggcggcatatcagcagccagggcct

SEQ ID NO: 383493 - DNA, 140 bp, Artificial Sequence
  Synthetic
aggccctggctgctgatatgccgccttgggcactcctgtcgtgggcttgaccatggcaggtgcgttcatggggggggccagtgtctccccctccttggtcaccattttattgggggccgtgaccttttgggacagcggtg

SEQ ID NO: 383494 - DNA, 140 bp, Artificial Sequence
  Synthetic
caccgctgtcccaaaaggtcacggcccccaataaaatggtgaccaaggagggggagacactggccccccccatgaacgcacctgccatggtcaagcccacgacaggagtgcccaaggcggcatatcagcagccagggcct

SEQ ID NO: 383495 - DNA, 140 bp, Artificial Sequence
  Synthetic
aggccctggctgctgatatgcggaggttgggagggtgttgtcaacgcggcgagcctagtctttgacttcatggcggggaaactttcatcagaagatctgtggtatgccatcccggtactggaccttttgggacagcggtg

SEQ ID NO: 383496 - DNA, 140 bp, Artificial Sequence
  Synthetic
caccgctgtcccaaaaggtccagtaccgggatggcataccacagatcttctgatgaaagtttccccgccatgaagtcaaagactaggctcgccgcgttgacaacaccctcccaacctccgcatatcagcagccagggcct

SEQ ID NO: 383497 - DNA, 140 bp, Artificial Sequence
  Synthetic
aggccctggctgctgatatgaccagcccgggggcgggccttgcggggatcgctctcgggttggttttgtattcagctaacaactctggcactaccacttggttgaaccgtctgctgactagaccttttgggacagcggtg

SEQ ID NO: 383498 - DNA, 140 bp, Artificial Sequence
  Synthetic
caccgctgtcccaaaaggtctagtcagcagacggttcaaccaagtggtagtgccagagttgttagctgaatacaaaaccaacccgagagcgatccccgcaaggcccgcccccgggctggtcatatcagcagccagggcct

SEQ ID NO: 383499 - DNA, 140 bp, Artificial Sequence
  Synthetic
aggccctggctgctgatatgcgttaccaaggtcttcatgtatcccggacagttactttcagcaagttgactattgcgacaaggtctcagccgtgctccggcgcctgagcctcacccgcacgaccttttgggacagcggtg

SEQ ID NO: 383500 - DNA, 140 bp, Artificial Sequence
  Synthetic
caccgctgtcccaaaaggtcgtgcgggtgaggctcaggcgccggagcacggctgagaccttgtcgcaatagtcaacttgctgaaagtaactgtccgggatacatgaagaccttggtaacgcatatcagcagccagggcct

SEQ ID NO: 383501 - DNA, 140 bp, Artificial Sequence
  Synthetic
aggccctggctgctgatatgagtggttgccctggtcaacagggagcctaaggtggatgaggtacaggtggggtatgtctgggacctgtgggagtggatcatgcgccaagtgcgcgtggtcgaccttttgggacagcggtg

SEQ ID NO: 383502 - DNA, 140 bp, Artificial Sequence
  Synthetic
caccgctgtcccaaaaggtcgaccacgcgcacttggcgcatgatccactcccacaggtcccagacataccccacctgtacctcatccaccttaggctccctgttgaccagggcaaccactcatatcagcagccagggcct

SEQ ID NO: 383503 - DNA, 140 bp, Artificial Sequence
  Synthetic
aggccctggctgctgatatgatggccagactcagggccctctgccccgtggtgtcactacccttgtggcattgcggggaggggtggtccggggaatggttgcttgacggtcatgttgagagaccttttgggacagcggtg

SEQ ID NO: 383504 - DNA, 140 bp, Artificial Sequence
  Synthetic
caccgctgtcccaaaaggtctctcaacatgaccgtcaagcaaccattccccggaccacccctccccgcaatgccacaagggtagtgacaccacggggcagagggccctgagtctggccatcatatcagcagccagggcct

SEQ ID NO: 383505 - DNA, 140 bp, Artificial Sequence
  Synthetic
aggccctggctgctgatatggtcgctgcctctgtggctgcgtgatcactggtgacgttctgaatgggcaactcaaagaaccagtttactctaccaagctgtgccggcactattggatggggaccttttgggacagcggtg

SEQ ID NO: 383506 - DNA, 140 bp, Artificial Sequence
  Synthetic
caccgctgtcccaaaaggtccccatccaatagtgccggcacagcttggtagagtaaactggttctttgagttgcccattcagaacgtcaccagtgatcacgcagccacagaggcagcgaccatatcagcagccagggcct

SEQ ID NO: 383507 - DNA, 140 bp, Artificial Sequence
  Synthetic
aggccctggctgctgatatggactgtccctgtgaacatgctgggttacggtgaaacgtcgcctctcctggcctccgacaccccgaaggttgtgcccttcgggacgtctggctgggctgaggaccttttgggacagcggtg

SEQ ID NO: 383508 - DNA, 140 bp, Artificial Sequence
  Synthetic
caccgctgtcccaaaaggtcctcagcccagccagacgtcccgaagggcacaaccttcggggtgtcggaggccaggagaggcgacgtttcaccgtaacccagcatgttcacagggacagtccatatcagcagccagggcct

SEQ ID NO: 383509 - DNA, 140 bp, Artificial Sequence
  Synthetic
aggccctggctgctgatatggtggtggtgaccactacccacgtggtaatcaggaggacctccgcctataagctgctgcgccagcaaatcctatcggctgctgtagctgagccctactacggaccttttgggacagcggtg

SEQ ID NO: 383510 - DNA, 140 bp, Artificial Sequence
  Synthetic
caccgctgtcccaaaaggtccgtagtagggctcagctacagcagccgataggatttgctggcgcagcagcttataggcggaggtcctcctgattaccacgtgggtagtggtcaccaccaccatatcagcagccagggcct

SEQ ID NO: 383511 - DNA, 140 bp, Artificial Sequence
  Synthetic
aggccctggctgctgatatgtcgacggcattccggtctcatgggacgcggacgctcgtgcgcccgccatggtctatggccctgggcaaagtgttaccattgacggggagcgctacaccttgaccttttgggacagcggtg

SEQ ID NO: 383512 - DNA, 140 bp, Artificial Sequence
  Synthetic
caccgctgtcccaaaaggtcaaggtgtagcgctccccgtcaatggtaacactttgcccagggccatagaccatggcgggcgcacgagcgtccgcgtcccatgagaccggaatgccgtcgacatatcagcagccagggcct

SEQ ID NO: 383513 - DNA, 140 bp, Artificial Sequence
  Synthetic
aggccctggctgctgatatggcctcatcaactgaggctcaggaatgtggcaccctctgaggtttcatccgaggtgtccattgacattgggacggagactgaagactcagaactgactgaggaccttttgggacagcggtg

SEQ ID NO: 383514 - DNA, 140 bp, Artificial Sequence
  Synthetic
caccgctgtcccaaaaggtcctcagtcagttctgagtcttcagtctccgtcccaatgtcaatggacacctcggatgaaacctcagagggtgccacattcctgagcctcagttgatgaggccatatcagcagccagggcct

SEQ ID NO: 383515 - DNA, 140 bp, Artificial Sequence
  Synthetic
atacgccatgctgggtctccaggtgtccattgacattgggacggagactgaagactcagaactgactgaggccgatctgccgccggcggctgctgctctccaagcgatcgagaatgctgccgtacttgggagtcggccat

SEQ ID NO: 383516 - DNA, 140 bp, Artificial Sequence
  Synthetic
atggccgactcccaagtacggcagcattctcgatcgcttggagagcagcagccgccggcggcagatcggcctcagtcagttctgagtcttcagtctccgtcccaatgtcaatggacacctggagacccagcatggcgtat

SEQ ID NO: 383517 - DNA, 140 bp, Artificial Sequence
  Synthetic
atacgccatgctgggtctcccctctctttgtggtagtagccgagagatgcctgtatggggagaagacatcccccgtactccatcgccagcacttatctcggttactgagagcagctcagacgtacttgggagtcggccat

SEQ ID NO: 383518 - DNA, 140 bp, Artificial Sequence
  Synthetic
atggccgactcccaagtacgtctgagctgctctcagtaaccgagataagtgctggcgatggagtacgggggatgtcttctccccatacaggcatctctcggctactaccacaaagagaggggagacccagcatggcgtat

SEQ ID NO: 383519 - DNA, 140 bp, Artificial Sequence
  Synthetic
atacgccatgctgggtctccactcattcgaggtcatccaagagtccgagacagccgaaggggaggaaagtgtcttcaacgtggctctttccgtattaaaagccttatttccacagagcgacgtacttgggagtcggccat

SEQ ID NO: 383520 - DNA, 140 bp, Artificial Sequence
  Synthetic
atggccgactcccaagtacgtcgctctgtggaaataaggcttttaatacggaaagagccacgttgaagacactttcctccccttcggctgtctcggactcttggatgacctcgaatgagtggagacccagcatggcgtat

SEQ ID NO: 383521 - DNA, 140 bp, Artificial Sequence
  Synthetic
aggccctggctgctgatatgcgcgaccaggaagcttaccgtcaagatgtcgtgctgcgttgaaaagagcgtcacgcgctttttctcattggggttgacggtggctgatgttgctagcctggaccttttgggacagcggtg

SEQ ID NO: 383522 - DNA, 140 bp, Artificial Sequence
  Synthetic
caccgctgtcccaaaaggtccaggctagcaacatcagccaccgtcaaccccaatgagaaaaagcgcgtgacgctcttttcaacgcagcacgacatcttgacggtaagcttcctggtcgcgcatatcagcagccagggcct

SEQ ID NO: 383523 - DNA, 140 bp, Artificial Sequence
  Synthetic
atacgccatgctgggtctcctccgcttgaattgcaggttgggtgcttggtgggcaatgaacttacctttgaatgtgacaagtgtgaggctaggcaagaaaccttggcctccttctcttaccgtacttgggagtcggccat

SEQ ID NO: 383524 - DNA, 140 bp, Artificial Sequence
  Synthetic
atggccgactcccaagtacggtaagagaaggaggccaaggtttcttgcctagcctcacacttgtcacattcaaaggtaagttcattgcccaccaagcacccaacctgcaattcaagcggaggagacccagcatggcgtat

SEQ ID NO: 383525 - DNA, 140 bp, Artificial Sequence
  Synthetic
aggccctggctgctgatatgatttggtctggagtgccgctgactagggccacgccggccaagcctcccgtggtgaggccggttggctctttgttagtggccgacactactaaggtgtatggaccttttgggacagcggtg

SEQ ID NO: 383526 - DNA, 140 bp, Artificial Sequence
  Synthetic
caccgctgtcccaaaaggtccatacaccttagtagtgtcggccactaacaaagagccaaccggcctcaccacgggaggcttggccggcgtggccctagtcagcggcactccagaccaaatcatatcagcagccagggcct

SEQ ID NO: 383527 - DNA, 140 bp, Artificial Sequence
  Synthetic
aggccctggctgctgatatgttaccaatccagacaatgtgggacggagggtggacaaggtgaccttctggcgtgctcctagggttcatgataagtacctcgtggactctattgagcgcgcgaccttttgggacagcggtg

SEQ ID NO: 383528 - DNA, 140 bp, Artificial Sequence
  Synthetic
caccgctgtcccaaaaggtcgcgcgctcaatagagtccacgaggtacttatcatgaaccctaggagcacgccagaaggtcaccttgtccaccctccgtcccacattgtctggattggtaacatatcagcagccagggcct

SEQ ID NO: 383529 - DNA, 140 bp, Artificial Sequence
  Synthetic
aggccctggctgctgatatgtaagagggccgctcaagcctgcctaagcatgggttacacttatgaggaagcaataaggactgtaaggccacatgctgccatgggctggggatctaaggtggaccttttgggacagcggtg

SEQ ID NO: 383530 - DNA, 140 bp, Artificial Sequence
  Synthetic
caccgctgtcccaaaaggtccaccttagatccccagcccatggcagcatgtggccttacagtccttattgcttcctcataagtgtaacccatgcttaggcaggcttgagcggccctcttacatatcagcagccagggcct

SEQ ID NO: 383531 - DNA, 140 bp, Artificial Sequence
  Synthetic
aggccctggctgctgatatgtcggttaaggacttagccacccccgcggggaagatggccgtccatgaccggcttcaggagatacttgaagggactccggtcccctttactcttactgtgagaccttttgggacagcggtg

SEQ ID NO: 383532 - DNA, 140 bp, Artificial Sequence
  Synthetic
caccgctgtcccaaaaggtctcacagtaagagtaaaggggaccggagtcccttcaagtatctcctgaagccggtcatggacggccatcttccccgcgggggtggctaagtccttaaccgacatatcagcagccagggcct

SEQ ID NO: 383533 - DNA, 140 bp, Artificial Sequence
  Synthetic
aggccctggctgctgatatgaaaaggaggtgttcttcaaagaccggaaggaggagaaggccccccgcctcattgtgttcccccccctggacttccggatagctgaaaagctcatcttggggaccttttgggacagcggtg

SEQ ID NO: 383534 - DNA, 140 bp, Artificial Sequence
  Synthetic
caccgctgtcccaaaaggtccccaagatgagcttttcagctatccggaagtccaggggggggaacacaatgaggcggggggccttctcctccttccggtctttgaagaacacctccttttcatatcagcagccagggcct

SEQ ID NO: 383535 - DNA, 140 bp, Artificial Sequence
  Synthetic
aggccctggctgctgatatgagacccaggccgggtagccaaggcggtgttggggggggcctacgccttccagtacaccccaaatcagcgagttaaggagatgctcaagctatgggagtctgaccttttgggacagcggtg

SEQ ID NO: 383536 - DNA, 140 bp, Artificial Sequence
  Synthetic
caccgctgtcccaaaaggtcagactcccatagcttgagcatctccttaactcgctgatttggggtgtactggaaggcgtaggccccccccaacaccgccttggctacccggcctgggtctcatatcagcagccagggcct

SEQ ID NO: 383537 - DNA, 140 bp, Artificial Sequence
  Synthetic
aggccctggctgctgatatgaagaagaccccttgcgccatctgtgtggacgccacctgcttcgacagtagcataactgaagaggacgtggctttggagacagagctatacgctctggcctgaccttttgggacagcggtg

SEQ ID NO: 383538 - DNA, 140 bp, Artificial Sequence
  Synthetic
caccgctgtcccaaaaggtcaggccagagcgtatagctctgtctccaaagccacgtcctcttcagttatgctactgtcgaagcaggtggcgtccacacagatggcgcaaggggtcttcttcatatcagcagccagggcct

SEQ ID NO: 383539 - DNA, 140 bp, Artificial Sequence
  Synthetic
atacgccatgctgggtctcccataactgaagaggacgtggctttggagacagagctatacgctctggcctctgaccatccagaatgggtgcgggcacttgggaaatactatgcctcaggccgtacttgggagtcggccat

SEQ ID NO: 383540 - DNA, 140 bp, Artificial Sequence
  Synthetic
atggccgactcccaagtacggcctgaggcatagtatttcccaagtgcccgcacccattctggatggtcagaggccagagcgtatagctctgtctccaaagccacgtcctcttcagttatgggagacccagcatggcgtat

SEQ ID NO: 383541 - DNA, 140 bp, Artificial Sequence
  Synthetic
aggccctggctgctgatatgaccatggtcaccccggaaggggtgcccgtcggtgagaggtattgcagatcctcgggtgtcctaacaactagcgcgagcaactgcttgacctgctacatcagaccttttgggacagcggtg

SEQ ID NO: 383542 - DNA, 140 bp, Artificial Sequence
  Synthetic
caccgctgtcccaaaaggtctgatgtagcaggtcaagcagttgctcgcgctagttgttaggacacccgaggatctgcaatacctctcaccgacgggcaccccttccggggtgaccatggtcatatcagcagccagggcct

SEQ ID NO: 383543 - DNA, 140 bp, Artificial Sequence
  Synthetic
aggccctggctgctgatatgaggtgaaagctgcctgtgagagagtggggctgaaaaatgtctctcttctcatagccggcgatgactgcttgatcatatgtgagcggccagtgtgcgacccgaccttttgggacagcggtg

SEQ ID NO: 383544 - DNA, 140 bp, Artificial Sequence
  Synthetic
caccgctgtcccaaaaggtcgggtcgcacactggccgctcacatatgatcaagcagtcatcgccggctatgagaagagagacatttttcagccccactctctcacaggcagctttcacctcatatcagcagccagggcct

SEQ ID NO: 383545 - DNA, 140 bp, Artificial Sequence
  Synthetic
aggccctggctgctgatatgaagcgacgctttgggcagagccctagcgagctatgggtacgcgtgcgagccctcatatcatgcatcattggacacggcccccttctgctccacttggcttgaccttttgggacagcggtg

SEQ ID NO: 383546 - DNA, 140 bp, Artificial Sequence
  Synthetic
caccgctgtcccaaaaggtcaagccaagtggagcagaagggggccgtgtccaatgatgcatgatatgagggctcgcacgcgtacccatagctcgctagggctctgcccaaagcgtcgcttcatatcagcagccagggcct

SEQ ID NO: 383547 - DNA, 140 bp, Artificial Sequence
  Synthetic
aggccctggctgctgatatggctgagtgcaatgcagatgggaagcgccatttcttcctgaccacggacttccggaggccgctcgctcgcatgtcgagtgagtatagtgacccgatggcttgaccttttgggacagcggtg

SEQ ID NO: 383548 - DNA, 140 bp, Artificial Sequence
  Synthetic
caccgctgtcccaaaaggtcaagccatcgggtcactatactcactcgacatgcgagcgagcggcctccggaagtccgtggtcaggaagaaatggcgcttcccatctgcattgcactcagccatatcagcagccagggcct

SEQ ID NO: 383549 - DNA, 140 bp, Artificial Sequence
  Synthetic
aggccctggctgctgatatgcggcgatcggttacatcctcctttatccttggcaccccatcacacggtgggtcatcatccctcatgtgctaacgtgcgcattcaggggtggaggcacaccgaccttttgggacagcggtg

SEQ ID NO: 383550 - DNA, 140 bp, Artificial Sequence
  Synthetic
caccgctgtcccaaaaggtcggtgtgcctccacccctgaatgcgcacgttagcacatgagggatgatgacccaccgtgtgatggggtgccaaggataaaggaggatgtaaccgatcgccgcatatcagcagccagggcct

SEQ ID NO: 383551 - DNA, 140 bp, Artificial Sequence
  Synthetic
atacgccatgctgggtctccgtcatcatccctcatgtgctaacgtgcgcattcaggggtggaggcacaccgtctgatccggtttggtgccaggtgcatggtaactactacaagtttccaccgtacttgggagtcggccat

SEQ ID NO: 383552 - DNA, 140 bp, Artificial Sequence
  Synthetic
atggccgactcccaagtacggtggaaacttgtagtagttaccatgcacctggcaccaaaccggatcagacggtgtgcctccacccctgaatgcgcacgttagcacatgagggatgatgacggagacccagcatggcgtat

SEQ ID NO: 383553 - DNA, 140 bp, Artificial Sequence
  Synthetic
atacgccatgctgggtctcctggacaaactgcctaacatcatcgtggccctccacggaccagcagcgttgagggttaccgcagacacaactaaaacaaagatggaggctggtaaggttctcgtacttgggagtcggccat

SEQ ID NO: 383554 - DNA, 140 bp, Artificial Sequence
  Synthetic
atggccgactcccaagtacgagaaccttaccagcctccatctttgttttagttgtgtctgcggtaaccctcaacgctgctggtccgtggagggccacgatgatgttaggcagtttgtccaggagacccagcatggcgtat

SEQ ID NO: 383555 - DNA, 140 bp, Artificial Sequence
  Synthetic
aggccctggctgctgatatggagcgacctcaagctccctggcttagcagtccaccgaaagaaggccggggcgttgcgaacacgcatgctccgctcgcgcggttgggctgagttggctagggaccttttgggacagcggtg

SEQ ID NO: 383556 - DNA, 140 bp, Artificial Sequence
  Synthetic
caccgctgtcccaaaaggtccctagccaactcagcccaaccgcgcgagcggagcatgcgtgttcgcaacgccccggccttctttcggtggactgctaagccagggagcttgaggtcgctccatatcagcagccagggcct

SEQ ID NO: 383557 - DNA, 140 bp, Artificial Sequence
  Synthetic
aggccctggctgctgatatgggcttgttgtggcatccaggcctacggcttcctccccctgagattgctggtatcccggggggtttccctctctcccccccctatatgggggtggtacatcgaccttttgggacagcggtg

SEQ ID NO: 383558 - DNA, 140 bp, Artificial Sequence
  Synthetic
caccgctgtcccaaaaggtcgatgtaccacccccatataggggggggagagagggaaaccccccgggataccagcaatctcagggggaggaagccgtaggcctggatgccacaacaagcccatatcagcagccagggcct

SEQ ID NO: 383559 - DNA, 140 bp, Artificial Sequence
  Synthetic
aggccctggctgctgatatggccctgctcatcgtagccctcttcgggtgaactaaattcatctgttgcggcaaggtctggtgactgatcatcaccggaggaggttcccgccctccccgccgaccttttgggacagcggtg

SEQ ID NO: 383560 - DNA, 140 bp, Artificial Sequence
  Synthetic
caccgctgtcccaaaaggtcggcggggagggcgggaacctcctccggtgatgatcagtcaccagaccttgccgcaacagatgaatttagttcacccgaagagggctacgatgagcagggccatatcagcagccagggcct

SEQ ID NO: 383561 - DNA, 140 bp, Artificial Sequence
  Synthetic
  misc_feature (113)..(113): n is a, c, g, or t
aggccctggctgctgatatgtacgggctgctcgcagagccctccccggatggggcacagtgcactgtgatctgaaggggtgcaccccgggaagagctcggcccgaaggccggnttctactgaccttttgggacagcggtg

SEQ ID NO: 383562 - DNA, 140 bp, Artificial Sequence
  Synthetic
  misc_feature (28)..(28): n is a, c, g, or t
caccgctgtcccaaaaggtcagtagaanccggccttcgggccgagctcttcccggggtgcaccccttcagatcacagtgcactgtgccccatccggggagggctctgcgagcagcccgtacatatcagcagccagggcct

SEQ ID NO: 383563 - DNA, 140 bp, Artificial Sequence
  Synthetic
aggccctggctgctgatatgaccgacgcctatcaaagtaggcaataaggcctcgcgccgaaccggcgaccggccaaaaggtggtggatgggtgatgccagggttggtaggtcgtaaatccgaccttttgggacagcggtg

SEQ ID NO: 383564 - DNA, 140 bp, Artificial Sequence
  Synthetic
caccgctgtcccaaaaggtcggatttacgacctaccaaccctggcatcacccatccaccaccttttggccggtcgccggttcggcgcgaggccttattgcctactttgataggcgtcggtcatatcagcagccagggcct

SEQ ID NO: 383565 - DNA, 140 bp, Artificial Sequence
  Synthetic
aggccctggctgctgatatgggccaaaaggtggtggatgggtgatgccagggttggtaggtcgtaaatcccggtcatcttggtagccactataggtgggtcttaaggggaggctacagtcgaccttttgggacagcggtg

SEQ ID NO: 383566 - DNA, 140 bp, Artificial Sequence
  Synthetic
caccgctgtcccaaaaggtcgactgtagcctccccttaagacccacctatagtggctaccaagatgaccgggatttacgacctaccaaccctggcatcacccatccaccaccttttggcccatatcagcagccagggcct

SEQ ID NO: 383567 - DNA, 140 bp, Artificial Sequence
  Synthetic
aggccctggctgctgatatgcctctagtgcctgtggagagaaagcgcacggtccacaggtgttggtcctaccggtgtgaataaggacccgacgtcaggctcgtcgttaaaccgagcccgtgaccttttgggacagcggtg

SEQ ID NO: 383568 - DNA, 140 bp, Artificial Sequence
  Synthetic
caccgctgtcccaaaaggtcacgggctcggtttaacgacgagcctgacgtcgggtccttattcacaccggtaggaccaacacctgtggaccgtgcgctttctctccacaggcactagaggcatatcagcagccagggcct

SEQ ID NO: 383569 - DNA, 140 bp, Artificial Sequence
  Synthetic
aggccctggctgctgatatgtaaccccctgggcaaacgacgcccacgtacggcccacgtcgcccttcaatgtctctcttgaccaataggcaaagccggcgagttggcaagggccagtggggaccttttgggacagcggtg

SEQ ID NO: 383570 - DNA, 140 bp, Artificial Sequence
  Synthetic
caccgctgtcccaaaaggtccccactggcccttgccaactcgccggctttgcctattggtcaagagagacattgaagggcgacgtgggccgtacgtgggcgtcgtttgcccagggggttacatatcagcagccagggcct

SEQ ID NO: 383571 - DNA, 140 bp, Artificial Sequence
  Synthetic
aggccctggctgctgatatgggccgggggcagggagaaggactccctgtcctgcccttcccgggggtgcgggaaatgcatggggccacccagctccgcggcggcctgcagccggggtagcgaccttttgggacagcggtg

SEQ ID NO: 383572 - DNA, 140 bp, Artificial Sequence
  Synthetic
caccgctgtcccaaaaggtcgctaccccggctgcaggccgccgcggagctgggtggccccatgcatttcccgcacccccgggaagggcaggacagggagtccttctccctgcccccggcccatatcagcagccagggcct

SEQ ID NO: 383573 - DNA, 140 bp, Artificial Sequence
  Synthetic
aggccctggctgctgatatgccaagagccttcgggtgagggcgggtggcatttttctttcctataccgatcatggcagtcctcctgcttttactcgtggcggaggccggggccatcttgggaccttttgggacagcggtg

SEQ ID NO: 383574 - DNA, 140 bp, Artificial Sequence
  Synthetic
caccgctgtcccaaaaggtcccaagatggccccggcctccgccacgagtaaaagcaggaggactgccatgatcggtataggaaagaaaaatgccacccgccctcacccgaaggctcttggcatatcagcagccagggcct

SEQ ID NO: 383575 - DNA, 140 bp, Artificial Sequence
  Synthetic
aggccctggctgctgatatgccccggccacccatgcttgtgaagctgaggggcaatatttcctcacaaattgctgcgccatggaggacatagggttctgcctggagggcggatgccttgtgaccttttgggacagcggtg

SEQ ID NO: 383576 - DNA, 140 bp, Artificial Sequence
  Synthetic
caccgctgtcccaaaaggtcacaaggcatccgccctccaggcagaaccctatgtcctccatggcgcagcaatttgtgaggaaatattgcccctcagcttcacaagcatgggtggccggggcatatcagcagccagggcct

SEQ ID NO: 383577 - DNA, 140 bp, Artificial Sequence
  Synthetic
aggccctggctgctgatatgggccctagggtgcactgtttgtactgacaaatgctggccactgtatcaggcggggctggccgtgcggcctggcaagtccgcggcccaactggtcggggaagaccttttgggacagcggtg

SEQ ID NO: 383578 - DNA, 140 bp, Artificial Sequence
  Synthetic
caccgctgtcccaaaaggtcttccccgaccagttgggccgcggacttgccaggccgcacggccagccccgcctgatacagtggccagcatttgtcagtacaaacagtgcaccctagggcccatatcagcagccagggcct

SEQ ID NO: 383579 - DNA, 140 bp, Artificial Sequence
  Synthetic
aggccctggctgctgatatgcttgggagcctctacgggcccttgtcggtgtcggcgtacgtcgccggcatcctagggctgggggaggtttactcgggagtccttaccattggcgtcgcgtgaccttttgggacagcggtg

SEQ ID NO: 383580 - DNA, 140 bp, Artificial Sequence
  Synthetic
caccgctgtcccaaaaggtcacgcgacgccaatggtaaggactcccgagtaaacctcccccagccctaggatgccggcgacgtacgccgacaccgacaagggcccgtagaggctcccaagcatatcagcagccagggcct

SEQ ID NO: 383581 - DNA, 140 bp, Artificial Sequence
  Synthetic
aggccctggctgctgatatgtgacgcgccgggtctacccggtcccaaatctgacatgtgctgtggagtgtgagttgaagtgggaaagtgagttttggagatggactgagcagttggcctcgaccttttgggacagcggtg

SEQ ID NO: 383582 - DNA, 140 bp, Artificial Sequence
  Synthetic
caccgctgtcccaaaaggtcgaggccaactgctcagtccatctccaaaactcactttcccacttcaactcacactccacagcacatgtcagatttgggaccgggtagacccggcgcgtcacatatcagcagccagggcct

SEQ ID NO: 383583 - DNA, 140 bp, Artificial Sequence
  Synthetic
aggccctggctgctgatatgcaattactggattctggaatatctctggaaggtgccttttgacttctggcggggagtgatgagcctgacgcctctgttggtgtgcgtggcggcccttctcgaccttttgggacagcggtg

SEQ ID NO: 383584 - DNA, 140 bp, Artificial Sequence
  Synthetic
caccgctgtcccaaaaggtcgagaagggccgccacgcacaccaacagaggcgtcaggctcatcactccccgccagaagtcaaaaggcaccttccagagatattccagaatccagtaattgcatatcagcagccagggcct

SEQ ID NO: 383585 - DNA, 140 bp, Artificial Sequence
  Synthetic
aggccctggctgctgatatgttgctggagcagcgaattgtcatggtcttcctcctggttaccatggcgggcatgtctcagggcgcgcctgcttcggtactagggtcccggccattcgagcgaccttttgggacagcggtg

SEQ ID NO: 383586 - DNA, 140 bp, Artificial Sequence
  Synthetic
caccgctgtcccaaaaggtcgctcgaatggccgggaccctagtaccgaagcaggcgcgccctgagacatgcccgccatggtaaccaggaggaagaccatgacaattcgctgctccagcaacatatcagcagccagggcct

SEQ ID NO: 383587 - DNA, 140 bp, Artificial Sequence
  Synthetic
aggccctggctgctgatatgcgggcttgacatggcagtcctgttcctgtaaggcgaacgggtcccgcgttcccacgggggagcgggtttgggaccgagggaacgtcacactcctgtgtgagaccttttgggacagcggtg

SEQ ID NO: 383588 - DNA, 140 bp, Artificial Sequence
  Synthetic
caccgctgtcccaaaaggtctcacacaggagtgtgacgttccctcggtcccaaacccgctcccccgtgggaacgcgggacccgttcgccttacaggaacaggactgccatgtcaagcccgcatatcagcagccagggcct

SEQ ID NO: 383589 - DNA, 140 bp, Artificial Sequence
  Synthetic
aggccctggctgctgatatgctgccccaacggcccctgggtctggctgccggccttttgccaagcaatcggctggggcgaccctatcactcattggagccacggacaaaatcagtggcccgaccttttgggacagcggtg

SEQ ID NO: 383590 - DNA, 140 bp, Artificial Sequence
  Synthetic
caccgctgtcccaaaaggtcgggccactgattttgtccgtggctccaatgagtgatagggtcgccccagccgattgcttggcaaaaggccggcagccagacccaggggccgttggggcagcatatcagcagccagggcct

SEQ ID NO: 383591 - DNA, 140 bp, Artificial Sequence
  Synthetic
aggccctggctgctgatatgctctcgtgcccccagttcgtctatggtgctgtttcagtgacatgtgtgtggggctccgtgtcttggtttgcctctacgggaggccgcgattctaagatcggaccttttgggacagcggtg

SEQ ID NO: 383592 - DNA, 140 bp, Artificial Sequence
  Synthetic
caccgctgtcccaaaaggtccgatcttagaatcgcggcctcccgtagaggcaaaccaagacacggagccccacacacatgtcactgaaacagcaccatagacgaactgggggcacgagagcatatcagcagccagggcct

SEQ ID NO: 383593 - DNA, 140 bp, Artificial Sequence
  Synthetic
aggccctggctgctgatatgatgtgtggagtttggtgcctgttggctctgccagctgcaccatagccgcacttgggtcgtcggatcgcgacgtcgtcgtggagctctccgagtggggggtgaccttttgggacagcggtg

SEQ ID NO: 383594 - DNA, 140 bp, Artificial Sequence
  Synthetic
caccgctgtcccaaaaggtcaccccccactcggagagctccacgacgacgtcgcgatccgacgacccaagtgcggctatggtgcagctggcagagccaacaggcaccaaactccacacatcatatcagcagccagggcct

SEQ ID NO: 383595 - DNA, 140 bp, Artificial Sequence
  Synthetic
aggccctggctgctgatatgcccttgtgccacgtgtatcctggatcgtcgacctgcctcgtgcggtacctgtgtgcgggactgctggcccgaaaccgggtcggtcagattcccattccacgaccttttgggacagcggtg

SEQ ID NO: 383596 - DNA, 140 bp, Artificial Sequence
  Synthetic
caccgctgtcccaaaaggtcgtggaatgggaatctgaccgacccggtttcgggccagcagtcccgcacacaggtaccgcacgaggcaggtcgacgatccaggatacacgtggcacaagggcatatcagcagccagggcct

SEQ ID NO: 383597 - DNA, 140 bp, Artificial Sequence
  Synthetic
aggccctggctgctgatatgaggtgcggcgcgggccccaggttgacccgtgacttggaagcagtgcccttcgtcaacaggacaacccctttcaccattagagggcccctgggcaaccagggaccttttgggacagcggtg

SEQ ID NO: 383598 - DNA, 140 bp, Artificial Sequence
  Synthetic
caccgctgtcccaaaaggtccctggttgcccaggggccctctaatggtgaaaggggttgtcctgttgacgaagggcactgcttccaagtcacgggtcaacctggggcccgcgccgcacctcatatcagcagccagggcct

SEQ ID NO: 383599 - DNA, 140 bp, Artificial Sequence
  Synthetic
aggccctggctgctgatatggtagggggaacccggtgcgttcgcccctgggtttcgggtcatacgccatgaccaagatccgagactcccttcacttggtgaagtgtcccactcccgccatgaccttttgggacagcggtg

SEQ ID NO: 383600 - DNA, 140 bp, Artificial Sequence
  Synthetic
caccgctgtcccaaaaggtcatggcgggagtgggacacttcaccaagtgaagggagtctcggatcttggtcatggcgtatgacccgaaacccaggggcgaacgcaccgggttccccctaccatatcagcagccagggcct

SEQ ID NO: 383601 - DNA, 140 bp, Artificial Sequence
  Synthetic
aggccctggctgctgatatgtaagcctcccactgggacgtttgggttcttccccggcgtaccgccccttaacaactgcatgcttctggggactgaggtctcggaggcattggggggggctgaccttttgggacagcggtg

SEQ ID NO: 383602 - DNA, 140 bp, Artificial Sequence
  Synthetic
caccgctgtcccaaaaggtcagccccccccaatgcctccgagacctcagtccccagaagcatgcagttgttaaggggcggtacgccggggaagaacccaaacgtcccagtgggaggcttacatatcagcagccagggcct

SEQ ID NO: 383603 - DNA, 140 bp, Artificial Sequence
  Synthetic
aggccctggctgctgatatggggctcaccggggggttctacgagcccctagtgaggcggtgttcagagctgatgggacgccgaaatccggtctgcccggggtttgcatggctctcttcgggaccttttgggacagcggtg

SEQ ID NO: 383604 - DNA, 140 bp, Artificial Sequence
  Synthetic
caccgctgtcccaaaaggtcccgaagagagccatgcaaaccccgggcagaccggatttcggcgtcccatcagctctgaacaccgcctcactaggggctcgtagaaccccccggtgagccccatatcagcagccagggcct

SEQ ID NO: 383605 - DNA, 140 bp, Artificial Sequence
  Synthetic
aggccctggctgctgatatggcaggcctgatgggttcatacatgttcagggccacttgcaggaggtggatgcaggcaacttcattccgccccctcgctggctgctcttggactttgtgttgaccttttgggacagcggtg

SEQ ID NO: 383606 - DNA, 140 bp, Artificial Sequence
  Synthetic
caccgctgtcccaaaaggtcaacacaaagtccaagagcagccagcgagggggcggaatgaagttgcctgcatccacctcctgcaagtggccctgaacatgtatgaacccatcaggcctgccatatcagcagccagggcct

SEQ ID NO: 383607 - DNA, 140 bp, Artificial Sequence
  Synthetic
aggccctggctgctgatatgtgtccttctctacctgatgaagctggcggaggctaggttggttccactcatacttctcctcctgtggtggtgggtgaatcagttggcggtccttggacttgaccttttgggacagcggtg

SEQ ID NO: 383608 - DNA, 140 bp, Artificial Sequence
  Synthetic
caccgctgtcccaaaaggtcaagtccaaggaccgccaactgattcacccaccaccacaggaggagaagtatgagtggaaccaacctagcctccgccagcttcatcaggtagagaaggacacatatcagcagccagggcct

SEQ ID NO: 383609 - DNA, 140 bp, Artificial Sequence
  Synthetic
aggccctggctgctgatatgccttctgctcacgccgccgtagctggtgaggtgtttgctggtcccgccctatcctggtgtctggggctccccttcgtgagtatgatcctaggattagctagaccttttgggacagcggtg

SEQ ID NO: 383610 - DNA, 140 bp, Artificial Sequence
  Synthetic
caccgctgtcccaaaaggtctagctaatcctaggatcatactcacgaaggggagccccagacaccaggatagggcgggaccagcaaacacctcaccagctacggcggcgtgagcagaaggcatatcagcagccagggcct

SEQ ID NO: 383611 - DNA, 140 bp, Artificial Sequence
  Synthetic
aggccctggctgctgatatgacctggtgttgtactttcggtggatgggcccccaacgcctaatgttccttgtgttgtggaagcttgctcggggagctttcccgctggctcttttgatggggaccttttgggacagcggtg

SEQ ID NO: 383612 - DNA, 140 bp, Artificial Sequence
  Synthetic
caccgctgtcccaaaaggtccccatcaaaagagccagcgggaaagctccccgagcaagcttccacaacacaaggaacattaggcgttgggggcccatccaccgaaagtacaacaccaggtcatatcagcagccagggcct

SEQ ID NO: 383613 - DNA, 140 bp, Artificial Sequence
  Synthetic
  misc_feature (33)..(33): n is a, c, g, or t
aggccctggctgctgatatggatttcggctacncgtggccgcacctctgtgctcggagctgagttctgctttgatgtcaccttcgaagtcgatacgtcagtgctgggatgggtggtggccgaccttttgggacagcggtg

SEQ ID NO: 383614 - DNA, 140 bp, Artificial Sequence
  Synthetic
  misc_feature (108)..(108): n is a, c, g, or t
caccgctgtcccaaaaggtcggccaccacccatcccagcactgacgtatcgacttcgaaggtgacatcaaagcagaactcagctccgagcacagaggtgcggccacgngtagccgaaatccatatcagcagccagggcct

SEQ ID NO: 383615 - DNA, 140 bp, Artificial Sequence
  Synthetic
aggccctggctgctgatatgagtgttgtggcttgggccatagcgctcttaagctcaatgagcgcgggtggctggaggcacaaagctgtgatctataggacgtggtgtaaagggtaccagggaccttttgggacagcggtg

SEQ ID NO: 383616 - DNA, 140 bp, Artificial Sequence
  Synthetic
caccgctgtcccaaaaggtccctggtaccctttacaccacgtcctatagatcacagctttgtgcctccagccacccgcgctcattgagcttaagagcgctatggcccaagccacaacactcatatcagcagccagggcct

SEQ ID NO: 383617 - DNA, 140 bp, Artificial Sequence
  Synthetic
aggccctggctgctgatatgcgattcgccagcgggtgattcggagccccctcggggaggggcgtccgactaagccgctgacctttgcttggtgcttggcctcttacatctggccggacgcgaccttttgggacagcggtg

SEQ ID NO: 383618 - DNA, 140 bp, Artificial Sequence
  Synthetic
caccgctgtcccaaaaggtcgcgtccggccagatgtaagaggccaagcaccaagcaaaggtcagcggcttagtcggacgcccctccccgagggggctccgaatcacccgctggcgaatcgcatatcagcagccagggcct

SEQ ID NO: 383619 - DNA, 140 bp, Artificial Sequence
  Synthetic
aggccctggctgctgatatgtgtgatgttggtggtagtggctctagtacttctctttggcctcttcgatgcactcgactgggctttggaggagctcctggtgtcacggccctcgttacgggaccttttgggacagcggtg

SEQ ID NO: 383620 - DNA, 140 bp, Artificial Sequence
  Synthetic
caccgctgtcccaaaaggtcccgtaacgagggccgtgacaccaggagctcctccaaagcccagtcgagtgcatcgaagaggccaaagagaagtactagagccactaccaccaacatcacacatatcagcagccagggcct

SEQ ID NO: 383621 - DNA, 140 bp, Artificial Sequence
  Synthetic
aggccctggctgctgatatgcgtcttgcaagggtggtggagtgttgtgtgatggctggtgaaagggctacaaccattcggctcgtgtccaagatgtgcgctcgtggggcctatttgttcggaccttttgggacagcggtg

SEQ ID NO: 383622 - DNA, 140 bp, Artificial Sequence
  Synthetic
caccgctgtcccaaaaggtccgaacaaataggccccacgagcgcacatcttggacacgagccgaatggttgtagccctttcaccagccatcacacaacactccaccacccttgcaagacgcatatcagcagccagggcct

SEQ ID NO: 383623 - DNA, 140 bp, Artificial Sequence
  Synthetic
aggccctggctgctgatatgaccatatgggctctttttcccgcgcagtcaaggaacgcttgctagagtgggacgcggccctcgagccgctttcattcactaggacggactgtcgcatcatgaccttttgggacagcggtg

SEQ ID NO: 383624 - DNA, 140 bp, Artificial Sequence
  Synthetic
caccgctgtcccaaaaggtcatgatgcgacagtccgtcctagtgaatgaaagcggctcgagggccgcgtcccactctagcaagcgttccttgactgcgcgggaaaaagagcccatatggtcatatcagcagccagggcct

SEQ ID NO: 383625 - DNA, 140 bp, Artificial Sequence
  Synthetic
aggccctggctgctgatatgtcgagacgctgccaggaccttgagctgcggccagtgcgtcatgggcttgcccgtggtggctcggcgcggtgacgaggttctgattggcgtcttccaggatgaccttttgggacagcggtg

SEQ ID NO: 383626 - DNA, 140 bp, Artificial Sequence
  Synthetic
caccgctgtcccaaaaggtcatcctggaagacgccaatcagaacctcgtcaccgcgccgagccaccacgggcaagcccatgacgcactggccgcagctcaaggtcctggcagcgtctcgacatatcagcagccagggcct

SEQ ID NO: 383627 - DNA, 140 bp, Artificial Sequence
  Synthetic
aggccctggctgctgatatggtgaaccatttgcctccggcatttgtcccaaccgcgcccgttgtcatccggcggtgcggaaagggctttcttggagtcacgaaggctgccttgactggaagaccttttgggacagcggtg

SEQ ID NO: 383628 - DNA, 140 bp, Artificial Sequence
  Synthetic
caccgctgtcccaaaaggtcttccagtcaaggcagccttcgtgactccaagaaagccctttccgcaccgccggatgacaacgggcgcggttgggacaaatgccggaggcaaatggttcaccatatcagcagccagggcct

SEQ ID NO: 383629 - DNA, 140 bp, Artificial Sequence
  Synthetic
aggccctggctgctgatatggggatccggacttgcacccggggaacgtcatggtgttggggactgcgacctcgcgcagcatgggaacgtgcttgaacgggttgcttttcactacattccagaccttttgggacagcggtg

SEQ ID NO: 383630 - DNA, 140 bp, Artificial Sequence
  Synthetic
caccgctgtcccaaaaggtctggaatgtagtgaaaagcaacccgttcaagcacgttcccatgctgcgcgaggtcgcagtccccaacaccatgacgttccccgggtgcaagtccggatccccatatcagcagccagggcct

SEQ ID NO: 383631 - DNA, 140 bp, Artificial Sequence
  Synthetic
aggccctggctgctgatatgtggggcttcttcccgaaccattgcgacacctgtgggggccctcaacccaaggtggtggtctgccagtgatgacgtgacggtgtaccccctccctgacggggaccttttgggacagcggtg

SEQ ID NO: 383632 - DNA, 140 bp, Artificial Sequence
  Synthetic
caccgctgtcccaaaaggtccccgtcagggagggggtacaccgtcacgtcatcactggcagaccaccaccttgggttgagggcccccacaggtgtcgcaatggttcgggaagaagccccacatatcagcagccagggcct

SEQ ID NO: 383633 - DNA, 140 bp, Artificial Sequence
  Synthetic
aggccctggctgctgatatggcaacctcattggcgccttgcacatgccaggctgagtcgtgttgggtcatccggtccgacggggctctttgccatggcttgagcaagggggacaaggtgggaccttttgggacagcggtg

SEQ ID NO: 383634 - DNA, 140 bp, Artificial Sequence
  Synthetic
caccgctgtcccaaaaggtcccaccttgtcccccttgctcaagccatggcaaagagccccgtcggaccggatgacccaacacgactcagcctggcatgtgcaaggcgccaatgaggttgccatatcagcagccagggcct

SEQ ID NO: 383635 - DNA, 140 bp, Artificial Sequence
  Synthetic
aggccctggctgctgatatgaactagacgtggccatggaggtcgcagacttccgtgggtcgtccggatcccctgtcttgtgcgatgaggggcacgcagtaggaatgctcgtgtcagtcctgaccttttgggacagcggtg

SEQ ID NO: 383636 - DNA, 140 bp, Artificial Sequence
  Synthetic
caccgctgtcccaaaaggtcaggactgacacgagcattcctactgcgtgcccctcatcgcacaagacaggggatccggacgacccacggaagtctgcgacctccatggccacgtctagttcatatcagcagccagggcct

SEQ ID NO: 383637 - DNA, 140 bp, Artificial Sequence
  Synthetic
aggccctggctgctgatatgtcactcagggggaagggtcaccgccgcgagattcacgcggccgtggacccaagtcccaactgatgccaaaaccaccactgaacccccgccagtgccagctgaccttttgggacagcggtg

SEQ ID NO: 383638 - DNA, 140 bp, Artificial Sequence
  Synthetic
caccgctgtcccaaaaggtcagctggcactggcgggggttcagtggtggttttggcatcagttgggacttgggtccacggccgcgtgaatctcgcggcggtgacccttccccctgagtgacatatcagcagccagggcct

SEQ ID NO: 383639 - DNA, 140 bp, Artificial Sequence
  Synthetic
aggccctggctgctgatatgaagggtgtctttaaggaggctcctcttttcatgccaactggggccggtaagagcacacgggtccctttggaatatggaaacatgggccacaaagtcctcagaccttttgggacagcggtg

SEQ ID NO: 383640 - DNA, 140 bp, Artificial Sequence
  Synthetic
caccgctgtcccaaaaggtctgaggactttgtggcccatgtttccatattccaaagggacccgtgtgctcttaccggccccagttggcatgaaaagaggagcctccttaaagacacccttcatatcagcagccagggcct

SEQ ID NO: 383641 - DNA, 140 bp, Artificial Sequence
  Synthetic
aggccctggctgctgatatgttctgaacccgtccgtagctacggtgcgtgccatgggcccctatatggagcgcttggccgggaaacatcctagcatctactgcggacatgacaccacggcgaccttttgggacagcggtg

SEQ ID NO: 383642 - DNA, 140 bp, Artificial Sequence
  Synthetic
caccgctgtcccaaaaggtcgccgtggtgtcatgtccgcagtagatgctaggatgtttcccggccaagcgctccatataggggcccatggcacgcaccgtagctacggacgggttcagaacatatcagcagccagggcct

SEQ ID NO: 383643 - DNA, 140 bp, Artificial Sequence
  Synthetic
aggccctggctgctgatatgattcacacgcattacggattcccctttgacatattctacctatgggaggtttttggccaaccctaggcagatgctgaggggcgtctctgtggtgatttgtgaccttttgggacagcggtg

SEQ ID NO: 383644 - DNA, 140 bp, Artificial Sequence
  Synthetic
caccgctgtcccaaaaggtcacaaatcaccacagagacgcccctcagcatctgcctagggttggccaaaaacctcccataggtagaatatgtcaaaggggaatccgtaatgcgtgtgaatcatatcagcagccagggcct

SEQ ID NO: 383645 - DNA, 140 bp, Artificial Sequence
  Synthetic
aggccctggctgctgatatggatgagtgccacagccatgactcgactgtgctgctggggattgggagggtccgggaattggcgcgcggatgcggagttcaactagttctctacgccaccggaccttttgggacagcggtg

SEQ ID NO: 383646 - DNA, 140 bp, Artificial Sequence
  Synthetic
caccgctgtcccaaaaggtccggtggcgtagagaactagttgaactccgcatccgcgcgccaattcccggaccctcccaatccccagcagcacagtcgagtcatggctgtggcactcatccatatcagcagccagggcct

SEQ ID NO: 383647 - DNA, 140 bp, Artificial Sequence
  Synthetic
aggccctggctgctgatatgccactcccccgggctctcctatgacccagcacccttctatcatcgagaccaaactggatgtgggagagatccccttctatgggcatggcatacccctggagaccttttgggacagcggtg

SEQ ID NO: 383648 - DNA, 140 bp, Artificial Sequence
  Synthetic
caccgctgtcccaaaaggtctccaggggtatgccatgcccatagaaggggatctctcccacatccagtttggtctcgatgatagaagggtgctgggtcataggagagcccgggggagtggcatatcagcagccagggcct

SEQ ID NO: 383649 - DNA, 140 bp, Artificial Sequence
  Synthetic
aggccctggctgctgatatggaggatgcgcaccggacggcacctcgtattctgccactcaaaggcggagtgtgagcgcctcgccgggcaattctctgctaggggggtcaatgctattgccgaccttttgggacagcggtg

SEQ ID NO: 383650 - DNA, 140 bp, Artificial Sequence
  Synthetic
caccgctgtcccaaaaggtcggcaatagcattgacccccctagcagagaattgcccggcgaggcgctcacactccgcctttgagtggcagaatacgaggtgccgtccggtgcgcatcctccatatcagcagccagggcct

SEQ ID NO: 383651 - DNA, 140 bp, Artificial Sequence
  Synthetic
aggccctggctgctgatatgtattacagggggaaggacagttcgatcatcaaggatggggacctcgtggtctgcgctaccgacgcgctctccacggggtacacaggcaactttgactcgggaccttttgggacagcggtg

SEQ ID NO: 383652 - DNA, 140 bp, Artificial Sequence
  Synthetic
caccgctgtcccaaaaggtcccgagtcaaagttgcctgtgtaccccgtggagagcgcgtcggtagcgcagaccacgaggtccccatccttgatgatcgaactgtccttccccctgtaatacatatcagcagccagggcct

SEQ ID NO: 383653 - DNA, 140 bp, Artificial Sequence
  Synthetic
aggccctggctgctgatatgtcactgattgtgggttagtggtggaggaggtcgtcgaggtgacccttgatcccaccataaccatttccttgcgaacagtccctgcgtcggctgaactgtcgaccttttgggacagcggtg

SEQ ID NO: 383654 - DNA, 140 bp, Artificial Sequence
  Synthetic
caccgctgtcccaaaaggtcgacagttcagccgacgcagggactgttcgcaaggaaatggttatggtgggatcaagggtcacctcgacgacctcctccaccactaacccacaatcagtgacatatcagcagccagggcct

SEQ ID NO: 383655 - DNA, 140 bp, Artificial Sequence
  Synthetic
aggccctggctgctgatatggatgcagcggagaggacgcacaggcagaggccggtctgggcggtactattacgcgggggtgggcaaagcccccgcgggagtggtccgctcgggtccggtcgaccttttgggacagcggtg

SEQ ID NO: 383656 - DNA, 140 bp, Artificial Sequence
  Synthetic
caccgctgtcccaaaaggtcgaccggacccgagcggaccactcccgcgggggctttgcccacccccgcgtaatagtaccgcccagaccggcctctgcctgtgcgtcctctccgctgcatccatatcagcagccagggcct

SEQ ID NO: 383657 - DNA, 140 bp, Artificial Sequence
  Synthetic
aggccctggctgctgatatgtggtctgcagtggaagctggtgtgacctggtatggaatggaacctgacttgacagcaaaccttctgagactatacgacgactgcccttacaccgcagccggaccttttgggacagcggtg

SEQ ID NO: 383658 - DNA, 140 bp, Artificial Sequence
  Synthetic
caccgctgtcccaaaaggtccggctgcggtgtaagggcagtcgtcgtatagtctcagaaggtttgctgtcaagtcaggttccattccataccaggtcacaccagcttccactgcagaccacatatcagcagccagggcct

SEQ ID NO: 383659 - DNA, 140 bp, Artificial Sequence
  Synthetic
aggccctggctgctgatatgtcgcggctgacatcggcgaggccgcggtcttcttctcggggcttgcccccttgaggatgcaccctgatgtcagctgggcaaaagtacgcggcgtcaactggaccttttgggacagcggtg

SEQ ID NO: 383660 - DNA, 140 bp, Artificial Sequence
  Synthetic
caccgctgtcccaaaaggtccagttgacgccgcgtacttttgcccagctgacatcagggtgcatcctcaagggggcaagccccgagaagaagaccgcggcctcgccgatgtcagccgcgacatatcagcagccagggcct

SEQ ID NO: 383661 - DNA, 140 bp, Artificial Sequence
  Synthetic
aggccctggctgctgatatggcccctcttggtgggtgttcagcggacgatgtgtcgggaaacactgtcgcccggaccgtcggacgacccccaatgggcaggtctgaagggcccgaatcctgaccttttgggacagcggtg

SEQ ID NO: 383662 - DNA, 140 bp, Artificial Sequence
  Synthetic
caccgctgtcccaaaaggtcaggattcgggcccttcagacctgcccattgggggtcgtccgacggtccgggcgacagtgtttcccgacacatcgtccgctgaacacccaccaagaggggccatatcagcagccagggcct

SEQ ID NO: 383663 - DNA, 140 bp, Artificial Sequence
  Synthetic
aggccctggctgctgatatggtcccgctaccgctgaggtggggcaacgatcttccatcgaaagtggccggccaccacattgtagatgacctggtcaggcggctcggtgtggctgggggttgaccttttgggacagcggtg

SEQ ID NO: 383664 - DNA, 140 bp, Artificial Sequence
  Synthetic
caccgctgtcccaaaaggtcaacccccagccacaccgagccgcctgaccaggtcatctacaatgtggtggccggccactttcgatggaagatcgttgccccacctcagcggtagcgggaccatatcagcagccagggcct

SEQ ID NO: 383665 - DNA, 140 bp, Artificial Sequence
  Synthetic
aggccctggctgctgatatgatgtccgctgcgacgcggggcccatcttaatggtgggcctcgctatcgcgggggggatgatctacgcctcatacactgggtcccctgtggtggtgacagagaccttttgggacagcggtg

SEQ ID NO: 383666 - DNA, 140 bp, Artificial Sequence
  Synthetic
caccgctgtcccaaaaggtctctgtcaccaccacaggggacccagtgtatgaggcgtagatcatcccccccgcgatagcgaggcccaccattaagatgggccccgcgtcgcagcggacatcatatcagcagccagggcct

SEQ ID NO: 383667 - DNA, 140 bp, Artificial Sequence
  Synthetic
aggccctggctgctgatatgctgggatgtgaaggggggtggcaaccccctttaccggagtggtgaccaggccactcctcaacctgtggtgcaggtccccccggtagaccaccggccgggggaccttttgggacagcggtg

SEQ ID NO: 383668 - DNA, 140 bp, Artificial Sequence
  Synthetic
caccgctgtcccaaaaggtcccccggccggtggtctaccggggggacctgcaccacaggttgaggagtggcctggtcaccactccggtaaagggggttgccaccccccttcacatcccagcatatcagcagccagggcct

SEQ ID NO: 383669 - DNA, 140 bp, Artificial Sequence
  Synthetic
  misc_feature (32)..(32): n is a, c, g, or t
  misc_feature (35)..(35): n is a, c, g, or t
  misc_feature (74)..(74): n is a, c, g, or t
  misc_feature (98)..(98): n is a, c, g, or t
aggccctggctgctgatatgggggaatctgcnccntcagatgccaagacagtgacagatgcggtggcggccatncaggtgaactgcgattggtcggtnatgaccctgtcgatcggggaaggaccttttgggacagcggtg

SEQ ID NO: 383670 - DNA, 140 bp, Artificial Sequence
  Synthetic
  misc_feature (43)..(43): n is a, c, g, or t
  misc_feature (67)..(67): n is a, c, g, or t
  misc_feature (106)..(106): n is a, c, g, or t
  misc_feature (109)..(109): n is a, c, g, or t
caccgctgtcccaaaaggtccttccccgatcgacagggtcatnaccgaccaatcgcagttcacctgnatggccgccaccgcatctgtcactgtcttggcatctganggngcagattcccccatatcagcagccagggcct

SEQ ID NO: 383671 - DNA, 140 bp, Artificial Sequence
  Synthetic
atacgccatgctgggtctccaagtggcttgctggctgctacacggggacgcgggccgtccccactgtatccattgttgacaagctcttcgccggagggtgggcggctgttgttggccactcgtacttgggagtcggccat

SEQ ID NO: 383672 - DNA, 140 bp, Artificial Sequence
  Synthetic
atggccgactcccaagtacgagtggccaacaacagccgcccaccctccggcgaagagcttgtcaacaatggatacagtggggacggcccgcgtccccgtgtagcagccagcaagccacttggagacccagcatggcgtat

SEQ ID NO: 383673 - DNA, 140 bp, Artificial Sequence
  Synthetic
aggccctggctgctgatatggtcacagtgtcatagctgcggcggtggctgcctacggggcttctcgaagccctccgttggcagcagcggcttcctatctgatggggttgggcgttggagggaccttttgggacagcggtg

SEQ ID NO: 383674 - DNA, 140 bp, Artificial Sequence
  Synthetic
caccgctgtcccaaaaggtccctccaacgcccaaccccatcagataggaagccgctgctgccaacggagggcttcgagaagccccgtaggcagccaccgccgcagctatgacactgtgaccatatcagcagccagggcct

SEQ ID NO: 383675 - DNA, 140 bp, Artificial Sequence
  Synthetic
aggccctggctgctgatatgcaacgcgcaggctcgcttggcgtctgccctcctgctgggggccgcagggactgcccttggaacacccgtcgttggtttgaccatggcgggtgctttcatggaccttttgggacagcggtg

SEQ ID NO: 383676 - DNA, 140 bp, Artificial Sequence
  Synthetic
caccgctgtcccaaaaggtccatgaaagcacccgccatggtcaaaccaacgacgggtgttccaagggcagtccctgcggcccccagcaggagggcagacgccaagcgagcctgcgcgttgcatatcagcagccagggcct

SEQ ID NO: 383677 - DNA, 140 bp, Artificial Sequence
  Synthetic
aggccctggctgctgatatgggtggtgccagtgtgtccccgtcgctggtcacggtcctcttaggggccgtgggcggttgggagggcgtcgtcaatgcggccagccttgtcttcgatttcagaccttttgggacagcggtg

SEQ ID NO: 383678 - DNA, 140 bp, Artificial Sequence
  Synthetic
caccgctgtcccaaaaggtctgaaatcgaagacaaggctggccgcattgacgacgccctcccaaccgcccacggcccctaagaggaccgtgaccagcgacggggacacactggcaccacccatatcagcagccagggcct

SEQ ID NO: 383679 - DNA, 140 bp, Artificial Sequence
  Synthetic
aggccctggctgctgatatgtggcagggaaattatcaactgaagacttgtggtatgccatcccggtgctcactagtccaggggctggccttgcggggatagcccttgggttggtgttgtagaccttttgggacagcggtg

SEQ ID NO: 383680 - DNA, 140 bp, Artificial Sequence
  Synthetic
caccgctgtcccaaaaggtctacaacaccaacccaagggctatccccgcaaggccagcccctggactagtgagcaccgggatggcataccacaagtcttcagttgataatttccctgccacatatcagcagccagggcct

SEQ ID NO: 383681 - DNA, 140 bp, Artificial Sequence
  Synthetic
aggccctggctgctgatatgctcagcaaacaactctggcactaccacttggttgaatcgtctgcttacgacgcttccccggtcttcttgcattcctgacagttactttcagcaggctgacgaccttttgggacagcggtg

SEQ ID NO: 383682 - DNA, 140 bp, Artificial Sequence
  Synthetic
caccgctgtcccaaaaggtcgtcagcctgctgaaagtaactgtcaggaatgcaagaagaccggggaagcgtcgtaagcagacgattcaaccaagtggtagtgccagagttgtttgctgagcatatcagcagccagggcct

SEQ ID NO: 383683 - DNA, 140 bp, Artificial Sequence
  Synthetic
aggccctggctgctgatatgtactgtgacaaggtttctgccatgcttcgacgcctgagccttacccgcactgtggttgccctggtcaacagggagcctaaggtggatgaggtccaggtgggaccttttgggacagcggtg

SEQ ID NO: 383684 - DNA, 140 bp, Artificial Sequence
  Synthetic
caccgctgtcccaaaaggtcccacctggacctcatccaccttaggctccctgttgaccagggcaaccacagtgcgggtaaggctcaggcgtcgaagcatggcagaaaccttgtcacagtacatatcagcagccagggcct

SEQ ID NO: 383685 - DNA, 140 bp, Artificial Sequence
  Synthetic
aggccctggctgctgatatgggtatgtctgggacctgtgggagtgggtcatgcgccagattcgcatggtcatggccagactccgggccctctgccccgtggtgtcactacctttgtggcagaccttttgggacagcggtg

SEQ ID NO: 383686 - DNA, 140 bp, Artificial Sequence
  Synthetic
caccgctgtcccaaaaggtctgccacaaaggtagtgacaccacggggcagagggcccggagtctggccatgaccatgcgaatctggcgcatgacccactcccacaggtcccagacatacccatatcagcagccagggcct

SEQ ID NO: 383687 - DNA, 140 bp, Artificial Sequence
  Synthetic
aggccctggctgctgatatgctgcggagaggggtggtccggcgaatggctgttggacggtcatgtggagagtcgctgtctctgtggatgtgtgatcactggggacgtgttgaatgggcaagaccttttgggacagcggtg

SEQ ID NO: 383688 - DNA, 140 bp, Artificial Sequence
  Synthetic
caccgctgtcccaaaaggtcttgcccattcaacacgtccccagtgatcacacatccacagagacagcgactctccacatgaccgtccaacagccattcgccggaccacccctctccgcagcatatcagcagccagggcct

SEQ ID NO: 383689 - DNA, 140 bp, Artificial Sequence
  Synthetic
aggccctggctgctgatatgctcaaagatccagtttactctaccaaactgtgccggcactattggatggggactgtgcctgtcaacatgttgggttacggggaaacttcaccccttctgggaccttttgggacagcggtg

SEQ ID NO: 383690 - DNA, 140 bp, Artificial Sequence
  Synthetic
caccgctgtcccaaaaggtcccagaaggggtgaagtttccccgtaacccaacatgttgacaggcacagtccccatccaatagtgccggcacagtttggtagagtaaactggatctttgagcatatcagcagccagggcct

SEQ ID NO: 383691 - DNA, 140 bp, Artificial Sequence
  Synthetic
aggccctggctgctgatatgcctcggacaccccaaaggtcgtaccttttgggactgcaggctgggctgaggtggtggtgacccccacccacgtggtggtcaggcgcacttcctgttacaagaccttttgggacagcggtg

SEQ ID NO: 383692 - DNA, 140 bp, Artificial Sequence
  Synthetic
caccgctgtcccaaaaggtcttgtaacaggaagtgcgcctgaccaccacgtgggtgggggtcaccaccacctcagcccagcctgcagtcccaaaaggtacgacctttggggtgtccgaggcatatcagcagccagggcct

SEQ ID NO: 383693 - DNA, 140 bp, Artificial Sequence
  Synthetic
aggccctggctgctgatatggctgctgcgccaacaaattctatctgctgctgtagctgagccctattatgtcgacggcattccggtctcatgggacgcggacgcgcgggccccggccatggaccttttgggacagcggtg

SEQ ID NO: 383694 - DNA, 140 bp, Artificial Sequence
  Synthetic
caccgctgtcccaaaaggtccatggccggggcccgcgcgtccgcgtcccatgagaccggaatgccgtcgacataatagggctcagctacagcagcagatagaatttgttggcgcagcagccatatcagcagccagggcct

SEQ ID NO: 383695 - DNA, 140 bp, Artificial Sequence
  Synthetic
aggccctggctgctgatatggtctacggtcctggccaaagcgttaccattgacggggagaggtacaccctcccgcaccaactgcggatgaggaatgtagccccctctgaggtttcgtctggaccttttgggacagcggtg

SEQ ID NO: 383696 - DNA, 140 bp, Artificial Sequence
  Synthetic
caccgctgtcccaaaaggtccagacgaaacctcagagggggctacattcctcatccgcagttggtgcgggagggtgtacctctccccgtcaatggtaacgctttggccaggaccgtagaccatatcagcagccagggcct

SEQ ID NO: 383697 - DNA, 140 bp, Artificial Sequence
  Synthetic
aggccctggctgctgatatgaggtcagcatcgagattgggacggagactgaggattcagaactgacagaggccgatttgccgccggcagctgcagctctccaggctattgagaatgctgcgaccttttgggacagcggtg

SEQ ID NO: 383698 - DNA, 140 bp, Artificial Sequence
  Synthetic
caccgctgtcccaaaaggtcgcagcattctcaatagcctggagagctgcagctgccggcggcaaatcggcctctgtcagttctgaatcctcagtctccgtcccaatctcgatgctgacctcatatcagcagccagggcct

SEQ ID NO: 383699 - DNA, 140 bp, Artificial Sequence
  Synthetic
aggccctggctgctgatatggagaattctcgagcctcacattgatgtcatcatggaggactgcagtacaccctctctctgtggaagtagccgagagatgcctgtgtggggagaagacatagaccttttgggacagcggtg

SEQ ID NO: 383700 - DNA, 140 bp, Artificial Sequence
  Synthetic
caccgctgtcccaaaaggtctatgtcttctccccacacaggcatctctcggctacttccacagagagagggtgtactgcagtcctccatgatgacatcaatgtgaggctcgagaattctccatatcagcagccagggcct

SEQ ID NO: 383701 - DNA, 140 bp, Artificial Sequence
  Synthetic
aggccctggctgctgatatgccccgcactccatcgcctgcactaatctcggttacggagagcagctcagaagagaagaccccgtcggtgtccccctcgcaggaggacactccgtcgtccggaccttttgggacagcggtg

SEQ ID NO: 383702 - DNA, 140 bp, Artificial Sequence
  Synthetic
caccgctgtcccaaaaggtccggacgacggagtgtcctcctgcgagggggacaccgacggggtcttctcttctgagctgctctccgtaaccgagattagtgcaggcgatggagtgcggggcatatcagcagccagggcct

SEQ ID NO: 383703 - DNA, 140 bp, Artificial Sequence
  Synthetic
aggccctggctgctgatatgactcttttgaagtcatccaagagtctgattcagcagaaggagaggaaagcgtcttcaacgtggctctttccgtactaaaagccttatttccacagagcgagaccttttgggacagcggtg

SEQ ID NO: 383704 - DNA, 140 bp, Artificial Sequence
  Synthetic
caccgctgtcccaaaaggtctcgctctgtggaaataaggcttttagtacggaaagagccacgttgaagacgctttcctctccttctgctgaatcagactcttggatgacttcaaaagagtcatatcagcagccagggcct

SEQ ID NO: 383705 - DNA, 140 bp, Artificial Sequence
  Synthetic
aggccctggctgctgatatgcgccacacgaaagttgactgtcaagatgtcttgctgtgtggagaagagcgtcacacgcttcttttccttagggttgacagtggctgacgtggctagcctggaccttttgggacagcggtg

SEQ ID NO: 383706 - DNA, 140 bp, Artificial Sequence
  Synthetic
caccgctgtcccaaaaggtccaggctagccacgtcagccactgtcaaccctaaggaaaagaagcgtgtgacgctcttctccacacagcaagacatcttgacagtcaactttcgtgtggcgcatatcagcagccagggcct

SEQ ID NO: 383707 - DNA, 140 bp, Artificial Sequence
  Synthetic
aggccctggctgctgatatgtgtgagatggagatccagaaccatacagcctattgtgacaaggtgcgcactccgctcgaattgcaagttgggtgcttggtgggcaatgaacttacctttggaccttttgggacagcggtg

SEQ ID NO: 383708 - DNA, 140 bp, Artificial Sequence
  Synthetic
caccgctgtcccaaaaggtccaaaggtaagttcattgcccaccaagcacccaacttgcaattcgagcggagtgcgcaccttgtcacaataggctgtatggttctggatctccatctcacacatatcagcagccagggcct

SEQ ID NO: 383709 - DNA, 140 bp, Artificial Sequence
  Synthetic
aggccctggctgctgatatgaatgtgacaagtgtgaggcacggcaagagacgttggcctccttctcatacatctggtctggggtgccgctgactagggccacaccggccaaacctccagtgaccttttgggacagcggtg

SEQ ID NO: 383710 - DNA, 140 bp, Artificial Sequence
  Synthetic
caccgctgtcccaaaaggtcactggaggtttggccggtgtggccctagtcagcggcaccccagaccagatgtatgagaaggaggccaacgtctcttgccgtgcctcacacttgtcacattcatatcagcagccagggcct

SEQ ID NO: 383711 - DNA, 140 bp, Artificial Sequence
  Synthetic
aggccctggctgctgatatgggtgaggccggtggggtccttgttggtggccgacaccactaaggtgtacgtaaccaacccggataatgtggggaggagggtcgacaaggttactttctgggaccttttgggacagcggtg

SEQ ID NO: 383712 - DNA, 140 bp, Artificial Sequence
  Synthetic
caccgctgtcccaaaaggtcccagaaagtaaccttgtcgaccctcctccccacattatccgggttggttacgtacaccttagtggtgtcggccaccaacaaggaccccaccggcctcacccatatcagcagccagggcct

SEQ ID NO: 383713 - DNA, 140 bp, Artificial Sequence
  Synthetic
aggccctggctgctgatatgcgggccccaagagttcatgacaaatatctcgtggactcgatcgaggccgctcggaaggccgctcaagcctgtctaagcatgggttacacttatgaggagggaccttttgggacagcggtg

SEQ ID NO: 383714 - DNA, 140 bp, Artificial Sequence
  Synthetic
caccgctgtcccaaaaggtccctcctcataagtgtaacccatgcttagacaggcttgagcggccttccgagcggcctcgatcgagtccacgagatatttgtcatgaactcttggggcccgcatatcagcagccagggcct

SEQ ID NO: 383715 - DNA, 140 bp, Artificial Sequence
  Synthetic
aggccctggctgctgatatgcaataaggactgtaaggccgcatgctgccatgggctggggatctaaggtgtcggttaaggacttggccacccctgcggggaagatggctgttcacgaccggaccttttgggacagcggtg

SEQ ID NO: 383716 - DNA, 140 bp, Artificial Sequence
  Synthetic
caccgctgtcccaaaaggtccggtcgtgaacagccatcttccccgcaggggtggccaagtccttaaccgacaccttagatccccagcccatggcagcatgcggccttacagtccttattgcatatcagcagccagggcct

SEQ ID NO: 383717 - DNA, 140 bp, Artificial Sequence
  Synthetic
aggccctggctgctgatatggcttcaggagatacttgaagggactccggtcccctttacattgactgtgaaaaaggaggtgttcttcaaagatcggaaggaggagaaggccccccgcctggaccttttgggacagcggtg

SEQ ID NO: 383718 - DNA, 140 bp, Artificial Sequence
  Synthetic
caccgctgtcccaaaaggtccaggcggggggccttctcctccttccgatctttgaagaacacctcctttttcacagtcaatgtaaaggggaccggagtcccttcaagtatctcctgaagccatatcagcagccagggcct

SEQ ID NO: 383719 - DNA, 140 bp, Artificial Sequence
  Synthetic
aggccctggctgctgatatgattgtgttcccccccctggacttccggatagctgaaaagcttattctgggcgatccgggtagggtagccaaggcggtgttggggggagcttatgccttccgaccttttgggacagcggtg

SEQ ID NO: 383720 - DNA, 140 bp, Artificial Sequence
  Synthetic
caccgctgtcccaaaaggtcggaaggcataagctccccccaacaccgccttggctaccctacccggatcgcccagaataagcttttcagctatccggaagtccaggggggggaacacaatcatatcagcagccagggcct

SEQ ID NO: 383721 - DNA, 140 bp, Artificial Sequence
  Synthetic
aggccctggctgctgatatgagtacaccccaaaccagcgagtcagggagatgctcaagctgtgggagtcgaagaagaccccttgcgccatctgtgtggacgccacgtgcttcgacagtaggaccttttgggacagcggtg

SEQ ID NO: 383722 - DNA, 140 bp, Artificial Sequence
  Synthetic
caccgctgtcccaaaaggtcctactgtcgaagcacgtggcgtccacacagatggcgcaaggggtcttcttcgactcccacagcttgagcatctccctgactcgctggtttggggtgtactcatatcagcagccagggcct

SEQ ID NO: 383723 - DNA, 140 bp, Artificial Sequence
  Synthetic
aggccctggctgctgatatgcattactgaagaggatgtggccttggagacagagctatacgcccttgcctccgaccatccagagtgggtgcgagccctggggaaatactatgcctcgggtgaccttttgggacagcggtg

SEQ ID NO: 383724 - DNA, 140 bp, Artificial Sequence
  Synthetic
caccgctgtcccaaaaggtcacccgaggcatagtatttccccagggctcgcacccactctggatggtcggaggcaagggcgtatagctctgtctccaaggccacatcctcttcagtaatgcatatcagcagccagggcct

SEQ ID NO: 383725 - DNA, 140 bp, Artificial Sequence
  Synthetic
aggccctggctgctgatatgaccatggtcaccccggagggggtgcccgtgggagagaggtactgtagatcctcaggagttttgaccaccagcgcgagcaattgcctgacctgctacatcagaccttttgggacagcggtg

SEQ ID NO: 383726 - DNA, 140 bp, Artificial Sequence
  Synthetic
caccgctgtcccaaaaggtctgatgtagcaggtcaggcaattgctcgcgctggtggtcaaaactcctgaggatctacagtacctctctcccacgggcaccccctccggggtgaccatggtcatatcagcagccagggcct

SEQ ID NO: 383727 - DNA, 140 bp, Artificial Sequence
  Synthetic
aggccctggctgctgatatgaggtgaaagccgcctgccagagagtggggctgaaaaatgtctcacttctcatcgcgggcgatgactgcttgatcatatgtgagcggccaatgtgtgacccgaccttttgggacagcggtg

SEQ ID NO: 383728 - DNA, 140 bp, Artificial Sequence
  Synthetic
caccgctgtcccaaaaggtcgggtcacacattggccgctcacatatgatcaagcagtcatcgcccgcgatgagaagtgagacatttttcagccccactctctggcaggcggctttcacctcatatcagcagccagggcct

SEQ ID NO: 383729 - DNA, 140 bp, Artificial Sequence
  Synthetic
aggccctggctgctgatatgtagtgaggccttgggcagagccctggcctcctacggttacgcgtgtgagccctcatatcatgcatcactagacacagctcccttctgctccacttggttagaccttttgggacagcggtg

SEQ ID NO: 383730 - DNA, 140 bp, Artificial Sequence
  Synthetic
caccgctgtcccaaaaggtctaaccaagtggagcagaagggagctgtgtctagtgatgcatgatatgagggctcacacgcgtaaccgtaggaggccagggctctgcccaaggcctcactacatatcagcagccagggcct

SEQ ID NO: 383731 - DNA, 140 bp, Artificial Sequence
  Synthetic
aggccctggctgctgatatggccgagtgcaatgcagatgggaagcgccatttcttcctgacaacggactttcggaggccgcttgctcgcatgtcgagtgagtacagtgaccctatggcttgaccttttgggacagcggtg

SEQ ID NO: 383732 - DNA, 140 bp, Artificial Sequence
  Synthetic
caccgctgtcccaaaaggtcaagccatagggtcactgtactcactcgacatgcgagcaagcggcctccgaaagtccgttgtcaggaagaaatggcgcttcccatctgcattgcactcggccatatcagcagccagggcct

SEQ ID NO: 383733 - DNA, 140 bp, Artificial Sequence
  Synthetic
aggccctggctgctgatatgcggccattggttacatcctcctgtacccctggcatcccatcacacggtgggtcatcatccctcacgtactaacttgtgcgtttaggggtggtggcacaccgaccttttgggacagcggtg

SEQ ID NO: 383734 - DNA, 140 bp, Artificial Sequence
  Synthetic
caccgctgtcccaaaaggtcggtgtgccaccacccctaaacgcacaagttagtacgtgagggatgatgacccaccgtgtgatgggatgccaggggtacaggaggatgtaaccaatggccgcatatcagcagccagggcct

SEQ ID NO: 383735 - DNA, 140 bp, Artificial Sequence
  Synthetic
aggccctggctgctgatatggtctgatccggtctggtgccaggttcatggcaattactacaagtttcctctggacaaactgcctaacatcatcgtggccctccacggtccagcagcgttggaccttttgggacagcggtg

SEQ ID NO: 383736 - DNA, 140 bp, Artificial Sequence
  Synthetic
caccgctgtcccaaaaggtccaacgctgctggaccgtggagggccacgatgatgttaggcagtttgtccagaggaaacttgtagtaattgccatgaacctggcaccagaccggatcagaccatatcagcagccagggcct

SEQ ID NO: 383737 - DNA, 140 bp, Artificial Sequence
  Synthetic
aggccctggctgctgatatgagggttaccgcagacactaccaaaacaaaaatggaggccggcaaggtgctgagcgacctcaagctcccgggcttggctgtccaccgtaagaaggccgggggaccttttgggacagcggtg

SEQ ID NO: 383738 - DNA, 140 bp, Artificial Sequence
  Synthetic
caccgctgtcccaaaaggtcccccggccttcttacggtggacagccaagcccgggagcttgaggtcgctcagcaccttgccggcctccatttttgttttggtagtgtctgcggtaaccctcatatcagcagccagggcct

SEQ ID NO: 383739 - DNA, 140 bp, Artificial Sequence
  Synthetic
aggccctggctgctgatatgcactgcgaacacgcatgctccggtcgcgcggatgggcagagctggctcggggcctgttgtggcatccaggcctccggctccctccacccgagattgctgggaccttttgggacagcggtg

SEQ ID NO: 383740 - DNA, 140 bp, Artificial Sequence
  Synthetic
caccgctgtcccaaaaggtcccagcaatctcgggtggagggagccggaggcctggatgccacaacaggccccgagccagctctgcccatccgcgcgaccggagcatgcgtgttcgcagtgcatatcagcagccagggcct

SEQ ID NO: 383741 - DNA, 140 bp, Artificial Sequence
  Synthetic
atacgccatgctgggtctccggcctgttgtggcatccaggcctccggctccctccacccgagattgctggaatcccgggtgggtttcccctgtcccccccctacatgggggtggttcatccgtacttgggagtcggccat

SEQ ID NO: 383742 - DNA, 140 bp, Artificial Sequence
  Synthetic
atggccgactcccaagtacggatgaaccacccccatgtaggggggggacaggggaaacccacccgggattccagcaatctcgggtggagggagccggaggcctggatgccacaacaggccggagacccagcatggcgtat

SEQ ID NO: 383743 - DNA, 140 bp, Artificial Sequence
  Synthetic
aggccctggctgctgatatgtgactgatcatcacctgaggaggttcccgccctccccgccccaggggtctccccgctgggtaaaaagggcccggccttgggaggcatggtggttactaacgaccttttgggacagcggtg

SEQ ID NO: 383744 - DNA, 140 bp, Artificial Sequence
  Synthetic
caccgctgtcccaaaaggtcgttagtaaccaccatgcctcccaaggccgggccctttttacccagcggggagacccctggggcggggagggcgggaacctcctcaggtgatgatcagtcacatatcagcagccagggcct

SEQ ID NO: 383745 - DNA, 140 bp, Artificial Sequence
  Synthetic
  misc_feature (25)..(25): n is a, c, g, or t
  misc_feature (28)..(28): n is a, c, g, or t
  misc_feature (67)..(67): n is a, c, g, or t
  misc_feature (91)..(91): n is a, c, g, or t
  misc_feature (115)..(115): n is a, c, g, or t
atacgccatgctgggtctccctgcnccntcagatgccaagacagtgacagatgcggtggcggccatncaggtgaactgcgattggtcggtnatgaccctgtcgatcggggaagtnctgaccgtacttgggagtcggccat

SEQ ID NO: 383746 - DNA, 140 bp, Artificial Sequence
  Synthetic
  misc_feature (26)..(26): n is a, c, g, or t
  misc_feature (50)..(50): n is a, c, g, or t
  misc_feature (74)..(74): n is a, c, g, or t
  misc_feature (113)..(113): n is a, c, g, or t
  misc_feature (116)..(116): n is a, c, g, or t
atggccgactcccaagtacggtcagnacttccccgatcgacagggtcatnaccgaccaatcgcagttcacctgnatggccgccaccgcatctgtcactgtcttggcatctganggngcagggagacccagcatggcgtat

SEQ ID NO: 383747 - DNA, 140 bp, Artificial Sequence
  Synthetic
  misc_feature (55)..(55): n is a, c, g, or t
aggccctggctgctgatatgtggctcaggctaagacagccgaggcctacgcagcnaccaccaagtggcttgctggctgctacacggggacgcgggccgtccccactgtatccattgttgagaccttttgggacagcggtg

SEQ ID NO: 383748 - DNA, 140 bp, Artificial Sequence
  Synthetic
  misc_feature (86)..(86): n is a, c, g, or t
caccgctgtcccaaaaggtctcaacaatggatacagtggggacggcccgcgtccccgtgtagcagccagcaagccacttggtggtngctgcgtaggcctcggctgtcttagcctgagccacatatcagcagccagggcct

SEQ ID NO: 383749 - DNA, 140 bp, Artificial Sequence
  Synthetic
aggccctggctgctgatatgggcacggtccacaggtgttggatgggtgatgccagggttggtaggtcgtaaatcccggtcatcatcttggtagccactataggtgggtcttaagcgttgggaccttttgggacagcggtg

SEQ ID NO: 383750 - DNA, 140 bp, Artificial Sequence
  Synthetic
caccgctgtcccaaaaggtcccaacgcttaagacccacctatagtggctaccaagatgatgaccgggatttacgacctaccaaccctggcatcacccatccaacacctgtggaccgtgcccatatcagcagccagggcct

SEQ ID NO: 383751 - DNA, 140 bp, Artificial Sequence
  Synthetic
atacgccatgctgggtctccaatcccggtcatcatcttggtagccactataggtgggtcttaagcgttggtcaagatccctcttgtgcttgcggcgagaaagcgcacggtccacaggtgtcgtacttgggagtcggccat

SEQ ID NO: 383752 - DNA, 140 bp, Artificial Sequence
  Synthetic
atggccgactcccaagtacgacacctgtggaccgtgcgctttctcgccgcaagcacaagagggatcttgaccaacgcttaagacccacctatagtggctaccaagatgatgaccgggattggagacccagcatggcgtat

SEQ ID NO: 383753 - DNA, 140 bp, Artificial Sequence
  Synthetic
atacgccatgctgggtctccggcggaccgggaaatgcatggggccacccagctccgcggcggcctgcagccggggtagcccaagaacccttcgggtgagggcgggtggcatttccttttccgtacttgggagtcggccat

SEQ ID NO: 383754 - DNA, 140 bp, Artificial Sequence
  Synthetic
atggccgactcccaagtacggaaaaggaaatgccacccgccctcacccgaagggttcttgggctaccccggctgcaggccgccgcggagctgggtggccccatgcatttcccggtccgccggagacccagcatggcgtat

SEQ ID NO: 383755 - DNA, 140 bp, Artificial Sequence
  Synthetic
aggccctggctgctgatatgtataccgatcatggcagtcctcctgcttttcatggttgtggaggccggggccatcttggccccggccacacacgcttgcagagcgaaggaccaatacttcgaccttttgggacagcggtg

SEQ ID NO: 383756 - DNA, 140 bp, Artificial Sequence
  Synthetic
caccgctgtcccaaaaggtcgaagtattggtccttcgctctgcaagcgtgtgtggccggggccaagatggccccggcctccacaaccatgaaaagcaggaggactgccatgatcggtatacatatcagcagccagggcct

SEQ ID NO: 383757 - DNA, 140 bp, Artificial Sequence
  Synthetic
aggccctggctgctgatatgctcacaaactgctgtgccccggaagacatagggttctgccttgagggcggatgccttgtggctctggggtgcacgatttgtaccgaccgttgctggccacgaccttttgggacagcggtg

SEQ ID NO: 383758 - DNA, 140 bp, Artificial Sequence
  Synthetic
caccgctgtcccaaaaggtcgtggccagcaacggtcggtacaaatcgtgcaccccagagccacaaggcatccgccctcaaggcagaaccctatgtcttccggggcacagcagtttgtgagcatatcagcagccagggcct

SEQ ID NO: 383759 - DNA, 140 bp, Artificial Sequence
  Synthetic
aggccctggctgctgatatgtgtatcaggcgggattggctgtgcgtcccggcaagtccgccgcccagttggtgggggagctcgggagcctttacgggcccctgtcggtgtccgcctatgtgaccttttgggacagcggtg

SEQ ID NO: 383760 - DNA, 140 bp, Artificial Sequence
  Synthetic
caccgctgtcccaaaaggtcacataggcggacaccgacaggggcccgtaaaggctcccgagctcccccaccaactgggcggcggacttgccgggacgcacagccaatcccgcctgatacacatatcagcagccagggcct

SEQ ID NO: 383761 - DNA, 140 bp, Artificial Sequence
  Synthetic
aggccctggctgctgatatgggcgggcatcttggggctcggcgaggtttactcgggagttctcaccgttggagtggcgttgacgcgccgggtctacccggtcccgaacctgacctgtgcagaccttttgggacagcggtg

SEQ ID NO: 383762 - DNA, 140 bp, Artificial Sequence
  Synthetic
caccgctgtcccaaaaggtctgcacaggtcaggttcgggaccgggtagacccggcgcgtcaacgccactccaacggtgagaactcccgagtaaacctcgccgagccccaagatgcccgcccatatcagcagccagggcct

SEQ ID NO: 383763 - DNA, 140 bp, Artificial Sequence
  Synthetic
aggccctggctgctgatatggtagaatgtgagctaaagtgggaaagtgagttttggagatggactgagcagttggcctccaactactggattctggactacctctggaaggtgccttttggaccttttgggacagcggtg

SEQ ID NO: 383764 - DNA, 140 bp, Artificial Sequence
  Synthetic
caccgctgtcccaaaaggtccaaaaggcaccttccagaggtagtccagaatccagtagttggaggccaactgctcagtccatctccaaaactcactttcccactttagctcacattctaccatatcagcagccagggcct

SEQ ID NO: 383765 - DNA, 140 bp, Artificial Sequence
  Synthetic
aggccctggctgctgatatgacttctggcgtggggtgatgagcctgacaccgctgttggtgtgtgttgcggcccttctcctgctggagcagaggattgtcatggtcttccttcttgtgacgaccttttgggacagcggtg

SEQ ID NO: 383766 - DNA, 140 bp, Artificial Sequence
  Synthetic
caccgctgtcccaaaaggtcgtcacaagaaggaagaccatgacaatcctctgctccagcaggagaagggccgcaacacacaccaacagcggtgtcaggctcatcaccccacgccagaagtcatatcagcagccagggcct

SEQ ID NO: 383767 - DNA, 140 bp, Artificial Sequence
  Synthetic
aggccctggctgctgatatgtatggcggggatgtcgcaaggcgcccccgcctcggtcctaggctcacgaccatttgagccgggattgacatggcagtcgtgctcgtgcagggcgaatggggaccttttgggacagcggtg

SEQ ID NO: 383768 - DNA, 140 bp, Artificial Sequence
  Synthetic
caccgctgtcccaaaaggtccccattcgccctgcacgagcacgactgccatgtcaatcccggctcaaatggtcgtgagcctaggaccgaggcgggggcgccttgcgacatccccgccatacatatcagcagccagggcct

SEQ ID NO: 383769 - DNA, 140 bp, Artificial Sequence
  Synthetic
aggccctggctgctgatatgtcgcgcgtgcccacaggggagcgggtttgggatcgagggaatgtcacacttctgtgtgatttgcccaacggcccctgggtctggatcccggccatttgccgaccttttgggacagcggtg

SEQ ID NO: 383770 - DNA, 140 bp, Artificial Sequence
  Synthetic
caccgctgtcccaaaaggtcggcaaatggccgggatccagacccaggggccgttgggcaaatcacacagaagtgtgacattccctcgatcccaaacccgctcccctgtgggcacgcgcgacatatcagcagccagggcct

SEQ ID NO: 383771 - DNA, 140 bp, Artificial Sequence
  Synthetic
aggccctggctgctgatatgaagcaattggctggggcgaccctataacccattggagccacggacaagatcagtggcccctctcatgtccccagtatgtctatggtgctgtttcagtgacgaccttttgggacagcggtg

SEQ ID NO: 383772 - DNA, 140 bp, Artificial Sequence
  Synthetic
caccgctgtcccaaaaggtcgtcactgaaacagcaccatagacatactggggacatgagaggggccactgatcttgtccgtggctccaatgggttatagggtcgccccagccaattgcttcatatcagcagccagggcct

SEQ ID NO: 383773 - DNA, 140 bp, Artificial Sequence
  Synthetic
aggccctggctgctgatatgatgcgtttggggttccgtgtcttggtttgcctccactggcggccgcgactcgaagatcgatgtgtggagtttggtgcctgttggctctgccagctgcaccgaccttttgggacagcggtg

SEQ ID NO: 383774 - DNA, 140 bp, Artificial Sequence
  Synthetic
caccgctgtcccaaaaggtcggtgcagctggcagagccaacaggcaccaaactccacacatcgatcttcgagtcgcggccgccagtggaggcaaaccaagacacggaaccccaaacgcatcatatcagcagccagggcct

SEQ ID NO: 383775 - DNA, 140 bp, Artificial Sequence
  Synthetic
aggccctggctgctgatatgatagccgctctcggttcatcggatcgcgataccgtagtggagctctccgagtgggggataccatgcgctacctgcattttggatcgtcggcctgcctcatgaccttttgggacagcggtg

SEQ ID NO: 383776 - DNA, 140 bp, Artificial Sequence
  Synthetic
caccgctgtcccaaaaggtcatgaggcaggccgacgatccaaaatgcaggtagcgcatggtatcccccactcggagagctccactacggtatcgcgatccgatgaaccgagagcggctatcatatcagcagccagggcct

SEQ ID NO: 383777 - DNA, 140 bp, Artificial Sequence
  Synthetic
aggccctggctgctgatatggcggcacctgtgtgcgggactgctggcccgagaccgggtcggtgcgcttcccattccatcggtgcggcgcggggccaaggctgacaaaggacttggaggcgaccttttgggacagcggtg

SEQ ID NO: 383778 - DNA, 140 bp, Artificial Sequence
  Synthetic
caccgctgtcccaaaaggtcgcctccaagtcctttgtcagccttggccccgcgccgcaccgatggaatgggaagcgcaccgacccggtctcgggccagcagtcccgcacacaggtgccgccatatcagcagccagggcct

SEQ ID NO: 383779 - DNA, 140 bp, Artificial Sequence
  Synthetic
aggccctggctgctgatatgtatacccttcgtcaacaggacaactcccttcaccataagaggccccctgggcaaccaggggagaggcaacccggtgcggtcgcccttgggttttgggtccgaccttttgggacagcggtg

SEQ ID NO: 383780 - DNA, 140 bp, Artificial Sequence
  Synthetic
caccgctgtcccaaaaggtcggacccaaaacccaagggcgaccgcaccgggttgcctctcccctggttgcccagggggcctcttatggtgaagggagttgtcctgttgacgaagggtatacatatcagcagccagggcct

SEQ ID NO: 383781 - DNA, 140 bp, Artificial Sequence
  Synthetic
aggccctggctgctgatatgtacaccatgaccaagatccgagactctttacatctggtgaaatgtcccaccccagccatcgagcctcccaccgggacgttcgggttcttccctgggacccgaccttttgggacagcggtg

SEQ ID NO: 383782 - DNA, 140 bp, Artificial Sequence
  Synthetic
caccgctgtcccaaaaggtcgggtcccagggaagaacccgaacgtcccggtgggaggctcgatggctggggtgggacatttcaccagatgtaaagagtctcggatcttggtcatggtgtacatatcagcagccagggcct

SEQ ID NO: 383783 - DNA, 140 bp, Artificial Sequence
  Synthetic
aggccctggctgctgatatgccccgctaaacaactgcatgctcttgggcacggaagtgtccgaggcactgggcggtgcggggctaacaggggggttctacgagcccctggtgcggcggtggaccttttgggacagcggtg

SEQ ID NO: 383784 - DNA, 140 bp, Artificial Sequence
  Synthetic
caccgctgtcccaaaaggtccaccgccgcaccaggggctcgtagaacccccctgttagccccgcaccgcccagtgcctcggacacttccgtgcccaagagcatgcagttgtttagcggggcatatcagcagccagggcct

SEQ ID NO: 383785 - DNA, 140 bp, Artificial Sequence
  Synthetic
aggccctggctgctgatatgttcagagttagctgggcggcgaaatccggtctgccctgggtttgcatggctctcctcgggcaggcctgatgggttcatacatgttcaggggcacttgcaggaccttttgggacagcggtg

SEQ ID NO: 383786 - DNA, 140 bp, Artificial Sequence
  Synthetic
caccgctgtcccaaaaggtcctgcaagtgcccctgaacatgtatgaacccatcaggcctgcccgaggagagccatgcaaacccagggcagaccggatttcgccgcccagctaactctgaacatatcagcagccagggcct

SEQ ID NO: 383787 - DNA, 140 bp, Artificial Sequence
  Synthetic
aggccctggctgctgatatggaagtggatgcaggcaacttcattccgcccccccgctggttgctcttggattttgtatttgtcctcctctatctgatgaagctggcggaggctaggttgggaccttttgggacagcggtg

SEQ ID NO: 383788 - DNA, 140 bp, Artificial Sequence
  Synthetic
caccgctgtcccaaaaggtcccaacctagcctccgccagcttcatcagatagaggaggacaaatacaaaatccaagagcaaccagcgggggggcggaatgaagttgcctgcatccacttccatatcagcagccagggcct

SEQ ID NO: 383789 - DNA, 140 bp, Artificial Sequence
  Synthetic
aggccctggctgctgatatgtcccgttgatacttctcctgctgtggtggtgggtgaaccagctggcggttttaggactgccggcggctcatgctgccgtggcgggcgaggtttttgcggggaccttttgggacagcggtg

SEQ ID NO: 383790 - DNA, 140 bp, Artificial Sequence
  Synthetic
caccgctgtcccaaaaggtccccgcaaaaacctcgcccgccacggcagcatgagccgccggcagtcctaaaaccgccagctggttcacccaccaccacagcaggagaagtatcaacgggacatatcagcagccagggcct

SEQ ID NO: 383791 - DNA, 140 bp, Artificial Sequence
  Synthetic
aggccctggctgctgatatgccctgccttgtcctggtgccttgggcttcccttcgtgagtatgatcctgggtctcgcaaacctggtgttgtacttccgttggatgggccctcaacgcctggaccttttgggacagcggtg

SEQ ID NO: 383792 - DNA, 140 bp, Artificial Sequence
  Synthetic
caccgctgtcccaaaaggtccaggcgttgagggcccatccaacggaagtacaacaccaggtttgcgagacccaggatcatactcacgaagggaagcccaaggcaccaggacaaggcagggcatatcagcagccagggcct

SEQ ID NO: 383793 - DNA, 140 bp, Artificial Sequence
  Synthetic
aggccctggctgctgatatgatgttcctcgtgttgtggaagctcgctcggggagcattcccactggctttgttgatggggatttcagccacccgtggccgcacctccgtgctcggagccggaccttttgggacagcggtg

SEQ ID NO: 383794 - DNA, 140 bp, Artificial Sequence
  Synthetic
caccgctgtcccaaaaggtccggctccgagcacggaggtgcggccacgggtggctgaaatccccatcaacaaagccagtgggaatgctccccgagcgagcttccacaacacgaggaacatcatatcagcagccagggcct

SEQ ID NO: 383795 - DNA, 140 bp, Artificial Sequence
  Synthetic
aggccctggctgctgatatgagttctgctttgatgtcaccttcgaagtggacacgtcagttttgggatgggtggtggccagcgtgatagcctgggccattgcgctcctgagctccatgaggaccttttgggacagcggtg

SEQ ID NO: 383796 - DNA, 140 bp, Artificial Sequence
  Synthetic
caccgctgtcccaaaaggtcctcatggagctcaggagcgcaatggcccaggctatcacgctggccaccacccatcccaaaactgacgtgtccacttcgaaggtgacatcaaagcagaactcatatcagcagccagggcct

SEQ ID NO: 383797 - DNA, 140 bp, Artificial Sequence
  Synthetic
aggccctggctgctgatatgcgccgggggctggaggcacaaggctgtgatctatagaacgtggtgtaaagggtaccagtggttgcgtcacgaagtggtgcggacccccctcggggagggggaccttttgggacagcggtg

SEQ ID NO: 383798 - DNA, 140 bp, Artificial Sequence
  Synthetic
caccgctgtcccaaaaggtccccctccccgaggggggtccgcaccacttcgtgacgcaaccactggtaccctttacaccacgttctatagatcacagccttgtgcctccagcccccggcgcatatcagcagccagggcct

SEQ ID NO: 383799 - DNA, 140 bp, Artificial Sequence
  Synthetic
aggccctggctgctgatatgcggcccaccaagccgttgaccatcgcttggtgctttgcttcctacatctggcccgaagccgtgatgctggtggttgttgggctggtaccctggtttgcccgaccttttgggacagcggtg

SEQ ID NO: 383800 - DNA, 140 bp, Artificial Sequence
  Synthetic
caccgctgtcccaaaaggtcgggcaaaccagggtaccagcccaacaaccaccagcatcacggcttcgggccagatgtaggaagcaaagcaccaagcgatggtcaacggcttggtgggccgcatatcagcagccagggcct

SEQ ID NO: 383801 - DNA, 140 bp, Artificial Sequence
  Synthetic
atacgccatgctgggtctccgcccgaagccgtgatgctggtggttgttgggctggtaccctggtttgccctgttcgacgcgttggattgggccttggaggagatcttggtgtcccggccccgtacttgggagtcggccat

SEQ ID NO: 383802 - DNA, 140 bp, Artificial Sequence
  Synthetic
atggccgactcccaagtacggggccgggacaccaagatctcctccaaggcccaatccaacgcgtcgaacagggcaaaccagggtaccagcccaacaaccaccagcatcacggcttcgggcggagacccagcatggcgtat

SEQ ID NO: 383803 - DNA, 140 bp, Artificial Sequence
  Synthetic
atacgccatgctgggtctcctcgttgcggcgtttggctcgggtggttgagtgctgtgtgatggcgggtgagaaggccacaaccgtccggctggtctccaagatgtgtgcgcgtggggcctcgtacttgggagtcggccat

SEQ ID NO: 383804 - DNA, 140 bp, Artificial Sequence
  Synthetic
atggccgactcccaagtacgaggccccacgcgcacacatcttggagaccagccggacggttgtggccttctcacccgccatcacacagcactcaaccacccgagccaaacgccgcaacgaggagacccagcatggcgtat

SEQ ID NO: 383805 - DNA, 140 bp, Artificial Sequence
  Synthetic
aggccctggctgctgatatgatttgttcgaccatatgggctctttttcgcgctcggtcaaggaacgcctgctgcattgggacgcggccttggaacccctgtctttcaccaggacggactggaccttttgggacagcggtg

SEQ ID NO: 383806 - DNA, 140 bp, Artificial Sequence
  Synthetic
caccgctgtcccaaaaggtccagtccgtcctggtgaaagacaggggttccaaggccgcgtcccaatgcagcaggcgttccttgaccgagcgcgaaaaagagcccatatggtcgaacaaatcatatcagcagccagggcct

SEQ ID NO: 383807 - DNA, 140 bp, Artificial Sequence
  Synthetic
aggccctggctgctgatatgtcgcatcatcagagatgctgctcggacctttgtctgcggtcagtgtgtcacgggcttgcccgtggtcgatcgccgcggtgatgaggtcttgataggcgtcgaccttttgggacagcggtg

SEQ ID NO: 383808 - DNA, 140 bp, Artificial Sequence
  Synthetic
caccgctgtcccaaaaggtcgacgcctatcaagacctcatcaccgcggcgatcgaccacgggcaagcccgtgacacactgaccgcagacaaaggtccgagcagcatctctgatgatgcgacatatcagcagccagggcct

SEQ ID NO: 383809 - DNA, 140 bp, Artificial Sequence
  Synthetic
aggccctggctgctgatatgttccaagatgtgaaccatttgcctccagggtttgtccccactgcaccagttgtcatccgtcggtgcggtaagggcttccttggtgtcactaaggctgcctgaccttttgggacagcggtg

SEQ ID NO: 383810 - DNA, 140 bp, Artificial Sequence
  Synthetic
caccgctgtcccaaaaggtcaggcagccttagtgacaccaaggaagcccttaccgcaccgacggatgacaactggtgcagtggggacaaaccctggaggcaaatggttcacatcttggaacatatcagcagccagggcct

SEQ ID NO: 383811 - DNA, 140 bp, Artificial Sequence
  Synthetic
aggccctggctgctgatatgtgacgggtcgggatcctgacttacatccagggaacgtcatggtgttggggacggcaacgtcgcgaagcatgggaacatgcttaaacggcctgctgttcacgaccttttgggacagcggtg

SEQ ID NO: 383812 - DNA, 140 bp, Artificial Sequence
  Synthetic
caccgctgtcccaaaaggtcgtgaacagcaggccgtttaagcatgttcccatgcttcgcgacgttgccgtccccaacaccatgacgttccctggatgtaagtcaggatcccgacccgtcacatatcagcagccagggcct

SEQ ID NO: 383813 - DNA, 140 bp, Artificial Sequence
  Synthetic
aggccctggctgctgatatggactttccatggggcttcatcccgaaccatcgccacacctgtaggagcctcaaatccaaggtggtggtccgccgatgacgatgtcactgtgtaccccctcgaccttttgggacagcggtg

SEQ ID NO: 383814 - DNA, 140 bp, Artificial Sequence
  Synthetic
caccgctgtcccaaaaggtcgagggggtacacagtgacatcgtcatcggcggaccaccaccttggatttgaggctcctacaggtgtggcgatggttcgggatgaagccccatggaaagtccatatcagcagccagggcct

SEQ ID NO: 383815 - DNA, 140 bp, Artificial Sequence
  Synthetic
aggccctggctgctgatatgccggacggagcaaactcgttgactccttgcacttgccaggctgagtcctgttgggtcatgagatccgacggggccctatgccatggcttgagcaaggggggaccttttgggacagcggtg

SEQ ID NO: 383816 - DNA, 140 bp, Artificial Sequence
  Synthetic
caccgctgtcccaaaaggtccccccttgctcaagccatggcatagggccccgtcggatctcatgacccaacaggactcagcctggcaagtgcaaggagtcaacgagtttgctccgtccggcatatcagcagccagggcct

SEQ ID NO: 383817 - DNA, 140 bp, Artificial Sequence
  Synthetic
atacgccatgctgggtctcctctggctcaccggtcctatgtgacgaagggcacgcagtaggaatgctcgtgtccgtgcttcactccgggggtcgggtcacagcggcccggttcactcggccgtacttgggagtcggccat

SEQ ID NO: 383818 - DNA, 140 bp, Artificial Sequence
  Synthetic
atggccgactcccaagtacggccgagtgaaccgggccgctgtgacccgacccccggagtgaagcacggacacgagcattcctactgcgtgcccttcgtcacataggaccggtgagccagaggagacccagcatggcgtat

SEQ ID NO: 383819 - DNA, 140 bp, Artificial Sequence
  Synthetic
aggccctggctgctgatatgcgtggacccaagtcccaacagacgccaagactaccactgagtccccaccggttccggcaaaaggagtgttcaaggaggccccgttgtttatgcatacggggaccttttgggacagcggtg

SEQ ID NO: 383820 - DNA, 140 bp, Artificial Sequence
  Synthetic
caccgctgtcccaaaaggtccccgtatgcataaacaacggggcctccttgaacactccttttgccggaaccggtggggactcagtggtagtcttggcgtctgttgggacttgggtccacgcatatcagcagccagggcct

SEQ ID NO: 383821 - DNA, 140 bp, Artificial Sequence
  Synthetic
aggccctggctgctgatatgagccggtaagagcacacgggtcccgctggaatatggcaacatgggtcataaggtcctcattctcaacccgtcagtggccacggtgcgggccatgggccccgaccttttgggacagcggtg

SEQ ID NO: 383822 - DNA, 140 bp, Artificial Sequence
  Synthetic
caccgctgtcccaaaaggtcggggcccatggcccgcaccgtggccactgacgggttgagaatgaggaccttatgacccatgttgccatattccagcgggacccgtgtgctcttaccggctcatatcagcagccagggcct

SEQ ID NO: 383823 - DNA, 140 bp, Artificial Sequence
  Synthetic
aggccctggctgctgatatgtacatggaacgcttggcggggaaacatccaagcatttactgtgggcacgatacaacagcattcactaggatcaccgactcccccttgacgtattctacctgaccttttgggacagcggtg

SEQ ID NO: 383824 - DNA, 140 bp, Artificial Sequence
  Synthetic
caccgctgtcccaaaaggtcaggtagaatacgtcaagggggagtcggtgatcctagtgaatgctgttgtatcgtgcccacagtaaatgcttggatgtttccccgccaagcgttccatgtacatatcagcagccagggcct

SEQ ID NO: 383825 - DNA, 140 bp, Artificial Sequence
  Synthetic
aggccctggctgctgatatgacggtaggttcctggccaatcctaggcagatgctgaggggagtttcggtggtcatttgtgatgagtgccacagtcatgactcaactgtgttgctggggatgaccttttgggacagcggtg

SEQ ID NO: 383826 - DNA, 140 bp, Artificial Sequence
  Synthetic
caccgctgtcccaaaaggtcatccccagcaacacagttgagtcatgactgtggcactcatcacaaatgaccaccgaaactcccctcagcatctgcctaggattggccaggaacctaccgtcatatcagcagccagggcct

SEQ ID NO: 383827 - DNA, 140 bp, Artificial Sequence
  Synthetic
aggccctggctgctgatatgaggacgggttagggaattggcacgtggctgtggggtccaactggtcctctacgccaccgccacaccccctggctctccgatggtccagcatccttcaatcgaccttttgggacagcggtg

SEQ ID NO: 383828 - DNA, 140 bp, Artificial Sequence
  Synthetic
caccgctgtcccaaaaggtcgattgaaggatgctggaccatcggagagccagggggtgtggcggtggcgtagaggaccagttggaccccacagccacgtgccaattccctaacccgtcctcatatcagcagccagggcct

SEQ ID NO: 383829 - DNA, 140 bp, Artificial Sequence
  Synthetic
aggccctggctgctgatatgattgagaccaagttggatgtaggtgagatccccttttatgggcatggtatccccttggagcggatgcgtaccggcaggcatctcgtattctgccactcaagaccttttgggacagcggtg

SEQ ID NO: 383830 - DNA, 140 bp, Artificial Sequence
  Synthetic
caccgctgtcccaaaaggtcttgagtggcagaatacgagatgcctgccggtacgcatccgctccaaggggataccatgcccataaaaggggatctcacctacatccaacttggtctcaatcatatcagcagccagggcct

SEQ ID NO: 383831 - DNA, 140 bp, Artificial Sequence
  Synthetic
aggccctggctgctgatatgaggcggagtgcgagcgcttggcgggccaattctcctcccggggggtcaatgccattgcctattataggggcaaggacagttctatcatcaaagatggagagaccttttgggacagcggtg

SEQ ID NO: 383832 - DNA, 140 bp, Artificial Sequence
  Synthetic
caccgctgtcccaaaaggtctctccatctttgatgatagaactgtccttgcccctataataggcaatggcattgaccccccgggaggagaattggcccgccaagcgctcgcactccgcctcatatcagcagccagggcct

SEQ ID NO: 383833 - DNA, 140 bp, Artificial Sequence
  Synthetic
aggccctggctgctgatatgcctcgtggtttgtgcgacagacgcgctctccacggggtacacaggaaacttcgactccgtcaccgactgtggattagtggtggaggaggtcgttgaggtggaccttttgggacagcggtg

SEQ ID NO: 383834 - DNA, 140 bp, Artificial Sequence
  Synthetic
caccgctgtcccaaaaggtccacctcaacgacctcctccaccactaatccacagtcggtgacggagtcgaagtttcctgtgtaccccgtggagagcgcgtctgtcgcacaaaccacgaggcatatcagcagccagggcct

SEQ ID NO: 383835 - DNA, 140 bp, Artificial Sequence
  Synthetic
aggccctggctgctgatatgacccttgatcccaccattaccatctccctgcggacagtgcctgcttcggctgaactgtcgatgcagcggcgaggtcgcacgggcaggggccggtctggtcgaccttttgggacagcggtg

SEQ ID NO: 383836 - DNA, 140 bp, Artificial Sequence
  Synthetic
caccgctgtcccaaaaggtcgaccagaccggcccctgcccgtgcgacctcgccgctgcatcgacagttcagccgaagcaggcactgtccgcagggagatggtaatggtgggatcaagggtcatatcagcagccagggcct

SEQ ID NO: 383837 - DNA, 140 bp, Artificial Sequence
  Synthetic
aggccctggctgctgatatgggtactactacgctggtgtagggaaagcaccggtgggggtggtccgatctggcccggtctggtcggcggtggaagctggagtgacttggtatggaatggagaccttttgggacagcggtg

SEQ ID NO: 383838 - DNA, 140 bp, Artificial Sequence
  Synthetic
caccgctgtcccaaaaggtctccattccataccaagtcactccagcttccaccgccgaccagaccgggccagatcggaccacccccaccggtgctttccctacaccagcgtagtagtacccatatcagcagccagggcct

SEQ ID NO: 383839 - DNA, 140 bp, Artificial Sequence
  Synthetic
aggccctggctgctgatatgacctgatctgacagcaaaccttctgagactatacgatgactgcccttacaccgcagccatcgcagcagacatcggggaagccgcggtgttcttctcgggtgaccttttgggacagcggtg

SEQ ID NO: 383840 - DNA, 140 bp, Artificial Sequence
  Synthetic
caccgctgtcccaaaaggtcacccgagaagaacaccgcggcttccccgatgtctgctgcgatggctgcggtgtaagggcagtcatcgtatagtctcagaaggtttgctgtcagatcaggtcatatcagcagccagggcct

SEQ ID NO: 383841 - DNA, 140 bp, Artificial Sequence
  Synthetic
aggccctggctgctgatatgctcgcacccctgaggatgcatcctgatgtcagctgggcaaaagtgcgcggcgtcaactggcccctcctggtgggtgttcagcggacgatgtgccgggaaagaccttttgggacagcggtg

SEQ ID NO: 383842 - DNA, 140 bp, Artificial Sequence
  Synthetic
caccgctgtcccaaaaggtctttcccggcacatcgtccgctgaacacccaccaggaggggccagttgacgccgcgcacttttgcccagctgacatcaggatgcatcctcaggggtgcgagcatatcagcagccagggcct

SEQ ID NO: 383843 - DNA, 140 bp, Artificial Sequence
  Synthetic
aggccctggctgctgatatgcactgtcaaccggcccgtcggacgaaccccagtgggcaggtctgaaaagtccgaatcctgtcccgctactgctgaggtggggcaatgatttaccatcaaagaccttttgggacagcggtg

SEQ ID NO: 383844 - DNA, 140 bp, Artificial Sequence
  Synthetic
caccgctgtcccaaaaggtctttgatggtaaatcattgccccacctcagcagtagcgggacaggattcggacttttcagacctgcccactggggttcgtccgacgggccggttgacagtgcatatcagcagccagggcct

SEQ ID NO: 383845 - DNA, 140 bp, Artificial Sequence
  Synthetic
aggccctggctgctgatatgagtggccggccaccacattgtggacgatctggtcagaagactcggtgtggctgagggttacgtccgttgtgatgctgggcccatcttaatggtgggcctcgaccttttgggacagcggtg

SEQ ID NO: 383846 - DNA, 140 bp, Artificial Sequence
  Synthetic
caccgctgtcccaaaaggtcgaggcccaccattaagatgggcccagcatcacaacggacgtaaccctcagccacaccgagtcttctgaccagatcgtccacaatgtggtggccggccactcatatcagcagccagggcct

SEQ ID NO: 383847 - DNA, 140 bp, Artificial Sequence
  Synthetic
aggccctggctgctgatatggcaattgcagggggcatgatctacgcctcatacaccgggtccctagtggtggtgacagactgggatgtgaaggggggtggcaaccccctttataggaatggaccttttgggacagcggtg

SEQ ID NO: 383848 - DNA, 140 bp, Artificial Sequence
  Synthetic
caccgctgtcccaaaaggtccattcctataaagggggttgccaccccccttcacatcccagtctgtcaccaccactagggacccggtgtatgaggcgtagatcatgccccctgcaattgccatatcagcagccagggcct

SEQ ID NO: 383849 - DNA, 140 bp, Artificial Sequence
  Synthetic
aggccctggctgctgatatggagaccaggccactcctcaacctgtggtgcaggtccctccggtagaccatcggccggggggggaatcggcaccatcagatgccaacacagtgacagatgcgaccttttgggacagcggtg

SEQ ID NO: 383850 - DNA, 140 bp, Artificial Sequence
  Synthetic
caccgctgtcccaaaaggtcgcatctgtcactgtgttggcatctgatggtgccgattccccccccggccgatggtctaccggagggacctgcaccacaggttgaggagtggcctggtctccatatcagcagccagggcct

SEQ ID NO: 383851 - DNA, 140 bp, Artificial Sequence
  Synthetic
aggccctggctgctgatatgggtggcagccatccaggtggactgcgattggtctatcatgaccctgtcgatcggggaagtgctgtccttggctcaggctaaaacagctgaggcctacacggaccttttgggacagcggtg

SEQ ID NO: 383852 - DNA, 140 bp, Artificial Sequence
  Synthetic
caccgctgtcccaaaaggtccgtgtaggcctcagctgttttagcctgagccaaggacagcacttccccgatcgacagggtcatgatagaccaatcgcagtccacctggatggctgccacccatatcagcagccagggcct

SEQ ID NO: 383853 - DNA, 140 bp, Artificial Sequence
  Synthetic
aggccctggctgctgatatggcaaccgccaagtggctcgctggctgctacacggggacgcgggccgttcccactgtttcaattgttgacaagctcttcgccgggggttgggccgccgtgggaccttttgggacagcggtg

SEQ ID NO: 383854 - DNA, 140 bp, Artificial Sequence
  Synthetic
caccgctgtcccaaaaggtcccacggcggcccaacccccggcgaagagcttgtcaacaattgaaacagtgggaacggcccgcgtccccgtgtagcagccagcgagccacttggcggttgccatatcagcagccagggcct

SEQ ID NO: 383855 - DNA, 140 bp, Artificial Sequence
  Synthetic
aggccctggctgctgatatgtgggtcactgtcacagcgtcattgctgcggcggtggctgcctatggagcttctcgaagtcctccactggccgcggcggcgtcctacctcatggggttggggaccttttgggacagcggtg

SEQ ID NO: 383856 - DNA, 140 bp, Artificial Sequence
  Synthetic
caccgctgtcccaaaaggtccccaaccccatgaggtaggacgccgccgcggccagtggaggacttcgagaagctccataggcagccaccgccgcagcaatgacgctgtgacagtgacccacatatcagcagccagggcct

SEQ ID NO: 383857 - DNA, 140 bp, Artificial Sequence
  Synthetic
aggccctggctgctgatatgcgtcggaggcaacgcacaggcgcgcttggcttcagctcttctactgggggctgctggaaccgccttgggcactcctgtcgtgggcttgaccatggcaggtgaccttttgggacagcggtg

SEQ ID NO: 383858 - DNA, 140 bp, Artificial Sequence
  Synthetic
caccgctgtcccaaaaggtcacctgccatggtcaagcccacgacaggagtgcccaaggcggttccagcagcccccagtagaagagctgaagccaagcgcgcctgtgcgttgcctccgacgcatatcagcagccagggcct

SEQ ID NO: 383859 - DNA, 140 bp, Artificial Sequence
  Synthetic
aggccctggctgctgatatggggggccgtcggaggttgggagggcgttgtcaacgctgccagtctcgtcttcgacttcatggctgggaaactatcgtcagaagatctgtggtacgccatcgaccttttgggacagcggtg

SEQ ID NO: 383860 - DNA, 140 bp, Artificial Sequence
  Synthetic
caccgctgtcccaaaaggtcgatggcgtaccacagatcttctgacgatagtttcccagccatgaagtcgaagacgagactggcagcgttgacaacgccctcccaacctccgacggccccccatatcagcagccagggcct

SEQ ID NO: 383861 - DNA, 140 bp, Artificial Sequence
  Synthetic
aggccctggctgctgatatgccagtgctcaccagcccgggggcgggccttgcggggatcgcccttgggttggtgctgtactcagctaacaactctggcactaccacttggttgaaccgtcgaccttttgggacagcggtg

SEQ ID NO: 383862 - DNA, 140 bp, Artificial Sequence
  Synthetic
caccgctgtcccaaaaggtcgacggttcaaccaagtggtagtgccagagttgttagctgagtacagcaccaacccaagggcgatccccgcaaggcccgcccccgggctggtgagcactggcatatcagcagccagggcct

SEQ ID NO: 383863 - DNA, 140 bp, Artificial Sequence
  Synthetic
aggccctggctgctgatatgtgctaaccacacttccccggtcttcttgcatcccggatagctatttccaacaggccgactactgtgacaaagtctcagccatgttgcgccgcttgagcctgaccttttgggacagcggtg

SEQ ID NO: 383864 - DNA, 140 bp, Artificial Sequence
  Synthetic
caccgctgtcccaaaaggtcaggctcaagcggcgcaacatggctgagactttgtcacagtagtcggcctgttggaaatagctatccgggatgcaagaagaccggggaagtgtggttagcacatatcagcagccagggcct

SEQ ID NO: 383865 - DNA, 140 bp, Artificial Sequence
  Synthetic
aggccctggctgctgatatgcactcggactgtggtagccctggtcaacagggagccccgggtcgatgaggtccaggtggggtacgtctgggacctgtgggaatggatcatgcgccaggtggaccttttgggacagcggtg

SEQ ID NO: 383866 - DNA, 140 bp, Artificial Sequence
  Synthetic
caccgctgtcccaaaaggtccacctggcgcatgatccattcccacaggtcccagacgtaccccacctggacctcatcgacccggggctccctgttgaccagggctaccacagtccgagtgcatatcagcagccagggcct

SEQ ID NO: 383867 - DNA, 140 bp, Artificial Sequence
  Synthetic
aggccctggctgctgatatgcgcatggtcatagccagagtacgggccctctgccccgtggtgtcactgcctttgtggcactgcggggaggggtggtccggagaatggttgttagacggccgaccttttgggacagcggtg

SEQ ID NO: 383868 - DNA, 140 bp, Artificial Sequence
  Synthetic
caccgctgtcccaaaaggtcggccgtctaacaaccattctccggaccacccctccccgcagtgccacaaaggcagtgacaccacggggcagagggcccgtactctggctatgaccatgcgcatatcagcagccagggcct

SEQ ID NO: 383869 - DNA, 140 bp, Artificial Sequence
  Synthetic
aggccctggctgctgatatgatgtggagagtcgctgtctgtgtgggtgtgtgatcactggggacgtgctgaatgggcaactcaaagatccaagttactctaccaagctgtgccggcactagaccttttgggacagcggtg

SEQ ID NO: 383870 - DNA, 140 bp, Artificial Sequence
  Synthetic
caccgctgtcccaaaaggtctagtgccggcacagcttggtagagtaacttggatctttgagttgcccattcagcacgtccccagtgatcacacacccacacagacagcgactctccacatcatatcagcagccagggcct

SEQ ID NO: 383871 - DNA, 140 bp, Artificial Sequence
  Synthetic
aggccctggctgctgatatgttggatggggactgttccggtcaacatgctggggtatggggagacatcgcccctcctagcctctgacacgccgaagtcgtacctttcggcacgtcgggctgaccttttgggacagcggtg

SEQ ID NO: 383872 - DNA, 140 bp, Artificial Sequence
  Synthetic
caccgctgtcccaaaaggtcagcccgacgtgccgaaaggtacgacttcggcgtgtcagaggctaggaggggcgatgtctccccataccccagcatgttgaccggaacagtccccatccaacatatcagcagccagggcct

SEQ ID NO: 383873 - DNA, 140 bp, Artificial Sequence
  Synthetic
aggccctggctgctgatatggggcggagggtggtggtgacccctacccacgtggtgatccgacggacttcatgctacaagttgttgcgcccacaaatactctctgcagctgtagctgagcgaccttttgggacagcggtg

SEQ ID NO: 383874 - DNA, 140 bp, Artificial Sequence
  Synthetic
caccgctgtcccaaaaggtcgctcagctacagctgcagagagtatttgtgggcgcaacaacttgtagcatgaagtccgtcggatcaccacgtgggtaggggtcaccaccaccctccgccccatatcagcagccagggcct

SEQ ID NO: 383875 - DNA, 140 bp, Artificial Sequence
  Synthetic
aggccctggctgctgatatgcctactatgtggatggcattcctgtctcatgggaggccgacgctcgcgcgccggcaatggtctacggccctggccaaagcgtcaccattgacggggaacggaccttttgggacagcggtg

SEQ ID NO: 383876 - DNA, 140 bp, Artificial Sequence
  Synthetic
caccgctgtcccaaaaggtccgttccccgtcaatggtgacgctttggccagggccgtagaccattgccggcgcgcgagcgtcggcctcccatgagacaggaatgccatccacatagtaggcatatcagcagccagggcct

SEQ ID NO: 383877 - DNA, 140 bp, Artificial Sequence
  Synthetic
aggccctggctgctgatatgctacacccttccgcaccaactgcggatgaggaacgtggcgccctctgaggtttcgtctgaggtcagcatcgagattgggacggagactgaagactcagaagaccttttgggacagcggtg

SEQ ID NO: 383878 - DNA, 140 bp, Artificial Sequence
  Synthetic
caccgctgtcccaaaaggtcttctgagtcttcagtctccgtcccaatctcgatgctgacctcagacgaaacctcagagggcgccacgttcctcatccgcagttggtgcggaagggtgtagcatatcagcagccagggcct

SEQ ID NO: 383879 - DNA, 140 bp, Artificial Sequence
  Synthetic
atacgccatgctgggtctcctttcgtctgaggtcagcatcgagattgggacggagactgaagactcagaactgactgaggcagatctgccacccgcagctgcggcccttcaagcgatcgacgtacttgggagtcggccat

SEQ ID NO: 383880 - DNA, 140 bp, Artificial Sequence
  Synthetic
atggccgactcccaagtacgtcgatcgcttgaagggccgcagctgcgggtggcagatctgcctcagtcagttctgagtcttcagtctccgtcccaatctcgatgctgacctcagacgaaaggagacccagcatggcgtat

SEQ ID NO: 383881 - DNA, 140 bp, Artificial Sequence
  Synthetic
aggccctggctgctgatatggaatgctgcgagaattcttgaaccgcacattgatgtcatcatggaggactgcagtacaccctctctttgtggtagtagccgagagatgcctgtatggggagaccttttgggacagcggtg

SEQ ID NO: 383882 - DNA, 140 bp, Artificial Sequence
  Synthetic
caccgctgtcccaaaaggtctccccatacaggcatctctcggctactaccacaaagagagggtgtactgcagtcctccatgatgacatcaatgtgcggttcaagaattctcgcagcattccatatcagcagccagggcct

SEQ ID NO: 383883 - DNA, 140 bp, Artificial Sequence
  Synthetic
atacgccatgctgggtctccgcagtacaccctctctttgtggtagtagccgagagatgcctgtatggggagaagacatcccccgcactccatcgccagcacttatctcggttaccgagagcgtacttgggagtcggccat

SEQ ID NO: 383884 - DNA, 140 bp, Artificial Sequence
  Synthetic
atggccgactcccaagtacgctctcggtaaccgagataagtgctggcgatggagtgcgggggatgtcttctccccatacaggcatctctcggctactaccacaaagagagggtgtactgcggagacccagcatggcgtat

SEQ ID NO: 383885 - DNA, 140 bp, Artificial Sequence
  Synthetic
aggccctggctgctgatatgcagctcagatgagaagaccctgtcggtgtcctcctcgcaggaggacaccccgtcctctgactcattggaagtcatccaagagtccgagacagccgaaacggaccttttgggacagcggtg

SEQ ID NO: 383886 - DNA, 140 bp, Artificial Sequence
  Synthetic
caccgctgtcccaaaaggtccgtttcggctgtctcggactcttggatgacttccaatgagtcagaggacggggtgtcctcctgcgaggaggacaccgacagggtcttctcatctgagctgcatatcagcagccagggcct

SEQ ID NO: 383887 - DNA, 140 bp, Artificial Sequence
  Synthetic
aggccctggctgctgatatggaggaaagcgtcttcaacgtggctctttccgtactagaagccttctttccacagagcgacgcgactaggaagcttaccgtcaagatgtcgtgctgcgttggaccttttgggacagcggtg

SEQ ID NO: 383888 - DNA, 140 bp, Artificial Sequence
  Synthetic
caccgctgtcccaaaaggtccaacgcagcacgacatcttgacggtaagcttcctagtcgcgtcgctctgtggaaagaaggcttctagtacggaaagagccacgttgaagacgctttcctccatatcagcagccagggcct

SEQ ID NO: 383889 - DNA, 140 bp, Artificial Sequence
  Synthetic
atacgccatgctgggtctccggtgcgcactccgctcgaattgcaagttgggtgcttggtgggcaatgaacttacctttgaatgtgacaaatgtgaggcacggcaagagaccttggcttcccgtacttgggagtcggccat

SEQ ID NO: 383890 - DNA, 140 bp, Artificial Sequence
  Synthetic
atggccgactcccaagtacgggaagccaaggtctcttgccgtgcctcacatttgtcacattcaaaggtaagttcattgcccaccaagcacccaacttgcaattcgagcggagtgcgcaccggagacccagcatggcgtat

SEQ ID NO: 383891 - DNA, 140 bp, Artificial Sequence
  Synthetic
aggccctggctgctgatatgttttcctacatctggtctggggtgccgctgacgcgggcaacgccggccaaacctccagtggtgcggccggtggggtccctattagtggcggacaccaccagaccttttgggacagcggtg

SEQ ID NO: 383892 - DNA, 140 bp, Artificial Sequence
  Synthetic
caccgctgtcccaaaaggtctggtggtgtccgccactaatagggaccccaccggccgcaccactggaggtttggccggcgttgcccgcgtcagcggcaccccagaccagatgtaggaaaacatatcagcagccagggcct

SEQ ID NO: 383893 - DNA, 140 bp, Artificial Sequence
  Synthetic
aggccctggctgctgatatgaggtgtatgtgaccaacccggacaatgtgggtagaagggttgacaaggtgaccttttggcgcgctcctcgggttcacgacaagtttctcgtggactcgatgaccttttgggacagcggtg

SEQ ID NO: 383894 - DNA, 140 bp, Artificial Sequence
  Synthetic
caccgctgtcccaaaaggtcatcgagtccacgagaaacttgtcgtgaacccgaggagcgcgccaaaaggtcaccttgtcaacccttctacccacattgtccgggttggtcacatacacctcatatcagcagccagggcct

SEQ ID NO: 383895 - DNA, 140 bp, Artificial Sequence
  Synthetic
aggccctggctgctgatatgcgagcgggctcggaaggccgctcaagccagcctaagcatgggttacacttatgaggaggcaataaggactgttaggccgcatgctgccatgggctggggagaccttttgggacagcggtg

SEQ ID NO: 383896 - DNA, 140 bp, Artificial Sequence
  Synthetic
caccgctgtcccaaaaggtctccccagcccatggcagcatgcggcctaacagtccttattgcctcctcataagtgtaacccatgcttaggctggcttgagcggccttccgagcccgctcgcatatcagcagccagggcct

SEQ ID NO: 383897 - DNA, 140 bp, Artificial Sequence
  Synthetic
aggccctggctgctgatatgtctaaggtgtcagtcaaggacttggccacccccgcggggaagatggccgtccacgacaggctccaagagatacttgaagggactccggtcccctttacctgaccttttgggacagcggtg

SEQ ID NO: 383898 - DNA, 140 bp, Artificial Sequence
  Synthetic
caccgctgtcccaaaaggtcaggtaaaggggaccggagtcccttcaagtatctcttggagcctgtcgtggacggccatcttccccgcgggggtggccaagtccttgactgacaccttagacatatcagcagccagggcct

SEQ ID NO: 383899 - DNA, 140 bp, Artificial Sequence
  Synthetic
aggccctggctgctgatatgtgactgtgaaaaaggaggtgttcttcaaagaccgtaaggaggagaaggccccccgcctcattgtgttccctcccctggactttcggatagctgaaaagctgaccttttgggacagcggtg

SEQ ID NO: 383900 - DNA, 140 bp, Artificial Sequence
  Synthetic
caccgctgtcccaaaaggtcagcttttcagctatccgaaagtccaggggagggaacacaatgaggcggggggccttctcctccttacggtctttgaagaacacctcctttttcacagtcacatatcagcagccagggcct

SEQ ID NO: 383901 - DNA, 140 bp, Artificial Sequence
  Synthetic
aggccctggctgctgatatgaatcctgggagacccggggcgagtggccaaagccggtgttggggggcgttacgccttccagtacactccaaaccagcgagttaaggagatgctgagactagaccttttgggacagcggtg

SEQ ID NO: 383902 - DNA, 140 bp, Artificial Sequence
  Synthetic
caccgctgtcccaaaaggtctagtctcagcatctccttaactcgctggtttggagtgtactggaaggcgtaacgccccccaacaccggctttggccactcgccccgggtctcccaggattcatatcagcagccagggcct

SEQ ID NO: 383903 - DNA, 140 bp, Artificial Sequence
  Synthetic
atacgccatgctgggtctccacgccttccagtacactccaaaccagcgagttaaggagatgctgagactatgggagtcaaagaagaccccgtgcgccatctgtgtggacgccacctgcttcgtacttgggagtcggccat

SEQ ID NO: 383904 - DNA, 140 bp, Artificial Sequence
  Synthetic
atggccgactcccaagtacgaagcaggtggcgtccacacagatggcgcacggggtcttctttgactcccatagtctcagcatctccttaactcgctggtttggagtgtactggaaggcgtggagacccagcatggcgtat

SEQ ID NO: 383905 - DNA, 140 bp, Artificial Sequence
  Synthetic
atacgccatgctgggtctccctctggcctctgaccatccagaatgggtgcgggcacttgggaaatactatgcctcaggcaccatggtcacgccggaaggggtgcccgtgggagagaggtacgtacttgggagtcggccat

SEQ ID NO: 383906 - DNA, 140 bp, Artificial Sequence
  Synthetic
atggccgactcccaagtacgtacctctctcccacgggcaccccttccggcgtgaccatggtgcctgaggcatagtatttcccaagtgcccgcacccattctggatggtcagaggccagagggagacccagcatggcgtat

SEQ ID NO: 383907 - DNA, 140 bp, Artificial Sequence
  Synthetic
aggccctggctgctgatatgctgtagatcctcaggtgtactcaccactagcgccagcaactgcttgacttgctacattaaggtgaaagccgcttgtgagcgggtgggactcaaaaacgttgaccttttgggacagcggtg

SEQ ID NO: 383908 - DNA, 140 bp, Artificial Sequence
  Synthetic
caccgctgtcccaaaaggtcaacgtttttgagtcccacccgctcacaagcggctttcaccttaatgtagcaagtcaagcagttgctggcgctagtggtgagtacacctgaggatctacagcatatcagcagccagggcct

SEQ ID NO: 383909 - DNA, 140 bp, Artificial Sequence
  Synthetic
aggccctggctgctgatatgtccctcctaatcgcaggcgatgactgtcagatcatatgtgagcggcctatgtgcgaccccagtgaggccttgggcagagccctggcttcttacgggtacggaccttttgggacagcggtg

SEQ ID NO: 383910 - DNA, 140 bp, Artificial Sequence
  Synthetic
caccgctgtcccaaaaggtccgtacccgtaagaagccagggctctgcccaaggcctcactggggtcgcacataggccgctcacatatgatctgacagtcatcgcctgcgattaggagggacatatcagcagccagggcct

SEQ ID NO: 383911 - DNA, 140 bp, Artificial Sequence
  Synthetic
aggccctggctgctgatatgcatgcgagccctcatatcatacatcattggacacggcccccttctgctccacttggctagccgagtgcaatgcagatgggaaacgccatttcttcctgacgaccttttgggacagcggtg

SEQ ID NO: 383912 - DNA, 140 bp, Artificial Sequence
  Synthetic
caccgctgtcccaaaaggtcgtcaggaagaaatggcgtttcccatctgcattgcactcggctagccaagtggagcagaagggggccgtgtccaatgatgtatgatatgagggctcgcatgcatatcagcagccagggcct

SEQ ID NO: 383913 - DNA, 140 bp, Artificial Sequence
  Synthetic
aggccctggctgctgatatgaacggactttcagaggccgctggctcgcatgtcaagcgaatacagcgatcccatggcttcggccattgggtacatcctcctatatccctggcatcccatcgaccttttgggacagcggtg

SEQ ID NO: 383914 - DNA, 140 bp, Artificial Sequence
  Synthetic
caccgctgtcccaaaaggtcgatgggatgccagggatataggaggatgtacccaatggccgaagccatgggatcgctgtattcgcttgacatgcgagccagcggcctctgaaagtccgttcatatcagcagccagggcct

SEQ ID NO: 383915 - DNA, 140 bp, Artificial Sequence
  Synthetic
aggccctggctgctgatatgacacggtgggtcatcatcccccacgtgctcacgtgcgcgtttaggggtggcggcacaccgtctgatcctgtgtggtgccaggttcatggcaattactacagaccttttgggacagcggtg

SEQ ID NO: 383916 - DNA, 140 bp, Artificial Sequence
  Synthetic
caccgctgtcccaaaaggtctgtagtaattgccatgaacctggcaccacacaggatcagacggtgtgccgccacccctaaacgcgcacgtgagcacgtgggggatgatgacccaccgtgtcatatcagcagccagggcct

SEQ ID NO: 383917 - DNA, 140 bp, Artificial Sequence
  Synthetic
aggccctggctgctgatatgagtttcccctggacaaactgcctaacatcatcgtggccctccacggaccagcagcgttgagggttaccgcagacacaaccaaaacaaaaatggaagctgggaccttttgggacagcggtg

SEQ ID NO: 383918 - DNA, 140 bp, Artificial Sequence
  Synthetic
caccgctgtcccaaaaggtcccagcttccatttttgttttggttgtgtctgcggtaaccctcaacgctgctggtccgtggagggccacgatgatgttaggcagtttgtccaggggaaactcatatcagcagccagggcct

SEQ ID NO: 383919 - DNA, 140 bp, Artificial Sequence
  Synthetic
aggccctggctgctgatatgtaaggttctgagcgacctcaagctccctggcctagcggtccaccgaaagaaggccggagcattgcgaacacgcatgctccggtcgcgcggttgggcggaggaccttttgggacagcggtg

SEQ ID NO: 383920 - DNA, 140 bp, Artificial Sequence
  Synthetic
caccgctgtcccaaaaggtcctccgcccaaccgcgcgaccggagcatgcgtgttcgcaatgctccggccttctttcggtggaccgctaggccagggagcttgaggtcgctcagaaccttacatatcagcagccagggcct

SEQ ID NO: 383921 - DNA, 140 bp, Artificial Sequence
  Synthetic
aggccctggctgctgatatgttggctgggggcatgttgtggcatccaggactacggctacctccccctgagattgctgctatcccggggggtttccctctctcccccccgtacatggggggaccttttgggacagcggtg

SEQ ID NO: 383922 - DNA, 140 bp, Artificial Sequence
  Synthetic
caccgctgtcccaaaaggtccccccatgtacgggggggagagagggaaaccccccgggatagcagcaatctcagggggaggtagccgtagtcctggatgccacaacatgcccccagccaacatatcagcagccagggcct

SEQ ID NO: 383923 - DNA, 140 bp, Artificial Sequence
  Synthetic
aggccctggctgctgatatgtggtccatcaattggatttcacaggacagaggagtcgctggcggtggttggggtttgctcgacctgctacatcaaggtgaaagtgtctgataagaaagctgaccttttgggacagcggtg

SEQ ID NO: 383924 - DNA, 140 bp, Artificial Sequence
  Synthetic
caccgctgtcccaaaaggtcagctttcttatcagacactttcaccttgatgtagcaggtcgagcaaaccccaaccaccgccagcgactcctctgtcctgtgaaatccaattgatggaccacatatcagcagccagggcct

SEQ ID NO: 383925 - DNA, 140 bp, Artificial Sequence
  Synthetic
aggccctggctgctgatatgagtctggacatcggaaaactggagaaggggttggtggatgctgttgagaagggtacattagccaaggttacgaacgatacgctcaaagattaccccaagcgaccttttgggacagcggtg

SEQ ID NO: 383926 - DNA, 140 bp, Artificial Sequence
  Synthetic
caccgctgtcccaaaaggtcgcttggggtaatctttgagcgtatcgttcgtaaccttggctaatgtacccttctcaacagcatccaccaaccccttctccagttttccgatgtccagactcatatcagcagccagggcct

SEQ ID NO: 383927 - DNA, 140 bp, Artificial Sequence
  Synthetic
atacgccatgctgggtctccggttggtggatgctgttgagaagggtacattagccaaggttacgaacgatacgctcaaagattaccccaagcagaaagacgttaaaaagatcgcagggaacgtacttgggagtcggccat

SEQ ID NO: 383928 - DNA, 140 bp, Artificial Sequence
  Synthetic
atggccgactcccaagtacgttccctgcgatctttttaacgtctttctgcttggggtaatctttgagcgtatcgttcgtaaccttggctaatgtacccttctcaacagcatccaccaaccggagacccagcatggcgtat

SEQ ID NO: 383929 - DNA, 140 bp, Artificial Sequence
  Synthetic
atacgccatgctgggtctccaggctataggctaaatttccctttccctgttcctttccctatctccctttgttttgcttgtaaatattaattcttgcaggttcagggttctttaatctgtcgtacttgggagtcggccat

SEQ ID NO: 383930 - DNA, 140 bp, Artificial Sequence
  Synthetic
atggccgactcccaagtacgacagattaaagaaccctgaacctgcaagaattaatatttacaagcaaaacaaagggagatagggaaaggaacagggaaagggaaatttagcctatagcctggagacccagcatggcgtat

SEQ ID NO: 383931 - DNA, 140 bp, Artificial Sequence
  Synthetic
atacgccatgctgggtctcctggacattacaggagtgcagtcaaccttgagatttcgtgttccttggatttctgatacaccctatcgagtgaataggtacacgaagtcagcacatcaaaacgtacttgggagtcggccat

SEQ ID NO: 383932 - DNA, 140 bp, Artificial Sequence
  Synthetic
atggccgactcccaagtacgttttgatgtgctgacttcgtgtacctattcactcgatagggtgtatcagaaatccaaggaacacgaaatctcaaggttgactgcactcctgtaatgtccaggagacccagcatggcgtat

SEQ ID NO: 383933 - DNA, 140 bp, Artificial Sequence
  Synthetic
atacgccatgctgggtctcctgacttctccttctaatgttgcttctcatgttagagttaatgtttatctttcagcaattaatttggaatgttttgctcctctttaccatgctatggatgtcgtacttgggagtcggccat

SEQ ID NO: 383934 - DNA, 140 bp, Artificial Sequence
  Synthetic
atggccgactcccaagtacgacatccatagcatggtaaagaggagcaaaacattccaaattaattgctgaaagataaacattaactctaacatgagaagcaacattagaaggagaagtcaggagacccagcatggcgtat

SEQ ID NO: 383935 - DNA, 140 bp, Artificial Sequence
  Synthetic
atacgccatgctgggtctccacattggaaatggatgctggagttttgactggaaggctggtgagggttaatgatgagaaatggacagaaatgaaggatgacaaaatagtttctttggtggcgtacttgggagtcggccat

SEQ ID NO: 383936 - DNA, 140 bp, Artificial Sequence
  Synthetic
atggccgactcccaagtacgccaccaaagaaactattttgtcatccttcatttctgtccatttctcatcattaaccctcaccagccttccagtcaaaactccagcatccatttccaatgtggagacccagcatggcgtat

SEQ ID NO: 383937 - DNA, 140 bp, Artificial Sequence
  Synthetic
aggccctggctgctgatatgtccacaaggggtaggctacgggtgaaacctcttaggctaatacttctatgaagagatgctttggatagggtaacagcggcggatattggtgagttgttaagaccttttgggacagcggtg

SEQ ID NO: 383938 - DNA, 140 bp, Artificial Sequence
  Synthetic
caccgctgtcccaaaaggtcttaacaactcaccaatatccgccgctgttaccctatccaaagcatctcttcatagaagtattagcctaagaggtttcacccgtagcctaccccttgtggacatatcagcagccagggcct

SEQ ID NO: 383939 - DNA, 140 bp, Artificial Sequence
  Synthetic
aggccctggctgctgatatgaagagatgctttggatagggtaacagcggcggatattggtgagttgttaagacaaaaaccattcaacgccggaggactggctctcatccagtggatgcatgaccttttgggacagcggtg

SEQ ID NO: 383940 - DNA, 140 bp, Artificial Sequence
  Synthetic
caccgctgtcccaaaaggtcatgcatccactggatgagagccagtcctccggcgttgaatggtttttgtcttaacaactcaccaatatccgccgctgttaccctatccaaagcatctcttcatatcagcagccagggcct

SEQ ID NO: 383941 - DNA, 140 bp, Artificial Sequence
  Synthetic
atacgccatgctgggtctcctgtgcttagggcaaacaccatttggccttaaatgggatcctgtgagagggggtccctccattgacagctggactgttctttggggccttatgtggtgtttcgtacttgggagtcggccat

SEQ ID NO: 383942 - DNA, 140 bp, Artificial Sequence
  Synthetic
atggccgactcccaagtacgaaacaccacataaggccccaaagaacagtccagctgtcaatggagggaccccctctcacaggatcccatttaaggccaaatggtgtttgccctaagcacaggagacccagcatggcgtat

SEQ ID NO: 383943 - DNA, 140 bp, Artificial Sequence
  Synthetic
aggccctggctgctgatatgttttggagaggctctcattaacacaattatttactctaaacatttgctttataattgttgttatcatgtatgtgggtcaatgccttctgggtctccttgtgaccttttgggacagcggtg

SEQ ID NO: 383944 - DNA, 140 bp, Artificial Sequence
  Synthetic
caccgctgtcccaaaaggtcacaaggagacccagaaggcattgacccacatacatgataacaacaattataaagcaaatgtttagagtaaataattgtgttaatgagagcctctccaaaacatatcagcagccagggcct

SEQ ID NO: 383945 - DNA, 140 bp, Artificial Sequence
  Synthetic
atacgccatgctgggtctccaatgaatatgtctaaacaagggattttccagactgttgggagtggccttgaccacatcctgtctctggcagatattgaggaagagcaaatgattcagtctcgtacttgggagtcggccat

SEQ ID NO: 383946 - DNA, 140 bp, Artificial Sequence
  Synthetic
atggccgactcccaagtacgagactgaatcatttgctcttcctcaatatctgccagagacaggatgtggtcaaggccactcccaacagtctggaaaatcccttgtttagacatattcattggagacccagcatggcgtat

SEQ ID NO: 383947 - DNA, 140 bp, Artificial Sequence
  Synthetic
aggccctggctgctgatatggttgataggactgcagtgactggagcttcttattttacttctgtggaccaatcttcagttcatactgctgaggttggctcacatcaaattgaacctttgagaccttttgggacagcggtg

SEQ ID NO: 383948 - DNA, 140 bp, Artificial Sequence
  Synthetic
caccgctgtcccaaaaggtctcaaaggttcaatttgatgtgagccaacctcagcagtatgaactgaagattggtccacagaagtaaaataagaagctccagtcactgcagtcctatcaaccatatcagcagccagggcct

SEQ ID NO: 383949 - DNA, 140 bp, Artificial Sequence
  Synthetic
atacgccatgctgggtctcccgctagtttgagcccatttatgataagggaagctggaagaatactcactgaaatgtctggagcccctgttcactttggagaggccctcatcaacacaatccgtacttgggagtcggccat

SEQ ID NO: 383950 - DNA, 140 bp, Artificial Sequence
  Synthetic
atggccgactcccaagtacggattgtgttgatgagggcctctccaaagtgaacaggggctccagacatttcagtgagtattcttccagcttcccttatcataaatgggctcaaactagcgggagacccagcatggcgtat

SEQ ID NO: 383951 - DNA, 140 bp, Artificial Sequence
  Synthetic
atacgccatgctgggtctccatggtattcttatttgtatgccgtgtctggagcactggatggcttgggagataagacagattctacatttggattggtttctattcagattgcaaattaccgtacttgggagtcggccat

SEQ ID NO: 383952 - DNA, 140 bp, Artificial Sequence
  Synthetic
atggccgactcccaagtacggtaatttgcaatctgaatagaaaccaatccaaatgtagaatctgtcttatctcccaagccatccagtgctccagacacggcatacaaataagaataccatggagacccagcatggcgtat

SEQ ID NO: 383953 - DNA, 140 bp, Artificial Sequence
  Synthetic
aggccctggctgctgatatgataagacagattctacatttggattggtttctattcagattgcaaattacaatcattctgatgaatatttgtcctttagttgttatttgtctgtcacagagaccttttgggacagcggtg

SEQ ID NO: 383954 - DNA, 140 bp, Artificial Sequence
  Synthetic
caccgctgtcccaaaaggtctctgtgacagacaaataacaactaaaggacaaatattcatcagaatgattgtaatttgcaatctgaatagaaaccaatccaaatgtagaatctgtcttatcatatcagcagccagggcct

SEQ ID NO: 383955 - DNA, 140 bp, Artificial Sequence
  Synthetic
atacgccatgctgggtctcccatggttcctggtgaccagagttatggttcaatagcatccttgactgtttatcctcatggtctgttaaattgcaatattaataatgtagttagaataaagcgtacttgggagtcggccat

SEQ ID NO: 383956 - DNA, 140 bp, Artificial Sequence
  Synthetic
atggccgactcccaagtacgctttattctaactacattattaatattgcaatttaacagaccatgaggataaacagtcaaggatgctattgaaccataactctggtcaccaggaaccatgggagacccagcatggcgtat

SEQ ID NO: 383957 - DNA, 140 bp, Artificial Sequence
  Synthetic
aggccctggctgctgatatgatcctcatggtctgttaaattgcaatattaataatgtagttagaataaaggttccgtttatttacactagaggtgcttatcattttaaagatccacagtagaccttttgggacagcggtg

SEQ ID NO: 383958 - DNA, 140 bp, Artificial Sequence
  Synthetic
caccgctgtcccaaaaggtctactgtggatctttaaaatgataagcacctctagtgtaaataaacggaacctttattctaactacattattaatattgcaatttaacagaccatgaggatcatatcagcagccagggcct

SEQ ID NO: 383959 - DNA, 140 bp, Artificial Sequence
  Synthetic
atacgccatgctgggtctccgactcaaatatgctcaggaagagttatcaaatgaagtgcttccacctcctaggaaaatgaaggggttattttcacaagctaaaatttctcttttttataccgtacttgggagtcggccat

SEQ ID NO: 383960 - DNA, 140 bp, Artificial Sequence
  Synthetic
atggccgactcccaagtacggtataaaaaagagaaattttagcttgtgaaaataaccccttcattttcctaggaggtggaagcacttcatttgataactcttcctgagcatatttgagtcggagacccagcatggcgtat

SEQ ID NO: 383961 - DNA, 140 bp, Artificial Sequence
  Synthetic
aggccctggctgctgatatgcaggaacttcagcttacacttcactcaatgttttagctaggtttacagatttggagttgcatggattaactcctctttctacacagatgatgagaaatgagaccttttgggacagcggtg

SEQ ID NO: 383962 - DNA, 140 bp, Artificial Sequence
  Synthetic
caccgctgtcccaaaaggtctcatttctcatcatctgtgtagaaagaggagttaatccatgcaactccaaatctgtaaacctagctaaaacattgagtgaagtgtaagctgaagttcctgcatatcagcagccagggcct

SEQ ID NO: 383963 - DNA, 140 bp, Artificial Sequence
  Synthetic
atacgccatgctgggtctccagaggagcatgaaataatgaaattttcttggagaggagtgactgctgatactagggctttgagaagatttggattctctctggctgctggtagaagtgtgcgtacttgggagtcggccat

SEQ ID NO: 383964 - DNA, 140 bp, Artificial Sequence
  Synthetic
atggccgactcccaagtacgcacacttctaccagcagccagagagaatccaaatcttctcaaagccctagtatcagcagtcactcctctccaagaaaatttcattatttcatgctcctctggagacccagcatggcgtat

SEQ ID NO: 383965 - DNA, 140 bp, Artificial Sequence
  Synthetic
aggccctggctgctgatatgatgcaagggcaaaaatgtcttttgctttagatcaggaagattggaagtctgatccttcccaaggtggtggaattaaaattactcattttactacctggacgaccttttgggacagcggtg

SEQ ID NO: 383966 - DNA, 140 bp, Artificial Sequence
  Synthetic
caccgctgtcccaaaaggtcgtccaggtagtaaaatgagtaattttaattccaccaccttgggaaggatcagacttccaatcttcctgatctaaagcaaaagacatttttgcccttgcatcatatcagcagccagggcct

SEQ ID NO: 383967 - DNA, 140 bp, Artificial Sequence
  Synthetic
atacgccatgctgggtctccgatccttcccaaggtggtggaattaaaattactcattttactacctggacgtccattccaactttagctgctcagtttccatttaatgcttcagattcagcgtacttgggagtcggccat

SEQ ID NO: 383968 - DNA, 140 bp, Artificial Sequence
  Synthetic
atggccgactcccaagtacgctgaatctgaagcattaaatggaaactgagcagctaaagttggaatggacgtccaggtagtaaaatgagtaattttaattccaccaccttgggaaggatcggagacccagcatggcgtat

SEQ ID NO: 383969 - DNA, 140 bp, Artificial Sequence
  Synthetic
atacgccatgctgggtctccacaaacactaatcctgatcagaaatgtataactgctttggcttctatctgccagatgttttgcttttggaggggagatcttgtttttgattttcaggtttcgtacttgggagtcggccat

SEQ ID NO: 383970 - DNA, 140 bp, Artificial Sequence
  Synthetic
atggccgactcccaagtacgaaacctgaaaatcaaaaacaagatctcccctccaaaagcaaaacatctggcagatagaagccaaagcagttatacatttctgatcaggattagtgtttgtggagacccagcatggcgtat

SEQ ID NO: 383971 - DNA, 140 bp, Artificial Sequence
  Synthetic
aggccctggctgctgatatgaaattaatttagcagatagaatgcttggattgtctggagtgcaggaaattaaagaacagggtgttggactgatagcagagtgtagaactttcttggattcgaccttttgggacagcggtg

SEQ ID NO: 383972 - DNA, 140 bp, Artificial Sequence
  Synthetic
caccgctgtcccaaaaggtcgaatccaagaaagttctacactctgctatcagtccaacaccctgttctttaatttcctgcactccagacaatccaagcattctatctgctaaattaatttcatatcagcagccagggcct

SEQ ID NO: 383973 - DNA, 140 bp, Artificial Sequence
  Synthetic
aggccctggctgctgatatgtaaacttggcagatagaatgttgggtttatctggaatacaggaaattaaagaaaaaggagtgggactcattggcgagtgccgagctttcctggactctatgaccttttgggacagcggtg

SEQ ID NO: 383974 - DNA, 140 bp, Artificial Sequence
  Synthetic
caccgctgtcccaaaaggtcatagagtccaggaaagctcggcactcgccaatgagtcccactcctttttctttaatttcctgtattccagataaacccaacattctatctgccaagtttacatatcagcagccagggcct

SEQ ID NO: 383975 - DNA, 140 bp, Artificial Sequence
  Synthetic
atacgccatgctgggtctcctattgctgggactttgaaatctatgatttttgggtttcatcattctgtgactgttgaaattataaatattgtgctttgttttattaagagtggaatcctgcgtacttgggagtcggccat

SEQ ID NO: 383976 - DNA, 140 bp, Artificial Sequence
  Synthetic
atggccgactcccaagtacgcaggattccactcttaataaaacaaagcacaatatttataatttcaacagtcacagaatgatgaaacccaaaaatcatagatttcaaagtcccagcaataggagacccagcatggcgtat

SEQ ID NO: 383977 - DNA, 140 bp, Artificial Sequence
  Synthetic
aggccctggctgctgatatggtgttccttggatttctgatacaccttatcgagtgaataggtacacgaagtcagcacatcaaaaaggtgagtatactgccattgggaagcttattgtgtagaccttttgggacagcggtg

SEQ ID NO: 383978 - DNA, 140 bp, Artificial Sequence
  Synthetic
caccgctgtcccaaaaggtctacacaataagcttcccaatggcagtatactcacctttttgatgtgctgacttcgtgtacctattcactcgataaggtgtatcagaaatccaaggaacaccatatcagcagccagggcct

SEQ ID NO: 383979 - DNA, 140 bp, Artificial Sequence
  Synthetic
aggccctggctgctgatatgtcagcacatcaaaaaggtgagtatactgccattgggaagcttattgtgtattgttataatagactgacttctccttctaatgttgcttctcatgttagaggaccttttgggacagcggtg

SEQ ID NO: 383980 - DNA, 140 bp, Artificial Sequence
  Synthetic
caccgctgtcccaaaaggtcctctaacatgagaagcaacattagaaggagaagtcagtctattataacaatacacaataagcttcccaatggcagtatactcacctttttgatgtgctgacatatcagcagccagggcct

SEQ ID NO: 383981 - DNA, 140 bp, Artificial Sequence
  Synthetic
aggccctggctgctgatatggtggtaaagttttttccaaaatgttagaaacagtttttaattggcaaatggactctagaatgatggagctgaggactcagagcttctccaattggttaaggaccttttgggacagcggtg

SEQ ID NO: 383982 - DNA, 140 bp, Artificial Sequence
  Synthetic
caccgctgtcccaaaaggtccttaaccaattggagaagctctgagtcctcagctccatcattctagagtccatttgccaattaaaaactgtttctaacattttggaaaaaactttaccaccatatcagcagccagggcct

SEQ ID NO: 383983 - DNA, 140 bp, Artificial Sequence
  Synthetic
atacgccatgctgggtctccagatatttgttcgggaattactatttttaaaagttttaaggatgccatatattggttatgtacaaaattgaaggatttttatgaagtaaattatggcaagcgtacttgggagtcggccat

SEQ ID NO: 383984 - DNA, 140 bp, Artificial Sequence
  Synthetic
atggccgactcccaagtacgcttgccataatttacttcataaaaatccttcaattttgtacataaccaatatatggcatccttaaaacttttaaaaatagtaattcccgaacaaatatctggagacccagcatggcgtat

SEQ ID NO: 383985 - DNA, 140 bp, Artificial Sequence
  Synthetic
aggccctggctgctgatatgattggttatgtacaaaattgaaggatttttatgaagtaaattatggcaagaaaaaggatgttcttaatattctcaaagataaccagcaaaaaatagaaaagaccttttgggacagcggtg

SEQ ID NO: 383986 - DNA, 140 bp, Artificial Sequence
  Synthetic
caccgctgtcccaaaaggtcttttctattttttgctggttatctttgagaatattaagaacatcctttttcttgccataatttacttcataaaaatccttcaattttgtacataaccaatcatatcagcagccagggcct

SEQ ID NO: 383987 - DNA, 140 bp, Artificial Sequence
  Synthetic
aggccctggctgctgatatgcaaccatgagggacttaaaagggaaagccaataggggaaagatggatgtttcaggagtccaagcacctgtgggagctattacaacaattgaggatccagtgaccttttgggacagcggtg

SEQ ID NO: 383988 - DNA, 140 bp, Artificial Sequence
  Synthetic
caccgctgtcccaaaaggtcactggatcctcaattgttgtaatagctcccacaggtgcttggactcctgaaacatccatctttcccctattggctttcccttttaagtccctcatggttgcatatcagcagccagggcct

SEQ ID NO: 383989 - DNA, 140 bp, Artificial Sequence
  Synthetic
atacgccatgctgggtctccactgtccattcaatggctcaagttgaccccaatttgggggttcatttgtcacctctcagagattgcatagcaagagtccatcaaaagctcaagaatcttgcgtacttgggagtcggccat

SEQ ID NO: 383990 - DNA, 140 bp, Artificial Sequence
  Synthetic
atggccgactcccaagtacgcaagattcttgagcttttgatggactcttgctatgcaatctctgagaggtgacaaatgaacccccaaattggggtcaacttgagccattgaatggacagtggagacccagcatggcgtat

SEQ ID NO: 383991 - DNA, 140 bp, Artificial Sequence
  Synthetic
atacgccatgctgggtctcccactttttgtgtacttttactttcaattcaaataacaaagagtacacatttccaataaccctgtcttcgacttcaaatcctcctcatggtttaccatcaacgtacttgggagtcggccat

SEQ ID NO: 383992 - DNA, 140 bp, Artificial Sequence
  Synthetic
atggccgactcccaagtacgttgatggtaaaccatgaggaggatttgaagtcgaagacagggttattggaaatgtgtactctttgttatttgaattgaaagtaaaagtacacaaaaagtgggagacccagcatggcgtat

SEQ ID NO: 383993 - DNA, 140 bp, Artificial Sequence
  Synthetic
atacgccatgctgggtctcccattaaggtggtttttcaatttgttccagctgtatagaggaccattggatttgacaattataattacaggagccactgatgtggatggtatggcctggttcgtacttgggagtcggccat

SEQ ID NO: 383994 - DNA, 140 bp, Artificial Sequence
  Synthetic
atggccgactcccaagtacgaaccaggccataccatccacatcagtggctcctgtaattataattgtcaaatccaatggtcctctatacagctggaacaaattgaaaaaccaccttaatgggagacccagcatggcgtat

SEQ ID NO: 383995 - DNA, 140 bp, Artificial Sequence
  Synthetic
aggccctggctgctgatatgttgacaattataattacaggagccactgatgtggatggtatggcctggtttacaccagtgggccttgctgtcgacacgccttgggtagaaaaggagtcaggaccttttgggacagcggtg

SEQ ID NO: 383996 - DNA, 140 bp, Artificial Sequence
  Synthetic
caccgctgtcccaaaaggtcctgactccttttctacccaaggcgtgtcgacagcaaggcccactggtgtaaaccaggccataccatccacatcagtggctcctgtaattataattgtcaacatatcagcagccagggcct

SEQ ID NO: 383997 - DNA, 140 bp, Artificial Sequence
  Synthetic
atacgccatgctgggtctccccaaacctgtggcctcagattattgggatggatatagtggacaattagtttgtattattgatgatattggccaaaacacaacagatgaagattggtcagacgtacttgggagtcggccat

SEQ ID NO: 383998 - DNA, 140 bp, Artificial Sequence
  Synthetic
atggccgactcccaagtacgtctgaccaatcttcatctgttgtgttttggccaatatcatcaataatacaaactaattgtccactatatccatcccaataatctgaggccacaggtttggggagacccagcatggcgtat

SEQ ID NO: 383999 - DNA, 140 bp, Artificial Sequence
  Synthetic
aggccctggctgctgatatgctttgtctattgattataaaactgcccttggagctgttagatttaatacaagaagaacagggaacattcagattagattgccatggtattcttatttgtagaccttttgggacagcggtg

SEQ ID NO: 384000 - DNA, 140 bp, Artificial Sequence
  Synthetic
caccgctgtcccaaaaggtctacaaataagaataccatggcaatctaatctgaatgttccctgttcttcttgtattaaatctaacagctccaagggcagttttataatcaatagacaaagcatatcagcagccagggcct

SEQ ID NO: 384001 - DNA, 140 bp, Artificial Sequence
  Synthetic
aggccctggctgctgatatgtcaattgcattggcaaccaaaatttgtaaacactatggtgttgaacctgagaaaaatatttacactaaacctgtggcctcagattattgggatggttacagaccttttgggacagcggtg

SEQ ID NO: 384002 - DNA, 140 bp, Artificial Sequence
  Synthetic
caccgctgtcccaaaaggtctgtaaccatcccaataatctgaggccacaggtttagtgtaaatatttttctcaggttcaacaccatagtgtttacaaattttggttgccaatgcaattgacatatcagcagccagggcct

SEQ ID NO: 384003 - DNA, 140 bp, Artificial Sequence
  Synthetic
aggccctggctgctgatatgagaatatgagtgaattcatggagttgtggtctcagggaatttcagatgatgacagtgcagtagctgagtttttccagtcttttccatctggtgaaccatcgaccttttgggacagcggtg

SEQ ID NO: 384004 - DNA, 140 bp, Artificial Sequence
  Synthetic
caccgctgtcccaaaaggtcgatggttcaccagatggaaaagactggaaaaactcagctactgcactgtcatcatctgaaattccctgagaccacaactccatgaattcactcatattctcatatcagcagccagggcct

SEQ ID NO: 384005 - DNA, 140 bp, Artificial Sequence
  Synthetic
aggccctggctgctgatatgaagaattatcaaatgaagtgcttcctcctcctaggaaaatgaaggggctattttcacaagctaaaatttctcttttttatactgaggagcatgaaataatgaccttttgggacagcggtg

SEQ ID NO: 384006 - DNA, 140 bp, Artificial Sequence
  Synthetic
caccgctgtcccaaaaggtcattatttcatgctcctcagtataaaaaagagaaattttagcttgtgaaaatagccccttcattttcctaggaggaggaagcacttcatttgataattcttcatatcagcagccagggcct

SEQ ID NO: 384007 - DNA, 140 bp, Artificial Sequence
  Synthetic
aggccctggctgctgatatgaaattccaagttatctagttttttccaatctgtcactaatcacaagtgggttgctgtgggagctgcagttggtattcttggattgctagtgggaggatgggaccttttgggacagcggtg

SEQ ID NO: 384008 - DNA, 140 bp, Artificial Sequence
  Synthetic
caccgctgtcccaaaaggtcccatcctcccactagcaatccaagaataccaactgcagctcccacagcaacccacttgtgattagtgacagattggaaaaaactagataacttggaatttcatatcagcagccagggcct

SEQ ID NO: 384009 - DNA, 140 bp, Artificial Sequence
  Synthetic
aggccctggctgctgatatgtttgtgtataagcatttttcccgcaaagaggaagaaccaattccagctgaaggggtttatcatggagtgactaagcccaaacaagtgattaaattggatggaccttttgggacagcggtg

SEQ ID NO: 384010 - DNA, 140 bp, Artificial Sequence
  Synthetic
caccgctgtcccaaaaggtccatccaatttaatcacttgtttgggcttagtcactccatgataaaccccttcagctggaattggttcttcctctttgcgggaaaaatgcttatacacaaacatatcagcagccagggcct

SEQ ID NO: 384011 - DNA, 140 bp, Artificial Sequence
  Synthetic
atacgccatgctgggtctccagaaatgaaggatgataagattgtttcattaattgaaaagttcacaagcaataaatattggtctaaagtgaattttccacatggaatgttggatcttgaacgtacttgggagtcggccat

SEQ ID NO: 384012 - DNA, 140 bp, Artificial Sequence
  Synthetic
atggccgactcccaagtacgttcaagatccaacattccatgtggaaaattcactttagaccaatatttattgcttgtgaacttttcaattaatgaaacaatcttatcatccttcatttctggagacccagcatggcgtat

SEQ ID NO: 384013 - DNA, 140 bp, Artificial Sequence
  Synthetic
aggccctggctgctgatatgaaggaccctcaatatcctgtttgggagttgactattagagtttggtctgagttaaacattggaactggtacctctgcttacacatcactgaatgtgctgggaccttttgggacagcggtg

SEQ ID NO: 384014 - DNA, 140 bp, Artificial Sequence
  Synthetic
caccgctgtcccaaaaggtcccagcacattcagtgatgtgtaagcagaggtaccagttccaatgtttaactcagaccaaactctaatagtcaactcccaaacaggatattgagggtccttcatatcagcagccagggcct

SEQ ID NO: 384015 - DNA, 140 bp, Artificial Sequence
  Synthetic
aggccctggctgctgatatgtgttactggaattacattaaaacaggcaactactgctccttgtgcagtgatggacattacaggagtgcagtcaaccttgagatttcgtgttccttggattgaccttttgggacagcggtg

SEQ ID NO: 384016 - DNA, 140 bp, Artificial Sequence
  Synthetic
caccgctgtcccaaaaggtcaatccaaggaacacgaaatctcaaggttgactgcactcctgtaatgtccatcactgcacaaggagcagtagttgcctgttttaatgtaattccagtaacacatatcagcagccagggcct

SEQ ID NO: 384017 - DNA, 140 bp, Artificial Sequence
  Synthetic
aggccctggctgctgatatgtttagatgtgggattccaagatgttgttctaatgaaggttcctacaattcccaagtttagagatattactcaacattttattaagaaaggagatgtgcctgaccttttgggacagcggtg

SEQ ID NO: 384018 - DNA, 140 bp, Artificial Sequence
  Synthetic
caccgctgtcccaaaaggtcaggcacatctcctttcttaataaaatgttgagtaatatctctaaacttgggaattgtaggaaccttcattagaacaacatcttggaatcccacatctaaacatatcagcagccagggcct

SEQ ID NO: 384019 - DNA, 140 bp, Artificial Sequence
  Synthetic
aggccctggctgctgatatgccaagtttagagatattactcaacattttattaagaaaggagatgtgcctagagccttgaatcgcttggcaacattagtgacaaccgttaatggaactccgaccttttgggacagcggtg

SEQ ID NO: 384020 - DNA, 140 bp, Artificial Sequence
  Synthetic
caccgctgtcccaaaaggtcggagttccattaacggttgtcactaatgttgccaagcgattcaaggctctaggcacatctcctttcttaataaaatgttgagtaatatctctaaacttggcatatcagcagccagggcct

SEQ ID NO: 384021 - DNA, 140 bp, Artificial Sequence
  Synthetic
atacgccatgctgggtctccctgtgctttgttttgttaagagtggaatcctgctttatgtcatacaacaattgaaccaagatgaacactctcacataattggcttgttgagagttatgaacgtacttgggagtcggccat

SEQ ID NO: 384022 - DNA, 140 bp, Artificial Sequence
  Synthetic
atggccgactcccaagtacgttcataactctcaacaagccaattatgtgagagtgttcatcttggttcaattgttgtatgacataaagcaggattccactcttaacaaaacaaagcacagggagacccagcatggcgtat

SEQ ID NO: 384023 - DNA, 140 bp, Artificial Sequence
  Synthetic
aggccctggctgctgatatgttcataagaagaacgatggtactacggttgatttgactgtagatcaggcatggagaggaaaaggtgaaggtcttcctggaatgtgtggtggggccctagtgaccttttgggacagcggtg

SEQ ID NO: 384024 - DNA, 140 bp, Artificial Sequence
  Synthetic
caccgctgtcccaaaaggtcactagggccccaccacacattccaggaagaccttcaccttttcctctccatgcctgatctacagtcaaatcaaccgtagtaccatcgttcttcttatgaacatatcagcagccagggcct

SEQ ID NO: 384025 - DNA, 140 bp, Artificial Sequence
  Synthetic
atacgccatgctgggtctccctaaggactcagagcttctccaattggttaagagatatttgttcaggaattactatttttaaaagtttcaaggatgctatatattggttatataccaaatcgtacttgggagtcggccat

SEQ ID NO: 384026 - DNA, 140 bp, Artificial Sequence
  Synthetic
atggccgactcccaagtacgatttggtatataaccaatatatagcatccttgaaacttttaaaaatagtaattcctgaacaaatatctcttaaccaattggagaagctctgagtccttagggagacccagcatggcgtat

SEQ ID NO: 384027 - DNA, 140 bp, Artificial Sequence
  Synthetic
aggccctggctgctgatatgctcatggtttaccatcaacattaaggtggttctttaatttgtttcagttgtatagaggaccattggatttgacaattataatcacaggagccactgatgtgaccttttgggacagcggtg

SEQ ID NO: 384028 - DNA, 140 bp, Artificial Sequence
  Synthetic
caccgctgtcccaaaaggtcacatcagtggctcctgtgattataattgtcaaatccaatggtcctctatacaactgaaacaaattaaagaaccaccttaatgttgatggtaaaccatgagcatatcagcagccagggcct

SEQ ID NO: 384029 - DNA, 140 bp, Artificial Sequence
  Synthetic
atacgccatgctgggtctcctgaaggatttttatgacgtaaattatggcaagaaaaaggatgttcttaatattcttaaagataatcagcaaaaaatagaaaaagccattgaagaagcagacgtacttgggagtcggccat

SEQ ID NO: 384030 - DNA, 140 bp, Artificial Sequence
  Synthetic
atggccgactcccaagtacgtctgcttcttcaatggctttttctattttttgctgattatctttaagaatattaagaacatcctttttcttgccataatttacgtcataaaaatccttcaggagacccagcatggcgtat

SEQ ID NO: 384031 - DNA, 140 bp, Artificial Sequence
  Synthetic
atacgccatgctgggtctccctagatttactgatttggaactccatggactaacacctctgtccacacagatgatgagaaatgaatttagagtcagtacaacagaaaatgtagttaatttcgtacttgggagtcggccat

SEQ ID NO: 384032 - DNA, 140 bp, Artificial Sequence
  Synthetic
atggccgactcccaagtacgaaattaactacattttctgttgtactgactctaaattcatttctcatcatctgtgtggacagaggtgttagtccatggagttccaaatcagtaaatctagggagacccagcatggcgtat

SEQ ID NO: 384033 - DNA, 140 bp, Artificial Sequence
  Synthetic
atacgccatgctgggtctcccaaattgaccccaatttgggggttcatttgtcacctctgagagattgtatagcaagagttcaccaaaagctcaagaatcttggatctataaatcaggctacgtacttgggagtcggccat

SEQ ID NO: 384034 - DNA, 140 bp, Artificial Sequence
  Synthetic
atggccgactcccaagtacgtagcctgatttatagatccaagattcttgagcttttggtgaactcttgctatacaatctctcagaggtgacaaatgaacccccaaattggggtcaatttgggagacccagcatggcgtat

SEQ ID NO: 384035 - DNA, 140 bp, Artificial Sequence
  Synthetic
atacgccatgctgggtctcctgagcaatttgcagttcagggtctgttgaggtatcacacttatgcaagatttggaattgaaatacaagtccagatcaatcccacaccattccagcaaggtcgtacttgggagtcggccat

SEQ ID NO: 384036 - DNA, 140 bp, Artificial Sequence
  Synthetic
atggccgactcccaagtacgaccttgctggaatggtgtgggattgatctggacttgtatttcaattccaaatcttgcataagtgtgatacctcaacagaccctgaactgcaaattgctcaggagacccagcatggcgtat

SEQ ID NO: 384037 - DNA, 140 bp, Artificial Sequence
  Synthetic
atacgccatgctgggtctcctggtaacaagatgtgagccagttgtttgctatttatatggtaagagaggcggaggaaagagtttgacatcaattgcattggcaaccaaaatttgtaaacacgtacttgggagtcggccat

SEQ ID NO: 384038 - DNA, 140 bp, Artificial Sequence
  Synthetic
atggccgactcccaagtacgtgtttacaaattttggttgccaatgcaattgatgtcaaactctttcctccgcctctcttaccatataaatagcaaacaactggctcacatcttgttaccaggagacccagcatggcgtat

SEQ ID NO: 384039 - DNA, 140 bp, Artificial Sequence
  Synthetic
aggccctggctgctgatatgggaggaaagagtttgacatcaattgcattggcaaccaaaatttgtaaacattatggtgttgaacctgagaaaaatatatataccaaacctgtggcttcaggaccttttgggacagcggtg

SEQ ID NO: 384040 - DNA, 140 bp, Artificial Sequence
  Synthetic
caccgctgtcccaaaaggtcctgaagccacaggtttggtatatatatttttctcaggttcaacaccataatgtttacaaattttggttgccaatgcaattgatgtcaaactctttcctcccatatcagcagccagggcct

SEQ ID NO: 384041 - DNA, 140 bp, Artificial Sequence
  Synthetic
atacgccatgctgggtctcctgatttggttggatgaaaatggtttgctgttaggagttcacccaagattggcccagagaatcttatttaatactgtcatgatggaaaattgttctgacttcgtacttgggagtcggccat

SEQ ID NO: 384042 - DNA, 140 bp, Artificial Sequence
  Synthetic
atggccgactcccaagtacgaagtcagaacaattttccatcatgacagtattaaataagattctctgggccaatcttgggtgaactcctaacagcaaaccattttcatccaaccaaatcaggagacccagcatggcgtat

SEQ ID NO: 384043 - DNA, 140 bp, Artificial Sequence
  Synthetic
aggccctggctgctgatatgatgatgagaaatgaatttagagtcagtacaacagaaaatgtagttaatttgtccaattatgaagatgctagagcaaaaatgtcttttgctcttgaccagggaccttttgggacagcggtg

SEQ ID NO: 384044 - DNA, 140 bp, Artificial Sequence
  Synthetic
caccgctgtcccaaaaggtccctggtcaagagcaaaagacatttttgctctagcatcttcataattggacaaattaactacattttctgttgtactgactctaaattcatttctcatcatcatatcagcagccagggcct

SEQ ID NO: 384045 - DNA, 140 bp, Artificial Sequence
  Synthetic
aggccctggctgctgatatgggccaaaacacaacagatgaagattggtcagatttttgtcaattagtgtcaggatgtccaatgagattgaatatggcttctcttgaggagaaaggtagacgaccttttgggacagcggtg

SEQ ID NO: 384046 - DNA, 140 bp, Artificial Sequence
  Synthetic
caccgctgtcccaaaaggtcgtctacctttctcctcaagagaagccatattcaatctcattggacatcctgacactaattgacaaaaatctgaccaatcttcatctgttgtgttttggcccatatcagcagccagggcct

SEQ ID NO: 384047 - DNA, 140 bp, Artificial Sequence
  Synthetic
aggccctggctgctgatatgatttttcttctccttttataatagcaacttcaaattggtcaaatccaagtccaaaaacagtttatgttaaggaagcaattgatcgtagacttcattttaagaccttttgggacagcggtg

SEQ ID NO: 384048 - DNA, 140 bp, Artificial Sequence
  Synthetic
caccgctgtcccaaaaggtcttaaaatgaagtctacgatcaattgcttccttaacataaactgtttttggacttggatttgaccaatttgaagttgctattataaaaggagaagaaaaatcatatcagcagccagggcct

SEQ ID NO: 384049 - DNA, 140 bp, Artificial Sequence
  Synthetic
aggccctggctgctgatatggaatccagggtttcacacaggtgttgctattggcatagatcctgatagacagtgggatgaattatttaaaacaatgataagatttggagatgttggtcttgaccttttgggacagcggtg

SEQ ID NO: 384050 - DNA, 140 bp, Artificial Sequence
  Synthetic
caccgctgtcccaaaaggtcaagaccaacatctccaaatcttatcattgttttaaataattcatcccactgtctatcaggatctatgccaatagcaacacctgtgtgaaaccctggattccatatcagcagccagggcct

SEQ ID NO: 384051 - DNA, 140 bp, Artificial Sequence
  Synthetic
atacgccatgctgggtctccgatttagatttttctgcttttgatgccagtcttagtccatttatgattagggaagcaggtagaatcatgagtgaattatctggaacaccatctcattttgcgtacttgggagtcggccat

SEQ ID NO: 384052 - DNA, 140 bp, Artificial Sequence
  Synthetic
atggccgactcccaagtacgcaaaatgagatggtgttccagataattcactcatgattctacctgcttccctaatcataaatggactaagactggcatcaaaagcagaaaaatctaaatcggagacccagcatggcgtat

SEQ ID NO: 384053 - DNA, 140 bp, Artificial Sequence
  Synthetic
aggccctggctgctgatatggttgatttaataatggatggacataatatttcattaatggatttacttagttccttggtgatgacagttgaaattaggaaacagaatatgagtgaattcagaccttttgggacagcggtg

SEQ ID NO: 384054 - DNA, 140 bp, Artificial Sequence
  Synthetic
caccgctgtcccaaaaggtctgaattcactcatattctgtttcctaatttcaactgtcatcaccaaggaactaagtaaatccattaatgaaatattatgtccatccattattaaatcaaccatatcagcagccagggcct

SEQ ID NO: 384055 - DNA, 140 bp, Artificial Sequence
  Synthetic
atacgccatgctgggtctccgaacagctcttatcaatactatcatttattctaaacatctgctgtacaattgttgttatcacgtctgtggttcaatgccttctgggtctccttgtacagccgtacttgggagtcggccat

SEQ ID NO: 384056 - DNA, 140 bp, Artificial Sequence
  Synthetic
atggccgactcccaagtacggctgtacaaggagacccagaaggcattgaaccacagacgtgataacaacaattgtacagcagatgtttagaataaatgatagtattgataagagctgttcggagacccagcatggcgtat

SEQ ID NO: 384057 - DNA, 140 bp, Artificial Sequence
  Synthetic
aggccctggctgctgatatgccttatgttttgtttgcctctgaggtactcaggggcatttaggtttttcctcattaattaattattatgaatatgtccagacaaggtattttccagactggaccttttgggacagcggtg

SEQ ID NO: 384058 - DNA, 140 bp, Artificial Sequence
  Synthetic
caccgctgtcccaaaaggtccagtctggaaaataccttgtctggacatattcataataattaattaatgaggaaaaacctaaatgcccctgagtacctcagaggcaaacaaaacataaggcatatcagcagccagggcct

SEQ ID NO: 384059 - DNA, 140 bp, Artificial Sequence
  Synthetic
atacgccatgctgggtctccatctagttttttccaatctgttactaatcacaagtgggttgctgtgggggctgcagttggtattcttggagtgcttgtgggaggatggtttgtgtataagcgtacttgggagtcggccat

SEQ ID NO: 384060 - DNA, 140 bp, Artificial Sequence
  Synthetic
atggccgactcccaagtacgcttatacacaaaccatcctcccacaagcactccaagaataccaactgcagcccccacagcaacccacttgtgattagtaacagattggaaaaaactagatggagacccagcatggcgtat

SEQ ID NO: 384061 - DNA, 140 bp, Artificial Sequence
  Synthetic
aggccctggctgctgatatgaattgaagaggctgataatttttgtgttcttcaaattcaggatgttgaaaaatttgaacagtaccaaaaaggggttgatttaattcagaaattgagaactgaccttttgggacagcggtg

SEQ ID NO: 384062 - DNA, 140 bp, Artificial Sequence
  Synthetic
caccgctgtcccaaaaggtcagttctcaatttctgaattaaatcaacccctttttggtactgttcaaatttttcaacatcctgaatttgaagaacacaaaaattatcagcctcttcaattcatatcagcagccagggcct

SEQ ID NO: 384063 - DNA, 140 bp, Artificial Sequence
  Synthetic
aggccctggctgctgatatgggtatgtttacaagcattttacaaagaagcaagaagaatccattccaagtgaaggagtgtatcacggcgtgacaaagccaaaacaagtaattaaattggagaccttttgggacagcggtg

SEQ ID NO: 384064 - DNA, 140 bp, Artificial Sequence
  Synthetic
caccgctgtcccaaaaggtctccaatttaattacttgttttggctttgtcacgccgtgatacactccttcacttggaatggattcttcttgcttctttgtaaaatgcttgtaaacatacccatatcagcagccagggcct

SEQ ID NO: 384065 - DNA, 140 bp, Artificial Sequence
  Synthetic
aggccctggctgctgatatgtggcgtgactaagcccaaacaagtgattaaattggatgcagatccagtagagtctcagtcaactctagaaatagcaggattagttaggaaaaatttggttgaccttttgggacagcggtg

SEQ ID NO: 384066 - DNA, 140 bp, Artificial Sequence
  Synthetic
caccgctgtcccaaaaggtcaaccaaatttttcctaactaatcctgctatttctagagttgactgagactctactggatctgcatccaatttaatcacttgtttgggcttagtcacgccacatatcagcagccagggcct

SEQ ID NO: 384067 - DNA, 140 bp, Artificial Sequence
  Synthetic
aggccctggctgctgatatgagtctcagtcaactctagaaatagcaggattagttaggaaaaatttggttcagtttggagttggtgagaaaaatggatgtgtgagatgggtcatgaatgcgaccttttgggacagcggtg

SEQ ID NO: 384068 - DNA, 140 bp, Artificial Sequence
  Synthetic
caccgctgtcccaaaaggtcgcattcatgacccatctcacacatccatttttctcaccaactccaaactgaaccaaatttttcctaactaatcctgctatttctagagttgactgagactcatatcagcagccagggcct

SEQ ID NO: 384069 - DNA, 140 bp, Artificial Sequence
  Synthetic
aggccctggctgctgatatgtattattcaatctcagctggcaatgttgttattcaatctttagatgtgggatttcaagatgttgttctaatgaaggttcctacaattcccaagtttagaggaccttttgggacagcggtg

SEQ ID NO: 384070 - DNA, 140 bp, Artificial Sequence
  Synthetic
caccgctgtcccaaaaggtcctctaaacttgggaattgtaggaaccttcattagaacaacatcttgaaatcccacatctaaagattgaataacaacattgccagctgagattgaataatacatatcagcagccagggcct

SEQ ID NO: 384071 - DNA, 140 bp, Artificial Sequence
  Synthetic
aggccctggctgctgatatgagattttatgaccagtgtttcatttgtgacctttcatgatttgtttaaacaaattttcttaaaatttctgaggtttgtttatttcttttatcagtaaattgaccttttgggacagcggtg

SEQ ID NO: 384072 - DNA, 140 bp, Artificial Sequence
  Synthetic
caccgctgtcccaaaaggtcaatttactgataaaagaaataaacaaacctcagaaattttaagaaaatttgtttaaacaaatcatgaaaggtcacaaatgaaacactggtcataaaatctcatatcagcagccagggcct

SEQ ID NO: 384073 - DNA, 140 bp, Artificial Sequence
  Synthetic
atacgccatgctgggtctccttcaagaggggtctccggagttttccggagcccctcttggaagtccatggtgaggggacttgatacctcaccgccgtttgcctaggctataggctaaattcgtacttgggagtcggccat

SEQ ID NO: 384074 - DNA, 140 bp, Artificial Sequence
  Synthetic
atggccgactcccaagtacgaatttagcctatagcctaggcaaacggcggtgaggtatcaagtcccctcaccatggacttccaagaggggctccggaaaactccggagacccctcttgaaggagacccagcatggcgtat

SEQ ID NO: 384075 - DNA, 140 bp, Artificial Sequence
  Synthetic
aggccctggctgctgatatgtgaggggacttgatacctcaccgccgtttgcctaggctataggctaaatttccctttccctgtcccttccctatttccctttgttttgtttgtaaatattgaccttttgggacagcggtg

SEQ ID NO: 384076 - DNA, 140 bp, Artificial Sequence
  Synthetic
caccgctgtcccaaaaggtcaatatttacaaacaaaacaaagggaaatagggaagggacagggaaagggaaatttagcctatagcctaggcaaacggcggtgaggtatcaagtcccctcacatatcagcagccagggcct

SEQ ID NO: 384077 - DNA, 140 bp, Artificial Sequence
  Synthetic
atacgccatgctgggtctccatgatggtaccacagttgatttgactgtggatcaggcatggagaggaaaaggtgaaggtcttcctggaatgtgtggtggggccctagtgtcatcaaatcacgtacttgggagtcggccat

SEQ ID NO: 384078 - DNA, 140 bp, Artificial Sequence
  Synthetic
atggccgactcccaagtacgtgatttgatgacactagggccccaccacacattccaggaagaccttcaccttttcctctccatgcctgatccacagtcaaatcaactgtggtaccatcatggagacccagcatggcgtat

SEQ ID NO: 384079 - DNA, 140 bp, Artificial Sequence
  Synthetic
aggccctggctgctgatatgagttgcaaaattggatgtggtgaagctgctgtacaatgagcagtttgccgtccaaggtttgttgagataccatacatatgcaagatttggcattgagattgaccttttgggacagcggtg

SEQ ID NO: 384080 - DNA, 140 bp, Artificial Sequence
  Synthetic
caccgctgtcccaaaaggtcaatctcaatgccaaatcttgcatatgtatggtatctcaacaaaccttggacggcaaactgctcattgtacagcagcttcaccacatccaattttgcaactcatatcagcagccagggcct

SEQ ID NO: 384081 - DNA, 140 bp, Artificial Sequence
  Synthetic
atacgccatgctgggtctccggtaacagcggcggatattggtgagttgttaagacaaaaaccattcaacgccggaggactggctctcatccagtggatgcattgagtggattgattgtcacgtacttgggagtcggccat

SEQ ID NO: 384082 - DNA, 140 bp, Artificial Sequence
  Synthetic
atggccgactcccaagtacgtgacaatcaatccactcaatgcatccactggatgagagccagtcctccggcgttgaatggtttttgtcttaacaactcaccaatatccgccgctgttaccggagacccagcatggcgtat

SEQ ID NO: 384083 - DNA, 140 bp, Artificial Sequence
  Synthetic
atacgccatgctgggtctcctagtaggcaaagctcagttagttgatgactttttagatcttgatatggccattacaggggctccaggcattgatgctattaatatggattcatctcctggcgtacttgggagtcggccat

SEQ ID NO: 384084 - DNA, 140 bp, Artificial Sequence
  Synthetic
atggccgactcccaagtacgccaggagatgaatccatattaatagcatcaatgcctggagcccctgtaatggccatatcaagatctaaaaagtcatcaactaactgagctttgcctactaggagacccagcatggcgtat

SEQ ID NO: 384085 - DNA, 140 bp, Artificial Sequence
  Synthetic
atacgccatgctgggtctccgtttccttatgttcaagaaaaattgaccaaaagagatttaatttggttggatgagaatggtttgctgttaggagttcacccacgactggctcagagaattcgtacttgggagtcggccat

SEQ ID NO: 384086 - DNA, 140 bp, Artificial Sequence
  Synthetic
atggccgactcccaagtacgaattctctgagccagtcgtgggtgaactcctaacagcaaaccattctcatccaaccaaattaaatctcttttggtcaatttttcttgaacataaggaaacggagacccagcatggcgtat

SEQ ID NO: 384087 - DNA, 140 bp, Artificial Sequence
  Synthetic
atacgccatgctgggtctccgaatctcagatgatgacaatgatagtgcagtagctgagtttttccaatcttttccatctggtgaaccatcaaattccaaattatctagttttttccaatccgtacttgggagtcggccat

SEQ ID NO: 384088 - DNA, 140 bp, Artificial Sequence
  Synthetic
atggccgactcccaagtacggattggaaaaaactagataatttggaatttgatggttcaccagatggaaaagattggaaaaactcagctactgcactatcattgtcatcatctgagattcggagacccagcatggcgtat

SEQ ID NO: 384089 - DNA, 140 bp, Artificial Sequence
  Synthetic
atacgccatgctgggtctccttatttaatactgttatgatggaaaattgttctgatttagatgttgtttttacaacttgtccaaaagatgaattgagaccattagagaaagttttggaatcgtacttgggagtcggccat

SEQ ID NO: 384090 - DNA, 140 bp, Artificial Sequence
  Synthetic
atggccgactcccaagtacgattccaaaactttctctaatggtctcaattcatcttttggacaagttgtaaaaacaacatctaaatcagaacaattttccatcataacagtattaaataaggagacccagcatggcgtat

SEQ ID NO: 384091 - DNA, 140 bp, Artificial Sequence
  Synthetic
atacgccatgctgggtctccctaaaacaagagctatcgatgcttgccctttggattatacaattctatgtcggatgtattggggtccagccattagttattttcatttgaacccagggttcgtacttgggagtcggccat

SEQ ID NO: 384092 - DNA, 140 bp, Artificial Sequence
  Synthetic
atggccgactcccaagtacgaaccctgggttcaaatgaaaataactaatggctggaccccaatacatccgacatagaattgtataatccaaagggcaagcatcgatagctcttgttttagggagacccagcatggcgtat

SEQ ID NO: 384093 - DNA, 140 bp, Artificial Sequence
  Synthetic
atacgccatgctgggtctccctggttctaagaagactcagggagagaagttcttcctgattcattctgctgattggctcactacacatgctctctttcatgaagttgcaaaattggatgtcgtacttgggagtcggccat

SEQ ID NO: 384094 - DNA, 140 bp, Artificial Sequence
  Synthetic
atggccgactcccaagtacgacatccaattttgcaacttcatgaaagagagcatgtgtagtgagccaatcagcagaatgaatcaggaagaacttctctccctgagtcttcttagaaccagggagacccagcatggcgtat

SEQ ID NO: 384095 - DNA, 140 bp, Artificial Sequence
  Synthetic
atacgccatgctgggtctccggtgaaattactgtataatgagcagtttgctgtccaagggttgttgagataccatacatatgcaaggtttggaattgagattcaagttcagataaaccctcgtacttgggagtcggccat

SEQ ID NO: 384096 - DNA, 140 bp, Artificial Sequence
  Synthetic
atggccgactcccaagtacgagggtttatctgaacttgaatctcaattccaaaccttgcatatgtatggtatctcaacaacccttggacagcaaactgctcattatacagtaatttcaccggagacccagcatggcgtat

SEQ ID NO: 384097 - DNA, 140 bp, Artificial Sequence
  Synthetic
atacgccatgctgggtctccacaccctttcaacaagggggactaatttgtgccatggttcctggtgaccaaagttatggttcgatagcatctttgacagtttatcctcatggtttgttaacgtacttgggagtcggccat

SEQ ID NO: 384098 - DNA, 140 bp, Artificial Sequence
  Synthetic
atggccgactcccaagtacgttaacaaaccatgaggataaactgtcaaagatgctatcgaaccataactttggtcaccaggaaccatggcacaaattagtcccccttgttgaaagggtgtggagacccagcatggcgtat

SEQ ID NO: 384099 - DNA, 140 bp, Artificial Sequence
  Synthetic
atacgccatgctgggtctccgtttgtggttcaatgccttctgggtctccttgtacagctttgttgaattcaattattaacaacatcaatttgtattatgtgttttctaaaatatttagaacgtacttgggagtcggccat

SEQ ID NO: 384100 - DNA, 140 bp, Artificial Sequence
  Synthetic
atggccgactcccaagtacgttctaaatattttagaaaacacataatacaaattgatgttgttaataattgaattcaacaaagctgtacaaggagacccagaaggcattgaaccacaaacggagacccagcatggcgtat

SEQ ID NO: 384101 - DNA, 140 bp, Artificial Sequence
  Synthetic
aggccctggctgctgatatgaattattaacaacatcaatttgtattatgtgttttctaaaatatttagaaagtctccagttttcttttgccaagctttgaggattctttgttatggagatgaccttttgggacagcggtg

SEQ ID NO: 384102 - DNA, 140 bp, Artificial Sequence
  Synthetic
caccgctgtcccaaaaggtcatctccataacaaagaatcctcaaagcttggcaaaagaaaactggagactttctaaatattttagaaaacacataatacaaattgatgttgttaataattcatatcagcagccagggcct

SEQ ID NO: 384103 - DNA, 140 bp, Artificial Sequence
  Synthetic
atacgccatgctgggtctccatctgttcaggtataacaatttttaaaagttttaaggatgcaatttattggctttacacaaaaatcagagaatattatgatctgaattatggtaataaaacgtacttgggagtcggccat

SEQ ID NO: 384104 - DNA, 140 bp, Artificial Sequence
  Synthetic
atggccgactcccaagtacgttttattaccataattcagatcataatattctctgatttttgtgtaaagccaataaattgcatccttaaaacttttaaaaattgttatacctgaacagatggagacccagcatggcgtat

SEQ ID NO: 384105 - DNA, 140 bp, Artificial Sequence
  Synthetic
aggccctggctgctgatatgactcctctttccacacagatgatgagaaatgaatttagagttagtactactgagaatgttgtgaatttgtcaaattatgaagatgcaagggcaaaaatgtgaccttttgggacagcggtg

SEQ ID NO: 384106 - DNA, 140 bp, Artificial Sequence
  Synthetic
caccgctgtcccaaaaggtcacatttttgcccttgcatcttcataatttgacaaattcacaacattctcagtagtactaactctaaattcatttctcatcatctgtgtggaaagaggagtcatatcagcagccagggcct

SEQ ID NO: 384107 - DNA, 140 bp, Artificial Sequence
  Synthetic
atacgccatgctgggtctcccttcagctgataaaaatgtgccgcaactgaagccagtttcagagttgacttttcttaaaagatcttttaatttggtggaggatagaatcagacctgcaatcgtacttgggagtcggccat

SEQ ID NO: 384108 - DNA, 140 bp, Artificial Sequence
  Synthetic
atggccgactcccaagtacgattgcaggtctgattctatcctccaccaaattaaaagatcttttaagaaaagtcaactctgaaactggcttcagttgcggcacatttttatcagctgaagggagacccagcatggcgtat

SEQ ID NO: 384109 - DNA, 140 bp, Artificial Sequence
  Synthetic
atacgccatgctgggtctcccttttgctttggatcaggaagactggaagtctgatccctcccaaggtggtggaattaaaattactcattttactacctggacatctattccaaccttggccgtacttgggagtcggccat

SEQ ID NO: 384110 - DNA, 140 bp, Artificial Sequence
  Synthetic
atggccgactcccaagtacggccaaggttggaatagatgtccaggtagtaaaatgagtaattttaattccaccaccttgggagggatcagacttccagtcttcctgatccaaagcaaaagggagacccagcatggcgtat

SEQ ID NO: 384111 - DNA, 140 bp, Artificial Sequence
  Synthetic
aggccctggctgctgatatgggaattaaaattactcattttactacctggacatctattccaaccttggctgctcagtttccatttaatgcttcagattcggtaggacaacaaattaaaggaccttttgggacagcggtg

SEQ ID NO: 384112 - DNA, 140 bp, Artificial Sequence
  Synthetic
caccgctgtcccaaaaggtcctttaatttgttgtcctaccgaatctgaagcattaaatggaaactgagcagccaaggttggaatagatgtccaggtagtaaaatgagtaattttaattcccatatcagcagccagggcct

SEQ ID NO: 384113 - DNA, 140 bp, Artificial Sequence
  Synthetic
atacgccatgctgggtctccagtttgagcagaatctagaaaatgctcagtggtttgcttttatgcatggctatgaattttatcagaaattttattattttgttcagtcctgtttggagaacgtacttgggagtcggccat

SEQ ID NO: 384114 - DNA, 140 bp, Artificial Sequence
  Synthetic
atggccgactcccaagtacgttctccaaacaggactgaacaaaataataaaatttctgataaaattcatagccatgcataaaagcaaaccactgagcattttctagattctgctcaaactggagacccagcatggcgtat

SEQ ID NO: 384115 - DNA, 140 bp, Artificial Sequence
  Synthetic
aggccctggctgctgatatgttatcccagtggacccatattttttccagatgacaaacactaatcctgatcaaaagtgtataactgccttggcttctatttgtcagatgttttgcttttggaccttttgggacagcggtg

SEQ ID NO: 384116 - DNA, 140 bp, Artificial Sequence
  Synthetic
caccgctgtcccaaaaggtccaaaagcaaaacatctgacaaatagaagccaaggcagttatacacttttgatcaggattagtgtttgtcatctggaaaaaatatgggtccactgggataacatatcagcagccagggcct

SEQ ID NO: 384117 - DNA, 140 bp, Artificial Sequence
  Synthetic
aggccctggctgctgatatgtgtttggagaaagagatgatagaatatagacttaaatcttatgattggtggagaatgagattttatgaccagtgtttcatttgtgacctttcatgatttggaccttttgggacagcggtg

SEQ ID NO: 384118 - DNA, 140 bp, Artificial Sequence
  Synthetic
caccgctgtcccaaaaggtccaaatcatgaaaggtcacaaatgaaacactggtcataaaatctcattctccaccaatcataagatttaagtctatattctatcatctctttctccaaacacatatcagcagccagggcct

SEQ ID NO: 384119 - DNA, 140 bp, Artificial Sequence
  Synthetic
aggccctggctgctgatatgaactttgagatttcgtgttccttggatttcagatactccttacagagttaacagatacactaaatcgtcacatcagaaaggagagtatactgccataggagaccttttgggacagcggtg

SEQ ID NO: 384120 - DNA, 140 bp, Artificial Sequence
  Synthetic
caccgctgtcccaaaaggtctcctatggcagtatactctcctttctgatgtgacgatttagtgtatctgttaactctgtaaggagtatctgaaatccaaggaacacgaaatctcaaagttcatatcagcagccagggcct

SEQ ID NO: 384121 - DNA, 140 bp, Artificial Sequence
  Synthetic
atacgccatgctgggtctcctattacaggagtgcaatcaaccttgagatttcgtgttccttggatttctgacacaccctatcgggtgaataggtacacgaagtcagcacatcaaaaaggtcgtacttgggagtcggccat

SEQ ID NO: 384122 - DNA, 140 bp, Artificial Sequence
  Synthetic
atggccgactcccaagtacgacctttttgatgtgctgacttcgtgtacctattcacccgatagggtgtgtcagaaatccaaggaacacgaaatctcaaggttgattgcactcctgtaataggagacccagcatggcgtat

SEQ ID NO: 384123 - DNA, 140 bp, Artificial Sequence
  Synthetic
aggccctggctgctgatatgcccagtttgggaattgacaatcagagtctggtcagagttgaatattggaacaggaacttcagcttacacttcactcaatgttttagctaggtttacagatgaccttttgggacagcggtg

SEQ ID NO: 384124 - DNA, 140 bp, Artificial Sequence
  Synthetic
caccgctgtcccaaaaggtcatctgtaaacctagctaaaacattgagtgaagtgtaagctgaagttcctgttccaatattcaactctgaccagactctgattgtcaattcccaaactgggcatatcagcagccagggcct

SEQ ID NO: 384125 - DNA, 140 bp, Artificial Sequence
  Synthetic
atacgccatgctgggtctccaattgtaacatcaataatgtggtgagaataaaggtgccatttatttacactaggggtgcatatcatttcaaggatccacaatatcctgtttgggagttgacgtacttgggagtcggccat

SEQ ID NO: 384126 - DNA, 140 bp, Artificial Sequence
  Synthetic
atggccgactcccaagtacgtcaactcccaaacaggatattgtggatccttgaaatgatatgcacccctagtgtaaataaatggcacctttattctcaccacattattgatgttacaattggagacccagcatggcgtat

SEQ ID NO: 384127 - DNA, 140 bp, Artificial Sequence
  Synthetic
atacgccatgctgggtctccacacaggttggagatgattcaggaggtttttcaacaacagtttctacagagcagaacgttcctgatccccaagtcggcataacaaccatgagggacttaacgtacttgggagtcggccat

SEQ ID NO: 384128 - DNA, 140 bp, Artificial Sequence
  Synthetic
atggccgactcccaagtacgttaagtccctcatggttgttatgccgacttggggatcaggaacgttctgctctgtagaaactgttgttgaaaaacctcctgaatcatctccaacctgtgtggagacccagcatggcgtat

SEQ ID NO: 384129 - DNA, 140 bp, Artificial Sequence
  Synthetic
aggccctggctgctgatatggacaaaaaccattcaacgccggaggactggctctcatccagtggatgcattgagtggattgattgtcagggctgtctctaggtttaatctcagacctctcgaccttttgggacagcggtg

SEQ ID NO: 384130 - DNA, 140 bp, Artificial Sequence
  Synthetic
caccgctgtcccaaaaggtcgagaggtctgagattaaacctagagacagccctgacaatcaatccactcaatgcatccactggatgagagccagtcctccggcgttgaatggtttttgtccatatcagcagccagggcct

SEQ ID NO: 384131 - DNA, 140 bp, Artificial Sequence
  Synthetic
atacgccatgctgggtctccaagggaaagccaataaggggaagatggatgtttcaggagtgcaagcacctgtaggagctattacaacaattgaggatccagtcttagcaaagaaagtacccgtacttgggagtcggccat

SEQ ID NO: 384132 - DNA, 140 bp, Artificial Sequence
  Synthetic
atggccgactcccaagtacgggtactttctttgctaagactggatcctcaattgttgtaatagctcctacaggtgcttgcactcctgaaacatccatcttccccttattggctttcccttggagacccagcatggcgtat

SEQ ID NO: 384133 - DNA, 140 bp, Artificial Sequence
  Synthetic
atacgccatgctgggtctccacatgtccatttataaattcatgggaaggtctcattttctgtgtacttttacttttaactcaaataataaagagtacacatttccaataactttatcttccgtacttgggagtcggccat

SEQ ID NO: 384134 - DNA, 140 bp, Artificial Sequence
  Synthetic
atggccgactcccaagtacggaagataaagttattggaaatgtgtactctttattatttgagttaaaagtaaaagtacacagaaaatgagaccttcccatgaatttataaatggacatgtggagacccagcatggcgtat

SEQ ID NO: 384135 - DNA, 140 bp, Artificial Sequence
  Synthetic
aggccctggctgctgatatggaccagtgctttgtttgtgacctttcatgatttgtttaaacaaattttcttaaaatttctgaggtttgtttattttatcttttcagtaaataaaaaaaaagaccttttgggacagcggtg

SEQ ID NO: 384136 - DNA, 140 bp, Artificial Sequence
  Synthetic
caccgctgtcccaaaaggtctttttttttatttactgaaaagataaaataaacaaacctcagaaattttaagaaaatttgtttaaacaaatcatgaaaggtcacaaacaaagcactggtccatatcagcagccagggcct

SEQ ID NO: 384137 - DNA, 140 bp, Artificial Sequence
  Synthetic
aggccctggctgctgatatgttgatgatcctcgatctgaggaggatcgtaaatttgaaagtcatattgaaaagaggaaaccttataaagagttaagattggaggtaggtaagcaaaggctgaccttttgggacagcggtg

SEQ ID NO: 384138 - DNA, 140 bp, Artificial Sequence
  Synthetic
caccgctgtcccaaaaggtcagcctttgcttacctacctccaatcttaactctttataaggtttcctcttttcaatatgactttcaaatttacgatcctcctcagatcgaggatcatcaacatatcagcagccagggcct

SEQ ID NO: 384139 - DNA, 140 bp, Artificial Sequence
  Synthetic
atacgccatgctgggtctcctgtcgacaccccttgggtggaaaaggagtcagctttgtctattgattataaaactgcccttggagctgttagatttaatacaagaagaacagggaacattcgtacttgggagtcggccat

SEQ ID NO: 384140 - DNA, 140 bp, Artificial Sequence
  Synthetic
atggccgactcccaagtacgaatgttccctgttcttcttgtattaaatctaacagctccaagggcagttttataatcaatagacaaagctgactccttttccacccaaggggtgtcgacaggagacccagcatggcgtat

SEQ ID NO: 384141 - DNA, 140 bp, Artificial Sequence
  Synthetic
atacgccatgctgggtctccatcctcatggtttgttaaattgcaatattaataacgtagttagaataaaggttccatttatttacactagaggtgcttatcatttcaaagacccacagtacgtacttgggagtcggccat

SEQ ID NO: 384142 - DNA, 140 bp, Artificial Sequence
  Synthetic
atggccgactcccaagtacgtactgtgggtctttgaaatgataagcacctctagtgtaaataaatggaacctttattctaactacgttattaatattgcaatttaacaaaccatgaggatggagacccagcatggcgtat

SEQ ID NO: 384143 - DNA, 140 bp, Artificial Sequence
  Synthetic
aggccctggctgctgatatgcaggaacttcagcttacacttcactcaatgttttagctaggttcacagatttggagttacatggattaactcctctttctacacaaatgatgagaaatgagaccttttgggacagcggtg

SEQ ID NO: 384144 - DNA, 140 bp, Artificial Sequence
  Synthetic
caccgctgtcccaaaaggtctcatttctcatcatttgtgtagaaagaggagttaatccatgtaactccaaatctgtgaacctagctaaaacattgagtgaagtgtaagctgaagttcctgcatatcagcagccagggcct

SEQ ID NO: 384145 - DNA, 140 bp, Artificial Sequence
  Synthetic
atacgccatgctgggtctccttgtctgtcacagaacaatcggagttttattttcccagagctccattgaactcaaatgctatgttgtccactgagtctatgatgagtagaattgcagctgcgtacttgggagtcggccat

SEQ ID NO: 384146 - DNA, 140 bp, Artificial Sequence
  Synthetic
atggccgactcccaagtacgcagctgcaattctactcatcatagactcagtggacaacatagcatttgagttcaatggagctctgggaaaataaaactccgattgttctgtgacagacaaggagacccagcatggcgtat

SEQ ID NO: 384147 - DNA, 140 bp, Artificial Sequence
  Synthetic
atacgccatgctgggtctccgagacttggagtcatcagtggatgatcctagatcagaggaggacagaagatttgagagccatatagaatgtaggaaaccatacaaagaattgagattggacgtacttgggagtcggccat

SEQ ID NO: 384148 - DNA, 140 bp, Artificial Sequence
  Synthetic
atggccgactcccaagtacgtccaatctcaattctttgtatggtttcctacattctatatggctctcaaatcttctgtcctcctctgatctaggatcatccactgatgactccaagtctcggagacccagcatggcgtat

SEQ ID NO: 384149 - DNA, 140 bp, Artificial Sequence
  Synthetic
atacgccatgctgggtctcctccctgtgcagtgatggacattacaggagtgcagtccaccttgagatttcgtgttccttggatttctgatacaccctatcgggtgaataggtacacgaagcgtacttgggagtcggccat

SEQ ID NO: 384150 - DNA, 140 bp, Artificial Sequence
  Synthetic
atggccgactcccaagtacgcttcgtgtacctattcacccgatagggtgtatcagaaatccaaggaacacgaaatctcaaggtggactgcactcctgtaatgtccatcactgcacagggaggagacccagcatggcgtat

SEQ ID NO: 384151 - DNA, 140 bp, Artificial Sequence
  Synthetic
aggccctggctgctgatatgtgcttccacctcctagaaaagtgaaaggagttttttcccaggctaaaatttctcttttttatactgaggagcatgaaataatgaaattttcttggagagggaccttttgggacagcggtg

SEQ ID NO: 384152 - DNA, 140 bp, Artificial Sequence
  Synthetic
caccgctgtcccaaaaggtccctctccaagaaaatttcattatttcatgctcctcagtataaaaaagagaaattttagcctgggaaaaaactcctttcacttttctaggaggtggaagcacatatcagcagccagggcct

SEQ ID NO: 384153 - DNA, 140 bp, Artificial Sequence
  Synthetic
atacgccatgctgggtctcctcagcacaccaaaaaggtgagtatactgctattgggaagcttattgtgtattgttacaacagattgacttctccttctaatgttgcttctcatgttagagcgtacttgggagtcggccat

SEQ ID NO: 384154 - DNA, 140 bp, Artificial Sequence
  Synthetic
atggccgactcccaagtacgctctaacatgagaagcaacattagaaggagaagtcaatctgttgtaacaatacacaataagcttcccaatagcagtatactcacctttttggtgtgctgaggagacccagcatggcgtat

SEQ ID NO: 384155 - DNA, 140 bp, Artificial Sequence
  Synthetic
aggccctggctgctgatatgcatgctatggatgttaccacacaggttggagatgattcaggaggtttttcaacaacagtttctacagagcagaatgttcctgatccccaagttggcataagaccttttgggacagcggtg

SEQ ID NO: 384156 - DNA, 140 bp, Artificial Sequence
  Synthetic
caccgctgtcccaaaaggtcttatgccaacttggggatcaggaacattctgctctgtagaaactgttgttgaaaaacctcctgaatcatctccaacctgtgtggtaacatccatagcatgcatatcagcagccagggcct

SEQ ID NO: 384157 - DNA, 140 bp, Artificial Sequence
  Synthetic
aggccctggctgctgatatggctttacacaaaaattagagaatactatgatctgaattatggtaataagaaggatgttctcaatattttgaaagatcatcaacaaaagatagagagagcagaccttttgggacagcggtg

SEQ ID NO: 384158 - DNA, 140 bp, Artificial Sequence
  Synthetic
caccgctgtcccaaaaggtctgctctctctatcttttgttgatgatctttcaaaatattgagaacatccttcttattaccataattcagatcatagtattctctaatttttgtgtaaagccatatcagcagccagggcct

SEQ ID NO: 384159 - DNA, 140 bp, Artificial Sequence
  Synthetic
atacgccatgctgggtctcctttagcaaagaaagtacctgagacatttcctgaattgaagcctggagagtccagacatacatcagatcatatgtccatttataaattcatgggaaggtctcgtacttgggagtcggccat

SEQ ID NO: 384160 - DNA, 140 bp, Artificial Sequence
  Synthetic
atggccgactcccaagtacgagaccttcccatgaatttataaatggacatatgatctgatgtatgtctggactctccaggcttcaattcaggaaatgtctcaggtactttctttgctaaaggagacccagcatggcgtat

SEQ ID NO: 384161 - DNA, 140 bp, Artificial Sequence
  Synthetic
aggccctggctgctgatatgactttcttggattctattgctgggactctgaaatctatgatgtttgggtttcatcattctgtgactgttgaaattataaatactgtgctttgctttgttagaccttttgggacagcggtg

SEQ ID NO: 384162 - DNA, 140 bp, Artificial Sequence
  Synthetic
caccgctgtcccaaaaggtctaacaaagcaaagcacagtatttataatttcaacagtcacagaatgatgaaacccaaacatcatagatttcagagtcccagcaatagaatccaagaaagtcatatcagcagccagggcct

SEQ ID NO: 384163 - DNA, 140 bp, Artificial Sequence
  Synthetic
aggccctggctgctgatatgaaagacatgtcatgtgttgatcttgttatggataatcataatgtttcattgtctgaattacttagttcactggtgatgacagtagaaattagaaaacaaagaccttttgggacagcggtg

SEQ ID NO: 384164 - DNA, 140 bp, Artificial Sequence
  Synthetic
caccgctgtcccaaaaggtctttgttttctaatttctactgtcatcaccagtgaactaagtaattcagacaatgaaacattatgattatccataacaagatcaacacatgacatgtctttcatatcagcagccagggcct

SEQ ID NO: 384165 - DNA, 140 bp, Artificial Sequence
  Synthetic
aggccctggctgctgatatgaaagtggaatcctgctttatgtcatacaacaattgaaccaagatgagcactctcacataattggtttattgagagttatgaattatgcagatattggctggaccttttgggacagcggtg

SEQ ID NO: 384166 - DNA, 140 bp, Artificial Sequence
  Synthetic
caccgctgtcccaaaaggtccagccaatatctgcataattcataactctcaataaaccaattatgtgagagtgctcatcttggttcaattgttgtatgacataaagcaggattccactttcatatcagcagccagggcct

SEQ ID NO: 384167 - DNA, 140 bp, Artificial Sequence
  Synthetic
aggccctggctgctgatatgaagagttatcaaatgaagtgcttccacctcctaggaaaatgaaagggatattttcacaagctaaaatctctcttttttatactgaggagcatgaaataatgaccttttgggacagcggtg

SEQ ID NO: 384168 - DNA, 140 bp, Artificial Sequence
  Synthetic
caccgctgtcccaaaaggtcattatttcatgctcctcagtataaaaaagagagattttagcttgtgaaaatatccctttcattttcctaggaggtggaagcacttcatttgataactcttcatatcagcagccagggcct

SEQ ID NO: 384169 - DNA, 140 bp, Artificial Sequence
  Synthetic
aggccctggctgctgatatgtaaattatggcaagaaaaaggatgttcttaatattcttaaagacaatcagcaaaaaatagaaaaagccattgaagaagcagacaatttttgcattttgcagaccttttgggacagcggtg

SEQ ID NO: 384170 - DNA, 140 bp, Artificial Sequence
  Synthetic
caccgctgtcccaaaaggtctgcaaaatgcaaaaattgtctgcttcttcaatggctttttctattttttgctgattgtctttaagaatattaagaacatcctttttcttgccataatttacatatcagcagccagggcct

SEQ ID NO: 384171 - DNA, 140 bp, Artificial Sequence
  Synthetic
atacgccatgctgggtctccaattcaagatgtagaaaaatttgaccagtatcagaagggggttgatttaatacaaaagctgagaactgtccattcaatggctcaggttgaccctaacctgcgtacttgggagtcggccat

SEQ ID NO: 384172 - DNA, 140 bp, Artificial Sequence
  Synthetic
atggccgactcccaagtacgcaggttagggtcaacctgagccattgaatggacagttctcagcttttgtattaaatcaacccccttctgatactggtcaaatttttctacatcttgaattggagacccagcatggcgtat

SEQ ID NO: 384173 - DNA, 140 bp, Artificial Sequence
  Synthetic
atacgccatgctgggtctccggggttcatttatcacctcttagagattgtatagcaagagttcatcaaaagctcaagaatcttggatctataaatcaggctatggtgacaagatgtgagccgtacttgggagtcggccat

SEQ ID NO: 384174 - DNA, 140 bp, Artificial Sequence
  Synthetic
atggccgactcccaagtacggctcacatcttgtcaccatagcctgatttatagatccaagattcttgagcttttgatgaactcttgctatacaatctctaagaggtgataaatgaaccccggagacccagcatggcgtat

SEQ ID NO: 384175 - DNA, 140 bp, Artificial Sequence
  Synthetic
aggccctggctgctgatatggtgtttcctgttgcattggttaaatccaaagaaaattaatttagcagatagaatgcttggattgtctggagtgcaggaaattaaagaacagggtgttggagaccttttgggacagcggtg

SEQ ID NO: 384176 - DNA, 140 bp, Artificial Sequence
  Synthetic
caccgctgtcccaaaaggtctccaacaccctgttctttaatttcctgcactccagacaatccaagcattctatctgctaaattaattttctttggatttaaccaatgcaacaggaaacaccatatcagcagccagggcct

SEQ ID NO: 384177 - DNA, 140 bp, Artificial Sequence
  Synthetic
aggccctggctgctgatatgagcaagagtccaccaaaagctcaagagtcttggatctataaatcaagccatggtaacaagatgtgagccagttgtgtgctatttgtatggcaaaagaggggaccttttgggacagcggtg

SEQ ID NO: 384178 - DNA, 140 bp, Artificial Sequence
  Synthetic
caccgctgtcccaaaaggtcccctcttttgccatacaaatagcacacaactggctcacatcttgttaccatggcttgatttatagatccaagactcttgagcttttggtggactcttgctcatatcagcagccagggcct

SEQ ID NO: 384179 - DNA, 140 bp, Artificial Sequence
  Synthetic
aggccctggctgctgatatggaaaaatatttacactaaacctgtggcctcagactattgggatggttacagtggacgattggtttgtataattgatgatatcggccaaaatacaacagatgaccttttgggacagcggtg

SEQ ID NO: 384180 - DNA, 140 bp, Artificial Sequence
  Synthetic
caccgctgtcccaaaaggtcatctgttgtattttggccgatatcatcaattatacaaaccaatcgtccactgtaaccatcccaatagtctgaggccacaggtttagtgtaaatatttttccatatcagcagccagggcct

SEQ ID NO: 384181 - DNA, 140 bp, Artificial Sequence
  Synthetic
atacgccatgctgggtctccttatgcagatattggctgttcagttatttcatgtggcaaagttttttccaaaatgttagaaacagtttttaattggcaaatggactctagaatgatggagcgtacttgggagtcggccat

SEQ ID NO: 384182 - DNA, 140 bp, Artificial Sequence
  Synthetic
atggccgactcccaagtacgctccatcattctagagtccatttgccaattaaaaactgtttctaacattttggaaaaaactttgccacatgaaataactgaacagccaatatctgcataaggagacccagcatggcgtat

SEQ ID NO: 384183 - DNA, 140 bp, Artificial Sequence
  Synthetic
atacgccatgctgggtctcctgaaggatttttatgacgtaaattatggcaagaaaaaggatgttcttaacattcttaaagataaccagcaaaaaatagagaaagccattgaagaagcagacgtacttgggagtcggccat

SEQ ID NO: 384184 - DNA, 140 bp, Artificial Sequence
  Synthetic
atggccgactcccaagtacgtctgcttcttcaatggctttctctattttttgctggttatctttaagaatgttaagaacatcctttttcttgccataatttacgtcataaaaatccttcaggagacccagcatggcgtat

SEQ ID NO: 384185 - DNA, 140 bp, Artificial Sequence
  Synthetic
aggccctggctgctgatatgttatgggcagatctcacttcctatgtacatttacatttaattctaacaacaaagagtatacttttcccatcactttgtcatcaacttctaatcctcctcagaccttttgggacagcggtg

SEQ ID NO: 384186 - DNA, 140 bp, Artificial Sequence
  Synthetic
caccgctgtcccaaaaggtctgaggaggattagaagttgatgacaaagtgatgggaaaagtatactctttgttgttagaattaaatgtaaatgtacataggaagtgagatctgcccataacatatcagcagccagggcct

SEQ ID NO: 384187 - DNA, 140 bp, Artificial Sequence
  Synthetic
aggccctggctgctgatatgcaatttttgcattttgcaaattcaagatgtagagaaatttgatcagtatcagaaaggggttgatttaatacaaaagttgagaactgtccattcaatggctgaccttttgggacagcggtg

SEQ ID NO: 384188 - DNA, 140 bp, Artificial Sequence
  Synthetic
caccgctgtcccaaaaggtcagccattgaatggacagttctcaacttttgtattaaatcaacccctttctgatactgatcaaatttctctacatcttgaatttgcaaaatgcaaaaattgcatatcagcagccagggcct

SEQ ID NO: 384189 - DNA, 140 bp, Artificial Sequence
  Synthetic
atacgccatgctgggtctccatctgggtcaaggctgtcacagtttttccaatcagttaccaatcataagtgggttgcagttggggctgctgtgggagttcttggtgttttggttgggggtcgtacttgggagtcggccat

SEQ ID NO: 384190 - DNA, 140 bp, Artificial Sequence
  Synthetic
atggccgactcccaagtacgacccccaaccaaaacaccaagaactcccacagcagccccaactgcaacccacttatgattggtaactgattggaaaaactgtgacagccttgacccagatggagacccagcatggcgtat

SEQ ID NO: 384191 - DNA, 140 bp, Artificial Sequence
  Synthetic
atacgccatgctgggtctcccaagttgaccccaacttgggggttcatttgtcacctctgagagattgcatagcaagagtccaccaaaagctcaagagtcttggatctataaatcaagccacgtacttgggagtcggccat

SEQ ID NO: 384192 - DNA, 140 bp, Artificial Sequence
  Synthetic
atggccgactcccaagtacgtggcttgatttatagatccaagactcttgagcttttggtggactcttgctatgcaatctctcagaggtgacaaatgaacccccaagttggggtcaacttgggagacccagcatggcgtat

SEQ ID NO: 384193 - DNA, 140 bp, Artificial Sequence
  Synthetic
atacgccatgctgggtctccttccaaccaaatatcattcaggtagattgttgttttgttttgttcctgggaatgagttgatagatgttactggaattacattaaaacaggcaaccactgccgtacttgggagtcggccat

SEQ ID NO: 384194 - DNA, 140 bp, Artificial Sequence
  Synthetic
atggccgactcccaagtacggcagtggttgcctgttttaatgtaattccagtaacatctatcaactcattcccaggaacaaaacaaaacaacaatctacctgaatgatatttggttggaaggagacccagcatggcgtat

SEQ ID NO: 384195 - DNA, 140 bp, Artificial Sequence
  Synthetic
atacgccatgctgggtctccgagtgcttgtaggaggatggtttgtatataggcacttctcccgtaaagaggaagaaccaattccagcagaaggggtctatcatggtgtgactaagcccaacgtacttgggagtcggccat

SEQ ID NO: 384196 - DNA, 140 bp, Artificial Sequence
  Synthetic
atggccgactcccaagtacgttgggcttagtcacaccatgatagaccccttctgctggaattggttcttcctctttacgggagaagtgcctatatacaaaccatcctcctacaagcactcggagacccagcatggcgtat

SEQ ID NO: 384197 - DNA, 140 bp, Artificial Sequence
  Synthetic
atacgccatgctgggtctccattattgggatggatatagtggacaattagtttgcattattgatgatattggccaaaatacaacagatgaagattggtcagatttttgtcaattggtgtccgtacttgggagtcggccat

SEQ ID NO: 384198 - DNA, 140 bp, Artificial Sequence
  Synthetic
atggccgactcccaagtacggacaccaattgacaaaaatctgaccaatcttcatctgttgtattttggccaatatcatcaataatgcaaactaattgtccactatatccatcccaataatggagacccagcatggcgtat

SEQ ID NO: 384199 - DNA, 140 bp, Artificial Sequence
  Synthetic
aggccctggctgctgatatgggccaaaatacaacagatgaagattggtcagatttttgtcaattggtgtcagggtgtccaatgagattgaatatggcttctcttgaggagaagggtagacgaccttttgggacagcggtg

SEQ ID NO: 384200 - DNA, 140 bp, Artificial Sequence
  Synthetic
caccgctgtcccaaaaggtcgtctacccttctcctcaagagaagccatattcaatctcattggacaccctgacaccaattgacaaaaatctgaccaatcttcatctgttgtattttggcccatatcagcagccagggcct

SEQ ID NO: 384201 - DNA, 140 bp, Artificial Sequence
  Synthetic
atacgccatgctgggtctccaatgaaggttcctacaattcctaagtttagagatattactcagcattttattaagaaaggagatgtgcctagagctttgaatcgcttggcaacattagtgcgtacttgggagtcggccat

SEQ ID NO: 384202 - DNA, 140 bp, Artificial Sequence
  Synthetic
atggccgactcccaagtacgcactaatgttgccaagcgattcaaagctctaggcacatctcctttcttaataaaatgctgagtaatatctctaaacttaggaattgtaggaaccttcattggagacccagcatggcgtat

SEQ ID NO: 384203 - DNA, 140 bp, Artificial Sequence
  Synthetic
aggccctggctgctgatatggtttcatttgtgacctttcatgatttgtttaaacaaattttcttaaaatttctgaggtttgtttatttcttttatcagtaaataaaaaaaaaaaaaaaaagaccttttgggacagcggtg

SEQ ID NO: 384204 - DNA, 140 bp, Artificial Sequence
  Synthetic
caccgctgtcccaaaaggtctttttttttttttttttatttactgataaaagaaataaacaaacctcagaaattttaagaaaatttgtttaaacaaatcatgaaaggtcacaaatgaaaccatatcagcagccagggcct

SEQ ID NO: 384205 - DNA, 140 bp, Artificial Sequence
  Synthetic
aggccctggctgctgatatgattttcctgcagctatgccattttctaaagctgagattgatccaatggctataatgttgtccaaatattcactgcctattgtggaagaaccagaggattagaccttttgggacagcggtg

SEQ ID NO: 384206 - DNA, 140 bp, Artificial Sequence
  Synthetic
caccgctgtcccaaaaggtctaatcctctggttcttccacaataggcagtgaatatttggacaacattatagccattggatcaatctcagctttagaaaatggcatagctgcaggaaaatcatatcagcagccagggcct

SEQ ID NO: 384207 - DNA, 140 bp, Artificial Sequence
  Synthetic
aggccctggctgctgatatgttgaaaaggattatgaaatgatggagttttattttaatagaggtggaacttactattcaatctcagctggcaatgttgttattcaatctttagatgtggggaccttttgggacagcggtg

SEQ ID NO: 384208 - DNA, 140 bp, Artificial Sequence
  Synthetic
caccgctgtcccaaaaggtccccacatctaaagattgaataacaacattgccagctgagattgaatagtaagttccacctctattaaaataaaactccatcatttcataatccttttcaacatatcagcagccagggcct

SEQ ID NO: 384209 - DNA, 140 bp, Artificial Sequence
  Synthetic
aggccctggctgctgatatgaagattgactaaaagagatttgatttggttggatgagaatggtttgctgctgggagttcatccaagattggcccagagaattttatttaatactgttatggaccttttgggacagcggtg

SEQ ID NO: 384210 - DNA, 140 bp, Artificial Sequence
  Synthetic
caccgctgtcccaaaaggtccataacagtattaaataaaattctctgggccaatcttggatgaactcccagcagcaaaccattctcatccaaccaaatcaaatctcttttagtcaatcttcatatcagcagccagggcct

SEQ ID NO: 384211 - DNA, 140 bp, Artificial Sequence
  Synthetic
aggccctggctgctgatatgcgcttggcaacattagtgacaaccgttaatggaactcctatgttaatttctgagggaccattaaaaatggaagaaaaagccacttatgttcacaagaagagaccttttgggacagcggtg

SEQ ID NO: 384212 - DNA, 140 bp, Artificial Sequence
  Synthetic
caccgctgtcccaaaaggtctcttcttgtgaacataagtggctttttcttccatttttaatggtccctcagaaattaacataggagttccattaacggttgtcactaatgttgccaagcgcatatcagcagccagggcct

SEQ ID NO: 384213 - DNA, 140 bp, Artificial Sequence
  Synthetic
atacgccatgctgggtctccacttctgtggatcaatcttctgttcatacggctgaagttggttcacaccaacctgaacctctgaaaacctctgttgacaagccaggttctaagaggacaccgtacttgggagtcggccat

SEQ ID NO: 384214 - DNA, 140 bp, Artificial Sequence
  Synthetic
atggccgactcccaagtacggtgtcctcttagaacctggcttgtcaacagaggttttcagaggttcaggttggtgtgaaccaacttcagccgtatgaacagaagattgatccacagaagtggagacccagcatggcgtat

SEQ ID NO: 384215 - DNA, 140 bp, Artificial Sequence
  Synthetic
atacgccatgctgggtctccgatttggagatgttggtcttgacttggatttttccgcttttgatgctagtcttagtccatttatgattagagaggcaggtagaattatgagtgaattatccgtacttgggagtcggccat

SEQ ID NO: 384216 - DNA, 140 bp, Artificial Sequence
  Synthetic
atggccgactcccaagtacggataattcactcataattctacctgcctctctaatcataaatggactaagactagcatcaaaagcggaaaaatccaagtcaagaccaacatctccaaatcggagacccagcatggcgtat

SEQ ID NO: 384217 - DNA, 140 bp, Artificial Sequence
  Synthetic
atacgccatgctgggtctccggaatggcttggttcactcccgttgggttggcagtagacaccccatgggttgagaaggagtctgctctttccattgactataaaacagctcttggcgctgcgtacttgggagtcggccat

SEQ ID NO: 384218 - DNA, 140 bp, Artificial Sequence
  Synthetic
atggccgactcccaagtacgcagcgccaagagctgttttatagtcaatggaaagagcagactccttctcaacccatggggtgtctactgccaacccaacgggagtgaaccaagccattccggagacccagcatggcgtat

SEQ ID NO: 384219 - DNA, 140 bp, Artificial Sequence
  Synthetic
atacgccatgctgggtctccgaaattgatccaatggctatgatgttgtctaaatattcattacctattgtagaagaaccagaggattataaggaagcttcagttttttatcaaaataaaacgtacttgggagtcggccat

SEQ ID NO: 384220 - DNA, 140 bp, Artificial Sequence
  Synthetic
atggccgactcccaagtacgttttattttgataaaaaactgaagcttccttataatcctctggttcttctacaataggtaatgaatatttagacaacatcatagccattggatcaatttcggagacccagcatggcgtat

SEQ ID NO: 384221 - DNA, 140 bp, Artificial Sequence
  Synthetic
aggccctggctgctgatatgctaaacatctgctgtacaattgttgttatcacgtttgtggttcaatgccttctgggtctccttgcacagctctgttgaattcaattattaataatatcaagaccttttgggacagcggtg

SEQ ID NO: 384222 - DNA, 140 bp, Artificial Sequence
  Synthetic
caccgctgtcccaaaaggtcttgatattattaataattgaattcaacagagctgtgcaaggagacccagaaggcattgaaccacaaacgtgataacaacaattgtacagcagatgtttagcatatcagcagccagggcct

SEQ ID NO: 384223 - DNA, 140 bp, Artificial Sequence
  Synthetic
atacgccatgctgggtctcctaataggcaaggctcagttagttgatgactttttagatcttgatatggccattacaggggctccaggtattgatgctattaatatggattcatctcctggcgtacttgggagtcggccat

SEQ ID NO: 384224 - DNA, 140 bp, Artificial Sequence
  Synthetic
atggccgactcccaagtacgccaggagatgaatccatattaatagcatcaatacctggagcccctgtaatggccatatcaagatctaaaaagtcatcaactaactgagccttgcctattaggagacccagcatggcgtat

SEQ ID NO: 384225 - DNA, 140 bp, Artificial Sequence
  Synthetic
atacgccatgctgggtctcctttgtattatgtgttttctaaaatatttggaaagtctccagttttcttttgtcaagctttgaggatcctttgttatggagatgatgttttgatagtctttcgtacttgggagtcggccat

SEQ ID NO: 384226 - DNA, 140 bp, Artificial Sequence
  Synthetic
atggccgactcccaagtacgaaagactatcaaaacatcatctccataacaaaggatcctcaaagcttgacaaaagaaaactggagactttccaaatattttagaaaacacataatacaaaggagacccagcatggcgtat

SEQ ID NO: 384227 - DNA, 140 bp, Artificial Sequence
  Synthetic
atacgccatgctgggtctccgtttccttatgttcaagaaaaattgactaaaagagatttaatttggttggatgaaaatggtttgctgttaggagttcatccacgactggcccagagaattcgtacttgggagtcggccat

SEQ ID NO: 384228 - DNA, 140 bp, Artificial Sequence
  Synthetic
atggccgactcccaagtacgaattctctgggccagtcgtggatgaactcctaacagcaaaccattttcatccaaccaaattaaatctcttttagtcaatttttcttgaacataaggaaacggagacccagcatggcgtat

SEQ ID NO: 384229 - DNA, 140 bp, Artificial Sequence
  Synthetic
atacgccatgctgggtctccggatgagtttaaaaaacttggcatgacagctacttcagctgataaaaatatgcctcaattaaagccagtttcagaattgacttttcttaaaagatcttttcgtacttgggagtcggccat

SEQ ID NO: 384230 - DNA, 140 bp, Artificial Sequence
  Synthetic
atggccgactcccaagtacgaaaagatcttttaagaaaagtcaattctgaaactggctttaattgaggcatatttttatcagctgaagtagctgtcatgccaagttttttaaactcatccggagacccagcatggcgtat

SEQ ID NO: 384231 - DNA, 140 bp, Artificial Sequence
  Synthetic
atacgccatgctgggtctccaatttggtggaggatagaattagacctgcaatttcagaaaagacaatttggtctttgatagcttggcagagaagtaacgctgagtttgagcagaatttagcgtacttgggagtcggccat

SEQ ID NO: 384232 - DNA, 140 bp, Artificial Sequence
  Synthetic
atggccgactcccaagtacgctaaattctgctcaaactcagcgttacttctctgccaagctatcaaagaccaaattgtcttttctgaaattgcaggtctaattctatcctccaccaaattggagacccagcatggcgtat

SEQ ID NO: 384233 - DNA, 140 bp, Artificial Sequence
  Synthetic
atacgccatgctgggtctccattttcctgcagctatgcctttttctaaagctgaaattgatccaatggctgtaatgttgtctaaatattcattacctattgtggaagaaccagaggattacgtacttgggagtcggccat

SEQ ID NO: 384234 - DNA, 140 bp, Artificial Sequence
  Synthetic
atggccgactcccaagtacgtaatcctctggttcttccacaataggtaatgaatatttagacaacattacagccattggatcaatttcagctttagaaaaaggcatagctgcaggaaaatggagacccagcatggcgtat

SEQ ID NO: 384235 - DNA, 140 bp, Artificial Sequence
  Synthetic
aggccctggctgctgatatggagattttatgaccagtgtttcatttgtgacctttcatgatttgtttaaacaaattttcttaaaatttctgaggtttgtttatttcttttatcagtaaatgaccttttgggacagcggtg

SEQ ID NO: 384236 - DNA, 140 bp, Artificial Sequence
  Synthetic
caccgctgtcccaaaaggtcatttactgataaaagaaataaacaaacctcagaaattttaagaaaatttgtttaaacaaatcatgaaaggtcacaaatgaaacactggtcataaaatctccatatcagcagccagggcct

SEQ ID NO: 384237 - DNA, 140 bp, Artificial Sequence
  Synthetic
atacgccatgctgggtctccttcaagaggggtctccgggaatttccggagtccctcttggaagtccatggtgaggggacttgatacctcaccgccgtttgcctaggctataggctaaattcgtacttgggagtcggccat

SEQ ID NO: 384238 - DNA, 140 bp, Artificial Sequence
  Synthetic
atggccgactcccaagtacgaatttagcctatagcctaggcaaacggcggtgaggtatcaagtcccctcaccatggacttccaagagggactccggaaattcccggagacccctcttgaaggagacccagcatggcgtat

SEQ ID NO: 384239 - DNA, 140 bp, Artificial Sequence
  Synthetic
atacgccatgctgggtctccgatgttttgatagtcttttccagagatgttcaaattgacaatcttgacttgattggacagaaaattgtggatgagttcaaaaaacttggcatgacagctacgtacttgggagtcggccat

SEQ ID NO: 384240 - DNA, 140 bp, Artificial Sequence
  Synthetic
atggccgactcccaagtacgtagctgtcatgccaagttttttgaactcatccacaattttctgtccaatcaagtcaagattgtcaatttgaacatctctggaaaagactatcaaaacatcggagacccagcatggcgtat

SEQ ID NO: 384241 - DNA, 140 bp, Artificial Sequence
  Synthetic
aggccctggctgctgatatgtaattcctgcaggttcagggttctttaatctgtttctctataagaacactcaattttcacgctttctgtcttctttcttccagggctctccccttgccctgaccttttgggacagcggtg

SEQ ID NO: 384242 - DNA, 140 bp, Artificial Sequence
  Synthetic
caccgctgtcccaaaaggtcagggcaaggggagagccctggaagaaagaagacagaaagcgtgaaaattgagtgttcttatagagaaacagattaaagaaccctgaacctgcaggaattacatatcagcagccagggcct

SEQ ID NO: 384243 - DNA, 140 bp, Artificial Sequence
  Synthetic
aggccctggctgctgatatgggagggaaaagtttgacttcaattgcattggcaaccaaaatttgtaaacactatggtgttgaacctgagaaaaatatttataccaagcctgtggcctcaggaccttttgggacagcggtg

SEQ ID NO: 384244 - DNA, 140 bp, Artificial Sequence
  Synthetic
caccgctgtcccaaaaggtcctgaggccacaggcttggtataaatatttttctcaggttcaacaccatagtgtttacaaattttggttgccaatgcaattgaagtcaaacttttccctcccatatcagcagccagggcct

SEQ ID NO: 384245 - DNA, 140 bp, Artificial Sequence
  Synthetic
aggccctggctgctgatatgtttccctctggtgaaccatcgaactctaaattatctggctttttccaatctgttactaatcacaagtgggttgctgtgggagctgcagttggcattcttggaccttttgggacagcggtg

SEQ ID NO: 384246 - DNA, 140 bp, Artificial Sequence
  Synthetic
caccgctgtcccaaaaggtccaagaatgccaactgcagctcccacagcaacccacttgtgattagtaacagattggaaaaagccagataatttagagttcgatggttcaccagagggaaacatatcagcagccagggcct

SEQ ID NO: 384247 - DNA, 140 bp, Artificial Sequence
  Synthetic
aggccctggctgctgatatgtgaggggacttgatacctcaccgccgtttgcctaggctataggctaaatttccctttccctgtccttcccccattccccttcgttttatttgtaaatattgaccttttgggacagcggtg

SEQ ID NO: 384248 - DNA, 140 bp, Artificial Sequence
  Synthetic
caccgctgtcccaaaaggtcaatatttacaaataaaacgaaggggaatgggggaaggacagggaaagggaaatttagcctatagcctaggcaaacggcggtgaggtatcaagtcccctcacatatcagcagccagggcct

SEQ ID NO: 384249 - DNA, 140 bp, Artificial Sequence
  Synthetic
aggccctggctgctgatatgctggactgttctttggggccttatgtggtgtttgcctctgaggtactcaggggcatttaggtttttcctcatttttaaataattatgaatatgtctaaacgaccttttgggacagcggtg

SEQ ID NO: 384250 - DNA, 140 bp, Artificial Sequence
  Synthetic
caccgctgtcccaaaaggtcgtttagacatattcataattatttaaaaatgaggaaaaacctaaatgcccctgagtacctcagaggcaaacaccacataaggccccaaagaacagtccagcatatcagcagccagggcct

SEQ ID NO: 384251 - DNA, 140 bp, Artificial Sequence
  Synthetic
aggccctggctgctgatatgcctggttccaagaagactcagggggagaaattttttctgattcattctgcagattggcttactacacatgctctctttcatgaagttgcaaaattggatggaccttttgggacagcggtg

SEQ ID NO: 384252 - DNA, 140 bp, Artificial Sequence
  Synthetic
caccgctgtcccaaaaggtccatccaattttgcaacttcatgaaagagagcatgtgtagtaagccaatctgcagaatgaatcagaaaaaatttctccccctgagtcttcttggaaccaggcatatcagcagccagggcct

SEQ ID NO: 384253 - DNA, 140 bp, Artificial Sequence
  Synthetic
atacgccatgctgggtctccagattggcttactacacatgctctctttcatgaagttgcaaaattggatgtggtgaaattactgtataatgaacagtttgctgtccaaggtttgttgagacgtacttgggagtcggccat

SEQ ID NO: 384254 - DNA, 140 bp, Artificial Sequence
  Synthetic
atggccgactcccaagtacgtctcaacaaaccttggacagcaaactgttcattatacagtaatttcaccacatccaattttgcaacttcatgaaagagagcatgtgtagtaagccaatctggagacccagcatggcgtat

SEQ ID NO: 384255 - DNA, 140 bp, Artificial Sequence
  Synthetic
aggccctggctgctgatatgagggattttccagactgttgggagtggtcttgaccacatcctgtctttggcagatattgaggaagaacaaatgattcagtctgttgataggactgcagtggaccttttgggacagcggtg

SEQ ID NO: 384256 - DNA, 140 bp, Artificial Sequence
  Synthetic
caccgctgtcccaaaaggtccactgcagtcctatcaacagactgaatcatttgttcttcctcaatatctgccaaagacaggatgtggtcaagaccactcccaacagtctggaaaatccctcatatcagcagccagggcct

SEQ ID NO: 384257 - DNA, 140 bp, Artificial Sequence
  Synthetic
aggccctggctgctgatatgaaagttatggttcaatagcatctttgactgtctatcctcatggtttgttaaattgcaacattaataatgtggttagaataaaggttccatttatttatacgaccttttgggacagcggtg

SEQ ID NO: 384258 - DNA, 140 bp, Artificial Sequence
  Synthetic
caccgctgtcccaaaaggtcgtataaataaatggaacctttattctaaccacattattaatgttgcaatttaacaaaccatgaggatagacagtcaaagatgctattgaaccataactttcatatcagcagccagggcct

SEQ ID NO: 384259 - DNA, 140 bp, Artificial Sequence
  Synthetic
atacgccatgctgggtctccacttcacttaatgttttggctaggtttacagatttggagttgcatggattgactcctctttccacacagatgatgagaaatgaatttagagttagtactacgtacttgggagtcggccat

SEQ ID NO: 384260 - DNA, 140 bp, Artificial Sequence
  Synthetic
atggccgactcccaagtacgtagtactaactctaaattcatttctcatcatctgtgtggaaagaggagtcaatccatgcaactccaaatctgtaaacctagccaaaacattaagtgaagtggagacccagcatggcgtat

SEQ ID NO: 384261 - DNA, 140 bp, Artificial Sequence
  Synthetic
atacgccatgctgggtctccctgagaatgttgtgaatttgtcaaattatgaagatgcaagggcaaaaatgtcttttgctttggatcaggaagattggaagtctgatccttcccaaggaggcgtacttgggagtcggccat

SEQ ID NO: 384262 - DNA, 140 bp, Artificial Sequence
  Synthetic
atggccgactcccaagtacgcctccttgggaaggatcagacttccaatcttcctgatccaaagcaaaagacatttttgcccttgcatcttcataatttgacaaattcacaacattctcagggagacccagcatggcgtat

SEQ ID NO: 384263 - DNA, 140 bp, Artificial Sequence
  Synthetic
atacgccatgctgggtctccacaccctttcagcaagggggactaatttgtgccatggttcctggtgaccaaagttatggttcaatagcatccttgactgtttatcctcatggtttgttaacgtacttgggagtcggccat

SEQ ID NO: 384264 - DNA, 140 bp, Artificial Sequence
  Synthetic
atggccgactcccaagtacgttaacaaaccatgaggataaacagtcaaggatgctattgaaccataactttggtcaccaggaaccatggcacaaattagtcccccttgctgaaagggtgtggagacccagcatggcgtat

SEQ ID NO: 384265 - DNA, 140 bp, Artificial Sequence
  Synthetic
atacgccatgctgggtctcctggaattaaaattactcattttactacatggacatccattccaaccttggctgctcagtttccatttaatgcctcagattcggttggacaacaaattaaacgtacttgggagtcggccat

SEQ ID NO: 384266 - DNA, 140 bp, Artificial Sequence
  Synthetic
atggccgactcccaagtacgtttaatttgttgtccaaccgaatctgaggcattaaatggaaactgagcagccaaggttggaatggatgtccatgtagtaaaatgagtaattttaattccaggagacccagcatggcgtat

SEQ ID NO: 384267 - DNA, 140 bp, Artificial Sequence
  Synthetic
aggccctggctgctgatatgtaggagttcatccaagattggcccagagaattttatttaatactgtcatgatggaaaattgttctgacttagatgttgttttcacaacttgtccaaaggagaccttttgggacagcggtg

SEQ ID NO: 384268 - DNA, 140 bp, Artificial Sequence
  Synthetic
caccgctgtcccaaaaggtctcctttggacaagttgtgaaaacaacatctaagtcagaacaattttccatcatgacagtattaaataaaattctctgggccaatcttggatgaactcctacatatcagcagccagggcct

SEQ ID NO: 384269 - DNA, 140 bp, Artificial Sequence
  Synthetic
aggccctggctgctgatatgagaggtgcttatcattttaaagatccacagtacccagtttgggaattgacaatcagggtttggtcagagttgaatattggaacaggaacttcagcttacagaccttttgggacagcggtg

SEQ ID NO: 384270 - DNA, 140 bp, Artificial Sequence
  Synthetic
caccgctgtcccaaaaggtctgtaagctgaagttcctgttccaatattcaactctgaccaaaccctgattgtcaattcccaaactgggtactgtggatctttaaaatgataagcacctctcatatcagcagccagggcct

SEQ ID NO: 384271 - DNA, 140 bp, Artificial Sequence
  Synthetic
aggccctggctgctgatatgcttttgctttggatcaggaagattggaagtctgatccttctcaaggtggtggaattaaaattactcattttactacttggacatctattccaactttggcgaccttttgggacagcggtg

SEQ ID NO: 384272 - DNA, 140 bp, Artificial Sequence
  Synthetic
caccgctgtcccaaaaggtcgccaaagttggaatagatgtccaagtagtaaaatgagtaattttaattccaccaccttgagaaggatcagacttccaatcttcctgatccaaagcaaaagcatatcagcagccagggcct

SEQ ID NO: 384273 - DNA, 140 bp, Artificial Sequence
  Synthetic
atacgccatgctgggtctcccaaaaatgtataactgctctggcttctatttgtcagatgttttgtttttggaggggagatcttgtttttgattttcaggtttttccaaccaaatatcattcgtacttgggagtcggccat

SEQ ID NO: 384274 - DNA, 140 bp, Artificial Sequence
  Synthetic
atggccgactcccaagtacgaatgatatttggttggaaaaacctgaaaatcaaaaacaagatctcccctccaaaaacaaaacatctgacaaatagaagccagagcagttatacatttttgggagacccagcatggcgtat

SEQ ID NO: 384275 - DNA, 140 bp, Artificial Sequence
  Synthetic
aggccctggctgctgatatggaggggagatcttgtttttgattttcaggtttttccaaccaaatatcattcaggtagattattgttttgctttgttcctgggaatgagttaatagatgttgaccttttgggacagcggtg

SEQ ID NO: 384276 - DNA, 140 bp, Artificial Sequence
  Synthetic
caccgctgtcccaaaaggtcaacatctattaactcattcccaggaacaaagcaaaacaataatctacctgaatgatatttggttggaaaaacctgaaaatcaaaaacaagatctcccctccatatcagcagccagggcct

SEQ ID NO: 384277 - DNA, 140 bp, Artificial Sequence
  Synthetic
aggccctggctgctgatatgaaagggaaagccaataggggaaagatggatgtttcaggagtgcaagcacctgtgggagctattacaacaattgaggatccagttttagcaaagaaagtacgaccttttgggacagcggtg

SEQ ID NO: 384278 - DNA, 140 bp, Artificial Sequence
  Synthetic
caccgctgtcccaaaaggtcgtactttctttgctaaaactggatcctcaattgttgtaatagctcccacaggtgcttgcactcctgaaacatccatctttcccctattggctttccctttcatatcagcagccagggcct

SEQ ID NO: 384279 - DNA, 140 bp, Artificial Sequence
  Synthetic
aggccctggctgctgatatgcattacaggagtacaatcaaccttgagatttcgtgttccttggatttctgatacaccctaccgagtaaacaggtacacgaagtcagcacatcaaaaaggtgaccttttgggacagcggtg

SEQ ID NO: 384280 - DNA, 140 bp, Artificial Sequence
  Synthetic
caccgctgtcccaaaaggtcacctttttgatgtgctgacttcgtgtacctgtttactcggtagggtgtatcagaaatccaaggaacacgaaatctcaaggttgattgtactcctgtaatgcatatcagcagccagggcct

SEQ ID NO: 384281 - DNA, 140 bp, Artificial Sequence
  Synthetic
atacgccatgctgggtctccctgagacatttcctgagttgaagcctggagagtccagacacacatcagatcatatgtcaatttataaattcatgggaaggtctcattttttgtgtacattcgtacttgggagtcggccat

SEQ ID NO: 384282 - DNA, 140 bp, Artificial Sequence
  Synthetic
atggccgactcccaagtacgaatgtacacaaaaaatgagaccttcccatgaatttataaattgacatatgatctgatgtgtgtctggactctccaggcttcaactcaggaaatgtctcagggagacccagcatggcgtat

SEQ ID NO: 384283 - DNA, 140 bp, Artificial Sequence
  Synthetic
aggccctggctgctgatatgttctccttccaatgttgcttctcatgttagagttaatgtttatctttcagcaattaatttggaatgctttgctcctctgtaccatgccatggatgttactgaccttttgggacagcggtg

SEQ ID NO: 384284 - DNA, 140 bp, Artificial Sequence
  Synthetic
caccgctgtcccaaaaggtcagtaacatccatggcatggtacagaggagcaaagcattccaaattaattgctgaaagataaacattaactctaacatgagaagcaacattggaaggagaacatatcagcagccagggcct

SEQ ID NO: 384285 - DNA, 140 bp, Artificial Sequence
  Synthetic
aggccctggctgctgatatgagactccatttcaaagttgaggtgaaacctgcctcattctttaagaatcctcataatgacatgttaaatgtcaatctggcaaaaactaatgatgctattagaccttttgggacagcggtg

SEQ ID NO: 384286 - DNA, 140 bp, Artificial Sequence
  Synthetic
caccgctgtcccaaaaggtctaatagcatcattagtttttgccagattgacatttaacatgtcattatgaggattcttaaagaatgaggcaggtttcacctcaactttgaaatggagtctcatatcagcagccagggcct

SEQ ID NO: 384287 - DNA, 140 bp, Artificial Sequence
  Synthetic
atacgccatgctgggtctccacacaagttggagatgattcaggaggtttttcaacaacagtttctacagagcagaatgttcctgatccccaagtcggcataacaaccatgagggacctaacgtacttgggagtcggccat

SEQ ID NO: 384288 - DNA, 140 bp, Artificial Sequence
  Synthetic
atggccgactcccaagtacgttaggtccctcatggttgttatgccgacttggggatcaggaacattctgctctgtagaaactgttgttgaaaaacctcctgaatcatctccaacttgtgtggagacccagcatggcgtat

SEQ ID NO: 384289 - DNA, 140 bp, Artificial Sequence
  Synthetic
aggccctggctgctgatatgaggagccactgatgtggatggcatggcctggtttaccccagtaggtcttgctgttgataccccttgggtggaaaaggagtcagctttgtctattgattatgaccttttgggacagcggtg

SEQ ID NO: 384290 - DNA, 140 bp, Artificial Sequence
  Synthetic
caccgctgtcccaaaaggtcataatcaatagacaaagctgactccttttccacccaaggggtatcaacagcaagacctactggggtaaaccaggccatgccatccacatcagtggctcctcatatcagcagccagggcct

SEQ ID NO: 384291 - DNA, 140 bp, Artificial Sequence
  Synthetic
atacgccatgctgggtctccactttcaattcaaataataaagagtacacatttccaataactctgtcttcgacttctaatcctcctcatggcttaccatcaacattaaggtggtttttcacgtacttgggagtcggccat

SEQ ID NO: 384292 - DNA, 140 bp, Artificial Sequence
  Synthetic
atggccgactcccaagtacgtgaaaaaccaccttaatgttgatggtaagccatgaggaggattagaagtcgaagacagagttattggaaatgtgtactctttattatttgaattgaaagtggagacccagcatggcgtat

SEQ ID NO: 384293 - DNA, 140 bp, Artificial Sequence
  Synthetic
atacgccatgctgggtctcctttgtctgtcacagaacaatcagagttctattttcctagagctccattaaattccaatgctatgttgtccactgagtctatgatgagtagaattgcagctcgtacttgggagtcggccat

SEQ ID NO: 384294 - DNA, 140 bp, Artificial Sequence
  Synthetic
atggccgactcccaagtacgagctgcaattctactcatcatagactcagtggacaacatagcattggaatttaatggagctctaggaaaatagaactctgattgttctgtgacagacaaaggagacccagcatggcgtat

SEQ ID NO: 384295 - DNA, 140 bp, Artificial Sequence
  Synthetic
atacgccatgctgggtctccacctgtttcaattgtatagaggaccattggatttgacaattattatcacaggagccactgatgtagacggtatggcctggttcactccagtaggccttgccgtacttgggagtcggccat

SEQ ID NO: 384296 - DNA, 140 bp, Artificial Sequence
  Synthetic
atggccgactcccaagtacggcaaggcctactggagtgaaccaggccataccgtctacatcagtggctcctgtgataataattgtcaaatccaatggtcctctatacaattgaaacaggtggagacccagcatggcgtat

SEQ ID NO: 384297 - DNA, 140 bp, Artificial Sequence
  Synthetic
atacgccatgctgggtctccgtgcttccacctcctaggaaaatgaaggggatattttcacaagccaaaatttctcttttttatactgaggagcatgaaataatgaaattttcgtggagagcgtacttgggagtcggccat

SEQ ID NO: 384298 - DNA, 140 bp, Artificial Sequence
  Synthetic
atggccgactcccaagtacgctctccacgaaaatttcattatttcatgctcctcagtataaaaaagagaaattttggcttgtgaaaatatccccttcattttcctaggaggtggaagcacggagacccagcatggcgtat

SEQ ID NO: 384299 - DNA, 140 bp, Artificial Sequence
  Synthetic
aggccctggctgctgatatggctggtagaagtgtgtggactcttgagatggatgctggagttcttactggaagactggttagattgaatgatgagaaatggacagaaatgaaggatgatagaccttttgggacagcggtg

SEQ ID NO: 384300 - DNA, 140 bp, Artificial Sequence
  Synthetic
caccgctgtcccaaaaggtctatcatccttcatttctgtccatttctcatcattcaatctaaccagtcttccagtaagaactccagcatccatctcaagagtccacacacttctaccagccatatcagcagccagggcct

SEQ ID NO: 384301 - DNA, 140 bp, Artificial Sequence
  Synthetic
aggccctggctgctgatatgttcaaatgctatgttgtccactgagtccatgatgagtagaattgcagctggagatttggagtcatcagtggatgatcctagatcagaggaggatagaagagaccttttgggacagcggtg

SEQ ID NO: 384302 - DNA, 140 bp, Artificial Sequence
  Synthetic
caccgctgtcccaaaaggtctcttctatcctcctctgatctaggatcatccactgatgactccaaatctccagctgcaattctactcatcatggactcagtggacaacatagcatttgaacatatcagcagccagggcct

SEQ ID NO: 384303 - DNA, 140 bp, Artificial Sequence
  Synthetic
atacgccatgctgggtctcctttgagagtcatatagaatgtaggaaaccatacaaagaattgagattggaggttggcaaacaaagactcaaatatgctcaggaagagttgtcaaatgaagcgtacttgggagtcggccat

SEQ ID NO: 384304 - DNA, 140 bp, Artificial Sequence
  Synthetic
atggccgactcccaagtacgcttcatttgacaactcttcctgagcatatttgagtctttgtttgccaacctccaatctcaattctttgtatggtttcctacattctatatgactctcaaaggagacccagcatggcgtat

SEQ ID NO: 384305 - DNA, 140 bp, Artificial Sequence
  Synthetic
aggccctggctgctgatatgggttggcaaacaaagactcaaatatgctcaggaagagttgtcaaatgaagtgcttccgcctcctaggaaaatgaaaggggtattttcacaagctaaaattgaccttttgggacagcggtg

SEQ ID NO: 384306 - DNA, 140 bp, Artificial Sequence
  Synthetic
caccgctgtcccaaaaggtcaattttagcttgtgaaaatacccctttcattttcctaggaggcggaagcacttcatttgacaactcttcctgagcatatttgagtctttgtttgccaacccatatcagcagccagggcct

SEQ ID NO: 384307 - DNA, 140 bp, Artificial Sequence
  Synthetic
atacgccatgctgggtctcccttagtccatttatgattagggaggcgggtagaatcatgagtgagttatctggaacaccatctcattttggaacagctcttatcaatactattatttattcgtacttgggagtcggccat

SEQ ID NO: 384308 - DNA, 140 bp, Artificial Sequence
  Synthetic
atggccgactcccaagtacgaataaataatagtattgataagagctgttccaaaatgagatggtgttccagataactcactcatgattctacccgcctccctaatcataaatggactaagggagacccagcatggcgtat

SEQ ID NO: 384309 - DNA, 140 bp, Artificial Sequence
  Synthetic
aggccctggctgctgatatgaagagtggaatcctgctttatgtcatacaacaactgaaccaagatgaacactctcacataattgggttgttgagagttatgaattatgcagatattggctgaccttttgggacagcggtg

SEQ ID NO: 384310 - DNA, 140 bp, Artificial Sequence
  Synthetic
caccgctgtcccaaaaggtcagccaatatctgcataattcataactctcaacaacccaattatgtgagagtgttcatcttggttcagttgttgtatgacataaagcaggattccactcttcatatcagcagccagggcct

SEQ ID NO: 384311 - DNA, 140 bp, Artificial Sequence
  Synthetic
atacgccatgctgggtctccctctcacataattgggttgttgagagttatgaattatgcagatattggctgttcagtcatttcatgtggcaaggttttttccaaaatgttagaaacagttcgtacttgggagtcggccat

SEQ ID NO: 384312 - DNA, 140 bp, Artificial Sequence
  Synthetic
atggccgactcccaagtacgaactgtttctaacattttggaaaaaaccttgccacatgaaatgactgaacagccaatatctgcataattcataactctcaacaacccaattatgtgagagggagacccagcatggcgtat

SEQ ID NO: 384313 - DNA, 140 bp, Artificial Sequence
  Synthetic
atacgccatgctgggtctccaaacttggcagacagaatgttgggtctatcaggaatacaggagataaaagaaaaaggggtgggtttgattggcgagtgccgagcttttttagattctatacgtacttgggagtcggccat

SEQ ID NO: 384314 - DNA, 140 bp, Artificial Sequence
  Synthetic
atggccgactcccaagtacgtatagaatctaaaaaagctcggcactcgccaatcaaacccacccctttttcttttatctcctgtattcctgatagacccaacattctgtctgccaagtttggagacccagcatggcgtat

SEQ ID NO: 384315 - DNA, 140 bp, Artificial Sequence
  Synthetic
atacgccatgctgggtctccgaaatagcaggattagttaggaaaaatctggttcaatttggagttggcgagaaaaatggatgtgtgagatggcttatgaatgccttgggagtgaaagatgcgtacttgggagtcggccat

SEQ ID NO: 384316 - DNA, 140 bp, Artificial Sequence
  Synthetic
atggccgactcccaagtacgcatctttcactcccaaggcattcataagccatctcacacatccatttttctcgccaactccaaattgaaccagatttttcctaactaatcctgctatttcggagacccagcatggcgtat

SEQ ID NO: 384317 - DNA, 140 bp, Artificial Sequence
  Synthetic
atacgccatgctgggtctccgtaaactatggcaagaagaaggacgttcttaatattcttaaagataaccagcaaaaaatagaaaaagccattgaggaagcagacaatttctgcattctgccgtacttgggagtcggccat

SEQ ID NO: 384318 - DNA, 140 bp, Artificial Sequence
  Synthetic
atggccgactcccaagtacggcagaatgcagaaattgtctgcttcctcaatggctttttctattttttgctggttatctttaagaatattaagaacgtccttcttcttgccatagtttacggagacccagcatggcgtat

SEQ ID NO: 384319 - DNA, 140 bp, Artificial Sequence
  Synthetic
aggccctggctgctgatatgaaattcaagatgtagagaaatttgatcagtatcagaaaggggttgatttaatacaaaagttgagaactgttcattcaatggctcaagttgaccctaacctgaccttttgggacagcggtg

SEQ ID NO: 384320 - DNA, 140 bp, Artificial Sequence
  Synthetic
caccgctgtcccaaaaggtcaggttagggtcaacttgagccattgaatgaacagttctcaacttttgtattaaatcaacccctttctgatactgatcaaatttctctacatcttgaatttcatatcagcagccagggcct

SEQ ID NO: 384321 - DNA, 140 bp, Artificial Sequence
  Synthetic
aggccctggctgctgatatgatacaaaagttgagaactgttcattcaatggctcaagttgaccctaacctgggggttcatttgtcacctcttagagattgtatagcaagggtccatcaaagaccttttgggacagcggtg

SEQ ID NO: 384322 - DNA, 140 bp, Artificial Sequence
  Synthetic
caccgctgtcccaaaaggtctttgatggacccttgctatacaatctctaagaggtgacaaatgaacccccaggttagggtcaacttgagccattgaatgaacagttctcaacttttgtatcatatcagcagccagggcct

SEQ ID NO: 384323 - DNA, 140 bp, Artificial Sequence
  Synthetic
  misc_feature (36)..(36): n is a, c, g, or t
  misc_feature (80)..(80): n is a, c, g, or t
aggccctggctgctgatatgctcagttatctcatgnggcaaagttttttccaaaatgttagaaacagtttttaattggcnaatggactccagaatgatggagctgagaactcagagttttgaccttttgggacagcggtg

SEQ ID NO: 384324 - DNA, 140 bp, Artificial Sequence
  Synthetic
  misc_feature (61)..(61): n is a, c, g, or t
  misc_feature (105)..(105): n is a, c, g, or t
caccgctgtcccaaaaggtcaaaactctgagttctcagctccatcattctggagtccattngccaattaaaaactgtttctaacattttggaaaaaactttgccncatgagataactgagcatatcagcagccagggcct

SEQ ID NO: 384325 - DNA, 140 bp, Artificial Sequence
  Synthetic
aggccctggctgctgatatgagctcaagaatcttggatctataaatcaggctatggtgacaagatgtgagccagttgtttgctatttgtatggcaaaagagggggagggaaaagcttgacgaccttttgggacagcggtg

SEQ ID NO: 384326 - DNA, 140 bp, Artificial Sequence
  Synthetic
caccgctgtcccaaaaggtcgtcaagcttttccctccccctcttttgccatacaaatagcaaacaactggctcacatcttgtcaccatagcctgatttatagatccaagattcttgagctcatatcagcagccagggcct

SEQ ID NO: 384327 - DNA, 140 bp, Artificial Sequence
  Synthetic
aggccctggctgctgatatgtaaggatgccatatattggctatatacaaaattgaaggatttttatgaagtaaattatggcaagaagaaggatgttcttaatattctcaaagacaaccaggaccttttgggacagcggtg

SEQ ID NO: 384328 - DNA, 140 bp, Artificial Sequence
  Synthetic
caccgctgtcccaaaaggtcctggttgtctttgagaatattaagaacatccttcttcttgccataatttacttcataaaaatccttcaattttgtatatagccaatatatggcatccttacatatcagcagccagggcct

SEQ ID NO: 384329 - DNA, 140 bp, Artificial Sequence
  Synthetic
  misc_feature (72)..(72): n is a, c, g, or t
atacgccatgctgggtctcccaaaagatagaaaaagccattgaggaagcagacaatttttgcattttgcaanttcaagatgtagaaaaatttgatcagtatcagaaaggagttgatttaacgtacttgggagtcggccat

SEQ ID NO: 384330 - DNA, 140 bp, Artificial Sequence
  Synthetic
  misc_feature (69)..(69): n is a, c, g, or t
atggccgactcccaagtacgttaaatcaactcctttctgatactgatcaaatttttctacatcttgaanttgcaaaatgcaaaaattgtctgcttcctcaatggctttttctatcttttgggagacccagcatggcgtat

SEQ ID NO: 384331 - DNA, 140 bp, Artificial Sequence
  Synthetic
aggccctggctgctgatatgtgaagattggtcagatttttgtcaattagtgtcaggatgtccaatgagattgaatatggcttctcttgaggagaagggcagacatttttcctctccttttgaccttttgggacagcggtg

SEQ ID NO: 384332 - DNA, 140 bp, Artificial Sequence
  Synthetic
caccgctgtcccaaaaggtcaaaaggagaggaaaaatgtctgcccttctcctcaagagaagccatattcaatctcattggacatcctgacactaattgacaaaaatctgaccaatcttcacatatcagcagccagggcct

SEQ ID NO: 384333 - DNA, 140 bp, Artificial Sequence
  Synthetic
atacgccatgctgggtctccaaacttggcagacagaatgttgggtctgtcagggatacaggagataaaagaaaaaggggtgggattgattggtgagtgccgagcttttctagattccatacgtacttgggagtcggccat

SEQ ID NO: 384334 - DNA, 140 bp, Artificial Sequence
  Synthetic
atggccgactcccaagtacgtatggaatctagaaaagctcggcactcaccaatcaatcccacccctttttcttttatctcctgtatccctgacagacccaacattctgtctgccaagtttggagacccagcatggcgtat

SEQ ID NO: 384335 - DNA, 140 bp, Artificial Sequence
  Synthetic
atacgccatgctgggtctcccagttgtttgctatttatatggcaaaagagggggagggaaaagtttgacttcaattgcattggcaaccaaaatttgtaaacactatggtgttgaacctgacgtacttgggagtcggccat

SEQ ID NO: 384336 - DNA, 140 bp, Artificial Sequence
  Synthetic
atggccgactcccaagtacgtcaggttcaacaccatagtgtttacaaattttggttgccaatgcaattgaagtcaaacttttccctccccctcttttgccatataaatagcaaacaactgggagacccagcatggcgtat

SEQ ID NO: 384337 - DNA, 140 bp, Artificial Sequence
  Synthetic
aggccctggctgctgatatgaaaacaaatgatgcaattaaggacatgtcttgtgttgatttaataatggatggacataatatttcattgatggatttacttagttccttagtgatgacaggaccttttgggacagcggtg

SEQ ID NO: 384338 - DNA, 140 bp, Artificial Sequence
  Synthetic
caccgctgtcccaaaaggtcctgtcatcactaaggaactaagtaaatccatcaatgaaatattatgtccatccattattaaatcaacacaagacatgtccttaattgcatcatttgttttcatatcagcagccagggcct

SEQ ID NO: 384339 - DNA, 140 bp, Artificial Sequence
  Synthetic
atacgccatgctgggtctccgaaaaatatttacactaaacctgtggcctcagattattgggatggttacagtggacaattggtttgcattattgatgatattggacaaaacacaacagatcgtacttgggagtcggccat

SEQ ID NO: 384340 - DNA, 140 bp, Artificial Sequence
  Synthetic
atggccgactcccaagtacgatctgttgtgttttgtccaatatcatcaataatgcaaaccaattgtccactgtaaccatcccaataatctgaggccacaggtttagtgtaaatatttttcggagacccagcatggcgtat

SEQ ID NO: 384341 - DNA, 140 bp, Artificial Sequence
  Synthetic
aggccctggctgctgatatggttgtcaaatgaagtgcttccacctcctaggaaaatgaaggggctattttcacaagctaagatttctcttttttacactgaggagcatgaaataatgaaagaccttttgggacagcggtg

SEQ ID NO: 384342 - DNA, 140 bp, Artificial Sequence
  Synthetic
caccgctgtcccaaaaggtctttcattatttcatgctcctcagtgtaaaaaagagaaatcttagcttgtgaaaatagccccttcattttcctaggaggtggaagcacttcatttgacaaccatatcagcagccagggcct

SEQ ID NO: 384343 - DNA, 140 bp, Artificial Sequence
  Synthetic
aggccctggctgctgatatgtgagtagaattgcagctggagatttggagtcatcagtggatgatcccagatcagaggaggacagaagatttgagagtcatatagaatgtaggaaaccatagaccttttgggacagcggtg

SEQ ID NO: 384344 - DNA, 140 bp, Artificial Sequence
  Synthetic
caccgctgtcccaaaaggtctatggtttcctacattctatatgactctcaaatcttctgtcctcctctgatctgggatcatccactgatgactccaaatctccagctgcaattctactcacatatcagcagccagggcct

SEQ ID NO: 384345 - DNA, 140 bp, Artificial Sequence
  Synthetic
aggccctggctgctgatatgctgtcactaatcacaagtgggttgctgtgggagctgcagttggcattcttggagtgcttgtgggaggatggtttgtgtataagcatttctcccgcagagagaccttttgggacagcggtg

SEQ ID NO: 384346 - DNA, 140 bp, Artificial Sequence
  Synthetic
caccgctgtcccaaaaggtctctctgcgggagaaatgcttatacacaaaccatcctcccacaagcactccaagaatgccaactgcagctcccacagcaacccacttgtgattagtgacagcatatcagcagccagggcct

SEQ ID NO: 384347 - DNA, 140 bp, Artificial Sequence
  Synthetic
atacgccatgctgggtctcctctatctgttactgagcagtcagagttttattttccaagggcccccttgaactctaatgctatgctgtccactgaaactatgatgagcagaattgcagctcgtacttgggagtcggccat

SEQ ID NO: 384348 - DNA, 140 bp, Artificial Sequence
  Synthetic
atggccgactcccaagtacgagctgcaattctgctcatcatagtttcagtggacagcatagcattagagttcaagggggcccttggaaaataaaactctgactgctcagtaacagatagaggagacccagcatggcgtat

SEQ ID NO: 384349 - DNA, 140 bp, Artificial Sequence
  Synthetic
aggccctggctgctgatatgttcattttttaaaaatcctcacaatgatatgttgaatgttaatttggctaaaacaaatgatgcaattaaggatatgtcttgtgttgatttaataatggatgaccttttgggacagcggtg

SEQ ID NO: 384350 - DNA, 140 bp, Artificial Sequence
  Synthetic
caccgctgtcccaaaaggtcatccattattaaatcaacacaagacatatccttaattgcatcatttgttttagccaaattaacattcaacatatcattgtgaggatttttaaaaaatgaacatatcagcagccagggcct

SEQ ID NO: 384351 - DNA, 140 bp, Artificial Sequence
  Synthetic
atacgccatgctgggtctccggacataatatttcactgatggatttacttagttccttagtgatgacagttgaaattaggaaacaaaatatgagtgaattcatggagttgtggtctcaggcgtacttgggagtcggccat

SEQ ID NO: 384352 - DNA, 140 bp, Artificial Sequence
  Synthetic
atggccgactcccaagtacgcctgagaccacaactccatgaattcactcatattttgtttcctaatttcaactgtcatcactaaggaactaagtaaatccatcagtgaaatattatgtccggagacccagcatggcgtat

SEQ ID NO: 384353 - DNA, 140 bp, Artificial Sequence
  Synthetic
aggccctggctgctgatatgggtctttagtagcttggcaaagaagcaatgccgagtttgaacaaaatttggaaaatgctcagtggtttgcttttatgcatggttttgagttttatcagaagaccttttgggacagcggtg

SEQ ID NO: 384354 - DNA, 140 bp, Artificial Sequence
  Synthetic
caccgctgtcccaaaaggtcttctgataaaactcaaaaccatgcataaaagcaaaccactgagcattttccaaattttgttcaaactcggcattgcttctttgccaagctactaaagacccatatcagcagccagggcct

SEQ ID NO: 384355 - DNA, 140 bp, Artificial Sequence
  Synthetic
aggccctggctgctgatatgattggttgttagtaccttctcatgcttataaatttgaaaaggattatgaaatgatggagttttattttaatagaggtggaacttactattcaatttcagcgaccttttgggacagcggtg

SEQ ID NO: 384356 - DNA, 140 bp, Artificial Sequence
  Synthetic
caccgctgtcccaaaaggtcgctgaaattgaatagtaagttccacctctattaaaataaaactccatcatttcataatccttttcaaatttataagcatgagaaggtactaacaaccaatcatatcagcagccagggcct

SEQ ID NO: 384357 - DNA, 140 bp, Artificial Sequence
  Synthetic
atacgccatgctgggtctccagtcactaatcacaagtgggttgctgtgggagctgcagttggtattcttggagtgcttgtggggggatggttcgtgtataagcatttctcccacaaagagcgtacttgggagtcggccat

SEQ ID NO: 384358 - DNA, 140 bp, Artificial Sequence
  Synthetic
atggccgactcccaagtacgctctttgtgggagaaatgcttatacacgaaccatccccccacaagcactccaagaataccaactgcagctcccacagcaacccacttgtgattagtgactggagacccagcatggcgtat

SEQ ID NO: 384359 - DNA, 140 bp, Artificial Sequence
  Synthetic
atacgccatgctgggtctccttaaatcttatgattggtggagaatgagattttatgaccagtgtttcatttgtgacctttcatgatttgtttaaacaaattttcttaaaatttctgaggacgtacttgggagtcggccat

SEQ ID NO: 384360 - DNA, 140 bp, Artificial Sequence
  Synthetic
atggccgactcccaagtacgtcctcagaaattttaagaaaatttgtttaaacaaatcatgaaaggtcacaaatgaaacactggtcataaaatctcattctccaccaatcataagatttaaggagacccagcatggcgtat

SEQ ID NO: 384361 - DNA, 140 bp, Artificial Sequence
  Synthetic
atacgccatgctgggtctccacaggtgattaaattagatgcagatccagtagagtctcagtcaactttagaaatagcaggattagttaggaagaatttggttcaatttggagttggggagcgtacttgggagtcggccat

SEQ ID NO: 384362 - DNA, 140 bp, Artificial Sequence
  Synthetic
atggccgactcccaagtacgctccccaactccaaattgaaccaaattcttcctaactaatcctgctatttctaaagttgactgagactctactggatctgcatctaatttaatcacctgtggagacccagcatggcgtat

SEQ ID NO: 384363 - DNA, 140 bp, Artificial Sequence
  Synthetic
aggccctggctgctgatatgaattgaagcctggagaatccagacatacatcagatcacatgtctatttataaattcatgggaaggtctcatttcttgtgtacttttacttttaattcaaagaccttttgggacagcggtg

SEQ ID NO: 384364 - DNA, 140 bp, Artificial Sequence
  Synthetic
caccgctgtcccaaaaggtctttgaattaaaagtaaaagtacacaagaaatgagaccttcccatgaatttataaatagacatgtgatctgatgtatgtctggattctccaggcttcaattcatatcagcagccagggcct

SEQ ID NO: 384365 - DNA, 140 bp, Artificial Sequence
  Synthetic
atacgccatgctgggtctcctgatggagttttatttcaatagaggtggaacttactattcaatttcagctggcaatgttgttattcaatctttagatgtggggttccaagatgttgttctcgtacttgggagtcggccat

SEQ ID NO: 384366 - DNA, 140 bp, Artificial Sequence
  Synthetic
atggccgactcccaagtacgagaacaacatcttggaaccccacatctaaagattgaataacaacattgccagctgaaattgaatagtaagttccacctctattgaaataaaactccatcaggagacccagcatggcgtat

SEQ ID NO: 384367 - DNA, 140 bp, Artificial Sequence
  Synthetic
atacgccatgctgggtctccttaagaaaggagatgtacctagagccctgaatcgcttggcaacattagtgacaactgttaatggaactcctatgttaatttcagagggaccattaaaaatcgtacttgggagtcggccat

SEQ ID NO: 384368 - DNA, 140 bp, Artificial Sequence
  Synthetic
atggccgactcccaagtacgatttttaatggtccctctgaaattaacataggagttccattaacagttgtcactaatgttgccaagcgattcagggctctaggtacatctcctttcttaaggagacccagcatggcgtat

SEQ ID NO: 384369 - DNA, 140 bp, Artificial Sequence
  Synthetic
aggccctggctgctgatatgtatgatgttgtccaaatattcattacccattgtggaagaaccagaggattataaagaagcttcggttttttatcaaaataaaatagtaggcaaaactcaggaccttttgggacagcggtg

SEQ ID NO: 384370 - DNA, 140 bp, Artificial Sequence
  Synthetic
caccgctgtcccaaaaggtcctgagttttgcctactattttattttgataaaaaaccgaagcttctttataatcctctggttcttccacaatgggtaatgaatatttggacaacatcatacatatcagcagccagggcct

SEQ ID NO: 384371 - DNA, 140 bp, Artificial Sequence
  Synthetic
aggccctggctgctgatatgacttgactgtggatcaggcatggagaggaaaaggtgaaggtcttcctggaatgtgtggtggggccctggtgtcatcaaatcagtccatacagaatgcaatgaccttttgggacagcggtg

SEQ ID NO: 384372 - DNA, 140 bp, Artificial Sequence
  Synthetic
caccgctgtcccaaaaggtcattgcattctgtatggactgatttgatgacaccagggccccaccacacattccaggaagaccttcaccttttcctctccatgcctgatccacagtcaagtcatatcagcagccagggcct

SEQ ID NO: 384373 - DNA, 140 bp, Artificial Sequence
  Synthetic
aggccctggctgctgatatgatgtgtggtggggccctggtgtcatcaaatcagtccatacagaatgcaattttgggtattcatgttgctggaggaaattcaattcttgtagcaaagttgggaccttttgggacagcggtg

SEQ ID NO: 384374 - DNA, 140 bp, Artificial Sequence
  Synthetic
caccgctgtcccaaaaggtcccaactttgctacaagaattgaatttcctccagcaacatgaatacccaaaattgcattctgtatggactgatttgatgacaccagggccccaccacacatcatatcagcagccagggcct

SEQ ID NO: 384375 - DNA, 140 bp, Artificial Sequence
  Synthetic
aggccctggctgctgatatgcattgatgctattaatatggattcatctcctgggtttccctatgttcaagaaaaattgactaaaagagatttaatttggttggatgaaaatggtttgttagaccttttgggacagcggtg

SEQ ID NO: 384376 - DNA, 140 bp, Artificial Sequence
  Synthetic
caccgctgtcccaaaaggtctaacaaaccattttcatccaaccaaattaaatctcttttagtcaatttttcttgaacatagggaaacccaggagatgaatccatattaatagcatcaatgcatatcagcagccagggcct

SEQ ID NO: 384377 - DNA, 140 bp, Artificial Sequence
  Synthetic
atacgccatgctgggtctccttaggagttcatccaagattggcccagagaattttatttaacactgtcatgatggaaaattgttctgacctagatgttgtctttacaacttgtccaaaggcgtacttgggagtcggccat

SEQ ID NO: 384378 - DNA, 140 bp, Artificial Sequence
  Synthetic
atggccgactcccaagtacgcctttggacaagttgtaaagacaacatctaggtcagaacaattttccatcatgacagtgttaaataaaattctctgggccaatcttggatgaactcctaaggagacccagcatggcgtat

SEQ ID NO: 384379 - DNA, 140 bp, Artificial Sequence
  Synthetic
aggccctggctgctgatatggctttttagaaagagtcccattcatcatcacattgataaaaccatgattaattttcctgcagctatgcctttttctaaagctgaaattgatccaatggctgaccttttgggacagcggtg

SEQ ID NO: 384380 - DNA, 140 bp, Artificial Sequence
  Synthetic
caccgctgtcccaaaaggtcagccattggatcaatttcagctttagaaaaaggcatagctgcaggaaaattaatcatggttttatcaatgtgatgatgaatgggactctttctaaaaagccatatcagcagccagggcct

SEQ ID NO: 384381 - DNA, 140 bp, Artificial Sequence
  Synthetic
aggccctggctgctgatatgtcccacataattggtttgttgagagttatgaattatgcagatattggctgctcagttatctcatgtggcaaagttttttccaaaatgttagaaacagtttgaccttttgggacagcggtg

SEQ ID NO: 384382 - DNA, 140 bp, Artificial Sequence
  Synthetic
caccgctgtcccaaaaggtcaaactgtttctaacattttggaaaaaactttgccacatgagataactgagcagccaatatctgcataattcataactctcaacaaaccaattatgtgggacatatcagcagccagggcct

SEQ ID NO: 384383 - DNA, 140 bp, Artificial Sequence
  Synthetic
aggccctggctgctgatatggtaatgttgtctaaatattcattacctattgtggaagaaccagaggattacaaagaagcttctgttttttatcaaaacaaaatagtaggcaagactcagtgaccttttgggacagcggtg

SEQ ID NO: 384384 - DNA, 140 bp, Artificial Sequence
  Synthetic
caccgctgtcccaaaaggtcactgagtcttgcctactattttgttttgataaaaaacagaagcttctttgtaatcctctggttcttccacaataggtaatgaatatttagacaacattaccatatcagcagccagggcct

SEQ ID NO: 384385 - DNA, 140 bp, Artificial Sequence
  Synthetic
atacgccatgctgggtctcccaaagaagcttctgttttttatcaaaacaaaatagtaggcaagactcagttagttgatgactttctggatcttgatatggccattacaggggctccgggccgtacttgggagtcggccat

SEQ ID NO: 384386 - DNA, 140 bp, Artificial Sequence
  Synthetic
atggccgactcccaagtacggcccggagcccctgtaatggccatatcaagatccagaaagtcatcaactaactgagtcttgcctactattttgttttgataaaaaacagaagcttctttgggagacccagcatggcgtat

SEQ ID NO: 384387 - DNA, 140 bp, Artificial Sequence
  Synthetic
aggccctggctgctgatatgagatttggagatgttggtcttgatttagatttttctgcttttgatgctagtcttagtccatttatgattagggaggcaggcagaatcatgagtgaattgtgaccttttgggacagcggtg

SEQ ID NO: 384388 - DNA, 140 bp, Artificial Sequence
  Synthetic
caccgctgtcccaaaaggtcacaattcactcatgattctgcctgcctccctaatcataaatggactaagactagcatcaaaagcagaaaaatctaaatcaagaccaacatctccaaatctcatatcagcagccagggcct

SEQ ID NO: 384389 - DNA, 140 bp, Artificial Sequence
  Synthetic
atacgccatgctgggtctccaaaattgactaaaagagatttaatttggttggatgaaaatggtttgttgctaggagttcatccaagattggcccagagaattttatttaatactgtcatgcgtacttgggagtcggccat

SEQ ID NO: 384390 - DNA, 140 bp, Artificial Sequence
  Synthetic
atggccgactcccaagtacgcatgacagtattaaataaaattctctgggccaatcttggatgaactcctagcaacaaaccattttcatccaaccaaattaaatctcttttagtcaattttggagacccagcatggcgtat

SEQ ID NO: 384391 - DNA, 140 bp, Artificial Sequence
  Synthetic
aggccctggctgctgatatgctggaacaccatctcattttggaacagctcttatcaatactatcatttattctaaacatttgctgtacaattgttgttatcacgtttgtggttcaatgccgaccttttgggacagcggtg

SEQ ID NO: 384392 - DNA, 140 bp, Artificial Sequence
  Synthetic
caccgctgtcccaaaaggtcggcattgaaccacaaacgtgataacaacaattgtacagcaaatgtttagaataaatgatagtattgataagagctgttccaaaatgagatggtgttccagcatatcagcagccagggcct

SEQ ID NO: 384393 - DNA, 140 bp, Artificial Sequence
  Synthetic
atacgccatgctgggtctccatggaaaattgttctgacttagatgttgttttcacaacttgtccaaaggatgagttgagaccattagagaaagttttggaatcaaaaacaagagcaattgcgtacttgggagtcggccat

SEQ ID NO: 384394 - DNA, 140 bp, Artificial Sequence
  Synthetic
atggccgactcccaagtacgcaattgctcttgtttttgattccaaaactttctctaatggtctcaactcatcctttggacaagttgtgaaaacaacatctaagtcagaacaattttccatggagacccagcatggcgtat

SEQ ID NO: 384395 - DNA, 140 bp, Artificial Sequence
  Synthetic
atacgccatgctgggtctccatgcctgtcccttggattatacaattctatgtcgaatgtattggggcccagccattagttattttcatctgaatccagggttccacacaggtgttgctatcgtacttgggagtcggccat

SEQ ID NO: 384396 - DNA, 140 bp, Artificial Sequence
  Synthetic
atggccgactcccaagtacgatagcaacacctgtgtggaaccctggattcagatgaaaataactaatggctgggccccaatacattcgacatagaattgtataatccaagggacaggcatggagacccagcatggcgtat

SEQ ID NO: 384397 - DNA, 140 bp, Artificial Sequence
  Synthetic
aggccctggctgctgatatgttctagagatgttcaaattgacaatcttgacttgattggacagaaaattgtggatgagttcgaaaaacttggcatgacagctacttcagctgataaaagtgaccttttgggacagcggtg

SEQ ID NO: 384398 - DNA, 140 bp, Artificial Sequence
  Synthetic
caccgctgtcccaaaaggtcacttttatcagctgaagtagctgtcatgccaagtttttcgaactcatccacaattttctgtccaatcaagtcaagattgtcaatttgaacatctctagaacatatcagcagccagggcct

SEQ ID NO: 384399 - DNA, 140 bp, Artificial Sequence
  Synthetic
atacgccatgctgggtctccgtgcctcaattgaagccagtttcagaattgtcttttctcaaaagatctttcaatttggtggaggatagaattagacctgcaatttcagagaaaacaatttcgtacttgggagtcggccat

SEQ ID NO: 384400 - DNA, 140 bp, Artificial Sequence
  Synthetic
atggccgactcccaagtacgaaattgttttctctgaaattgcaggtctaattctatcctccaccaaattgaaagatcttttgagaaaagacaattctgaaactggcttcaattgaggcacggagacccagcatggcgtat

SEQ ID NO: 384401 - DNA, 140 bp, Artificial Sequence
  Synthetic
aggccctggctgctgatatgcaatttggtggaggatagaattagacctgcaatttcagagaaaacaatttggtctttaatagcttggcagagaagtaacgctgagtttgagcagaatttggaccttttgggacagcggtg

SEQ ID NO: 384402 - DNA, 140 bp, Artificial Sequence
  Synthetic
caccgctgtcccaaaaggtccaaattctgctcaaactcagcgttacttctctgccaagctattaaagaccaaattgttttctctgaaattgcaggtctaattctatcctccaccaaattgcatatcagcagccagggcct

SEQ ID NO: 384403 - DNA, 140 bp, Artificial Sequence
  Synthetic
aggccctggctgctgatatgtctgggtctccctgtacagctttgttgaattcaattattaacaacattaatttgtattatgtgttttctaaaatatttggaaagtctccagttttcttttgaccttttgggacagcggtg

SEQ ID NO: 384404 - DNA, 140 bp, Artificial Sequence
  Synthetic
caccgctgtcccaaaaggtcaaaagaaaactggagactttccaaatattttagaaaacacataatacaaattaatgttgttaataattgaattcaacaaagctgtacagggagacccagacatatcagcagccagggcct

SEQ ID NO: 384405 - DNA, 140 bp, Artificial Sequence
  Synthetic
aggccctggctgctgatatgtttgtattatgtgttttctaaaatatttggaaagtctccagttttcttttgtcaagctctgaggattctttgttatggagatgatgtcttgatagtttttgaccttttgggacagcggtg

SEQ ID NO: 384406 - DNA, 140 bp, Artificial Sequence
  Synthetic
caccgctgtcccaaaaggtcaaaaactatcaagacatcatctccataacaaagaatcctcagagcttgacaaaagaaaactggagactttccaaatattttagaaaacacataatacaaacatatcagcagccagggcct

SEQ ID NO: 384407 - DNA, 140 bp, Artificial Sequence
  Synthetic
aggccctggctgctgatatgtggacataatatttcattgatggatttacttagttccttagtgatgacagttgaaattaggaaacaaaatatgagtgaattcatggagttgtggtctcaggaccttttgggacagcggtg

SEQ ID NO: 384408 - DNA, 140 bp, Artificial Sequence
  Synthetic
caccgctgtcccaaaaggtcctgagaccacaactccatgaattcactcatattttgtttcctaatttcaactgtcatcactaaggaactaagtaaatccatcaatgaaatattatgtccacatatcagcagccagggcct

SEQ ID NO: 384409 - DNA, 140 bp, Artificial Sequence
  Synthetic
atacgccatgctgggtctcctccagagatgttcaaattgataatcttgatttgattggacagaaaattgtggatgagttcaaaaaacttggcatgacagctacttcagctgataaaaatgcgtacttgggagtcggccat

SEQ ID NO: 384410 - DNA, 140 bp, Artificial Sequence
  Synthetic
atggccgactcccaagtacgcatttttatcagctgaagtagctgtcatgccaagttttttgaactcatccacaattttctgtccaatcaaatcaagattatcaatttgaacatctctggaggagacccagcatggcgtat

SEQ ID NO: 384411 - DNA, 140 bp, Artificial Sequence
  Synthetic
atacgccatgctgggtctcctgcctcaattaaagccagtttcagaattgactttccttaaaagatcctttaatttggtagaggacagaattagacctgcaatttcagaaaagacaatttgcgtacttgggagtcggccat

SEQ ID NO: 384412 - DNA, 140 bp, Artificial Sequence
  Synthetic
atggccgactcccaagtacgcaaattgtcttttctgaaattgcaggtctaattctgtcctctaccaaattaaaggatcttttaaggaaagtcaattctgaaactggctttaattgaggcaggagacccagcatggcgtat

SEQ ID NO: 384413 - DNA, 140 bp, Artificial Sequence
  Synthetic
aggccctggctgctgatatgaatttggtagaggacagaattagacctgcaatttcagaaaagacaatttggtccttgatagcttggcagagaagtaatgctgagtttgagcagaatttgggaccttttgggacagcggtg

SEQ ID NO: 384414 - DNA, 140 bp, Artificial Sequence
  Synthetic
caccgctgtcccaaaaggtcccaaattctgctcaaactcagcattacttctctgccaagctatcaaggaccaaattgtcttttctgaaattgcaggtctaattctgtcctctaccaaattcatatcagcagccagggcct

SEQ ID NO: 384415 - DNA, 140 bp, Artificial Sequence
  Synthetic
aggccctggctgctgatatgaaaatgctcagtggtttgcttttatgcatggttatgagttttatcagaaattttattattttgttcagtcctgtttggagaaagagatgatagaatataggaccttttgggacagcggtg

SEQ ID NO: 384416 - DNA, 140 bp, Artificial Sequence
  Synthetic
caccgctgtcccaaaaggtcctatattctatcatctctttctccaaacaggactgaacaaaataataaaatttctgataaaactcataaccatgcataaaagcaaaccactgagcattttcatatcagcagccagggcct

SEQ ID NO: 384417 - DNA, 140 bp, Artificial Sequence
  Synthetic
aggccctggctgctgatatggtgtttcatttgtgacctttcatgatttgtttaaacaaattttcttaaaatttctgaggtttgtttatttcttttatcagtaaataaaaaaaaaaaaaaagaccttttgggacagcggtg

SEQ ID NO: 384418 - DNA, 140 bp, Artificial Sequence
  Synthetic
caccgctgtcccaaaaggtctttttttttttttttatttactgataaaagaaataaacaaacctcagaaattttaagaaaatttgtttaaacaaatcatgaaaggtcacaaatgaaacaccatatcagcagccagggcct

SEQ ID NO: 384419 - DNA, 140 bp, Artificial Sequence
  Synthetic
aggccctggctgctgatatggtccctcttggaagtccatggtgaggggacttgatacctcaccgccgtttgcctaggctataggctaaattttccctttcccttttccctttcccattccgaccttttgggacagcggtg

SEQ ID NO: 384420 - DNA, 140 bp, Artificial Sequence
  Synthetic
caccgctgtcccaaaaggtcggaatgggaaagggaaaagggaaagggaaaatttagcctatagcctaggcaaacggcggtgaggtatcaagtcccctcaccatggacttccaagagggaccatatcagcagccagggcct

SEQ ID NO: 384421 - DNA, 140 bp, Artificial Sequence
  Synthetic
atacgccatgctgggtctcccttttgcttgtaaatattgattcctgcaggttcagggttcttaaatctgtttctctataagaacactcattttcacgctttctgtcttctttcttccaggcgtacttgggagtcggccat

SEQ ID NO: 384422 - DNA, 140 bp, Artificial Sequence
  Synthetic
atggccgactcccaagtacgcctggaagaaagaagacagaaagcgtgaaaatgagtgttcttatagagaaacagatttaagaaccctgaacctgcaggaatcaatatttacaagcaaaagggagacccagcatggcgtat

SEQ ID NO: 384423 - DNA, 140 bp, Artificial Sequence
  Synthetic
atacgccatgctgggtctccgctctccccttgccctaggctctggccgttgcgcccggcggggtcaactccatgattagcatggagctgtaggagtctaaattggggacacagatgtttgcgtacttgggagtcggccat

SEQ ID NO: 384424 - DNA, 140 bp, Artificial Sequence
  Synthetic
atggccgactcccaagtacgcaaacatctgtgtccccaatttagactcctacagctccatgctaatcatggagttgaccccgccgggcgcaacggccagagcctagggcaaggggagagcggagacccagcatggcgtat

SEQ ID NO: 384425 - DNA, 140 bp, Artificial Sequence
  Synthetic
atacgccatgctgggtctccacttctgtggatcaatcttctgttcatacagctgaagttggctcacaccaacctgaacctttgaaaacctctgttgataaaccaggctctaagaggacaccgtacttgggagtcggccat

SEQ ID NO: 384426 - DNA, 140 bp, Artificial Sequence
  Synthetic
atggccgactcccaagtacggtgtcctcttagagcctggtttatcaacagaggttttcaaaggttcaggttggtgtgagccaacttcagctgtatgaacagaagattgatccacagaagtggagacccagcatggcgtat

SEQ ID NO: 384427 - DNA, 140 bp, Artificial Sequence
  Synthetic
atacgccatgctgggtctccaaaatttgtaaacattatggtgttgagcctgagaaaaatatatacacaaaacctgttgcatctgattattgggatggatatagtggacaattggtgtgcacgtacttgggagtcggccat

SEQ ID NO: 384428 - DNA, 140 bp, Artificial Sequence
  Synthetic
atggccgactcccaagtacgtgcacaccaattgtccactatatccatcccaataatcagatgcaacaggttttgtgtatatatttttctcaggctcaacaccataatgtttacaaattttggagacccagcatggcgtat

SEQ ID NO: 384429 - DNA, 140 bp, Artificial Sequence
  Synthetic
aggccctggctgctgatatggagtggattgactgtcagggctgtctttaggcttaattccagacctctctgtgcttggggcaaacatcatttggccttaaatgggattctgtgagagggggaccttttgggacagcggtg

SEQ ID NO: 384430 - DNA, 140 bp, Artificial Sequence
  Synthetic
caccgctgtcccaaaaggtccccctctcacagaatcccatttaaggccaaatgatgtttgccccaagcacagagaggtctggaattaagcctaaagacagccctgacagtcaatccactccatatcagcagccagggcct

SEQ ID NO: 384431 - DNA, 140 bp, Artificial Sequence
  Synthetic
atacgccatgctgggtctccatccctccattaacagctggactgttctttggggccttatgtggtgtttgccgctgaggtactcaggggcatttaggtttttcctcattcttaaataatacgtacttgggagtcggccat

SEQ ID NO: 384432 - DNA, 140 bp, Artificial Sequence
  Synthetic
atggccgactcccaagtacgtattatttaagaatgaggaaaaacctaaatgcccctgagtacctcagcggcaaacaccacataaggccccaaagaacagtccagctgttaatggagggatggagacccagcatggcgtat

SEQ ID NO: 384433 - DNA, 140 bp, Artificial Sequence
  Synthetic
atacgccatgctgggtctcctggtcagaatcaaggttccttttatttacacaagaggagcttatcactttaaggaccctcagtatcctgtttgggagttgactattagagtttggtctgacgtacttgggagtcggccat

SEQ ID NO: 384434 - DNA, 140 bp, Artificial Sequence
  Synthetic
atggccgactcccaagtacgtcagaccaaactctaatagtcaactcccaaacaggatactgagggtccttaaagtgataagctcctcttgtgtaaataaaaggaaccttgattctgaccaggagacccagcatggcgtat

SEQ ID NO: 384435 - DNA, 140 bp, Artificial Sequence
  Synthetic
aggccctggctgctgatatgaaggaccctcagtatcctgtttgggagttgactattagagtttggtctgagctaaacattggaactggtacctcggcttacacatcactgaatgtgctgggaccttttgggacagcggtg

SEQ ID NO: 384436 - DNA, 140 bp, Artificial Sequence
  Synthetic
caccgctgtcccaaaaggtcccagcacattcagtgatgtgtaagccgaggtaccagttccaatgtttagctcagaccaaactctaatagtcaactcccaaacaggatactgagggtccttcatatcagcagccagggcct

SEQ ID NO: 384437 - DNA, 140 bp, Artificial Sequence
  Synthetic
atacgccatgctgggtctccttgataggactgcagtgactggttcttcttattttacttctgtggatcaatcttcagttcatacagctgaggttggatcacaccaggttgaacctttgagcgtacttgggagtcggccat

SEQ ID NO: 384438 - DNA, 140 bp, Artificial Sequence
  Synthetic
atggccgactcccaagtacgctcaaaggttcaacctggtgtgatccaacctcagctgtatgaactgaagattgatccacagaagtaaaataagaagaaccagtcactgcagtcctatcaaggagacccagcatggcgtat

SEQ ID NO: 384439 - DNA, 140 bp, Artificial Sequence
  Synthetic
atacgccatgctgggtctccaacctctgttgataaacccggttcaaagaggactcagggagagaaatttttcttgattcattctgcagattggcttactacacatgctcttttccatgaacgtacttgggagtcggccat

SEQ ID NO: 384440 - DNA, 140 bp, Artificial Sequence
  Synthetic
atggccgactcccaagtacgttcatggaaaagagcatgtgtagtaagccaatctgcagaatgaatcaagaaaaatttctctccctgagtcctctttgaaccgggtttatcaacagaggttggagacccagcatggcgtat

SEQ ID NO: 384441 - DNA, 140 bp, Artificial Sequence
  Synthetic
atacgccatgctgggtctccgttgcaaaattggatgtggtgaaattattatacaatgagcagtttgctgttcaagggttgttgagataccatacatatgcaagatttggcattgaaattccgtacttgggagtcggccat

SEQ ID NO: 384442 - DNA, 140 bp, Artificial Sequence
  Synthetic
atggccgactcccaagtacggaatttcaatgccaaatcttgcatatgtatggtatctcaacaacccttgaacagcaaactgctcattgtataataatttcaccacatccaattttgcaacggagacccagcatggcgtat

SEQ ID NO: 384443 - DNA, 140 bp, Artificial Sequence
  Synthetic
atacgccatgctgggtctcctttacaacatggacatcaattcccactttggctgcccagtttccattcaatgcctctgattcagttgggcaacagattaaggttattccagttgatccatcgtacttgggagtcggccat

SEQ ID NO: 384444 - DNA, 140 bp, Artificial Sequence
  Synthetic
atggccgactcccaagtacgatggatcaactggaataaccttaatctgttgcccaactgaatcagaggcattgaatggaaactgggcagccaaagtgggaattgatgtccatgttgtaaaggagacccagcatggcgtat

SEQ ID NO: 384445 - DNA, 140 bp, Artificial Sequence
  Synthetic
atacgccatgctgggtctccctaatagcagagtgcagaactttcttggattctattgctgggactttgaaatccatgatgtttgggtttcatcattctgtgactgttgaaatcataaatacgtacttgggagtcggccat

SEQ ID NO: 384446 - DNA, 140 bp, Artificial Sequence
  Synthetic
atggccgactcccaagtacgtatttatgatttcaacagtcacagaatgatgaaacccaaacatcatggatttcaaagtcccagcaatagaatccaagaaagttctgcactctgctattagggagacccagcatggcgtat

SEQ ID NO: 384447 - DNA, 140 bp, Artificial Sequence
  Synthetic
atacgccatgctgggtctcctcctcatggtttgttaaattgcaatattaacaatgtggttagaataaaggttccatttatttacacaagaggtgcttaccactttaaagatccacaataccgtacttgggagtcggccat

SEQ ID NO: 384448 - DNA, 140 bp, Artificial Sequence
  Synthetic
atggccgactcccaagtacggtattgtggatctttaaagtggtaagcacctcttgtgtaaataaatggaacctttattctaaccacattgttaatattgcaatttaacaaaccatgaggaggagacccagcatggcgtat

SEQ ID NO: 384449 - DNA, 140 bp, Artificial Sequence
  Synthetic
aggccctggctgctgatatgtgacttccaggtttttcctacaaaatatcactcaggaagattattattttgttttgttcctggaaatgaactgattgatgtttcccacataacactgaaagaccttttgggacagcggtg

SEQ ID NO: 384450 - DNA, 140 bp, Artificial Sequence
  Synthetic
caccgctgtcccaaaaggtctttcagtgttatgtgggaaacatcaatcagttcatttccaggaacaaaacaaaataataatcttcctgagtgatattttgtaggaaaaacctggaagtcacatatcagcagccagggcct

SEQ ID NO: 384451 - DNA, 140 bp, Artificial Sequence
  Synthetic
atacgccatgctgggtctccccagtttgggaattgacaattagagtttggtcagaattaaatattgggacaggaacttcagcttatacttcactcaatgttttagctagatttacagattcgtacttgggagtcggccat

SEQ ID NO: 384452 - DNA, 140 bp, Artificial Sequence
  Synthetic
atggccgactcccaagtacgaatctgtaaatctagctaaaacattgagtgaagtataagctgaagttcctgtcccaatatttaattctgaccaaactctaattgtcaattcccaaactggggagacccagcatggcgtat

SEQ ID NO: 384453 - DNA, 140 bp, Artificial Sequence
  Synthetic
aggccctggctgctgatatgagggaaaagcttgacttcaattgcattggcaaccaaaatttgtaaacactatggtgttgaacctgagaaaaatatttacaccaaacctgtggcctcagatgaccttttgggacagcggtg

SEQ ID NO: 384454 - DNA, 140 bp, Artificial Sequence
  Synthetic
caccgctgtcccaaaaggtcatctgaggccacaggtttggtgtaaatatttttctcaggttcaacaccatagtgtttacaaattttggttgccaatgcaattgaagtcaagcttttccctcatatcagcagccagggcct

SEQ ID NO: 384455 - DNA, 140 bp, Artificial Sequence
  Synthetic
atacgccatgctgggtctcctgcaagagcaaagatgtcttttgctttggatcaggaagattggaaatctgatccgtcccagggtggtgggatcaaaattactcattttactacttggacacgtacttgggagtcggccat

SEQ ID NO: 384456 - DNA, 140 bp, Artificial Sequence
  Synthetic
atggccgactcccaagtacgtgtccaagtagtaaaatgagtaattttgatcccaccaccctgggacggatcagatttccaatcttcctgatccaaagcaaaagacatctttgctcttgcaggagacccagcatggcgtat

SEQ ID NO: 384457 - DNA, 140 bp, Artificial Sequence
  Synthetic
atacgccatgctgggtctcctctattccaactttggctgctcaggttccatttaatgcttcagactcagttggtcaacaaattaaagttattccagttgacccatattttttccaaatgacgtacttgggagtcggccat

SEQ ID NO: 384458 - DNA, 140 bp, Artificial Sequence
  Synthetic
atggccgactcccaagtacgtcatttggaaaaaatatgggtcaactggaataactttaatttgttgaccaactgagtctgaagcattaaatggaacctgagcagccaaagttggaatagaggagacccagcatggcgtat

SEQ ID NO: 384459 - DNA, 140 bp, Artificial Sequence
  Synthetic
aggccctggctgctgatatgtctggaggcttctctactactgtttcaacaaaacaaaatgttccagaccctcaagttggttttacaacagtgaaggatcttaaaggtagagcaaaccaaggaccttttgggacagcggtg

SEQ ID NO: 384460 - DNA, 140 bp, Artificial Sequence
  Synthetic
caccgctgtcccaaaaggtccttggtttgctctacctttaagatccttcactgttgtaaaaccaacttgagggtctggaacattttgttttgttgaaacagtagtagagaagcctccagacatatcagcagccagggcct

SEQ ID NO: 384461 - DNA, 140 bp, Artificial Sequence
  Synthetic
atacgccatgctgggtctcccaaatacaaatcctgaccaaaaatgtataactgctttggcttctatttgtcagatgttttgtttttggagaggagatcttgtctttgattttcaagttttcgtacttgggagtcggccat

SEQ ID NO: 384462 - DNA, 140 bp, Artificial Sequence
  Synthetic
atggccgactcccaagtacgaaaacttgaaaatcaaagacaagatctcctctccaaaaacaaaacatctgacaaatagaagccaaagcagttatacatttttggtcaggatttgtatttgggagacccagcatggcgtat

SEQ ID NO: 384463 - DNA, 140 bp, Artificial Sequence
  Synthetic
atacgccatgctgggtctccggaaaatggatatttcaggtgtccaagctcctgtaggagccattactaccattgaagatccagttttggcaaagaaagagcctgaaaccttcccagaattcgtacttgggagtcggccat

SEQ ID NO: 384464 - DNA, 140 bp, Artificial Sequence
  Synthetic
atggccgactcccaagtacgaattctgggaaggtttcaggctctttctttgccaaaactggatcttcaatggtagtaatggctcctacaggagcttggacacctgaaatatccattttccggagacccagcatggcgtat

SEQ ID NO: 384465 - DNA, 140 bp, Artificial Sequence
  Synthetic
atacgccatgctgggtctcctcccaccaaatatcattcaggtagattactgttttgttttgttcctggcaatgagctaatagatgtttctggaatcacattaaagcaagcaactactgctcgtacttgggagtcggccat

SEQ ID NO: 384466 - DNA, 140 bp, Artificial Sequence
  Synthetic
atggccgactcccaagtacgagcagtagttgcttgctttaatgtgattccagaaacatctattagctcattgccaggaacaaaacaaaacagtaatctacctgaatgatatttggtgggaggagacccagcatggcgtat

SEQ ID NO: 384467 - DNA, 140 bp, Artificial Sequence
  Synthetic
atacgccatgctgggtctccgaagcctggagagtcaagacatacttctgatcatatgtctatttataaatttatgggcagatctcatttcctgtgtacatttacatttaattctaacaaccgtacttgggagtcggccat

SEQ ID NO: 384468 - DNA, 140 bp, Artificial Sequence
  Synthetic
atggccgactcccaagtacggttgttagaattaaatgtaaatgtacacaggaaatgagatctgcccataaatttataaatagacatatgatcagaagtatgtcttgactctccaggcttcggagacccagcatggcgtat

SEQ ID NO: 384469 - DNA, 140 bp, Artificial Sequence
  Synthetic
atacgccatgctgggtctccccttgtgcagtaatggatattacaggagtgcagtcaactttgagatttcgtgttccctggatttctgacactccttacagagtgaacaggtatacaaagtcgtacttgggagtcggccat

SEQ ID NO: 384470 - DNA, 140 bp, Artificial Sequence
  Synthetic
atggccgactcccaagtacgactttgtatacctgttcactctgtaaggagtgtcagaaatccagggaacacgaaatctcaaagttgactgcactcctgtaatatccattactgcacaaggggagacccagcatggcgtat

SEQ ID NO: 384471 - DNA, 140 bp, Artificial Sequence
  Synthetic
atacgccatgctgggtctcccagcacatcagaaaggtgagtacactgccattgggaagcttattgtgtattgttataacagattgacctctccttctaacgttgcttcccatgtcagagtcgtacttgggagtcggccat

SEQ ID NO: 384472 - DNA, 140 bp, Artificial Sequence
  Synthetic
atggccgactcccaagtacgactctgacatgggaagcaacgttagaaggagaggtcaatctgttataacaatacacaataagcttcccaatggcagtgtactcacctttctgatgtgctgggagacccagcatggcgtat

SEQ ID NO: 384473 - DNA, 140 bp, Artificial Sequence
  Synthetic
atacgccatgctgggtctccgaatgtttatctttcagcaattaacttggaatgttttgctcctctttatcatgctatggatgttactacacaagttggagatgattctggaggtttttcacgtacttgggagtcggccat

SEQ ID NO: 384474 - DNA, 140 bp, Artificial Sequence
  Synthetic
atggccgactcccaagtacgtgaaaaacctccagaatcatctccaacttgtgtagtaacatccatagcatgataaagaggagcaaaacattccaagttaattgctgaaagataaacattcggagacccagcatggcgtat

SEQ ID NO: 384475 - DNA, 140 bp, Artificial Sequence
  Synthetic
atacgccatgctgggtctccttaggtttaataccagaagaacaggaaacattcagattaggttgccctggtactcctatctttatgctgtttcaggggcactggatgggcttggagataacgtacttgggagtcggccat

SEQ ID NO: 384476 - DNA, 140 bp, Artificial Sequence
  Synthetic
atggccgactcccaagtacgttatctccaagcccatccagtgcccctgaaacagcataaagataggagtaccagggcaacctaatctgaatgtttcctgttcttctggtattaaacctaaggagacccagcatggcgtat

SEQ ID NO: 384477 - DNA, 140 bp, Artificial Sequence
  Synthetic
aggccctggctgctgatatgtactcctatctttatgctgtttcaggggcactggatgggcttggagataaaacggattcaacttttgggcttgtttccattcaaattgcgaactacaatcgaccttttgggacagcggtg

SEQ ID NO: 384478 - DNA, 140 bp, Artificial Sequence
  Synthetic
caccgctgtcccaaaaggtcgattgtagttcgcaatttgaatggaaacaagcccaaaagttgaatccgttttatctccaagcccatccagtgcccctgaaacagcataaagataggagtacatatcagcagccagggcct

SEQ ID NO: 384479 - DNA, 140 bp, Artificial Sequence
  Synthetic
atacgccatgctgggtctcccaggagtacaagcacctgtgggagctatcacaacaattgaggatccagttttagcaaagaaagtacctgagacatttcctgaattgaaacctggagaatccgtacttgggagtcggccat

SEQ ID NO: 384480 - DNA, 140 bp, Artificial Sequence
  Synthetic
atggccgactcccaagtacggattctccaggtttcaattcaggaaatgtctcaggtactttctttgctaaaactggatcctcaattgttgtgatagctcccacaggtgcttgtactcctgggagacccagcatggcgtat

SEQ ID NO: 384481 - DNA, 140 bp, Artificial Sequence
  Synthetic
atacgccatgctgggtctcccagacatacatcagatcatatgtccatctacaagtttatgggaaggtctcatttcttgtgcacttttacattcaattcaaataataaagagtacacatttcgtacttgggagtcggccat

SEQ ID NO: 384482 - DNA, 140 bp, Artificial Sequence
  Synthetic
atggccgactcccaagtacgaaatgtgtactctttattatttgaattgaatgtaaaagtgcacaagaaatgagaccttcccataaacttgtagatggacatatgatctgatgtatgtctgggagacccagcatggcgtat

SEQ ID NO: 384483 - DNA, 140 bp, Artificial Sequence
  Synthetic
atacgccatgctgggtctcccctataaccttgtcttcaacctctaatcctcctcatggtttgccatcaacactgaggtggtttttcaacttgtttcagttgtatagagggcctttagatccgtacttgggagtcggccat

SEQ ID NO: 384484 - DNA, 140 bp, Artificial Sequence
  Synthetic
atggccgactcccaagtacggatctaaaggccctctatacaactgaaacaagttgaaaaaccacctcagtgttgatggcaaaccatgaggaggattagaggttgaagacaaggttataggggagacccagcatggcgtat

SEQ ID NO: 384485 - DNA, 140 bp, Artificial Sequence
  Synthetic
atacgccatgctgggtctccaagaggaaaccttataaagagttaagattggaggtaggtaagcaaaggctaaagtatgctcaggaagaattgtcaaatgaagtgttgcctcctcctcgtacgtacttgggagtcggccat

SEQ ID NO: 384486 - DNA, 140 bp, Artificial Sequence
  Synthetic
atggccgactcccaagtacgtacgaggaggaggcaacacttcatttgacaattcttcctgagcatactttagcctttgcttacctacctccaatcttaactctttataaggtttcctcttggagacccagcatggcgtat

SEQ ID NO: 384487 - DNA, 140 bp, Artificial Sequence
  Synthetic
aggccctggctgctgatatgaaagtatgctcaggaagaattgtcaaatgaagtgttgcctcctcctcgtaaaattaagggtgtattttcacaagcaaaaatctcattgttctatacagaagaccttttgggacagcggtg

SEQ ID NO: 384488 - DNA, 140 bp, Artificial Sequence
  Synthetic
caccgctgtcccaaaaggtcttctgtatagaacaatgagatttttgcttgtgaaaatacacccttaattttacgaggaggaggcaacacttcatttgacaattcttcctgagcatactttcatatcagcagccagggcct

SEQ ID NO: 384489 - DNA, 140 bp, Artificial Sequence
  Synthetic
atacgccatgctgggtctcctttgtctattgactacaaaactgctcttggagctgtcagatttaacacaaggagaacagggaacattcagattagattaccatggtattcttatttatatcgtacttgggagtcggccat

SEQ ID NO: 384490 - DNA, 140 bp, Artificial Sequence
  Synthetic
atggccgactcccaagtacgatataaataagaataccatggtaatctaatctgaatgttccctgttctccttgtgttaaatctgacagctccaagagcagttttgtagtcaatagacaaaggagacccagcatggcgtat

SEQ ID NO: 384491 - DNA, 140 bp, Artificial Sequence
  Synthetic
atacgccatgctgggtctccgctgtgtctggagcactggatggtttgggagacaagacagattctacatttggattggtttctattcagattgcaaattacaatcattctgatgaatactcgtacttgggagtcggccat

SEQ ID NO: 384492 - DNA, 140 bp, Artificial Sequence
  Synthetic
atggccgactcccaagtacgagtattcatcagaatgattgtaatttgcaatctgaatagaaaccaatccaaatgtagaatctgtcttgtctcccaaaccatccagtgctccagacacagcggagacccagcatggcgtat

SEQ ID NO: 384493 - DNA, 140 bp, Artificial Sequence
  Synthetic
atacgccatgctgggtctccgatgaaaaatggacagaaatgaaagatgacaaaatagtttctttggtggagaaatttactagtaataaacactggtccaaagttaattttcctcatggaacgtacttgggagtcggccat

SEQ ID NO: 384494 - DNA, 140 bp, Artificial Sequence
  Synthetic
atggccgactcccaagtacgttccatgaggaaaattaactttggaccagtgtttattactagtaaatttctccaccaaagaaactattttgtcatctttcatttctgtccatttttcatcggagacccagcatggcgtat

SEQ ID NO: 384495 - DNA, 140 bp, Artificial Sequence
  Synthetic
atacgccatgctgggtctccggttgcagttggggctgctgtgggagtacttggtgttttggttggaggttggtatgtctacaagcattttacaaagaagcaagaagagtccattccaagtcgtacttgggagtcggccat

SEQ ID NO: 384496 - DNA, 140 bp, Artificial Sequence
  Synthetic
atggccgactcccaagtacgacttggaatggactcttcttgcttctttgtaaaatgcttgtagacataccaacctccaaccaaaacaccaagtactcccacagcagccccaactgcaaccggagacccagcatggcgtat

SEQ ID NO: 384497 - DNA, 140 bp, Artificial Sequence
  Synthetic
atacgccatgctgggtctcctgttggatttggaagaaattgctgcaaatgcaaaagaatttccgaatatgtcagaaactgatttgtgtttcttgttgcattggctgaaccccaaaaagatcgtacttgggagtcggccat

SEQ ID NO: 384498 - DNA, 140 bp, Artificial Sequence
  Synthetic
atggccgactcccaagtacgatctttttggggttcagccaatgcaacaagaaacacaaatcagtttctgacatattcggaaattcttttgcatttgcagcaatttcttccaaatccaacaggagacccagcatggcgtat

SEQ ID NO: 384499 - DNA, 140 bp, Artificial Sequence
  Synthetic
atacgccatgctgggtctccgagcagaattgcagctggagacttggagtcatcagtggatgatcctagatcagaggaagataaaagatttgagagtcatatagaatgcaggaagccatatcgtacttgggagtcggccat

SEQ ID NO: 384500 - DNA, 140 bp, Artificial Sequence
  Synthetic
atggccgactcccaagtacgatatggcttcctgcattctatatgactctcaaatcttttatcttcctctgatctaggatcatccactgatgactccaagtctccagctgcaattctgctcggagacccagcatggcgtat

SEQ ID NO: 384501 - DNA, 140 bp, Artificial Sequence
  Synthetic
atacgccatgctgggtctccaaatttggcggataggatgttgggtctgtcagggatacaggaaataaaagaaaaaggggtgggattgattggcgagtgccgagctttcctagattctatacgtacttgggagtcggccat

SEQ ID NO: 384502 - DNA, 140 bp, Artificial Sequence
  Synthetic
atggccgactcccaagtacgtatagaatctaggaaagctcggcactcgccaatcaatcccacccctttttcttttatttcctgtatccctgacagacccaacatcctatccgccaaatttggagacccagcatggcgtat

SEQ ID NO: 384503 - DNA, 140 bp, Artificial Sequence
  Synthetic
atacgccatgctgggtctccaaagaactgagattagaagttgggaaacaaagactcaagtatgctcaggaagaattgtcaagtgaagtacttccaccccctaggaaaatgaagggactgtcgtacttgggagtcggccat

SEQ ID NO: 384504 - DNA, 140 bp, Artificial Sequence
  Synthetic
atggccgactcccaagtacgacagtcccttcattttcctagggggtggaagtacttcacttgacaattcttcctgagcatacttgagtctttgtttcccaacttctaatctcagttctttggagacccagcatggcgtat

SEQ ID NO: 384505 - DNA, 140 bp, Artificial Sequence
  Synthetic
atacgccatgctgggtctcctttcacaagccaaaatttctcttttttatactgaggagcatgaaataatgaagttttcccggagaggtgtgactgctgatactagagctttaaggaggttcgtacttgggagtcggccat

SEQ ID NO: 384506 - DNA, 140 bp, Artificial Sequence
  Synthetic
atggccgactcccaagtacgaacctccttaaagctctagtatcagcagtcacacctctccgggaaaacttcattatttcatgctcctcagtataaaaaagagaaattttggcttgtgaaaggagacccagcatggcgtat

SEQ ID NO: 384507 - DNA, 140 bp, Artificial Sequence
  Synthetic
aggccctggctgctgatatgttgagagtgatgaattatgctgatattgggtgttctgtcatttcatgtggtaaagtgttttcaaaaatgttagaaactgtttttaattggcagatggattgaccttttgggacagcggtg

SEQ ID NO: 384508 - DNA, 140 bp, Artificial Sequence
  Synthetic
caccgctgtcccaaaaggtcaatccatctgccaattaaaaacagtttctaacatttttgaaaacactttaccacatgaaatgacagaacacccaatatcagcataattcatcactctcaacatatcagcagccagggcct

SEQ ID NO: 384509 - DNA, 140 bp, Artificial Sequence
  Synthetic
atacgccatgctgggtctcctaaagtgttttcaaaaatgttagaaactgtttttaattggcagatggattcgagaatgatggagctcagaactcagagtatctcaaattggcttagagaccgtacttgggagtcggccat

SEQ ID NO: 384510 - DNA, 140 bp, Artificial Sequence
  Synthetic
atggccgactcccaagtacggtctctaagccaatttgagatactctgagttctgagctccatcattctcgaatccatctgccaattaaaaacagtttctaacatttttgaaaacactttaggagacccagcatggcgtat

SEQ ID NO: 384511 - DNA, 140 bp, Artificial Sequence
  Synthetic
atacgccatgctgggtctccgaaatgaaggatgacaagattgtttcattgattgaaaagttcacaagtaacaaatattggtccaaagtgaatttcccacatgggatgttggatcttgaagcgtacttgggagtcggccat

SEQ ID NO: 384512 - DNA, 140 bp, Artificial Sequence
  Synthetic
atggccgactcccaagtacgcttcaagatccaacatcccatgtgggaaattcactttggaccaatatttgttacttgtgaacttttcaatcaatgaaacaatcttgtcatccttcatttcggagacccagcatggcgtat

SEQ ID NO: 384513 - DNA, 140 bp, Artificial Sequence
  Synthetic
atacgccatgctgggtctccatttgttcaggtataacaatttttaaaagttttaaggatgcgatttattggctttacacaaaaattagagaatactatgatctgaattatggtaataagacgtacttgggagtcggccat

SEQ ID NO: 384514 - DNA, 140 bp, Artificial Sequence
  Synthetic
atggccgactcccaagtacgtcttattaccataattcagatcatagtattctctaatttttgtgtaaagccaataaatcgcatccttaaaacttttaaaaattgttatacctgaacaaatggagacccagcatggcgtat

SEQ ID NO: 384515 - DNA, 140 bp, Artificial Sequence
  Synthetic
atacgccatgctgggtctccaaattgctgccaattctaaggattttcctaacatgtctgaaacggatttgtgtttcttgctgcattggttaaatccaaagaaaattaatttagcagatagcgtacttgggagtcggccat

SEQ ID NO: 384516 - DNA, 140 bp, Artificial Sequence
  Synthetic
atggccgactcccaagtacgctatctgctaaattaattttctttggatttaaccaatgcagcaagaaacacaaatccgtttcagacatgttaggaaaatccttagaattggcagcaatttggagacccagcatggcgtat

SEQ ID NO: 384517 - DNA, 140 bp, Artificial Sequence
  Synthetic
atacgccatgctgggtctccaatgcttggattgtctggagttcaggaaattaaagaacaaggtgttggattaatagcagagtgtagaactttcttagattctattgctggaactttaaaacgtacttgggagtcggccat

SEQ ID NO: 384518 - DNA, 140 bp, Artificial Sequence
  Synthetic
atggccgactcccaagtacgttttaaagttccagcaatagaatctaagaaagttctacactctgctattaatccaacaccttgttctttaatttcctgaactccagacaatccaagcattggagacccagcatggcgtat

SEQ ID NO: 384519 - DNA, 140 bp, Artificial Sequence
  Synthetic
atacgccatgctgggtctcctctatgatgtttggatttcatcattctgtgactgttgaaattataaacactgtgctctgttttgttaagagtggaattttgctttatgtaatacaacaatcgtacttgggagtcggccat

SEQ ID NO: 384520 - DNA, 140 bp, Artificial Sequence
  Synthetic
atggccgactcccaagtacgattgttgtattacataaagcaaaattccactcttaacaaaacagagcacagtgtttataatttcaacagtcacagaatgatgaaatccaaacatcatagaggagacccagcatggcgtat

SEQ ID NO: 384521 - DNA, 140 bp, Artificial Sequence
  Synthetic
aggccctggctgctgatatgcttagagactgtattgctagagttcatcaaaaattgaaaaatttgggttcaattaaccaggcaatggtgacaagatgtgagccagtcgtctgctacctctgaccttttgggacagcggtg

SEQ ID NO: 384522 - DNA, 140 bp, Artificial Sequence
  Synthetic
caccgctgtcccaaaaggtcagaggtagcagacgactggctcacatcttgtcaccattgcctggttaattgaacccaaatttttcaatttttgatgaactctagcaatacagtctctaagcatatcagcagccagggcct

SEQ ID NO: 384523 - DNA, 140 bp, Artificial Sequence
  Synthetic
atacgccatgctgggtctcctgaatcaggatgaacattctcacataattggtttgttgagagtcatgaattatgtagatattggttgttcagttatttcatgtgccaaagctttttccagcgtacttgggagtcggccat

SEQ ID NO: 384524 - DNA, 140 bp, Artificial Sequence
  Synthetic
atggccgactcccaagtacgctggaaaaagctttggcacatgaaataactgaacaaccaatatctacataattcatgactctcaacaaaccaattatgtgagaatgttcatcctgattcaggagacccagcatggcgtat

SEQ ID NO: 384525 - DNA, 140 bp, Artificial Sequence
  Synthetic
atacgccatgctgggtctccaatgctggaaacagtctttaattggcaaatggactccagaatgatggagttaaggactcagagtttttctaactggttaaaagatatttgttctgggatccgtacttgggagtcggccat

SEQ ID NO: 384526 - DNA, 140 bp, Artificial Sequence
  Synthetic
atggccgactcccaagtacggatcccagaacaaatatcttttaaccagttagaaaaactctgagtccttaactccatcattctggagtccatttgccaattaaagactgtttccagcattggagacccagcatggcgtat

SEQ ID NO: 384527 - DNA, 140 bp, Artificial Sequence
  Synthetic
atacgccatgctgggtctccaccatttttaaaaacttcaaggatgcaatttattggctttatacaaaattaatggacttttatgaagtgaattatggcaagaagaaggacattttaaatacgtacttgggagtcggccat

SEQ ID NO: 384528 - DNA, 140 bp, Artificial Sequence
  Synthetic
atggccgactcccaagtacgtatttaaaatgtccttcttcttgccataattcacttcataaaagtccattaattttgtataaagccaataaattgcatccttgaagtttttaaaaatggtggagacccagcatggcgtat

SEQ ID NO: 384529 - DNA, 140 bp, Artificial Sequence
  Synthetic
atacgccatgctgggtctccttcttaaagataaccaacaaaaaatagagaaagccattgaggaagccgataaattttgcattttgcaaatccaagatgtggaaaaatctgaacagtatcacgtacttgggagtcggccat

SEQ ID NO: 384530 - DNA, 140 bp, Artificial Sequence
  Synthetic
atggccgactcccaagtacgtgatactgttcagatttttccacatcttggatttgcaaaatgcaaaatttatcggcttcctcaatggctttctctattttttgttggttatctttaagaaggagacccagcatggcgtat

SEQ ID NO: 384531 - DNA, 140 bp, Artificial Sequence
  Synthetic
atacgccatgctgggtctccggtctaatccaagtcctaaaacggtttatgttaaggaagccatagaccgtaaacttcattttaaagttgaggtgaaacctgcctcattctttaaaaatcccgtacttgggagtcggccat

SEQ ID NO: 384532 - DNA, 140 bp, Artificial Sequence
  Synthetic
atggccgactcccaagtacgggatttttaaagaatgaggcaggtttcacctcaactttaaaatgaagtttacggtctatggcttccttaacataaaccgttttaggacttggattagaccggagacccagcatggcgtat

SEQ ID NO: 384533 - DNA, 140 bp, Artificial Sequence
  Synthetic
atacgccatgctgggtctccgaaaggggttgacttgatacaaaaattgagaactgttcattcaatggctcaggttgatccaaatttaatggttcatttgtcacctttgagagattgtatacgtacttgggagtcggccat

SEQ ID NO: 384534 - DNA, 140 bp, Artificial Sequence
  Synthetic
atggccgactcccaagtacgtatacaatctctcaaaggtgacaaatgaaccattaaatttggatcaacctgagccattgaatgaacagttctcaatttttgtatcaagtcaacccctttcggagacccagcatggcgtat

SEQ ID NO: 384535 - DNA, 140 bp, Artificial Sequence
  Synthetic
atacgccatgctgggtctcctcataatgatatgttaaatgtcaatctggcaaaaactaatgatgctattaaagacatgtcatgtgttgatcttgtcatggataatcacaatgtttcattgcgtacttgggagtcggccat

SEQ ID NO: 384536 - DNA, 140 bp, Artificial Sequence
  Synthetic
atggccgactcccaagtacgcaatgaaacattgtgattatccatgacaagatcaacacatgacatgtctttaatagcatcattagtttttgccagattgacatttaacatatcattatgaggagacccagcatggcgtat

SEQ ID NO: 384537 - DNA, 140 bp, Artificial Sequence
  Synthetic
atacgccatgctgggtctccgcaagagttcatcagaaacttaaaaaccttggatctataaatcaggcaatggtaacgagatgtgagccagttgtttgttatttatatggcaaaagaggggcgtacttgggagtcggccat

SEQ ID NO: 384538 - DNA, 140 bp, Artificial Sequence
  Synthetic
atggccgactcccaagtacgcccctcttttgccatataaataacaaacaactggctcacatctcgttaccattgcctgatttatagatccaaggtttttaagtttctgatgaactcttgcggagacccagcatggcgtat

SEQ ID NO: 384539 - DNA, 140 bp, Artificial Sequence
  Synthetic
atacgccatgctgggtctccgaggaaagagcttaacatcaattgcattggcaaccaaaatttgtaaacattatggtgttgagcctgaaaagaatatctatactaaacctgtggcttcagacgtacttgggagtcggccat

SEQ ID NO: 384540 - DNA, 140 bp, Artificial Sequence
  Synthetic
atggccgactcccaagtacgtctgaagccacaggtttagtatagatattcttttcaggctcaacaccataatgtttacaaattttggttgccaatgcaattgatgttaagctctttcctcggagacccagcatggcgtat

SEQ ID NO: 384541 - DNA, 140 bp, Artificial Sequence
  Synthetic
aggccctggctgctgatatgatgatagtgcagttgctgaatttttccaatcttttccctctggtgagccatctgggtcaaggttgtcacagtttttccaatcagttaccaaccacaagtggaccttttgggacagcggtg

SEQ ID NO: 384542 - DNA, 140 bp, Artificial Sequence
  Synthetic
caccgctgtcccaaaaggtccacttgtggttggtaactgattggaaaaactgtgacaaccttgacccagatggctcaccagagggaaaagattggaaaaattcagcaactgcactatcatcatatcagcagccagggcct

SEQ ID NO: 384543 - DNA, 140 bp, Artificial Sequence
  Synthetic
atacgccatgctgggtctccttactgggatggatatagtggacaattaatttgcatcattgatgatattggccaaaacacaacagatgaggattggtcagatttttgtcagttagtgtcacgtacttgggagtcggccat

SEQ ID NO: 384544 - DNA, 140 bp, Artificial Sequence
  Synthetic
atggccgactcccaagtacgtgacactaactgacaaaaatctgaccaatcctcatctgttgtgttttggccaatatcatcaatgatgcaaattaattgtccactatatccatcccagtaaggagacccagcatggcgtat

SEQ ID NO: 384545 - DNA, 140 bp, Artificial Sequence
  Synthetic
atacgccatgctgggtctccggttgcagttggggctgctgtgggagtacttggtgtcttggttggaggttggtatgtttacaagcattttacaaagaagcaagaagaatccattccaagtcgtacttgggagtcggccat

SEQ ID NO: 384546 - DNA, 140 bp, Artificial Sequence
  Synthetic
atggccgactcccaagtacgacttggaatggattcttcttgcttctttgtaaaatgcttgtaaacataccaacctccaaccaagacaccaagtactcccacagcagccccaactgcaaccggagacccagcatggcgtat

SEQ ID NO: 384547 - DNA, 140 bp, Artificial Sequence
  Synthetic
atacgccatgctgggtctccatgaacatgtctagacaaggtattttccagactgttgggagtggtcttgaccacatcctgtctttggcagacattgaggaagagcaaatgattcaatcagcgtacttgggagtcggccat

SEQ ID NO: 384548 - DNA, 140 bp, Artificial Sequence
  Synthetic
atggccgactcccaagtacgctgattgaatcatttgctcttcctcaatgtctgccaaagacaggatgtggtcaagaccactcccaacagtctggaaaataccttgtctagacatgttcatggagacccagcatggcgtat

SEQ ID NO: 384549 - DNA, 140 bp, Artificial Sequence
  Synthetic
atacgccatgctgggtctcccaaaaacagtttatgttaaggaagcaattgaccgcagactccatttcaaggttgaagttaaacctgcttcatttttcaaaaatcctcacaatgatatgttcgtacttgggagtcggccat

SEQ ID NO: 384550 - DNA, 140 bp, Artificial Sequence
  Synthetic
atggccgactcccaagtacgaacatatcattgtgaggatttttgaaaaatgaagcaggtttaacttcaaccttgaaatggagtctgcggtcaattgcttccttaacataaactgtttttgggagacccagcatggcgtat

SEQ ID NO: 384551 - DNA, 140 bp, Artificial Sequence
  Synthetic
atacgccatgctgggtctccgaatgttaatttagctaaaacaaatgatgcaatcaaagatatgtcttgtgttgatttgataatggatggacataatgtttcattgatggatttgctcagtcgtacttgggagtcggccat

SEQ ID NO: 384552 - DNA, 140 bp, Artificial Sequence
  Synthetic
atggccgactcccaagtacgactgagcaaatccatcaatgaaacattatgtccatccattatcaaatcaacacaagacatatctttgattgcatcatttgttttagctaaattaacattcggagacccagcatggcgtat

SEQ ID NO: 384553 - DNA, 140 bp, Artificial Sequence
  Synthetic
atacgccatgctgggtctcctctttagtcatgacagttgaaattagaaaacaaaacatgactgaattcatggggttgtggtctcagggaatttcagatgatgataatgatagtgcagtagcgtacttgggagtcggccat

SEQ ID NO: 384554 - DNA, 140 bp, Artificial Sequence
  Synthetic
atggccgactcccaagtacgctactgcactatcattatcatcatctgaaattccctgagaccacaaccccatgaattcagtcatgttttgttttctaatttcaactgtcatgactaaagaggagacccagcatggcgtat

SEQ ID NO: 384555 - DNA, 140 bp, Artificial Sequence
  Synthetic
aggccctggctgctgatatgctgagtttttccagtcttttccatctggtgaaccatcgaactctaaattatctggctttttccaatctgttactaatcacgagtgggttgctgtgggagcgaccttttgggacagcggtg

SEQ ID NO: 384556 - DNA, 140 bp, Artificial Sequence
  Synthetic
caccgctgtcccaaaaggtcgctcccacagcaacccactcgtgattagtaacagattggaaaaagccagataatttagagttcgatggttcaccagatggaaaagactggaaaaactcagcatatcagcagccagggcct

SEQ ID NO: 384557 - DNA, 140 bp, Artificial Sequence
  Synthetic
atacgccatgctgggtctcctgcagttggcattcttggagtgctcgttggaggatggtttgtgtataagcatttctcctgcaaagaggaagaaccaatcccatctgaaggggtatattatcgtacttgggagtcggccat

SEQ ID NO: 384558 - DNA, 140 bp, Artificial Sequence
  Synthetic
atggccgactcccaagtacgataatataccccttcagatgggattggttcttcctctttgcaggagaaatgcttatacacaaaccatcctccaacgagcactccaagaatgccaactgcaggagacccagcatggcgtat

SEQ ID NO: 384559 - DNA, 140 bp, Artificial Sequence
  Synthetic
atacgccatgctgggtctccatgaattgagaccattagagaaagttctggaatcaaaaacaagagccattgatgcttgtcctttggactatacaattctatgtcgaatgtattggggtcccgtacttgggagtcggccat

SEQ ID NO: 384560 - DNA, 140 bp, Artificial Sequence
  Synthetic
atggccgactcccaagtacgggaccccaatacattcgacatagaattgtatagtccaaaggacaagcatcaatggctcttgtttttgattccagaactttctctaatggtctcaattcatggagacccagcatggcgtat

SEQ ID NO: 384561 - DNA, 140 bp, Artificial Sequence
  Synthetic
atacgccatgctgggtctcccctggagaggtaaaggagaaggtcttccagggatgtgtggtggggccttgatttcttccaatcagtccatccagaatgccatattaggaatccatgttgccgtacttgggagtcggccat

SEQ ID NO: 384562 - DNA, 140 bp, Artificial Sequence
  Synthetic
atggccgactcccaagtacggcaacatggattcctaatatggcattctggatggactgattggaagaaatcaaggccccaccacacatccctggaagaccttctcctttacctctccaggggagacccagcatggcgtat

SEQ ID NO: 384563 - DNA, 140 bp, Artificial Sequence
  Synthetic
aggccctggctgctgatatgatttcttccaatcagtccatccagaatgccatattaggaatccatgttgctggtggaaactcaattttggttgctaagctagtgactcaggagatgtttcgaccttttgggacagcggtg

SEQ ID NO: 384564 - DNA, 140 bp, Artificial Sequence
  Synthetic
caccgctgtcccaaaaggtcgaaacatctcctgagtcactagcttagcaaccaaaattgagtttccaccagcaacatggattcctaatatggcattctggatggactgattggaagaaatcatatcagcagccagggcct

SEQ ID NO: 384565 - DNA, 140 bp, Artificial Sequence
  Synthetic
atacgccatgctgggtctccagtttggagttggagagaagaatggatgtgtgagatgggttatgaatgccttgggagtgaaagatgattggctgcttgtgccttcccatgcttataaattcgtacttgggagtcggccat

SEQ ID NO: 384566 - DNA, 140 bp, Artificial Sequence
  Synthetic
atggccgactcccaagtacgaatttataagcatgggaaggcacaagcagccaatcatctttcactcccaaggcattcataacccatctcacacatccattcttctctccaactccaaactggagacccagcatggcgtat

SEQ ID NO: 384567 - DNA, 140 bp, Artificial Sequence
  Synthetic
atacgccatgctgggtctcctgagaaagattatgaaatgatggagttttattttaatagaggtggaacttactattcaatttcagctggtaatgttgttattcaatctttggatgtgggacgtacttgggagtcggccat

SEQ ID NO: 384568 - DNA, 140 bp, Artificial Sequence
  Synthetic
atggccgactcccaagtacgtcccacatccaaagattgaataacaacattaccagctgaaattgaatagtaagttccacctctattaaaataaaactccatcatttcataatctttctcaggagacccagcatggcgtat

SEQ ID NO: 384569 - DNA, 140 bp, Artificial Sequence
  Synthetic
atacgccatgctgggtctccttccaggatgttgttctgatgaaggttcctacaattcctaagtttagagatattactcagcattttattaagaaaggggatgtgcctagagctttgaatccgtacttgggagtcggccat

SEQ ID NO: 384570 - DNA, 140 bp, Artificial Sequence
  Synthetic
atggccgactcccaagtacggattcaaagctctaggcacatcccctttcttaataaaatgctgagtaatatctctaaacttaggaattgtaggaaccttcatcagaacaacatcctggaaggagacccagcatggcgtat

SEQ ID NO: 384571 - DNA, 140 bp, Artificial Sequence
  Synthetic
atacgccatgctgggtctccgcctggcaacattagtgacaactgtaaatggaacccctatgttaatttctgagggcccactaaagatggaagagaaagctgcttatgttcataagaaaaacgtacttgggagtcggccat

SEQ ID NO: 384572 - DNA, 140 bp, Artificial Sequence
  Synthetic
atggccgactcccaagtacgtttttcttatgaacataagcagctttctcttccatctttagtgggccctcagaaattaacataggggttccatttacagttgtcactaatgttgccaggcggagacccagcatggcgtat

SEQ ID NO: 384573 - DNA, 140 bp, Artificial Sequence
  Synthetic
atacgccatgctgggtctcctgatggtacaacagttgatttaactgtggatcaggcatggagaggaaaaggcgaaggtcttcctggaatgtgtggtggggccttggtttcatcgaatcaacgtacttgggagtcggccat

SEQ ID NO: 384574 - DNA, 140 bp, Artificial Sequence
  Synthetic
atggccgactcccaagtacgttgattcgatgaaaccaaggccccaccacacattccaggaagaccttcgccttttcctctccatgcctgatccacagttaaatcaactgttgtaccatcaggagacccagcatggcgtat

SEQ ID NO: 384575 - DNA, 140 bp, Artificial Sequence
  Synthetic
atacgccatgctgggtctccgacttggatgttgttttcactacttgtcccaaggatgaattaagacctctagacaaagtattggaatccaaaactagggctattgattcttgtcctcttgcgtacttgggagtcggccat

SEQ ID NO: 384576 - DNA, 140 bp, Artificial Sequence
  Synthetic
atggccgactcccaagtacgcaagaggacaagaatcaatagccctagttttggattccaatactttgtctagaggtcttaattcatccttgggacaagtagtgaaaacaacatccaagtcggagacccagcatggcgtat

SEQ ID NO: 384577 - DNA, 140 bp, Artificial Sequence
  Synthetic
atacgccatgctgggtctccaaattgaaagtcagagaattatgaaagtggagtttactcagtgttcaatgaatgtggtctccaaaacgctttttagaaagagtcccatttatcatcacatcgtacttgggagtcggccat

SEQ ID NO: 384578 - DNA, 140 bp, Artificial Sequence
  Synthetic
atggccgactcccaagtacgatgtgatgataaatgggactctttctaaaaagcgttttggagaccacattcattgaacactgagtaaactccactttcataattctctgactttcaatttggagacccagcatggcgtat

SEQ ID NO: 384579 - DNA, 140 bp, Artificial Sequence
  Synthetic
aggccctggctgctgatatgacttttaattcaaataataaagagtacacatttccaataactctgtcctcgacttccaatcctcctcatggtttaccatcaacattaaggtggtttttcagaccttttgggacagcggtg

SEQ ID NO: 384580 - DNA, 140 bp, Artificial Sequence
  Synthetic
caccgctgtcccaaaaggtctgaaaaaccaccttaatgttgatggtaaaccatgaggaggattggaagtcgaggacagagttattggaaatgtgtactctttattatttgaattaaaagtcatatcagcagccagggcct

SEQ ID NO: 384581 - DNA, 140 bp, Artificial Sequence
  Synthetic
atacgccatgctgggtctcctgataaaaccatgattaattttcctgcagctatgcccttttctaaagctgaaattgatccaatggctgtgatgttatctaagtattcattacctattgtacgtacttgggagtcggccat

SEQ ID NO: 384582 - DNA, 140 bp, Artificial Sequence
  Synthetic
atggccgactcccaagtacgtacaataggtaatgaatacttagataacatcacagccattggatcaatttcagctttagaaaagggcatagctgcaggaaaattaatcatggttttatcaggagacccagcatggcgtat

SEQ ID NO: 384583 - DNA, 140 bp, Artificial Sequence
  Synthetic
atacgccatgctgggtctccgaagaaccagagaattataaagaggcttcaattttttatcaaaataaaatagtgggtaagactcagttagttgatgattttctagatcttgatatggccacgtacttgggagtcggccat

SEQ ID NO: 384584 - DNA, 140 bp, Artificial Sequence
  Synthetic
atggccgactcccaagtacgtggccatatcaagatctagaaaatcatcaactaactgagtcttacccactattttattttgataaaaaattgaagcctctttataattctctggttcttcggagacccagcatggcgtat

SEQ ID NO: 384585 - DNA, 140 bp, Artificial Sequence
  Synthetic
atacgccatgctgggtctccttacaggggccccaggaattgatgctatcaacatggattcatctcctggatttccttatgtccaggagaagttgaccaaaagagatttaatttggttggacgtacttgggagtcggccat

SEQ ID NO: 384586 - DNA, 140 bp, Artificial Sequence
  Synthetic
atggccgactcccaagtacgtccaaccaaattaaatctcttttggtcaacttctcctggacataaggaaatccaggagatgaatccatgttgatagcatcaattcctggggcccctgtaaggagacccagcatggcgtat

SEQ ID NO: 384587 - DNA, 140 bp, Artificial Sequence
  Synthetic
atacgccatgctgggtctcctgaaaatggtttattgctgggagttcatccaagattggctcagagaatcttattcaatactgtcatgatggaaaattgttctgatttggatgttgtttttcgtacttgggagtcggccat

SEQ ID NO: 384588 - DNA, 140 bp, Artificial Sequence
  Synthetic
atggccgactcccaagtacgaaaaacaacatccaaatcagaacaattttccatcatgacagtattgaataagattctctgagccaatcttggatgaactcccagcaataaaccattttcaggagacccagcatggcgtat

SEQ ID NO: 384589 - DNA, 140 bp, Artificial Sequence
  Synthetic
atacgccatgctgggtctccacaacctgtccaaaagatgaattgagaccattagagaaagtgttggaatcaaaaacaagagctattgatgcttgtcctctggattacacaattttgtgcccgtacttgggagtcggccat

SEQ ID NO: 384590 - DNA, 140 bp, Artificial Sequence
  Synthetic
atggccgactcccaagtacgggcacaaaattgtgtaatccagaggacaagcatcaatagctcttgtttttgattccaacactttctctaatggtctcaattcatcttttggacaggttgtggagacccagcatggcgtat

SEQ ID NO: 384591 - DNA, 140 bp, Artificial Sequence
  Synthetic
aggccctggctgctgatatgaaaaacaagagctattgatgcttgtcctctggattacacaattttgtgccgaatgtattggggtccagctattagttattttcatttgaatccaggtttcgaccttttgggacagcggtg

SEQ ID NO: 384592 - DNA, 140 bp, Artificial Sequence
  Synthetic
caccgctgtcccaaaaggtcgaaacctggattcaaatgaaaataactaatagctggaccccaatacattcggcacaaaattgtgtaatccagaggacaagcatcaatagctcttgtttttcatatcagcagccagggcct

SEQ ID NO: 384593 - DNA, 140 bp, Artificial Sequence
  Synthetic
aggccctggctgctgatatggatcatgaaattatgaaattttcctggaaaggaattactgctgacactagagctctgaggagatttggcttttcattggctgctggtaggagtgtgtggagaccttttgggacagcggtg

SEQ ID NO: 384594 - DNA, 140 bp, Artificial Sequence
  Synthetic
caccgctgtcccaaaaggtctccacacactcctaccagcagccaatgaaaagccaaatctcctcagagctctagtgtcagcagtaattcctttccaggaaaatttcataatttcatgatccatatcagcagccagggcct

SEQ ID NO: 384595 - DNA, 140 bp, Artificial Sequence
  Synthetic
aggccctggctgctgatatgcatacaggtgttgctattggcatagatcctgatagacagtgggatgaattatttaaaacaatgataagattcggagatgttggtcttgatttagatttctgaccttttgggacagcggtg

SEQ ID NO: 384596 - DNA, 140 bp, Artificial Sequence
  Synthetic
caccgctgtcccaaaaggtcagaaatctaaatcaagaccaacatctccgaatcttatcattgttttaaataattcatcccactgtctatcaggatctatgccaatagcaacacctgtatgcatatcagcagccagggcct

SEQ ID NO: 384597 - DNA, 140 bp, Artificial Sequence
  Synthetic
atacgccatgctgggtctccctgcttttgatgctagtcttagtccatttatgattagagaagcaggtagaatcatgagtgaactatctggaactccatcccattttggcacagctcttatcgtacttgggagtcggccat

SEQ ID NO: 384598 - DNA, 140 bp, Artificial Sequence
  Synthetic
atggccgactcccaagtacgataagagctgtgccaaaatgggatggagttccagatagttcactcatgattctacctgcttctctaatcataaatggactaagactagcatcaaaagcagggagacccagcatggcgtat

SEQ ID NO: 384599 - DNA, 140 bp, Artificial Sequence
  Synthetic
atacgccatgctgggtctcccaatactatcatttattccaagcatttgctgtataactgttgttaccatgtctgtggttcaatgccctctgggtctccttgtacagctttgctaaattcacgtacttgggagtcggccat

SEQ ID NO: 384600 - DNA, 140 bp, Artificial Sequence
  Synthetic
atggccgactcccaagtacgtgaatttagcaaagctgtacaaggagacccagagggcattgaaccacagacatggtaacaacagttatacagcaaatgcttggaataaatgatagtattgggagacccagcatggcgtat

SEQ ID NO: 384601 - DNA, 140 bp, Artificial Sequence
  Synthetic
atacgccatgctgggtctccccctttcccctctccctttattcttgtatatattaattcctgcaggttcaggtctcttggatttgttccactttatggacactcatttcacgctttctgtcgtacttgggagtcggccat

SEQ ID NO: 384602 - DNA, 140 bp, Artificial Sequence
  Synthetic
atggccgactcccaagtacgacagaaagcgtgaaatgagtgtccataaagtggaacaaatccaagagacctgaacctgcaggaattaatatatacaagaataaagggagaggggaaagggggagacccagcatggcgtat

SEQ ID NO: 384603 - DNA, 140 bp, Artificial Sequence
  Synthetic
atacgccatgctgggtctccattattaataatgtcaatttgtattatgtgttttccaaggtatttggaaagtctccagttttcttttgtcaggctttgaagattctctgttatggagatgcgtacttgggagtcggccat

SEQ ID NO: 384604 - DNA, 140 bp, Artificial Sequence
  Synthetic
atggccgactcccaagtacgcatctccataacagagaatcttcaaagcctgacaaaagaaaactggagactttccaaataccttggaaaacacataatacaaattgacattattaataatggagacccagcatggcgtat

SEQ ID NO: 384605 - DNA, 140 bp, Artificial Sequence
  Synthetic
atacgccatgctgggtctccatgttttaatagttttctctcgagatgttcagattgataatcttgatctgattggacaaaaaattgtagatgagtttaagaaacttggcatgacagctaccgtacttgggagtcggccat

SEQ ID NO: 384606 - DNA, 140 bp, Artificial Sequence
  Synthetic
atggccgactcccaagtacggtagctgtcatgccaagtttcttaaactcatctacaattttttgtccaatcagatcaagattatcaatctgaacatctcgagagaaaactattaaaacatggagacccagcatggcgtat

SEQ ID NO: 384607 - DNA, 140 bp, Artificial Sequence
  Synthetic
atacgccatgctgggtctccaagttcagataaaccctacacctttccaacaggggggattgatttgtgctatggttcctggtgaccagagctatggttctatagcatcattgactgtttacgtacttgggagtcggccat

SEQ ID NO: 384608 - DNA, 140 bp, Artificial Sequence
  Synthetic
atggccgactcccaagtacgtaaacagtcaatgatgctatagaaccatagctctggtcaccaggaaccatagcacaaatcaatcccccctgttggaaaggtgtagggtttatctgaacttggagacccagcatggcgtat

SEQ ID NO: 384609 - DNA, 140 bp, Artificial Sequence
  Synthetic
atacgccatgctgggtctccttctgctgacaagaatgtacctcagctgaaaccagtttcggaattgacttttctcaaaagatctttcaatttggtagaggatagaattagacctgcaattcgtacttgggagtcggccat

SEQ ID NO: 384610 - DNA, 140 bp, Artificial Sequence
  Synthetic
atggccgactcccaagtacgaattgcaggtctaattctatcctctaccaaattgaaagatcttttgagaaaagtcaattccgaaactggtttcagctgaggtacattcttgtcagcagaaggagacccagcatggcgtat

SEQ ID NO: 384611 - DNA, 140 bp, Artificial Sequence
  Synthetic
atacgccatgctgggtctcctcggaaaaaacaatttggtctttaatagcaaggcagagaagtaacgctgagtttgagcagaatttagaaattgctcagtggtttgcttttatgcatggctcgtacttgggagtcggccat

SEQ ID NO: 384612 - DNA, 140 bp, Artificial Sequence
  Synthetic
atggccgactcccaagtacgagccatgcataaaagcaaaccactgagcaatttctaaattctgctcaaactcagcgttacttctctgccttgctattaaagaccaaattgttttttccgaggagacccagcatggcgtat

SEQ ID NO: 384613 - DNA, 140 bp, Artificial Sequence
  Synthetic
aggccctggctgctgatatggctttgtttcatgaagttgcaaaattggatgtggtcaaactgttgtacaatgagcaatttgctgtccagggtttgttgaggtatcagacttatgcaagatgaccttttgggacagcggtg

SEQ ID NO: 384614 - DNA, 140 bp, Artificial Sequence
  Synthetic
caccgctgtcccaaaaggtcatcttgcataagtctgatacctcaacaaaccctggacagcaaattgctcattgtacaacagtttgaccacatccaattttgcaacttcatgaaacaaagccatatcagcagccagggcct

SEQ ID NO: 384615 - DNA, 140 bp, Artificial Sequence
  Synthetic
atacgccatgctgggtctccccctttcccctttccctttattgttgtaaatattaattcctgcaggttcaggtttcttggatttgttccactttatggacactcatttcacgctttctgtcgtacttgggagtcggccat

SEQ ID NO: 384616 - DNA, 140 bp, Artificial Sequence
  Synthetic
atggccgactcccaagtacgacagaaagcgtgaaatgagtgtccataaagtggaacaaatccaagaaacctgaacctgcaggaattaatatttacaacaataaagggaaaggggaaagggggagacccagcatggcgtat

SEQ ID NO: 384617 - DNA, 140 bp, Artificial Sequence
  Synthetic
atacgccatgctgggtctccaaggatcctcaatatcccgtttgggagttgactattagagtttggtctgagctaaatattggaactggtacctccgcttacacatcattgaatgtgctggcgtacttgggagtcggccat

SEQ ID NO: 384618 - DNA, 140 bp, Artificial Sequence
  Synthetic
atggccgactcccaagtacgccagcacattcaatgatgtgtaagcggaggtaccagttccaatatttagctcagaccaaactctaatagtcaactcccaaacgggatattgaggatccttggagacccagcatggcgtat

SEQ ID NO: 384619 - DNA, 140 bp, Artificial Sequence
  Synthetic
aggccctggctgctgatatggctaaatattggaactggtacctccgcttacacatcattgaatgtgctggctagatttactgatttggaactccatgggctaacacccctgtctacacaggaccttttgggacagcggtg

SEQ ID NO: 384620 - DNA, 140 bp, Artificial Sequence
  Synthetic
caccgctgtcccaaaaggtcctgtgtagacaggggtgttagcccatggagttccaaatcagtaaatctagccagcacattcaatgatgtgtaagcggaggtaccagttccaatatttagccatatcagcagccagggcct

SEQ ID NO: 384621 - DNA, 140 bp, Artificial Sequence
  Synthetic
atacgccatgctgggtctccctagatttactgatttggaactccatgggctaacacccctgtctacacagatgatgagaaatgaatttagagtcagtacaacagaaaatgtagttaatttcgtacttgggagtcggccat

SEQ ID NO: 384622 - DNA, 140 bp, Artificial Sequence
  Synthetic
atggccgactcccaagtacgaaattaactacattttctgttgtactgactctaaattcatttctcatcatctgtgtagacaggggtgttagcccatggagttccaaatcagtaaatctagggagacccagcatggcgtat

SEQ ID NO: 384623 - DNA, 140 bp, Artificial Sequence
  Synthetic
aggccctggctgctgatatggctaatacttctatgaagagatgctttggatagggtaacagcggcggatattggtgagttatttgacaaaaaccattcaacgccggaggactggctctcagaccttttgggacagcggtg

SEQ ID NO: 384624 - DNA, 140 bp, Artificial Sequence
  Synthetic
caccgctgtcccaaaaggtctgagagccagtcctccggcgttgaatggtttttgtcaaataactcaccaatatccgccgctgttaccctatccaaagcatctcttcatagaagtattagccatatcagcagccagggcct

SEQ ID NO: 384625 - DNA, 140 bp, Artificial Sequence
  Synthetic
atacgccatgctgggtctcctccagtggatgcattaagtggattgtctgtcagggctgtctctaggtttaattcctgacctctctgtgcttagggcaaacaaaacttggccttaaatgagcgtacttgggagtcggccat

SEQ ID NO: 384626 - DNA, 140 bp, Artificial Sequence
  Synthetic
atggccgactcccaagtacgctcatttaaggccaagttttgtttgccctaagcacagagaggtcaggaattaaacctagagacagccctgacagacaatccacttaatgcatccactggaggagacccagcatggcgtat

SEQ ID NO: 384627 - DNA, 140 bp, Artificial Sequence
  Synthetic
aggccctggctgctgatatgcttttgttttgtttgcctctgaggtactcaggggcatttaggtttttcctcatcaataaataattatgaatatgtccaggcaaggtattttccagactgtgaccttttgggacagcggtg

SEQ ID NO: 384628 - DNA, 140 bp, Artificial Sequence
  Synthetic
caccgctgtcccaaaaggtcacagtctggaaaataccttgcctggacatattcataattatttattgatgaggaaaaacctaaatgcccctgagtacctcagaggcaaacaaaacaaaagcatatcagcagccagggcct

SEQ ID NO: 384629 - DNA, 140 bp, Artificial Sequence
  Synthetic
aggccctggctgctgatatgatcaaaataaaatagtaggcaagactcagctagttgatgactttctagatcttgatatggccattacaggggctccaggcattgatgctattaatatggagaccttttgggacagcggtg

SEQ ID NO: 384630 - DNA, 140 bp, Artificial Sequence
  Synthetic
caccgctgtcccaaaaggtctccatattaatagcatcaatgcctggagcccctgtaatggccatatcaagatctagaaagtcatcaactagctgagtcttgcctactattttattttgatcatatcagcagccagggcct

SEQ ID NO: 384631 - DNA, 140 bp, Artificial Sequence
  Synthetic
atacgccatgctgggtctccgttttgttcctggaaatgaactgattgatgtttcccacataacactgaaacaagccaccactgcaccttgtgctgtgatggatattactggagtacagtccgtacttgggagtcggccat

SEQ ID NO: 384632 - DNA, 140 bp, Artificial Sequence
  Synthetic
atggccgactcccaagtacggactgtactccagtaatatccatcacagcacaaggtgcagtggtggcttgtttcagtgttatgtgggaaacatcaatcagttcatttccaggaacaaaacggagacccagcatggcgtat

SEQ ID NO: 384633 - DNA, 140 bp, Artificial Sequence
  Synthetic
atacgccatgctgggtctccatagatacaccaagtcgtcacatcaaaaaggggagtatactgccataggaaagttgattgtttattgttacaatagactgacttctccctctaatgtggccgtacttgggagtcggccat

SEQ ID NO: 384634 - DNA, 140 bp, Artificial Sequence
  Synthetic
atggccgactcccaagtacggccacattagagggagaagtcagtctattgtaacaataaacaatcaactttcctatggcagtatactcccctttttgatgtgacgacttggtgtatctatggagacccagcatggcgtat

SEQ ID NO: 384635 - DNA, 140 bp, Artificial Sequence
  Synthetic
aggccctggctgctgatatgaagttgattgtttattgttacaatagactgacttctccctctaatgtggcctctcatgttagagttaatgtttacctctcagctattaacttagaatgttgaccttttgggacagcggtg

SEQ ID NO: 384636 - DNA, 140 bp, Artificial Sequence
  Synthetic
caccgctgtcccaaaaggtcaacattctaagttaatagctgagaggtaaacattaactctaacatgagaggccacattagagggagaagtcagtctattgtaacaataaacaatcaacttcatatcagcagccagggcct

SEQ ID NO: 384637 - DNA, 140 bp, Artificial Sequence
  Synthetic
atacgccatgctgggtctcctgagcaatttgctgttcagggtctgttgaggtatcacacttatgcaagatttggaattgagatacaagttcagatcaatcctacaccattccagcaaggtcgtacttgggagtcggccat

SEQ ID NO: 384638 - DNA, 140 bp, Artificial Sequence
  Synthetic
atggccgactcccaagtacgaccttgctggaatggtgtaggattgatctgaacttgtatctcaattccaaatcttgcataagtgtgatacctcaacagaccctgaacagcaaattgctcaggagacccagcatggcgtat

SEQ ID NO: 384639 - DNA, 140 bp, Artificial Sequence
  Synthetic
aggccctggctgctgatatgttggaattgagatacaagttcagatcaatcctacaccattccagcaaggtggtttgatatgtgccatggtgccaggagatcagagctatggatctatagcgaccttttgggacagcggtg

SEQ ID NO: 384640 - DNA, 140 bp, Artificial Sequence
  Synthetic
caccgctgtcccaaaaggtcgctatagatccatagctctgatctcctggcaccatggcacatatcaaaccaccttgctggaatggtgtaggattgatctgaacttgtatctcaattccaacatatcagcagccagggcct

SEQ ID NO: 384641 - DNA, 140 bp, Artificial Sequence
  Synthetic
atacgccatgctgggtctcctcaagttggtattacaacagtgaaagatcttaaaggtagagcaaaccaagggaaaatggatatttcgggtgtccaagctcctgtaggagctattactacccgtacttgggagtcggccat

SEQ ID NO: 384642 - DNA, 140 bp, Artificial Sequence
  Synthetic
atggccgactcccaagtacgggtagtaatagctcctacaggagcttggacacccgaaatatccattttcccttggtttgctctacctttaagatctttcactgttgtaataccaacttgaggagacccagcatggcgtat

SEQ ID NO: 384643 - DNA, 140 bp, Artificial Sequence
  Synthetic
aggccctggctgctgatatgggaaaatggatatttcgggtgtccaagctcctgtaggagctattactaccattgaagatccagttttggcaaagaaagtacctgaaaccttcccagaattgaccttttgggacagcggtg

SEQ ID NO: 384644 - DNA, 140 bp, Artificial Sequence
  Synthetic
caccgctgtcccaaaaggtcaattctgggaaggtttcaggtactttctttgccaaaactggatcttcaatggtagtaatagctcctacaggagcttggacacccgaaatatccattttcccatatcagcagccagggcct

SEQ ID NO: 384645 - DNA, 140 bp, Artificial Sequence
  Synthetic
atacgccatgctgggtctccttgaaagtcagagaataatgaaagtggaatttactcagtgttcaatgaatgtagtctccaaaacgctttttagaaagagtcccattcatcaccacattgacgtacttgggagtcggccat

SEQ ID NO: 384646 - DNA, 140 bp, Artificial Sequence
  Synthetic
atggccgactcccaagtacgtcaatgtggtgatgaatgggactctttctaaaaagcgttttggagactacattcattgaacactgagtaaattccactttcattattctctgactttcaaggagacccagcatggcgtat

SEQ ID NO: 384647 - DNA, 140 bp, Artificial Sequence
  Synthetic
aggccctggctgctgatatgaaggaccctcaatatcccgtttgggagttgactattagagtttggtctgagctaaacattggaactggtacctccgcttacacatcactgaatgtgttgggaccttttgggacagcggtg

SEQ ID NO: 384648 - DNA, 140 bp, Artificial Sequence
  Synthetic
caccgctgtcccaaaaggtcccaacacattcagtgatgtgtaagcggaggtaccagttccaatgtttagctcagaccaaactctaatagtcaactcccaaacgggatattgagggtccttcatatcagcagccagggcct

SEQ ID NO: 384649 - DNA, 140 bp, Artificial Sequence
  Synthetic
atacgccatgctgggtctccttatgggcagatctcatttcttatgtacatttacattcaattctaataacaaagagtacacttttcctattactttgtcatcaacttctaatcctcctcacgtacttgggagtcggccat

SEQ ID NO: 384650 - DNA, 140 bp, Artificial Sequence
  Synthetic
atggccgactcccaagtacgtgaggaggattagaagttgatgacaaagtaataggaaaagtgtactctttgttattagaattgaatgtaaatgtacataagaaatgagatctgcccataaggagacccagcatggcgtat

SEQ ID NO: 384651 - DNA, 140 bp, Artificial Sequence
  Synthetic
aggccctggctgctgatatgaaagagtacacttttcctattactttgtcatcaacttctaatcctcctcatggactaccttcaactctgagatggttttttaatcttttccagctttatagaccttttgggacagcggtg

SEQ ID NO: 384652 - DNA, 140 bp, Artificial Sequence
  Synthetic
caccgctgtcccaaaaggtctataaagctggaaaagattaaaaaaccatctcagagttgaaggtagtccatgaggaggattagaagttgatgacaaagtaataggaaaagtgtactctttcatatcagcagccagggcct

SEQ ID NO: 384653 - DNA, 140 bp, Artificial Sequence
  Synthetic
atacgccatgctgggtctcctggagttgcatggattaactcctctttctacacaaatgatgagaaatgaatttagggtcagtactactgagaatgtggtgaatctgtcaaattatgaagacgtacttgggagtcggccat

SEQ ID NO: 384654 - DNA, 140 bp, Artificial Sequence
  Synthetic
atggccgactcccaagtacgtcttcataatttgacagattcaccacattctcagtagtactgaccctaaattcatttctcatcatttgtgtagaaagaggagttaatccatgcaactccaggagacccagcatggcgtat

SEQ ID NO: 384655 - DNA, 140 bp, Artificial Sequence
  Synthetic
atacgccatgctgggtctccgtccaattatgaagatgctagagcaaaaatgtcttttgctcttgaccaggaagattggaaatctgatgcctctcaagggggaggaattaaaattacacatcgtacttgggagtcggccat

SEQ ID NO: 384656 - DNA, 140 bp, Artificial Sequence
  Synthetic
atggccgactcccaagtacgatgtgtaattttaattcctcccccttgagaggcatcagatttccaatcttcctggtcaagagcaaaagacatttttgctctagcatcttcataattggacggagacccagcatggcgtat

SEQ ID NO: 384657 - DNA, 140 bp, Artificial Sequence
  Synthetic
aggccctggctgctgatatgaagattggaaatctgatgcctctcaagggggaggaattaaaattacacattttacaacctggacatcaattcccactttggctgctcagtttccgtttaagaccttttgggacagcggtg

SEQ ID NO: 384658 - DNA, 140 bp, Artificial Sequence
  Synthetic
caccgctgtcccaaaaggtcttaaacggaaactgagcagccaaagtgggaattgatgtccaggttgtaaaatgtgtaattttaattcctcccccttgagaggcatcagatttccaatcttcatatcagcagccagggcct

SEQ ID NO: 384659 - DNA, 140 bp, Artificial Sequence
  Synthetic
atacgccatgctgggtctcctgcctctgattcagttgggcagcagatcaaggttattccagttgatccatactttttccagatgactaacacaaatcctgaacaaaaatgtataactgcacgtacttgggagtcggccat

SEQ ID NO: 384660 - DNA, 140 bp, Artificial Sequence
  Synthetic
atggccgactcccaagtacgtgcagttatacatttttgttcaggatttgtgttagtcatctggaaaaagtatggatcaactggaataaccttgatctgctgcccaactgaatcagaggcaggagacccagcatggcgtat

SEQ ID NO: 384661 - DNA, 140 bp, Artificial Sequence
  Synthetic
atacgccatgctgggtctccttggcttcaatatgtcaaatgttctgtttttggagaggagacttggtttttgacttccaggtttttcctacaaaatatcactcaggaagattattattttcgtacttgggagtcggccat

SEQ ID NO: 384662 - DNA, 140 bp, Artificial Sequence
  Synthetic
atggccgactcccaagtacgaaaataataatcttcctgagtgatattttgtaggaaaaacctggaagtcaaaaaccaagtctcctctccaaaaacagaacatttgacatattgaagccaaggagacccagcatggcgtat

SEQ ID NO: 384663 - DNA, 140 bp, Artificial Sequence
  Synthetic
atacgccatgctgggtctcccaggccactactgcgccttgtgctgtgatggatattactggagtacagtcaactttgagattccgtgttccttggatttcagatactccttatagagttacgtacttgggagtcggccat

SEQ ID NO: 384664 - DNA, 140 bp, Artificial Sequence
  Synthetic
atggccgactcccaagtacgtaactctataaggagtatctgaaatccaaggaacacggaatctcaaagttgactgtactccagtaatatccatcacagcacaaggcgcagtagtggcctgggagacccagcatggcgtat

SEQ ID NO: 384665 - DNA, 140 bp, Artificial Sequence
  Synthetic
atacgccatgctgggtctccttgaaattagaaaacaaaatatgactgaatttatggaattatggtctcaaggtatttcagatgatgataatgatagtgcagtggcagaatttttccaatccgtacttgggagtcggccat

SEQ ID NO: 384666 - DNA, 140 bp, Artificial Sequence
  Synthetic
atggccgactcccaagtacggattggaaaaattctgccactgcactatcattatcatcatctgaaataccttgagaccataattccataaattcagtcatattttgttttctaatttcaaggagacccagcatggcgtat

SEQ ID NO: 384667 - DNA, 140 bp, Artificial Sequence
  Synthetic
atacgccatgctgggtctccaagctgattgtttactgttacaacagactgacttctccctccaatgtggcttctcatgttagagtcaatgtctatctctcagctattaatttggaatgttcgtacttgggagtcggccat

SEQ ID NO: 384668 - DNA, 140 bp, Artificial Sequence
  Synthetic
atggccgactcccaagtacgaacattccaaattaatagctgagagatagacattgactctaacatgagaagccacattggagggagaagtcagtctgttgtaacagtaaacaatcagcttggagacccagcatggcgtat

SEQ ID NO: 384669 - DNA, 140 bp, Artificial Sequence
  Synthetic
aggccctggctgctgatatgttctcatgttagagttaatgtttatctctcagctattaatttagaatgttttgctccactctatcatgctatggatgtcacaactcaggttggagatgatgaccttttgggacagcggtg

SEQ ID NO: 384670 - DNA, 140 bp, Artificial Sequence
  Synthetic
caccgctgtcccaaaaggtcatcatctccaacctgagttgtgacatccatagcatgatagagtggagcaaaacattctaaattaatagctgagagataaacattaactctaacatgagaacatatcagcagccagggcct

SEQ ID NO: 384671 - DNA, 140 bp, Artificial Sequence
  Synthetic
aggccctggctgctgatatggatcatgaaattatgaaattctcctggaaaggaattactgctgacactagagctttgaggagatttggcttttcattggctgctggtaggagtgtgtggagaccttttgggacagcggtg

SEQ ID NO: 384672 - DNA, 140 bp, Artificial Sequence
  Synthetic
caccgctgtcccaaaaggtctccacacactcctaccagcagccaatgaaaagccaaatctcctcaaagctctagtgtcagcagtaattcctttccaggagaatttcataatttcatgatccatatcagcagccagggcct

SEQ ID NO: 384673 - DNA, 140 bp, Artificial Sequence
  Synthetic
atacgccatgctgggtctcctctggaggtttttccaccactgtttcaacaaagcagaatgttccagaccctcaagttggcattacaacagtgaaagatcttaaaggtagagcaaaccaagcgtacttgggagtcggccat

SEQ ID NO: 384674 - DNA, 140 bp, Artificial Sequence
  Synthetic
atggccgactcccaagtacgcttggtttgctctacctttaagatctttcactgttgtaatgccaacttgagggtctggaacattctgctttgttgaaacagtggtggaaaaacctccagaggagacccagcatggcgtat

SEQ ID NO: 384675 - DNA, 140 bp, Artificial Sequence
  Synthetic
aggccctggctgctgatatgtcaagttggcattacaacagtgaaagatcttaaaggtagagcaaaccaaggaaaaatggatatttcgggtgttcaagctcctgtgggagctatcactaccgaccttttgggacagcggtg

SEQ ID NO: 384676 - DNA, 140 bp, Artificial Sequence
  Synthetic
caccgctgtcccaaaaggtcggtagtgatagctcccacaggagcttgaacacccgaaatatccatttttccttggtttgctctacctttaagatctttcactgttgtaatgccaacttgacatatcagcagccagggcct

SEQ ID NO: 384677 - DNA, 140 bp, Artificial Sequence
  Synthetic
atacgccatgctgggtctccattgaagatccagttttagcaaagaaagtgcctgaaactttcccagaattaaagcctggagagtcaagacatacttctgaccatatgtctatttataaatcgtacttgggagtcggccat

SEQ ID NO: 384678 - DNA, 140 bp, Artificial Sequence
  Synthetic
atggccgactcccaagtacgatttataaatagacatatggtcagaagtatgtcttgactctccaggctttaattctgggaaagtttcaggcactttctttgctaaaactggatcttcaatggagacccagcatggcgtat

SEQ ID NO: 384679 - DNA, 140 bp, Artificial Sequence
  Synthetic
atacgccatgctgggtctcctgctagatttggaagagattgctgcaaatgcaaaagaatttccgaatatgtcagaaactgatttgtgtttcttgttgcattggctgaatcccaaaaagatcgtacttgggagtcggccat

SEQ ID NO: 384680 - DNA, 140 bp, Artificial Sequence
  Synthetic
atggccgactcccaagtacgatctttttgggattcagccaatgcaacaagaaacacaaatcagtttctgacatattcggaaattcttttgcatttgcagcaatctcttccaaatctagcaggagacccagcatggcgtat

SEQ ID NO: 384681 - DNA, 140 bp, Artificial Sequence
  Synthetic
aggccctggctgctgatatgtcagaaactgatttgtgtttcttgttgcattggctgaatcccaaaaagataaacttggcagatagaatgttgggtctgtcagggatacaggagataaaaggaccttttgggacagcggtg

SEQ ID NO: 384682 - DNA, 140 bp, Artificial Sequence
  Synthetic
caccgctgtcccaaaaggtccttttatctcctgtatccctgacagacccaacattctatctgccaagtttatctttttgggattcagccaatgcaacaagaaacacaaatcagtttctgacatatcagcagccagggcct

SEQ ID NO: 384683 - DNA, 140 bp, Artificial Sequence
  Synthetic
aggccctggctgctgatatgaaagagtacacctttcctatcactttgtcatcaacctctaatcctcctcatggattgccttcaaccctgagatggttttttaatctttttcagctttatagaccttttgggacagcggtg

SEQ ID NO: 384684 - DNA, 140 bp, Artificial Sequence
  Synthetic
caccgctgtcccaaaaggtctataaagctgaaaaagattaaaaaaccatctcagggttgaaggcaatccatgaggaggattagaggttgatgacaaagtgataggaaaggtgtactctttcatatcagcagccagggcct

SEQ ID NO: 384685 - DNA, 140 bp, Artificial Sequence
  Synthetic
atacgccatgctgggtctccactagcaccttaaagtcaatgatgtttggtttccatcactctgtcacagttgaaatcattaatactgttttatgttttgttaaaagtggcattttgctgtcgtacttgggagtcggccat

SEQ ID NO: 384686 - DNA, 140 bp, Artificial Sequence
  Synthetic
atggccgactcccaagtacgacagcaaaatgccacttttaacaaaacataaaacagtattaatgatttcaactgtgacagagtgatggaaaccaaacatcattgactttaaggtgctagtggagacccagcatggcgtat

SEQ ID NO: 384687 - DNA, 140 bp, Artificial Sequence
  Synthetic
atacgccatgctgggtctccggaatggcttggtttactcccgttgggttggcagtagacaccccatgggttgagaaggagtctgctctttccattgattacaagacagctcttggtgctgcgtacttgggagtcggccat

SEQ ID NO: 384688 - DNA, 140 bp, Artificial Sequence
  Synthetic
atggccgactcccaagtacgcagcaccaagagctgtcttgtaatcaatggaaagagcagactccttctcaacccatggggtgtctactgccaacccaacgggagtaaaccaagccattccggagacccagcatggcgtat

SEQ ID NO: 384689 - DNA, 140 bp, Artificial Sequence
  Synthetic
aggccctggctgctgatatgtgagaaggagtctgctctttccattgattacaagacagctcttggtgctgttaggtttaatactagaagaacaggaaacattcagattaggttgccctgggaccttttgggacagcggtg

SEQ ID NO: 384690 - DNA, 140 bp, Artificial Sequence
  Synthetic
caccgctgtcccaaaaggtcccagggcaacctaatctgaatgtttcctgttcttctagtattaaacctaacagcaccaagagctgtcttgtaatcaatggaaagagcagactccttctcacatatcagcagccagggcct

SEQ ID NO: 384691 - DNA, 140 bp, Artificial Sequence
  Synthetic
aggccctggctgctgatatgttaggtttaatactagaagaacaggaaacattcagattaggttgccctggtactcctatctttatgctgtctcaggggcactggatgggcttggagacaagaccttttgggacagcggtg

SEQ ID NO: 384692 - DNA, 140 bp, Artificial Sequence
  Synthetic
caccgctgtcccaaaaggtcttgtctccaagcccatccagtgcccctgagacagcataaagataggagtaccagggcaacctaatctgaatgtttcctgttcttctagtattaaacctaacatatcagcagccagggcct

SEQ ID NO: 384693 - DNA, 140 bp, Artificial Sequence
  Synthetic
aggccctggctgctgatatgtactcctatctttatgctgtctcaggggcactggatgggcttggagacaaaacagattcaacttttggacttgtctccatacaaattgcaaattacaatcgaccttttgggacagcggtg

SEQ ID NO: 384694 - DNA, 140 bp, Artificial Sequence
  Synthetic
caccgctgtcccaaaaggtcgattgtaatttgcaatttgtatggagacaagtccaaaagttgaatctgttttgtctccaagcccatccagtgcccctgagacagcataaagataggagtacatatcagcagccagggcct

SEQ ID NO: 384695 - DNA, 140 bp, Artificial Sequence
  Synthetic
aggccctggctgctgatatgactcagatgaatatttgtcttttagttgttacttgtctgtgactgaacagtctgagttttattttcctagagcacctttgaataccaatgctatgatgtcgaccttttgggacagcggtg

SEQ ID NO: 384696 - DNA, 140 bp, Artificial Sequence
  Synthetic
caccgctgtcccaaaaggtcgacatcatagcattggtattcaaaggtgctctaggaaaataaaactcagactgttcagtcacagacaagtaacaactaaaagacaaatattcatctgagtcatatcagcagccagggcct

SEQ ID NO: 384697 - DNA, 140 bp, Artificial Sequence
  Synthetic
aggccctggctgctgatatggctttacacaaaaatcagagaatattatgatctgaattatggtaataaaaaggatgttcttaatattctgaaagatcatcaacagaagatagagagagcagaccttttgggacagcggtg

SEQ ID NO: 384698 - DNA, 140 bp, Artificial Sequence
  Synthetic
caccgctgtcccaaaaggtctgctctctctatcttctgttgatgatctttcagaatattaagaacatcctttttattaccataattcagatcataatattctctgatttttgtgtaaagccatatcagcagccagggcct

SEQ ID NO: 384699 - DNA, 140 bp, Artificial Sequence
  Synthetic
atacgccatgctgggtctccattgaggaggctgataatttctgtgttcttcagatccaggatgttgaaaaatttgaacagtaccaaaaaggggtagatttgattcaaaaattgagaactgcgtacttgggagtcggccat

SEQ ID NO: 384700 - DNA, 140 bp, Artificial Sequence
  Synthetic
atggccgactcccaagtacgcagttctcaatttttgaatcaaatctacccctttttggtactgttcaaatttttcaacatcctggatctgaagaacacagaaattatcagcctcctcaatggagacccagcatggcgtat

SEQ ID NO: 384701 - DNA, 140 bp, Artificial Sequence
  Synthetic
atacgccatgctgggtctcctccactcaatggcacaagttgatccaggtttaactgttcatttagcccctcttagagactgtattgctagagttcatcaaaaattaaaaaatttgggttccgtacttgggagtcggccat

SEQ ID NO: 384702 - DNA, 140 bp, Artificial Sequence
  Synthetic
atggccgactcccaagtacggaacccaaattttttaatttttgatgaactctagcaatacagtctctaagaggggctaaatgaacagttaaacctggatcaacttgtgccattgagtggaggagacccagcatggcgtat

SEQ ID NO: 384703 - DNA, 140 bp, Artificial Sequence
  Synthetic
atacgccatgctgggtctccaaattaagggtgtattttcacaagcaaaaatctcattgttctacacagaagatcatgaaattatgaaattttcctggaaaggaatcactgctgacactagcgtacttgggagtcggccat

SEQ ID NO: 384704 - DNA, 140 bp, Artificial Sequence
  Synthetic
atggccgactcccaagtacgctagtgtcagcagtgattcctttccaggaaaatttcataatttcatgatcttctgtgtagaacaatgagatttttgcttgtgaaaatacacccttaatttggagacccagcatggcgtat

SEQ ID NO: 384705 - DNA, 140 bp, Artificial Sequence
  Synthetic
aggccctggctgctgatatgatggaaagaggggcggcggaaaaagtctgacttcaattgctttggctacaaaaatttgtaaacattatggtgttgagcctgagaaaaatatatacaaaaagaccttttgggacagcggtg

SEQ ID NO: 384706 - DNA, 140 bp, Artificial Sequence
  Synthetic
caccgctgtcccaaaaggtctttttgtatatatttttctcaggctcaacaccataatgtttacaaatttttgtagccaaagcaattgaagtcagactttttccgccgcccctctttccatcatatcagcagccagggcct

SEQ ID NO: 384707 - DNA, 140 bp, Artificial Sequence
  Synthetic
aggccctggctgctgatatgaattaaccaggcaatggtgacaagatgtgagccagttgtctgctacctctatggaaagaggggcggggggaaaagtctgacttcaattgctttggccacagaccttttgggacagcggtg

SEQ ID NO: 384708 - DNA, 140 bp, Artificial Sequence
  Synthetic
caccgctgtcccaaaaggtctgtggccaaagcaattgaagtcagacttttccccccgcccctctttccatagaggtagcagacaactggctcacatcttgtcaccattgcctggttaattcatatcagcagccagggcct

SEQ ID NO: 384709 - DNA, 140 bp, Artificial Sequence
  Synthetic
atacgccatgctgggtctccacctgttgcatctgattattgggatggatatagtggacaactagtatgcatcattgatgacattggtcaaaacacaactgatgaggattggtctgattttcgtacttgggagtcggccat

SEQ ID NO: 384710 - DNA, 140 bp, Artificial Sequence
  Synthetic
atggccgactcccaagtacgaaaatcagaccaatcctcatcagttgtgttttgaccaatgtcatcaatgatgcatactagttgtccactatatccatcccaataatcagatgcaacaggtggagacccagcatggcgtat

SEQ ID NO: 384711 - DNA, 140 bp, Artificial Sequence
  Synthetic
aggccctggctgctgatatgagaaaagggtcgtcatttttcttcaccctttataattgcaacatccaactggtctaatccaagtcctaaaacggtctatgttaaggaagccatagaccgtgaccttttgggacagcggtg

SEQ ID NO: 384712 - DNA, 140 bp, Artificial Sequence
  Synthetic
caccgctgtcccaaaaggtcacggtctatggcttccttaacatagaccgttttaggacttggattagaccagttggatgttgcaattataaagggtgaagaaaaatgacgacccttttctcatatcagcagccagggcct

SEQ ID NO: 384713 - DNA, 140 bp, Artificial Sequence
  Synthetic
atacgccatgctgggtctccggtctaatccaagtcctaaaacggtctatgttaaggaagccatagaccgtagactccatttcaaagttgaggtgaaacctgcctcattcttcaagaatcccgtacttgggagtcggccat

SEQ ID NO: 384714 - DNA, 140 bp, Artificial Sequence
  Synthetic
atggccgactcccaagtacgggattcttgaagaatgaggcaggtttcacctcaactttgaaatggagtctacggtctatggcttccttaacatagaccgttttaggacttggattagaccggagacccagcatggcgtat

SEQ ID NO: 384715 - DNA, 140 bp, Artificial Sequence
  Synthetic
atacgccatgctgggtctccaaaaaggagtgggattgattggtgagtgtcgagcttttcttgattccataactagtaccttaaagtcaatgatgtttggtttccaccactctgtcacagtcgtacttgggagtcggccat

SEQ ID NO: 384716 - DNA, 140 bp, Artificial Sequence
  Synthetic
atggccgactcccaagtacgactgtgacagagtggtggaaaccaaacatcattgactttaaggtactagttatggaatcaagaaaagctcgacactcaccaatcaatcccactcctttttggagacccagcatggcgtat

SEQ ID NO: 384717 - DNA, 140 bp, Artificial Sequence
  Synthetic
aggccctggctgctgatatgtctgaattacttagctcactggtgatgacagttgaaattagaaaacaaaatatgtcagaattcatggaactttggtcacagggattatcagatgatgacagaccttttgggacagcggtg

SEQ ID NO: 384718 - DNA, 140 bp, Artificial Sequence
  Synthetic
caccgctgtcccaaaaggtctgtcatcatctgataatccctgtgaccaaagttccatgaattctgacatattttgttttctaatttcaactgtcatcaccagtgagctaagtaattcagacatatcagcagccagggcct

SEQ ID NO: 384719 - DNA, 140 bp, Artificial Sequence
  Synthetic
aggccctggctgctgatatgattgaagatccagttttggcaaagaaagagcctgaaaccttcccagaattgaagcctggagagtcaagacatacttctgatcatatgtctatttataaatgaccttttgggacagcggtg

SEQ ID NO: 384720 - DNA, 140 bp, Artificial Sequence
  Synthetic
caccgctgtcccaaaaggtcatttataaatagacatatgatcagaagtatgtcttgactctccaggcttcaattctgggaaggtttcaggctctttctttgccaaaactggatcttcaatcatatcagcagccagggcct

SEQ ID NO: 384721 - DNA, 140 bp, Artificial Sequence
  Synthetic
aggccctggctgctgatatgtaaagtgttttcaaaaatgttagaaactgtttttaattggcagatggattcgagaatgatggagcttagaactcagagcatttcaaattggcttagagatgaccttttgggacagcggtg

SEQ ID NO: 384722 - DNA, 140 bp, Artificial Sequence
  Synthetic
caccgctgtcccaaaaggtcatctctaagccaatttgaaatgctctgagttctaagctccatcattctcgaatccatctgccaattaaaaacagtttctaacatttttgaaaacactttacatatcagcagccagggcct

SEQ ID NO: 384723 - DNA, 140 bp, Artificial Sequence
  Synthetic
atacgccatgctgggtctccggttgcagttggggctgctgtgggagtacttggtgttttggttggaggttggtacgtgtacaagcattttacaaagaaacaagaagagtccattccaagtcgtacttgggagtcggccat

SEQ ID NO: 384724 - DNA, 140 bp, Artificial Sequence
  Synthetic
atggccgactcccaagtacgacttggaatggactcttcttgtttctttgtaaaatgcttgtacacgtaccaacctccaaccaaaacaccaagtactcccacagcagccccaactgcaaccggagacccagcatggcgtat

SEQ ID NO: 384725 - DNA, 140 bp, Artificial Sequence
  Synthetic
atacgccatgctgggtctccaggatgttcttaatattttgaaagatcatcaacaaaagatagagagggcaattgaggaggctgataatttttgtgtccttcagattcaggatgttgaaaacgtacttgggagtcggccat

SEQ ID NO: 384726 - DNA, 140 bp, Artificial Sequence
  Synthetic
atggccgactcccaagtacgttttcaacatcctgaatctgaaggacacaaaaattatcagcctcctcaattgccctctctatcttttgttgatgatctttcaaaatattaagaacatcctggagacccagcatggcgtat

SEQ ID NO: 384727 - DNA, 140 bp, Artificial Sequence
  Synthetic
atacgccatgctgggtctccgaaagaatcttgttcagtttggagttggtgagaagaatgggtgtgttagatgggtcatgaatgctttaggaattaaggatgattggctattagtgccctccgtacttgggagtcggccat

SEQ ID NO: 384728 - DNA, 140 bp, Artificial Sequence
  Synthetic
atggccgactcccaagtacggagggcactaatagccaatcatccttaattcctaaagcattcatgacccatctaacacacccattcttctcaccaactccaaactgaacaagattctttcggagacccagcatggcgtat

SEQ ID NO: 384729 - DNA, 140 bp, Artificial Sequence
  Synthetic
aggccctggctgctgatatgacttgtccaaaagatgaattgagaccattagagaaagttttggaatcaaaaacaagagcaattgatgcttgtcctttggattatacaattctatgtcgaagaccttttgggacagcggtg

SEQ ID NO: 384730 - DNA, 140 bp, Artificial Sequence
  Synthetic
caccgctgtcccaaaaggtcttcgacatagaattgtataatccaaaggacaagcatcaattgctcttgtttttgattccaaaactttctctaatggtctcaattcatcttttggacaagtcatatcagcagccagggcct

SEQ ID NO: 384731 - DNA, 140 bp, Artificial Sequence
  Synthetic
atacgccatgctgggtctcctccttagatgttggttttcaggatgtggttttaatgaaagtgcccacaattccaaaatttagagatataacagaacattttattaaaaagagtgatgtaccgtacttgggagtcggccat

SEQ ID NO: 384732 - DNA, 140 bp, Artificial Sequence
  Synthetic
atggccgactcccaagtacggtacatcactctttttaataaaatgttctgttatatctctaaattttggaattgtgggcactttcattaaaaccacatcctgaaaaccaacatctaaggaggagacccagcatggcgtat

SEQ ID NO: 384733 - DNA, 140 bp, Artificial Sequence
  Synthetic
aggccctggctgctgatatgttatgggcagatctcatttcctgtgtacatttacatttaattctaacaacaaagagtacacttttcctatcactttgtcatcaacttctaatcctccccagaccttttgggacagcggtg

SEQ ID NO: 384734 - DNA, 140 bp, Artificial Sequence
  Synthetic
caccgctgtcccaaaaggtctggggaggattagaagttgatgacaaagtgataggaaaagtgtactctttgttgttagaattaaatgtaaatgtacacaggaaatgagatctgcccataacatatcagcagccagggcct

SEQ ID NO: 384735 - DNA, 140 bp, Artificial Sequence
  Synthetic
aggccctggctgctgatatgacctgttgcatctgattattgggatggatatagtggacaactagtgtgtatcattgatgacattggtcaaaatacaactgatgaggattggtctgatttcgaccttttgggacagcggtg

SEQ ID NO: 384736 - DNA, 140 bp, Artificial Sequence
  Synthetic
caccgctgtcccaaaaggtcgaaatcagaccaatcctcatcagttgtattttgaccaatgtcatcaatgatacacactagttgtccactatatccatcccaataatcagatgcaacaggtcatatcagcagccagggcct

SEQ ID NO: 384737 - DNA, 140 bp, Artificial Sequence
  Synthetic
atacgccatgctgggtctcctcattgatgacattggtcaaaatacaactgatgaggattggtctgatttctgtcaattggtgtctggatgtccaatgaggttaaatatggcttctttggacgtacttgggagtcggccat

SEQ ID NO: 384738 - DNA, 140 bp, Artificial Sequence
  Synthetic
atggccgactcccaagtacgtccaaagaagccatatttaacctcattggacatccagacaccaattgacagaaatcagaccaatcctcatcagttgtattttgaccaatgtcatcaatgaggagacccagcatggcgtat

SEQ ID NO: 384739 - DNA, 140 bp, Artificial Sequence
  Synthetic
atacgccatgctgggtctcctggtggaaattcaattttggttgctaagttagtgactcaagagatgtttcaaaatatagataagaaaatagttgaaagtcagagaataatgaaagtggaacgtacttgggagtcggccat

SEQ ID NO: 384740 - DNA, 140 bp, Artificial Sequence
  Synthetic
atggccgactcccaagtacgttccactttcattattctctgactttcaactattttcttatctatattttgaaacatctcttgagtcactaacttagcaaccaaaattgaatttccaccaggagacccagcatggcgtat

SEQ ID NO: 384741 - DNA, 140 bp, Artificial Sequence
  Synthetic
aggccctggctgctgatatgaaaatatagataagaaaatagttgaaagtcagagaataatgaaagtggaatttactcagtgttcaatgaatgtggtctccaaaacgctttttagaaagaggaccttttgggacagcggtg

SEQ ID NO: 384742 - DNA, 140 bp, Artificial Sequence
  Synthetic
caccgctgtcccaaaaggtcctctttctaaaaagcgttttggagaccacattcattgaacactgagtaaattccactttcattattctctgactttcaactattttcttatctatattttcatatcagcagccagggcct

SEQ ID NO: 384743 - DNA, 140 bp, Artificial Sequence
  Synthetic
atacgccatgctgggtctccaggttgcatttcaaagttgaggtgaaacctgcctcatttttcaagaatcctcataatgatatgttgaatgtcaatctggcaaaaactaatgatgctattacgtacttgggagtcggccat

SEQ ID NO: 384744 - DNA, 140 bp, Artificial Sequence
  Synthetic
atggccgactcccaagtacgtaatagcatcattagtttttgccagattgacattcaacatatcattatgaggattcttgaaaaatgaggcaggtttcacctcaactttgaaatgcaacctggagacccagcatggcgtat

SEQ ID NO: 384745 - DNA, 140 bp, Artificial Sequence
  Synthetic
atacgccatgctgggtctcccatgtcagaatttatggagctttggtcacagggattatcagatgatgacaatgatagtgcagttgctgaatttttccaatcttttccctctggtgagccacgtacttgggagtcggccat

SEQ ID NO: 384746 - DNA, 140 bp, Artificial Sequence
  Synthetic
atggccgactcccaagtacgtggctcaccagagggaaaagattggaaaaattcagcaactgcactatcattgtcatcatctgataatccctgtgaccaaagctccataaattctgacatgggagacccagcatggcgtat

SEQ ID NO: 384747 - DNA, 140 bp, Artificial Sequence
  Synthetic
atacgccatgctgggtctccatgatagtgcagttgctgaatttttccaatcttttccctctggtgagccatctgggtcaaggttgtcacagtttttccaatcagttaccaatcacaagtgcgtacttgggagtcggccat

SEQ ID NO: 384748 - DNA, 140 bp, Artificial Sequence
  Synthetic
atggccgactcccaagtacgcacttgtgattggtaactgattggaaaaactgtgacaaccttgacccagatggctcaccagagggaaaagattggaaaaattcagcaactgcactatcatggagacccagcatggcgtat

SEQ ID NO: 384749 - DNA, 140 bp, Artificial Sequence
  Synthetic
aggccctggctgctgatatgtctgggtcaaggttgtcacagtttttccaatcagttaccaatcacaagtgggttgcagttggtgctgctgtgggagtacttggtgttttggttggaggttgaccttttgggacagcggtg

SEQ ID NO: 384750 - DNA, 140 bp, Artificial Sequence
  Synthetic
caccgctgtcccaaaaggtcaacctccaaccaaaacaccaagtactcccacagcagcaccaactgcaacccacttgtgattggtaactgattggaaaaactgtgacaaccttgacccagacatatcagcagccagggcct

SEQ ID NO: 384751 - DNA, 140 bp, Artificial Sequence
  Synthetic
aggccctggctgctgatatgggttgcagttggtgctgctgtgggagtacttggtgttttggttggaggttggtatgtctacaaacattttacaaagaaacaagaagagtccattccgagtgaccttttgggacagcggtg

SEQ ID NO: 384752 - DNA, 140 bp, Artificial Sequence
  Synthetic
caccgctgtcccaaaaggtcactcggaatggactcttcttgtttctttgtaaaatgtttgtagacataccaacctccaaccaaaacaccaagtactcccacagcagcaccaactgcaacccatatcagcagccagggcct

SEQ ID NO: 384753 - DNA, 140 bp, Artificial Sequence
  Synthetic
atacgccatgctgggtctccgaaggagtgtatcatggtgtaacaaagccaaaacaagtaattaaactggatgctgatcctgtggagtcacaatcaactttagaaattgctggtttggtgacgtacttgggagtcggccat

SEQ ID NO: 384754 - DNA, 140 bp, Artificial Sequence
  Synthetic
atggccgactcccaagtacgtcaccaaaccagcaatttctaaagttgattgtgactccacaggatcagcatccagtttaattacttgttttggctttgttacaccatgatacactccttcggagacccagcatggcgtat

SEQ ID NO: 384755 - DNA, 140 bp, Artificial Sequence
  Synthetic
aggccctggctgctgatatgtgctgatcctgtggagtcacaatcaactttagaaattgctggtttggtgagaaagaatcttgttcagtttggagttggtgagaagaatgggtgtgttagagaccttttgggacagcggtg

SEQ ID NO: 384756 - DNA, 140 bp, Artificial Sequence
  Synthetic
caccgctgtcccaaaaggtctctaacacacccattcttctcaccaactccaaactgaacaagattctttctcaccaaaccagcaatttctaaagttgattgtgactccacaggatcagcacatatcagcagccagggcct

SEQ ID NO: 384757 - DNA, 140 bp, Artificial Sequence
  Synthetic
aggccctggctgctgatatgtgggtcatgaatgctttaggaattaaagatgattggctactagtgccctctcatgcttacaagtttgaaaaagattatgaaatgatggaattttattttagaccttttgggacagcggtg

SEQ ID NO: 384758 - DNA, 140 bp, Artificial Sequence
  Synthetic
caccgctgtcccaaaaggtctaaaataaaattccatcatttcataatctttttcaaacttgtaagcatgagagggcactagtagccaatcatctttaattcctaaagcattcatgacccacatatcagcagccagggcct

SEQ ID NO: 384759 - DNA, 140 bp, Artificial Sequence
  Synthetic
atacgccatgctgggtctcctctttagatgttggttttcaggatgtggttctaatgaaagtgcccacaattccaaaatttagagatataacagaacattttattaaaaagagtgatgtgccgtacttgggagtcggccat

SEQ ID NO: 384760 - DNA, 140 bp, Artificial Sequence
  Synthetic
atggccgactcccaagtacggcacatcactctttttaataaaatgttctgttatatctctaaattttggaattgtgggcactttcattagaaccacatcctgaaaaccaacatctaaagaggagacccagcatggcgtat

SEQ ID NO: 384761 - DNA, 140 bp, Artificial Sequence
  Synthetic
aggccctggctgctgatatgtccaaaatttagagatataacagaacattttattaaaaagagtgatgtgcctagagctttgaacaggctggcaacacttgtgacaacagttaatgggactgaccttttgggacagcggtg

SEQ ID NO: 384762 - DNA, 140 bp, Artificial Sequence
  Synthetic
caccgctgtcccaaaaggtcagtcccattaactgttgtcacaagtgttgccagcctgttcaaagctctaggcacatcactctttttaataaaatgttctgttatatctctaaattttggacatatcagcagccagggcct

SEQ ID NO: 384763 - DNA, 140 bp, Artificial Sequence
  Synthetic
aggccctggctgctgatatgccaatgttaatttcagagggacccctcaaaatggaggagaaggctacttatgttcataaaaagaatgatggaaccaccatagatttgactgttgatcaaggaccttttgggacagcggtg

SEQ ID NO: 384764 - DNA, 140 bp, Artificial Sequence
  Synthetic
caccgctgtcccaaaaggtccttgatcaacagtcaaatctatggtggttccatcattctttttatgaacataagtagccttctcctccattttgaggggtccctctgaaattaacattggcatatcagcagccagggcct

SEQ ID NO: 384765 - DNA, 140 bp, Artificial Sequence
  Synthetic
aggccctggctgctgatatgaaggaccctcaatatcccgtttgggagttgactattagagtttggtctgagttaaacattggaactggtacctcctcttacacatcactgaatgtgctaggaccttttgggacagcggtg

SEQ ID NO: 384766 - DNA, 140 bp, Artificial Sequence
  Synthetic
caccgctgtcccaaaaggtcctagcacattcagtgatgtgtaagaggaggtaccagttccaatgtttaactcagaccaaactctaatagtcaactcccaaacgggatattgagggtccttcatatcagcagccagggcct

SEQ ID NO: 384767 - DNA, 140 bp, Artificial Sequence
  Synthetic
atacgccatgctgggtctcccagtttctgagttaacatttttaaagagatctttcaatttggttgaagatagaatcaggcctgctattgctgagaaaaccatatggtcattagttgcatgcgtacttgggagtcggccat

SEQ ID NO: 384768 - DNA, 140 bp, Artificial Sequence
  Synthetic
atggccgactcccaagtacgcatgcaactaatgaccatatggttttctcagcaatagcaggcctgattctatcttcaaccaaattgaaagatctctttaaaaatgttaactcagaaactgggagacccagcatggcgtat

SEQ ID NO: 384769 - DNA, 140 bp, Artificial Sequence
  Synthetic
aggccctggctgctgatatgtccaattcatcatcacattgataaaaacatgattaattttcctgctgtgatgcccttttctagggcagaaattgatcctatggcagtgatgctgtcaaaggaccttttgggacagcggtg

SEQ ID NO: 384770 - DNA, 140 bp, Artificial Sequence
  Synthetic
caccgctgtcccaaaaggtcctttgacagcatcactgccataggatcaatttctgccctagaaaagggcatcacagcaggaaaattaatcatgtttttatcaatgtgatgatgaattggacatatcagcagccagggcct

SEQ ID NO: 384771 - DNA, 140 bp, Artificial Sequence
  Synthetic
aggccctggctgctgatatgtgaggggacttgatacctcaccgccgtttgcctaggctataggctaaattttccctttcccttttccctttcctattccctttgttttgcttgtaaatatgaccttttgggacagcggtg

SEQ ID NO: 384772 - DNA, 140 bp, Artificial Sequence
  Synthetic
caccgctgtcccaaaaggtcatatttacaagcaaaacaaagggaataggaaagggaaaagggaaagggaaaatttagcctatagcctaggcaaacggcggtgaggtatcaagtcccctcacatatcagcagccagggcct

SEQ ID NO: 384773 - DNA, 140 bp, Artificial Sequence
  Synthetic
atacgccatgctgggtctccttattgatgatattggacaaaatacaactgatgaggattggtctgacttttgtcaattggtgtctggatgtccaatgaggttaaatatggcttctttggacgtacttgggagtcggccat

SEQ ID NO: 384774 - DNA, 140 bp, Artificial Sequence
  Synthetic
atggccgactcccaagtacgtccaaagaagccatatttaacctcattggacatccagacaccaattgacaaaagtcagaccaatcctcatcagttgtattttgtccaatatcatcaataaggagacccagcatggcgtat

SEQ ID NO: 384775 - DNA, 140 bp, Artificial Sequence
  Synthetic
aggccctggctgctgatatgatggattcttcccctggatatccttatgttcaggagaaattaaccaaaagagatttgatttggcttgatgataatggaatgtttttgggtctgcatcccagaccttttgggacagcggtg

SEQ ID NO: 384776 - DNA, 140 bp, Artificial Sequence
  Synthetic
caccgctgtcccaaaaggtctgggatgcagacccaaaaacattccattatcatcaagccaaatcaaatctcttttggttaatttctcctgaacataaggatatccaggggaagaatccatcatatcagcagccagggcct

SEQ ID NO: 384777 - DNA, 140 bp, Artificial Sequence
  Synthetic
atacgccatgctgggtctccagatttgatttggcttgatgataatggaatgtttttgggtctgcatcccaggctggctcaaagaattttatttaacacaacaatgatggaaaattgctcacgtacttgggagtcggccat

SEQ ID NO: 384778 - DNA, 140 bp, Artificial Sequence
  Synthetic
atggccgactcccaagtacgtgagcaattttccatcattgttgtgttaaataaaattctttgagccagcctgggatgcagacccaaaaacattccattatcatcaagccaaatcaaatctggagacccagcatggcgtat

SEQ ID NO: 384779 - DNA, 140 bp, Artificial Sequence
  Synthetic
atacgccatgctgggtctccgatttggacgttgtttttactacctgtcccaaggatgaattgagacctctggacaaagtattggaatctaaaactagggctattgattcttgtccccttgcgtacttgggagtcggccat

SEQ ID NO: 384780 - DNA, 140 bp, Artificial Sequence
  Synthetic
atggccgactcccaagtacgcaaggggacaagaatcaatagccctagttttagattccaatactttgtccagaggtctcaattcatccttgggacaggtagtaaaaacaacgtccaaatcggagacccagcatggcgtat

SEQ ID NO: 384781 - DNA, 140 bp, Artificial Sequence
  Synthetic
atacgccatgctgggtctccaaggagagaaatttttccttattcattctgctgattggttgacgacacatgctttgtttcatgaagttgcaaaattggatgtggtcaaactgttgtataacgtacttgggagtcggccat

SEQ ID NO: 384782 - DNA, 140 bp, Artificial Sequence
  Synthetic
atggccgactcccaagtacgttatacaacagtttgaccacatccaattttgcaacttcatgaaacaaagcatgtgtcgtcaaccaatcagcagaatgaataaggaaaaatttctctccttggagacccagcatggcgtat

SEQ ID NO: 384783 - DNA, 140 bp, Artificial Sequence
  Synthetic
atacgccatgctgggtctccgtccatacagaatgcaatattaggtattcatgttgccggaggaaattcaattcttgtggcaaagttggttacccaagagatgtttcaaaatattgataagcgtacttgggagtcggccat

SEQ ID NO: 384784 - DNA, 140 bp, Artificial Sequence
  Synthetic
atggccgactcccaagtacgcttatcaatattttgaaacatctcttgggtaaccaactttgccacaagaattgaatttcctccggcaacatgaatacctaatattgcattctgtatggacggagacccagcatggcgtat

SEQ ID NO: 384785 - DNA, 140 bp, Artificial Sequence
  Synthetic
atacgccatgctgggtctccataagggaagctggaagaatcctcactgagatgtctggagcccctgttcattttggagaggccctcattaacacaattatttattctaaacatttgctttcgtacttgggagtcggccat

SEQ ID NO: 384786 - DNA, 140 bp, Artificial Sequence
  Synthetic
atggccgactcccaagtacgaaagcaaatgtttagaataaataattgtgttaatgagggcctctccaaaatgaacaggggctccagacatctcagtgaggattcttccagcttcccttatggagacccagcatggcgtat

SEQ ID NO: 384787 - DNA, 140 bp, Artificial Sequence
  Synthetic
aggccctggctgctgatatgtaatagcaacttcaaattggtcaaatccaagtccaaaaacagtttatgttaaggaagcaattgatcgtagacttcattttaaggttgaagttaaacctgcgaccttttgggacagcggtg

SEQ ID NO: 384788 - DNA, 140 bp, Artificial Sequence
  Synthetic
caccgctgtcccaaaaggtcgcaggtttaacttcaaccttaaaatgaagtctacgatcaattgcttccttaacataaactgtttttggacttggatttgaccaatttgaagttgctattacatatcagcagccagggcct

SEQ ID NO: 384789 - DNA, 140 bp, Artificial Sequence
  Synthetic
atacgccatgctgggtctccataattgctgttatcatgtatgtgggtcaatgccttctgggtctccttgtacagctttgttgaattcaattataaataatgttaatctgtattatgttttcgtacttgggagtcggccat

SEQ ID NO: 384790 - DNA, 140 bp, Artificial Sequence
  Synthetic
atggccgactcccaagtacgaaaacataatacagattaacattatttataattgaattcaacaaagctgtacaaggagacccagaaggcattgacccacatacatgataacagcaattatggagacccagcatggcgtat

SEQ ID NO: 384791 - DNA, 140 bp, Artificial Sequence
  Synthetic
atacgccatgctgggtctccttccaaaatttttaaaaaatctccagttttcttttgtgatgctgtgagaattctttgttatggagatgatgttcttattgtcttctccagacaggtccaacgtacttgggagtcggccat

SEQ ID NO: 384792 - DNA, 140 bp, Artificial Sequence
  Synthetic
atggccgactcccaagtacgttggacctgtctggagaagacaataagaacatcatctccataacaaagaattctcacagcatcacaaaagaaaactggagattttttaaaaattttggaaggagacccagcatggcgtat

SEQ ID NO: 384793 - DNA, 140 bp, Artificial Sequence
  Synthetic
aggccctggctgctgatatgattgggaatgacagctacttcagctgacaagtctgttccccaattgaagccagtttctgagttaacatttttaaaaagatctttcaatttggttgaagatgaccttttgggacagcggtg

SEQ ID NO: 384794 - DNA, 140 bp, Artificial Sequence
  Synthetic
caccgctgtcccaaaaggtcatcttcaaccaaattgaaagatctttttaaaaatgttaactcagaaactggcttcaattggggaacagacttgtcagctgaagtagctgtcattcccaatcatatcagcagccagggcct

SEQ ID NO: 384795 - DNA, 140 bp, Artificial Sequence
  Synthetic
atacgccatgctgggtctcctgcctctgattcagttgggcagcagatcaaggttattccagttgatccatatttcttccaaatgactaacacaaatcctgaacaaaaatgtataactgcacgtacttgggagtcggccat

SEQ ID NO: 384796 - DNA, 140 bp, Artificial Sequence
  Synthetic
atggccgactcccaagtacgtgcagttatacatttttgttcaggatttgtgttagtcatttggaagaaatatggatcaactggaataaccttgatctgctgcccaactgaatcagaggcaggagacccagcatggcgtat

SEQ ID NO: 384797 - DNA, 140 bp, Artificial Sequence
  Synthetic
aggccctggctgctgatatgatttcttccaaatgactaacacaaatcctgaacaaaaatgtataactgcattggcttcaatatgtcaaatgttttgtttttggagaggagacttggttttgaccttttgggacagcggtg

SEQ ID NO: 384798 - DNA, 140 bp, Artificial Sequence
  Synthetic
caccgctgtcccaaaaggtcaaaaccaagtctcctctccaaaaacaaaacatttgacatattgaagccaatgcagttatacatttttgttcaggatttgtgttagtcatttggaagaaatcatatcagcagccagggcct

SEQ ID NO: 384799 - DNA, 140 bp, Artificial Sequence
  Synthetic
atacgccatgctgggtctccttggcttcaatatgtcaaatgttttgtttttggagaggagacttggtttttgacttccaggtttttcctacaaaatatcactcagggagattattattctcgtacttgggagtcggccat

SEQ ID NO: 384800 - DNA, 140 bp, Artificial Sequence
  Synthetic
atggccgactcccaagtacgagaataataatctccctgagtgatattttgtaggaaaaacctggaagtcaaaaaccaagtctcctctccaaaaacaaaacatttgacatattgaagccaaggagacccagcatggcgtat

SEQ ID NO: 384801 - DNA, 140 bp, Artificial Sequence
  Synthetic
atacgccatgctgggtctccttggtggagaatgaagtttaatgaccagtgctttgtttgtgacctttcatgatttgtttaaacaaattttcttaaaatttctgaggtttgtttattttatcgtacttgggagtcggccat

SEQ ID NO: 384802 - DNA, 140 bp, Artificial Sequence
  Synthetic
atggccgactcccaagtacgataaaataaacaaacctcagaaattttaagaaaatttgtttaaacaaatcatgaaaggtcacaaacaaagcactggtcattaaacttcattctccaccaaggagacccagcatggcgtat

SEQ ID NO: 384803 - DNA, 140 bp, Artificial Sequence
  Synthetic
aggccctggctgctgatatgcaagccactactgcgccttgtgctgtgatggatattactggtgtacagtcaactttgagatttcgtgttccttggatttcagatactccttacagagttagaccttttgggacagcggtg

SEQ ID NO: 384804 - DNA, 140 bp, Artificial Sequence
  Synthetic
caccgctgtcccaaaaggtctaactctgtaaggagtatctgaaatccaaggaacacgaaatctcaaagttgactgtacaccagtaatatccatcacagcacaaggcgcagtagtggcttgcatatcagcagccagggcct

SEQ ID NO: 384805 - DNA, 140 bp, Artificial Sequence
  Synthetic
atacgccatgctgggtctccttcaagaggggcctccgggattcccggagtccctcttgggagtccatggtgaggggacttgatacctcaccgccgtttgcctaggctataggctaaacttcgtacttgggagtcggccat

SEQ ID NO: 384806 - DNA, 140 bp, Artificial Sequence
  Synthetic
atggccgactcccaagtacgaagtttagcctatagcctaggcaaacggcggtgaggtatcaagtcccctcaccatggactcccaagagggactccgggaatcccggaggcccctcttgaaggagacccagcatggcgtat

SEQ ID NO: 384807 - DNA, 140 bp, Artificial Sequence
  Synthetic
aggccctggctgctgatatgttctcatgttagagttaatgtttatctctcagctattaatttggaatgttttgctccactctatcatgctatggatgtcacaactcaggttggagatgatgaccttttgggacagcggtg

SEQ ID NO: 384808 - DNA, 140 bp, Artificial Sequence
  Synthetic
caccgctgtcccaaaaggtcatcatctccaacctgagttgtgacatccatagcatgatagagtggagcaaaacattccaaattaatagctgagagataaacattaactctaacatgagaacatatcagcagccagggcct

SEQ ID NO: 384809 - DNA, 140 bp, Artificial Sequence
  Synthetic
aggccctggctgctgatatggggacacagatgttgggaacgtcaccttgcagtgttaacttggctttcatgaagctttttgatcttccacaagaggtaggctacgggtgaaacctcttaagaccttttgggacagcggtg

SEQ ID NO: 384810 - DNA, 140 bp, Artificial Sequence
  Synthetic
caccgctgtcccaaaaggtcttaagaggtttcacccgtagcctacctcttgtggaagatcaaaaagcttcatgaaagccaagttaacactgcaaggtgacgttcccaacatctgtgtccccatatcagcagccagggcct

SEQ ID NO: 384811 - DNA, 140 bp, Artificial Sequence
  Synthetic
atacgccatgctgggtctccgaagctttttgatcttccacaagaggtaggctacgggtgaaacctcttaagctagtacttctatgaagagatgctttggatagggtaacagcggcggatacgtacttgggagtcggccat

SEQ ID NO: 384812 - DNA, 140 bp, Artificial Sequence
  Synthetic
atggccgactcccaagtacgtatccgccgctgttaccctatccaaagcatctcttcatagaagtactagcttaagaggtttcacccgtagcctacctcttgtggaagatcaaaaagcttcggagacccagcatggcgtat

SEQ ID NO: 384813 - DNA, 140 bp, Artificial Sequence
  Synthetic
atacgccatgctgggtctccggaaaatggatatttcaggtgtccaagctcctgtgggagctattactaccattgaggatccagttttggcaaagaaagtgcctgaaaccttcccagaattcgtacttgggagtcggccat

SEQ ID NO: 384814 - DNA, 140 bp, Artificial Sequence
  Synthetic
atggccgactcccaagtacgaattctgggaaggtttcaggcactttctttgccaaaactggatcctcaatggtagtaatagctcccacaggagcttggacacctgaaatatccattttccggagacccagcatggcgtat

SEQ ID NO: 384815 - DNA, 140 bp, Artificial Sequence
  Synthetic
aggccctggctgctgatatggaaacctggagagtcaagacatacttctgatcatatgtctatttataaatttatgggcagatctcacttcctatgtacatttacatttaattctaacaacgaccttttgggacagcggtg

SEQ ID NO: 384816 - DNA, 140 bp, Artificial Sequence
  Synthetic
caccgctgtcccaaaaggtcgttgttagaattaaatgtaaatgtacataggaagtgagatctgcccataaatttataaatagacatatgatcagaagtatgtcttgactctccaggtttccatatcagcagccagggcct

SEQ ID NO: 384817 - DNA, 140 bp, Artificial Sequence
  Synthetic
atacgccatgctgggtctccgtcctgtgagaggggacctcgccattgaatgctggacatttctttggggccttatgttttgtttgcctctgaggtactcaggggcatttaggtttttcctcgtacttgggagtcggccat

SEQ ID NO: 384818 - DNA, 140 bp, Artificial Sequence
  Synthetic
atggccgactcccaagtacgaggaaaaacctaaatgcccctgagtacctcagaggcaaacaaaacataaggccccaaagaaatgtccagcattcaatggcgaggtcccctctcacaggacggagacccagcatggcgtat

SEQ ID NO: 384819 - DNA, 140 bp, Artificial Sequence
  Synthetic
atacgccatgctgggtctccttaggtttaataccagaagaacaggaaatatccagattagggtggccttgtactcctatctttatgctgtttcaggcgcactggatgggcttggagacaacgtacttgggagtcggccat

SEQ ID NO: 384820 - DNA, 140 bp, Artificial Sequence
  Synthetic
atggccgactcccaagtacgttgtctccaagcccatccagtgcgcctgaaacagcataaagataggagtacaaggccaccctaatctggatatttcctgttcttctggtattaaacctaaggagacccagcatggcgtat

SEQ ID NO: 384821 - DNA, 140 bp, Artificial Sequence
  Synthetic
atacgccatgctgggtctccaacagattcaacttttggacttgtctccattcaaattgcaaactacaatcattcagatgaatatttgtcttttagttgttacttgtctgtgactgaacagcgtacttgggagtcggccat

SEQ ID NO: 384822 - DNA, 140 bp, Artificial Sequence
  Synthetic
atggccgactcccaagtacgctgttcagtcacagacaagtaacaactaaaagacaaatattcatctgaatgattgtagtttgcaatttgaatggagacaagtccaaaagttgaatctgttggagacccagcatggcgtat

SEQ ID NO: 384823 - DNA, 140 bp, Artificial Sequence
  Synthetic
aggccctggctgctgatatgtgagcaatttgctgttcagggtctactgaggtatcatacttatgcaagatttggaattgagatacaagttcagatcaatcctacaccatttcaacaaggtgaccttttgggacagcggtg

SEQ ID NO: 384824 - DNA, 140 bp, Artificial Sequence
  Synthetic
caccgctgtcccaaaaggtcaccttgttgaaatggtgtaggattgatctgaacttgtatctcaattccaaatcttgcataagtatgatacctcagtagaccctgaacagcaaattgctcacatatcagcagccagggcct

SEQ ID NO: 384825 - DNA, 140 bp, Artificial Sequence
  Synthetic
atacgccatgctgggtctccatcagaaacaatgatggatagaattgctcttggtgatcttgaatcctcagttgatgatcctcgatctgaagaggatcgtaaatttgaaagtcatattgaacgtacttgggagtcggccat

SEQ ID NO: 384826 - DNA, 140 bp, Artificial Sequence
  Synthetic
atggccgactcccaagtacgttcaatatgactttcaaatttacgatcctcttcagatcgaggatcatcaactgaggattcaagatcaccaagagcaattctatccatcattgtttctgatggagacccagcatggcgtat

SEQ ID NO: 384827 - DNA, 140 bp, Artificial Sequence
  Synthetic
atacgccatgctgggtctccggtttgatatgtgccatggtgccaggagatcagagttatggatctatagcttccttaacagtttatcctcatggtttgttgaattgtaacattaataatgcgtacttgggagtcggccat

SEQ ID NO: 384828 - DNA, 140 bp, Artificial Sequence
  Synthetic
atggccgactcccaagtacgcattattaatgttacaattcaacaaaccatgaggataaactgttaaggaagctatagatccataactctgatctcctggcaccatggcacatatcaaaccggagacccagcatggcgtat

SEQ ID NO: 384829 - DNA, 140 bp, Artificial Sequence
  Synthetic
atacgccatgctgggtctcctagtcagaattaaggttccttttatttacacaagaggagcttaccattttaaggaccctcaatatcccgtttgggagttgactattagagtttggtctgacgtacttgggagtcggccat

SEQ ID NO: 384830 - DNA, 140 bp, Artificial Sequence
  Synthetic
atggccgactcccaagtacgtcagaccaaactctaatagtcaactcccaaacgggatattgagggtccttaaaatggtaagctcctcttgtgtaaataaaaggaaccttaattctgactaggagacccagcatggcgtat

SEQ ID NO: 384831 - DNA, 140 bp, Artificial Sequence
  Synthetic
atacgccatgctgggtctcctgacaattattattacaggagcaactgatgtagatggcatggcctggttcactccagtaggtcttgccgttgatactccttgggtagagaaggagtcagccgtacttgggagtcggccat

SEQ ID NO: 384832 - DNA, 140 bp, Artificial Sequence
  Synthetic
atggccgactcccaagtacggctgactccttctctacccaaggagtatcaacggcaagacctactggagtgaaccaggccatgccatctacatcagttgctcctgtaataataattgtcaggagacccagcatggcgtat

SEQ ID NO: 384833 - DNA, 140 bp, Artificial Sequence
  Synthetic
aggccctggctgctgatatgagctttgaggagatttggcttttcattggctgctggtaggagtgtgtggacattggaaatggatgctggagttttgactggcaggttggtgagggtcaatgaccttttgggacagcggtg

SEQ ID NO: 384834 - DNA, 140 bp, Artificial Sequence
  Synthetic
caccgctgtcccaaaaggtcattgaccctcaccaacctgccagtcaaaactccagcatccatttccaatgtccacacactcctaccagcagccaatgaaaagccaaatctcctcaaagctcatatcagcagccagggcct

SEQ ID NO: 384835 - DNA, 140 bp, Artificial Sequence
  Synthetic
atacgccatgctgggtctccatgatgagaaatgaattcagagttagtacaacagagaatgtagtcaatttgtccaattatgaagatgctagagctaaaatgtcttttgctcttgaccaggcgtacttgggagtcggccat

SEQ ID NO: 384836 - DNA, 140 bp, Artificial Sequence
  Synthetic
atggccgactcccaagtacgcctggtcaagagcaaaagacattttagctctagcatcttcataattggacaaattgactacattctctgttgtactaactctgaattcatttctcatcatggagacccagcatggcgtat

SEQ ID NO: 384837 - DNA, 140 bp, Artificial Sequence
  Synthetic
atacgccatgctgggtctccaagattggaaatctgatgcctctcaggggggaggaatcaaaattacacattttacaacttggacatcaattcccactttggctgctcagttcccatttaacgtacttgggagtcggccat

SEQ ID NO: 384838 - DNA, 140 bp, Artificial Sequence
  Synthetic
atggccgactcccaagtacgttaaatgggaactgagcagccaaagtgggaattgatgtccaagttgtaaaatgtgtaattttgattcctcccccctgagaggcatcagatttccaatcttggagacccagcatggcgtat

SEQ ID NO: 384839 - DNA, 140 bp, Artificial Sequence
  Synthetic
atacgccatgctgggtctcctgcctctgattcagttggacagcagatcaaggttatcccagttgatccatattttttccaaatgaccaacacaaatcctgagcaaaaatgtataactgcacgtacttgggagtcggccat

SEQ ID NO: 384840 - DNA, 140 bp, Artificial Sequence
  Synthetic
atggccgactcccaagtacgtgcagttatacatttttgctcaggatttgtgttggtcatttggaaaaaatatggatcaactgggataaccttgatctgctgtccaactgaatcagaggcaggagacccagcatggcgtat

SEQ ID NO: 384841 - DNA, 140 bp, Artificial Sequence
  Synthetic
aggccctggctgctgatatgtgagcagaatttagaaaatgctcagtggtttgcttttatgcatggctatgagttttatcagaaattttattattttgttcagtcctgtttggagaaagaggaccttttgggacagcggtg

SEQ ID NO: 384842 - DNA, 140 bp, Artificial Sequence
  Synthetic
caccgctgtcccaaaaggtcctctttctccaaacaggactgaacaaaataataaaatttctgataaaactcatagccatgcataaaagcaaaccactgagcattttctaaattctgctcacatatcagcagccagggcct

SEQ ID NO: 384843 - DNA, 140 bp, Artificial Sequence
  Synthetic
atacgccatgctgggtctccttggcctcaatatgtcaaatgttttgtttttggagaggggacttggtttttgatttccaggtttttcctacaaaatatcactcaggaagactgttattctcgtacttgggagtcggccat

SEQ ID NO: 384844 - DNA, 140 bp, Artificial Sequence
  Synthetic
atggccgactcccaagtacgagaataacagtcttcctgagtgatattttgtaggaaaaacctggaaatcaaaaaccaagtcccctctccaaaaacaaaacatttgacatattgaggccaaggagacccagcatggcgtat

SEQ ID NO: 384845 - DNA, 140 bp, Artificial Sequence
  Synthetic
atacgccatgctgggtctcctccgggtcaaggctgtcacagtttttccaatccgtgaccaatcacaagtgggttgcagttggggctgctgtgggagttcttggtgttttggttggtggttcgtacttgggagtcggccat

SEQ ID NO: 384846 - DNA, 140 bp, Artificial Sequence
  Synthetic
atggccgactcccaagtacgaaccaccaaccaaaacaccaagaactcccacagcagccccaactgcaacccacttgtgattggtcacggattggaaaaactgtgacagccttgacccggaggagacccagcatggcgtat

SEQ ID NO: 384847 - DNA, 140 bp, Artificial Sequence
  Synthetic
atacgccatgctgggtctccgttttgttcctggaaatgaattgattgatgtttcccacataacattgaagcaagccactactgcgccatgtgctgtaatggatattactggtgtacagtccgtacttgggagtcggccat

SEQ ID NO: 384848 - DNA, 140 bp, Artificial Sequence
  Synthetic
atggccgactcccaagtacggactgtacaccagtaatatccattacagcacatggcgcagtagtggcttgcttcaatgttatgtgggaaacatcaatcaattcatttccaggaacaaaacggagacccagcatggcgtat

SEQ ID NO: 384849 - DNA, 140 bp, Artificial Sequence
  Synthetic
aggccctggctgctgatatgcaagccactactgcgccatgtgctgtaatggatattactggtgtacagtcaactttgagattccgtgttccttggatttcagatactccttatagagttagaccttttgggacagcggtg

SEQ ID NO: 384850 - DNA, 140 bp, Artificial Sequence
  Synthetic
caccgctgtcccaaaaggtctaactctataaggagtatctgaaatccaaggaacacggaatctcaaagttgactgtacaccagtaatatccattacagcacatggcgcagtagtggcttgcatatcagcagccagggcct

SEQ ID NO: 384851 - DNA, 140 bp, Artificial Sequence
  Synthetic
aggccctggctgctgatatgatagatataccaagtcatcacatcagaaaggagagtatactgccataggaaaattgattgtctattgttacaacagattgacttcaccctccaatgtggcgaccttttgggacagcggtg

SEQ ID NO: 384852 - DNA, 140 bp, Artificial Sequence
  Synthetic
caccgctgtcccaaaaggtcgccacattggagggtgaagtcaatctgttgtaacaatagacaatcaattttcctatggcagtatactctcctttctgatgtgatgacttggtatatctatcatatcagcagccagggcct

SEQ ID NO: 384853 - DNA, 140 bp, Artificial Sequence
  Synthetic
atacgccatgctgggtctccttcccatgttagagttaatgtttatctttcagctattaatttagagtgttttgctcccctctatcatgctatggatgtcacaactcaggttggagatgatcgtacttgggagtcggccat

SEQ ID NO: 384854 - DNA, 140 bp, Artificial Sequence
  Synthetic
atggccgactcccaagtacgatcatctccaacctgagttgtgacatccatagcatgatagaggggagcaaaacactctaaattaatagctgaaagataaacattaactctaacatgggaaggagacccagcatggcgtat

SEQ ID NO: 384855 - DNA, 140 bp, Artificial Sequence
  Synthetic
atacgccatgctgggtctcctctggaggtttctctactactgtctcaacaaaacagaatgttccagaccctcaagttggtattacaacagtgaaggatcttaaaggtagggcaaatcaagcgtacttgggagtcggccat

SEQ ID NO: 384856 - DNA, 140 bp, Artificial Sequence
  Synthetic
atggccgactcccaagtacgcttgatttgccctacctttaagatccttcactgttgtaataccaacttgagggtctggaacattctgttttgttgagacagtagtagagaaacctccagaggagacccagcatggcgtat

SEQ ID NO: 384857 - DNA, 140 bp, Artificial Sequence
  Synthetic
atacgccatgctgggtctccggaaaatggacatttcaggtgttcaggctcctgtgggagctatcactaccattgaggatccagtgttggcaaagaaagtgcctgaaacctttccagaattcgtacttgggagtcggccat

SEQ ID NO: 384858 - DNA, 140 bp, Artificial Sequence
  Synthetic
atggccgactcccaagtacgaattctggaaaggtttcaggcactttctttgccaacactggatcctcaatggtagtgatagctcccacaggagcctgaacacctgaaatgtccattttccggagacccagcatggcgtat

SEQ ID NO: 384859 - DNA, 140 bp, Artificial Sequence
  Synthetic
atacgccatgctgggtctccgaagcctggagagtcgagacatacttctgatcatatgtctatttataaatttatgggcagatctcatttcttgtgtacattcacatttaattctaacaaccgtacttgggagtcggccat

SEQ ID NO: 384860 - DNA, 140 bp, Artificial Sequence
  Synthetic
atggccgactcccaagtacggttgttagaattaaatgtgaatgtacacaagaaatgagatctgcccataaatttataaatagacatatgatcagaagtatgtctcgactctccaggcttcggagacccagcatggcgtat

SEQ ID NO: 384861 - DNA, 140 bp, Artificial Sequence
  Synthetic
aggccctggctgctgatatgttatgggcagatctcatttcttgtgtacattcacatttaattctaacaacaaagagtatacttttcctataaccttgtcatcaacttctaatcctcctcagaccttttgggacagcggtg

SEQ ID NO: 384862 - DNA, 140 bp, Artificial Sequence
  Synthetic
caccgctgtcccaaaaggtctgaggaggattagaagttgatgacaaggttataggaaaagtatactctttgttgttagaattaaatgtgaatgtacacaagaaatgagatctgcccataacatatcagcagccagggcct

SEQ ID NO: 384863 - DNA, 140 bp, Artificial Sequence
  Synthetic
aggccctggctgctgatatgtggattgccttcaactctgagatggttttttaacctttttcagctttataggggtcctttggatttgacaataattataactggggccactgatgttgatgaccttttgggacagcggtg

SEQ ID NO: 384864 - DNA, 140 bp, Artificial Sequence
  Synthetic
caccgctgtcccaaaaggtcatcaacatcagtggccccagttataattattgtcaaatccaaaggacccctataaagctgaaaaaggttaaaaaaccatctcagagttgaaggcaatccacatatcagcagccagggcct

SEQ ID NO: 384865 - DNA, 140 bp, Artificial Sequence
  Synthetic
aggccctggctgctgatatgcatgagggacctaaaagggaaagccaataggggaaagatggatgtttcaggagtgcaagcacctgtgggagctatcacaacaattgaggatccagttttagaccttttgggacagcggtg

SEQ ID NO: 384866 - DNA, 140 bp, Artificial Sequence
  Synthetic
caccgctgtcccaaaaggtctaaaactggatcctcaattgttgtgatagctcccacaggtgcttgcactcctgaaacatccatctttcccctattggctttcccttttaggtccctcatgcatatcagcagccagggcct

SEQ ID NO: 384867 - DNA, 140 bp, Artificial Sequence
  Synthetic
atacgccatgctgggtctccatcaggatctccttgtacagctttgctcaattcaattattaataacatcaatttgtattatgttttctcaaaaatttttaggaagtctcctgtgttttttcgtacttgggagtcggccat

SEQ ID NO: 384868 - DNA, 140 bp, Artificial Sequence
  Synthetic
atggccgactcccaagtacgaaaaaacacaggagacttcctaaaaatttttgagaaaacataatacaaattgatgttattaataattgaattgagcaaagctgtacaaggagatcctgatggagacccagcatggcgtat

SEQ ID NO: 384869 - DNA, 140 bp, Artificial Sequence
  Synthetic
atacgccatgctgggtctccttaggttcaatactagaagaacaggaaatattcagattagattaccttggtattcttatctttatgctgtctcaggggcactggatgggctcggagacaacgtacttgggagtcggccat

SEQ ID NO: 384870 - DNA, 140 bp, Artificial Sequence
  Synthetic
atggccgactcccaagtacgttgtctccgagcccatccagtgcccctgagacagcataaagataagaataccaaggtaatctaatctgaatatttcctgttcttctagtattgaacctaaggagacccagcatggcgtat

SEQ ID NO: 384871 - DNA, 140 bp, Artificial Sequence
  Synthetic
atacgccatgctgggtctccaacagattcaacttttggacttgtttccattcaaattgcaaattacaatcactcggatgaatatttgtcttttagttgttatttgtctgtgactgaacagcgtacttgggagtcggccat

SEQ ID NO: 384872 - DNA, 140 bp, Artificial Sequence
  Synthetic
atggccgactcccaagtacgctgttcagtcacagacaaataacaactaaaagacaaatattcatccgagtgattgtaatttgcaatttgaatggaaacaagtccaaaagttgaatctgttggagacccagcatggcgtat

SEQ ID NO: 384873 - DNA, 140 bp, Artificial Sequence
  Synthetic
atacgccatgctgggtctcctctgagttttactttcctagagcacccttgaatactaatgctatgatgtcatcagaaacaatgatggacagaattgctcttggtgatctcgaatcttcagcgtacttgggagtcggccat

SEQ ID NO: 384874 - DNA, 140 bp, Artificial Sequence
  Synthetic
atggccgactcccaagtacgctgaagattcgagatcaccaagagcaattctgtccatcattgtttctgatgacatcatagcattagtattcaagggtgctctaggaaagtaaaactcagaggagacccagcatggcgtat

SEQ ID NO: 384875 - DNA, 140 bp, Artificial Sequence
  Synthetic
atacgccatgctgggtctccttgatgatcctcgatctgaagaggatcgtaaatttgagagtcatattgaaaagaggaagccctataaagagttaagactggaggttggtaagcaaagactcgtacttgggagtcggccat

SEQ ID NO: 384876 - DNA, 140 bp, Artificial Sequence
  Synthetic
atggccgactcccaagtacgagtctttgcttaccaacctccagtcttaactctttatagggcttcctcttttcaatatgactctcaaatttacgatcctcttcagatcgaggatcatcaaggagacccagcatggcgtat

SEQ ID NO: 384877 - DNA, 140 bp, Artificial Sequence
  Synthetic
atacgccatgctgggtctcctgtcttttagttgttatttgtctgtcacagaacaatcagagttttattttcccagagctccattgaactcaaatgccatgttatccactgtatcaatgatcgtacttgggagtcggccat

SEQ ID NO: 384878 - DNA, 140 bp, Artificial Sequence
  Synthetic
atggccgactcccaagtacgatcattgatacagtggataacatggcatttgagttcaatggagctctgggaaaataaaactctgattgttctgtgacagacaaataacaactaaaagacaggagacccagcatggcgtat

SEQ ID NO: 384879 - DNA, 140 bp, Artificial Sequence
  Synthetic
atacgccatgctgggtctccaaagtatgctcaggaagaattgtcaaatgaagtgttacctcctcctcgtaaaattaagggtgtgttttcacaagcaaaaatttcattgttctacacagaacgtacttgggagtcggccat

SEQ ID NO: 384880 - DNA, 140 bp, Artificial Sequence
  Synthetic
atggccgactcccaagtacgttctgtgtagaacaatgaaatttttgcttgtgaaaacacacccttaattttacgaggaggaggtaacacttcatttgacaattcttcctgagcatactttggagacccagcatggcgtat

SEQ ID NO: 384881 - DNA, 140 bp, Artificial Sequence
  Synthetic
atacgccatgctgggtctccgatcatgagattatgaaattttcttggaaaggaatcactgctgatactagagctttgaggagatttggcttttcactggctgctggcaggagtgtgtggacgtacttgggagtcggccat

SEQ ID NO: 384882 - DNA, 140 bp, Artificial Sequence
  Synthetic
atggccgactcccaagtacgtccacacactcctgccagcagccagtgaaaagccaaatctcctcaaagctctagtatcagcagtgattcctttccaagaaaatttcataatctcatgatcggagacccagcatggcgtat

SEQ ID NO: 384883 - DNA, 140 bp, Artificial Sequence
  Synthetic
atacgccatgctgggtctcccattggaaatggatgctggagttttgactggaaggttggtgagggttaatgatgagaaatggacagaaataaaagatgacaaaatagcttctttggtggacgtacttgggagtcggccat

SEQ ID NO: 384884 - DNA, 140 bp, Artificial Sequence
  Synthetic
atggccgactcccaagtacgtccaccaaagaagctattttgtcatcttttatttctgtccatttctcatcattaaccctcaccaaccttccagtcaaaactccagcatccatttccaatgggagacccagcatggcgtat

SEQ ID NO: 384885 - DNA, 140 bp, Artificial Sequence
  Synthetic
atacgccatgctgggtctccgaagtttactagcaataaacactggtcaaaggttaattttcctcatggaatgctagatttggaagaaattgctgcaaatgcaaaagaatttccgaatatgcgtacttgggagtcggccat

SEQ ID NO: 384886 - DNA, 140 bp, Artificial Sequence
  Synthetic
atggccgactcccaagtacgcatattcggaaattcttttgcatttgcagcaatttcttccaaatctagcattccatgaggaaaattaacctttgaccagtgtttattgctagtaaacttcggagacccagcatggcgtat

SEQ ID NO: 384887 - DNA, 140 bp, Artificial Sequence
  Synthetic
atacgccatgctgggtctccggatgtccaatgagattaaacatggcctctcttgaggagaagggtaggcatttttcttctccttttataatagcaacttcaaattggtcaaatccaagtccgtacttgggagtcggccat

SEQ ID NO: 384888 - DNA, 140 bp, Artificial Sequence
  Synthetic
atggccgactcccaagtacggacttggatttgaccaatttgaagttgctattataaaaggagaagaaaaatgcctacccttctcctcaagagaggccatgtttaatctcattggacatccggagacccagcatggcgtat

SEQ ID NO: 384889 - DNA, 140 bp, Artificial Sequence
  Synthetic
atacgccatgctgggtctcctcagaaactgatttgggttttttgttgcattggctgaaccccaaaaggataaatttggcagataggatgttgggtctatcagggatacaggaaattaaagcgtacttgggagtcggccat

SEQ ID NO: 384890 - DNA, 140 bp, Artificial Sequence
  Synthetic
atggccgactcccaagtacgctttaatttcctgtatccctgatagacccaacatcctatctgccaaatttatccttttggggttcagccaatgcaacaaaaaacccaaatcagtttctgaggagacccagcatggcgtat

SEQ ID NO: 384891 - DNA, 140 bp, Artificial Sequence
  Synthetic
atacgccatgctgggtctccaaaaaggagtgggactgattggtgagtgccgagctttcctagattctataactagtaccttaaagtcaatgatgtttggctttcatcactctgtcacagtcgtacttgggagtcggccat

SEQ ID NO: 384892 - DNA, 140 bp, Artificial Sequence
  Synthetic
atggccgactcccaagtacgactgtgacagagtgatgaaagccaaacatcattgactttaaggtactagttatagaatctaggaaagctcggcactcaccaatcagtcccactcctttttggagacccagcatggcgtat

SEQ ID NO: 384893 - DNA, 140 bp, Artificial Sequence
  Synthetic
aggccctggctgctgatatgtgcccttttctagggcagaaattgatcccatggcagtgatgctgtcaaagtattctcttcctattgttgatgagccagatgattataaagatgtttctgtgaccttttgggacagcggtg

SEQ ID NO: 384894 - DNA, 140 bp, Artificial Sequence
  Synthetic
caccgctgtcccaaaaggtcacagaaacatctttataatcatctggctcatcaacaataggaagagaatactttgacagcatcactgccatgggatcaatttctgccctagaaaagggcacatatcagcagccagggcct

SEQ ID NO: 384895 - DNA, 140 bp, Artificial Sequence
  Synthetic
atacgccatgctgggtctcctgaaatcattaacactgttttatgttttgttaaaagtggcattctgctgtatgtgattcagcaattaaatcaagaggaacattcacatataattggtctgcgtacttgggagtcggccat

SEQ ID NO: 384896 - DNA, 140 bp, Artificial Sequence
  Synthetic
atggccgactcccaagtacgcagaccaattatatgtgaatgttcctcttgatttaattgctgaatcacatacagcagaatgccacttttaacaaaacataaaacagtgttaatgatttcaggagacccagcatggcgtat

SEQ ID NO: 384897 - DNA, 140 bp, Artificial Sequence
  Synthetic
  misc_feature (22)..(22): n is a, c, g, or t
aggccctggctgctgatatganttcaagatgtagaaaaatttgatcagtatcagaaaggagttgatttaatacaaaagctgagaactgtccattcaatggctcaagttgatcctaaccttgaccttttgggacagcggtg

SEQ ID NO: 384898 - DNA, 140 bp, Artificial Sequence
  Synthetic
  misc_feature (119)..(119): n is a, c, g, or t
caccgctgtcccaaaaggtcaaggttaggatcaacttgagccattgaatggacagttctcagcttttgtattaaatcaactcctttctgatactgatcaaatttttctacatcttgaantcatatcagcagccagggcct

SEQ ID NO: 384899 - DNA, 140 bp, Artificial Sequence
  Synthetic
atacgccatgctgggtctcccaagaatgatggagcttagaactcagagtatttcaaattggcttagagatatttgttcaggtataacaatctttaaaagttttaaagatgcaatttattgcgtacttgggagtcggccat

SEQ ID NO: 384900 - DNA, 140 bp, Artificial Sequence
  Synthetic
atggccgactcccaagtacgcaataaattgcatctttaaaacttttaaagattgttatacctgaacaaatatctctaagccaatttgaaatactctgagttctaagctccatcattcttgggagacccagcatggcgtat

SEQ ID NO: 384901 - DNA, 140 bp, Artificial Sequence
  Synthetic
aggccctggctgctgatatgtgcctctgattcagttgggcaacagattaaggttattccagttgatccatatttcttccaaatgactaatacaaatcctgaacaaaaatgtataactgcagaccttttgggacagcggtg

SEQ ID NO: 384902 - DNA, 140 bp, Artificial Sequence
  Synthetic
caccgctgtcccaaaaggtctgcagttatacatttttgttcaggatttgtattagtcatttggaagaaatatggatcaactggaataaccttaatctgttgcccaactgaatcagaggcacatatcagcagccagggcct

SEQ ID NO: 384903 - DNA, 140 bp, Artificial Sequence
  Synthetic
atacgccatgctgggtctccgctttatacaaaaatcagagaatattatgatctgaattatggcagtaaaaaggatgttctcaatattctgaaagatcatcaacaaaagatagagagagcacgtacttgggagtcggccat

SEQ ID NO: 384904 - DNA, 140 bp, Artificial Sequence
  Synthetic
atggccgactcccaagtacgtgctctctctatcttttgttgatgatctttcagaatattgagaacatcctttttactgccataattcagatcataatattctctgatttttgtataaagcggagacccagcatggcgtat

SEQ ID NO: 384905 - DNA, 140 bp, Artificial Sequence
  Synthetic
atacgccatgctgggtctccattgaggaggctgacaatttttgtgttcttcaaattcaggatgttgaaaaatttgaacagtatcaaaaaggggttgatttaattcaaaaattgagaactgcgtacttgggagtcggccat

SEQ ID NO: 384906 - DNA, 140 bp, Artificial Sequence
  Synthetic
atggccgactcccaagtacgcagttctcaatttttgaattaaatcaacccctttttgatactgttcaaatttttcaacatcctgaatttgaagaacacaaaaattgtcagcctcctcaatggagacccagcatggcgtat

SEQ ID NO: 384907 - DNA, 140 bp, Artificial Sequence
  Synthetic
atacgccatgctgggtctccagctataagttatttccatttgaatcctggatttcatactggtgtggctattggaattgatcctgataggcaatgggatgaattatttaaaacaatgattcgtacttgggagtcggccat

SEQ ID NO: 384908 - DNA, 140 bp, Artificial Sequence
  Synthetic
atggccgactcccaagtacgaatcattgttttaaataattcatcccattgcctatcaggatcaattccaatagccacaccagtatgaaatccaggattcaaatggaaataacttatagctggagacccagcatggcgtat

SEQ ID NO: 384909 - DNA, 140 bp, Artificial Sequence
  Synthetic
atacgccatgctgggtctcctagacagtgggaccaactttttaaaacaatgattagatttggagatgttggtctagatttggatttttctgcttttgatgctagtttgagtccattcatgcgtacttgggagtcggccat

SEQ ID NO: 384910 - DNA, 140 bp, Artificial Sequence
  Synthetic
atggccgactcccaagtacgcatgaatggactcaaactagcatcaaaagcagaaaaatccaaatctagaccaacatctccaaatctaatcattgttttaaaaagttggtcccactgtctaggagacccagcatggcgtat

SEQ ID NO: 384911 - DNA, 140 bp, Artificial Sequence
  Synthetic
aggccctggctgctgatatgaaaaaggggtgggattgattggcgagtgccgagctttcctagattctataactagtaccttgaagtcaatgatgtttggtttccatcattctgtcacagtgaccttttgggacagcggtg

SEQ ID NO: 384912 - DNA, 140 bp, Artificial Sequence
  Synthetic
caccgctgtcccaaaaggtcactgtgacagaatgatggaaaccaaacatcattgacttcaaggtactagttatagaatctaggaaagctcggcactcgccaatcaatcccacccctttttcatatcagcagccagggcct

SEQ ID NO: 384913 - DNA, 140 bp, Artificial Sequence
  Synthetic
atacgccatgctgggtctccaattaaccaggcaatggtgacaagatgtgagccagtcgtctgctacctctatggaaagaggggcggcggaaaaagtctgacttcaattgctttggccacacgtacttgggagtcggccat

SEQ ID NO: 384914 - DNA, 140 bp, Artificial Sequence
  Synthetic
atggccgactcccaagtacgtgtggccaaagcaattgaagtcagactttttccgccgcccctctttccatagaggtagcagacgactggctcacatcttgtcaccattgcctggttaattggagacccagcatggcgtat

SEQ ID NO: 384915 - DNA, 140 bp, Artificial Sequence
  Synthetic
atacgccatgctgggtctccttgcttttatgcatggatatgaattttaccaacaattttatcattttgttcagtcctgtttggagaaagagatgatagaatacagacttaaatcatatgacgtacttgggagtcggccat

SEQ ID NO: 384916 - DNA, 140 bp, Artificial Sequence
  Synthetic
atggccgactcccaagtacgtcatatgatttaagtctgtattctatcatctctttctccaaacaggactgaacaaaatgataaaattgttggtaaaattcatatccatgcataaaagcaaggagacccagcatggcgtat

SEQ ID NO: 384917 - DNA, 140 bp, Artificial Sequence
  Synthetic
aggccctggctgctgatatgcttcgacttctaatcctcctcatggtttaccatcaacactaaggtggtttttcaacctgtttcagttgtatagaggaccattggacttgacaattattatgaccttttgggacagcggtg

SEQ ID NO: 384918 - DNA, 140 bp, Artificial Sequence
  Synthetic
caccgctgtcccaaaaggtcataataattgtcaagtccaatggtcctctatacaactgaaacaggttgaaaaaccaccttagtgttgatggtaaaccatgaggaggattagaagtcgaagcatatcagcagccagggcct

SEQ ID NO: 384919 - DNA, 140 bp, Artificial Sequence
  Synthetic
atacgccatgctgggtctccagaaaagggtcgtcatttttcctcacctttcataattgcaacatcgaactggtctaatccaagtcccaaaacagtctatgttaaagaagccatagaccgtcgtacttgggagtcggccat

SEQ ID NO: 384920 - DNA, 140 bp, Artificial Sequence
  Synthetic
atggccgactcccaagtacgacggtctatggcttctttaacatagactgttttgggacttggattagaccagttcgatgttgcaattatgaaaggtgaggaaaaatgacgacccttttctggagacccagcatggcgtat

SEQ ID NO: 384921 - DNA, 140 bp, Artificial Sequence
  Synthetic
atacgccatgctgggtctccaggttgcattttaaagttgaagtgaaacctgcctcattctttaaaaatcctcacaatgatatgttaaatgttaatttggcaaaaactaatgatgctattacgtacttgggagtcggccat

SEQ ID NO: 384922 - DNA, 140 bp, Artificial Sequence
  Synthetic
atggccgactcccaagtacgtaatagcatcattagtttttgccaaattaacatttaacatatcattgtgaggatttttaaagaatgaggcaggtttcacttcaactttaaaatgcaacctggagacccagcatggcgtat

SEQ ID NO: 384923 - DNA, 140 bp, Artificial Sequence
  Synthetic
atacgccatgctgggtctccagatttggggatgttggtcttgatttggatttttccgcctttgatgctagtcttagtccatttatgattagagaagcaggcagaattatgtctgaaatttcgtacttgggagtcggccat

SEQ ID NO: 384924 - DNA, 140 bp, Artificial Sequence
  Synthetic
atggccgactcccaagtacgaaatttcagacataattctgcctgcttctctaatcataaatggactaagactagcatcaaaggcggaaaaatccaaatcaagaccaacatccccaaatctggagacccagcatggcgtat

SEQ ID NO: 384925 - DNA, 140 bp, Artificial Sequence
  Synthetic
atacgccatgctgggtctcctatgtcagaatttatggagctttggtcacagggattatcagatgatgacaatgatagtgcagttgctgaatttttccagtcctttccttctggtgaaccacgtacttgggagtcggccat

SEQ ID NO: 384926 - DNA, 140 bp, Artificial Sequence
  Synthetic
atggccgactcccaagtacgtggttcaccagaaggaaaggactggaaaaattcagcaactgcactatcattgtcatcatctgataatccctgtgaccaaagctccataaattctgacataggagacccagcatggcgtat

SEQ ID NO: 384927 - DNA, 140 bp, Artificial Sequence
  Synthetic
aggccctggctgctgatatgtctcttttttatactgaggagcatgaaataatgaaattttcttggagaggagtaactgctgacactagggctttgagaagatttggattctctatggctggaccttttgggacagcggtg

SEQ ID NO: 384928 - DNA, 140 bp, Artificial Sequence
  Synthetic
caccgctgtcccaaaaggtccagccatagagaatccaaatcttctcaaagccctagtgtcagcagttactcctctccaagaaaatttcattatttcatgctcctcagtataaaaaagagacatatcagcagccagggcct

SEQ ID NO: 384929 - DNA, 140 bp, Artificial Sequence
  Synthetic
atacgccatgctgggtctcctgggagtggccttgaccacatcctgtctttggcagatgtggaggaggaacaaatgattcagtctgtggatcgtaccgcagttactggggcttcatatttccgtacttgggagtcggccat

SEQ ID NO: 384930 - DNA, 140 bp, Artificial Sequence
  Synthetic
atggccgactcccaagtacggaaatatgaagccccagtaactgcggtacgatccacagactgaatcatttgttcctcctccacatctgccaaagacaggatgtggtcaaggccactcccaggagacccagcatggcgtat

SEQ ID NO: 384931 - DNA, 140 bp, Artificial Sequence
  Synthetic
atacgccatgctgggtctccggtatgtttacaagcattttacaaagaagcgagaagagtccattccaagtgaaggagtgtatcatggtgtgactaagccaaagcaagtaattaaattggacgtacttgggagtcggccat

SEQ ID NO: 384932 - DNA, 140 bp, Artificial Sequence
  Synthetic
atggccgactcccaagtacgtccaatttaattacttgctttggcttagtcacaccatgatacactccttcacttggaatggactcttctcgcttctttgtaaaatgcttgtaaacataccggagacccagcatggcgtat

SEQ ID NO: 384933 - DNA, 140 bp, Artificial Sequence
  Synthetic
atacgccatgctgggtctcctgaatgttaatttagccaaaacaaatgatgcaatcaaggacatgtcttgtgttgatttaataatggatggacataatatttcattaatggatttacttagcgtacttgggagtcggccat

SEQ ID NO: 384934 - DNA, 140 bp, Artificial Sequence
  Synthetic
atggccgactcccaagtacgctaagtaaatccattaatgaaatattatgtccatccattattaaatcaacacaagacatgtccttgattgcatcatttgttttggctaaattaacattcaggagacccagcatggcgtat

SEQ ID NO: 384935 - DNA, 140 bp, Artificial Sequence
  Synthetic
atacgccatgctgggtctcctgggttatgaatgctttaggaatcaaggatgattggctattagtgccctctcatgcttataagtttgaaaaagattatgagatgatggaattttattttacgtacttgggagtcggccat

SEQ ID NO: 384936 - DNA, 140 bp, Artificial Sequence
  Synthetic
atggccgactcccaagtacgtaaaataaaattccatcatctcataatctttttcaaacttataagcatgagagggcactaatagccaatcatccttgattcctaaagcattcataacccaggagacccagcatggcgtat

SEQ ID NO: 384937 - DNA, 140 bp, Artificial Sequence
  Synthetic
atacgccatgctgggtctccacagaggtggtacttattactcaatttcagcaggaaatgtagtgattcaatccttagatgttggttttcaggatgtagttttaatgaaagtgcctacaatcgtacttgggagtcggccat

SEQ ID NO: 384938 - DNA, 140 bp, Artificial Sequence
  Synthetic
atggccgactcccaagtacgattgtaggcactttcattaaaactacatcctgaaaaccaacatctaaggattgaatcactacatttcctgctgaaattgagtaataagtaccacctctgtggagacccagcatggcgtat

SEQ ID NO: 384939 - DNA, 140 bp, Artificial Sequence
  Synthetic
atacgccatgctgggtctcctggattctctttggccgcaggcagaagtgtgtggactcttgaaatggatgctggggttcttactgggagactgattagattgaatgatgagaaatggacacgtacttgggagtcggccat

SEQ ID NO: 384940 - DNA, 140 bp, Artificial Sequence
  Synthetic
atggccgactcccaagtacgtgtccatttctcatcattcaatctaatcagtctcccagtaagaaccccagcatccatttcaagagtccacacacttctgcctgcggccaaagagaatccaggagacccagcatggcgtat

SEQ ID NO: 384941 - DNA, 140 bp, Artificial Sequence
  Synthetic
atacgccatgctgggtctcctccaaaatttagagatataacagaacatttcatcaaaaagagtgatgtacccagagctttgaatagactggcaacacttgtgacaacggttaacgggactcgtacttgggagtcggccat

SEQ ID NO: 384942 - DNA, 140 bp, Artificial Sequence
  Synthetic
atggccgactcccaagtacgagtcccgttaaccgttgtcacaagtgttgccagtctattcaaagctctgggtacatcactctttttgatgaaatgttctgttatatctctaaattttggaggagacccagcatggcgtat

SEQ ID NO: 384943 - DNA, 140 bp, Artificial Sequence
  Synthetic
aggccctggctgctgatatgtgttcataaaaagaatgatggaaccaccatagatttgactgttgatcaagcttggagaggtaaaggagaaggccttccagggatgtgtggtggggccttggaccttttgggacagcggtg

SEQ ID NO: 384944 - DNA, 140 bp, Artificial Sequence
  Synthetic
caccgctgtcccaaaaggtccaaggccccaccacacatccctggaaggccttctcctttacctctccaagcttgatcaacagtcaaatctatggtggttccatcattctttttatgaacacatatcagcagccagggcct

SEQ ID NO: 384945 - DNA, 140 bp, Artificial Sequence
  Synthetic
aggccctggctgctgatatgcttggagaggtaaaggagaaggccttccagggatgtgtggtggggccttgatttcttctaatcagtccattcagaatgccatactaggaatccatgttgcgaccttttgggacagcggtg

SEQ ID NO: 384946 - DNA, 140 bp, Artificial Sequence
  Synthetic
caccgctgtcccaaaaggtcgcaacatggattcctagtatggcattctgaatggactgattagaagaaatcaaggccccaccacacatccctggaaggccttctcctttacctctccaagcatatcagcagccagggcct

SEQ ID NO: 384947 - DNA, 140 bp, Artificial Sequence
  Synthetic
aggccctggctgctgatatgtggtggaaattcaattttggttgctaagttagtgacccaagagatgtttcaaaatatagataagaaaatagttgaaagtcagaggataatgaaagtggaagaccttttgggacagcggtg

SEQ ID NO: 384948 - DNA, 140 bp, Artificial Sequence
  Synthetic
caccgctgtcccaaaaggtcttccactttcattatcctctgactttcaactattttcttatctatattttgaaacatctcttgggtcactaacttagcaaccaaaattgaatttccaccacatatcagcagccagggcct

SEQ ID NO: 384949 - DNA, 140 bp, Artificial Sequence
  Synthetic
aggccctggctgctgatatggttttgttcctggaaatgaactgattgatgtttcccacataacactgaaacaagccactactgcgccttgtgctgtgatggatattactggtgtacagtcgaccttttgggacagcggtg

SEQ ID NO: 384950 - DNA, 140 bp, Artificial Sequence
  Synthetic
caccgctgtcccaaaaggtcgactgtacaccagtaatatccatcacagcacaaggcgcagtagtggcttgtttcagtgttatgtgggaaacatcaatcagttcatttccaggaacaaaaccatatcagcagccagggcct

SEQ ID NO: 384951 - DNA, 140 bp, Artificial Sequence
  Synthetic
aggccctggctgctgatatgaactttgagatttcgtgttccttggatttcagatactccttatagagttaatagatacaccaaatcgtcacatcagaaaggagagtatactgccataggagaccttttgggacagcggtg

SEQ ID NO: 384952 - DNA, 140 bp, Artificial Sequence
  Synthetic
caccgctgtcccaaaaggtctcctatggcagtatactctcctttctgatgtgacgatttggtgtatctattaactctataaggagtatctgaaatccaaggaacacgaaatctcaaagttcatatcagcagccagggcct

SEQ ID NO: 384953 - DNA, 140 bp, Artificial Sequence
  Synthetic
aggccctggctgctgatatgtggatattgaaatggccataacaggggctcctgggatagatgcaatcaatatggattcttctcctggatatccttatgttcaagaaaaattaaccaaaaggaccttttgggacagcggtg

SEQ ID NO: 384954 - DNA, 140 bp, Artificial Sequence
  Synthetic
caccgctgtcccaaaaggtccttttggttaatttttcttgaacataaggatatccaggagaagaatccatattgattgcatctatcccaggagcccctgttatggccatttcaatatccacatatcagcagccagggcct

SEQ ID NO: 384955 - DNA, 140 bp, Artificial Sequence
  Synthetic
aggccctggctgctgatatgttgctccactctatcatgctatggatgtcacaactcaggttggagatgattctggaggcttctctaccactgtttcaacaaaacagaatgttccagacccgaccttttgggacagcggtg

SEQ ID NO: 384956 - DNA, 140 bp, Artificial Sequence
  Synthetic
caccgctgtcccaaaaggtcgggtctggaacattctgttttgttgaaacagtggtagagaagcctccagaatcatctccaacctgagttgtgacatccatagcatgatagagtggagcaacatatcagcagccagggcct

SEQ ID NO: 384957 - DNA, 140 bp, Artificial Sequence
  Synthetic
atacgccatgctgggtctccagatttgatttggcttgatgacaatggaatgtttttgggtctgcatcctaggctggctcagagaattctatttaatacaacaatgatggaaaattgctcacgtacttgggagtcggccat

SEQ ID NO: 384958 - DNA, 140 bp, Artificial Sequence
  Synthetic
atggccgactcccaagtacgtgagcaattttccatcattgttgtattaaatagaattctctgagccagcctaggatgcagacccaaaaacattccattgtcatcaagccaaatcaaatctggagacccagcatggcgtat

SEQ ID NO: 384959 - DNA, 140 bp, Artificial Sequence
  Synthetic
atacgccatgctgggtctccccaagttggcatcacaacagtcaaggatcttaaaggcagagcaaaccaagggaaaatggacatttcgggtgtccaagctcctgtgggagctattactacccgtacttgggagtcggccat

SEQ ID NO: 384960 - DNA, 140 bp, Artificial Sequence
  Synthetic
atggccgactcccaagtacgggtagtaatagctcccacaggagcttggacacccgaaatgtccattttcccttggtttgctctgcctttaagatccttgactgttgtgatgccaacttggggagacccagcatggcgtat

SEQ ID NO: 384961 - DNA, 140 bp, Artificial Sequence
  Synthetic
atacgccatgctgggtctccgatttggatgttgttttcactacttgtcctaaggatgagctaagacctctggataaggtgttggaatccaaaactagggctattgattcttgtcctcttgcgtacttgggagtcggccat

SEQ ID NO: 384962 - DNA, 140 bp, Artificial Sequence
  Synthetic
atggccgactcccaagtacgcaagaggacaagaatcaatagccctagttttggattccaacaccttatccagaggtcttagctcatccttaggacaagtagtgaaaacaacatccaaatcggagacccagcatggcgtat

SEQ ID NO: 384963 - DNA, 140 bp, Artificial Sequence
  Synthetic
aggccctggctgctgatatgttatgggcagatctcatttcttgtgtacatttacatttaattctaacaacaaagagtacacttttcccatcactttgtcatctacttctaatcctcctcagaccttttgggacagcggtg

SEQ ID NO: 384964 - DNA, 140 bp, Artificial Sequence
  Synthetic
caccgctgtcccaaaaggtctgaggaggattagaagtagatgacaaagtgatgggaaaagtgtactctttgttgttagaattaaatgtaaatgtacacaagaaatgagatctgcccataacatatcagcagccagggcct

SEQ ID NO: 384965 - DNA, 140 bp, Artificial Sequence
  Synthetic
atacgccatgctgggtctccataagggaagctggaagaatccttactgagatgtctggagcccctgttcactttggagaggctttgatcaacacaatcatttactctaaacatttgctttcgtacttgggagtcggccat

SEQ ID NO: 384966 - DNA, 140 bp, Artificial Sequence
  Synthetic
atggccgactcccaagtacgaaagcaaatgtttagagtaaatgattgtgttgatcaaagcctctccaaagtgaacaggggctccagacatctcagtaaggattcttccagcttcccttatggagacccagcatggcgtat

SEQ ID NO: 384967 - DNA, 140 bp, Artificial Sequence
  Synthetic
atacgccatgctgggtctccataattgttgttaccatgtatgtgggtcaatgccttctgggtccccttgtacagctttgttaaattcaattataaacaatgttaatttgtattacgttttcgtacttgggagtcggccat

SEQ ID NO: 384968 - DNA, 140 bp, Artificial Sequence
  Synthetic
atggccgactcccaagtacgaaaacgtaatacaaattaacattgtttataattgaatttaacaaagctgtacaaggggacccagaaggcattgacccacatacatggtaacaacaattatggagacccagcatggcgtat

SEQ ID NO: 384969 - DNA, 140 bp, Artificial Sequence
  Synthetic
atacgccatgctgggtctccttccaagatttttaaaaaatctccagttttcttttgtgatgctgtgagaattctttgttatggagatgatgttcttattgtcttttccagacaagttcaacgtacttgggagtcggccat

SEQ ID NO: 384970 - DNA, 140 bp, Artificial Sequence
  Synthetic
atggccgactcccaagtacgttgaacttgtctggaaaagacaataagaacatcatctccataacaaagaattctcacagcatcacaaaagaaaactggagattttttaaaaatcttggaaggagacccagcatggcgtat

SEQ ID NO: 384971 - DNA, 140 bp, Artificial Sequence
  Synthetic
aggccctggctgctgatatgttctttgttatggagatgatgttcttattgtcttttccagacaagttcaaattgacaatctggattctattggacaaagaattgttgatgagtttaagaagaccttttgggacagcggtg

SEQ ID NO: 384972 - DNA, 140 bp, Artificial Sequence
  Synthetic
caccgctgtcccaaaaggtcttcttaaactcatcaacaattctttgtccaatagaatccagattgtcaatttgaacttgtctggaaaagacaataagaacatcatctccataacaaagaacatatcagcagccagggcct

SEQ ID NO: 384973 - DNA, 140 bp, Artificial Sequence
  Synthetic
atacgccatgctgggtctccagaattaggcctgctattgctgagaaaaccatatggtcattagttgcatggcaaaggaacaatgctgagtttgaacagaatttggaaaatgcccaatggtcgtacttgggagtcggccat

SEQ ID NO: 384974 - DNA, 140 bp, Artificial Sequence
  Synthetic
atggccgactcccaagtacgaccattgggcattttccaaattctgttcaaactcagcattgttcctttgccatgcaactaatgaccatatggttttctcagcaatagcaggcctaattctggagacccagcatggcgtat

SEQ ID NO: 384975 - DNA, 140 bp, Artificial Sequence
  Synthetic
atacgccatgctgggtctcctgcatgaatttaaacagttggggatgacagctacttctgctgacaaaactgtaccacaactgaagccagtttcagaattaacttttctcaagaggtccttcgtacttgggagtcggccat

SEQ ID NO: 384976 - DNA, 140 bp, Artificial Sequence
  Synthetic
atggccgactcccaagtacgaaggacctcttgagaaaagttaattctgaaactggcttcagttgtggtacagttttgtcagcagaagtagctgtcatccccaactgtttaaattcatgcaggagacccagcatggcgtat

SEQ ID NO: 384977 - DNA, 140 bp, Artificial Sequence
  Synthetic
atacgccatgctgggtctccgacaactgttaatggaactcccatgctaatttctgagggaccattaaagatggaagaaaaagccccttatgtccataagaagaatgatggtacaacagttcgtacttgggagtcggccat

SEQ ID NO: 384978 - DNA, 140 bp, Artificial Sequence
  Synthetic
atggccgactcccaagtacgaactgttgtaccatcattcttcttatggacataaggggctttttcttccatctttaatggtccctcagaaattagcatgggagttccattaacagttgtcggagacccagcatggcgtat

SEQ ID NO: 384979 - DNA, 140 bp, Artificial Sequence
  Synthetic
atacgccatgctgggtctccttcaagaggggtctccggagttttccggagcctctcttggaagtccatggtgaggggacttgatacctcaccgccgtttgcctaggctataggctaaacccgtacttgggagtcggccat

SEQ ID NO: 384980 - DNA, 140 bp, Artificial Sequence
  Synthetic
atggccgactcccaagtacgggtttagcctatagcctaggcaaacggcggtgaggtatcaagtcccctcaccatggacttccaagagaggctccggaaaactccggagacccctcttgaaggagacccagcatggcgtat

SEQ ID NO: 384981 - DNA, 140 bp, Artificial Sequence
  Synthetic
atacgccatgctgggtctccaaacttggcagatagaatgttgggtttgtcagggatacaggaaataaaagaaaaaggggtgggattgattggcgagtgccgagcttttttagattctatacgtacttgggagtcggccat

SEQ ID NO: 384982 - DNA, 140 bp, Artificial Sequence
  Synthetic
atggccgactcccaagtacgtatagaatctaaaaaagctcggcactcgccaatcaatcccacccctttttcttttatttcctgtatccctgacaaacccaacattctatctgccaagtttggagacccagcatggcgtat

SEQ ID NO: 384983 - DNA, 140 bp, Artificial Sequence
  Synthetic
aggccctggctgctgatatgaaaaaggggtgggattgattggcgagtgccgagcttttttagattctataactagcaccttgaagtcaatgatgtttggtttccaccattctgtcacagtgaccttttgggacagcggtg

SEQ ID NO: 384984 - DNA, 140 bp, Artificial Sequence
  Synthetic
caccgctgtcccaaaaggtcactgtgacagaatggtggaaaccaaacatcattgacttcaaggtgctagttatagaatctaaaaaagctcggcactcgccaatcaatcccacccctttttcatatcagcagccagggcct

SEQ ID NO: 384985 - DNA, 140 bp, Artificial Sequence
  Synthetic
aggccctggctgctgatatggagatttggagtcatcggtggatgatcctagatcagaggaggatagaagatttgagagtcatatagaatgtaggaaaccatacaaagaactgaggctggagaccttttgggacagcggtg

SEQ ID NO: 384986 - DNA, 140 bp, Artificial Sequence
  Synthetic
caccgctgtcccaaaaggtctccagcctcagttctttgtatggtttcctacattctatatgactctcaaatcttctatcctcctctgatctaggatcatccaccgatgactccaaatctccatatcagcagccagggcct

SEQ ID NO: 384987 - DNA, 140 bp, Artificial Sequence
  Synthetic
atacgccatgctgggtctcctgaaatcattaatactgttttgtgttttgttaaaagtggcattttgctgtatgtgattcaacaattaaatcaagaggaacattcccacataattggtctgcgtacttgggagtcggccat

SEQ ID NO: 384988 - DNA, 140 bp, Artificial Sequence
  Synthetic
atggccgactcccaagtacgcagaccaattatgtgggaatgttcctcttgatttaattgttgaatcacatacagcaaaatgccacttttaacaaaacacaaaacagtattaatgatttcaggagacccagcatggcgtat

SEQ ID NO: 384989 - DNA, 140 bp, Artificial Sequence
  Synthetic
atacgccatgctgggtctccatgtgattcaacaattaaatcaagaggaacattcccacataattggtctgttgagagtgatgaattatgctgacattgggtgttctgtcatttcatgtggcgtacttgggagtcggccat

SEQ ID NO: 384990 - DNA, 140 bp, Artificial Sequence
  Synthetic
atggccgactcccaagtacgccacatgaaatgacagaacacccaatgtcagcataattcatcactctcaacagaccaattatgtgggaatgttcctcttgatttaattgttgaatcacatggagacccagcatggcgtat

SEQ ID NO: 384991 - DNA, 140 bp, Artificial Sequence
  Synthetic
atacgccatgctgggtctcctaatctggtagaggacagggttagaccagctatttctgagaagacaatctggtctttagtagcttggcaaagaagcaatgccgagtttgaacaaaatttgcgtacttgggagtcggccat

SEQ ID NO: 384992 - DNA, 140 bp, Artificial Sequence
  Synthetic
atggccgactcccaagtacgcaaattttgttcaaactcggcattgcttctttgccaagctactaaagaccagattgtcttctcagaaatagctggtctaaccctgtcctctaccagattaggagacccagcatggcgtat

SEQ ID NO: 384993 - DNA, 140 bp, Artificial Sequence
  Synthetic
aggccctggctgctgatatggctttacacaaaaatcagagaatattatgatctgaattatggtaataaaaaggatgttcttaatattttgaaagatcatcaacataagatagagagagcagaccttttgggacagcggtg

SEQ ID NO: 384994 - DNA, 140 bp, Artificial Sequence
  Synthetic
caccgctgtcccaaaaggtctgctctctctatcttatgttgatgatctttcaaaatattaagaacatcctttttattaccataattcagatcataatattctctgatttttgtgtaaagccatatcagcagccagggcct

SEQ ID NO: 384995 - DNA, 140 bp, Artificial Sequence
  Synthetic
atacgccatgctgggtctccattgaggaggctgataatttttgtgttcttcagattcaggatgttgaaaaatttgaacagtaccaaaaaggggtagatttaattcaaaaattgagaactgcgtacttgggagtcggccat

SEQ ID NO: 384996 - DNA, 140 bp, Artificial Sequence
  Synthetic
atggccgactcccaagtacgcagttctcaatttttgaattaaatctacccctttttggtactgttcaaatttttcaacatcctgaatctgaagaacacaaaaattatcagcctcctcaatggagacccagcatggcgtat

SEQ ID NO: 384997 - DNA, 140 bp, Artificial Sequence
  Synthetic
atacgccatgctgggtctcctactctcttcccattgttgatgagccagatgattataaagatgtttctgtctttttccaaaataaaattttgggcaagagtcccctagttgatgattttccgtacttgggagtcggccat

SEQ ID NO: 384998 - DNA, 140 bp, Artificial Sequence
  Synthetic
atggccgactcccaagtacggaaaatcatcaactaggggactcttgcccaaaattttattttggaaaaagacagaaacatctttataatcatctggctcatcaacaatgggaagagagtaggagacccagcatggcgtat

SEQ ID NO: 384999 - DNA, 140 bp, Artificial Sequence
  Synthetic
aggccctggctgctgatatgatttcttccaatcagtccatccagaatgccatattaggaatccacgttgctggtggaaattcaattttggttgctaagttagtgactcaagagatgtttcgaccttttgggacagcggtg

SEQ ID NO: 385000 - DNA, 140 bp, Artificial Sequence
  Synthetic
caccgctgtcccaaaaggtcgaaacatctcttgagtcactaacttagcaaccaaaattgaatttccaccagcaacgtggattcctaatatggcattctggatggactgattggaagaaatcatatcagcagccagggcct

SEQ ID NO: 385001 - DNA, 140 bp, Artificial Sequence
  Synthetic
aggccctggctgctgatatgaggaattttccagactgttgggagtggccttgaccacatcctgtctttggcagatattgaggaagaacaaatgattcagtccgttgatagaactgcagtggaccttttgggacagcggtg

SEQ ID NO: 385002 - DNA, 140 bp, Artificial Sequence
  Synthetic
caccgctgtcccaaaaggtccactgcagttctatcaacggactgaatcatttgttcttcctcaatatctgccaaagacaggatgtggtcaaggccactcccaacagtctggaaaattcctcatatcagcagccagggcct

SEQ ID NO: 385003 - DNA, 140 bp, Artificial Sequence
  Synthetic
aggccctggctgctgatatgtgtcaattggtgtctggatgtccaatgaggttaaatatggcttctttggaagaaaagggtcgtcatttttcttcaccctttataattgcaacatccaactgaccttttgggacagcggtg

SEQ ID NO: 385004 - DNA, 140 bp, Artificial Sequence
  Synthetic
caccgctgtcccaaaaggtcagttggatgttgcaattataaagggtgaagaaaaatgacgacccttttcttccaaagaagccatatttaacctcattggacatccagacaccaattgacacatatcagcagccagggcct

SEQ ID NO: 385005 - DNA, 140 bp, Artificial Sequence
  Synthetic
aggccctggctgctgatatgactggtgcttcttatttcacttctgtggaccaatcttcagttcatactgctgaggttggctcacatcaaattgaacctttgaaaacctctgttgataaacgaccttttgggacagcggtg

SEQ ID NO: 385006 - DNA, 140 bp, Artificial Sequence
  Synthetic
caccgctgtcccaaaaggtcgtttatcaacagaggttttcaaaggttcaatttgatgtgagccaacctcagcagtatgaactgaagattggtccacagaagtgaaataagaagcaccagtcatatcagcagccagggcct

SEQ ID NO: 385007 - DNA, 140 bp, Artificial Sequence
  Synthetic
aggccctggctgctgatatgggtcttatccaagtcctaaaacggtctatgttaaggaagccatagaccgtatactccattttcaagttgaggtgaaacctgcctcattcttcaagaatccgaccttttgggacagcggtg

SEQ ID NO: 385008 - DNA, 140 bp, Artificial Sequence
  Synthetic
caccgctgtcccaaaaggtcggattcttgaagaatgaggcaggtttcacctcaacttgaaaatggagtatacggtctatggcttccttaacatagaccgttttaggacttggataagacccatatcagcagccagggcct

SEQ ID NO: 385009 - DNA, 140 bp, Artificial Sequence
  Synthetic
atacgccatgctgggtctccgattggctcactacacatgctctttttcatgaagttgcaaaattggatgtggtgaaattactatataatgagcagtttgccgtccaaggtttgttgagatcgtacttgggagtcggccat

SEQ ID NO: 385010 - DNA, 140 bp, Artificial Sequence
  Synthetic
atggccgactcccaagtacgatctcaacaaaccttggacggcaaactgctcattatatagtaatttcaccacatccaattttgcaacttcatgaaaaagagcatgtgtagtgagccaatcggagacccagcatggcgtat

SEQ ID NO: 385011 - DNA, 140 bp, Artificial Sequence
  Synthetic
atacgccatgctgggtctccaagacatgtcatgtgttgatcttgttatggataatcacaatgtttcattgtctgaattgcttagctcactggtgatgacagttgaaattagaaaacaaaacgtacttgggagtcggccat

SEQ ID NO: 385012 - DNA, 140 bp, Artificial Sequence
  Synthetic
atggccgactcccaagtacgttttgttttctaatttcaactgtcatcaccagtgagctaagcaattcagacaatgaaacattgtgattatccataacaagatcaacacatgacatgtcttggagacccagcatggcgtat

SEQ ID NO: 385013 - DNA, 140 bp, Artificial Sequence
  Synthetic
atacgccatgctgggtctcctctgaattgcttagctcactggtgatgacagttgaaattagaaaacaaaacatgtcagaatttatggaactttggtcacagggattatcatatgatgatacgtacttgggagtcggccat

SEQ ID NO: 385014 - DNA, 140 bp, Artificial Sequence
  Synthetic
atggccgactcccaagtacgtatcatcatatgataatccctgtgaccaaagttccataaattctgacatgttttgttttctaatttcaactgtcatcaccagtgagctaagcaattcagaggagacccagcatggcgtat

SEQ ID NO: 385015 - DNA, 140 bp, Artificial Sequence
  Synthetic
atacgccatgctgggtctccgagctatggttcaatagcatctttgactgtttatcctcatggtctgttgaattgtaacatcaacaatgtagttagaataaaggttccatttatttatactcgtacttgggagtcggccat

SEQ ID NO: 385016 - DNA, 140 bp, Artificial Sequence
  Synthetic
atggccgactcccaagtacgagtataaataaatggaacctttattctaactacattgttgatgttacaattcaacagaccatgaggataaacagtcaaagatgctattgaaccatagctcggagacccagcatggcgtat

SEQ ID NO: 385017 - DNA, 140 bp, Artificial Sequence
  Synthetic
atacgccatgctgggtctccaattagagtttggtcagaactgaatattggaacaggaacttcagcttacacttcacttaatgttttggctaggtttacagatttggagctgcatgggttacgtacttgggagtcggccat

SEQ ID NO: 385018 - DNA, 140 bp, Artificial Sequence
  Synthetic
atggccgactcccaagtacgtaacccatgcagctccaaatctgtaaacctagccaaaacattaagtgaagtgtaagctgaagttcctgttccaatattcagttctgaccaaactctaattggagacccagcatggcgtat

SEQ ID NO: 385019 - DNA, 140 bp, Artificial Sequence
  Synthetic
aggccctggctgctgatatggttttgcttgtaaatattaattcctgcaggttcagggttctttaatctgtttctctataagaacactcaattttcacgctttctgtcttctttcttccaggaccttttgggacagcggtg

SEQ ID NO: 385020 - DNA, 140 bp, Artificial Sequence
  Synthetic
caccgctgtcccaaaaggtcctggaagaaagaagacagaaagcgtgaaaattgagtgttcttatagagaaacagattaaagaaccctgaacctgcaggaattaatatttacaagcaaaaccatatcagcagccagggcct

SEQ ID NO: 385021 - DNA, 140 bp, Artificial Sequence
  Synthetic
atacgccatgctgggtctcctcatgcttacaagtttgaaaaagattatgaaatgatggaattttattttaatagaggtggtacttattattcaatttcagcaggaaatgttgtgattcaacgtacttgggagtcggccat

SEQ ID NO: 385022 - DNA, 140 bp, Artificial Sequence
  Synthetic
atggccgactcccaagtacgttgaatcacaacatttcctgctgaaattgaataataagtaccacctctattaaaataaaattccatcatttcataatctttttcaaacttgtaagcatgaggagacccagcatggcgtat

SEQ ID NO: 385023 - DNA, 140 bp, Artificial Sequence
  Synthetic
atacgccatgctgggtctcccttttgctttggaccaggaggattggaagtctgatccttctcaaggtggtggaattaaaatcacccattttactacttggacatctattccaaccttagccgtacttgggagtcggccat

SEQ ID NO: 385024 - DNA, 140 bp, Artificial Sequence
  Synthetic
atggccgactcccaagtacggctaaggttggaatagatgtccaagtagtaaaatgggtgattttaattccaccaccttgagaaggatcagacttccaatcctcctggtccaaagcaaaagggagacccagcatggcgtat

SEQ ID NO: 385025 - DNA, 140 bp, Artificial Sequence
  Synthetic
aggccctggctgctgatatgtccaaaatttagagatataacagaacattttattaaaaagagtgatgtacctagagctttgaacaggttggcaacacttgtgacaacagttaatgggactgaccttttgggacagcggtg

SEQ ID NO: 385026 - DNA, 140 bp, Artificial Sequence
  Synthetic
caccgctgtcccaaaaggtcagtcccattaactgttgtcacaagtgttgccaacctgttcaaagctctaggtacatcactctttttaataaaatgttctgttatatctctaaattttggacatatcagcagccagggcct

SEQ ID NO: 385027 - DNA, 140 bp, Artificial Sequence
  Synthetic
atacgccatgctgggtctccttattccagtggatccatattttttccagatgacaaacactaatcctgatcaaaaatgtataactgccctggcttctatctgtcagatgttttgtttttgcgtacttgggagtcggccat

SEQ ID NO: 385028 - DNA, 140 bp, Artificial Sequence
  Synthetic
atggccgactcccaagtacgcaaaaacaaaacatctgacagatagaagccagggcagttatacatttttgatcaggattagtgtttgtcatctggaaaaaatatggatccactggaataaggagacccagcatggcgtat

SEQ ID NO: 385029 - DNA, 140 bp, Artificial Sequence
  Synthetic
aggccctggctgctgatatgcaaaaatgtataactgccctggcttctatctgtcagatgttttgtttttggagaggagaccttgtttttgattttcaggtttttccaaccaaatatcattgaccttttgggacagcggtg

SEQ ID NO: 385030 - DNA, 140 bp, Artificial Sequence
  Synthetic
caccgctgtcccaaaaggtcaatgatatttggttggaaaaacctgaaaatcaaaaacaaggtctcctctccaaaaacaaaacatctgacagatagaagccagggcagttatacatttttgcatatcagcagccagggcct

SEQ ID NO: 385031 - DNA, 140 bp, Artificial Sequence
  Synthetic
aggccctggctgctgatatgagactccatttcaaagttgaggtgaaacctgcctcattcttcaagaatcctcataatgacatgttaaatgtcaatctggcaaaaactaatgagccttttagaccttttgggacagcggtg

SEQ ID NO: 385032 - DNA, 140 bp, Artificial Sequence
  Synthetic
caccgctgtcccaaaaggtctaaaaggctcattagtttttgccagattgacatttaacatgtcattatgaggattcttgaagaatgaggcaggtttcacctcaactttgaaatggagtctcatatcagcagccagggcct

SEQ ID NO: 385033 - DNA, 140 bp, Artificial Sequence
  Synthetic
atacgccatgctgggtctccgattggtggagaatgaggttttatgatcagtgctttgtttgtgacctttcatgatttgtttaaacaaattttcttaaaatttctgaggtttgtacctgctcgtacttgggagtcggccat

SEQ ID NO: 385034 - DNA, 140 bp, Artificial Sequence
  Synthetic
atggccgactcccaagtacgagcaggtacaaacctcagaaattttaagaaaatttgtttaaacaaatcatgaaaggtcacaaacaaagcactgatcataaaacctcattctccaccaatcggagacccagcatggcgtat

SEQ ID NO: 385035 - DNA, 140 bp, Artificial Sequence
  Synthetic
atacgccatgctgggtctcccattacaggagtgcaatcaactttgagattccgtgttccttggatttctgatacaccctatcgcgtgaataggtacacaaagtctgcacatcaaaaaggtcgtacttgggagtcggccat

SEQ ID NO: 385036 - DNA, 140 bp, Artificial Sequence
  Synthetic
atggccgactcccaagtacgacctttttgatgtgcagactttgtgtacctattcacgcgatagggtgtatcagaaatccaaggaacacggaatctcaaagttgattgcactcctgtaatgggagacccagcatggcgtat

SEQ ID NO: 385037 - DNA, 140 bp, Artificial Sequence
  Synthetic
aggccctggctgctgatatgggctggctcaaagaattttatttaatacaacaatgatggaaaattgctcagacttggatgttgttttcactacctgtcccaaggatgaattaagacctctgaccttttgggacagcggtg

SEQ ID NO: 385038 - DNA, 140 bp, Artificial Sequence
  Synthetic
caccgctgtcccaaaaggtcagaggtcttaattcatccttgggacaggtagtgaaaacaacatccaagtctgagcaattttccatcattgttgtattaaataaaattctttgagccagcccatatcagcagccagggcct

SEQ ID NO: 385039 - DNA, 140 bp, Artificial Sequence
  Synthetic
atacgccatgctgggtctccgcagaatgttcctgatccccaggttggcataacaactgcgagggacctaaaagggaaagccaataggggaaagatggatgtttcaggagtgcaagcgcctcgtacttgggagtcggccat

SEQ ID NO: 385040 - DNA, 140 bp, Artificial Sequence
  Synthetic
atggccgactcccaagtacgaggcgcttgcactcctgaaacatccatctttcccctattggctttcccttttaggtccctcgcagttgttatgccaacctggggatcaggaacattctgcggagacccagcatggcgtat

SEQ ID NO: 385041 - DNA, 140 bp, Artificial Sequence
  Synthetic
atacgccatgctgggtctccactatacaattttgtgtagaatgtactggggtccagccattagttatttccatttaaatcctggttttcatactggtgttgcaattggaattgatcctgacgtacttgggagtcggccat

SEQ ID NO: 385042 - DNA, 140 bp, Artificial Sequence
  Synthetic
atggccgactcccaagtacgtcaggatcaattccaattgcaacaccagtatgaaaaccaggatttaaatggaaataactaatggctggaccccagtacattctacacaaaattgtatagtggagacccagcatggcgtat

SEQ ID NO: 385043 - DNA, 140 bp, Artificial Sequence
  Synthetic
aggccctggctgctgatatgggaaaatggacatttcgggtgtccaagctcctgtgggagctattactaccattgaagatccagttttggcaaagaaagtgcctgaaaccttcccagagttgaccttttgggacagcggtg

SEQ ID NO: 385044 - DNA, 140 bp, Artificial Sequence
  Synthetic
caccgctgtcccaaaaggtcaactctgggaaggtttcaggcactttctttgccaaaactggatcttcaatggtagtaatagctcccacaggagcttggacacccgaaatgtccattttcccatatcagcagccagggcct

SEQ ID NO: 385045 - DNA, 140 bp, Artificial Sequence
  Synthetic
aggccctggctgctgatatgttttggagaggccctcattaacacaattatttattccaaacatttgctttataattgttgttatcatgtatgtgggtcaatgccttctgggtctccttgtgaccttttgggacagcggtg

SEQ ID NO: 385046 - DNA, 140 bp, Artificial Sequence
  Synthetic
caccgctgtcccaaaaggtcacaaggagacccagaaggcattgacccacatacatgataacaacaattataaagcaaatgtttggaataaataattgtgttaatgagggcctctccaaaacatatcagcagccagggcct

SEQ ID NO: 385047 - DNA, 140 bp, Artificial Sequence
  Synthetic
atacgccatgctgggtctccataattgttgttatcatgtatgtgggtcaatgccttctgggtctccttgtacagctttgctgaattcaattataaacaatgttaatctgtactatgtcttcgtacttgggagtcggccat

SEQ ID NO: 385048 - DNA, 140 bp, Artificial Sequence
  Synthetic
atggccgactcccaagtacgaagacatagtacagattaacattgtttataattgaattcagcaaagctgtacaaggagacccagaaggcattgacccacatacatgataacaacaattatggagacccagcatggcgtat

SEQ ID NO: 385049 - DNA, 140 bp, Artificial Sequence
  Synthetic
atacgccatgctgggtctccatctgtttcagttgtatagaggaccattggatttgacaattattattacaggagccactgatgtagatggtatggcctggtttactccagtaggccttgccgtacttgggagtcggccat

SEQ ID NO: 385050 - DNA, 140 bp, Artificial Sequence
  Synthetic
atggccgactcccaagtacggcaaggcctactggagtaaaccaggccataccatctacatcagtggctcctgtaataataattgtcaaatccaatggtcctctatacaactgaaacagatggagacccagcatggcgtat

SEQ ID NO: 385051 - DNA, 140 bp, Artificial Sequence
  Synthetic
atacgccatgctgggtctccattgacaatctggattctattggacaaagaattgttgatgagtttaagaaattgggaatgacagctacttcagctgacaagtctgttcctcaattgaaaccgtacttgggagtcggccat

SEQ ID NO: 385052 - DNA, 140 bp, Artificial Sequence
  Synthetic
atggccgactcccaagtacggtttcaattgaggaacagacttgtcagctgaagtagctgtcattcccaatttcttaaactcatcaacaattctttgtccaatagaatccagattgtcaatggagacccagcatggcgtat

SEQ ID NO: 385053 - DNA, 140 bp, Artificial Sequence
  Synthetic
aggccctggctgctgatatgagtgctttgtttgtgacctttcatgatttgtttaaacaaattttcttaaaatttctgaggtttgtttattttatcttttcagtaaataaaaaaaaaaaaagaccttttgggacagcggtg

SEQ ID NO: 385054 - DNA, 140 bp, Artificial Sequence
  Synthetic
caccgctgtcccaaaaggtctttttttttttttatttactgaaaagataaaataaacaaacctcagaaattttaagaaaatttgtttaaacaaatcatgaaaggtcacaaacaaagcactcatatcagcagccagggcct

SEQ ID NO: 385055 - DNA, 140 bp, Artificial Sequence
  Synthetic
aggccctggctgctgatatgcagattagattgccatggtattcttatctgtatgccgtgtctggagcactggatggtttgggagataagacagattctacatttgggctggtctccattcgaccttttgggacagcggtg

SEQ ID NO: 385056 - DNA, 140 bp, Artificial Sequence
  Synthetic
caccgctgtcccaaaaggtcgaatggagaccagcccaaatgtagaatctgtcttatctcccaaaccatccagtgctccagacacggcatacagataagaataccatggcaatctaatctgcatatcagcagccagggcct

SEQ ID NO: 385057 - DNA, 140 bp, Artificial Sequence
  Synthetic
atacgccatgctgggtctccggtttgatatgtgccatggtaccaggagaccagagctatggatcgatagcttctttgacagtttatccccatggtttgttgaattgtaatattaacaatgcgtacttgggagtcggccat

SEQ ID NO: 385058 - DNA, 140 bp, Artificial Sequence
  Synthetic
atggccgactcccaagtacgcattgttaatattacaattcaacaaaccatggggataaactgtcaaagaagctatcgatccatagctctggtctcctggtaccatggcacatatcaaaccggagacccagcatggcgtat

SEQ ID NO: 385059 - DNA, 140 bp, Artificial Sequence
  Synthetic
atacgccatgctgggtctcctggtcagaattaaggttccttttatttacacgagaggagcttatcactttaaggaccctcaatatcccgtttgggagttgactattagggtttggtctgacgtacttgggagtcggccat

SEQ ID NO: 385060 - DNA, 140 bp, Artificial Sequence
  Synthetic
atggccgactcccaagtacgtcagaccaaaccctaatagtcaactcccaaacgggatattgagggtccttaaagtgataagctcctctcgtgtaaataaaaggaaccttaattctgaccaggagacccagcatggcgtat

SEQ ID NO: 385061 - DNA, 140 bp, Artificial Sequence
  Synthetic
atacgccatgctgggtctccattggctgaatccaaagaaaattaacttagcagatagaatgcttggattgtctggagtgcaggaaattaaagaacagggtgttggattgatagcagagtgcgtacttgggagtcggccat

SEQ ID NO: 385062 - DNA, 140 bp, Artificial Sequence
  Synthetic
atggccgactcccaagtacgcactctgctatcaatccaacaccctgttctttaatttcctgcactccagacaatccaagcattctatctgctaagttaattttctttggattcagccaatggagacccagcatggcgtat

SEQ ID NO: 385063 - DNA, 140 bp, Artificial Sequence
  Synthetic
atacgccatgctgggtctccaaagattttccaaatatgtctgaaacagacttgtgtttcctattgcattggctaaatccaaagaaaattaatttagcagatagaatgcttggattgtctgcgtacttgggagtcggccat

SEQ ID NO: 385064 - DNA, 140 bp, Artificial Sequence
  Synthetic
atggccgactcccaagtacgcagacaatccaagcattctatctgctaaattaattttctttggatttagccaatgcaataggaaacacaagtctgtttcagacatatttggaaaatctttggagacccagcatggcgtat

SEQ ID NO: 385065 - DNA, 140 bp, Artificial Sequence
  Synthetic
aggccctggctgctgatatgactttcttggattctattgctgggactctgaaatctatgatgtttggatttcatcattctgtgactgttgaaattataaatactgtactttgttttgttagaccttttgggacagcggtg

SEQ ID NO: 385066 - DNA, 140 bp, Artificial Sequence
  Synthetic
caccgctgtcccaaaaggtctaacaaaacaaagtacagtatttataatttcaacagtcacagaatgatgaaatccaaacatcatagatttcagagtcccagcaatagaatccaagaaagtcatatcagcagccagggcct

SEQ ID NO: 385067 - DNA, 140 bp, Artificial Sequence
  Synthetic
atacgccatgctgggtctccagagtggaattttactttatgtcatacaacaattgaaccaagatgagcactcccatataattggtctgttgagagttatgaattatgcagatattggctgcgtacttgggagtcggccat

SEQ ID NO: 385068 - DNA, 140 bp, Artificial Sequence
  Synthetic
atggccgactcccaagtacgcagccaatatctgcataattcataactctcaacagaccaattatatgggagtgctcatcttggttcaattgttgtatgacataaagtaaaattccactctggagacccagcatggcgtat

SEQ ID NO: 385069 - DNA, 140 bp, Artificial Sequence
  Synthetic
aggccctggctgctgatatgtcccatataattggtctgttgagagttatgaattatgcagatattggctgctcagtcatttcatgtggtaaagtcttttccaaaatgttagaaacagtttgaccttttgggacagcggtg

SEQ ID NO: 385070 - DNA, 140 bp, Artificial Sequence
  Synthetic
caccgctgtcccaaaaggtcaaactgtttctaacattttggaaaagactttaccacatgaaatgactgagcagccaatatctgcataattcataactctcaacagaccaattatatgggacatatcagcagccagggcct

SEQ ID NO: 385071 - DNA, 140 bp, Artificial Sequence
  Synthetic
aggccctggctgctgatatgtaaggatgccatatattggctatatataaaattgaaggacttttatgaagtaaattatggcaagaagaaggatgttcttaatattcttaaagataaccaggaccttttgggacagcggtg

SEQ ID NO: 385072 - DNA, 140 bp, Artificial Sequence
  Synthetic
caccgctgtcccaaaaggtcctggttatctttaagaatattaagaacatccttcttcttgccataatttacttcataaaagtccttcaattttatatatagccaatatatggcatccttacatatcagcagccagggcct

SEQ ID NO: 385073 - DNA, 140 bp, Artificial Sequence
  Synthetic
aggccctggctgctgatatgaattcaagatgtggagaaatttgatcagtatcagaaaggggttgatttaatacaaaagttgagaactgtccactcaatggctcaagttgaccctaatcttgaccttttgggacagcggtg

SEQ ID NO: 385074 - DNA, 140 bp, Artificial Sequence
  Synthetic
caccgctgtcccaaaaggtcaagattagggtcaacttgagccattgagtggacagttctcaacttttgtattaaatcaacccctttctgatactgatcaaatttctccacatcttgaattcatatcagcagccagggcct

SEQ ID NO: 385075 - DNA, 140 bp, Artificial Sequence
  Synthetic
atacgccatgctgggtctccattgaagatccagttttggcaaagaaagtgcctgaaacctttccagaattaaagcctggagagtcaagacatacctctgatcacatgtctatttacaaatcgtacttgggagtcggccat

SEQ ID NO: 385076 - DNA, 140 bp, Artificial Sequence
  Synthetic
atggccgactcccaagtacgatttgtaaatagacatgtgatcagaggtatgtcttgactctccaggctttaattctggaaaggtttcaggcactttctttgccaaaactggatcttcaatggagacccagcatggcgtat

SEQ ID NO: 385077 - DNA, 140 bp, Artificial Sequence
  Synthetic
atacgccatgctgggtctccggggttcatttgtcacctcttagagattgtatagctagagtccaccaaaagctcaagaatcttggatctataaaccaggctatggtgacaaggtgtgagccgtacttgggagtcggccat

SEQ ID NO: 385078 - DNA, 140 bp, Artificial Sequence
  Synthetic
atggccgactcccaagtacggctcacaccttgtcaccatagcctggtttatagatccaagattcttgagcttttggtggactctagctatacaatctctaagaggtgacaaatgaaccccggagacccagcatggcgtat

SEQ ID NO: 385079 - DNA, 140 bp, Artificial Sequence
  Synthetic
aggccctggctgctgatatgggggtcccttggatttgacaataattataactggggctactgatgttgatggaatggcttggtttactcccgttgggttggcagtagacaccccatgggtgaccttttgggacagcggtg

SEQ ID NO: 385080 - DNA, 140 bp, Artificial Sequence
  Synthetic
caccgctgtcccaaaaggtcacccatggggtgtctactgccaacccaacgggagtaaaccaagccattccatcaacatcagtagccccagttataattattgtcaaatccaagggacccccatatcagcagccagggcct

SEQ ID NO: 385081 - DNA, 140 bp, Artificial Sequence
  Synthetic
aggccctggctgctgatatgactggtgcttcttatttcacttctgtagaccaatcttcagttcacactgctgaagttggctcacatcaaattgaacctttgaaaacctctgttgataaacgaccttttgggacagcggtg

SEQ ID NO: 385082 - DNA, 140 bp, Artificial Sequence
  Synthetic
caccgctgtcccaaaaggtcgtttatcaacagaggttttcaaaggttcaatttgatgtgagccaacttcagcagtgtgaactgaagattggtctacagaagtgaaataagaagcaccagtcatatcagcagccagggcct

SEQ ID NO: 385083 - DNA, 140 bp, Artificial Sequence
  Synthetic
aggccctggctgctgatatgttcattttttaaaaatcctcacaatgatatgttgaatgttaatttggctaaaacaaatgatgcaattaaggacatgtcatgtgttgatttaataatggatgaccttttgggacagcggtg

SEQ ID NO: 385084 - DNA, 140 bp, Artificial Sequence
  Synthetic
caccgctgtcccaaaaggtcatccattattaaatcaacacatgacatgtccttaattgcatcatttgttttagccaaattaacattcaacatatcattgtgaggatttttaaaaaatgaacatatcagcagccagggcct

SEQ ID NO: 385085 - DNA, 140 bp, Artificial Sequence
  Synthetic
aggccctggctgctgatatggagtgcttgtgggaggatggtttgtatataagcatttctcccgcaaagaggaagaaccaattccagctgaaggggtatatcatggcgtgaccaagcccaagaccttttgggacagcggtg

SEQ ID NO: 385086 - DNA, 140 bp, Artificial Sequence
  Synthetic
caccgctgtcccaaaaggtcttgggcttggtcacgccatgatataccccttcagctggaattggttcttcctctttgcgggagaaatgcttatatacaaaccatcctcccacaagcactccatatcagcagccagggcct

SEQ ID NO: 385087 - DNA, 140 bp, Artificial Sequence
  Synthetic
atacgccatgctgggtctccgaagaaccaattccagctgaaggggtatatcatggcgtgaccaagcccaaacaggtgattaaattggacgcagatccagtagagtctcagtcaactttagcgtacttgggagtcggccat

SEQ ID NO: 385088 - DNA, 140 bp, Artificial Sequence
  Synthetic
atggccgactcccaagtacgctaaagttgactgagactctactggatctgcgtccaatttaatcacctgtttgggcttggtcacgccatgatataccccttcagctggaattggttcttcggagacccagcatggcgtat

SEQ ID NO: 385089 - DNA, 140 bp, Artificial Sequence
  Synthetic
aggccctggctgctgatatgacaggtgattaaattggacgcagatccagtagagtctcagtcaactttagaaatagcaggattagttaggaaaaatttggttcagtttggagttggcgaggaccttttgggacagcggtg

SEQ ID NO: 385090 - DNA, 140 bp, Artificial Sequence
  Synthetic
caccgctgtcccaaaaggtcctcgccaactccaaactgaaccaaatttttcctaactaatcctgctatttctaaagttgactgagactctactggatctgcgtccaatttaatcacctgtcatatcagcagccagggcct

SEQ ID NO: 385091 - DNA, 140 bp, Artificial Sequence
  Synthetic
atacgccatgctgggtctccaaaaaggagtgggattgattggtgagtgccgagctttcctggactctataactagcaccttaaagtcaatgatgtttggtttccatcactctgtcacagtcgtacttgggagtcggccat

SEQ ID NO: 385092 - DNA, 140 bp, Artificial Sequence
  Synthetic
atggccgactcccaagtacgactgtgacagagtgatggaaaccaaacatcattgactttaaggtgctagttatagagtccaggaaagctcggcactcaccaatcaatcccactcctttttggagacccagcatggcgtat

SEQ ID NO: 385093 - DNA, 140 bp, Artificial Sequence
  Synthetic
aggccctggctgctgatatgactagcaccttaaagtcaatgatgtttggtttccatcactctgtcacagttgaaattattaatactgttttatgttttgtcaaaagtggcattctgctatgaccttttgggacagcggtg

SEQ ID NO: 385094 - DNA, 140 bp, Artificial Sequence
  Synthetic
caccgctgtcccaaaaggtcatagcagaatgccacttttgacaaaacataaaacagtattaataatttcaactgtgacagagtgatggaaaccaaacatcattgactttaaggtgctagtcatatcagcagccagggcct

SEQ ID NO: 385095 - DNA, 140 bp, Artificial Sequence
  Synthetic
aggccctggctgctgatatgtactcctatctttatgctgtttcaggggctctggatgggcttggagataaaacagattcaacttttgggcttgtctccattcaaattgcaaactataatcgaccttttgggacagcggtg

SEQ ID NO: 385096 - DNA, 140 bp, Artificial Sequence
  Synthetic
caccgctgtcccaaaaggtcgattatagtttgcaatttgaatggagacaagcccaaaagttgaatctgttttatctccaagcccatccagagcccctgaaacagcataaagataggagtacatatcagcagccagggcct

SEQ ID NO: 385097 - DNA, 140 bp, Artificial Sequence
  Synthetic
atacgccatgctgggtctccggaggaaaaagccacttatgttcataagaagaatgatggtactacagttgacttgactgtggatcaggcatggagaggaaaaggtgaaggtcttcctggacgtacttgggagtcggccat

SEQ ID NO: 385098 - DNA, 140 bp, Artificial Sequence
  Synthetic
atggccgactcccaagtacgtccaggaagaccttcaccttttcctctccatgcctgatccacagtcaagtcaactgtagtaccatcattcttcttatgaacataagtggctttttcctccggagacccagcatggcgtat

SEQ ID NO: 385099 - DNA, 140 bp, Artificial Sequence
  Synthetic
aggccctggctgctgatatggctttacacaaaaatcagagaatattatgatctgaattatggtaataaaaaggatgttcttaatattctgaaagatcaccaacaaaaaatagagagagcagaccttttgggacagcggtg

SEQ ID NO: 385100 - DNA, 140 bp, Artificial Sequence
  Synthetic
caccgctgtcccaaaaggtctgctctctctattttttgttggtgatctttcagaatattaagaacatcctttttattaccataattcagatcataatattctctgatttttgtgtaaagccatatcagcagccagggcct

SEQ ID NO: 385101 - DNA, 140 bp, Artificial Sequence
  Synthetic
aggccctggctgctgatatgtttgggtattcatgttgctggaggaaattcaattcttgtggcaaagttggttactcaagaaatgtttcaaaatattgataagaaaattgaaagtcagagagaccttttgggacagcggtg

SEQ ID NO: 385102 - DNA, 140 bp, Artificial Sequence
  Synthetic
caccgctgtcccaaaaggtctctctgactttcaattttcttatcaatattttgaaacatttcttgagtaaccaactttgccacaagaattgaatttcctccagcaacatgaatacccaaacatatcagcagccagggcct

SEQ ID NO: 385103 - DNA, 140 bp, Artificial Sequence
  Synthetic
aggccctggctgctgatatggctttttagaaagagtcccatttatcaccacattgataaaaccatgattaattttcctgcagctatgcccttttcaaaggctgaaattgatccaatggctgaccttttgggacagcggtg

SEQ ID NO: 385104 - DNA, 140 bp, Artificial Sequence
  Synthetic
caccgctgtcccaaaaggtcagccattggatcaatttcagcctttgaaaagggcatagctgcaggaaaattaatcatggttttatcaatgtggtgataaatgggactctttctaaaaagccatatcagcagccagggcct

SEQ ID NO: 385105 - DNA, 140 bp, Artificial Sequence
  Synthetic
aggccctggctgctgatatgcaaagaagcttcagttttttatcaaaacaaaataataggcaagactcagttagttgatgattttctagatcttgatatggctattacaggggctccaggcgaccttttgggacagcggtg

SEQ ID NO: 385106 - DNA, 140 bp, Artificial Sequence
  Synthetic
caccgctgtcccaaaaggtcgcctggagcccctgtaatagccatatcaagatctagaaaatcatcaactaactgagtcttgcctattattttgttttgataaaaaactgaagcttctttgcatatcagcagccagggcct

SEQ ID NO: 385107 - DNA, 140 bp, Artificial Sequence
  Synthetic
aggccctggctgctgatatgaaaatttgtaaacattatggtgttgagcctgagaaaaatatatatacaaaacctgttgcatctgattattgggatggatatagtggacaactagtgtgtagaccttttgggacagcggtg

SEQ ID NO: 385108 - DNA, 140 bp, Artificial Sequence
  Synthetic
caccgctgtcccaaaaggtctacacactagttgtccactatatccatcccaataatcagatgcaacaggttttgtatatatatttttctcaggctcaacaccataatgtttacaaattttcatatcagcagccagggcct

SEQ ID NO: 385109 - DNA, 140 bp, Artificial Sequence
  Synthetic
aggccctggctgctgatatgattgatgctattaatatggattcatctcctgggtttccttatgtccaagaaaaattgaccaaaagagatttaatttggttggatgaaaatggtttactgtgaccttttgggacagcggtg

SEQ ID NO: 385110 - DNA, 140 bp, Artificial Sequence
  Synthetic
caccgctgtcccaaaaggtcacagtaaaccattttcatccaaccaaattaaatctcttttggtcaatttttcttggacataaggaaacccaggagatgaatccatattaatagcatcaatcatatcagcagccagggcct

SEQ ID NO: 385111 - DNA, 140 bp, Artificial Sequence
  Synthetic
atacgccatgctgggtctccgttttgtacctgggaatgaattgattgatgtttctcacattacattgaagcaagcaaccactgcaccttgtgctgtgatggatattactggtgttcagtccgtacttgggagtcggccat

SEQ ID NO: 385112 - DNA, 140 bp, Artificial Sequence
  Synthetic
atggccgactcccaagtacggactgaacaccagtaatatccatcacagcacaaggtgcagtggttgcttgcttcaatgtaatgtgagaaacatcaatcaattcattcccaggtacaaaacggagacccagcatggcgtat

SEQ ID NO: 385113 - DNA, 140 bp, Artificial Sequence
  Synthetic
atacgccatgctgggtctcctaggagttcatcctagattggctcagagaattttatttaatactgttatgatggaaaattgttctgacctagatgttatttttacaacttgtccaaaagacgtacttgggagtcggccat

SEQ ID NO: 385114 - DNA, 140 bp, Artificial Sequence
  Synthetic
atggccgactcccaagtacgtcttttggacaagttgtaaaaataacatctaggtcagaacaattttccatcataacagtattaaataaaattctctgagccaatctaggatgaactcctaggagacccagcatggcgtat

SEQ ID NO: 385115 - DNA, 140 bp, Artificial Sequence
  Synthetic
aggccctggctgctgatatgatggaaaattgttctgacctagatgttatttttacaacttgtccaaaagatgagttgagaccattagagaaagttttggaatcaaaaacaagagcaattggaccttttgggacagcggtg

SEQ ID NO: 385116 - DNA, 140 bp, Artificial Sequence
  Synthetic
caccgctgtcccaaaaggtccaattgctcttgtttttgattccaaaactttctctaatggtctcaactcatcttttggacaagttgtaaaaataacatctaggtcagaacaattttccatcatatcagcagccagggcct

SEQ ID NO: 385117 - DNA, 140 bp, Artificial Sequence
  Synthetic
aggccctggctgctgatatgtgagttgagaccattagagaaagttttggaatcaaaaacaagagcaattgatgcttgtcccttggattatacaattctatgtcgaatgtattggggtccagaccttttgggacagcggtg

SEQ ID NO: 385118 - DNA, 140 bp, Artificial Sequence
  Synthetic
caccgctgtcccaaaaggtctggaccccaatacattcgacatagaattgtataatccaagggacaagcatcaattgctcttgtttttgattccaaaactttctctaatggtctcaactcacatatcagcagccagggcct

SEQ ID NO: 385119 - DNA, 140 bp, Artificial Sequence
  Synthetic
aggccctggctgctgatatgatgcttgtcccttggattatacaattctatgtcgaatgtattggggtccagctattagttattttcatctgaatccagggtttcacacaggtgttgctatgaccttttgggacagcggtg

SEQ ID NO: 385120 - DNA, 140 bp, Artificial Sequence
  Synthetic
caccgctgtcccaaaaggtcatagcaacacctgtgtgaaaccctggattcagatgaaaataactaatagctggaccccaatacattcgacatagaattgtataatccaagggacaagcatcatatcagcagccagggcct

SEQ ID NO: 385121 - DNA, 140 bp, Artificial Sequence
  Synthetic
aggccctggctgctgatatgtggcatagatcctgatagacagtgggatgaattatttaaaacaatgataagatttggggatgttggtcttgatttagatttttccgcctttgatgctagtgaccttttgggacagcggtg

SEQ ID NO: 385122 - DNA, 140 bp, Artificial Sequence
  Synthetic
caccgctgtcccaaaaggtcactagcatcaaaggcggaaaaatctaaatcaagaccaacatccccaaatcttatcattgttttaaataattcatcccactgtctatcaggatctatgccacatatcagcagccagggcct

SEQ ID NO: 385123 - DNA, 140 bp, Artificial Sequence
  Synthetic
aggccctggctgctgatatgatgacagtgcagttgctgaatttttccaatcttttccctctggtgagccatctgggtcaaggttgacacaatttttccaatcagttaccaaccataagtggaccttttgggacagcggtg

SEQ ID NO: 385124 - DNA, 140 bp, Artificial Sequence
  Synthetic
caccgctgtcccaaaaggtccacttatggttggtaactgattggaaaaattgtgtcaaccttgacccagatggctcaccagagggaaaagattggaaaaattcagcaactgcactgtcatcatatcagcagccagggcct

SEQ ID NO: 385125 - DNA, 140 bp, Artificial Sequence
  Synthetic
aggccctggctgctgatatgggtatgtctataagcattttacaaagaagcaagaagagtccattccgagtgaaggagtgtatcatggtgtgacaaaaccaaaacaagtaattaaactggagaccttttgggacagcggtg

SEQ ID NO: 385126 - DNA, 140 bp, Artificial Sequence
  Synthetic
caccgctgtcccaaaaggtctccagtttaattacttgttttggttttgtcacaccatgatacactccttcactcggaatggactcttcttgcttctttgtaaaatgcttatagacatacccatatcagcagccagggcct

SEQ ID NO: 385127 - DNA, 140 bp, Artificial Sequence
  Synthetic
aggccctggctgctgatatgggacgagttcaaaaaacttggcatgacagctacttcagctgataaaaatgtgcctcaactgaaaccagtttcagaattgacttttcttaaaagatcttttgaccttttgggacagcggtg

SEQ ID NO: 385128 - DNA, 140 bp, Artificial Sequence
  Synthetic
caccgctgtcccaaaaggtcaaaagatcttttaagaaaagtcaattctgaaactggtttcagttgaggcacatttttatcagctgaagtagctgtcatgccaagttttttgaactcgtcccatatcagcagccagggcct

SEQ ID NO: 385129 - DNA, 140 bp, Artificial Sequence
  Synthetic
atacgccatgctgggtctcccctggagaggtaaaggagaaggtctgccagggatgtgtggtggagccttgatttcttccaatcagtccattcagaatgccattttaggaattcacgttgccgtacttgggagtcggccat

SEQ ID NO: 385130 - DNA, 140 bp, Artificial Sequence
  Synthetic
atggccgactcccaagtacggcaacgtgaattcctaaaatggcattctgaatggactgattggaagaaatcaaggctccaccacacatccctggcagaccttctcctttacctctccaggggagacccagcatggcgtat

SEQ ID NO: 385131 - DNA, 140 bp, Artificial Sequence
  Synthetic
aggccctggctgctgatatgttggaagtccatggtgaggggacttgatacctcaccgccgtttgcctaggctataggctaaatttccctttccctgtccttcccctatttccttttgtttgaccttttgggacagcggtg

SEQ ID NO: 385132 - DNA, 140 bp, Artificial Sequence
  Synthetic
caccgctgtcccaaaaggtcaaacaaaaggaaataggggaaggacagggaaagggaaatttagcctatagcctaggcaaacggcggtgaggtatcaagtcccctcaccatggacttccaacatatcagcagccagggcct

SEQ ID NO: 385133 - DNA, 140 bp, Artificial Sequence
  Synthetic
aggccctggctgctgatatgagtttaatgaccagtgctttgtttgtgacctttcatgatttgtttaaacaaattttcttaaaatttctgaggtttgtttattttgtcttttcagtaaatagaccttttgggacagcggtg

SEQ ID NO: 385134 - DNA, 140 bp, Artificial Sequence
  Synthetic
caccgctgtcccaaaaggtctatttactgaaaagacaaaataaacaaacctcagaaattttaagaaaatttgtttaaacaaatcatgaaaggtcacaaacaaagcactggtcattaaactcatatcagcagccagggcct

SEQ ID NO: 385135 - DNA, 140 bp, Artificial Sequence
  Synthetic
atacgccatgctgggtctccagatttgatttggcttgatgataatggaatgtttttgggtctgcatcctaggctggcacaaagaattttatttaatacaacaatgatggaaaattgctcacgtacttgggagtcggccat

SEQ ID NO: 385136 - DNA, 140 bp, Artificial Sequence
  Synthetic
atggccgactcccaagtacgtgagcaattttccatcattgttgtattaaataaaattctttgtgccagcctaggatgcagacccaaaaacattccattatcatcaagccaaatcaaatctggagacccagcatggcgtat

SEQ ID NO: 385137 - DNA, 140 bp, Artificial Sequence
  Synthetic
aggccctggctgctgatatgtgaaattaggaaacaaaacatgactgaattcatggagttgtggtctcagggaatttcagatgatgacaatgatagtgcagtagctgagtttttccagtctgaccttttgggacagcggtg

SEQ ID NO: 385138 - DNA, 140 bp, Artificial Sequence
  Synthetic
caccgctgtcccaaaaggtcagactggaaaaactcagctactgcactatcattgtcatcatctgaaattccctgagaccacaactccatgaattcagtcatgttttgtttcctaatttcacatatcagcagccagggcct

SEQ ID NO: 385139 - DNA, 140 bp, Artificial Sequence
  Synthetic
aggccctggctgctgatatggatttggatgttgtttttactacctgtcccaaggatgaattaagacctctggacaaagtattggaatctaaaactagggctattgattcttgtcctcttggaccttttgggacagcggtg

SEQ ID NO: 385140 - DNA, 140 bp, Artificial Sequence
  Synthetic
caccgctgtcccaaaaggtccaagaggacaagaatcaatagccctagttttagattccaatactttgtccagaggtcttaattcatccttgggacaggtagtaaaaacaacatccaaatccatatcagcagccagggcct

SEQ ID NO: 385141 - DNA, 140 bp, Artificial Sequence
  Synthetic
atacgccatgctgggtctccctgaggtactcaggggcatttaggtttttcctcattcttaaacaataatgaatatgtccaaacaaggaattttccagactgttgggagtggtcttgaccacgtacttgggagtcggccat

SEQ ID NO: 385142 - DNA, 140 bp, Artificial Sequence
  Synthetic
atggccgactcccaagtacgtggtcaagaccactcccaacagtctggaaaattccttgtttggacatattcattattgtttaagaatgaggaaaaacctaaatgcccctgagtacctcagggagacccagcatggcgtat

SEQ ID NO: 385143 - DNA, 140 bp, Artificial Sequence
  Synthetic
atacgccatgctgggtctccataagggaagctggaagaatcctcactgagatgtctggagcccctattcattttggagaggctctcattaacacaattatttactctaaacatttgctttcgtacttgggagtcggccat

SEQ ID NO: 385144 - DNA, 140 bp, Artificial Sequence
  Synthetic
atggccgactcccaagtacgaaagcaaatgtttagagtaaataattgtgttaatgagagcctctccaaaatgaataggggctccagacatctcagtgaggattcttccagcttcccttatggagacccagcatggcgtat

SEQ ID NO: 385145 - DNA, 140 bp, Artificial Sequence
  Synthetic
aggccctggctgctgatatgctctgttgataaacctggttctaagaagactcagggggagaagtttttcctgattcattctgctgattggctcactacacatgctctttttcatgaagttgaccttttgggacagcggtg

SEQ ID NO: 385146 - DNA, 140 bp, Artificial Sequence
  Synthetic
caccgctgtcccaaaaggtcaacttcatgaaaaagagcatgtgtagtgagccaatcagcagaatgaatcaggaaaaacttctccccctgagtcttcttagaaccaggtttatcaacagagcatatcagcagccagggcct

SEQ ID NO: 385147 - DNA, 140 bp, Artificial Sequence
  Synthetic
aggccctggctgctgatatgaggtttgttgagataccatacatatgcaagatttggcattgagattcaagttcagataaaccccacaccctttcagcaagggggactaatttgtgccatggaccttttgggacagcggtg

SEQ ID NO: 385148 - DNA, 140 bp, Artificial Sequence
  Synthetic
caccgctgtcccaaaaggtccatggcacaaattagtcccccttgctgaaagggtgtggggtttatctgaacttgaatctcaatgccaaatcttgcatatgtatggtatctcaacaaacctcatatcagcagccagggcct

SEQ ID NO: 385149 - DNA, 140 bp, Artificial Sequence
  Synthetic
aggccctggctgctgatatgagaatcaggcctgctattgctgagaaaaccatatggtcattagttgcatggcaaaggaacaatgctgaatttgaacagaatttagagaatgcccagtggtgaccttttgggacagcggtg

SEQ ID NO: 385150 - DNA, 140 bp, Artificial Sequence
  Synthetic
caccgctgtcccaaaaggtcaccactgggcattctctaaattctgttcaaattcagcattgttcctttgccatgcaactaatgaccatatggttttctcagcaatagcaggcctgattctcatatcagcagccagggcct

SEQ ID NO: 385151 - DNA, 140 bp, Artificial Sequence
  Synthetic
aggccctggctgctgatatggttcctggtgaccaaagttatggttcgatagcatccttgactgtttatcctcatggtctgttaaattgtaacatcaacaatgtagttagaataaaggttcgaccttttgggacagcggtg

SEQ ID NO: 385152 - DNA, 140 bp, Artificial Sequence
  Synthetic
caccgctgtcccaaaaggtcgaacctttattctaactacattgttgatgttacaatttaacagaccatgaggataaacagtcaaggatgctatcgaaccataactttggtcaccaggaaccatatcagcagccagggcct

SEQ ID NO: 385153 - DNA, 140 bp, Artificial Sequence
  Synthetic
atacgccatgctgggtctcccattcatttatactagaggtgcttatcatttcaaagatccacagtacccagtttgggaattaacaatcagagtttggtcagagttgaatattggaacaggcgtacttgggagtcggccat

SEQ ID NO: 385154 - DNA, 140 bp, Artificial Sequence
  Synthetic
atggccgactcccaagtacgcctgttccaatattcaactctgaccaaactctgattgttaattcccaaactgggtactgtggatctttgaaatgataagcacctctagtataaatgaatgggagacccagcatggcgtat

SEQ ID NO: 385155 - DNA, 140 bp, Artificial Sequence
  Synthetic
atacgccatgctgggtctccaacttcagcttacacttcacttaacgttctagctaggtttacagatttggagttgcatgggttaactcctctttctacacagatgatgagaaatgaatttcgtacttgggagtcggccat

SEQ ID NO: 385156 - DNA, 140 bp, Artificial Sequence
  Synthetic
atggccgactcccaagtacgaaattcatttctcatcatctgtgtagaaagaggagttaacccatgcaactccaaatctgtaaacctagctagaacgttaagtgaagtgtaagctgaagttggagacccagcatggcgtat

SEQ ID NO: 385157 - DNA, 140 bp, Artificial Sequence
  Synthetic
aggccctggctgctgatatgcctctcaaggtggtggaattaaaatcactcattttactacttggacatctattccaactttagctgcccagtttccatttaatgcttcagattcggttgggaccttttgggacagcggtg

SEQ ID NO: 385158 - DNA, 140 bp, Artificial Sequence
  Synthetic
caccgctgtcccaaaaggtcccaaccgaatctgaagcattaaatggaaactgggcagctaaagttggaatagatgtccaagtagtaaaatgagtgattttaattccaccaccttgagaggcatatcagcagccagggcct

SEQ ID NO: 385159 - DNA, 140 bp, Artificial Sequence
  Synthetic
aggccctggctgctgatatgtgaggggacttgatacctcaccgccgtttgcctaggctataggctaaacctccctttccctgccctccccctatttccctttgttttgtttgtaaatattgaccttttgggacagcggtg

SEQ ID NO: 385160 - DNA, 140 bp, Artificial Sequence
  Synthetic
caccgctgtcccaaaaggtcaatatttacaaacaaaacaaagggaaatagggggagggcagggaaagggaggtttagcctatagcctaggcaaacggcggtgaggtatcaagtcccctcacatatcagcagccagggcct

SEQ ID NO: 385161 - DNA, 140 bp, Artificial Sequence
  Synthetic
aggccctggctgctgatatgatgttttgcttttggaggggagatcttgtttttgattttcaggtttttccaaccaaatatcattcaggtagattattgttttgctttgttcctgggaatggaccttttgggacagcggtg

SEQ ID NO: 385162 - DNA, 140 bp, Artificial Sequence
  Synthetic
caccgctgtcccaaaaggtccattcccaggaacaaagcaaaacaataatctacctgaatgatatttggttggaaaaacctgaaaatcaaaaacaagatctcccctccaaaagcaaaacatcatatcagcagccagggcct

SEQ ID NO: 385163 - DNA, 140 bp, Artificial Sequence
  Synthetic
atacgccatgctgggtctccggttggaaaacaaagactcaagtatgctcaggaagagttgtcaaatgaagtgcttccacctcctagaaaagtgaaaggagttttttcccaggctaaaattcgtacttgggagtcggccat

SEQ ID NO: 385164 - DNA, 140 bp, Artificial Sequence
  Synthetic
atggccgactcccaagtacgaattttagcctgggaaaaaactcctttcacttttctaggaggtggaagcacttcatttgacaactcttcctgagcatacttgagtctttgttttccaaccggagacccagcatggcgtat

SEQ ID NO: 385165 - DNA, 140 bp, Artificial Sequence
  Synthetic
atacgccatgctgggtctccggtgtaactaagcccaagcaagtgattaaattagatgcagatccagtagaatctcagtcaactttggaaatagcaggactggttaggaagaacttggttccgtacttgggagtcggccat

SEQ ID NO: 385166 - DNA, 140 bp, Artificial Sequence
  Synthetic
atggccgactcccaagtacggaaccaagttcttcctaaccagtcctgctatttccaaagttgactgagattctactggatctgcatctaatttaatcacttgcttgggcttagttacaccggagacccagcatggcgtat

SEQ ID NO: 385167 - DNA, 140 bp, Artificial Sequence
  Synthetic
aggccctggctgctgatatgctatggatgttaccacacaggttggagatgattcaggaggtttttcaacaacagtttctacagagcagaatgttcctgatccccaagtcggcataacaacgaccttttgggacagcggtg

SEQ ID NO: 385168 - DNA, 140 bp, Artificial Sequence
  Synthetic
caccgctgtcccaaaaggtcgttgttatgccgacttggggatcaggaacattctgctctgtagaaactgttgttgaaaaacctcctgaatcatctccaacctgtgtggtaacatccatagcatatcagcagccagggcct

SEQ ID NO: 385169 - DNA, 140 bp, Artificial Sequence
  Synthetic
atacgccatgctgggtctccaagattggaaatctgatgcctctcaagggggaggaattaaaattacacattttacaacttggacatcaattcccactttggctgctcagtttccattcaacgtacttgggagtcggccat

SEQ ID NO: 385170 - DNA, 140 bp, Artificial Sequence
  Synthetic
atggccgactcccaagtacgttgaatggaaactgagcagccaaagtgggaattgatgtccaagttgtaaaatgtgtaattttaattcctcccccttgagaggcatcagatttccaatcttggagacccagcatggcgtat

SEQ ID NO: 385171 - DNA, 140 bp, Artificial Sequence
  Synthetic
atacgccatgctgggtctccttctgtgtacttttaccttcaattcaaataataaagagtacacatttccaataactctgtcttcgacttctaatcctcctcatggtttaccatcaacattcgtacttgggagtcggccat

SEQ ID NO: 385172 - DNA, 140 bp, Artificial Sequence
  Synthetic
atggccgactcccaagtacgaatgttgatggtaaaccatgaggaggattagaagtcgaagacagagttattggaaatgtgtactctttattatttgaattgaaggtaaaagtacacagaaggagacccagcatggcgtat

SEQ ID NO: 385173 - DNA, 140 bp, Artificial Sequence
  Synthetic
atacgccatgctgggtctccatagatacactaaatcgtcacatcagaagggagagtatactgccataggaaagttgattgtttattgttacaacagactaacttctccttccaatgtggccgtacttgggagtcggccat

SEQ ID NO: 385174 - DNA, 140 bp, Artificial Sequence
  Synthetic
atggccgactcccaagtacggccacattggaaggagaagttagtctgttgtaacaataaacaatcaactttcctatggcagtatactctcccttctgatgtgacgatttagtgtatctatggagacccagcatggcgtat

SEQ ID NO: 385175 - DNA, 140 bp, Artificial Sequence
  Synthetic
aggccctggctgctgatatggaacagggaacattcagattagattgccatggtattcttatttgtatgccgtgtctggagcactggatggcttgggagataagacagattctacatttgggaccttttgggacagcggtg

SEQ ID NO: 385176 - DNA, 140 bp, Artificial Sequence
  Synthetic
caccgctgtcccaaaaggtcccaaatgtagaatctgtcttatctcccaagccatccagtgctccagacacggcatacaaataagaataccatggcaatctaatctgaatgttccctgttccatatcagcagccagggcct

SEQ ID NO: 385177 - DNA, 140 bp, Artificial Sequence
  Synthetic
aggccctggctgctgatatgggctctggccgttgcgcccggcggggtcaactccatgattagcatggagctgtaggagtctaaattggggacgcagatgtttgggacgtcaccttgcagtgaccttttgggacagcggtg

SEQ ID NO: 385178 - DNA, 140 bp, Artificial Sequence
  Synthetic
caccgctgtcccaaaaggtcactgcaaggtgacgtcccaaacatctgcgtccccaatttagactcctacagctccatgctaatcatggagttgaccccgccgggcgcaacggccagagcccatatcagcagccagggcct

SEQ ID NO: 385179 - DNA, 140 bp, Artificial Sequence
  Synthetic
atacgccatgctgggtctcctcaagttgggatcacaacactgaaggatcttaaaggtagagcaaaccaagggaaaatggatatctcaggtgtccaagctcctgtgggagccattactactcgtacttgggagtcggccat

SEQ ID NO: 385180 - DNA, 140 bp, Artificial Sequence
  Synthetic
atggccgactcccaagtacgagtagtaatggctcccacaggagcttggacacctgagatatccattttcccttggtttgctctacctttaagatccttcagtgttgtgatcccaacttgaggagacccagcatggcgtat

SEQ ID NO: 385181 - DNA, 140 bp, Artificial Sequence
  Synthetic
aggccctggctgctgatatgagagctccattaaactcaaatgctatgttgtccactgagtccatgatgagtagaattgcagctggagacttggagtcatcggtggatgatcctagatcaggaccttttgggacagcggtg

SEQ ID NO: 385182 - DNA, 140 bp, Artificial Sequence
  Synthetic
caccgctgtcccaaaaggtcctgatctaggatcatccaccgatgactccaagtctccagctgcaattctactcatcatggactcagtggacaacatagcatttgagtttaatggagctctcatatcagcagccagggcct

SEQ ID NO: 385183 - DNA, 140 bp, Artificial Sequence
  Synthetic
aggccctggctgctgatatgtagaattgcagctggagacttggagtcatcggtggatgatcctagatcagaggaggacagaagatttgagagtcatatagaatgtaggaaaccatacaaagaccttttgggacagcggtg

SEQ ID NO: 385184 - DNA, 140 bp, Artificial Sequence
  Synthetic
caccgctgtcccaaaaggtctttgtatggtttcctacattctatatgactctcaaatcttctgtcctcctctgatctaggatcatccaccgatgactccaagtctccagctgcaattctacatatcagcagccagggcct

SEQ ID NO: 385185 - DNA, 140 bp, Artificial Sequence
  Synthetic
atacgccatgctgggtctcctggattgccttcaactctgagatggttctttaacctttttcagctttataggggtcccttggatttgacaataattataactggggctactgatgttgatcgtacttgggagtcggccat

SEQ ID NO: 385186 - DNA, 140 bp, Artificial Sequence
  Synthetic
atggccgactcccaagtacgatcaacatcagtagccccagttataattattgtcaaatccaagggacccctataaagctgaaaaaggttaaagaaccatctcagagttgaaggcaatccaggagacccagcatggcgtat

SEQ ID NO: 385187 - DNA, 140 bp, Artificial Sequence
  Synthetic
atacgccatgctgggtctccttttcttggagaggagtgactgctgatactagggctttgagaagatttggattctctatggccgctggtagaagtgtgtggactcttgagatggatgctgcgtacttgggagtcggccat

SEQ ID NO: 385188 - DNA, 140 bp, Artificial Sequence
  Synthetic
atggccgactcccaagtacgcagcatccatctcaagagtccacacacttctaccagcggccatagagaatccaaatcttctcaaagccctagtatcagcagtcactcctctccaagaaaaggagacccagcatggcgtat

SEQ ID NO: 385189 - DNA, 140 bp, Artificial Sequence
  Synthetic
atacgccatgctgggtctccttaggtttaacaccagaagaacaggaaacattcagattaggttgccctggtactcctatctttatgctgtttcaggggccctggatgggcttggagacaacgtacttgggagtcggccat

SEQ ID NO: 385190 - DNA, 140 bp, Artificial Sequence
  Synthetic
atggccgactcccaagtacgttgtctccaagcccatccagggcccctgaaacagcataaagataggagtaccagggcaacctaatctgaatgtttcctgttcttctggtgttaaacctaaggagacccagcatggcgtat

SEQ ID NO: 385191 - DNA, 140 bp, Artificial Sequence
  Synthetic
aggccctggctgctgatatgatattggtctaaagtgaattttccgcatggaatgttggatcttgaagaaattgctgccaactctaaagatttcccaaatatgtctgagacagatttgtgtgaccttttgggacagcggtg

SEQ ID NO: 385192 - DNA, 140 bp, Artificial Sequence
  Synthetic
caccgctgtcccaaaaggtcacacaaatctgtctcagacatatttgggaaatctttagagttggcagcaatttcttcaagatccaacattccatgcggaaaattcactttagaccaatatcatatcagcagccagggcct

SEQ ID NO: 385193 - DNA, 140 bp, Artificial Sequence
  Synthetic
aggccctggctgctgatatggcttggattgtctggagtacaggaaattaaagaacagggtgttggattgatagcagagtgcagaactttcttggattctattgctgggactctgaaatctgaccttttgggacagcggtg

SEQ ID NO: 385194 - DNA, 140 bp, Artificial Sequence
  Synthetic
caccgctgtcccaaaaggtcagatttcagagtcccagcaatagaatccaagaaagttctgcactctgctatcaatccaacaccctgttctttaatttcctgtactccagacaatccaagccatatcagcagccagggcct

SEQ ID NO: 385195 - DNA, 140 bp, Artificial Sequence
  Synthetic
aggccctggctgctgatatgatgatgtttggatttcatcattctgtgactgttgaaattataaatactgtactttgttttgttaagagtggaatcctgctttatgtcatacaacaattgagaccttttgggacagcggtg

SEQ ID NO: 385196 - DNA, 140 bp, Artificial Sequence
  Synthetic
caccgctgtcccaaaaggtctcaattgttgtatgacataaagcaggattccactcttaacaaaacaaagtacagtatttataatttcaacagtcacagaatgatgaaatccaaacatcatcatatcagcagccagggcct

SEQ ID NO: 385197 - DNA, 140 bp, Artificial Sequence
  Synthetic
atacgccatgctgggtctcctattcttttcctattgttgatgagccagatgattataaagatgtttctgtctttttccaaaataaaattttgggtaagagtcctttagttgatgacttttcgtacttgggagtcggccat

SEQ ID NO: 385198 - DNA, 140 bp, Artificial Sequence
  Synthetic
atggccgactcccaagtacgaaaagtcatcaactaaaggactcttacccaaaattttattttggaaaaagacagaaacatctttataatcatctggctcatcaacaataggaaaagaataggagacccagcatggcgtat

SEQ ID NO: 385199 - DNA, 140 bp, Artificial Sequence
  Synthetic
aggccctggctgctgatatggttagaaacagtttttaattggcaaatggactccagaatgatggagctgagaactcagagcttttccaattggttaagagacatttgttcaggaattactgaccttttgggacagcggtg

SEQ ID NO: 385200 - DNA, 140 bp, Artificial Sequence
  Synthetic
caccgctgtcccaaaaggtcagtaattcctgaacaaatgtctcttaaccaattggaaaagctctgagttctcagctccatcattctggagtccatttgccaattaaaaactgtttctaaccatatcagcagccagggcct

SEQ ID NO: 385201 - DNA, 140 bp, Artificial Sequence
  Synthetic
aggccctggctgctgatatggaactcagagcttttccaattggttaagagacatttgttcaggaattactatttttaaaagttttaaggatgccatatattggctatatacaaaattgaagaccttttgggacagcggtg

SEQ ID NO: 385202 - DNA, 140 bp, Artificial Sequence
  Synthetic
caccgctgtcccaaaaggtcttcaattttgtatatagccaatatatggcatccttaaaacttttaaaaatagtaattcctgaacaaatgtctcttaaccaattggaaaagctctgagttccatatcagcagccagggcct

SEQ ID NO: 385203 - DNA, 140 bp, Artificial Sequence
  Synthetic
aggccctggctgctgatatgatttttaaaagttttaaggatgccatatattggctatatacaaaattgaaggatttttatgaagtaaattatggcaagaagaaggatgttcttaatattcgaccttttgggacagcggtg

SEQ ID NO: 385204 - DNA, 140 bp, Artificial Sequence
  Synthetic
caccgctgtcccaaaaggtcgaatattaagaacatccttcttcttgccataatttacttcataaaaatccttcaattttgtatatagccaatatatggcatccttaaaacttttaaaaatcatatcagcagccagggcct

SEQ ID NO: 385205 - DNA, 140 bp, Artificial Sequence
  Synthetic
aggccctggctgctgatatgggtgttgaacctgagaaaaatatttacactaaacctgtggcctcagattattgggatggttacagtggacaattggtttgcattattgatgatattggccgaccttttgggacagcggtg

SEQ ID NO: 385206 - DNA, 140 bp, Artificial Sequence
  Synthetic
caccgctgtcccaaaaggtcggccaatatcatcaataatgcaaaccaattgtccactgtaaccatcccaataatctgaggccacaggtttagtgtaaatatttttctcaggttcaacacccatatcagcagccagggcct

SEQ ID NO: 385207 - DNA, 140 bp, Artificial Sequence
  Synthetic
aggccctggctgctgatatgagactccattttaaagttgaggtgaaacctgcctcattcttcaagaatcctcataatgacatgttaaatgtcaatctggcaaaaactaatgacgccattagaccttttgggacagcggtg

SEQ ID NO: 385208 - DNA, 140 bp, Artificial Sequence
  Synthetic
caccgctgtcccaaaaggtctaatggcgtcattagtttttgccagattgacatttaacatgtcattatgaggattcttgaagaatgaggcaggtttcacctcaactttaaaatggagtctcatatcagcagccagggcct

SEQ ID NO: 385209 - DNA, 140 bp, Artificial Sequence
  Synthetic
aggccctggctgctgatatggaagttaaacctgcttcattttttaaaaatcctcacaatgatatgttgaatgttaatttggctaaaacaaatgatgcaattaaggacatgtcttgtgttggaccttttgggacagcggtg

SEQ ID NO: 385210 - DNA, 140 bp, Artificial Sequence
  Synthetic
caccgctgtcccaaaaggtccaacacaagacatgtccttaattgcatcatttgttttagccaaattaacattcaacatatcattgtgaggatttttaaaaaatgaagcaggtttaacttccatatcagcagccagggcct

SEQ ID NO: 385211 - DNA, 140 bp, Artificial Sequence
  Synthetic
aggccctggctgctgatatggttgtggtctcagggaatttcagatgatgacaatgatagtgcagtagctgagtttttccaatcttttccatctggtgaaccatcaaattccaaattatctgaccttttgggacagcggtg

SEQ ID NO: 385212 - DNA, 140 bp, Artificial Sequence
  Synthetic
caccgctgtcccaaaaggtcagataatttggaatttgatggttcaccagatggaaaagattggaaaaactcagctactgcactatcattgtcatcatctgaaattccctgagaccacaaccatatcagcagccagggcct

SEQ ID NO: 385213 - DNA, 140 bp, Artificial Sequence
  Synthetic
aggccctggctgctgatatgagtttttccaatcttttccatctggtgaaccatcaaattccaaattatctagttttttccaatctgtcactaatcacaagtgggttgctgtgggagctgcgaccttttgggacagcggtg

SEQ ID NO: 385214 - DNA, 140 bp, Artificial Sequence
  Synthetic
caccgctgtcccaaaaggtcgcagctcccacagcaacccacttgtgattagtgacagattggaaaaaactagataatttggaatttgatggttcaccagatggaaaagattggaaaaactcatatcagcagccagggcct

SEQ ID NO: 385215 - DNA, 140 bp, Artificial Sequence
  Synthetic
atacgccatgctgggtctcctctcccgcaaagaggaagaacctatcccagctgaaggggtttatcatggcgtgactaagcctaaacaggtgattaaattggatgcagatccagtagagtccgtacttgggagtcggccat

SEQ ID NO: 385216 - DNA, 140 bp, Artificial Sequence
  Synthetic
atggccgactcccaagtacggactctactggatctgcatccaatttaatcacctgtttaggcttagtcacgccatgataaaccccttcagctgggataggttcttcctctttgcgggagaggagacccagcatggcgtat

SEQ ID NO: 385217 - DNA, 140 bp, Artificial Sequence
  Synthetic
aggccctggctgctgatatgtggactgttctttggggccttatgtggtgtttgcctctgaggtactcaggggcatttaggtttttcctcattctttaataataatgaatatgtccaaacagaccttttgggacagcggtg

SEQ ID NO: 385218 - DNA, 140 bp, Artificial Sequence
  Synthetic
caccgctgtcccaaaaggtctgtttggacatattcattattattaaagaatgaggaaaaacctaaatgcccctgagtacctcagaggcaaacaccacataaggccccaaagaacagtccacatatcagcagccagggcct

SEQ ID NO: 385219 - DNA, 140 bp, Artificial Sequence
  Synthetic
aggccctggctgctgatatgagctttgaggagatttggcttttcattggctgctggtaggagtgtgtggacattggaaatggatgctggagttctgactggcaggttggtgagggtcaatgaccttttgggacagcggtg

SEQ ID NO: 385220 - DNA, 140 bp, Artificial Sequence
  Synthetic
caccgctgtcccaaaaggtcattgaccctcaccaacctgccagtcagaactccagcatccatttccaatgtccacacactcctaccagcagccaatgaaaagccaaatctcctcaaagctcatatcagcagccagggcct

SEQ ID NO: 385221 - DNA, 140 bp, Artificial Sequence
  Synthetic
aggccctggctgctgatatgattcaatttcagctggcaatgttgttattcaatctttagatgtggggtttcaagatgttgttctaatgaaggttcctacaattcccaagtttagagatatgaccttttgggacagcggtg

SEQ ID NO: 385222 - DNA, 140 bp, Artificial Sequence
  Synthetic
caccgctgtcccaaaaggtcatatctctaaacttgggaattgtaggaaccttcattagaacaacatcttgaaaccccacatctaaagattgaataacaacattgccagctgaaattgaatcatatcagcagccagggcct

SEQ ID NO: 385223 - DNA, 140 bp, Artificial Sequence
  Synthetic
aggccctggctgctgatatgcaagatgttgttctaatgaaggttcctacaattcccaagtttagagatattactcaacattttattaagaaaggagatgtacctagagccttgaatcgctgaccttttgggacagcggtg

SEQ ID NO: 385224 - DNA, 140 bp, Artificial Sequence
  Synthetic
caccgctgtcccaaaaggtcagcgattcaaggctctaggtacatctcctttcttaataaaatgttgagtaatatctctaaacttgggaattgtaggaaccttcattagaacaacatcttgcatatcagcagccagggcct

SEQ ID NO: 385225 - DNA, 140 bp, Artificial Sequence
  Synthetic
atacgccatgctgggtctcctactcaacattttattaagaaaggagatgtacctagagccttgaatcgcttggcaacattagtgacaactgttaatggaactcctatgttaatttctgagcgtacttgggagtcggccat

SEQ ID NO: 385226 - DNA, 140 bp, Artificial Sequence
  Synthetic
atggccgactcccaagtacgctcagaaattaacataggagttccattaacagttgtcactaatgttgccaagcgattcaaggctctaggtacatctcctttcttaataaaatgttgagtaggagacccagcatggcgtat

SEQ ID NO: 385227 - DNA, 140 bp, Artificial Sequence
  Synthetic
atacgccatgctgggtctcctctatacagaatgcaatcttgggcatccatgttgctggaggaaattcaattcttgttgcaaaattggttactcaagaaatgttccaaaatattgataagacgtacttgggagtcggccat

SEQ ID NO: 385228 - DNA, 140 bp, Artificial Sequence
  Synthetic
atggccgactcccaagtacgtcttatcaatattttggaacatttcttgagtaaccaattttgcaacaagaattgaatttcctccagcaacatggatgcccaagattgcattctgtatagaggagacccagcatggcgtat

SEQ ID NO: 385229 - DNA, 140 bp, Artificial Sequence
  Synthetic
aggccctggctgctgatatgctttttccaaaataaaattttgggtaagagccctttagttgatgactttctggatattgaaatggctataacaggggctcctgggatagatgcaatcaatgaccttttgggacagcggtg

SEQ ID NO: 385230 - DNA, 140 bp, Artificial Sequence
  Synthetic
caccgctgtcccaaaaggtcattgattgcatctatcccaggagcccctgttatagccatttcaatatccagaaagtcatcaactaaagggctcttacccaaaattttattttggaaaaagcatatcagcagccagggcct

SEQ ID NO: 385231 - DNA, 140 bp, Artificial Sequence
  Synthetic
aggccctggctgctgatatgtggatattgaaatggctataacaggggctcctgggatagatgcaatcaatatggattcttccccaggatatccttatgttcaggagaaattaaccaaaaggaccttttgggacagcggtg

SEQ ID NO: 385232 - DNA, 140 bp, Artificial Sequence
  Synthetic
caccgctgtcccaaaaggtccttttggttaatttctcctgaacataaggatatcctggggaagaatccatattgattgcatctatcccaggagcccctgttatagccatttcaatatccacatatcagcagccagggcct

SEQ ID NO: 385233 - DNA, 140 bp, Artificial Sequence
  Synthetic
aggccctggctgctgatatgaaggtcttcctggaatgtgtggtggggccctggtgtcatcaaatcagtccatacagaatgcaattttgggtattcatgttgctggaggaaattcaattctgaccttttgggacagcggtg

SEQ ID NO: 385234 - DNA, 140 bp, Artificial Sequence
  Synthetic
caccgctgtcccaaaaggtcagaattgaatttcctccagcaacatgaatacccaaaattgcattctgtatggactgatttgatgacaccagggccccaccacacattccaggaagaccttcatatcagcagccagggcct

SEQ ID NO: 385235 - DNA, 140 bp, Artificial Sequence
  Synthetic
atacgccatgctgggtctccgatttggatgttgttttcactacctgccctaaggatgaattaagacctctggacaaagtgttggaatccaaaactagggctattgattcttgtcctcttgcgtacttgggagtcggccat

SEQ ID NO: 385236 - DNA, 140 bp, Artificial Sequence
  Synthetic
atggccgactcccaagtacgcaagaggacaagaatcaatagccctagttttggattccaacactttgtccagaggtcttaattcatccttagggcaggtagtgaaaacaacatccaaatcggagacccagcatggcgtat

SEQ ID NO: 385237 - DNA, 140 bp, Artificial Sequence
  Synthetic
atacgccatgctgggtctccttcaaatgctatgctgtccactgagtccatgatgagtagaattgcagctggagatttagagtcatcagtagatgatcctagatcagaagaggacagaagacgtacttgggagtcggccat

SEQ ID NO: 385238 - DNA, 140 bp, Artificial Sequence
  Synthetic
atggccgactcccaagtacgtcttctgtcctcttctgatctaggatcatctactgatgactctaaatctccagctgcaattctactcatcatggactcagtggacagcatagcatttgaaggagacccagcatggcgtat

SEQ ID NO: 385239 - DNA, 140 bp, Artificial Sequence
  Synthetic
aggccctggctgctgatatggaaccagaggattacaaagaagcttcagttttttatcaaaacaaaatagtaggcaagactcagttagttgatgactttctagatcttgatatggccattagaccttttgggacagcggtg

SEQ ID NO: 385240 - DNA, 140 bp, Artificial Sequence
  Synthetic
caccgctgtcccaaaaggtctaatggccatatcaagatctagaaagtcatcaactaactgagtcttgcctactattttgttttgataaaaaactgaagcttctttgtaatcctctggttccatatcagcagccagggcct

SEQ ID NO: 385241 - DNA, 140 bp, Artificial Sequence
  Synthetic
aggccctggctgctgatatgaggcaagactcagttagttgatgactttctagatcttgatatggccattacaggggctccaggcattgatgctattaatatggattcatctcctgggtttgaccttttgggacagcggtg

SEQ ID NO: 385242 - DNA, 140 bp, Artificial Sequence
  Synthetic
caccgctgtcccaaaaggtcaaacccaggagatgaatccatattaatagcatcaatgcctggagcccctgtaatggccatatcaagatctagaaagtcatcaactaactgagtcttgcctcatatcagcagccagggcct

SEQ ID NO: 385243 - DNA, 140 bp, Artificial Sequence
  Synthetic
aggccctggctgctgatatgcaggggctccaggcattgatgctattaatatggattcatctcctgggtttccttatgttcaagaaaaattgaccaaaagagatttaatttggttggatgagaccttttgggacagcggtg

SEQ ID NO: 385244 - DNA, 140 bp, Artificial Sequence
  Synthetic
caccgctgtcccaaaaggtctcatccaaccaaattaaatctcttttggtcaatttttcttgaacataaggaaacccaggagatgaatccatattaatagcatcaatgcctggagcccctgcatatcagcagccagggcct

SEQ ID NO: 385245 - DNA, 140 bp, Artificial Sequence
  Synthetic
aggccctggctgctgatatgttaatactgtcatgatggaaaattgttctgacctagatgttgttttcacaacttgtccaaaagatgaattgagaccattagagaaagttttggaatcaaagaccttttgggacagcggtg

SEQ ID NO: 385246 - DNA, 140 bp, Artificial Sequence
  Synthetic
caccgctgtcccaaaaggtctttgattccaaaactttctctaatggtctcaattcatcttttggacaagttgtgaaaacaacatctaggtcagaacaattttccatcatgacagtattaacatatcagcagccagggcct

SEQ ID NO: 385247 - DNA, 140 bp, Artificial Sequence
  Synthetic
aggccctggctgctgatatgtgaggggacttgatacctcaccgccgtttgcctaggctataggctaaatttccctttccctgtccttcccctattcccttttgttttgtttgtaaatattgaccttttgggacagcggtg

SEQ ID NO: 385248 - DNA, 140 bp, Artificial Sequence
  Synthetic
caccgctgtcccaaaaggtcaatatttacaaacaaaacaaaagggaataggggaaggacagggaaagggaaatttagcctatagcctaggcaaacggcggtgaggtatcaagtcccctcacatatcagcagccagggcct

SEQ ID NO: 385249 - DNA, 140 bp, Artificial Sequence
  Synthetic
aggccctggctgctgatatgcctttgatgctagtcttagtccatttatgattagggaggcgggtagaatcatgagtgaattatctggaacaccatctcattttggaacagctcttatcaagaccttttgggacagcggtg

SEQ ID NO: 385250 - DNA, 140 bp, Artificial Sequence
  Synthetic
caccgctgtcccaaaaggtcttgataagagctgttccaaaatgagatggtgttccagataattcactcatgattctacccgcctccctaatcataaatggactaagactagcatcaaaggcatatcagcagccagggcct

SEQ ID NO: 385251 - DNA, 140 bp, Artificial Sequence
  Synthetic
aggccctggctgctgatatgatgagtgaattatctggaacaccatctcattttggaacagctcttatcaatactatcatttattctaaacatttgctgtacaattgttgttatcatgtttgaccttttgggacagcggtg

SEQ ID NO: 385252 - DNA, 140 bp, Artificial Sequence
  Synthetic
caccgctgtcccaaaaggtcaaacatgataacaacaattgtacagcaaatgtttagaataaatgatagtattgataagagctgttccaaaatgagatggtgttccagataattcactcatcatatcagcagccagggcct

SEQ ID NO: 385253 - DNA, 140 bp, Artificial Sequence
  Synthetic
aggccctggctgctgatatgttttgatagttttttccagagatgttcaaattgacaatcttgacttgattggacagaaaattgtggatgagttcaaaaaacttggcatgacagctacttcgaccttttgggacagcggtg

SEQ ID NO: 385254 - DNA, 140 bp, Artificial Sequence
  Synthetic
caccgctgtcccaaaaggtcgaagtagctgtcatgccaagttttttgaactcatccacaattttctgtccaatcaagtcaagattgtcaatttgaacatctctggaaaaaactatcaaaacatatcagcagccagggcct

SEQ ID NO: 385255 - DNA, 140 bp, Artificial Sequence
  Synthetic
aggccctggctgctgatatgggacagaaaattgtggatgagttcaaaaaacttggcatgacagctacttcagctgataaaaatgtgcctcaactgaagccagtttcagaattgacttttcgaccttttgggacagcggtg

SEQ ID NO: 385256 - DNA, 140 bp, Artificial Sequence
  Synthetic
caccgctgtcccaaaaggtcgaaaagtcaattctgaaactggcttcagttgaggcacatttttatcagctgaagtagctgtcatgccaagttttttgaactcatccacaattttctgtcccatatcagcagccagggcct

SEQ ID NO: 385257 - DNA, 140 bp, Artificial Sequence
  Synthetic
atacgccatgctgggtctcccttcactcaacgttttagctaggttcacagatttggagttgcatgggttaactcctctttctacacagatgatgagaaatgaatttagagttagtactaccgtacttgggagtcggccat

SEQ ID NO: 385258 - DNA, 140 bp, Artificial Sequence
  Synthetic
atggccgactcccaagtacggtagtactaactctaaattcatttctcatcatctgtgtagaaagaggagttaacccatgcaactccaaatctgtgaacctagctaaaacgttgagtgaagggagacccagcatggcgtat

SEQ ID NO: 385259 - DNA, 140 bp, Artificial Sequence
  Synthetic
aggccctggctgctgatatgactcctctttctacacagatgatgagaaatgaatttagagttagtactactgaaaatgttgtaaatttgtcaaattatgaagatgcaagggcaaaaatgtgaccttttgggacagcggtg

SEQ ID NO: 385260 - DNA, 140 bp, Artificial Sequence
  Synthetic
caccgctgtcccaaaaggtcacatttttgcccttgcatcttcataatttgacaaatttacaacattttcagtagtactaactctaaattcatttctcatcatctgtgtagaaagaggagtcatatcagcagccagggcct

SEQ ID NO: 385261 - DNA, 140 bp, Artificial Sequence
  Synthetic
aggccctggctgctgatatgactggaattacattaaaacaggcaactactgctccttgtgcagtaatggacattacaggagtgcaatcaaccttgagatttcgtgttccttggatttctggaccttttgggacagcggtg

SEQ ID NO: 385262 - DNA, 140 bp, Artificial Sequence
  Synthetic
caccgctgtcccaaaaggtccagaaatccaaggaacacgaaatctcaaggttgattgcactcctgtaatgtccattactgcacaaggagcagtagttgcctgttttaatgtaattccagtcatatcagcagccagggcct

SEQ ID NO: 385263 - DNA, 140 bp, Artificial Sequence
  Synthetic
aggccctggctgctgatatgtttcatttgtgacctttcatgatttgtttaaacaaattttcttaaaatttctgaggtttgtttatttcttttatcagtaaataaaaaaaaaaaaaaaaaagaccttttgggacagcggtg

SEQ ID NO: 385264 - DNA, 140 bp, Artificial Sequence
  Synthetic
caccgctgtcccaaaaggtcttttttttttttttttttatttactgataaaagaaataaacaaacctcagaaattttaagaaaatttgtttaaacaaatcatgaaaggtcacaaatgaaacatatcagcagccagggcct

SEQ ID NO: 385265 - DNA, 140 bp, Artificial Sequence
  Synthetic
atacgccatgctgggtctccttcaagaggggcctccgggttttccggagcccctcttgggagtccatggtgaggggacttgatacctcaccgccgtttgcctaggctataggctaattttcgtacttgggagtcggccat

SEQ ID NO: 385266 - DNA, 140 bp, Artificial Sequence
  Synthetic
atggccgactcccaagtacgaaaattagcctatagcctaggcaaacggcggtgaggtatcaagtcccctcaccatggactcccaagaggggctccggaaaacccggaggcccctcttgaaggagacccagcatggcgtat

SEQ ID NO: 385267 - DNA, 140 bp, Artificial Sequence
  Synthetic
atacgccatgctgggtctcccccttttccctttccctgtgttattgtaaatattaattcctgcaggttcagggttcttgaatttgttctgctgtacggacactcatttcacgctctctgtcgtacttgggagtcggccat

SEQ ID NO: 385268 - DNA, 140 bp, Artificial Sequence
  Synthetic
atggccgactcccaagtacgacagagagcgtgaaatgagtgtccgtacagcagaacaaattcaagaaccctgaacctgcaggaattaatatttacaataacacagggaaagggaaaagggggagacccagcatggcgtat

SEQ ID NO: 385269 - DNA, 140 bp, Artificial Sequence
  Synthetic
aggccctggctgctgatatggggacacagatgttgggaacgtcaccttgcagtgttaacttggctttcatgaaactccttgatcttccacaagaggtaggctacgggtgaaacctcttaagaccttttgggacagcggtg

SEQ ID NO: 385270 - DNA, 140 bp, Artificial Sequence
  Synthetic
caccgctgtcccaaaaggtcttaagaggtttcacccgtagcctacctcttgtggaagatcaaggagtttcatgaaagccaagttaacactgcaaggtgacgttcccaacatctgtgtccccatatcagcagccagggcct

SEQ ID NO: 385271 - DNA, 140 bp, Artificial Sequence
  Synthetic
atacgccatgctgggtctcctccagtggatgcattgagtgaattgactgtcagggctgtctttaggcttaattcctgacctctctgtgcttagggcaaacaaaatttggccttaaatgagcgtacttgggagtcggccat

SEQ ID NO: 385272 - DNA, 140 bp, Artificial Sequence
  Synthetic
atggccgactcccaagtacgctcatttaaggccaaattttgtttgccctaagcacagagaggtcaggaattaagcctaaagacagccctgacagtcaattcactcaatgcatccactggaggagacccagcatggcgtat

SEQ ID NO: 385273 - DNA, 140 bp, Artificial Sequence
  Synthetic
aggccctggctgctgatatgattcctgacctctctgtgcttagggcaaacaaaatttggccttaaatgaggctctgtgagagggggcctcgccattgaatgctggacatttctttggggcgaccttttgggacagcggtg

SEQ ID NO: 385274 - DNA, 140 bp, Artificial Sequence
  Synthetic
caccgctgtcccaaaaggtcgccccaaagaaatgtccagcattcaatggcgaggccccctctcacagagcctcatttaaggccaaattttgtttgccctaagcacagagaggtcaggaatcatatcagcagccagggcct

SEQ ID NO: 385275 - DNA, 140 bp, Artificial Sequence
  Synthetic
atacgccatgctgggtctcctgttgacactccttgggtggaaaaggagtcagctttgtctattgattacaagactgctcttggagctgttagatttaatacaagaagaacagggaatattcgtacttgggagtcggccat

SEQ ID NO: 385276 - DNA, 140 bp, Artificial Sequence
  Synthetic
atggccgactcccaagtacgaatattccctgttcttcttgtattaaatctaacagctccaagagcagtcttgtaatcaatagacaaagctgactccttttccacccaaggagtgtcaacaggagacccagcatggcgtat

SEQ ID NO: 385277 - DNA, 140 bp, Artificial Sequence
  Synthetic
atacgccatgctgggtctcctgggagtggccttgaccacattctgtctttggcagatgtggaggaggagcaaatgattcagtctgttgaccgtactgcagttactggagcttcatattttcgtacttgggagtcggccat

SEQ ID NO: 385278 - DNA, 140 bp, Artificial Sequence
  Synthetic
atggccgactcccaagtacgaaaatatgaagctccagtaactgcagtacggtcaacagactgaatcatttgctcctcctccacatctgccaaagacagaatgtggtcaaggccactcccaggagacccagcatggcgtat

SEQ ID NO: 385279 - DNA, 140 bp, Artificial Sequence
  Synthetic
atacgccatgctgggtctccacttctgtggatcaatcttctgttcatacagctgaagttggtgcacatcagtctgaacctttaaaaacttctgttgataagccaggctcaaaaagaacaccgtacttgggagtcggccat

SEQ ID NO: 385280 - DNA, 140 bp, Artificial Sequence
  Synthetic
atggccgactcccaagtacggtgttctttttgagcctggcttatcaacagaagtttttaaaggttcagactgatgtgcaccaacttcagctgtatgaacagaagattgatccacagaagtggagacccagcatggcgtat

SEQ ID NO: 385281 - DNA, 140 bp, Artificial Sequence
  Synthetic
atacgccatgctgggtctccaaggtgagaagtttttccttattcattctgctgattggttgacaacacatgctttgtttcatgaagttgcaaaattggatgtggttaaattattatataacgtacttgggagtcggccat

SEQ ID NO: 385282 - DNA, 140 bp, Artificial Sequence
  Synthetic
atggccgactcccaagtacgttatataataatttaaccacatccaattttgcaacttcatgaaacaaagcatgtgttgtcaaccaatcagcagaatgaataaggaaaaacttctcaccttggagacccagcatggcgtat

SEQ ID NO: 385283 - DNA, 140 bp, Artificial Sequence
  Synthetic
atacgccatgctgggtctcctgaacagtttgctgtccagggcttgttgaggtatcatacttatgcaagatttggaattgaaatacaagttcaaattaatcctactccattccaacaaggtcgtacttgggagtcggccat

SEQ ID NO: 385284 - DNA, 140 bp, Artificial Sequence
  Synthetic
atggccgactcccaagtacgaccttgttggaatggagtaggattaatttgaacttgtatttcaattccaaatcttgcataagtatgatacctcaacaagccctggacagcaaactgttcaggagacccagcatggcgtat

SEQ ID NO: 385285 - DNA, 140 bp, Artificial Sequence
  Synthetic
atacgccatgctgggtctccggattaatatgtgctatggtccctggagatcagagctatggatccatagcttctctgacagtgtatcctcatggtttgttaaattgcaacataaacaatgcgtacttgggagtcggccat

SEQ ID NO: 385286 - DNA, 140 bp, Artificial Sequence
  Synthetic
atggccgactcccaagtacgcattgtttatgttgcaatttaacaaaccatgaggatacactgtcagagaagctatggatccatagctctgatctccagggaccatagcacatattaatccggagacccagcatggcgtat

SEQ ID NO: 385287 - DNA, 140 bp, Artificial Sequence
  Synthetic
atacgccatgctgggtctcctggttaggattaaagttcctttcatttatacaaggggggcttaccattttaaagatcctcaatatcctgtttgggaattgactattagagtgtggtcagacgtacttgggagtcggccat

SEQ ID NO: 385288 - DNA, 140 bp, Artificial Sequence
  Synthetic
atggccgactcccaagtacgtctgaccacactctaatagtcaattcccaaacaggatattgaggatctttaaaatggtaagccccccttgtataaatgaaaggaactttaatcctaaccaggagacccagcatggcgtat

SEQ ID NO: 385289 - DNA, 140 bp, Artificial Sequence
  Synthetic
atacgccatgctgggtctccattgaacattggaactggcacatcagcttacacctcattaaatgtgttggctagatttactgacttagaactccatggattaacacctttatctacacagcgtacttgggagtcggccat

SEQ ID NO: 385290 - DNA, 140 bp, Artificial Sequence
  Synthetic
atggccgactcccaagtacgctgtgtagataaaggtgttaatccatggagttctaagtcagtaaatctagccaacacatttaatgaggtgtaagctgatgtgccagttccaatgttcaatggagacccagcatggcgtat

SEQ ID NO: 385291 - DNA, 140 bp, Artificial Sequence
  Synthetic
atacgccatgctgggtctccatgatgagaaatgaatttagagtcagtacaacagaaaatgtggttaacttatctaattatgaggatgctagagcaaaaatgtcttttgctttggatcaggcgtacttgggagtcggccat

SEQ ID NO: 385292 - DNA, 140 bp, Artificial Sequence
  Synthetic
atggccgactcccaagtacgcctgatccaaagcaaaagacatttttgctctagcatcctcataattagataagttaaccacattttctgttgtactgactctaaattcatttctcatcatggagacccagcatggcgtat

SEQ ID NO: 385293 - DNA, 140 bp, Artificial Sequence
  Synthetic
atacgccatgctgggtctccaggactggaaatccgatgcttctcaaggaggaggaattaaaattacacacttcacaacctggacatcaattcctaccttggctgctcagtttccatttaacgtacttgggagtcggccat

SEQ ID NO: 385294 - DNA, 140 bp, Artificial Sequence
  Synthetic
atggccgactcccaagtacgttaaatggaaactgagcagccaaggtaggaattgatgtccaggttgtgaagtgtgtaattttaattcctcctccttgagaagcatcggatttccagtcctggagacccagcatggcgtat

SEQ ID NO: 385295 - DNA, 140 bp, Artificial Sequence
  Synthetic
atacgccatgctgggtctcctgcttctgactctgttgggcaacaaattaaggttattccagttgatccatactttttccagatgactaacacaaatcctgaacaaaagtgtattactgcacgtacttgggagtcggccat

SEQ ID NO: 385296 - DNA, 140 bp, Artificial Sequence
  Synthetic
atggccgactcccaagtacgtgcagtaatacacttttgttcaggatttgtgttagtcatctggaaaaagtatggatcaactggaataaccttaatttgttgcccaacagagtcagaagcaggagacccagcatggcgtat

SEQ ID NO: 385297 - DNA, 140 bp, Artificial Sequence
  Synthetic
atacgccatgctgggtctcccttgcatcaatatgtcagatgttttgtttttggagaggagacctagtttttgattttcaggttttcccaacaaaataccattcaggaaggctgttgttttcgtacttgggagtcggccat

SEQ ID NO: 385298 - DNA, 140 bp, Artificial Sequence
  Synthetic
atggccgactcccaagtacgaaaacaacagccttcctgaatggtattttgttgggaaaacctgaaaatcaaaaactaggtctcctctccaaaaacaaaacatctgacatattgatgcaagggagacccagcatggcgtat

SEQ ID NO: 385299 - DNA, 140 bp, Artificial Sequence
  Synthetic
aggccctggctgctgatatgcagaaaatagaaaaagccattgaagaagcagacaatttttgcattttgcaaattcaagatgtagagaaatttgatcagtatcagaaaggggttgatttaagaccttttgggacagcggtg

SEQ ID NO: 385300 - DNA, 140 bp, Artificial Sequence
  Synthetic
caccgctgtcccaaaaggtcttaaatcaacccctttctgatactgatcaaatttctctacatcttgaatttgcaaaatgcaaaaattgtctgcttcttcaatggctttttctattttctgcatatcagcagccagggcct

SEQ ID NO: 385301 - DNA, 140 bp, Artificial Sequence
  Synthetic
aggccctggctgctgatatgaattcaagatgtagagaaatttgatcagtatcagaaaggggttgatttaatacaaaagctgagaactgtccattcaatggctcaagttgaccctaaccttgaccttttgggacagcggtg

SEQ ID NO: 385302 - DNA, 140 bp, Artificial Sequence
  Synthetic
caccgctgtcccaaaaggtcaaggttagggtcaacttgagccattgaatggacagttctcagcttttgtattaaatcaacccctttctgatactgatcaaatttctctacatcttgaattcatatcagcagccagggcct

SEQ ID NO: 385303 - DNA, 140 bp, Artificial Sequence
  Synthetic
atacgccatgctgggtctccaactttgagatttcgtgtgccctggatttcagatactccttatagggttaatagatacaccaagtcatcacaccagaagggagagtatactgccataggacgtacttgggagtcggccat

SEQ ID NO: 385304 - DNA, 140 bp, Artificial Sequence
  Synthetic
atggccgactcccaagtacgtcctatggcagtatactctcccttctggtgtgatgacttggtgtatctattaaccctataaggagtatctgaaatccagggcacacgaaatctcaaagttggagacccagcatggcgtat

SEQ ID NO: 385305 - DNA, 140 bp, Artificial Sequence
  Synthetic
atacgccatgctgggtctccaagttgattgtctattgttataatagattaacctctccttctaatgtggcctctcatgttagagttaatgtttacctttcagccatcaatttggaatgttcgtacttgggagtcggccat

SEQ ID NO: 385306 - DNA, 140 bp, Artificial Sequence
  Synthetic
atggccgactcccaagtacgaacattccaaattgatggctgaaaggtaaacattaactctaacatgagaggccacattagaaggagaggttaatctattataacaatagacaatcaacttggagacccagcatggcgtat

SEQ ID NO: 385307 - DNA, 140 bp, Artificial Sequence
  Synthetic
atacgccatgctgggtctccttgctccactctatcatgccatggatgttacaactcaggttggagatgattctggaggtttttctaccacagtttctacaaagcagaatgttccagaccccgtacttgggagtcggccat

SEQ ID NO: 385308 - DNA, 140 bp, Artificial Sequence
  Synthetic
atggccgactcccaagtacggggtctggaacattctgctttgtagaaactgtggtagaaaaacctccagaatcatctccaacctgagttgtaacatccatggcatgatagagtggagcaaggagacccagcatggcgtat

SEQ ID NO: 385309 - DNA, 140 bp, Artificial Sequence
  Synthetic
atacgccatgctgggtctccattgaagatccagttttggcaaagaaagtacctgaaaccttcccagaattgaagcctggagagtcaagacacacctctgatcatatgtctatttacaaatcgtacttgggagtcggccat

SEQ ID NO: 385310 - DNA, 140 bp, Artificial Sequence
  Synthetic
atggccgactcccaagtacgatttgtaaatagacatatgatcagaggtgtgtcttgactctccaggcttcaattctgggaaggtttcaggtactttctttgccaaaactggatcttcaatggagacccagcatggcgtat

SEQ ID NO: 385311 - DNA, 140 bp, Artificial Sequence
  Synthetic
atacgccatgctgggtctcctcaagttggcatcacaacagtgagggatctcaaaggtaaggcaaatcaggggaaaatggacgtgtcaggtgtccaagctcctgtaggtgctattacaacccgtacttgggagtcggccat

SEQ ID NO: 385312 - DNA, 140 bp, Artificial Sequence
  Synthetic
atggccgactcccaagtacgggttgtaatagcacctacaggagcttggacacctgacacgtccattttcccctgatttgccttacctttgagatccctcactgttgtgatgccaacttgaggagacccagcatggcgtat

SEQ ID NO: 385313 - DNA, 140 bp, Artificial Sequence
  Synthetic
atacgccatgctgggtctccattgaagatccagttttggcaaagaaagttcctgagactttcccagagttgaagcctggtgagtcaagacatacatctgatcacatgtccatttacaaatcgtacttgggagtcggccat

SEQ ID NO: 385314 - DNA, 140 bp, Artificial Sequence
  Synthetic
atggccgactcccaagtacgatttgtaaatggacatgtgatcagatgtatgtcttgactcaccaggcttcaactctgggaaagtctcaggaactttctttgccaaaactggatcttcaatggagacccagcatggcgtat

SEQ ID NO: 385315 - DNA, 140 bp, Artificial Sequence
  Synthetic
atacgccatgctgggtctccttatgggtagatctcatttcttgtgtacttttacatttaattccaataataaggagtacacttttcctattaccttgtcatctacttctaatcccccacacgtacttgggagtcggccat

SEQ ID NO: 385316 - DNA, 140 bp, Artificial Sequence
  Synthetic
atggccgactcccaagtacgtgtgggggattagaagtagatgacaaggtaataggaaaagtgtactccttattattggaattaaatgtaaaagtacacaagaaatgagatctacccataaggagacccagcatggcgtat

SEQ ID NO: 385317 - DNA, 140 bp, Artificial Sequence
  Synthetic
atacgccatgctgggtctccagttactaatcacaagtgggttgctgtgggagctgcagttggtattcttggagtgcttgtggggggatggttcgtgtataagcatttctcccacagggagcgtacttgggagtcggccat

SEQ ID NO: 385318 - DNA, 140 bp, Artificial Sequence
  Synthetic
atggccgactcccaagtacgctccctgtgggagaaatgcttatacacgaaccatccccccacaagcactccaagaataccaactgcagctcccacagcaacccacttgtgattagtaactggagacccagcatggcgtat

SEQ ID NO: 385319 - DNA, 140 bp, Artificial Sequence
  Synthetic
atacgccatgctgggtctcctggattgccctcaacattgagatggttcttcaatcttttccaactttatagaggtcctctggacttaacaataattattactggagccactgatgttgatcgtacttgggagtcggccat

SEQ ID NO: 385320 - DNA, 140 bp, Artificial Sequence
  Synthetic
atggccgactcccaagtacgatcaacatcagtggctccagtaataattattgttaagtccagaggacctctataaagttggaaaagattgaagaaccatctcaatgttgagggcaatccaggagacccagcatggcgtat

SEQ ID NO: 385321 - DNA, 140 bp, Artificial Sequence
  Synthetic
atacgccatgctgggtctccttcactcaatggcacaagttgatccaggtttaactgttcatttagcccctcttagagattgtattgccagagttcatcaaaaattaaaaaatttgggttccgtacttgggagtcggccat

SEQ ID NO: 385322 - DNA, 140 bp, Artificial Sequence
  Synthetic
atggccgactcccaagtacggaacccaaattttttaatttttgatgaactctggcaatacaatctctaagaggggctaaatgaacagttaaacctggatcaacttgtgccattgagtgaaggagacccagcatggcgtat

SEQ ID NO: 385323 - DNA, 140 bp, Artificial Sequence
  Synthetic
atacgccatgctgggtctccggaatggcatggtttactcctgttggattggcagtggataccccttgggttgagaaagagtctgctctctctattgactacaaaacagctcttggtgctgcgtacttgggagtcggccat

SEQ ID NO: 385324 - DNA, 140 bp, Artificial Sequence
  Synthetic
atggccgactcccaagtacgcagcaccaagagctgttttgtagtcaatagagagagcagactctttctcaacccaaggggtatccactgccaatccaacaggagtaaaccatgccattccggagacccagcatggcgtat

SEQ ID NO: 385325 - DNA, 140 bp, Artificial Sequence
  Synthetic
atacgccatgctgggtctccttagatttaataccagaagaacaggaaatattcagattagactgccttggtattcttacctttatgctgtttccggagcattggatggacttggagacaacgtacttgggagtcggccat

SEQ ID NO: 385326 - DNA, 140 bp, Artificial Sequence
  Synthetic
atggccgactcccaagtacgttgtctccaagtccatccaatgctccggaaacagcataaaggtaagaataccaaggcagtctaatctgaatatttcctgttcttctggtattaaatctaaggagacccagcatggcgtat

SEQ ID NO: 385327 - DNA, 140 bp, Artificial Sequence
  Synthetic
atacgccatgctgggtctccaactgattcaacttttggacttgtttccattcaaattgcaaattacaatcattctgatgagtatttgtcttttagttgttatttgtctgtgactgaacagcgtacttgggagtcggccat

SEQ ID NO: 385328 - DNA, 140 bp, Artificial Sequence
  Synthetic
atggccgactcccaagtacgctgttcagtcacagacaaataacaactaaaagacaaatactcatcagaatgattgtaatttgcaatttgaatggaaacaagtccaaaagttgaatcagttggagacccagcatggcgtat

SEQ ID NO: 385329 - DNA, 140 bp, Artificial Sequence
  Synthetic
atacgccatgctgggtctcctctgagttttattttcctagagcacctttgaacaccaatgctatgatgtcatctgaaacaatgttagatagaattgctcttggtgatcttgaatcttcagcgtacttgggagtcggccat

SEQ ID NO: 385330 - DNA, 140 bp, Artificial Sequence
  Synthetic
atggccgactcccaagtacgctgaagattcaagatcaccaagagcaattctatctaacattgtttcagatgacatcatagcattggtgttcaaaggtgctctaggaaaataaaactcagaggagacccagcatggcgtat

SEQ ID NO: 385331 - DNA, 140 bp, Artificial Sequence
  Synthetic
atacgccatgctgggtctccttgatgatcctcggtctgaagaagatcgaaaatttgaaagtcacattgagaagagaaaaccctataaggaattgagattggaggttggcaaacaaagattcgtacttgggagtcggccat

SEQ ID NO: 385332 - DNA, 140 bp, Artificial Sequence
  Synthetic
atggccgactcccaagtacgaatctttgtttgccaacctccaatctcaattccttatagggttttctcttctcaatgtgactttcaaattttcgatcttcttcagaccgaggatcatcaaggagacccagcatggcgtat

SEQ ID NO: 385333 - DNA, 140 bp, Artificial Sequence
  Synthetic
atacgccatgctgggtctccaaagtatgctcaagaagaactgtcaaatgaagtgttgcctcctcctcggaaaatcaagggtgtgttctcacaagcaaaaatttcactgttttatacagagcgtacttgggagtcggccat

SEQ ID NO: 385334 - DNA, 140 bp, Artificial Sequence
  Synthetic
atggccgactcccaagtacgctctgtataaaacagtgaaatttttgcttgtgagaacacacccttgattttccgaggaggaggcaacacttcatttgacagttcttcttgagcatactttggagacccagcatggcgtat

SEQ ID NO: 385335 - DNA, 140 bp, Artificial Sequence
  Synthetic
atacgccatgctgggtctccgatcatgaaataatgaagttttcttggaagggaattactgctgacactagagctctgaggagatttgggttttctttagctgctggcagaagtgtgtggacgtacttgggagtcggccat

SEQ ID NO: 385336 - DNA, 140 bp, Artificial Sequence
  Synthetic
atggccgactcccaagtacgtccacacacttctgccagcagctaaagaaaacccaaatctcctcagagctctagtgtcagcagtaattcccttccaagaaaacttcattatttcatgatcggagacccagcatggcgtat

SEQ ID NO: 385337 - DNA, 140 bp, Artificial Sequence
  Synthetic
atacgccatgctgggtctcccattggaaatggatgctggtgttttaactggaagattggtgagagttaatgatgagaaatggacagaaatgaaggatgataaaattgtttctctggtggacgtacttgggagtcggccat

SEQ ID NO: 385338 - DNA, 140 bp, Artificial Sequence
  Synthetic
atggccgactcccaagtacgtccaccagagaaacaattttatcatccttcatttctgtccatttctcatcattaactctcaccaatcttccagttaaaacaccagcatccatttccaatgggagacccagcatggcgtat

SEQ ID NO: 385339 - DNA, 140 bp, Artificial Sequence
  Synthetic
atacgccatgctgggtctccaaagttcactagcaataaacattggtctaagattaattttcctcacggaatgctagatttagaagagattgctgcaaattcaaaggagtttccaaatatgcgtacttgggagtcggccat

SEQ ID NO: 385340 - DNA, 140 bp, Artificial Sequence
  Synthetic
atggccgactcccaagtacgcatatttggaaactcctttgaatttgcagcaatctcttctaaatctagcattccgtgaggaaaattaatcttagaccaatgtttattgctagtgaactttggagacccagcatggcgtat

SEQ ID NO: 385341 - DNA, 140 bp, Artificial Sequence
  Synthetic
atacgccatgctgggtctcctcagagactgacttgtgttttctgttgcattggttgaatcccaagaaaataaatttagcagatagaatgttaggtatgtcaggaatacaagagatcaaagcgtacttgggagtcggccat

SEQ ID NO: 385342 - DNA, 140 bp, Artificial Sequence
  Synthetic
atggccgactcccaagtacgctttgatctcttgtattcctgacatacctaacattctatctgctaaatttattttcttgggattcaaccaatgcaacagaaaacacaagtcagtctctgaggagacccagcatggcgtat

SEQ ID NO: 385343 - DNA, 140 bp, Artificial Sequence
  Synthetic
atacgccatgctgggtctccaaaaaggagtaggattaattggtgagtgtagagctttccttgattcaataactaccactttgaagtctatgatgtttggctttcatcattctgttactgtcgtacttgggagtcggccat

SEQ ID NO: 385344 - DNA, 140 bp, Artificial Sequence
  Synthetic
atggccgactcccaagtacgacagtaacagaatgatgaaagccaaacatcatagacttcaaagtggtagttattgaatcaaggaaagctctacactcaccaattaatcctactcctttttggagacccagcatggcgtat

SEQ ID NO: 385345 - DNA, 140 bp, Artificial Sequence
  Synthetic
atacgccatgctgggtctcctgagattattaacactgttttgtgttttgttaaaagtgggattttgctgtatgtaattcaacaattgaaccaagaggaacattcacacataattggcttgcgtacttgggagtcggccat

SEQ ID NO: 385346 - DNA, 140 bp, Artificial Sequence
  Synthetic
atggccgactcccaagtacgcaagccaattatgtgtgaatgttcctcttggttcaattgttgaattacatacagcaaaatcccacttttaacaaaacacaaaacagtgttaataatctcaggagacccagcatggcgtat

SEQ ID NO: 385347 - DNA, 140 bp, Artificial Sequence
  Synthetic
aggccctggctgctgatatgtggaacaccatctcattttggaacagctcttatcaatactattatttattctaaacatttgctgtacaattgttgttatcacgtttgtggttcaatgcctgaccttttgggacagcggtg

SEQ ID NO: 385348 - DNA, 140 bp, Artificial Sequence
  Synthetic
caccgctgtcccaaaaggtcaggcattgaaccacaaacgtgataacaacaattgtacagcaaatgtttagaataaataatagtattgataagagctgttccaaaatgagatggtgttccacatatcagcagccagggcct

SEQ ID NO: 385349 - DNA, 140 bp, Artificial Sequence
  Synthetic
atacgccatgctgggtctccttgagagtgatgaattatgctgacattggttgctctgttatttcatgtggtaaagtgttttcaaaaatgctggaaactgtttttaattggcagatggattcgtacttgggagtcggccat

SEQ ID NO: 385350 - DNA, 140 bp, Artificial Sequence
  Synthetic
atggccgactcccaagtacgaatccatctgccaattaaaaacagtttccagcatttttgaaaacactttaccacatgaaataacagagcaaccaatgtcagcataattcatcactctcaaggagacccagcatggcgtat

SEQ ID NO: 385351 - DNA, 140 bp, Artificial Sequence
  Synthetic
atacgccatgctgggtctcccaagaatgatggaattgaggactcagagcatttcaaactggcttagagacatttgttcaggtataacaatttttaaaagtttcaaagatgcaatttattgcgtacttgggagtcggccat

SEQ ID NO: 385352 - DNA, 140 bp, Artificial Sequence
  Synthetic
atggccgactcccaagtacgcaataaattgcatctttgaaacttttaaaaattgttatacctgaacaaatgtctctaagccagtttgaaatgctctgagtcctcaattccatcattcttgggagacccagcatggcgtat

SEQ ID NO: 385353 - DNA, 140 bp, Artificial Sequence
  Synthetic
atacgccatgctgggtctccgctttatacaagaatcagagaatattatgatgtcaactatggcaataagaaggatgttcttaatattcttaaagataatcaacagaaaattgagagggctcgtacttgggagtcggccat

SEQ ID NO: 385354 - DNA, 140 bp, Artificial Sequence
  Synthetic
atggccgactcccaagtacgagccctctcaattttctgttgattatctttaagaatattaagaacatccttcttattgccatagttgacatcataatattctctgattcttgtataaagcggagacccagcatggcgtat

SEQ ID NO: 385355 - DNA, 140 bp, Artificial Sequence
  Synthetic
atacgccatgctgggtctccattgaggaagctgataatttttgtgttttacagattcaggatgttgagaagtttgaacagtatcagaaaggagtggacttaattcaaaagctgagaactgcgtacttgggagtcggccat

SEQ ID NO: 385356 - DNA, 140 bp, Artificial Sequence
  Synthetic
atggccgactcccaagtacgcagttctcagcttttgaattaagtccactcctttctgatactgttcaaacttctcaacatcctgaatctgtaaaacacaaaaattatcagcttcctcaatggagacccagcatggcgtat

SEQ ID NO: 385357 - DNA, 140 bp, Artificial Sequence
  Synthetic
atacgccatgctgggtctccttcattcaatggcacaggttgatcctggcttgactgttcatttggctcctctcagagattgcattgctagggttcatcagaaattaaaaaatttaggttccgtacttgggagtcggccat

SEQ ID NO: 385358 - DNA, 140 bp, Artificial Sequence
  Synthetic
atggccgactcccaagtacggaacctaaattttttaatttctgatgaaccctagcaatgcaatctctgagaggagccaaatgaacagtcaagccaggatcaacctgtgccattgaatgaaggagacccagcatggcgtat

SEQ ID NO: 385359 - DNA, 140 bp, Artificial Sequence
  Synthetic
aggccctggctgctgatatggcctaggctataggctaaatttccctttcccctttccctttattgttgtaaatattaattcctgcaggttcaggtttcttggatttgttccactttatgggaccttttgggacagcggtg

SEQ ID NO: 385360 - DNA, 140 bp, Artificial Sequence
  Synthetic
caccgctgtcccaaaaggtcccataaagtggaacaaatccaagaaacctgaacctgcaggaattaatatttacaacaataaagggaaaggggaaagggaaatttagcctatagcctaggccatatcagcagccagggcct

SEQ ID NO: 385361 - DNA, 140 bp, Artificial Sequence
  Synthetic
atacgccatgctgggtctcctatcaaccaagccatggtgacaagatgtgaaccagttgtttgttatctttatggaaagaggggtggaggaaagagtttgacttcaattgctttggccacacgtacttgggagtcggccat

SEQ ID NO: 385362 - DNA, 140 bp, Artificial Sequence
  Synthetic
atggccgactcccaagtacgtgtggccaaagcaattgaagtcaaactctttcctccacccctctttccataaagataacaaacaactggttcacatcttgtcaccatggcttggttgataggagacccagcatggcgtat

SEQ ID NO: 385363 - DNA, 140 bp, Artificial Sequence
  Synthetic
aggccctggctgctgatatgacactcatttcacgctttctgtctgcttttcttccagggctctccccttgccctaggctctggccgttgcgcccggcggggtcaactccatgattagcatgaccttttgggacagcggtg

SEQ ID NO: 385364 - DNA, 140 bp, Artificial Sequence
  Synthetic
caccgctgtcccaaaaggtcatgctaatcatggagttgaccccgccgggcgcaacggccagagcctagggcaaggggagagccctggaagaaaagcagacagaaagcgtgaaatgagtgtcatatcagcagccagggcct

SEQ ID NO: 385365 - DNA, 140 bp, Artificial Sequence
  Synthetic
atacgccatgctgggtctccaaaatttgcaagcattatggtgttgagcctgagaaaaatatttacacaaaacctgttgcctctgattattgggatggatatagtgggcaactggtatgcacgtacttgggagtcggccat

SEQ ID NO: 385366 - DNA, 140 bp, Artificial Sequence
  Synthetic
atggccgactcccaagtacgtgcataccagttgcccactatatccatcccaataatcagaggcaacaggttttgtgtaaatatttttctcaggctcaacaccataatgcttgcaaattttggagacccagcatggcgtat

SEQ ID NO: 385367 - DNA, 140 bp, Artificial Sequence
  Synthetic
aggccctggctgctgatatgtgaggggacttgatacctcaccgccgtttgcctaggctataggctaaacttccctttccctgcctttcccctattttcctttgttttgtttgtaaatattgaccttttgggacagcggtg

SEQ ID NO: 385368 - DNA, 140 bp, Artificial Sequence
  Synthetic
caccgctgtcccaaaaggtcaatatttacaaacaaaacaaaggaaaataggggaaaggcagggaaagggaagtttagcctatagcctaggcaaacggcggtgaggtatcaagtcccctcacatatcagcagccagggcct

SEQ ID NO: 385369 - DNA, 140 bp, Artificial Sequence
  Synthetic
atacgccatgctgggtctcctaattgatgatattggccaaaatacaactgatgaagactggtctgatttttgtcaactggtgtctggatgtccgatgaggttgaatatggcctctttggacgtacttgggagtcggccat

SEQ ID NO: 385370 - DNA, 140 bp, Artificial Sequence
  Synthetic
atggccgactcccaagtacgtccaaagaggccatattcaacctcatcggacatccagacaccagttgacaaaaatcagaccagtcttcatcagttgtattttggccaatatcatcaattaggagacccagcatggcgtat

SEQ ID NO: 385371 - DNA, 140 bp, Artificial Sequence
  Synthetic
atacgccatgctgggtctccagaaaaaggccgacatttttcatcacctttcataattgccacttctaactggtctaatcctagccctaaaacagtttatgttaaagaagcaatagaccgccgtacttgggagtcggccat

SEQ ID NO: 385372 - DNA, 140 bp, Artificial Sequence
  Synthetic
atggccgactcccaagtacggcggtctattgcttctttaacataaactgttttagggctaggattagaccagttagaagtggcaattatgaaaggtgatgaaaaatgtcggcctttttctggagacccagcatggcgtat

SEQ ID NO: 385373 - DNA, 140 bp, Artificial Sequence
  Synthetic
atacgccatgctgggtctccagattgcattttaaagttgaagtgaagccagcttcattttttaaaaatcctcacaatgacatgttgaatgttaacctagcaaaaactaatgatgctatcacgtacttgggagtcggccat

SEQ ID NO: 385374 - DNA, 140 bp, Artificial Sequence
  Synthetic
atggccgactcccaagtacgtgatagcatcattagtttttgctaggttaacattcaacatgtcattgtgaggatttttaaaaaatgaagctggcttcacttcaactttaaaatgcaatctggagacccagcatggcgtat

SEQ ID NO: 385375 - DNA, 140 bp, Artificial Sequence
  Synthetic
atacgccatgctgggtctccaggatatgtcatgtgttgacttggtcatggatagccataacatctcactatcagaattacttagttcactagtgatgacagtagaaattagaaagcaaaacgtacttgggagtcggccat

SEQ ID NO: 385376 - DNA, 140 bp, Artificial Sequence
  Synthetic
atggccgactcccaagtacgttttgctttctaatttctactgtcatcactagtgaactaagtaattctgatagtgagatgttatggctatccatgaccaagtcaacacatgacatatcctggagacccagcatggcgtat

SEQ ID NO: 385377 - DNA, 140 bp, Artificial Sequence
  Synthetic
atacgccatgctgggtctcctatgtcagaattcatggaactttggtcacaaggaatgtcagatgatgataatgatagtgcagttgcagagtttttccagtcctttccttctggtgagccacgtacttgggagtcggccat

SEQ ID NO: 385378 - DNA, 140 bp, Artificial Sequence
  Synthetic
atggccgactcccaagtacgtggctcaccagaaggaaaggactggaaaaactctgcaactgcactatcattatcatcatctgacattccttgtgaccaaagttccatgaattctgacataggagacccagcatggcgtat

SEQ ID NO: 385379 - DNA, 140 bp, Artificial Sequence
  Synthetic
atacgccatgctgggtctcctctgggtctaagctgtctcgatttttccaatcagtcaccaaccataaatgggttgcagttggggctgctgtgggggttcttggtgttttggttgggggctcgtacttgggagtcggccat

SEQ ID NO: 385380 - DNA, 140 bp, Artificial Sequence
  Synthetic
atggccgactcccaagtacgagcccccaaccaaaacaccaagaacccccacagcagccccaactgcaacccatttatggttggtgactgattggaaaaatcgagacagcttagacccagaggagacccagcatggcgtat

SEQ ID NO: 385381 - DNA, 140 bp, Artificial Sequence
  Synthetic
atacgccatgctgggtctccggtatgtttataagcattttacaaagaaaaaggaagagcccattccaagtgagggagtttatcatggtgtgactaaacctaaacaagtgattaaattagacgtacttgggagtcggccat

SEQ ID NO: 385382 - DNA, 140 bp, Artificial Sequence
  Synthetic
atggccgactcccaagtacgtctaatttaatcacttgtttaggtttagtcacaccatgataaactccctcacttggaatgggctcttcctttttctttgtaaaatgcttataaacataccggagacccagcatggcgtat

SEQ ID NO: 385383 - DNA, 140 bp, Artificial Sequence
  Synthetic
atacgccatgctgggtctcctgctgaccctgtagaatcacaatcaactttggaaattgctggtttggtgaggaaaaatcttgtccagtttggagttggtgagaaaaatggatgtgttagacgtacttgggagtcggccat

SEQ ID NO: 385384 - DNA, 140 bp, Artificial Sequence
  Synthetic
atggccgactcccaagtacgtctaacacatccatttttctcaccaactccaaactggacaagatttttcctcaccaaaccagcaatttccaaagttgattgtgattctacagggtcagcaggagacccagcatggcgtat

SEQ ID NO: 385385 - DNA, 140 bp, Artificial Sequence
  Synthetic
atacgccatgctgggtctcctgggtcatgaatgccttaggtattaaagatgattggctgttggtgccatcccatgcttataaatttgaaaaggattatgaaatgatggaattctattttacgtacttgggagtcggccat

SEQ ID NO: 385386 - DNA, 140 bp, Artificial Sequence
  Synthetic
atggccgactcccaagtacgtaaaatagaattccatcatttcataatccttttcaaatttataagcatgggatggcaccaacagccaatcatctttaatacctaaggcattcatgacccaggagacccagcatggcgtat

SEQ ID NO: 385387 - DNA, 140 bp, Artificial Sequence
  Synthetic
aggccctggctgctgatatgatcagagctatggatccatagcttctttgacagtttatccccatggtttgttgaattgtaatattaacaatgtggtgagaattaaggttccttttatttagaccttttgggacagcggtg

SEQ ID NO: 385388 - DNA, 140 bp, Artificial Sequence
  Synthetic
caccgctgtcccaaaaggtctaaataaaaggaaccttaattctcaccacattgttaatattacaattcaacaaaccatggggataaactgtcaaagaagctatggatccatagctctgatcatatcagcagccagggcct

SEQ ID NO: 385389 - DNA, 140 bp, Artificial Sequence
  Synthetic
atacgccatgctgggtctccatagaggtggtacttactattcaatttctgcaggaaatgttgtgatacagtctctggatgttgggttccaggatgtagttttaatgaaggtgcctacaatcgtacttgggagtcggccat

SEQ ID NO: 385390 - DNA, 140 bp, Artificial Sequence
  Synthetic
atggccgactcccaagtacgattgtaggcaccttcattaaaactacatcctggaacccaacatccagagactgtatcacaacatttcctgcagaaattgaatagtaagtaccacctctatggagacccagcatggcgtat

SEQ ID NO: 385391 - DNA, 140 bp, Artificial Sequence
  Synthetic
atacgccatgctgggtctcctacaagaggagcttatcatttcaaagaccctcaatatcccgtttgggagttgactattagagtttggtctgagttaaacattggaactggcacctccgctcgtacttgggagtcggccat

SEQ ID NO: 385392 - DNA, 140 bp, Artificial Sequence
  Synthetic
atggccgactcccaagtacgagcggaggtgccagttccaatgtttaactcagaccaaactctaatagtcaactcccaaacgggatattgagggtctttgaaatgataagctcctcttgtaggagacccagcatggcgtat

SEQ ID NO: 385393 - DNA, 140 bp, Artificial Sequence
  Synthetic
atacgccatgctgggtctcctccaaaatttagagatattacagaacattttattaaaaagagtgatgtacctagagccttgaataggttggcaacacttgtaaccactgttaatggaacacgtacttgggagtcggccat

SEQ ID NO: 385394 - DNA, 140 bp, Artificial Sequence
  Synthetic
atggccgactcccaagtacgtgttccattaacagtggttacaagtgttgccaacctattcaaggctctaggtacatcactctttttaataaaatgttctgtaatatctctaaattttggaggagacccagcatggcgtat

SEQ ID NO: 385395 - DNA, 140 bp, Artificial Sequence
  Synthetic
atacgccatgctgggtctcctacacatcactaaatgtgctggctagatttactgatttggaacttcatgggctaacacccctatcaacacagatgatgagaaatgaatttagagtcagtacgtacttgggagtcggccat

SEQ ID NO: 385396 - DNA, 140 bp, Artificial Sequence
  Synthetic
atggccgactcccaagtacgtactgactctaaattcatttctcatcatctgtgttgataggggtgttagcccatgaagttccaaatcagtaaatctagccagcacatttagtgatgtgtaggagacccagcatggcgtat

SEQ ID NO: 385397 - DNA, 140 bp, Artificial Sequence
  Synthetic
atacgccatgctgggtctccccaatgttaatttcagaggggcctctcaaaatggaagaaaaggccacatatgttcataaaaagaatgatggcactactatagatttgactgttgaccaagcgtacttgggagtcggccat

SEQ ID NO: 385398 - DNA, 140 bp, Artificial Sequence
  Synthetic
atggccgactcccaagtacgcttggtcaacagtcaaatctatagtagtgccatcattctttttatgaacatatgtggccttttcttccattttgagaggcccctctgaaattaacattggggagacccagcatggcgtat

SEQ ID NO: 385399 - DNA, 140 bp, Artificial Sequence
  Synthetic
atacgccatgctgggtctcccctggagaggtaaaggagagggtcttccagggatgtgtggtggtgctttgatttcctctaatcagtctattcaaaatgccatattagggatacatgttgccgtacttgggagtcggccat

SEQ ID NO: 385400 - DNA, 140 bp, Artificial Sequence
  Synthetic
atggccgactcccaagtacggcaacatgtatccctaatatggcattttgaatagactgattagaggaaatcaaagcaccaccacacatccctggaagaccctctcctttacctctccaggggagacccagcatggcgtat

SEQ ID NO: 385401 - DNA, 140 bp, Artificial Sequence
  Synthetic
atacgccatgctgggtctcctggtggaaactcaattttggtcgctaaattagtcactcaagaaatgtttcagaatatagataagaaaatagttgaaagtcagagaataatgaaagtggaacgtacttgggagtcggccat

SEQ ID NO: 385402 - DNA, 140 bp, Artificial Sequence
  Synthetic
atggccgactcccaagtacgttccactttcattattctctgactttcaactattttcttatctatattctgaaacatttcttgagtgactaatttagcgaccaaaattgagtttccaccaggagacccagcatggcgtat

SEQ ID NO: 385403 - DNA, 140 bp, Artificial Sequence
  Synthetic
aggccctggctgctgatatgagaatatagataagaaaatagttgaaagtcagagaataatgaaagtggaatttactcaatgttcaatgaatgtggtctccaaaacgctttttaaaaagaggaccttttgggacagcggtg

SEQ ID NO: 385404 - DNA, 140 bp, Artificial Sequence
  Synthetic
caccgctgtcccaaaaggtcctctttttaaaaagcgttttggagaccacattcattgaacattgagtaaattccactttcattattctctgactttcaactattttcttatctatattctcatatcagcagccagggcct

SEQ ID NO: 385405 - DNA, 140 bp, Artificial Sequence
  Synthetic
aggccctggctgctgatatgtccaattcatcatcacattgataagaacatgattaattttcctgctgtgatgcccttttctagggcagaaattgatccaatggcagttatgttgtcaaaggaccttttgggacagcggtg

SEQ ID NO: 385406 - DNA, 140 bp, Artificial Sequence
  Synthetic
caccgctgtcccaaaaggtcctttgacaacataactgccattggatcaatttctgccctagaaaagggcatcacagcaggaaaattaatcatgttcttatcaatgtgatgatgaattggacatatcagcagccagggcct

SEQ ID NO: 385407 - DNA, 140 bp, Artificial Sequence
  Synthetic
atacgccatgctgggtctcctattctctccctattgtggatgagccagaggattataaggatgtttctgtctttttccaaaataaaattttagggaagagtcccttggttgatgattttccgtacttgggagtcggccat

SEQ ID NO: 385408 - DNA, 140 bp, Artificial Sequence
  Synthetic
atggccgactcccaagtacggaaaatcatcaaccaagggactcttccctaaaattttattttggaaaaagacagaaacatccttataatcctctggctcatccacaatagggagagaataggagacccagcatggcgtat

SEQ ID NO: 385409 - DNA, 140 bp, Artificial Sequence
  Synthetic
atacgccatgctgggtctcctagatattgaaatggctataaccggggctcctggaatagatgcaatcaatatggattcttcccctggatatccatatgttcaggagaagctgacaaaaagcgtacttgggagtcggccat

SEQ ID NO: 385410 - DNA, 140 bp, Artificial Sequence
  Synthetic
atggccgactcccaagtacgctttttgtcagcttctcctgaacatatggatatccaggggaagaatccatattgattgcatctattccaggagccccggttatagccatttcaatatctaggagacccagcatggcgtat

SEQ ID NO: 385411 - DNA, 140 bp, Artificial Sequence
  Synthetic
atacgccatgctgggtctccaggagagtatactgccataggaaagttgattgtctattgttacaacagactgacttctccctccaatgtggcttctcatgttagagttaatgtttatctccgtacttgggagtcggccat

SEQ ID NO: 385412 - DNA, 140 bp, Artificial Sequence
  Synthetic
atggccgactcccaagtacggagataaacattaactctaacatgagaagccacattggagggagaagtcagtctgttgtaacaatagacaatcaactttcctatggcagtatactctcctggagacccagcatggcgtat

SEQ ID NO: 385413 - DNA, 140 bp, Artificial Sequence
  Synthetic
atacgccatgctgggtctccggatttgatttggcttgatgataatggaatgtttttgggtgtgcaccctagattggcacaaagaattctgtttaatacaacaatgatggaaaattgttctcgtacttgggagtcggccat

SEQ ID NO: 385414 - DNA, 140 bp, Artificial Sequence
  Synthetic
atggccgactcccaagtacgagaacaattttccatcattgttgtattaaacagaattctttgtgccaatctagggtgcacacccaaaaacattccattatcatcaagccaaatcaaatccggagacccagcatggcgtat

SEQ ID NO: 385415 - DNA, 140 bp, Artificial Sequence
  Synthetic
atacgccatgctgggtctcctcagccattaatctagaatgttttgctccactctatcatgctatggatgtcacaactcaggttggagatgattccggaggtttttctaccactgtttcaacgtacttgggagtcggccat

SEQ ID NO: 385416 - DNA, 140 bp, Artificial Sequence
  Synthetic
atggccgactcccaagtacgttgaaacagtggtagaaaaacctccggaatcatctccaacctgagttgtgacatccatagcatgatagagtggagcaaaacattctagattaatggctgaggagacccagcatggcgtat

SEQ ID NO: 385417 - DNA, 140 bp, Artificial Sequence
  Synthetic
atacgccatgctgggtctccgatttagatgttgtttttactacttgtcctaaagatgaactgagacctttggataaggttttggagtctaagactagggctattgactcttgtccacttgcgtacttgggagtcggccat

SEQ ID NO: 385418 - DNA, 140 bp, Artificial Sequence
  Synthetic
atggccgactcccaagtacgcaagtggacaagagtcaatagccctagtcttagactccaaaaccttatccaaaggtctcagttcatctttaggacaagtagtaaaaacaacatctaaatcggagacccagcatggcgtat

SEQ ID NO: 385419 - DNA, 140 bp, Artificial Sequence
  Synthetic
aggccctggctgctgatatgcaaaacagaatgttccagaccctcaagttggcattacaacagtgaaagatcttaaaggtagagcaaaccaagggaagatggatatttcgggtgtccaagcgaccttttgggacagcggtg

SEQ ID NO: 385420 - DNA, 140 bp, Artificial Sequence
  Synthetic
caccgctgtcccaaaaggtcgcttggacacccgaaatatccatcttcccttggtttgctctacctttaagatctttcactgttgtaatgccaacttgagggtctggaacattctgttttgcatatcagcagccagggcct

SEQ ID NO: 385421 - DNA, 140 bp, Artificial Sequence
  Synthetic
atacgccatgctgggtctccattatacaattttgtgtagaatgtattggggccctgctattagttattttcacttgaaccctggctttcatactggagttgcaattggaattgatcctgacgtacttgggagtcggccat

SEQ ID NO: 385422 - DNA, 140 bp, Artificial Sequence
  Synthetic
atggccgactcccaagtacgtcaggatcaattccaattgcaactccagtatgaaagccagggttcaagtgaaaataactaatagcagggccccaatacattctacacaaaattgtataatggagacccagcatggcgtat

SEQ ID NO: 385423 - DNA, 140 bp, Artificial Sequence
  Synthetic
atacgccatgctgggtctcccagacagtgggaccaactttttaaaacaatgattagatttggagatgttggtttagatttggatttttctgcttttgatgctagtcttagtccatttatgcgtacttgggagtcggccat

SEQ ID NO: 385424 - DNA, 140 bp, Artificial Sequence
  Synthetic
atggccgactcccaagtacgcataaatggactaagactagcatcaaaagcagaaaaatccaaatctaaaccaacatctccaaatctaatcattgttttaaaaagttggtcccactgtctgggagacccagcatggcgtat

SEQ ID NO: 385425 - DNA, 140 bp, Artificial Sequence
  Synthetic
aggccctggctgctgatatggatcatatgtctatttataaatttatgggcagatctcatttcttgtgtacatttacatttaattctaataataaagaatacacctttcctattactttgtgaccttttgggacagcggtg

SEQ ID NO: 385426 - DNA, 140 bp, Artificial Sequence
  Synthetic
caccgctgtcccaaaaggtcacaaagtaataggaaaggtgtattctttattattagaattaaatgtaaatgtacacaagaaatgagatctgcccataaatttataaatagacatatgatccatatcagcagccagggcct

SEQ ID NO: 385427 - DNA, 140 bp, Artificial Sequence
  Synthetic
atacgccatgctgggtctccattagagaagctggaagaatactgactgagatgtctggagcacccaatcattttggggaagctctgataaatacaatcatctattctaaacatttgctctcgtacttgggagtcggccat

SEQ ID NO: 385428 - DNA, 140 bp, Artificial Sequence
  Synthetic
atggccgactcccaagtacgagagcaaatgtttagaatagatgattgtatttatcagagcttccccaaaatgattgggtgctccagacatctcagtcagtattcttccagcttctctaatggagacccagcatggcgtat

SEQ ID NO: 385429 - DNA, 140 bp, Artificial Sequence
  Synthetic
atacgccatgctgggtctcccatcaacctctaatcctcctcatggattgccttcaactctgagatggttttttaacctttttcagctttataggggtcctttggatttgacaataattatcgtacttgggagtcggccat

SEQ ID NO: 385430 - DNA, 140 bp, Artificial Sequence
  Synthetic
atggccgactcccaagtacgataattattgtcaaatccaaaggacccctataaagctgaaaaaggttaaaaaaccatctcagagttgaaggcaatccatgaggaggattagaggttgatgggagacccagcatggcgtat

SEQ ID NO: 385431 - DNA, 140 bp, Artificial Sequence
  Synthetic
atacgccatgctgggtctccacaattgttgttaccatgtgtatggttcaatgccttctgggtctccatgcactgctttattaaattcaattattaataatgttaacttgtattacgttttcgtacttgggagtcggccat

SEQ ID NO: 385432 - DNA, 140 bp, Artificial Sequence
  Synthetic
atggccgactcccaagtacgaaaacgtaatacaagttaacattattaataattgaatttaataaagcagtgcatggagacccagaaggcattgaaccatacacatggtaacaacaattgtggagacccagcatggcgtat

SEQ ID NO: 385433 - DNA, 140 bp, Artificial Sequence
  Synthetic
atacgccatgctgggtctccttctaaaatttttaaaaagtcccccgttttcttttgtgatgccataagaattctttgttatggggatgatgttctgattgtcttttcaagacaagtccaacgtacttgggagtcggccat

SEQ ID NO: 385434 - DNA, 140 bp, Artificial Sequence
  Synthetic
atggccgactcccaagtacgttggacttgtcttgaaaagacaatcagaacatcatccccataacaaagaattcttatggcatcacaaaagaaaacgggggactttttaaaaattttagaaggagacccagcatggcgtat

SEQ ID NO: 385435 - DNA, 140 bp, Artificial Sequence
  Synthetic
aggccctggctgctgatatgctggtagaagtgtgtggactcttgagatggatgccggagttcttactggaaggttggtcagattgaatgatgaaaaatggacagaaatgaaggatgataagaccttttgggacagcggtg

SEQ ID NO: 385436 - DNA, 140 bp, Artificial Sequence
  Synthetic
caccgctgtcccaaaaggtcttatcatccttcatttctgtccatttttcatcattcaatctgaccaaccttccagtaagaactccggcatccatctcaagagtccacacacttctaccagcatatcagcagccagggcct

SEQ ID NO: 385437 - DNA, 140 bp, Artificial Sequence
  Synthetic
atacgccatgctgggtctcctttgacaatctggactctatcggtcaacgtattgttgatgagtttaggaagttaggaatgacagctacatcagctgataagtctgttccccaattgaaaccgtacttgggagtcggccat

SEQ ID NO: 385438 - DNA, 140 bp, Artificial Sequence
  Synthetic
atggccgactcccaagtacggtttcaattggggaacagacttatcagctgatgtagctgtcattcctaacttcctaaactcatcaacaatacgttgaccgatagagtccagattgtcaaaggagacccagcatggcgtat

SEQ ID NO: 385439 - DNA, 140 bp, Artificial Sequence
  Synthetic
atacgccatgctgggtctccacaggtgattaaattggatgcagatccagtagagtctcagtcaactttagaaatagcaggattggttaggaaaaatctggttcagtttggagttggagagcgtacttgggagtcggccat

SEQ ID NO: 385440 - DNA, 140 bp, Artificial Sequence
  Synthetic
atggccgactcccaagtacgctctccaactccaaactgaaccagatttttcctaaccaatcctgctatttctaaagttgactgagactctactggatctgcatccaatttaatcacctgtggagacccagcatggcgtat

SEQ ID NO: 385441 - DNA, 140 bp, Artificial Sequence
  Synthetic
atacgccatgctgggtctcccagtttcggaattgacctttctgaaaagatcttttaatttggttgatgatagaatcaggcctgccattgctgagaaaaccatatggtcactggttgcctgcgtacttgggagtcggccat

SEQ ID NO: 385442 - DNA, 140 bp, Artificial Sequence
  Synthetic
atggccgactcccaagtacgcaggcaaccagtgaccatatggttttctcagcaatggcaggcctgattctatcatcaaccaaattaaaagatcttttcagaaaggtcaattccgaaactgggagacccagcatggcgtat

SEQ ID NO: 385443 - DNA, 140 bp, Artificial Sequence
  Synthetic
aggccctggctgctgatatgagaatcaggcctgccattgctgagaaaaccatatggtcactggttgcctggcaaagaagcaatgctgaatttgaacaaaatttggaaaatgcccagtggtgaccttttgggacagcggtg

SEQ ID NO: 385444 - DNA, 140 bp, Artificial Sequence
  Synthetic
caccgctgtcccaaaaggtcaccactgggcattttccaaattttgttcaaattcagcattgcttctttgccaggcaaccagtgaccatatggttttctcagcaatggcaggcctgattctcatatcagcagccagggcct

SEQ ID NO: 385445 - DNA, 140 bp, Artificial Sequence
  Synthetic
atacgccatgctgggtctcctggaggtaggtaagcaaagacttaaatatgctcaggaagaattgtcaaatgaagtgttgcctcctcctcgtaaaattaagggtgtgttttcacaagcaaacgtacttgggagtcggccat

SEQ ID NO: 385446 - DNA, 140 bp, Artificial Sequence
  Synthetic
atggccgactcccaagtacgtttgcttgtgaaaacacacccttaattttacgaggaggaggcaacacttcatttgacaattcttcctgagcatatttaagtctttgcttacctacctccaggagacccagcatggcgtat

SEQ ID NO: 385447 - DNA, 140 bp, Artificial Sequence
  Synthetic
aggccctggctgctgatatgtgctttgtttgtgacctttcatgatttgtttaaacaaatcttcttaaaatttctgaggtttgtttattttattgttcagtaaataaaaaaaaaaaaaaaagaccttttgggacagcggtg

SEQ ID NO: 385448 - DNA, 140 bp, Artificial Sequence
  Synthetic
caccgctgtcccaaaaggtcttttttttttttttttatttactgaacaataaaataaacaaacctcagaaattttaagaagatttgtttaaacaaatcatgaaaggtcacaaacaaagcacatatcagcagccagggcct

SEQ ID NO: 385449 - DNA, 140 bp, Artificial Sequence
  Synthetic
aggccctggctgctgatatgttcaagaggggcctccgggattcccggagtccctcttgggagtccatggtgaggggacttgatacctcaccgccgtttgcctaggctataggctaaatttgaccttttgggacagcggtg

SEQ ID NO: 385450 - DNA, 140 bp, Artificial Sequence
  Synthetic
caccgctgtcccaaaaggtcaaatttagcctatagcctaggcaaacggcggtgaggtatcaagtcccctcaccatggactcccaagagggactccgggaatcccggaggcccctcttgaacatatcagcagccagggcct

SEQ ID NO: 385451 - DNA, 140 bp, Artificial Sequence
  Synthetic
aggccctggctgctgatatgtcccttttccctttccctttattattgtaaatattaattcctgcaggttcagggctcttggatttgttccactatatggacactcatttcacgctttctggaccttttgggacagcggtg

SEQ ID NO: 385452 - DNA, 140 bp, Artificial Sequence
  Synthetic
caccgctgtcccaaaaggtccagaaagcgtgaaatgagtgtccatatagtggaacaaatccaagagccctgaacctgcaggaattaatatttacaataataaagggaaagggaaaagggacatatcagcagccagggcct

SEQ ID NO: 385453 - DNA, 140 bp, Artificial Sequence
  Synthetic
aggccctggctgctgatatgaaagttaattttcctcatggaatgttggatttggaagagattgctgcaaatgcaaaggaatttccgaacatgtcagaaactgatttgtgtttcttgttgcgaccttttgggacagcggtg

SEQ ID NO: 385454 - DNA, 140 bp, Artificial Sequence
  Synthetic
caccgctgtcccaaaaggtcgcaacaagaaacacaaatcagtttctgacatgttcggaaattcctttgcatttgcagcaatctcttccaaatccaacattccatgaggaaaattaactttcatatcagcagccagggcct

SEQ ID NO: 385455 - DNA, 140 bp, Artificial Sequence
  Synthetic
aggccctggctgctgatatgggtgttctgttatttcatgtggtaaagtgttttcaaaaatgttagaaactgtttttaactggcagatggattcgagaatgatggaacttagaactcagaggaccttttgggacagcggtg

SEQ ID NO: 385456 - DNA, 140 bp, Artificial Sequence
  Synthetic
caccgctgtcccaaaaggtcctctgagttctaagttccatcattctcgaatccatctgccagttaaaaacagtttctaacatttttgaaaacactttaccacatgaaataacagaacacccatatcagcagccagggcct

SEQ ID NO: 385457 - DNA, 140 bp, Artificial Sequence
  Synthetic
atacgccatgctgggtctccttctttgacagtttatccccatggtttgttgaattgtaatattaataatgtggtcagaattaaggttccttttatttatacaagaggagcttatcactttcgtacttgggagtcggccat

SEQ ID NO: 385458 - DNA, 140 bp, Artificial Sequence
  Synthetic
atggccgactcccaagtacgaaagtgataagctcctcttgtataaataaaaggaaccttaattctgaccacattattaatattacaattcaacaaaccatggggataaactgtcaaagaaggagacccagcatggcgtat

SEQ ID NO: 385459 - DNA, 140 bp, Artificial Sequence
  Synthetic
aggccctggctgctgatatgcaaatgattcagtctgtggatcgtaccgcagttactggggcttcatatttcacttctgtggatcaatcttctgttcatacggctgaagttggctcacaccgaccttttgggacagcggtg

SEQ ID NO: 385460 - DNA, 140 bp, Artificial Sequence
  Synthetic
caccgctgtcccaaaaggtcggtgtgagccaacttcagccgtatgaacagaagattgatccacagaagtgaaatatgaagccccagtaactgcggtacgatccacagactgaatcatttgcatatcagcagccagggcct

SEQ ID NO: 385461 - DNA, 140 bp, Artificial Sequence
  Synthetic
atacgccatgctgggtctccaacctgaacctttgagaacttcggttgataagccaggctctaagaggacacagggagagaaatttttccttattcattctgctgactggttgacaacacacgtacttgggagtcggccat

SEQ ID NO: 385462 - DNA, 140 bp, Artificial Sequence
  Synthetic
atggccgactcccaagtacgtgtgttgtcaaccagtcagcagaatgaataaggaaaaatttctctccctgtgtcctcttagagcctggcttatcaaccgaagttctcaaaggttcaggttggagacccagcatggcgtat

SEQ ID NO: 385463 - DNA, 140 bp, Artificial Sequence
  Synthetic
aggccctggctgctgatatgttgattcaaaaattgagaactgttcactcaatggcacaggttgatccaggtttaactgttcatttagcccctcttagagactgcattgctagagttcatcgaccttttgggacagcggtg

SEQ ID NO: 385464 - DNA, 140 bp, Artificial Sequence
  Synthetic
caccgctgtcccaaaaggtcgatgaactctagcaatgcagtctctaagaggggctaaatgaacagttaaacctggatcaacctgtgccattgagtgaacagttctcaatttttgaatcaacatatcagcagccagggcct

SEQ ID NO: 385465 - DNA, 140 bp, Artificial Sequence
  Synthetic
aggccctggctgctgatatgtggtttgatatgtgccatggtgccaggagatcagagctacggatctatagcttctttgacagtttaccctcatggtttattgaattgtaatattaacaatgaccttttgggacagcggtg

SEQ ID NO: 385466 - DNA, 140 bp, Artificial Sequence
  Synthetic
caccgctgtcccaaaaggtcattgttaatattacaattcaataaaccatgagggtaaactgtcaaagaagctatagatccgtagctctgatctcctggcaccatggcacatatcaaaccacatatcagcagccagggcct

SEQ ID NO: 385467 - DNA, 140 bp, Artificial Sequence
  Synthetic
aggccctggctgctgatatggacttcaattgctttggccacaaaaatttgtaaacattatggtgttgagcctgagaaaaatatatacacaaaacctgttgcatctgattattgggatggagaccttttgggacagcggtg

SEQ ID NO: 385468 - DNA, 140 bp, Artificial Sequence
  Synthetic
caccgctgtcccaaaaggtctccatcccaataatcagatgcaacaggttttgtgtatatatttttctcaggctcaacaccataatgtttacaaatttttgtggccaaagcaattgaagtccatatcagcagccagggcct

SEQ ID NO: 385469 - DNA, 140 bp, Artificial Sequence
  Synthetic
atacgccatgctgggtctccgtagtcagaattaaagttccttttatctacacaagaggagcttatcatttcaaggaccctcaatatcccgtttgggagttgactattagagtttggtctgcgtacttgggagtcggccat

SEQ ID NO: 385470 - DNA, 140 bp, Artificial Sequence
  Synthetic
atggccgactcccaagtacgcagaccaaactctaatagtcaactcccaaacgggatattgagggtccttgaaatgataagctcctcttgtgtagataaaaggaactttaattctgactacggagacccagcatggcgtat

SEQ ID NO: 385471 - DNA, 140 bp, Artificial Sequence
  Synthetic
atacgccatgctgggtctccagctaaatattggaactggtacctccgcctatacatcactgaatgtgctggctagatttactgatttggaacttcatgggttgacacccctgtccacacacgtacttgggagtcggccat

SEQ ID NO: 385472 - DNA, 140 bp, Artificial Sequence
  Synthetic
atggccgactcccaagtacgtgtgtggacaggggtgtcaacccatgaagttccaaatcagtaaatctagccagcacattcagtgatgtataggcggaggtaccagttccaatatttagctggagacccagcatggcgtat

SEQ ID NO: 385473 - DNA, 140 bp, Artificial Sequence
  Synthetic
aggccctggctgctgatatggatgatgagaaatgaatttagagtcagtacaacagaaaatgtagttaatctgtccaattatgaagatgctagagctaaaatgtcttttgctcttgatcaggaccttttgggacagcggtg

SEQ ID NO: 385474 - DNA, 140 bp, Artificial Sequence
  Synthetic
caccgctgtcccaaaaggtcctgatcaagagcaaaagacattttagctctagcatcttcataattggacagattaactacattttctgttgtactgactctaaattcatttctcatcatccatatcagcagccagggcct

SEQ ID NO: 385475 - DNA, 140 bp, Artificial Sequence
  Synthetic
aggccctggctgctgatatgtgttaaggaagccatagaccgtaggctgcattttaaagttgaggtgaaacctgcctcatttttcaagaatcctcataatgatatgttaaatgtcaatttggaccttttgggacagcggtg

SEQ ID NO: 385476 - DNA, 140 bp, Artificial Sequence
  Synthetic
caccgctgtcccaaaaggtccaaattgacatttaacatatcattatgaggattcttgaaaaatgaggcaggtttcacctcaactttaaaatgcagcctacggtctatggcttccttaacacatatcagcagccagggcct

SEQ ID NO: 385477 - DNA, 140 bp, Artificial Sequence
  Synthetic
aggccctggctgctgatatgttttacaacttggacatcaattcccactttggctgcccagtttccatttaacgcttctgattcagttgggcagcagatcaaggttattccagttgatccagaccttttgggacagcggtg

SEQ ID NO: 385478 - DNA, 140 bp, Artificial Sequence
  Synthetic
caccgctgtcccaaaaggtctggatcaactggaataaccttgatctgctgcccaactgaatcagaagcgttaaatggaaactgggcagccaaagtgggaattgatgtccaagttgtaaaacatatcagcagccagggcct

SEQ ID NO: 385479 - DNA, 140 bp, Artificial Sequence
  Synthetic
aggccctggctgctgatatgcagttgaaattagaaaacaaaacatgtcagaatttatggaactttggtctcagggattatcagatgatgacaatgatagtgcagttgctgaatttttccagaccttttgggacagcggtg

SEQ ID NO: 385480 - DNA, 140 bp, Artificial Sequence
  Synthetic
caccgctgtcccaaaaggtctggaaaaattcagcaactgcactatcattgtcatcatctgataatccctgagaccaaagttccataaattctgacatgttttgttttctaatttcaactgcatatcagcagccagggcct

SEQ ID NO: 385481 - DNA, 140 bp, Artificial Sequence
  Synthetic
aggccctggctgctgatatgcagggattatcagatgatgacaatgatagtgcagttgctgaatttttccagtcttttccctctggtgagccatctgggtcaagattgtcacagtttttccgaccttttgggacagcggtg

SEQ ID NO: 385482 - DNA, 140 bp, Artificial Sequence
  Synthetic
caccgctgtcccaaaaggtcggaaaaactgtgacaatcttgacccagatggctcaccagagggaaaagactggaaaaattcagcaactgcactatcattgtcatcatctgataatccctgcatatcagcagccagggcct

SEQ ID NO: 385483 - DNA, 140 bp, Artificial Sequence
  Synthetic
atacgccatgctgggtctccttgatttccaggtttttcctacaaagtatcattcaggaagattattattttgttttgttcctggaaatgaactgattgatgtttcccacataacactgaacgtacttgggagtcggccat

SEQ ID NO: 385484 - DNA, 140 bp, Artificial Sequence
  Synthetic
atggccgactcccaagtacgttcagtgttatgtgggaaacatcaatcagttcatttccaggaacaaaacaaaataataatcttcctgaatgatactttgtaggaaaaacctggaaatcaaggagacccagcatggcgtat

SEQ ID NO: 385485 - DNA, 140 bp, Artificial Sequence
  Synthetic
atacgccatgctgggtctcccaaccctgagattccgtgttccttggatttcagatactccttatagagttaatagatataccaagtcagcacatcagaaaggagagtatactgccataggcgtacttgggagtcggccat

SEQ ID NO: 385486 - DNA, 140 bp, Artificial Sequence
  Synthetic
atggccgactcccaagtacgcctatggcagtatactctcctttctgatgtgctgacttggtatatctattaactctataaggagtatctgaaatccaaggaacacggaatctcagggttgggagacccagcatggcgtat

SEQ ID NO: 385487 - DNA, 140 bp, Artificial Sequence
  Synthetic
aggccctggctgctgatatgttctgggggcttctctactactgtttcaacaaaacagaatgttccagacccccaagttggtattacaacagtgaaggatcttaaaggtagagcaaatcaggaccttttgggacagcggtg

SEQ ID NO: 385488 - DNA, 140 bp, Artificial Sequence
  Synthetic
caccgctgtcccaaaaggtcctgatttgctctacctttaagatccttcactgttgtaataccaacttgggggtctggaacattctgttttgttgaaacagtagtagagaagcccccagaacatatcagcagccagggcct

SEQ ID NO: 385489 - DNA, 140 bp, Artificial Sequence
  Synthetic
atacgccatgctgggtctccgggaaaatggatatttcgggtgttcaagcacctgtaggagctatcactaccattgaagatccagttttggcaaagaaagtgcctgaaacttttccagaatcgtacttgggagtcggccat

SEQ ID NO: 385490 - DNA, 140 bp, Artificial Sequence
  Synthetic
atggccgactcccaagtacgattctggaaaagtttcaggcactttctttgccaaaactggatcttcaatggtagtgatagctcctacaggtgcttgaacacccgaaatatccattttcccggagacccagcatggcgtat

SEQ ID NO: 385491 - DNA, 140 bp, Artificial Sequence
  Synthetic
atacgccatgctgggtctcctgaagcctggagagtcaagacatacttctgatcatatgtctatttacaaatttatgggcagatctcatttcttgtgcacatttacatttaattctaacaacgtacttgggagtcggccat

SEQ ID NO: 385492 - DNA, 140 bp, Artificial Sequence
  Synthetic
atggccgactcccaagtacgttgttagaattaaatgtaaatgtgcacaagaaatgagatctgcccataaatttgtaaatagacatatgatcagaagtatgtcttgactctccaggcttcaggagacccagcatggcgtat

SEQ ID NO: 385493 - DNA, 140 bp, Artificial Sequence
  Synthetic
atacgccatgctgggtctcccaaagaatacacttttcctattactttgtcatcaacttctaatcctcctcatggattgccttcaactctgagatggttttttaacctttttcagctttaccgtacttgggagtcggccat

SEQ ID NO: 385494 - DNA, 140 bp, Artificial Sequence
  Synthetic
atggccgactcccaagtacggtaaagctgaaaaaggttaaaaaaccatctcagagttgaaggcaatccatgaggaggattagaagttgatgacaaagtaataggaaaagtgtattctttgggagacccagcatggcgtat

SEQ ID NO: 385495 - DNA, 140 bp, Artificial Sequence
  Synthetic
atacgccatgctgggtctccgacaaggtattttccagactgttgggagtggccttgaccacatcctgtctttggcagatgttgaggaggagcaaatgattcagtctgtggatcgtaccgccgtacttgggagtcggccat

SEQ ID NO: 385496 - DNA, 140 bp, Artificial Sequence
  Synthetic
atggccgactcccaagtacggcggtacgatccacagactgaatcatttgctcctcctcaacatctgccaaagacaggatgtggtcaaggccactcccaacagtctggaaaataccttgtcggagacccagcatggcgtat

SEQ ID NO: 385497 - DNA, 140 bp, Artificial Sequence
  Synthetic
atacgccatgctgggtctccccaaaacgctttttagaaagagtccaattcatcatcacattgataaaaacatgattaattttcctgctgtgatgcccttttctagggcagaaattgatcccgtacttgggagtcggccat

SEQ ID NO: 385498 - DNA, 140 bp, Artificial Sequence
  Synthetic
atggccgactcccaagtacgggatcaatttctgccctagaaaagggcatcacagcaggaaaattaatcatgtttttatcaatgtgatgatgaattggactctttctaaaaagcgttttggggagacccagcatggcgtat

SEQ ID NO: 385499 - DNA, 140 bp, Artificial Sequence
  Synthetic
atacgccatgctgggtctccagacagattcaacttttgggcttgtttccattcaaattgcaaattacaatcattcagatgaatatttgtcttttagttgttatttgtctgtgactgaacacgtacttgggagtcggccat

SEQ ID NO: 385500 - DNA, 140 bp, Artificial Sequence
  Synthetic
atggccgactcccaagtacgtgttcagtcacagacaaataacaactaaaagacaaatattcatctgaatgattgtaatttgcaatttgaatggaaacaagcccaaaagttgaatctgtctggagacccagcatggcgtat

SEQ ID NO: 385501 - DNA, 140 bp, Artificial Sequence
  Synthetic
atacgccatgctgggtctccagtcctttggttgatgattttctggatattgaaatggctataacaggggctcctgggatagatgcaatcaatatggattcttcccctggatatccttatgcgtacttgggagtcggccat

SEQ ID NO: 385502 - DNA, 140 bp, Artificial Sequence
  Synthetic
atggccgactcccaagtacgcataaggatatccaggggaagaatccatattgattgcatctatcccaggagcccctgttatagccatttcaatatccagaaaatcatcaaccaaaggactggagacccagcatggcgtat

SEQ ID NO: 385503 - DNA, 140 bp, Artificial Sequence
  Synthetic
atacgccatgctgggtctccgttgatgatcctcgatctgaagaagatcgtaaatttgagagccatattgaaaagaggaagccttataaagagctaagattagaggttggcaagcaaagaccgtacttgggagtcggccat

SEQ ID NO: 385504 - DNA, 140 bp, Artificial Sequence
  Synthetic
atggccgactcccaagtacggtctttgcttgccaacctctaatcttagctctttataaggcttcctcttttcaatatggctctcaaatttacgatcttcttcagatcgaggatcatcaacggagacccagcatggcgtat

SEQ ID NO: 385505 - DNA, 140 bp, Artificial Sequence
  Synthetic
atacgccatgctgggtctcctaaagtatgctcaggaagaactgtcaaatgaagtactacctcctcctcgtaaaatcaagggcgtattttcacaagcaaaaatttcattgttctatacagacgtacttgggagtcggccat

SEQ ID NO: 385506 - DNA, 140 bp, Artificial Sequence
  Synthetic
atggccgactcccaagtacgtctgtatagaacaatgaaatttttgcttgtgaaaatacgcccttgattttacgaggaggaggtagtacttcatttgacagttcttcctgagcatactttaggagacccagcatggcgtat

SEQ ID NO: 385507 - DNA, 140 bp, Artificial Sequence
  Synthetic
atacgccatgctgggtctccagatcatgagattatgaaattttcttggaaaggaattactgctgatactagagccttgaggagatttggcttttcattggctgctggcaggagtgtgtggcgtacttgggagtcggccat

SEQ ID NO: 385508 - DNA, 140 bp, Artificial Sequence
  Synthetic
atggccgactcccaagtacgccacacactcctgccagcagccaatgaaaagccaaatctcctcaaggctctagtatcagcagtaattcctttccaagaaaatttcataatctcatgatctggagacccagcatggcgtat

SEQ ID NO: 385509 - DNA, 140 bp, Artificial Sequence
  Synthetic
aggccctggctgctgatatgttgcaattggaattgatcctgatagacagtgggaccaactttttaaaacaatgattagatttggagatgttggtctagatttggatttttctgcttttgagaccttttgggacagcggtg

SEQ ID NO: 385510 - DNA, 140 bp, Artificial Sequence
  Synthetic
caccgctgtcccaaaaggtctcaaaagcagaaaaatccaaatctagaccaacatctccaaatctaatcattgttttaaaaagttggtcccactgtctatcaggatcaattccaattgcaacatatcagcagccagggcct

SEQ ID NO: 385511 - DNA, 140 bp, Artificial Sequence
  Synthetic
atacgccatgctgggtctccagaagtttactagtaataaacattggtcaaaagttaatttccctcatggaatgctagatttggaagagattgctgcaaatgcaaaagagtttacgaatatcgtacttgggagtcggccat

SEQ ID NO: 385512 - DNA, 140 bp, Artificial Sequence
  Synthetic
atggccgactcccaagtacgatattcgtaaactcttttgcatttgcagcaatctcttccaaatctagcattccatgagggaaattaacttttgaccaatgtttattactagtaaacttctggagacccagcatggcgtat

SEQ ID NO: 385513 - DNA, 140 bp, Artificial Sequence
  Synthetic
aggccctggctgctgatatgaaatgtctggagcccctgttcactttggagaggccctcatcaacacaatcatttattctaaacatttgctttacaattgctgttatcatgtatgtgggtcgaccttttgggacagcggtg

SEQ ID NO: 385514 - DNA, 140 bp, Artificial Sequence
  Synthetic
caccgctgtcccaaaaggtcgacccacatacatgataacagcaattgtaaagcaaatgtttagaataaatgattgtgttgatgagggcctctccaaagtgaacaggggctccagacatttcatatcagcagccagggcct

SEQ ID NO: 385515 - DNA, 140 bp, Artificial Sequence
  Synthetic
atacgccatgctgggtctccgtcagaaactgatttgtgcttcttgttacactggctgaaccccaaaaagataaacttggcagatagaatgttgggtttatctggaatacaggaaattaaacgtacttgggagtcggccat

SEQ ID NO: 385516 - DNA, 140 bp, Artificial Sequence
  Synthetic
atggccgactcccaagtacgtttaatttcctgtattccagataaacccaacattctatctgccaagtttatctttttggggttcagccagtgtaacaagaagcacaaatcagtttctgacggagacccagcatggcgtat

SEQ ID NO: 385517 - DNA, 140 bp, Artificial Sequence
  Synthetic
aggccctggctgctgatatgaatgccttctgggtctccttgtacagcattgttgaattcaattataaacaatgttaatctgtattatgttttttccaaaattttcaaaaaatctccagttgaccttttgggacagcggtg

SEQ ID NO: 385518 - DNA, 140 bp, Artificial Sequence
  Synthetic
caccgctgtcccaaaaggtcaactggagattttttgaaaattttggaaaaaacataatacagattaacattgtttataattgaattcaacaatgctgtacaaggagacccagaaggcattcatatcagcagccagggcct

SEQ ID NO: 385519 - DNA, 140 bp, Artificial Sequence
  Synthetic
aggccctggctgctgatatgaactagcaccttaaagtcaatgatgtttggttttcatcactctgtcacagttgaaatcattaatactgttttatgttttgttaaaagtggcattttgctggaccttttgggacagcggtg

SEQ ID NO: 385520 - DNA, 140 bp, Artificial Sequence
  Synthetic
caccgctgtcccaaaaggtccagcaaaatgccacttttaacaaaacataaaacagtattaatgatttcaactgtgacagagtgatgaaaaccaaacatcattgactttaaggtgctagttcatatcagcagccagggcct

SEQ ID NO: 385521 - DNA, 140 bp, Artificial Sequence
  Synthetic
atacgccatgctgggtctcctacgtgattcaacaattaaatcaagaggaacactcacatataattggtttgttgagagtgatgaattatgctgatattgggtgttctgtcatctcatgtgcgtacttgggagtcggccat

SEQ ID NO: 385522 - DNA, 140 bp, Artificial Sequence
  Synthetic
atggccgactcccaagtacgcacatgagatgacagaacacccaatatcagcataattcatcactctcaacaaaccaattatatgtgagtgttcctcttgatttaattgttgaatcacgtaggagacccagcatggcgtat

SEQ ID NO: 385523 - DNA, 140 bp, Artificial Sequence
  Synthetic
atacgccatgctgggtctcctcgagaatgatggagcttagaactcagagcatctcaaactggcttagagatatctgttcaggtataacaattttcaaaagttttaaagatgcaatttattcgtacttgggagtcggccat

SEQ ID NO: 385524 - DNA, 140 bp, Artificial Sequence
  Synthetic
atggccgactcccaagtacgaataaattgcatctttaaaacttttgaaaattgttatacctgaacagatatctctaagccagtttgagatgctctgagttctaagctccatcattctcgaggagacccagcatggcgtat

SEQ ID NO: 385525 - DNA, 140 bp, Artificial Sequence
  Synthetic
aggccctggctgctgatatgtatctgttcaggtataacaattttcaaaagttttaaagatgcaatttattggctttacacaaaaatcagagaatattacgatctgaattatggtaataaagaccttttgggacagcggtg

SEQ ID NO: 385526 - DNA, 140 bp, Artificial Sequence
  Synthetic
caccgctgtcccaaaaggtctttattaccataattcagatcgtaatattctctgatttttgtgtaaagccaataaattgcatctttaaaacttttgaaaattgttatacctgaacagatacatatcagcagccagggcct

SEQ ID NO: 385527 - DNA, 140 bp, Artificial Sequence
  Synthetic
atacgccatgctgggtctccacaacagtttctacagaacagaatgctccagatccccaagttggtataacaaccatgaaagatttgaaaggaaaagctaacagagggaaaatggatgtttcgtacttgggagtcggccat

SEQ ID NO: 385528 - DNA, 140 bp, Artificial Sequence
  Synthetic
atggccgactcccaagtacgaaacatccattttccctctgttagcttttcctttcaaatctttcatggttgttataccaacttggggatctggagcattctgttctgtagaaactgttgtggagacccagcatggcgtat

SEQ ID NO: 385529 - DNA, 140 bp, Artificial Sequence
  Synthetic
aggccctggctgctgatatgaatttgaacagtaccaaaaaggggttgatttaattcagaaattgagaactgtccactcaatggcacaagttgatccaggtttaactgttcatttagctccgaccttttgggacagcggtg

SEQ ID NO: 385530 - DNA, 140 bp, Artificial Sequence
  Synthetic
caccgctgtcccaaaaggtcggagctaaatgaacagttaaacctggatcaacttgtgccattgagtggacagttctcaatttctgaattaaatcaacccctttttggtactgttcaaattcatatcagcagccagggcct

SEQ ID NO: 385531 - DNA, 140 bp, Artificial Sequence
  Synthetic
atacgccatgctgggtctccggtatggcttggtttactcccgttgggttggcagtagacaccccatgggttgagaaggagtctgctctttccatcgattacaagacagcccttggtgctgcgtacttgggagtcggccat

SEQ ID NO: 385532 - DNA, 140 bp, Artificial Sequence
  Synthetic
atggccgactcccaagtacgcagcaccaagggctgtcttgtaatcgatggaaagagcagactccttctcaacccatggggtgtctactgccaacccaacgggagtaaaccaagccataccggagacccagcatggcgtat

SEQ ID NO: 385533 - DNA, 140 bp, Artificial Sequence
  Synthetic
atacgccatgctgggtctcccagatattgaggaagaacaaatgattcagtctgttgataggactgcagtgactggtgcttcttattttacttctgtagaccaatcttcagttcacactgccgtacttgggagtcggccat

SEQ ID NO: 385534 - DNA, 140 bp, Artificial Sequence
  Synthetic
atggccgactcccaagtacggcagtgtgaactgaagattggtctacagaagtaaaataagaagcaccagtcactgcagtcctatcaacagactgaatcatttgttcttcctcaatatctgggagacccagcatggcgtat

SEQ ID NO: 385535 - DNA, 140 bp, Artificial Sequence
  Synthetic
aggccctggctgctgatatgctttgtttgtgacctttcatgatttgtttaaacaaattttcttaaaatttctgaggtttgtttattttatcttttcagtaaataaaaaaaaaaaaaaaaagaccttttgggacagcggtg

SEQ ID NO: 385536 - DNA, 140 bp, Artificial Sequence
  Synthetic
caccgctgtcccaaaaggtctttttttttttttttttatttactgaaaagataaaataaacaaacctcagaaattttaagaaaatttgtttaaacaaatcatgaaaggtcacaaacaaagcatatcagcagccagggcct

SEQ ID NO: 385537 - DNA, 140 bp, Artificial Sequence
  Synthetic
aggccctggctgctgatatgctggttctaagaagactcagggggagaagtttttcttgattcattctgctgactggctcactacacatgctctttttcatgaagttgcaaaattggatgtgaccttttgggacagcggtg

SEQ ID NO: 385538 - DNA, 140 bp, Artificial Sequence
  Synthetic
caccgctgtcccaaaaggtcacatccaattttgcaacttcatgaaaaagagcatgtgtagtgagccagtcagcagaatgaatcaagaaaaacttctccccctgagtcttcttagaaccagcatatcagcagccagggcct

SEQ ID NO: 385539 - DNA, 140 bp, Artificial Sequence
  Synthetic
aggccctggctgctgatatgttgtcaattggtgtctggatgtccaatgaggttaaatatggcttctttggaagaaaagggtcgccacttttcctcgcccttcataattgcaacatccaacgaccttttgggacagcggtg

SEQ ID NO: 385540 - DNA, 140 bp, Artificial Sequence
  Synthetic
caccgctgtcccaaaaggtcgttggatgttgcaattatgaagggcgaggaaaagtggcgacccttttcttccaaagaagccatatttaacctcattggacatccagacaccaattgacaacatatcagcagccagggcct

SEQ ID NO: 385541 - DNA, 140 bp, Artificial Sequence
  Synthetic
atacgccatgctgggtctccaccacacatatgcaagatttggcattgagattcaagttcagataaaccccacaccctttcagcaagggggactaatttgtgctatggtccctggtgaccacgtacttgggagtcggccat

SEQ ID NO: 385542 - DNA, 140 bp, Artificial Sequence
  Synthetic
atggccgactcccaagtacgtggtcaccagggaccatagcacaaattagtcccccttgctgaaagggtgtggggtttatctgaacttgaatctcaatgccaaatcttgcatatgtgtggtggagacccagcatggcgtat

SEQ ID NO: 385543 - DNA, 140 bp, Artificial Sequence
  Synthetic
atacgccatgctgggtctcctggtctaatccaagtcctaaaacagtctatgttaaagaagccatagatcgtaggttgcatttcaaagttgaggtgaaacctgcctcattctttaaaaatccgtacttgggagtcggccat

SEQ ID NO: 385544 - DNA, 140 bp, Artificial Sequence
  Synthetic
atggccgactcccaagtacggatttttaaagaatgaggcaggtttcacctcaactttgaaatgcaacctacgatctatggcttctttaacatagactgttttaggacttggattagaccaggagacccagcatggcgtat

SEQ ID NO: 385545 - DNA, 140 bp, Artificial Sequence
  Synthetic
aggccctggctgctgatatgtaggttgcatttcaaagttgaggtgaaacctgcctcattctttaaaaatcctcacaatgatatgttaaatgttaatctggcaaaaaccaatgatgctattgaccttttgggacagcggtg

SEQ ID NO: 385546 - DNA, 140 bp, Artificial Sequence
  Synthetic
caccgctgtcccaaaaggtcaatagcatcattggtttttgccagattaacatttaacatatcattgtgaggatttttaaagaatgaggcaggtttcacctcaactttgaaatgcaacctacatatcagcagccagggcct

SEQ ID NO: 385547 - DNA, 140 bp, Artificial Sequence
  Synthetic
aggccctggctgctgatatgagaggtgcttatcattttaaagatccacagtacccagtttgggaattgacaatcagggtttggtcagagttgaatattggaacaggaacttcagcttatagaccttttgggacagcggtg

SEQ ID NO: 385548 - DNA, 140 bp, Artificial Sequence
  Synthetic
caccgctgtcccaaaaggtctataagctgaagttcctgttccaatattcaactctgaccaaaccctgattgtcaattcccaaactgggtactgtggatctttaaaatgataagcacctctcatatcagcagccagggcct

SEQ ID NO: 385549 - DNA, 140 bp, Artificial Sequence
  Synthetic
aggccctggctgctgatatgatatgtcagagtttatggaactctggtcacagggattatcagatgatgacaatgatagtgcagttgctgaatttttccaatcttttccttctggtgagccgaccttttgggacagcggtg

SEQ ID NO: 385550 - DNA, 140 bp, Artificial Sequence
  Synthetic
caccgctgtcccaaaaggtcggctcaccagaaggaaaagattggaaaaattcagcaactgcactatcattgtcatcatctgataatccctgtgaccagagttccataaactctgacatatcatatcagcagccagggcct

SEQ ID NO: 385551 - DNA, 140 bp, Artificial Sequence
  Synthetic
aggccctggctgctgatatgtcaatactattatttattctaaacatctactgtacaattgttgttatcacgtttgtggttcaatgccttctgggtctccttgcacagctttgttgaattcgaccttttgggacagcggtg

SEQ ID NO: 385552 - DNA, 140 bp, Artificial Sequence
  Synthetic
caccgctgtcccaaaaggtcgaattcaacaaagctgtgcaaggagacccagaaggcattgaaccacaaacgtgataacaacaattgtacagtagatgtttagaataaataatagtattgacatatcagcagccagggcct

SEQ ID NO: 385553 - DNA, 140 bp, Artificial Sequence
  Synthetic
atacgccatgctgggtctcctgcccagtttccatttaatgcttcagattcggttgggcaacaaattaaagttattccagtggacccatattttttccagatgacaaacactaatcctgatcgtacttgggagtcggccat

SEQ ID NO: 385554 - DNA, 140 bp, Artificial Sequence
  Synthetic
atggccgactcccaagtacgatcaggattagtgtttgtcatctggaaaaaatatgggtccactggaataactttaatttgttgcccaaccgaatctgaagcattaaatggaaactgggcaggagacccagcatggcgtat

SEQ ID NO: 385555 - DNA, 140 bp, Artificial Sequence
  Synthetic
atacgccatgctgggtctcctggtatgtctataagcattttacaaagaagcaagaagagtccattccaagtgaaggagtgtatcatggtgtgactaagccaaaacaagtgattaaattggcgtacttgggagtcggccat

SEQ ID NO: 385556 - DNA, 140 bp, Artificial Sequence
  Synthetic
atggccgactcccaagtacgccaatttaatcacttgttttggcttagtcacaccatgatacactccttcacttggaatggactcttcttgcttctttgtaaaatgcttatagacataccaggagacccagcatggcgtat

SEQ ID NO: 385557 - DNA, 140 bp, Artificial Sequence
  Synthetic
atacgccatgctgggtctccatgctgatcctgtagagtcacaatcaaccttagaaattgctggtttggtgagaaagaatcttgttcagtttggggttggtgagaagaacggatgtgttagcgtacttgggagtcggccat

SEQ ID NO: 385558 - DNA, 140 bp, Artificial Sequence
  Synthetic
atggccgactcccaagtacgctaacacatccgttcttctcaccaaccccaaactgaacaagattctttctcaccaaaccagcaatttctaaggttgattgtgactctacaggatcagcatggagacccagcatggcgtat

SEQ ID NO: 385559 - DNA, 140 bp, Artificial Sequence
  Synthetic
atacgccatgctgggtctccatgggtcatgaatgctttgggaatcaaggatgattggctattagtgccctctcacgcttacaagtttgaaaaagattatgaaatgatggaattttatttccgtacttgggagtcggccat

SEQ ID NO: 385560 - DNA, 140 bp, Artificial Sequence
  Synthetic
atggccgactcccaagtacggaaataaaattccatcatttcataatctttttcaaacttgtaagcgtgagagggcactaatagccaatcatccttgattcccaaagcattcatgacccatggagacccagcatggcgtat

SEQ ID NO: 385561 - DNA, 140 bp, Artificial Sequence
  Synthetic
atacgccatgctgggtctccaacagaggtggtacttattactcaatttcagcgggaaatgtagtgattcaatctttagatgttggttttcaggatgtagttttaatgaaagtgcccacaacgtacttgggagtcggccat

SEQ ID NO: 385562 - DNA, 140 bp, Artificial Sequence
  Synthetic
atggccgactcccaagtacgttgtgggcactttcattaaaactacatcctgaaaaccaacatctaaagattgaatcactacatttcccgctgaaattgagtaataagtaccacctctgttggagacccagcatggcgtat

SEQ ID NO: 385563 - DNA, 140 bp, Artificial Sequence
  Synthetic
atacgccatgctgggtctccttccaaaatttagagatataacagaacattttatcaaaaagagtgatgtacccagagctttgaacagattggcaacactagtgacaacagttaatgggaccgtacttgggagtcggccat

SEQ ID NO: 385564 - DNA, 140 bp, Artificial Sequence
  Synthetic
atggccgactcccaagtacggtcccattaactgttgtcactagtgttgccaatctgttcaaagctctgggtacatcactctttttgataaaatgttctgttatatctctaaattttggaaggagacccagcatggcgtat

SEQ ID NO: 385565 - DNA, 140 bp, Artificial Sequence
  Synthetic
atacgccatgctgggtctcctccaatgttaatttcagagggaccccttaaaatggaggagaaggctacttatgttcataaaaagaatgatggaaccaccatagatttgactgttgatcaacgtacttgggagtcggccat

SEQ ID NO: 385566 - DNA, 140 bp, Artificial Sequence
  Synthetic
atggccgactcccaagtacgttgatcaacagtcaaatctatggtggttccatcattctttttatgaacataagtagccttctcctccattttaaggggtccctctgaaattaacattggaggagacccagcatggcgtat

SEQ ID NO: 385567 - DNA, 140 bp, Artificial Sequence
  Synthetic
atacgccatgctgggtctccgatttcttctaatcagtccattcagaatgccatattgggaattcatgttgctggtggaaattctattttggttgctaagttagtgacccaagagatgtttcgtacttgggagtcggccat

SEQ ID NO: 385568 - DNA, 140 bp, Artificial Sequence
  Synthetic
atggccgactcccaagtacgaaacatctcttgggtcactaacttagcaaccaaaatagaatttccaccagcaacatgaattcccaatatggcattctgaatggactgattagaagaaatcggagacccagcatggcgtat

SEQ ID NO: 385569 - DNA, 140 bp, Artificial Sequence
  Synthetic
atacgccatgctgggtctccctggtagaagtgtgtggactcttgagatggatgctggagttcttactggaagattgatcagattgaatgatgagaaatggacagaaatgaaggatgataacgtacttgggagtcggccat

SEQ ID NO: 385570 - DNA, 140 bp, Artificial Sequence
  Synthetic
atggccgactcccaagtacgttatcatccttcatttctgtccatttctcatcattcaatctgatcaatcttccagtaagaactccagcatccatctcaagagtccacacacttctaccagggagacccagcatggcgtat

SEQ ID NO: 385571 - DNA, 140 bp, Artificial Sequence
  Synthetic
atacgccatgctgggtctcctctttttccaaaataaaattttgggaaagagtccattagttgatgattttctggatattgaaatggccataacaggggctcctgggatagatgcaattaacgtacttgggagtcggccat

SEQ ID NO: 385572 - DNA, 140 bp, Artificial Sequence
  Synthetic
atggccgactcccaagtacgttaattgcatctatcccaggagcccctgttatggccatttcaatatccagaaaatcatcaactaatggactctttcccaaaattttattttggaaaaagaggagacccagcatggcgtat

SEQ ID NO: 385573 - DNA, 140 bp, Artificial Sequence
  Synthetic
atacgccatgctgggtctcctatggattcttctcctggatatccttatgttcaagaaaaattaaccaaaagagacttgatttggcttgatgataatggaatgtttctgggtctgcatcctcgtacttgggagtcggccat

SEQ ID NO: 385574 - DNA, 140 bp, Artificial Sequence
  Synthetic
atggccgactcccaagtacgaggatgcagacccagaaacattccattatcatcaagccaaatcaagtctcttttggttaatttttcttgaacataaggatatccaggagaagaatccataggagacccagcatggcgtat

SEQ ID NO: 385575 - DNA, 140 bp, Artificial Sequence
  Synthetic
atacgccatgctgggtctccaggctggctcaaagaattctattcaatacaacaatgatggaaaattgctcagatttggatgttgttttcactacctgtcccaaagatgagttaagacctccgtacttgggagtcggccat

SEQ ID NO: 385576 - DNA, 140 bp, Artificial Sequence
  Synthetic
atggccgactcccaagtacggaggtcttaactcatctttgggacaggtagtgaaaacaacatccaaatctgagcaattttccatcattgttgtattgaatagaattctttgagccagcctggagacccagcatggcgtat

SEQ ID NO: 385577 - DNA, 140 bp, Artificial Sequence
  Synthetic
aggccctggctgctgatatgagatttggatgttgttttcactacctgtcccaaagatgagttaagacctctggacaaggtattggaatccaagactagggctattgattcttgtcctcttgaccttttgggacagcggtg

SEQ ID NO: 385578 - DNA, 140 bp, Artificial Sequence
  Synthetic
caccgctgtcccaaaaggtcaagaggacaagaatcaatagccctagtcttggattccaataccttgtccagaggtcttaactcatctttgggacaggtagtgaaaacaacatccaaatctcatatcagcagccagggcct

SEQ ID NO: 385579 - DNA, 140 bp, Artificial Sequence
  Synthetic
aggccctggctgctgatatggactacacgattttgtgtagaatgtactggggtccagctattagttattttcatttgaatcctggttttcatactggtgttgcaattggaattgatcctggaccttttgggacagcggtg

SEQ ID NO: 385580 - DNA, 140 bp, Artificial Sequence
  Synthetic
caccgctgtcccaaaaggtccaggatcaattccaattgcaacaccagtatgaaaaccaggattcaaatgaaaataactaatagctggaccccagtacattctacacaaaatcgtgtagtccatatcagcagccagggcct

SEQ ID NO: 385581 - DNA, 140 bp, Artificial Sequence
  Synthetic
atacgccatgctgggtctccggtctagatttggacttttctgcttttgatgctagtctgagtccatttatgataagggaagctggaagaatccttactgagatgtctggagcccctgttccgtacttgggagtcggccat

SEQ ID NO: 385582 - DNA, 140 bp, Artificial Sequence
  Synthetic
atggccgactcccaagtacggaacaggggctccagacatctcagtaaggattcttccagcttcccttatcataaatggactcagactagcatcaaaagcagaaaagtccaaatctagaccggagacccagcatggcgtat

SEQ ID NO: 385583 - DNA, 140 bp, Artificial Sequence
  Synthetic
aggccctggctgctgatatggataagggaagctggaagaatccttactgagatgtctggagcccctgttcattttggagaggccctgattaacacaattatttattccaaacatttgcttgaccttttgggacagcggtg

SEQ ID NO: 385584 - DNA, 140 bp, Artificial Sequence
  Synthetic
caccgctgtcccaaaaggtcaagcaaatgtttggaataaataattgtgttaatcagggcctctccaaaatgaacaggggctccagacatctcagtaaggattcttccagcttcccttatccatatcagcagccagggcct

SEQ ID NO: 385585 - DNA, 140 bp, Artificial Sequence
  Synthetic
aggccctggctgctgatatgtataattgttgttatcatgtatgtgggtcaatgccttctgggtctccttgtacagccttgttaaattcaattataaacaatgttaatctatattatgtttgaccttttgggacagcggtg

SEQ ID NO: 385586 - DNA, 140 bp, Artificial Sequence
  Synthetic
caccgctgtcccaaaaggtcaaacataatatagattaacattgtttataattgaatttaacaaggctgtacaaggagacccagaaggcattgacccacatacatgataacaacaattatacatatcagcagccagggcct

SEQ ID NO: 385587 - DNA, 140 bp, Artificial Sequence
  Synthetic
atacgccatgctgggtctcctttccaagatcttcaaaaaatctccagttttcttttgtgatgctgtgagaattctttgttatggagatgatgttcttattgtcttctccagacaagtacacgtacttgggagtcggccat

SEQ ID NO: 385588 - DNA, 140 bp, Artificial Sequence
  Synthetic
atggccgactcccaagtacgtgtacttgtctggagaagacaataagaacatcatctccataacaaagaattctcacagcatcacaaaagaaaactggagattttttgaagatcttggaaaggagacccagcatggcgtat

SEQ ID NO: 385589 - DNA, 140 bp, Artificial Sequence
  Synthetic
aggccctggctgctgatatgattctttgttatggagatgatgttcttattgtcttctccagacaagtacaaattgataatttggattctattggacaaagaattgttgatgagtttaagagaccttttgggacagcggtg

SEQ ID NO: 385590 - DNA, 140 bp, Artificial Sequence
  Synthetic
caccgctgtcccaaaaggtctcttaaactcatcaacaattctttgtccaatagaatccaaattatcaatttgtacttgtctggagaagacaataagaacatcatctccataacaaagaatcatatcagcagccagggcct

SEQ ID NO: 385591 - DNA, 140 bp, Artificial Sequence
  Synthetic
atacgccatgctgggtctccggtttgatatgtgccatggtgccaggagatcagagctatggatctatagcttctttgacagtttatccccatggtttgttgaattgtaatattaacaatgcgtacttgggagtcggccat

SEQ ID NO: 385592 - DNA, 140 bp, Artificial Sequence
  Synthetic
atggccgactcccaagtacgcattgttaatattacaattcaacaaaccatggggataaactgtcaaagaagctatagatccatagctctgatctcctggcaccatggcacatatcaaaccggagacccagcatggcgtat

SEQ ID NO: 385593 - DNA, 140 bp, Artificial Sequence
  Synthetic
atacgccatgctgggtctccaattgggaatgacagctacttcagctgacaagtctgttcctcaactgaaaccagtttctgagttaacatttttaaagagatcttttaatttggttgaagacgtacttgggagtcggccat

SEQ ID NO: 385594 - DNA, 140 bp, Artificial Sequence
  Synthetic
atggccgactcccaagtacgtcttcaaccaaattaaaagatctctttaaaaatgttaactcagaaactggtttcagttgaggaacagacttgtcagctgaagtagctgtcattcccaattggagacccagcatggcgtat

SEQ ID NO: 385595 - DNA, 140 bp, Artificial Sequence
  Synthetic
atacgccatgctgggtctcccagaattaggcctgctattgctgagaaaaccatatggtcattagttgcctggcagaggagcaatgctgaatttgaacagaatttggaaaatgcccagtggcgtacttgggagtcggccat

SEQ ID NO: 385596 - DNA, 140 bp, Artificial Sequence
  Synthetic
atggccgactcccaagtacgccactgggcattttccaaattctgttcaaattcagcattgctcctctgccaggcaactaatgaccatatggttttctcagcaatagcaggcctaattctgggagacccagcatggcgtat

SEQ ID NO: 385597 - DNA, 140 bp, Artificial Sequence
  Synthetic
aggccctggctgctgatatgggcagaggagcaatgctgaatttgaacagaatttggaaaatgcccagtggtttgcttttatgcatggatatgaattttaccaacacttctatcattttgtgaccttttgggacagcggtg

SEQ ID NO: 385598 - DNA, 140 bp, Artificial Sequence
  Synthetic
caccgctgtcccaaaaggtcacaaaatgatagaagtgttggtaaaattcatatccatgcataaaagcaaaccactgggcattttccaaattctgttcaaattcagcattgctcctctgcccatatcagcagccagggcct

SEQ ID NO: 385599 - DNA, 140 bp, Artificial Sequence
  Synthetic
aggccctggctgctgatatggtgctttgtttgtgacctttcatgatttgtttaaacaaattttcttaaaatttctgaggtttgtttattttatcttttcagtaaataaaaaaaaaaaaaagaccttttgggacagcggtg

SEQ ID NO: 385600 - DNA, 140 bp, Artificial Sequence
  Synthetic
caccgctgtcccaaaaggtcttttttttttttttatttactgaaaagataaaataaacaaacctcagaaattttaagaaaatttgtttaaacaaatcatgaaaggtcacaaacaaagcaccatatcagcagccagggcct

SEQ ID NO: 385601 - DNA, 140 bp, Artificial Sequence
  Synthetic
aggccctggctgctgatatgtggtgaggggacttgatacctcaccgccgtttgcctaggctataggctaaatttccctttccctgtccttcccctatttccttttgttttgtttgtaaatgaccttttgggacagcggtg

SEQ ID NO: 385602 - DNA, 140 bp, Artificial Sequence
  Synthetic
caccgctgtcccaaaaggtcatttacaaacaaaacaaaaggaaataggggaaggacagggaaagggaaatttagcctatagcctaggcaaacggcggtgaggtatcaagtcccctcaccacatatcagcagccagggcct

SEQ ID NO: 385603 - DNA, 140 bp, Artificial Sequence
  Synthetic
atacgccatgctgggtctccattaattcctgcaggttcagggttctttaatctgtttctctgtaagaacactcaatttttcacgctttctgtctcctttcttccagggctctccccttgccgtacttgggagtcggccat

SEQ ID NO: 385604 - DNA, 140 bp, Artificial Sequence
  Synthetic
atggccgactcccaagtacggcaaggggagagccctggaagaaaggagacagaaagcgtgaaaaattgagtgttcttacagagaaacagattaaagaaccctgaacctgcaggaattaatggagacccagcatggcgtat

SEQ ID NO: 385605 - DNA, 140 bp, Artificial Sequence
  Synthetic
atacgccatgctgggtctcctggtcagaatcaaggttccttttatttacacaagaggagcctatcatttcaaggaccctcaatatcccgtttgggagttgactattagagtttggtctgacgtacttgggagtcggccat

SEQ ID NO: 385606 - DNA, 140 bp, Artificial Sequence
  Synthetic
atggccgactcccaagtacgtcagaccaaactctaatagtcaactcccaaacgggatattgagggtccttgaaatgataggctcctcttgtgtaaataaaaggaaccttgattctgaccaggagacccagcatggcgtat

SEQ ID NO: 385607 - DNA, 140 bp, Artificial Sequence
  Synthetic
aggccctggctgctgatatggctttttagaaagagtcccattcatcaccacattgataaaaccatgattaattttcctgcagctatgcctttttctaaagctgaaattgatccaatggctgaccttttgggacagcggtg

SEQ ID NO: 385608 - DNA, 140 bp, Artificial Sequence
  Synthetic
caccgctgtcccaaaaggtcagccattggatcaatttcagctttagaaaaaggcatagctgcaggaaaattaatcatggttttatcaatgtggtgatgaatgggactctttctaaaaagccatatcagcagccagggcct

SEQ ID NO: 385609 - DNA, 140 bp, Artificial Sequence
  Synthetic
atacgccatgctgggtctccaacaaggaattttccagactgttgggagtggccttgaccacatcctgtctttggcagatattgaggaagaacaaatgattcagtccgttgataggactgccgtacttgggagtcggccat

SEQ ID NO: 385610 - DNA, 140 bp, Artificial Sequence
  Synthetic
atggccgactcccaagtacggcagtcctatcaacggactgaatcatttgttcttcctcaatatctgccaaagacaggatgtggtcaaggccactcccaacagtctggaaaattccttgttggagacccagcatggcgtat

SEQ ID NO: 385611 - DNA, 140 bp, Artificial Sequence
  Synthetic
aggccctggctgctgatatgtctgggtctccttgtacagctttgttgaattcaattattaacaacattaatttgtattatgtgttttctaaaatatttggaaagtctccagttttcttttgaccttttgggacagcggtg

SEQ ID NO: 385612 - DNA, 140 bp, Artificial Sequence
  Synthetic
caccgctgtcccaaaaggtcaaaagaaaactggagactttccaaatattttagaaaacacataatacaaattaatgttgttaataattgaattcaacaaagctgtacaaggagacccagacatatcagcagccagggcct

SEQ ID NO: 385613 - DNA, 140 bp, Artificial Sequence
  Synthetic
aggccctggctgctgatatgagtgactggtgcttcttattttacttctgttgaccaatcttcagttcacactgctgaggttggttcacatcagattgaacctttgaaaacctctgttgatgaccttttgggacagcggtg

SEQ ID NO: 385614 - DNA, 140 bp, Artificial Sequence
  Synthetic
caccgctgtcccaaaaggtcatcaacagaggttttcaaaggttcaatctgatgtgaaccaacctcagcagtgtgaactgaagattggtcaacagaagtaaaataagaagcaccagtcactcatatcagcagccagggcct

SEQ ID NO: 385615 - DNA, 140 bp, Artificial Sequence
  Synthetic
aggccctggctgctgatatgtgctgattggctcactacacatgctctttttcatgaagttgcaaaattggatgtggtaaaattactgtataatgagcagtttgctgttcaaggtttgttggaccttttgggacagcggtg

SEQ ID NO: 385616 - DNA, 140 bp, Artificial Sequence
  Synthetic
caccgctgtcccaaaaggtccaacaaaccttgaacagcaaactgctcattatacagtaattttaccacatccaattttgcaacttcatgaaaaagagcatgtgtagtgagccaatcagcacatatcagcagccagggcct

SEQ ID NO: 385617 - DNA, 140 bp, Artificial Sequence
  Synthetic
atacgccatgctgggtctcctccctttccctgtccttcccctattcccctttgttttatttgtaaatattaattcctgcaggttcagggttctttaatctgtttctctataagaacactccgtacttgggagtcggccat

SEQ ID NO: 385618 - DNA, 140 bp, Artificial Sequence
  Synthetic
atggccgactcccaagtacggagtgttcttatagagaaacagattaaagaaccctgaacctgcaggaattaatatttacaaataaaacaaaggggaataggggaaggacagggaaagggaggagacccagcatggcgtat

SEQ ID NO: 385619 - DNA, 140 bp, Artificial Sequence
  Synthetic
aggccctggctgctgatatgaccaaagttatggttcgatagcatccttgactgtttatccacatggtctgttaaattgtaacatcaataatgtagttagaataaaggttccatttatttagaccttttgggacagcggtg

SEQ ID NO: 385620 - DNA, 140 bp, Artificial Sequence
  Synthetic
caccgctgtcccaaaaggtctaaataaatggaacctttattctaactacattattgatgttacaatttaacagaccatgtggataaacagtcaaggatgctatcgaaccataactttggtcatatcagcagccagggcct

SEQ ID NO: 385621 - DNA, 140 bp, Artificial Sequence
  Synthetic
atacgccatgctgggtctcctactagaggtgcttaccattttaaagatccacaatacccagtttgggaattaacaatcagagtttggtcagagttgaatattggaacaggaacttcagctcgtacttgggagtcggccat

SEQ ID NO: 385622 - DNA, 140 bp, Artificial Sequence
  Synthetic
atggccgactcccaagtacgagctgaagttcctgttccaatattcaactctgaccaaactctgattgttaattcccaaactgggtattgtggatctttaaaatggtaagcacctctagtaggagacccagcatggcgtat

SEQ ID NO: 385623 - DNA, 140 bp, Artificial Sequence
  Synthetic
aggccctggctgctgatatgtaacaatcagagtttggtcagagttgaatattggaacaggaacttcagcttacacttcacttaatgttttggctaggtttacagatttggagttgcatgggaccttttgggacagcggtg

SEQ ID NO: 385624 - DNA, 140 bp, Artificial Sequence
  Synthetic
caccgctgtcccaaaaggtcccatgcaactccaaatctgtaaacctagccaaaacattaagtgaagtgtaagctgaagttcctgttccaatattcaactctgaccaaactctgattgttacatatcagcagccagggcct

SEQ ID NO: 385625 - DNA, 140 bp, Artificial Sequence
  Synthetic
aggccctggctgctgatatgatgatgagaaatgaatttagagtcagtacaacagaaaatgtggttaatttgtccaattatgaagatgctagagcaaaaatgtcttttgctcttgaccagggaccttttgggacagcggtg

SEQ ID NO: 385626 - DNA, 140 bp, Artificial Sequence
  Synthetic
caccgctgtcccaaaaggtccctggtcaagagcaaaagacatttttgctctagcatcttcataattggacaaattaaccacattttctgttgtactgactctaaattcatttctcatcatcatatcagcagccagggcct

SEQ ID NO: 385627 - DNA, 140 bp, Artificial Sequence
  Synthetic
atacgccatgctgggtctccatgtcttttgctttggatcaagaagattggaagtctgatccttctcaaggtggtggaattaaaatcactcattttactacttggacatctattccaacttcgtacttgggagtcggccat

SEQ ID NO: 385628 - DNA, 140 bp, Artificial Sequence
  Synthetic
atggccgactcccaagtacgaagttggaatagatgtccaagtagtaaaatgagtgattttaattccaccaccttgagaaggatcagacttccaatcttcttgatccaaagcaaaagacatggagacccagcatggcgtat

SEQ ID NO: 385629 - DNA, 140 bp, Artificial Sequence
  Synthetic
atacgccatgctgggtctcctagctgcccagtttccatttaatgcttcagattcagttgggcaacagatcaaagttattccagttgacccatactttttccagatgacaaacactaatcccgtacttgggagtcggccat

SEQ ID NO: 385630 - DNA, 140 bp, Artificial Sequence
  Synthetic
atggccgactcccaagtacgggattagtgtttgtcatctggaaaaagtatgggtcaactggaataactttgatctgttgcccaactgaatctgaagcattaaatggaaactgggcagctaggagacccagcatggcgtat

SEQ ID NO: 385631 - DNA, 140 bp, Artificial Sequence
  Synthetic
atacgccatgctgggtctcctgaccagaaatgtataactgccctggcctctatttgtcagatgttttgcttttggaggggagatcttgtttttgattttcaggtttttccaaccaaatatcgtacttgggagtcggccat

SEQ ID NO: 385632 - DNA, 140 bp, Artificial Sequence
  Synthetic
atggccgactcccaagtacgatatttggttggaaaaacctgaaaatcaaaaacaagatctcccctccaaaagcaaaacatctgacaaatagaggccagggcagttatacatttctggtcaggagacccagcatggcgtat

SEQ ID NO: 385633 - DNA, 140 bp, Artificial Sequence
  Synthetic
atacgccatgctgggtctcccattcaggcagattattgttttgttttgttcctggaaatgagttaatagatgttactggaattacattaaagcaagcaactactgccccttgtgcagtaacgtacttgggagtcggccat

SEQ ID NO: 385634 - DNA, 140 bp, Artificial Sequence
  Synthetic
atggccgactcccaagtacgttactgcacaaggggcagtagttgcttgctttaatgtaattccagtaacatctattaactcatttccaggaacaaaacaaaacaataatctgcctgaatgggagacccagcatggcgtat

SEQ ID NO: 385635 - DNA, 140 bp, Artificial Sequence
  Synthetic
aggccctggctgctgatatgtctgatacaccctatcgagtaaataggtacacgaagtcagcacatcaaaaaggtgagtacactgccattggaaagcttattgtgtattgttataatagacgaccttttgggacagcggtg

SEQ ID NO: 385636 - DNA, 140 bp, Artificial Sequence
  Synthetic
caccgctgtcccaaaaggtcgtctattataacaatacacaataagctttccaatggcagtgtactcacctttttgatgtgctgacttcgtgtacctatttactcgatagggtgtatcagacatatcagcagccagggcct

SEQ ID NO: 385637 - DNA, 140 bp, Artificial Sequence
  Synthetic
aggccctggctgctgatatggaggggagatcttgtttttgattttcaggtttttccaaccaaatatcattcaggtaggttgttgttttgttttgttcctgggaatgagttaatagatgttgaccttttgggacagcggtg

SEQ ID NO: 385638 - DNA, 140 bp, Artificial Sequence
  Synthetic
caccgctgtcccaaaaggtcaacatctattaactcattcccaggaacaaaacaaaacaacaacctacctgaatgatatttggttggaaaaacctgaaaatcaaaaacaagatctcccctccatatcagcagccagggcct

SEQ ID NO: 385639 - DNA, 140 bp, Artificial Sequence
  Synthetic
aggccctggctgctgatatgtgagacatttcctgaattgaagcctggagagtctagacatacatcagatcatatgtctatttataaattcatgggaaggtctcattttctgtgtacttttgaccttttgggacagcggtg

SEQ ID NO: 385640 - DNA, 140 bp, Artificial Sequence
  Synthetic
caccgctgtcccaaaaggtcaaaagtacacagaaaatgagaccttcccatgaatttataaatagacatatgatctgatgtatgtctagactctccaggcttcaattcaggaaatgtctcacatatcagcagccagggcct

SEQ ID NO: 385641 - DNA, 140 bp, Artificial Sequence
  Synthetic
atacgccatgctgggtctcccacaggagccactgatgtggatggtatggcctggttcactccagtaggccttgctgtcgacaccccttgggtggaaaaggagtcagccttatctattgatcgtacttgggagtcggccat

SEQ ID NO: 385642 - DNA, 140 bp, Artificial Sequence
  Synthetic
atggccgactcccaagtacgatcaatagataaggctgactccttttccacccaaggggtgtcgacagcaaggcctactggagtgaaccaggccataccatccacatcagtggctcctgtgggagacccagcatggcgtat

SEQ ID NO: 385643 - DNA, 140 bp, Artificial Sequence
  Synthetic
aggccctggctgctgatatgttgctgtcgacaccccttgggtggaaaaggagtcagccttatctattgattacaaaactgcccttggagctgttagatttaacacaagaagaacagggaagaccttttgggacagcggtg

SEQ ID NO: 385644 - DNA, 140 bp, Artificial Sequence
  Synthetic
caccgctgtcccaaaaggtcttccctgttcttcttgtgttaaatctaacagctccaagggcagttttgtaatcaatagataaggctgactccttttccacccaaggggtgtcgacagcaacatatcagcagccagggcct

SEQ ID NO: 385645 - DNA, 140 bp, Artificial Sequence
  Synthetic
atacgccatgctgggtctccggagtgcttgtgggaggatggtttgtgtataagcatttctcccgcagagaggaagagccaattccagctgaaggagtttatcatggcgtgactaagcccacgtacttgggagtcggccat

SEQ ID NO: 385646 - DNA, 140 bp, Artificial Sequence
  Synthetic
atggccgactcccaagtacgtgggcttagtcacgccatgataaactccttcagctggaattggctcttcctctctgcgggagaaatgcttatacacaaaccatcctcccacaagcactccggagacccagcatggcgtat

SEQ ID NO: 385647 - DNA, 140 bp, Artificial Sequence
  Synthetic
aggccctggctgctgatatgcactggatggtttgggagataagacagattctacatttggattggtttctattcagattgcaaattacaatcattctgatgaatatttgtcctttagttggaccttttgggacagcggtg

SEQ ID NO: 385648 - DNA, 140 bp, Artificial Sequence
  Synthetic
caccgctgtcccaaaaggtccaactaaaggacaaatattcatcagaatgattgtaatttgcaatctgaatagaaaccaatccaaatgtagaatctgtcttatctcccaaaccatccagtgcatatcagcagccagggcct

SEQ ID NO: 385649 - DNA, 140 bp, Artificial Sequence
  Synthetic
aggccctggctgctgatatgttatttgtctgtcacagaacaatcagagttttattttcctagagctccattaaattcaaatgctatgttgtccactgagtccatgatgagtagaattgcagaccttttgggacagcggtg

SEQ ID NO: 385650 - DNA, 140 bp, Artificial Sequence
  Synthetic
caccgctgtcccaaaaggtctgcaattctactcatcatggactcagtggacaacatagcatttgaatttaatggagctctaggaaaataaaactctgattgttctgtgacagacaaataacatatcagcagccagggcct

SEQ ID NO: 385651 - DNA, 140 bp, Artificial Sequence
  Synthetic
aggccctggctgctgatatgtaaattcaaatgctatgttgtccactgagtccatgatgagtagaattgcagctggagatttggagtcatcggtggatgatcctagatcagaggaggacaggaccttttgggacagcggtg

SEQ ID NO: 385652 - DNA, 140 bp, Artificial Sequence
  Synthetic
caccgctgtcccaaaaggtcctgtcctcctctgatctaggatcatccaccgatgactccaaatctccagctgcaattctactcatcatggactcagtggacaacatagcatttgaatttacatatcagcagccagggcct

SEQ ID NO: 385653 - DNA, 140 bp, Artificial Sequence
  Synthetic
atacgccatgctgggtctccgctaaacattggaactggtacctctgcttatacatcattgaatgtactggctagatttactgatttggaacttcatggattgacacccctgtctacacagcgtacttgggagtcggccat

SEQ ID NO: 385654 - DNA, 140 bp, Artificial Sequence
  Synthetic
atggccgactcccaagtacgctgtgtagacaggggtgtcaatccatgaagttccaaatcagtaaatctagccagtacattcaatgatgtataagcagaggtaccagttccaatgtttagcggagacccagcatggcgtat

SEQ ID NO: 385655 - DNA, 140 bp, Artificial Sequence
  Synthetic
atacgccatgctgggtctcctggaagactagtcagattgaatgatgagaaatggacagaaatgaaggatgataaaattgtttcattaatcgaaaagttcacaagtaataaatactggtctcgtacttgggagtcggccat

SEQ ID NO: 385656 - DNA, 140 bp, Artificial Sequence
  Synthetic
atggccgactcccaagtacgagaccagtatttattacttgtgaacttttcgattaatgaaacaattttatcatccttcatttctgtccatttctcatcattcaatctgactagtcttccaggagacccagcatggcgtat

SEQ ID NO: 385657 - DNA, 140 bp, Artificial Sequence
  Synthetic
aggccctggctgctgatatgaaagtgaattttccacatggaatgttggatcttgaagaaattgctgccaactctaaagattttccaaatatgtctgagacagatttgtgtttcctgttgcgaccttttgggacagcggtg

SEQ ID NO: 385658 - DNA, 140 bp, Artificial Sequence
  Synthetic
caccgctgtcccaaaaggtcgcaacaggaaacacaaatctgtctcagacatatttggaaaatctttagagttggcagcaatttcttcaagatccaacattccatgtggaaaattcactttcatatcagcagccagggcct

SEQ ID NO: 385659 - DNA, 140 bp, Artificial Sequence
  Synthetic
atacgccatgctgggtctccaattatcaacaacatcaacttgtattatgtgttttctaaaatatttggaaagtctccagttttcttttgtcaagctttgaggattctttgttacggagatcgtacttgggagtcggccat

SEQ ID NO: 385660 - DNA, 140 bp, Artificial Sequence
  Synthetic
atggccgactcccaagtacgatctccgtaacaaagaatcctcaaagcttgacaaaagaaaactggagactttccaaatattttagaaaacacataatacaagttgatgttgttgataattggagacccagcatggcgtat

SEQ ID NO: 385661 - DNA, 140 bp, Artificial Sequence
  Synthetic
aggccctggctgctgatatgggctccaggcattgatgctattaatatggattcatctcctgggtttccttatgttcaagaaaaattgactaaaagagatttgatttggttggatgaaaatgaccttttgggacagcggtg

SEQ ID NO: 385662 - DNA, 140 bp, Artificial Sequence
  Synthetic
caccgctgtcccaaaaggtcattttcatccaaccaaatcaaatctcttttagtcaatttttcttgaacataaggaaacccaggagatgaatccatattaatagcatcaatgcctggagcccatatcagcagccagggcct

SEQ ID NO: 385663 - DNA, 140 bp, Artificial Sequence
  Synthetic
aggccctggctgctgatatggtcaagagtggaatcctgctttatgttatacaacaattgaatcaagatgagcactctcacataattggattgttgagagttatgaattatgcagatattggaccttttgggacagcggtg

SEQ ID NO: 385664 - DNA, 140 bp, Artificial Sequence
  Synthetic
caccgctgtcccaaaaggtccaatatctgcataattcataactctcaacaatccaattatgtgagagtgctcatcttgattcaattgttgtataacataaagcaggattccactcttgaccatatcagcagccagggcct

SEQ ID NO: 385665 - DNA, 140 bp, Artificial Sequence
  Synthetic
aggccctggctgctgatatggtttttaattggcaaatggattccagaatgatggagctgagaactcagagcttttccaattggttaagagacatttgttcaggaattactatttttaaaagaccttttgggacagcggtg

SEQ ID NO: 385666 - DNA, 140 bp, Artificial Sequence
  Synthetic
caccgctgtcccaaaaggtcttttaaaaatagtaattcctgaacaaatgtctcttaaccaattggaaaagctctgagttctcagctccatcattctggaatccatttgccaattaaaaaccatatcagcagccagggcct

SEQ ID NO: 385667 - DNA, 140 bp, Artificial Sequence
  Synthetic
atacgccatgctgggtctccggggttcatttgtcacctctcagagattgcatagccagagtccaccaaaagctcaagaatcttggatctataaatcaggctatggtgacaaggtgtgagccgtacttgggagtcggccat

SEQ ID NO: 385668 - DNA, 140 bp, Artificial Sequence
  Synthetic
atggccgactcccaagtacggctcacaccttgtcaccatagcctgatttatagatccaagattcttgagcttttggtggactctggctatgcaatctctgagaggtgacaaatgaaccccggagacccagcatggcgtat

SEQ ID NO: 385669 - DNA, 140 bp, Artificial Sequence
  Synthetic
atacgccatgctgggtctccgaagtaaattatggtaagaagaaggatattcttaatattcttaaagataaccaacagaaaatagaaaaagccattgaagaagcagacaatttttgcatttcgtacttgggagtcggccat

SEQ ID NO: 385670 - DNA, 140 bp, Artificial Sequence
  Synthetic
atggccgactcccaagtacgaaatgcaaaaattgtctgcttcttcaatggctttttctattttctgttggttatctttaagaatattaagaatatccttcttcttaccataatttacttcggagacccagcatggcgtat

SEQ ID NO: 385671 - DNA, 140 bp, Artificial Sequence
  Synthetic
atacgccatgctgggtctcctgcaaattcaagatgtagagaaatttgatcagtatcagaaaggggttgatttgatacaaaaactgagaactgtccattcaatggctcaagtcgaccctaacgtacttgggagtcggccat

SEQ ID NO: 385672 - DNA, 140 bp, Artificial Sequence
  Synthetic
atggccgactcccaagtacgttagggtcgacttgagccattgaatggacagttctcagtttttgtatcaaatcaacccctttctgatactgatcaaatttctctacatcttgaatttgcaggagacccagcatggcgtat

SEQ ID NO: 385673 - DNA, 140 bp, Artificial Sequence
  Synthetic
atacgccatgctgggtctcccctgggggttcatttgtcacctcttagagattgcatagccagagtccatcaaaagctcaagaatcttggatctataaatcaggccatggtgacaagatgtcgtacttgggagtcggccat

SEQ ID NO: 385674 - DNA, 140 bp, Artificial Sequence
  Synthetic
atggccgactcccaagtacgacatcttgtcaccatggcctgatttatagatccaagattcttgagcttttgatggactctggctatgcaatctctaagaggtgacaaatgaacccccaggggagacccagcatggcgtat

SEQ ID NO: 385675 - DNA, 140 bp, Artificial Sequence
  Synthetic
atacgccatgctgggtctccgagccagttgtctgctatttatatggcaaaagagggggagggaagagtttgacttcaattgcattggcaaccaaaatttgcaaacactatggtgttgaaccgtacttgggagtcggccat

SEQ ID NO: 385676 - DNA, 140 bp, Artificial Sequence
  Synthetic
atggccgactcccaagtacggttcaacaccatagtgtttgcaaattttggttgccaatgcaattgaagtcaaactcttccctccccctcttttgccatataaatagcagacaactggctcggagacccagcatggcgtat

SEQ ID NO: 385677 - DNA, 140 bp, Artificial Sequence
  Synthetic
aggccctggctgctgatatggacttcaattgcattggcaaccaaaatttgcaaacactatggtgttgaaccggagaaaaatatttacactaaacctgtggcctcagattattgggatggtgaccttttgggacagcggtg

SEQ ID NO: 385678 - DNA, 140 bp, Artificial Sequence
  Synthetic
caccgctgtcccaaaaggtcaccatcccaataatctgaggccacaggtttagtgtaaatatttttctccggttcaacaccatagtgtttgcaaattttggttgccaatgcaattgaagtccatatcagcagccagggcct

SEQ ID NO: 385679 - DNA, 140 bp, Artificial Sequence
  Synthetic
aggccctggctgctgatatgcttaaaggtagagcaaaccaagggaagatggatatttcgggtgtccaagctcctgtgggagctattactaccattgaagatccagttttagcaaagaaaggaccttttgggacagcggtg

SEQ ID NO: 385680 - DNA, 140 bp, Artificial Sequence
  Synthetic
caccgctgtcccaaaaggtcctttctttgctaaaactggatcttcaatggtagtaatagctcccacaggagcttggacacccgaaatatccatcttcccttggtttgctctacctttaagcatatcagcagccagggcct

SEQ ID NO: 385681 - DNA, 140 bp, Artificial Sequence
  Synthetic
aggccctggctgctgatatgactggtgcttcttattttacttctgtggaccaatcttcagttcatactgctgaggttggctcacatcaaattgaacctttgaaaacctctgttgataaacgaccttttgggacagcggtg

SEQ ID NO: 385682 - DNA, 140 bp, Artificial Sequence
  Synthetic
caccgctgtcccaaaaggtcgtttatcaacagaggttttcaaaggttcaatttgatgtgagccaacctcagcagtatgaactgaagattggtccacagaagtaaaataagaagcaccagtcatatcagcagccagggcct

SEQ ID NO: 385683 - DNA, 140 bp, Artificial Sequence
  Synthetic
aggccctggctgctgatatgtttataatagcaacttcaaattggtcaaatccaagtccaaaaacagtttatgttaaggaagcaattgatcgtaggcttcattttaaggttgaagttaaacgaccttttgggacagcggtg

SEQ ID NO: 385684 - DNA, 140 bp, Artificial Sequence
  Synthetic
caccgctgtcccaaaaggtcgtttaacttcaaccttaaaatgaagcctacgatcaattgcttccttaacataaactgtttttggacttggatttgaccaatttgaagttgctattataaacatatcagcagccagggcct

SEQ ID NO: 385685 - DNA, 140 bp, Artificial Sequence
  Synthetic
aggccctggctgctgatatgaatctgttactaatcacaagtgggttgctgtgggagctgcagttggtattcttggagtgcttgtgggaggatggttcgtgtataagcatttctctcgcaggaccttttgggacagcggtg

SEQ ID NO: 385686 - DNA, 140 bp, Artificial Sequence
  Synthetic
caccgctgtcccaaaaggtcctgcgagagaaatgcttatacacgaaccatcctcccacaagcactccaagaataccaactgcagctcccacagcaacccacttgtgattagtaacagattcatatcagcagccagggcct

SEQ ID NO: 385687 - DNA, 140 bp, Artificial Sequence
  Synthetic
aggccctggctgctgatatgaactttgagattccgtgttccttggatttcagatactccttatagagttaatagatacactaaatcgtcacatcagaaaggagagtatactgccataggagaccttttgggacagcggtg

SEQ ID NO: 385688 - DNA, 140 bp, Artificial Sequence
  Synthetic
caccgctgtcccaaaaggtctcctatggcagtatactctcctttctgatgtgacgatttagtgtatctattaactctataaggagtatctgaaatccaaggaacacggaatctcaaagttcatatcagcagccagggcct

SEQ ID NO: 385689 - DNA, 140 bp, Artificial Sequence
  Synthetic
atacgccatgctgggtctccagaggaagaaccaattccagctgaaggggtttaccatggcgtgactaaacccaaacaggtgattaaattggatgcagatccagtagagtctcagtcaactcgtacttgggagtcggccat

SEQ ID NO: 385690 - DNA, 140 bp, Artificial Sequence
  Synthetic
atggccgactcccaagtacgagttgactgagactctactggatctgcatccaatttaatcacctgtttgggtttagtcacgccatggtaaaccccttcagctggaattggttcttcctctggagacccagcatggcgtat

SEQ ID NO: 385691 - DNA, 140 bp, Artificial Sequence
  Synthetic
atacgccatgctgggtctccttggaaatagctggattggttaggaagaacttggtccagtttggagttggggagaaaaatggatgtgtgagatgggttatgaatgccttaggagtgaaagcgtacttgggagtcggccat

SEQ ID NO: 385692 - DNA, 140 bp, Artificial Sequence
  Synthetic
atggccgactcccaagtacgctttcactcctaaggcattcataacccatctcacacatccatttttctccccaactccaaactggaccaagttcttcctaaccaatccagctatttccaaggagacccagcatggcgtat

SEQ ID NO: 385693 - DNA, 140 bp, Artificial Sequence
  Synthetic
atacgccatgctgggtctcctggcatagatcctgatagacagtgggatgaattatttaaaacaatgataagatttggagatgttggtcttgacttagatttttctgcctttgatgctagtcgtacttgggagtcggccat

SEQ ID NO: 385694 - DNA, 140 bp, Artificial Sequence
  Synthetic
atggccgactcccaagtacgactagcatcaaaggcagaaaaatctaagtcaagaccaacatctccaaatcttatcattgttttaaataattcatcccactgtctatcaggatctatgccaggagacccagcatggcgtat

SEQ ID NO: 385695 - DNA, 140 bp, Artificial Sequence
  Synthetic
atacgccatgctgggtctccgaaatgatggagttttatttcaatagaggtggaacttactactcaatttcagcaggtaatgttgttattcaatctttggatgtggggtttcaagatgttgcgtacttgggagtcggccat

SEQ ID NO: 385696 - DNA, 140 bp, Artificial Sequence
  Synthetic
atggccgactcccaagtacgcaacatcttgaaaccccacatccaaagattgaataacaacattacctgctgaaattgagtagtaagttccacctctattgaaataaaactccatcatttcggagacccagcatggcgtat

SEQ ID NO: 385697 - DNA, 140 bp, Artificial Sequence
  Synthetic
aggccctggctgctgatatggttgatttgactgtggatcaggcatggagaggaaaaggtgaaggtcttcctggaatgtgtggtggggccctggtgtcatcaaatcagtccatacagaatggaccttttgggacagcggtg

SEQ ID NO: 385698 - DNA, 140 bp, Artificial Sequence
  Synthetic
caccgctgtcccaaaaggtccattctgtatggactgatttgatgacaccagggccccaccacacattccaggaagaccttcaccttttcctctccatgcctgatccacagtcaaatcaaccatatcagcagccagggcct

SEQ ID NO: 385699 - DNA, 140 bp, Artificial Sequence
  Synthetic
aggccctggctgctgatatgtgaggggacttgatacctcaccgccgtttgcctaggctataggctaaatttccctttccctgtccttcccttatttccctttgttttgcttgtaaatattgaccttttgggacagcggtg

SEQ ID NO: 385700 - DNA, 140 bp, Artificial Sequence
  Synthetic
caccgctgtcccaaaaggtcaatatttacaagcaaaacaaagggaaataagggaaggacagggaaagggaaatttagcctatagcctaggcaaacggcggtgaggtatcaagtcccctcacatatcagcagccagggcct

SEQ ID NO: 385701 - DNA, 140 bp, Artificial Sequence
  Synthetic
atacgccatgctgggtctccgattgtaaatattgattcctgcaggttcagggttctttaatcatgtttctctataagaacactcaattttcacgctttctgtcttctttcttccagggctcgtacttgggagtcggccat

SEQ ID NO: 385702 - DNA, 140 bp, Artificial Sequence
  Synthetic
atggccgactcccaagtacgagccctggaagaaagaagacagaaagcgtgaaaattgagtgttcttatagagaaacatgattaaagaaccctgaacctgcaggaatcaatatttacaatcggagacccagcatggcgtat

SEQ ID NO: 385703 - DNA, 140 bp, Artificial Sequence
  Synthetic
atacgccatgctgggtctcccgtcaccttgcagtgttaacttggctctcatgaacctctttgatcttccacaaggggtaggctacgggtgaaacctcttaggctaatacttctatgaagacgtacttgggagtcggccat

SEQ ID NO: 385704 - DNA, 140 bp, Artificial Sequence
  Synthetic
atggccgactcccaagtacgtcttcatagaagtattagcctaagaggtttcacccgtagcctaccccttgtggaagatcaaagaggttcatgagagccaagttaacactgcaaggtgacgggagacccagcatggcgtat

SEQ ID NO: 385705 - DNA, 140 bp, Artificial Sequence
  Synthetic
atacgccatgctgggtctccggctgtgatgttgtccaaatattcattacctattgtggaagaaccagaggattacaaagaagcttcaattttttaccaaaataaaatagtaggcaagactcgtacttgggagtcggccat

SEQ ID NO: 385706 - DNA, 140 bp, Artificial Sequence
  Synthetic
atggccgactcccaagtacgagtcttgcctactattttattttggtaaaaaattgaagcttctttgtaatcctctggttcttccacaataggtaatgaatatttggacaacatcacagccggagacccagcatggcgtat

SEQ ID NO: 385707 - DNA, 140 bp, Artificial Sequence
  Synthetic
atacgccatgctgggtctcctggattgattgtcagggctgtctctaggtttaatctcaagacctctctgtgcttagggcaaacaccatttggccttaaatgggatcctgtgagagggggtcgtacttgggagtcggccat

SEQ ID NO: 385708 - DNA, 140 bp, Artificial Sequence
  Synthetic
atggccgactcccaagtacgaccccctctcacaggatcccatttaaggccaaatggtgtttgccctaagcacagagaggtcttgagattaaacctagagacagccctgacaatcaatccaggagacccagcatggcgtat

SEQ ID NO: 385709 - DNA, 140 bp, Artificial Sequence
  Synthetic
aggccctggctgctgatatgaagatgaattgagaccattagagaaagttttggaatcaaaaacaagagcaattgatgcttgtcctttggattacacaattctatgtcgaatgtattgggggaccttttgggacagcggtg

SEQ ID NO: 385710 - DNA, 140 bp, Artificial Sequence
  Synthetic
caccgctgtcccaaaaggtcccccaatacattcgacatagaattgtgtaatccaaaggacaagcatcaattgctcttgtttttgattccaaaactttctctaatggtctcaattcatcttcatatcagcagccagggcct

SEQ ID NO: 385711 - DNA, 140 bp, Artificial Sequence
  Synthetic
aggccctggctgctgatatggaaatttactagtaataaacactggtccaaagttaattttcctcatggaatgctagatttggaagagattgctgcaaatgcaaaagaatttccgaatatggaccttttgggacagcggtg

SEQ ID NO: 385712 - DNA, 140 bp, Artificial Sequence
  Synthetic
caccgctgtcccaaaaggtccatattcggaaattcttttgcatttgcagcaatctcttccaaatctagcattccatgaggaaaattaactttggaccagtgtttattactagtaaatttccatatcagcagccagggcct

SEQ ID NO: 385713 - DNA, 140 bp, Artificial Sequence
  Synthetic
atacgccatgctgggtctccttttgtcaagctctgagaatcctctgttatggagatgatgttttgatagttttttccagagatgttcaaattgataatcttgatttaattggacagaaaacgtacttgggagtcggccat

SEQ ID NO: 385714 - DNA, 140 bp, Artificial Sequence
  Synthetic
atggccgactcccaagtacgttttctgtccaattaaatcaagattatcaatttgaacatctctggaaaaaactatcaaaacatcatctccataacagaggattctcagagcttgacaaaaggagacccagcatggcgtat

SEQ ID NO: 385715 - DNA, 140 bp, Artificial Sequence
  Synthetic
atacgccatgctgggtctccaatgtgcctcaattgaagccagtttcagaattgacttttcttaaaagatctttcaatctggtggaggataggattagacctgcaatttcagagaagacaacgtacttgggagtcggccat

SEQ ID NO: 385716 - DNA, 140 bp, Artificial Sequence
  Synthetic
atggccgactcccaagtacgttgtcttctctgaaattgcaggtctaatcctatcctccaccagattgaaagatcttttaagaaaagtcaattctgaaactggcttcaattgaggcacattggagacccagcatggcgtat

SEQ ID NO: 385717 - DNA, 140 bp, Artificial Sequence
  Synthetic
aggccctggctgctgatatgtgctttgtttgtgacctttcatgatttgtttaaacaaattttcttaaaatttctgaggtttgtttattttatcttttcagtaaataaaaaaaaaaaaaaagaccttttgggacagcggtg

SEQ ID NO: 385718 - DNA, 140 bp, Artificial Sequence
  Synthetic
caccgctgtcccaaaaggtctttttttttttttttatttactgaaaagataaaataaacaaacctcagaaattttaagaaaatttgtttaaacaaatcatgaaaggtcacaaacaaagcacatatcagcagccagggcct

SEQ ID NO: 385719 - DNA, 140 bp, Artificial Sequence
  Synthetic
aggccctggctgctgatatgagtgtttcatttgtgacctttcatgatttgtttaaacaaattttcttaaaatttctgaggtttgtttatttcttttatcagtaaataaaaaaaaaaaaaagaccttttgggacagcggtg

SEQ ID NO: 385720 - DNA, 140 bp, Artificial Sequence
  Synthetic
caccgctgtcccaaaaggtcttttttttttttttatttactgataaaagaaataaacaaacctcagaaattttaagaaaatttgtttaaacaaatcatgaaaggtcacaaatgaaacactcatatcagcagccagggcct

SEQ ID NO: 385721 - DNA, 140 bp, Artificial Sequence
  Synthetic
atacgccatgctgggtctccgaagtccatggtgaggggacttgatacctcaccgccgtttgcctaggctataggctaaaccttcctttccctgcccttcccttatttccctttgttttgtcgtacttgggagtcggccat

SEQ ID NO: 385722 - DNA, 140 bp, Artificial Sequence
  Synthetic
atggccgactcccaagtacgacaaaacaaagggaaataagggaagggcagggaaaggaaggtttagcctatagcctaggcaaacggcggtgaggtatcaagtcccctcaccatggacttcggagacccagcatggcgtat

SEQ ID NO: 385723 - DNA, 140 bp, Artificial Sequence
  Synthetic
aggccctggctgctgatatgcattcagattaggttgccctggtactcctatctttatgctgtctcaggggcactggatgggcttggagacaaaacagattcaacttttggactggtctctgaccttttgggacagcggtg

SEQ ID NO: 385724 - DNA, 140 bp, Artificial Sequence
  Synthetic
caccgctgtcccaaaaggtcagagaccagtccaaaagttgaatctgttttgtctccaagcccatccagtgcccctgagacagcataaagataggagtaccagggcaacctaatctgaatgcatatcagcagccagggcct

SEQ ID NO: 385725 - DNA, 140 bp, Artificial Sequence
  Synthetic
atacgccatgctgggtctccaaacttggcagatagaatgttgggtctgtcagggatacaggagataaaagaaaaaggggtgggattgattggcgagtgccgggcttttctagattctatacgtacttgggagtcggccat

SEQ ID NO: 385726 - DNA, 140 bp, Artificial Sequence
  Synthetic
atggccgactcccaagtacgtatagaatctagaaaagcccggcactcgccaatcaatcccacccctttttcttttatctcctgtatccctgacagacccaacattctatctgccaagtttggagacccagcatggcgtat

SEQ ID NO: 385727 - DNA, 140 bp, Artificial Sequence
  Synthetic
aggccctggctgctgatatgacttgtattatgtgttttctaaaatatttggaaagtctccagttttcttttgtcaagctctgaggattctttgttatggggatgatgttttgatagttttgaccttttgggacagcggtg

SEQ ID NO: 385728 - DNA, 140 bp, Artificial Sequence
  Synthetic
caccgctgtcccaaaaggtcaaaactatcaaaacatcatccccataacaaagaatcctcagagcttgacaaaagaaaactggagactttccaaatattttagaaaacacataatacaagtcatatcagcagccagggcct

SEQ ID NO: 385729 - DNA, 140 bp, Artificial Sequence
  Synthetic
aggccctggctgctgatatgcactggatgggcttggagacaaaacagattcaacttttggactggtctctattcagattgcaaattacaatcactcagatgaatatttgtcttttagctggaccttttgggacagcggtg

SEQ ID NO: 385730 - DNA, 140 bp, Artificial Sequence
  Synthetic
caccgctgtcccaaaaggtccagctaaaagacaaatattcatctgagtgattgtaatttgcaatctgaatagagaccagtccaaaagttgaatctgttttgtctccaagcccatccagtgcatatcagcagccagggcct

SEQ ID NO: 385731 - DNA, 140 bp, Artificial Sequence
  Synthetic
aggccctggctgctgatatgtgctatggatgttaccacacaggttggagatgattcaggaggtttctcaacaacagtttctacagagcagaatgttcctgacccccaagttggcataacagaccttttgggacagcggtg

SEQ ID NO: 385732 - DNA, 140 bp, Artificial Sequence
  Synthetic
caccgctgtcccaaaaggtctgttatgccaacttgggggtcaggaacattctgctctgtagaaactgttgttgagaaacctcctgaatcatctccaacctgtgtggtaacatccatagcacatatcagcagccagggcct

SEQ ID NO: 385733 - DNA, 140 bp, Artificial Sequence
  Synthetic
atacgccatgctgggtctccaccatgagggatttaaaagggaaagccaataggggaaagatggatgtatcaggagtgcaggtacctgtgggagctattacaacaattgaggatccagtttcgtacttgggagtcggccat

SEQ ID NO: 385734 - DNA, 140 bp, Artificial Sequence
  Synthetic
atggccgactcccaagtacgaaactggatcctcaattgttgtaatagctcccacaggtacctgcactcctgatacatccatctttcccctattggctttcccttttaaatccctcatggtggagacccagcatggcgtat

SEQ ID NO: 385735 - DNA, 140 bp, Artificial Sequence
  Synthetic
atacgccatgctgggtctcctagcaaagaaagtacctgagacatttcctgaattgaagcctggagaatccagacatacatcagatcacatgtctatttataaattcatgggaaggtctcacgtacttgggagtcggccat

SEQ ID NO: 385736 - DNA, 140 bp, Artificial Sequence
  Synthetic
atggccgactcccaagtacgtgagaccttcccatgaatttataaatagacatgtgatctgatgtatgtctggattctccaggcttcaattcaggaaatgtctcaggtactttctttgctaggagacccagcatggcgtat

SEQ ID NO: 385737 - DNA, 140 bp, Artificial Sequence
  Synthetic
atacgccatgctgggtctccgacaattataatcacaggagccactgatgtggatggtatggcctggtttactccagtgggccttgctgtcgacaccccttgggtggaaaaggagtcagctcgtacttgggagtcggccat

SEQ ID NO: 385738 - DNA, 140 bp, Artificial Sequence
  Synthetic
atggccgactcccaagtacgagctgactccttttccacccaaggggtgtcgacagcaaggcccactggagtaaaccaggccataccatccacatcagtggctcctgtgattataattgtcggagacccagcatggcgtat

SEQ ID NO: 385739 - DNA, 140 bp, Artificial Sequence
  Synthetic
aggccctggctgctgatatgctagagctccattaaattcaaatgctatgttgtccactgagtccatgatgagtagaattgcagctggagacttggagtcatcagtggatgatcccagatcgaccttttgggacagcggtg

SEQ ID NO: 385740 - DNA, 140 bp, Artificial Sequence
  Synthetic
caccgctgtcccaaaaggtcgatctgggatcatccactgatgactccaagtctccagctgcaattctactcatcatggactcagtggacaacatagcatttgaatttaatggagctctagcatatcagcagccagggcct

SEQ ID NO: 385741 - DNA, 140 bp, Artificial Sequence
  Synthetic
aggccctggctgctgatatgttatttatactagaggtgcttaccattttaaagatccacagtacccagtttgggaattaacaatcagagtttggtcagaactgaatattggaacaggaacgaccttttgggacagcggtg

SEQ ID NO: 385742 - DNA, 140 bp, Artificial Sequence
  Synthetic
caccgctgtcccaaaaggtcgttcctgttccaatattcagttctgaccaaactctgattgttaattcccaaactgggtactgtggatctttaaaatggtaagcacctctagtataaataacatatcagcagccagggcct

SEQ ID NO: 385743 - DNA, 140 bp, Artificial Sequence
  Synthetic
atacgccatgctgggtctccagaggaggacagaagatttgagagtcatatagaatgtaggaaaccatataaagaattgagactggaggttgggaaacaaagactcaaatatgctcaggaacgtacttgggagtcggccat

SEQ ID NO: 385744 - DNA, 140 bp, Artificial Sequence
  Synthetic
atggccgactcccaagtacgttcctgagcatatttgagtctttgtttcccaacctccagtctcaattctttatatggtttcctacattctatatgactctcaaatcttctgtcctcctctggagacccagcatggcgtat

SEQ ID NO: 385745 - DNA, 140 bp, Artificial Sequence
  Synthetic
aggccctggctgctgatatgttcagcttacacttcacttaacgttttggctaggtttacagatttggagttgcatgggttaactcctctttctacacagatgatgagaaatgaatttagggaccttttgggacagcggtg

SEQ ID NO: 385746 - DNA, 140 bp, Artificial Sequence
  Synthetic
caccgctgtcccaaaaggtccctaaattcatttctcatcatctgtgtagaaagaggagttaacccatgcaactccaaatctgtaaacctagccaaaacgttaagtgaagtgtaagctgaacatatcagcagccagggcct

SEQ ID NO: 385747 - DNA, 140 bp, Artificial Sequence
  Synthetic
atacgccatgctgggtctccgttagtaccactgaaaatgttgtaaatttgtcaaattatgaggatgctagggcaaaaatgtcttttgctttggaccaggaagattggaagtctgatccctcgtacttgggagtcggccat

SEQ ID NO: 385748 - DNA, 140 bp, Artificial Sequence
  Synthetic
atggccgactcccaagtacgagggatcagacttccaatcttcctggtccaaagcaaaagacatttttgccctagcatcctcataatttgacaaatttacaacattttcagtggtactaacggagacccagcatggcgtat

SEQ ID NO: 385749 - DNA, 140 bp, Artificial Sequence
  Synthetic
aggccctggctgctgatatgctcaaggtggtggaattaaaattacccattttactacttggacatccattccaaccttagctgctcagtttccgtttaatgcttcagattcggttgggcagaccttttgggacagcggtg

SEQ ID NO: 385750 - DNA, 140 bp, Artificial Sequence
  Synthetic
caccgctgtcccaaaaggtctgcccaaccgaatctgaagcattaaacggaaactgagcagctaaggttggaatggatgtccaagtagtaaaatgggtaattttaattccaccaccttgagcatatcagcagccagggcct

SEQ ID NO: 385751 - DNA, 140 bp, Artificial Sequence
  Synthetic
aggccctggctgctgatatgccaaccttagctgctcagtttccgtttaatgcttcagattcggttgggcaacaaattaaagttattccagtggatccatattttttccagatgacaaacagaccttttgggacagcggtg

SEQ ID NO: 385752 - DNA, 140 bp, Artificial Sequence
  Synthetic
caccgctgtcccaaaaggtctgtttgtcatctggaaaaaatatggatccactggaataactttaatttgttgcccaaccgaatctgaagcattaaacggaaactgagcagctaaggttggcatatcagcagccagggcct

SEQ ID NO: 385753 - DNA, 140 bp, Artificial Sequence
  Synthetic
aggccctggctgctgatatgaattgctgccaactctaaagattttccaaatatgtctgagacagatttgtgtttcctgttgcattggctaaatccaaagaaaattaatttagcagatagagaccttttgggacagcggtg

SEQ ID NO: 385754 - DNA, 140 bp, Artificial Sequence
  Synthetic
caccgctgtcccaaaaggtctctatctgctaaattaattttctttggatttagccaatgcaacaggaaacacaaatctgtctcagacatatttggaaaatctttagagttggcagcaattcatatcagcagccagggcct

SEQ ID NO: 385755 - DNA, 140 bp, Artificial Sequence
  Synthetic
aggccctggctgctgatatgtaatagatgttactggaattacattaaagcaggcaactactgctccctgtgcagtaatggacattacaggagtgcaatcaaccttgagatttcgtgttccgaccttttgggacagcggtg

SEQ ID NO: 385756 - DNA, 140 bp, Artificial Sequence
  Synthetic
caccgctgtcccaaaaggtcggaacacgaaatctcaaggttgattgcactcctgtaatgtccattactgcacagggagcagtagttgcctgctttaatgtaattccagtaacatctattacatatcagcagccagggcct

SEQ ID NO: 385757 - DNA, 140 bp, Artificial Sequence
  Synthetic
aggccctggctgctgatatggcagtaatggacattacaggagtgcaatcaaccttgagatttcgtgttccttggatttccgatacaccctatcgtgtaaataggtacacaaagtctgcacgaccttttgggacagcggtg

SEQ ID NO: 385758 - DNA, 140 bp, Artificial Sequence
  Synthetic
caccgctgtcccaaaaggtcgtgcagactttgtgtacctatttacacgatagggtgtatcggaaatccaaggaacacgaaatctcaaggttgattgcactcctgtaatgtccattactgccatatcagcagccagggcct

SEQ ID NO: 385759 - DNA, 140 bp, Artificial Sequence
  Synthetic
aggccctggctgctgatatgatcaaaaaggtgagtacactgccattggaaagcttattgtgtactgttataatagactgacttctccttctaatgttgcttctcatgttagagttaatgtgaccttttgggacagcggtg

SEQ ID NO: 385760 - DNA, 140 bp, Artificial Sequence
  Synthetic
caccgctgtcccaaaaggtcacattaactctaacatgagaagcaacattagaaggagaagtcagtctattataacagtacacaataagctttccaatggcagtgtactcacctttttgatcatatcagcagccagggcct

SEQ ID NO: 385761 - DNA, 140 bp, Artificial Sequence
  Synthetic
aggccctggctgctgatatgtacatcagatcatatgtctatttataaattcatgggaaggtctcatttcttgtgtacttttacttttaattcaaataataaagagtacacatttccaatagaccttttgggacagcggtg

SEQ ID NO: 385762 - DNA, 140 bp, Artificial Sequence
  Synthetic
caccgctgtcccaaaaggtctattggaaatgtgtactctttattatttgaattaaaagtaaaagtacacaagaaatgagaccttcccatgaatttataaatagacatatgatctgatgtacatatcagcagccagggcct

SEQ ID NO: 385763 - DNA, 140 bp, Artificial Sequence
  Synthetic
atacgccatgctgggtctcctgtgtacttttacttttaattcaaataataaagagtacacatttccaataactctgtcttcgacttccaatcctcctcatggtttaccatcaacattaagcgtacttgggagtcggccat

SEQ ID NO: 385764 - DNA, 140 bp, Artificial Sequence
  Synthetic
atggccgactcccaagtacgcttaatgttgatggtaaaccatgaggaggattggaagtcgaagacagagttattggaaatgtgtactctttattatttgaattaaaagtaaaagtacacaggagacccagcatggcgtat

SEQ ID NO: 385765 - DNA, 140 bp, Artificial Sequence
  Synthetic
aggccctggctgctgatatggtaggccttgctgtcgacaccccttgggtggaaaaggagtcagctttgtctattgattacaagactgctcttggagctgttagatttaatacaagaagaagaccttttgggacagcggtg

SEQ ID NO: 385766 - DNA, 140 bp, Artificial Sequence
  Synthetic
caccgctgtcccaaaaggtcttcttcttgtattaaatctaacagctccaagagcagtcttgtaatcaatagacaaagctgactccttttccacccaaggggtgtcgacagcaaggcctaccatatcagcagccagggcct

SEQ ID NO: 385767 - DNA, 140 bp, Artificial Sequence
  Synthetic
atacgccatgctgggtctccaatctccttattttacacagaagatcatgaaatcatgaaattctcctggaaaggaatcactgctgatactagagctttgaggagatttggcttttcattgcgtacttgggagtcggccat

SEQ ID NO: 385768 - DNA, 140 bp, Artificial Sequence
  Synthetic
atggccgactcccaagtacgcaatgaaaagccaaatctcctcaaagctctagtatcagcagtgattcctttccaggagaatttcatgatttcatgatcttctgtgtaaaataaggagattggagacccagcatggcgtat

SEQ ID NO: 385769 - DNA, 140 bp, Artificial Sequence
  Synthetic
atacgccatgctgggtctccggtttccattcagattgcaaattataatcattctgatgaatatttgtcctttagctgttatttgtctgtcacagaacaatcagagttctattttcctagacgtacttgggagtcggccat

SEQ ID NO: 385770 - DNA, 140 bp, Artificial Sequence
  Synthetic
atggccgactcccaagtacgtctaggaaaatagaactctgattgttctgtgacagacaaataacagctaaaggacaaatattcatcagaatgattataatttgcaatctgaatggaaaccggagacccagcatggcgtat

SEQ ID NO: 385771 - DNA, 140 bp, Artificial Sequence
  Synthetic
aggccctggctgctgatatgaatgttaatttggctaaaacaaatgatgcaattaaggacatgtcttgtgttgatttgatactggatggacacaatatttcattgatggatttactaaattgaccttttgggacagcggtg

SEQ ID NO: 385772 - DNA, 140 bp, Artificial Sequence
  Synthetic
caccgctgtcccaaaaggtcaatttagtaaatccatcaatgaaatattgtgtccatccagtatcaaatcaacacaagacatgtccttaattgcatcatttgttttagccaaattaacattcatatcagcagccagggcct

SEQ ID NO: 385773 - DNA, 140 bp, Artificial Sequence
  Synthetic
atacgccatgctgggtctccttgagattggaggttggcaaacaaagactcaaatatgctcaggaagagttgtcaaatgaagtgcttccacctcctaggaaaatgaaggggctattttcaccgtacttgggagtcggccat

SEQ ID NO: 385774 - DNA, 140 bp, Artificial Sequence
  Synthetic
atggccgactcccaagtacggtgaaaatagccccttcattttcctaggaggtggaagcacttcatttgacaactcttcctgagcatatttgagtctttgtttgccaacctccaatctcaaggagacccagcatggcgtat

SEQ ID NO: 385775 - DNA, 140 bp, Artificial Sequence
  Synthetic
atacgccatgctgggtctccccttagtgatgacagttgaaattaggaaacagaatatgagtgaatccatggagttgtggtctcagggaatttcagatgatgatagtgcagtacctgagttcgtacttgggagtcggccat

SEQ ID NO: 385776 - DNA, 140 bp, Artificial Sequence
  Synthetic
atggccgactcccaagtacgaactcaggtactgcactatcatcatctgaaattccctgagaccacaactccatggattcactcatattctgtttcctaatttcaactgtcatcactaaggggagacccagcatggcgtat

SEQ ID NO: 385777 - DNA, 140 bp, Artificial Sequence
  Synthetic
atacgccatgctgggtctccaatctaaaatttctcttttttatactgaggagcatgaaataatgaaattttcttggagaggagtaactgctgacactagggctttgagaagatttggattcgtacttgggagtcggccat

SEQ ID NO: 385778 - DNA, 140 bp, Artificial Sequence
  Synthetic
atggccgactcccaagtacgaatccaaatcttctcaaagccctagtgtcagcagttactcctctccaagaaaatttcattatttcatgctcctcagtataaaaaagagaaattttagattggagacccagcatggcgtat

SEQ ID NO: 385779 - DNA, 140 bp, Artificial Sequence
  Synthetic
atacgccatgctgggtctccagttggtgagaaaaatggatgtgtgagatgggtcatgaatgccttaggagtgaaggatgattggttgttagtaccttctcatgcttataaatttgaaaagcgtacttgggagtcggccat

SEQ ID NO: 385780 - DNA, 140 bp, Artificial Sequence
  Synthetic
atggccgactcccaagtacgcttttcaaatttataagcatgagaaggtactaacaaccaatcatccttcactcctaaggcattcatgacccatctcacacatccatttttctcaccaactggagacccagcatggcgtat

SEQ ID NO: 385781 - DNA, 140 bp, Artificial Sequence
  Synthetic
atacgccatgctgggtctcccagagtgtagaactttcttggattctattgctgggactctgaaatctatgatgtttggatttcatcattctgtgactgttgaaattataaatactgtactcgtacttgggagtcggccat

SEQ ID NO: 385782 - DNA, 140 bp, Artificial Sequence
  Synthetic
atggccgactcccaagtacgagtacagtatttataatttcaacagtcacagaatgatgaaatccaaacatcatagatttcagagtcccagcaatagaatccaagaaagttctacactctgggagacccagcatggcgtat

SEQ ID NO: 385783 - DNA, 140 bp, Artificial Sequence
  Synthetic
atacgccatgctgggtctccaagataaccagcagaaaatagaaaaagctattgaagaagcagacaatttttgcattttgcaaattcaagatgtggagaaatttgatcagtatcagaaaggcgtacttgggagtcggccat

SEQ ID NO: 385784 - DNA, 140 bp, Artificial Sequence
  Synthetic
atggccgactcccaagtacgcctttctgatactgatcaaatttctccacatcttgaatttgcaaaatgcaaaaattgtctgcttcttcaatagctttttctattttctgctggttatcttggagacccagcatggcgtat

SEQ ID NO: 385785 - DNA, 140 bp, Artificial Sequence
  Synthetic
aggccctggctgctgatatgtgcattttgcaaattcaagatgtggagaaatttgatcagtatcagaaaggggttgatttaatacaaaagttgagaactgtccattcaatggctcaagttggaccttttgggacagcggtg

SEQ ID NO: 385786 - DNA, 140 bp, Artificial Sequence
  Synthetic
caccgctgtcccaaaaggtccaacttgagccattgaatggacagttctcaacttttgtattaaatcaacccctttctgatactgatcaaatttctccacatcttgaatttgcaaaatgcacatatcagcagccagggcct

SEQ ID NO: 385787 - DNA, 140 bp, Artificial Sequence
  Synthetic
atacgccatgctgggtctccggttgatttaatacaaaagttgagaactgtccattcaatggctcaagttgacactaaccttggggttcatttgtcacctcttagagattgtatagctagacgtacttgggagtcggccat

SEQ ID NO: 385788 - DNA, 140 bp, Artificial Sequence
  Synthetic
atggccgactcccaagtacgtctagctatacaatctctaagaggtgacaaatgaaccccaaggttagtgtcaacttgagccattgaatggacagttctcaacttttgtattaaatcaaccggagacccagcatggcgtat

SEQ ID NO: 385789 - DNA, 140 bp, Artificial Sequence
  Synthetic
aggccctggctgctgatatgcttagagactgtattgctagagttcatcaaaaattaaaaaatttgggttcaattaaccaggcaatggtgacaagatgtgagccagtcgtctgctacctctgaccttttgggacagcggtg

SEQ ID NO: 385790 - DNA, 140 bp, Artificial Sequence
  Synthetic
caccgctgtcccaaaaggtcagaggtagcagacgactggctcacatcttgtcaccattgcctggttaattgaacccaaattttttaatttttgatgaactctagcaatacagtctctaagcatatcagcagccagggcct

SEQ ID NO: 385791 - DNA, 140 bp, Artificial Sequence
  Synthetic
aggccctggctgctgatatgggatggttacagtggacaattggtttgcattattgatgatattggccaaaacacaacagatgaagattggtcagatttttgtcaattagtgtcaggatgcgaccttttgggacagcggtg

SEQ ID NO: 385792 - DNA, 140 bp, Artificial Sequence
  Synthetic
caccgctgtcccaaaaggtcgcatcctgacactaattgacaaaaatctgaccaatcttcatctgttgtgttttggccaatatcatcaataatgcaaaccaattgtccactgtaaccatcccatatcagcagccagggcct

SEQ ID NO: 385793 - DNA, 140 bp, Artificial Sequence
  Synthetic
aggccctggctgctgatatgacacaacagatgaagattggtcagatttttgtcaattagtgtcaggatgcccaatgagattgaatatggcttctcttgaagagaagggcagacatttttcgaccttttgggacagcggtg

SEQ ID NO: 385794 - DNA, 140 bp, Artificial Sequence
  Synthetic
caccgctgtcccaaaaggtcgaaaaatgtctgcccttctcttcaagagaagccatattcaatctcattgggcatcctgacactaattgacaaaaatctgaccaatcttcatctgttgtgtcatatcagcagccagggcct

SEQ ID NO: 385795 - DNA, 140 bp, Artificial Sequence
  Synthetic
atacgccatgctgggtctccgtccaaaagatgaattgagaccattagagaaagttttggaatcaaaaacaagagctattgatgcttgccctttggattatacaattttatgtcgaatgtacgtacttgggagtcggccat

SEQ ID NO: 385796 - DNA, 140 bp, Artificial Sequence
  Synthetic
atggccgactcccaagtacgtacattcgacataaaattgtataatccaaagggcaagcatcaatagctcttgtttttgattccaaaactttctctaatggtctcaattcatcttttggacggagacccagcatggcgtat

SEQ ID NO: 385797 - DNA, 140 bp, Artificial Sequence
  Synthetic
aggccctggctgctgatatgttggggtccagctattagttattttcatttgaatccagggtttcatacaggtgttgctattggcatagatcctgatagacagtgggatgaattatttaaagaccttttgggacagcggtg

SEQ ID NO: 385798 - DNA, 140 bp, Artificial Sequence
  Synthetic
caccgctgtcccaaaaggtctttaaataattcatcccactgtctatcaggatctatgccaatagcaacacctgtatgaaaccctggattcaaatgaaaataactaatagctggaccccaacatatcagcagccagggcct

SEQ ID NO: 385799 - DNA, 140 bp, Artificial Sequence
  Synthetic
atacgccatgctgggtctccgactggctcactacacatgctctttttcatgaagttgcaaaattggatgtggtgaaattattgtataatgagcagttcgctgtccaaggtttgttgagatcgtacttgggagtcggccat

SEQ ID NO: 385800 - DNA, 140 bp, Artificial Sequence
  Synthetic
atggccgactcccaagtacgatctcaacaaaccttggacagcgaactgctcattatacaataatttcaccacatccaattttgcaacttcatgaaaaagagcatgtgtagtgagccagtcggagacccagcatggcgtat

SEQ ID NO: 385801 - DNA, 140 bp, Artificial Sequence
  Synthetic
aggccctggctgctgatatgagaaaattgtggatgagttcaaaaaacttggcatgacagccacttcagctgataaaaatgtgcctcaactgaagccagtttcagaattgacttttcttaagaccttttgggacagcggtg

SEQ ID NO: 385802 - DNA, 140 bp, Artificial Sequence
  Synthetic
caccgctgtcccaaaaggtcttaagaaaagtcaattctgaaactggcttcagttgaggcacatttttatcagctgaagtggctgtcatgccaagttttttgaactcatccacaattttctcatatcagcagccagggcct

SEQ ID NO: 385803 - DNA, 140 bp, Artificial Sequence
  Synthetic
aggccctggctgctgatatgaagatcttttaatttggtggaggacagaatcagacctgcaatttcagaaaagacaatttggtctttgatagcttggcagagaagtaacgctgagtttgaggaccttttgggacagcggtg

SEQ ID NO: 385804 - DNA, 140 bp, Artificial Sequence
  Synthetic
caccgctgtcccaaaaggtcctcaaactcagcgttacttctctgccaagctatcaaagaccaaattgtcttttctgaaattgcaggtctgattctgtcctccaccaaattaaaagatcttcatatcagcagccagggcct

SEQ ID NO: 385805 - DNA, 140 bp, Artificial Sequence
  Synthetic
atacgccatgctgggtctcccagaatctagaaaatgctcagtggtttgctttcatgcatggctatgagttctatcagaaattctattattttgttcagtcctgtttggagaaagagatgacgtacttgggagtcggccat

SEQ ID NO: 385806 - DNA, 140 bp, Artificial Sequence
  Synthetic
atggccgactcccaagtacgtcatctctttctccaaacaggactgaacaaaataatagaatttctgatagaactcatagccatgcatgaaagcaaaccactgagcattttctagattctgggagacccagcatggcgtat

SEQ ID NO: 385807 - DNA, 140 bp, Artificial Sequence
  Synthetic
atacgccatgctgggtctccccctcttggaagtccactgtgagggacctgatacctcaccgccgtttgcctaggctttaggctatttttccctttccctttcccctgttttgtgtaaatacgtacttgggagtcggccat

SEQ ID NO: 385808 - DNA, 140 bp, Artificial Sequence
  Synthetic
atggccgactcccaagtacgtatttacacaaaacaggggaaagggaaagggaaaaatagcctaaagcctaggcaaacggcggtgaggtatcaggtccctcacagtggacttccaagagggggagacccagcatggcgtat

SEQ ID NO: 385809 - DNA, 140 bp, Artificial Sequence
  Synthetic
atacgccatgctgggtctccttaattcctgcaggttcaggtttctttaatctgtttctctataagaacactcattttcacgctttctgtctgctttcttccagggctctccccttgccctcgtacttgggagtcggccat

SEQ ID NO: 385810 - DNA, 140 bp, Artificial Sequence
  Synthetic
atggccgactcccaagtacgagggcaaggggagagccctggaagaaagcagacagaaagcgtgaaaatgagtgttcttatagagaaacagattaaagaaacctgaacctgcaggaattaaggagacccagcatggcgtat

SEQ ID NO: 385811 - DNA, 140 bp, Artificial Sequence
  Synthetic
aggccctggctgctgatatgggcaaagttggttactcaagaaatgtttcaaaatattgataagaaaattgaaagtcagagaataatgaaagtggaatttactcagtgttcaatgaatgtagaccttttgggacagcggtg

SEQ ID NO: 385812 - DNA, 140 bp, Artificial Sequence
  Synthetic
caccgctgtcccaaaaggtctacattcattgaacactgagtaaattccactttcattattctctgactttcaattttcttatcaatattttgaaacatttcttgagtaaccaactttgcccatatcagcagccagggcct

SEQ ID NO: 385813 - DNA, 140 bp, Artificial Sequence
  Synthetic
aggccctggctgctgatatgcagggaacattcagattaggttgccatggtattcttatctgtatgccgtgtctggagcactggatggtttgggagataagacagattctacgtttggactgaccttttgggacagcggtg

SEQ ID NO: 385814 - DNA, 140 bp, Artificial Sequence
  Synthetic
caccgctgtcccaaaaggtcagtccaaacgtagaatctgtcttatctcccaaaccatccagtgctccagacacggcatacagataagaataccatggcaacctaatctgaatgttccctgcatatcagcagccagggcct

SEQ ID NO: 385815 - DNA, 140 bp, Artificial Sequence
  Synthetic
atacgccatgctgggtctccagggctgtctctaggcttaatctcagacctctctgtgcttagggcaaacactacttggccttaaatgggattctgtgagaggggatccctccattgactgcgtacttgggagtcggccat

SEQ ID NO: 385816 - DNA, 140 bp, Artificial Sequence
  Synthetic
atggccgactcccaagtacgcagtcaatggagggatcccctctcacagaatcccatttaaggccaagtagtgtttgccctaagcacagagaggtctgagattaagcctagagacagccctggagacccagcatggcgtat

SEQ ID NO: 385817 - DNA, 140 bp, Artificial Sequence
  Synthetic
atacgccatgctgggtctccctggacttttctttggggccttaggtagagtttgcctctgaggtactcaggggcatttaggtttttcctcatttttatataactatgaatatgtctagaccgtacttgggagtcggccat

SEQ ID NO: 385818 - DNA, 140 bp, Artificial Sequence
  Synthetic
atggccgactcccaagtacggtctagacatattcatagttatataaaaatgaggaaaaacctaaatgcccctgagtacctcagaggcaaactctacctaaggccccaaagaaaagtccagggagacccagcatggcgtat

SEQ ID NO: 385819 - DNA, 140 bp, Artificial Sequence
  Synthetic
atacgccatgctgggtctccagggtattttccaaactgttgggagtggtcttgaccacatcctgtctttggcagatattgaggaggaacaaatgattcaatcagttgatagaactgctgtcgtacttgggagtcggccat

SEQ ID NO: 385820 - DNA, 140 bp, Artificial Sequence
  Synthetic
atggccgactcccaagtacgacagcagttctatcaactgattgaatcatttgttcctcctcaatatctgccaaagacaggatgtggtcaagaccactcccaacagtttggaaaataccctggagacccagcatggcgtat

SEQ ID NO: 385821 - DNA, 140 bp, Artificial Sequence
  Synthetic
atacgccatgctgggtctccgactggtgcttcttattttacatctgttgatcagtcttcagttcatactgcagaggttggttcacatcaagttgagcctcttaaaacctccgtggacaaacgtacttgggagtcggccat

SEQ ID NO: 385822 - DNA, 140 bp, Artificial Sequence
  Synthetic
atggccgactcccaagtacgtttgtccacggaggttttaagaggctcaacttgatgtgaaccaacctctgcagtatgaactgaagactgatcaacagatgtaaaataagaagcaccagtcggagacccagcatggcgtat

SEQ ID NO: 385823 - DNA, 140 bp, Artificial Sequence
  Synthetic
atacgccatgctgggtctcctggagctactgatgtggatgggatggcctggtttactccagtgggtcttgctgttgacacaccttgggtggagaaggaatcagcattgtcaatagattaccgtacttgggagtcggccat

SEQ ID NO: 385824 - DNA, 140 bp, Artificial Sequence
  Synthetic
atggccgactcccaagtacggtaatctattgacaatgctgattccttctccacccaaggtgtgtcaacagcaagacccactggagtaaaccaggccatcccatccacatcagtagctccaggagacccagcatggcgtat

SEQ ID NO: 385825 - DNA, 140 bp, Artificial Sequence
  Synthetic
atacgccatgctgggtctcccctggctcaaagaagacacaaggagaaaaatttttcctgattcattctgcggactggttaacgacacatgccttgtttcatgaggtagcaaaattggatgcgtacttgggagtcggccat

SEQ ID NO: 385826 - DNA, 140 bp, Artificial Sequence
  Synthetic
atggccgactcccaagtacgcatccaattttgctacctcatgaaacaaggcatgtgtcgttaaccagtccgcagaatgaatcaggaaaaatttttctccttgtgtcttctttgagccaggggagacccagcatggcgtat

SEQ ID NO: 385827 - DNA, 140 bp, Artificial Sequence
  Synthetic
aggccctggctgctgatatgtcagaaactgatttgtgtttcttgttgcattggctgaaccccaaaaagataaacttagcagatagaatgttgggtctgtcagggatacaggagattaaaggaccttttgggacagcggtg

SEQ ID NO: 385828 - DNA, 140 bp, Artificial Sequence
  Synthetic
caccgctgtcccaaaaggtcctttaatctcctgtatccctgacagacccaacattctatctgctaagtttatctttttggggttcagccaatgcaacaagaaacacaaatcagtttctgacatatcagcagccagggcct

SEQ ID NO: 385829 - DNA, 140 bp, Artificial Sequence
  Synthetic
atacgccatgctgggtctccttgttaaattattgtataatgagcagtttgctgtccagggtttactgagatatcatacatatgcaagatttggcattgagattcaagttcaaataaatcccgtacttgggagtcggccat

SEQ ID NO: 385830 - DNA, 140 bp, Artificial Sequence
  Synthetic
atggccgactcccaagtacgggatttatttgaacttgaatctcaatgccaaatcttgcatatgtatgatatctcagtaaaccctggacagcaaactgctcattatacaataatttaacaaggagacccagcatggcgtat

SEQ ID NO: 385831 - DNA, 140 bp, Artificial Sequence
  Synthetic
atacgccatgctgggtctccgttattccagtggacccatattttttccagatgacaaatactaatcctgatcaaaaatgtataactgccttggcctctatttgtcagatgttttgcttttcgtacttgggagtcggccat

SEQ ID NO: 385832 - DNA, 140 bp, Artificial Sequence
  Synthetic
atggccgactcccaagtacgaaaagcaaaacatctgacaaatagaggccaaggcagttatacatttttgatcaggattagtatttgtcatctggaaaaaatatgggtccactggaataacggagacccagcatggcgtat

SEQ ID NO: 385833 - DNA, 140 bp, Artificial Sequence
  Synthetic
atacgccatgctgggtctcccactccttttcagcaaggaggactgatttgtgctatggttcctggtgaccagagttatggctctattgcttctttgactgtttatccccatggcttgctgcgtacttgggagtcggccat

SEQ ID NO: 385834 - DNA, 140 bp, Artificial Sequence
  Synthetic
atggccgactcccaagtacgcagcaagccatggggataaacagtcaaagaagcaatagagccataactctggtcaccaggaaccatagcacaaatcagtcctccttgctgaaaaggagtgggagacccagcatggcgtat

SEQ ID NO: 385835 - DNA, 140 bp, Artificial Sequence
  Synthetic
atacgccatgctgggtctccgttcaatgccttctgggtctccttgtacagctttgttgaattcaattattaataacattaatttgtattatgtgttttctaaaatatttggaaagtctcccgtacttgggagtcggccat

SEQ ID NO: 385836 - DNA, 140 bp, Artificial Sequence
  Synthetic
atggccgactcccaagtacgggagactttccaaatattttagaaaacacataatacaaattaatgttattaataattgaattcaacaaagctgtacaaggagacccagaaggcattgaacggagacccagcatggcgtat

SEQ ID NO: 385837 - DNA, 140 bp, Artificial Sequence
  Synthetic
atacgccatgctgggtctcccaattagagtttggtctgaattgaatattgggacaggaacctcagcttatacttctcttaatgttctggcaagatttacagatttggaattgcatgggttcgtacttgggagtcggccat

SEQ ID NO: 385838 - DNA, 140 bp, Artificial Sequence
  Synthetic
atggccgactcccaagtacgaacccatgcaattccaaatctgtaaatcttgccagaacattaagagaagtataagctgaggttcctgtcccaatattcaattcagaccaaactctaattgggagacccagcatggcgtat

SEQ ID NO: 385839 - DNA, 140 bp, Artificial Sequence
  Synthetic
aggccctggctgctgatatggtttttaactggcagatggattcgagaatgatggaacttagaactcagagtatttcaaattggcttagagatatctgttcaggtataacaatttttaaaagaccttttgggacagcggtg

SEQ ID NO: 385840 - DNA, 140 bp, Artificial Sequence
  Synthetic
caccgctgtcccaaaaggtcttttaaaaattgttatacctgaacagatatctctaagccaatttgaaatactctgagttctaagttccatcattctcgaatccatctgccagttaaaaaccatatcagcagccagggcct

SEQ ID NO: 385841 - DNA, 140 bp, Artificial Sequence
  Synthetic
atacgccatgctgggtctccgactcctttatccacacaaatgatgagaaatgaatttagagtcagcactacagaaaatgtggtgaatttatctaattatgaggatgccagagccaaaatgcgtacttgggagtcggccat

SEQ ID NO: 385842 - DNA, 140 bp, Artificial Sequence
  Synthetic
atggccgactcccaagtacgcattttggctctggcatcctcataattagataaattcaccacattttctgtagtgctgactctaaattcatttctcatcatttgtgtggataaaggagtcggagacccagcatggcgtat

SEQ ID NO: 385843 - DNA, 140 bp, Artificial Sequence
  Synthetic
atacgccatgctgggtctcctcttttgctttggatcaagaagattggaagtctgatccttctcagggtgggagaattaagataacccattttacaacttggacatctattccaaccctggcgtacttgggagtcggccat

SEQ ID NO: 385844 - DNA, 140 bp, Artificial Sequence
  Synthetic
atggccgactcccaagtacgccagggttggaatagatgtccaagttgtaaaatgggttatcttaattctcccaccctgagaaggatcagacttccaatcttcttgatccaaagcaaaagaggagacccagcatggcgtat

SEQ ID NO: 385845 - DNA, 140 bp, Artificial Sequence
  Synthetic
aggccctggctgctgatatgaagacaatttggtctttgatagcttggcagagaagcaacgctgagtttgagcagaatttagaaaatgctcagtggtttgcttttatgcatggctatgagtgaccttttgggacagcggtg

SEQ ID NO: 385846 - DNA, 140 bp, Artificial Sequence
  Synthetic
caccgctgtcccaaaaggtcactcatagccatgcataaaagcaaaccactgagcattttctaaattctgctcaaactcagcgttgcttctctgccaagctatcaaagaccaaattgtcttcatatcagcagccagggcct

SEQ ID NO: 385847 - DNA, 140 bp, Artificial Sequence
  Synthetic
atacgccatgctgggtctcccggcacagtttccatttaatgcttcagattctgttggacagcagatcaaagtcattccagttgacccttattttttccaaatgacaaattcaaatcctgacgtacttgggagtcggccat

SEQ ID NO: 385848 - DNA, 140 bp, Artificial Sequence
  Synthetic
atggccgactcccaagtacgtcaggatttgaatttgtcatttggaaaaaataagggtcaactggaatgactttgatctgctgtccaacagaatctgaagcattaaatggaaactgtgccgggagacccagcatggcgtat

SEQ ID NO: 385849 - DNA, 140 bp, Artificial Sequence
  Synthetic
atacgccatgctgggtctcctcaaaaatgtataactgctttggcttctatctgtcaaatgttttgcttttggagaggagatcttgtctttgactttcaggttttccctacaaagtatcatcgtacttgggagtcggccat

SEQ ID NO: 385850 - DNA, 140 bp, Artificial Sequence
  Synthetic
atggccgactcccaagtacgatgatactttgtagggaaaacctgaaagtcaaagacaagatctcctctccaaaagcaaaacatttgacagatagaagccaaagcagttatacatttttgaggagacccagcatggcgtat

SEQ ID NO: 385851 - DNA, 140 bp, Artificial Sequence
  Synthetic
atacgccatgctgggtctcctctggtaggttgttgttttgttttgtgcctggtaatgagttaattgatgtttctgggattaccttaaaacaggctaccacagctccatgtgctgttatggcgtacttgggagtcggccat

SEQ ID NO: 385852 - DNA, 140 bp, Artificial Sequence
  Synthetic
atggccgactcccaagtacgccataacagcacatggagctgtggtagcctgttttaaggtaatcccagaaacatcaattaactcattaccaggcacaaaacaaaacaacaacctaccagaggagacccagcatggcgtat

SEQ ID NO: 385853 - DNA, 140 bp, Artificial Sequence
  Synthetic
atacgccatgctgggtctccacatcacaggagtacagtccaccttgagatttcgtgttccctggatttctgacacaccttatagagtgaacagatatacgaaatctgcacaccagaaaggcgtacttgggagtcggccat

SEQ ID NO: 385854 - DNA, 140 bp, Artificial Sequence
  Synthetic
atggccgactcccaagtacgcctttctggtgtgcagatttcgtatatctgttcactctataaggtgtgtcagaaatccagggaacacgaaatctcaaggtggactgtactcctgtgatgtggagacccagcatggcgtat

SEQ ID NO: 385855 - DNA, 140 bp, Artificial Sequence
  Synthetic
atacgccatgctgggtctcctgaatatactgcaattggaaaattgattgtttattgttataatagattgacttccccatccaatgtggcttcacatgttagagttaatgtttacctttctcgtacttgggagtcggccat

SEQ ID NO: 385856 - DNA, 140 bp, Artificial Sequence
  Synthetic
atggccgactcccaagtacgagaaaggtaaacattaactctaacatgtgaagccacattggatggggaagtcaatctattataacaataaacaatcaattttccaattgcagtatattcaggagacccagcatggcgtat

SEQ ID NO: 385857 - DNA, 140 bp, Artificial Sequence
  Synthetic
atacgccatgctgggtctccgcaatcaatttggagtgttttgcaccattgtatcatgccatggatgttacaacgcaggttggagatgattcaggaggattttctactacagtttcaacagcgtacttgggagtcggccat

SEQ ID NO: 385858 - DNA, 140 bp, Artificial Sequence
  Synthetic
atggccgactcccaagtacgctgttgaaactgtagtagaaaatcctcctgaatcatctccaacctgcgttgtaacatccatggcatgatacaatggtgcaaaacactccaaattgattgcggagacccagcatggcgtat

SEQ ID NO: 385859 - DNA, 140 bp, Artificial Sequence
  Synthetic
atacgccatgctgggtctccttattgatgacattggccaaaatacaactgatgaggattggtctgatttttgtcaattggtgtctggatgtccaatgaggttaaatatggcttctttggacgtacttgggagtcggccat

SEQ ID NO: 385860 - DNA, 140 bp, Artificial Sequence
  Synthetic
atggccgactcccaagtacgtccaaagaagccatatttaacctcattggacatccagacaccaattgacaaaaatcagaccaatcctcatcagttgtattttggccaatgtcatcaataaggagacccagcatggcgtat

SEQ ID NO: 385861 - DNA, 140 bp, Artificial Sequence
  Synthetic
atacgccatgctgggtctccaacagaatgtccctgatccacaggttggcataacaacgatgagagatttgaagggcagagctaatagagggaagatggatgtttcaggagtacaggcccccgtacttgggagtcggccat

SEQ ID NO: 385862 - DNA, 140 bp, Artificial Sequence
  Synthetic
atggccgactcccaagtacgggggcctgtactcctgaaacatccatcttccctctattagctctgcccttcaaatctctcatcgttgttatgccaacctgtggatcagggacattctgttggagacccagcatggcgtat

SEQ ID NO: 385863 - DNA, 140 bp, Artificial Sequence
  Synthetic
atacgccatgctgggtctcctgtgggtgcaattacaaccatagaagatcctgttctggctaagaaagtgcctgaaacttttccagaactgaaacctggagagtctagacatacttcagatcgtacttgggagtcggccat

SEQ ID NO: 385864 - DNA, 140 bp, Artificial Sequence
  Synthetic
atggccgactcccaagtacgatctgaagtatgtctagactctccaggtttcagttctggaaaagtttcaggcactttcttagccagaacaggatcttctatggttgtaattgcacccacaggagacccagcatggcgtat

SEQ ID NO: 385865 - DNA, 140 bp, Artificial Sequence
  Synthetic
atacgccatgctgggtctcccatatgtctatttacaaattcatggggagatctcattttctgtgtacatttacttttaattcaaataacaaggagtatacattcccaattactttgtcttcgtacttgggagtcggccat

SEQ ID NO: 385866 - DNA, 140 bp, Artificial Sequence
  Synthetic
atggccgactcccaagtacgaagacaaagtaattgggaatgtatactccttgttatttgaattaaaagtaaatgtacacagaaaatgagatctccccatgaatttgtaaatagacatatgggagacccagcatggcgtat

SEQ ID NO: 385867 - DNA, 140 bp, Artificial Sequence
  Synthetic
atacgccatgctgggtctcctgaggttggctcacatcaaattgaacctttgaaaacctctgttgataaacctggttctaagaagactcaaggggagaagtttttcttgattcattctgctcgtacttgggagtcggccat

SEQ ID NO: 385868 - DNA, 140 bp, Artificial Sequence
  Synthetic
atggccgactcccaagtacgagcagaatgaatcaagaaaaacttctccccttgagtcttcttagaaccaggtttatcaacagaggttttcaaaggttcaatttgatgtgagccaacctcaggagacccagcatggcgtat

SEQ ID NO: 385869 - DNA, 140 bp, Artificial Sequence
  Synthetic
atacgccatgctgggtctcccaacatctaatcccccacatggactgccatcaacattaagatggtttttcaatttgtttcagttatatagaggtccattagacttgacaatcataataaccgtacttgggagtcggccat

SEQ ID NO: 385870 - DNA, 140 bp, Artificial Sequence
  Synthetic
atggccgactcccaagtacggttattatgattgtcaagtctaatggacctctatataactgaaacaaattgaaaaaccatcttaatgttgatggcagtccatgtgggggattagatgttgggagacccagcatggcgtat

SEQ ID NO: 385871 - DNA, 140 bp, Artificial Sequence
  Synthetic
atacgccatgctgggtctccaccatacatatgcaagatttggcattgagattcaagttcagataaatcccacaccctttcagcaagggggactaatttgtgccatggttcctggtgaccacgtacttgggagtcggccat

SEQ ID NO: 385872 - DNA, 140 bp, Artificial Sequence
  Synthetic
atggccgactcccaagtacgtggtcaccaggaaccatggcacaaattagtcccccttgctgaaagggtgtgggatttatctgaacttgaatctcaatgccaaatcttgcatatgtatggtggagacccagcatggcgtat

SEQ ID NO: 385873 - DNA, 140 bp, Artificial Sequence
  Synthetic
atacgccatgctgggtctccaaaacagccttaggagctgttaggttcaacacaagaagaacagggaacattcagattaggttaccttggtattcctacctgtatgctgtttcaggtgcaccgtacttgggagtcggccat

SEQ ID NO: 385874 - DNA, 140 bp, Artificial Sequence
  Synthetic
atggccgactcccaagtacggtgcacctgaaacagcatacaggtaggaataccaaggtaacctaatctgaatgttccctgttcttcttgtgttgaacctaacagctcctaaggctgttttggagacccagcatggcgtat

SEQ ID NO: 385875 - DNA, 140 bp, Artificial Sequence
  Synthetic
atacgccatgctgggtctcctggatggtttaggagataaaactgactcaacatttggattggtttctattcagattgccaattataaccattctgatgaatatttgtcttttagctgttacgtacttgggagtcggccat

SEQ ID NO: 385876 - DNA, 140 bp, Artificial Sequence
  Synthetic
atggccgactcccaagtacgtaacagctaaaagacaaatattcatcagaatggttataattggcaatctgaatagaaaccaatccaaatgttgagtcagttttatctcctaaaccatccaggagacccagcatggcgtat

SEQ ID NO: 385877 - DNA, 140 bp, Artificial Sequence
  Synthetic
aggccctggctgctgatatgactcctctttctacacagatgatgagaaatgaatttagggttagtaccactgaaaatgttgtaaatttgtcaaattatgaagatgctagggcaaaaatgtgaccttttgggacagcggtg

SEQ ID NO: 385878 - DNA, 140 bp, Artificial Sequence
  Synthetic
caccgctgtcccaaaaggtcacatttttgccctagcatcttcataatttgacaaatttacaacattttcagtggtactaaccctaaattcatttctcatcatctgtgtagaaagaggagtcatatcagcagccagggcct

SEQ ID NO: 385879 - DNA, 140 bp, Artificial Sequence
  Synthetic
atacgccatgctgggtctcctgaaaatgttgtaaatttgtcaaattatgaagatgctagggcaaaaatgtcctttgctttggatcaggaagattggaagtctgatccctctcaaggtggtcgtacttgggagtcggccat

SEQ ID NO: 385880 - DNA, 140 bp, Artificial Sequence
  Synthetic
atggccgactcccaagtacgaccaccttgagagggatcagacttccaatcttcctgatccaaagcaaaggacatttttgccctagcatcttcataatttgacaaatttacaacattttcaggagacccagcatggcgtat

SEQ ID NO: 385881 - DNA, 140 bp, Artificial Sequence
  Synthetic
atacgccatgctgggtctccggagatttggaatcttcagtggatgatcccagatcagaagaagataggagatttgaaagtcatattgagagcagaaaaccatacaaagaattaagacttgcgtacttgggagtcggccat

SEQ ID NO: 385882 - DNA, 140 bp, Artificial Sequence
  Synthetic
atggccgactcccaagtacgcaagtcttaattctttgtatggttttctgctctcaatatgactttcaaatctcctatcttcttctgatctgggatcatccactgaagattccaaatctccggagacccagcatggcgtat

SEQ ID NO: 385883 - DNA, 140 bp, Artificial Sequence
  Synthetic
aggccctggctgctgatatggagttgtggtctcagggaatttcagatgatgatagtgcagtacctgagttcttccagtcttttccatctggtgaaccatcaaattccaagttatctagttgaccttttgggacagcggtg

SEQ ID NO: 385884 - DNA, 140 bp, Artificial Sequence
  Synthetic
caccgctgtcccaaaaggtcaactagataacttggaatttgatggttcaccagatggaaaagactggaagaactcaggtactgcactatcatcatctgaaattccctgagaccacaactccatatcagcagccagggcct

SEQ ID NO: 385885 - DNA, 140 bp, Artificial Sequence
  Synthetic
atacgccatgctgggtctccaggttgggaagcagagactaaagtatgcccaggaagaattgtcaaatgaagtgcttccacctcctaggaaaatgaaaggtctgttttcacaggcaaaaatcgtacttgggagtcggccat

SEQ ID NO: 385886 - DNA, 140 bp, Artificial Sequence
  Synthetic
atggccgactcccaagtacgatttttgcctgtgaaaacagacctttcattttcctaggaggtggaagcacttcatttgacaattcttcctgggcatactttagtctctgcttcccaacctggagacccagcatggcgtat

SEQ ID NO: 385887 - DNA, 140 bp, Artificial Sequence
  Synthetic
atacgccatgctgggtctcctgctttgtttcatgaagttgcaaaattagatgtggttaaattgttatataatgagcaatttgctgttcagggtctgctgaggtatcatacttatgcaagacgtacttgggagtcggccat

SEQ ID NO: 385888 - DNA, 140 bp, Artificial Sequence
  Synthetic
atggccgactcccaagtacgtcttgcataagtatgatacctcagcagaccctgaacagcaaattgctcattatataacaatttaaccacatctaattttgcaacttcatgaaacaaagcaggagacccagcatggcgtat

SEQ ID NO: 385889 - DNA, 140 bp, Artificial Sequence
  Synthetic
atacgccatgctgggtctccttctttgttttatactgaagatcatgaaataatgaagttttcatggagaggagtgacagctgacactagggccttgagaagatttggcttttctctagcacgtacttgggagtcggccat

SEQ ID NO: 385890 - DNA, 140 bp, Artificial Sequence
  Synthetic
atggccgactcccaagtacgtgctagagaaaagccaaatcttctcaaggccctagtgtcagctgtcactcctctccatgaaaacttcattatttcatgatcttcagtataaaacaaagaaggagacccagcatggcgtat

SEQ ID NO: 385891 - DNA, 140 bp, Artificial Sequence
  Synthetic
atacgccatgctgggtctcccaggtagattattgttttgcttcgttcctgggaatgagttaatagatgttactggaattacattaaagcaggcaactactgctccttgtgcagtaatggacgtacttgggagtcggccat

SEQ ID NO: 385892 - DNA, 140 bp, Artificial Sequence
  Synthetic
atggccgactcccaagtacgtccattactgcacaaggagcagtagttgcctgctttaatgtaattccagtaacatctattaactcattcccaggaacgaagcaaaacaataatctacctgggagacccagcatggcgtat

SEQ ID NO: 385893 - DNA, 140 bp, Artificial Sequence
  Synthetic
atacgccatgctgggtctccgccggcaggagtgtgtggacccttgaaatggatgctggagtgcttactggtagattggtcaggttgaatgatgagaaatggacagaaatgaaggatgatacgtacttgggagtcggccat

SEQ ID NO: 385894 - DNA, 140 bp, Artificial Sequence
  Synthetic
atggccgactcccaagtacgtatcatccttcatttctgtccatttctcatcattcaacctgaccaatctaccagtaagcactccagcatccatttcaagggtccacacactcctgccggcggagacccagcatggcgtat

SEQ ID NO: 385895 - DNA, 140 bp, Artificial Sequence
  Synthetic
atacgccatgctgggtctccaaattgtttcattggttgaaaaatttacaagtaacaaacattggtctaaagtaaattttccacatggcatgttggaccttgaagaaattgctgctaattccgtacttgggagtcggccat

SEQ ID NO: 385896 - DNA, 140 bp, Artificial Sequence
  Synthetic
atggccgactcccaagtacggaattagcagcaatttcttcaaggtccaacatgccatgtggaaaatttactttagaccaatgtttgttacttgtaaatttttcaaccaatgaaacaatttggagacccagcatggcgtat

SEQ ID NO: 385897 - DNA, 140 bp, Artificial Sequence
  Synthetic
atacgccatgctgggtctccaaaagattttccaaatatgtctgaaactgatttgtgttttctgttacattggttgaaccccaagaaaattaatttggctgatagaatgcttggcttgtctcgtacttgggagtcggccat

SEQ ID NO: 385898 - DNA, 140 bp, Artificial Sequence
  Synthetic
atggccgactcccaagtacgagacaagccaagcattctatcagccaaattaattttcttggggttcaaccaatgtaacagaaaacacaaatcagtttcagacatatttggaaaatcttttggagacccagcatggcgtat

SEQ ID NO: 385899 - DNA, 140 bp, Artificial Sequence
  Synthetic
atacgccatgctgggtctccacacaggttggagatgattcaggaggtttttcaacaacagtttctacagagcagaatgttcctgatcctcaggttggcataacaactatgagggacctaacgtacttgggagtcggccat

SEQ ID NO: 385900 - DNA, 140 bp, Artificial Sequence
  Synthetic
atggccgactcccaagtacgttaggtccctcatagttgttatgccaacctgaggatcaggaacattctgctctgtagaaactgttgttgaaaaacctcctgaatcatctccaacctgtgtggagacccagcatggcgtat

SEQ ID NO: 385901 - DNA, 140 bp, Artificial Sequence
  Synthetic
atacgccatgctgggtctccggtgttcaagaaattaaagaacaaggcattggattaatagcagagtgtagaacctttttagattccatagctggcaccttaaagtctatgatgtttgggtcgtacttgggagtcggccat

SEQ ID NO: 385902 - DNA, 140 bp, Artificial Sequence
  Synthetic
atggccgactcccaagtacgacccaaacatcatagactttaaggtgccagctatggaatctaaaaaggttctacactctgctattaatccaatgccttgttctttaatttcttgaacaccggagacccagcatggcgtat

SEQ ID NO: 385903 - DNA, 140 bp, Artificial Sequence
  Synthetic
atacgccatgctgggtctcctccatcattctgttactgttgagattataaatactgttctttgctttgttaaaagtgggattctgctgtatgttgtacagcagttgaatcaagatgagcacgtacttgggagtcggccat

SEQ ID NO: 385904 - DNA, 140 bp, Artificial Sequence
  Synthetic
atggccgactcccaagtacgtgctcatcttgattcaactgctgtacaacatacagcagaatcccacttttaacaaagcaaagaacagtatttataatctcaacagtaacagaatgatggaggagacccagcatggcgtat

SEQ ID NO: 385905 - DNA, 140 bp, Artificial Sequence
  Synthetic
atacgccatgctgggtctccctctcacataataggtcttttgagggtaatgaattatgctgacattggatgttcggttatatcctgtggtaaagtgttttcaaaaatgctagaaacagttcgtacttgggagtcggccat

SEQ ID NO: 385906 - DNA, 140 bp, Artificial Sequence
  Synthetic
atggccgactcccaagtacgaactgtttctagcatttttgaaaacactttaccacaggatataaccgaacatccaatgtcagcataattcattaccctcaaaagacctattatgtgagagggagacccagcatggcgtat

SEQ ID NO: 385907 - DNA, 140 bp, Artificial Sequence
  Synthetic
aggccctggctgctgatatggacttctaatcctcctcatggtttaccatcaacattaaggtggtttttcaatctgtttcagttgtatagaggaccattggatttgacaattattatcacagaccttttgggacagcggtg

SEQ ID NO: 385908 - DNA, 140 bp, Artificial Sequence
  Synthetic
caccgctgtcccaaaaggtctgtgataataattgtcaaatccaatggtcctctatacaactgaaacagattgaaaaaccaccttaatgttgatggtaaaccatgaggaggattagaagtccatatcagcagccagggcct

SEQ ID NO: 385909 - DNA, 140 bp, Artificial Sequence
  Synthetic
atacgccatgctgggtctcctttaattggcagatggactctagaatgatggagctcagaacccaaagtttttctaattggcttagggatatctgttcaggaattacaatttttaaaagttcgtacttgggagtcggccat

SEQ ID NO: 385910 - DNA, 140 bp, Artificial Sequence
  Synthetic
atggccgactcccaagtacgaacttttaaaaattgtaattcctgaacagatatccctaagccaattagaaaaactttgggttctgagctccatcattctagagtccatctgccaattaaaggagacccagcatggcgtat

SEQ ID NO: 385911 - DNA, 140 bp, Artificial Sequence
  Synthetic
atacgccatgctgggtctcctcaaagacgcaatttactggctttacacaaagttgaaggatttctatgatgtgaattatggtaaaaagaaagatgttcttaatgttcttaaggacaaccacgtacttgggagtcggccat

SEQ ID NO: 385912 - DNA, 140 bp, Artificial Sequence
  Synthetic
atggccgactcccaagtacgtggttgtccttaagaacattaagaacatctttctttttaccataattcacatcatagaaatccttcaactttgtgtaaagccagtaaattgcgtctttgaggagacccagcatggcgtat

SEQ ID NO: 385913 - DNA, 140 bp, Artificial Sequence
  Synthetic
atacgccatgctgggtctccagactgctcttggagctgttagatttaatacaagaagaacagggaacattcagattagattgccatggtattcttatctgtatgccgtgtctggagcactcgtacttgggagtcggccat

SEQ ID NO: 385914 - DNA, 140 bp, Artificial Sequence
  Synthetic
atggccgactcccaagtacgagtgctccagacacggcatacagataagaataccatggcaatctaatctgaatgttccctgttcttcttgtattaaatctaacagctccaagagcagtctggagacccagcatggcgtat

SEQ ID NO: 385915 - DNA, 140 bp, Artificial Sequence
  Synthetic
atacgccatgctgggtctccgcaaaagattgagagagcaatagaagaagcagacaacttttgcattttacagattcaggatgtggaaaaatttgaacagtatcaaaaaggagttgatctacgtacttgggagtcggccat

SEQ ID NO: 385916 - DNA, 140 bp, Artificial Sequence
  Synthetic
atggccgactcccaagtacgtagatcaactcctttttgatactgttcaaatttttccacatcctgaatctgtaaaatgcaaaagttgtctgcttcttctattgctctctcaatcttttgcggagacccagcatggcgtat

SEQ ID NO: 385917 - DNA, 140 bp, Artificial Sequence
  Synthetic
atacgccatgctgggtctccatacaaaaattgagaacagttcactctatggcccaagttgatcctagcttgatgattcatttatcccccctgagagattgcattgctagagtgcatcagacgtacttgggagtcggccat

SEQ ID NO: 385918 - DNA, 140 bp, Artificial Sequence
  Synthetic
atggccgactcccaagtacgtctgatgcactctagcaatgcaatctctcaggggggataaatgaatcatcaagctaggatcaacttgggccatagagtgaactgttctcaatttttgtatggagacccagcatggcgtat

SEQ ID NO: 385919 - DNA, 140 bp, Artificial Sequence
  Synthetic
atacgccatgctgggtctccagctcaaaaatcttggttccattaatcaagccatggtgacaagatgtgaaccagtggtttgttatttatatggcaagagggggggaggaaaaagtttaaccgtacttgggagtcggccat

SEQ ID NO: 385920 - DNA, 140 bp, Artificial Sequence
  Synthetic
atggccgactcccaagtacggttaaactttttcctccccccctcttgccatataaataacaaaccactggttcacatcttgtcaccatggcttgattaatggaaccaagatttttgagctggagacccagcatggcgtat

SEQ ID NO: 385921 - DNA, 140 bp, Artificial Sequence
  Synthetic
atacgccatgctgggtctccatcaatagcattagcaacaaaaatttgcaaacactatggtgttgagccagagaaaaatatttacaccaagcccgttgcttcagattattgggatggataccgtacttgggagtcggccat

SEQ ID NO: 385922 - DNA, 140 bp, Artificial Sequence
  Synthetic
atggccgactcccaagtacggtatccatcccaataatctgaagcaacgggcttggtgtaaatatttttctctggctcaacaccatagtgtttgcaaatttttgttgctaatgctattgatggagacccagcatggcgtat

SEQ ID NO: 385923 - DNA, 140 bp, Artificial Sequence
  Synthetic
atacgccatgctgggtctccggtctaatccaagtcctaaaacagtctatgttaaggaagccatagaccgcaggctgcatttcaaagttgaggtgaaacctgcctcgtttttcaagaatcccgtacttgggagtcggccat

SEQ ID NO: 385924 - DNA, 140 bp, Artificial Sequence
  Synthetic
atggccgactcccaagtacgggattcttgaaaaacgaggcaggtttcacctcaactttgaaatgcagcctgcggtctatggcttccttaacatagactgttttaggacttggattagaccggagacccagcatggcgtat

SEQ ID NO: 385925 - DNA, 140 bp, Artificial Sequence
  Synthetic
atacgccatgctgggtctccagtgggcaactggtgtgtattattgatgacataggccaaaataccacagatgaagactggtctgatttttgtcaattggtttcaggatgtccaatgaggccgtacttgggagtcggccat

SEQ ID NO: 385926 - DNA, 140 bp, Artificial Sequence
  Synthetic
atggccgactcccaagtacggcctcattggacatcctgaaaccaattgacaaaaatcagaccagtcttcatctgtggtattttggcctatgtcatcaataatacacaccagttgcccactggagacccagcatggcgtat

SEQ ID NO: 385927 - DNA, 140 bp, Artificial Sequence
  Synthetic
atacgccatgctgggtctcctgaatatggcatctcttgaagagaagggtagacatttttcttctccttttataattgcaacttcaaattggtcaaatcctagtccgaaaacagtttatgtcgtacttgggagtcggccat

SEQ ID NO: 385928 - DNA, 140 bp, Artificial Sequence
  Synthetic
atggccgactcccaagtacgacataaactgttttcggactaggatttgaccaatttgaagttgcaattataaaaggagaagaaaaatgtctacccttctcttcaagagatgccatattcaggagacccagcatggcgtat

SEQ ID NO: 385929 - DNA, 140 bp, Artificial Sequence
  Synthetic
atacgccatgctgggtctcctaaagaagccattgatcgtagacttcattttaaaattgaagtgaaacctgcttcttttttcaaaaatcctcacaatgacatgctaaatgtcaatttagctcgtacttgggagtcggccat

SEQ ID NO: 385930 - DNA, 140 bp, Artificial Sequence
  Synthetic
atggccgactcccaagtacgagctaaattgacatttagcatgtcattgtgaggatttttgaaaaaagaagcaggtttcacttcaattttaaaatgaagtctacgatcaatggcttctttaggagacccagcatggcgtat

SEQ ID NO: 385931 - DNA, 140 bp, Artificial Sequence
  Synthetic
atacgccatgctgggtctccaaagattttccaaatatgtctgagacagatttgtgtttcctgttgcattggctaaatccaaagaaaattaatttagcagatagaatgcttggattgtctgcgtacttgggagtcggccat

SEQ ID NO: 385932 - DNA, 140 bp, Artificial Sequence
  Synthetic
atggccgactcccaagtacgcagacaatccaagcattctatctgctaaattaattttctttggatttagccaatgcaacaggaaacacaaatctgtctcagacatatttggaaaatctttggagacccagcatggcgtat

SEQ ID NO: 385933 - DNA, 140 bp, Artificial Sequence
  Synthetic
atacgccatgctgggtctccaagacaaatgatgccattaaggatatgtcatgtgttgatttaatcatggatggtcataatgtttcattaatggatttacttagttccttagtgatgactgcgtacttgggagtcggccat

SEQ ID NO: 385934 - DNA, 140 bp, Artificial Sequence
  Synthetic
atggccgactcccaagtacgcagtcatcactaaggaactaagtaaatccattaatgaaacattatgaccatccatgattaaatcaacacatgacatatccttaatggcatcatttgtcttggagacccagcatggcgtat

SEQ ID NO: 385935 - DNA, 140 bp, Artificial Sequence
  Synthetic
atacgccatgctgggtctccctcagttatttcatgtggtaaagttttttccaaaatgttagaaacagtttttaattggcaaatggactccagaatgatggagctgagaactcagagctttcgtacttgggagtcggccat

SEQ ID NO: 385936 - DNA, 140 bp, Artificial Sequence
  Synthetic
atggccgactcccaagtacgaaagctctgagttctcagctccatcattctggagtccatttgccaattaaaaactgtttctaacattttggaaaaaactttaccacatgaaataactgagggagacccagcatggcgtat

SEQ ID NO: 385937 - DNA, 140 bp, Artificial Sequence
  Synthetic
aggccctggctgctgatatgttaattggcaaatggactccagaatgatggagctgagaactcagagcttttccaattggttaagagatatttgttcagggattactatttttaaaagtttgaccttttgggacagcggtg

SEQ ID NO: 385938 - DNA, 140 bp, Artificial Sequence
  Synthetic
caccgctgtcccaaaaggtcaaacttttaaaaatagtaatccctgaacaaatatctcttaaccaattggaaaagctctgagttctcagctccatcattctggagtccatttgccaattaacatatcagcagccagggcct

SEQ ID NO: 385939 - DNA, 140 bp, Artificial Sequence
  Synthetic
atacgccatgctgggtctccttttccatcgggtgagccatcaaattctaaattatccagttttttccagtcagtgactaatcataagtgggtcgctgtgggggctgctgttggtattcttcgtacttgggagtcggccat

SEQ ID NO: 385940 - DNA, 140 bp, Artificial Sequence
  Synthetic
atggccgactcccaagtacgaagaataccaacagcagcccccacagcgacccacttatgattagtcactgactggaaaaaactggataatttagaatttgatggctcacccgatggaaaaggagacccagcatggcgtat

SEQ ID NO: 385941 - DNA, 140 bp, Artificial Sequence
  Synthetic
atacgccatgctgggtctccggtgtgcttgtgggaggatggtttgtttacaaacatttttcccgtaaagaggaagagccaattcctactgaaggagtgtaccatggtgtaacgaagcccacgtacttgggagtcggccat

SEQ ID NO: 385942 - DNA, 140 bp, Artificial Sequence
  Synthetic
atggccgactcccaagtacgtgggcttcgttacaccatggtacactccttcagtaggaattggctcttcctctttacgggaaaaatgtttgtaaacaaaccatcctcccacaagcacaccggagacccagcatggcgtat

SEQ ID NO: 385943 - DNA, 140 bp, Artificial Sequence
  Synthetic
aggccctggctgctgatatgttcactcaatggcacaggttgattcaggtttgactgttcatttagcccctcttagagactgcattgctagagttcatcaaaaattgaaaaatttgggctcgaccttttgggacagcggtg

SEQ ID NO: 385944 - DNA, 140 bp, Artificial Sequence
  Synthetic
caccgctgtcccaaaaggtcgagcccaaatttttcaatttttgatgaactctagcaatgcagtctctaagaggggctaaatgaacagtcaaacctgaatcaacctgtgccattgagtgaacatatcagcagccagggcct

SEQ ID NO: 385945 - DNA, 140 bp, Artificial Sequence
  Synthetic
atacgccatgctgggtctccaacaagtgatcaaactggatgctgatcccgtggaatctcagtcaacattagaaattgctggcttggttagaaagaatcttgttcagtttggtgttggagacgtacttgggagtcggccat

SEQ ID NO: 385946 - DNA, 140 bp, Artificial Sequence
  Synthetic
atggccgactcccaagtacgtctccaacaccaaactgaacaagattctttctaaccaagccagcaatttctaatgttgactgagattccacgggatcagcatccagtttgatcacttgttggagacccagcatggcgtat

SEQ ID NO: 385947 - DNA, 140 bp, Artificial Sequence
  Synthetic
atacgccatgctgggtctccactagtaccttaaagtcaatgatgtttggttttcatcattctgtcacagttgaaatcattaatactgttttatgttttgttaaaagtggcattttgttgtcgtacttgggagtcggccat

SEQ ID NO: 385948 - DNA, 140 bp, Artificial Sequence
  Synthetic
atggccgactcccaagtacgacaacaaaatgccacttttaacaaaacataaaacagtattaatgatttcaactgtgacagaatgatgaaaaccaaacatcattgactttaaggtactagtggagacccagcatggcgtat

SEQ ID NO: 385949 - DNA, 140 bp, Artificial Sequence
  Synthetic
atacgccatgctgggtctccgaaaaatggatgtgtgaggtgggttatgaatgccttaggagtgaaagatgattggctgcttgtaccttctcatgcttataaatttgaaaaggattatgaacgtacttgggagtcggccat

SEQ ID NO: 385950 - DNA, 140 bp, Artificial Sequence
  Synthetic
atggccgactcccaagtacgttcataatccttttcaaatttataagcatgagaaggtacaagcagccaatcatctttcactcctaaggcattcataacccacctcacacatccatttttcggagacccagcatggcgtat

SEQ ID NO: 385951 - DNA, 140 bp, Artificial Sequence
  Synthetic
aggccctggctgctgatatggctcaagaatcttggatctataaatcaggccatggtgacaaggtgtgagccagttgtttgctatttatatggtaaaagagggggagggaaaagtttgactgaccttttgggacagcggtg

SEQ ID NO: 385952 - DNA, 140 bp, Artificial Sequence
  Synthetic
caccgctgtcccaaaaggtcagtcaaacttttccctccccctcttttaccatataaatagcaaacaactggctcacaccttgtcaccatggcctgatttatagatccaagattcttgagccatatcagcagccagggcct

SEQ ID NO: 385953 - DNA, 140 bp, Artificial Sequence
  Synthetic
atacgccatgctgggtctccatgatggagttttattttaacagaggtggcacctattactctatatctgctggtaatgttgtgattcaatctttggatgtgggatttcaagatgtggtttcgtacttgggagtcggccat

SEQ ID NO: 385954 - DNA, 140 bp, Artificial Sequence
  Synthetic
atggccgactcccaagtacgaaaccacatcttgaaatcccacatccaaagattgaatcacaacattaccagcagatatagagtaataggtgccacctctgttaaaataaaactccatcatggagacccagcatggcgtat

SEQ ID NO: 385955 - DNA, 140 bp, Artificial Sequence
  Synthetic
atacgccatgctgggtctcctgatgaaagttccaactattccaaattttagagatattacagaacattttattaagaaaggtgatgtgcctcgtgccttaaatcgccttgcaacgttggtcgtacttgggagtcggccat

SEQ ID NO: 385956 - DNA, 140 bp, Artificial Sequence
  Synthetic
atggccgactcccaagtacgaccaacgttgcaaggcgatttaaggcacgaggcacatcacctttcttaataaaatgttctgtaatatctctaaaatttggaatagttggaactttcatcaggagacccagcatggcgtat

SEQ ID NO: 385957 - DNA, 140 bp, Artificial Sequence
  Synthetic
atacgccatgctgggtctccgacaacagtgaatggaaccccaatgttaatttctgagggtccccttaagatggaggaaaaagccacttatgtgcataagaagaatgatggcactactgttcgtacttgggagtcggccat

SEQ ID NO: 385958 - DNA, 140 bp, Artificial Sequence
  Synthetic
atggccgactcccaagtacgaacagtagtgccatcattcttcttatgcacataagtggctttttcctccatcttaaggggaccctcagaaattaacattggggttccattcactgttgtcggagacccagcatggcgtat

SEQ ID NO: 385959 - DNA, 140 bp, Artificial Sequence
  Synthetic
atacgccatgctgggtctccgatttgacagtggatcaagcttggagaggaaaaggtgagggtttgccaggaatgtgtggtggtgccttggtttcatcaaatcagtctatacagaatgcaacgtacttgggagtcggccat

SEQ ID NO: 385960 - DNA, 140 bp, Artificial Sequence
  Synthetic
atggccgactcccaagtacgttgcattctgtatagactgatttgatgaaaccaaggcaccaccacacattcctggcaaaccctcaccttttcctctccaagcttgatccactgtcaaatcggagacccagcatggcgtat

SEQ ID NO: 385961 - DNA, 140 bp, Artificial Sequence
  Synthetic
aggccctggctgctgatatgaaggaagcaattgatcgtagacttcattttaaggttgaagttaaacctgcttcattttttaaaaatcctcacaatgatatgttgaatgttaatttggccagaccttttgggacagcggtg

SEQ ID NO: 385962 - DNA, 140 bp, Artificial Sequence
  Synthetic
caccgctgtcccaaaaggtctggccaaattaacattcaacatatcattgtgaggatttttaaaaaatgaagcaggtttaacttcaaccttaaaatgaagtctacgatcaattgcttccttcatatcagcagccagggcct

SEQ ID NO: 385963 - DNA, 140 bp, Artificial Sequence
  Synthetic
atacgccatgctgggtctcctcttgggcatacatgtggctggaggtaattcaattcttgttgccaagttagtaactcaagaaatgtttcagaatatagataaaaagattgaaagtcagagcgtacttgggagtcggccat

SEQ ID NO: 385964 - DNA, 140 bp, Artificial Sequence
  Synthetic
atggccgactcccaagtacgctctgactttcaatctttttatctatattctgaaacatttcttgagttactaacttggcaacaagaattgaattacctccagccacatgtatgcccaagaggagacccagcatggcgtat

SEQ ID NO: 385965 - DNA, 140 bp, Artificial Sequence
  Synthetic
atacgccatgctgggtctcctactttcaattcaaataataaagagtacacatttccaataactttgtcttcaacttctaaccctcctcatggtttaccatcaacattaaggtggtttttccgtacttgggagtcggccat

SEQ ID NO: 385966 - DNA, 140 bp, Artificial Sequence
  Synthetic
atggccgactcccaagtacggaaaaaccaccttaatgttgatggtaaaccatgaggagggttagaagttgaagacaaagttattggaaatgtgtactctttattatttgaattgaaagtaggagacccagcatggcgtat

SEQ ID NO: 385967 - DNA, 140 bp, Artificial Sequence
  Synthetic
atacgccatgctgggtctccaataatgaaagtggaatttactcagtgttcaatgaatgtggtctccaaaacgctttttaggaagagtcccattcatcatcacattgataaagacatgattcgtacttgggagtcggccat

SEQ ID NO: 385968 - DNA, 140 bp, Artificial Sequence
  Synthetic
atggccgactcccaagtacgaatcatgtctttatcaatgtgatgatgaatgggactcttcctaaaaagcgttttggagaccacattcattgaacactgagtaaattccactttcattattggagacccagcatggcgtat

SEQ ID NO: 385969 - DNA, 140 bp, Artificial Sequence
  Synthetic
atacgccatgctgggtctccaattttcctgcagcaatgcctttctcaagagcagaaattgacccgatggctgtaatgctttctaaatattctttacctatggttgaagaaccagagggttcgtacttgggagtcggccat

SEQ ID NO: 385970 - DNA, 140 bp, Artificial Sequence
  Synthetic
atggccgactcccaagtacgaaccctctggttcttcaaccataggtaaagaatatttagaaagcattacagccatcgggtcaatttctgctcttgagaaaggcattgctgcaggaaaattggagacccagcatggcgtat

SEQ ID NO: 385971 - DNA, 140 bp, Artificial Sequence
  Synthetic
atacgccatgctgggtctcctgtcactaatcacaagtgggttgctgtgggagcagcagttggcattcttggagtgcttgtggggggatggtttgtatataagcatttctcccgcaaagagcgtacttgggagtcggccat

SEQ ID NO: 385972 - DNA, 140 bp, Artificial Sequence
  Synthetic
atggccgactcccaagtacgctctttgcgggagaaatgcttatatacaaaccatccccccacaagcactccaagaatgccaactgctgctcccacagcaacccacttgtgattagtgacaggagacccagcatggcgtat

SEQ ID NO: 385973 - DNA, 140 bp, Artificial Sequence
  Synthetic
atacgccatgctgggtctccacaaagatgtttcggttttctttcagaataaagttatggggaagagtgttttggttgatgattttttggatcttgacatggccattacaggggcccctggcgtacttgggagtcggccat

SEQ ID NO: 385974 - DNA, 140 bp, Artificial Sequence
  Synthetic
atggccgactcccaagtacgccaggggcccctgtaatggccatgtcaagatccaaaaaatcatcaaccaaaacactcttccccataactttattctgaaagaaaaccgaaacatctttgtggagacccagcatggcgtat

SEQ ID NO: 385975 - DNA, 140 bp, Artificial Sequence
  Synthetic
atacgccatgctgggtctccaaaaatggatgtgtgagatgggttatgaatgccttaggagtgaaggatgattggttgttagtaccttctcatgcttataaatttgaaaaggattatgaaacgtacttgggagtcggccat

SEQ ID NO: 385976 - DNA, 140 bp, Artificial Sequence
  Synthetic
atggccgactcccaagtacgtttcataatccttttcaaatttataagcatgagaaggtactaacaaccaatcatccttcactcctaaggcattcataacccatctcacacatccatttttggagacccagcatggcgtat

SEQ ID NO: 385977 - DNA, 140 bp, Artificial Sequence
  Synthetic
atacgccatgctgggtctccttaggcattcatccaagattagctcagagaatcttgtttaatacagttatgatggaaaattgttcagatctggatgtgattttcacaacctgtccaaaagcgtacttgggagtcggccat

SEQ ID NO: 385978 - DNA, 140 bp, Artificial Sequence
  Synthetic
atggccgactcccaagtacgcttttggacaggttgtgaaaatcacatccagatctgaacaattttccatcataactgtattaaacaagattctctgagctaatcttggatgaatgcctaaggagacccagcatggcgtat

SEQ ID NO: 385979 - DNA, 140 bp, Artificial Sequence
  Synthetic
atacgccatgctgggtctccatgagctaagacccttggataaagtgttagaatcaaaaacaagagccattgatgcctgtcctttagattatacaattttgtgtcggatgtattggggtcccgtacttgggagtcggccat

SEQ ID NO: 385980 - DNA, 140 bp, Artificial Sequence
  Synthetic
atggccgactcccaagtacgggaccccaatacatccgacacaaaattgtataatctaaaggacaggcatcaatggctcttgtttttgattctaacactttatccaagggtcttagctcatggagacccagcatggcgtat

SEQ ID NO: 385981 - DNA, 140 bp, Artificial Sequence
  Synthetic
atacgccatgctgggtctccaatttgtttcagttatatagaggaccattggatttgacaatcattatcacaggagccactgatgtggatggcatggcctggtttaccccagtaggtcttgcgtacttgggagtcggccat

SEQ ID NO: 385982 - DNA, 140 bp, Artificial Sequence
  Synthetic
atggccgactcccaagtacgcaagacctactggggtaaaccaggccatgccatccacatcagtggctcctgtgataatgattgtcaaatccaatggtcctctatataactgaaacaaattggagacccagcatggcgtat

SEQ ID NO: 385983 - DNA, 140 bp, Artificial Sequence
  Synthetic
aggccctggctgctgatatgacaactgttaatggaactcctatgttaatttctgagggaccattaaagatggaggaaaaagccacttatgttcataagaagaatgatggtactacagttggaccttttgggacagcggtg

SEQ ID NO: 385984 - DNA, 140 bp, Artificial Sequence
  Synthetic
caccgctgtcccaaaaggtccaactgtagtaccatcattcttcttatgaacataagtggctttttcctccatctttaatggtccctcagaaattaacataggagttccattaacagttgtcatatcagcagccagggcct

SEQ ID NO: 385985 - DNA, 140 bp, Artificial Sequence
  Synthetic
atacgccatgctgggtctccaatagatgcaattaatatggactcttctcctggattcccatatgtccaagaaagattgacaaaaagggatttaatttggcttgatgaaaatggactgctgcgtacttgggagtcggccat

SEQ ID NO: 385986 - DNA, 140 bp, Artificial Sequence
  Synthetic
atggccgactcccaagtacgcagcagtccattttcatcaagccaaattaaatccctttttgtcaatctttcttggacatatgggaatccaggagaagagtccatattaattgcatctattggagacccagcatggcgtat

SEQ ID NO: 385987 - DNA, 140 bp, Artificial Sequence
  Synthetic
atacgccatgctgggtctccatgtgtggtggggccctggtgtcatcaaatcaatccatacagaatgcaattttgggtattcatgttgctggaggaaattcaattcttgtggcaaagttggcgtacttgggagtcggccat

SEQ ID NO: 385988 - DNA, 140 bp, Artificial Sequence
  Synthetic
atggccgactcccaagtacgccaactttgccacaagaattgaatttcctccagcaacatgaatacccaaaattgcattctgtatggattgatttgatgacaccagggccccaccacacatggagacccagcatggcgtat

SEQ ID NO: 385989 - DNA, 140 bp, Artificial Sequence
  Synthetic
atacgccatgctgggtctcccaggaacgccatctcattttggaacagctcttatcaacacaattatttactcaaaacacctgttgtacaattgttgttaccatgtgtatgggtcaatgcccgtacttgggagtcggccat

SEQ ID NO: 385990 - DNA, 140 bp, Artificial Sequence
  Synthetic
atggccgactcccaagtacgggcattgacccatacacatggtaacaacaattgtacaacaggtgttttgagtaaataattgtgttgataagagctgttccaaaatgagatggcgttcctgggagacccagcatggcgtat

SEQ ID NO: 385991 - DNA, 140 bp, Artificial Sequence
  Synthetic
atacgccatgctgggtctccgtgatgttgtctaaatattcattacctattgtggaagaaccagaggattacaaagaagcttcagttttttatcaaaacaaaatagtaggcaagactcagtcgtacttgggagtcggccat

SEQ ID NO: 385992 - DNA, 140 bp, Artificial Sequence
  Synthetic
atggccgactcccaagtacgactgagtcttgcctactattttgttttgataaaaaactgaagcttctttgtaatcctctggttcttccacaataggtaatgaatatttagacaacatcacggagacccagcatggcgtat

SEQ ID NO: 385993 - DNA, 140 bp, Artificial Sequence
  Synthetic
atacgccatgctgggtctccagccaagctgtgaggattttatgttatggggatgatgttttaatagtcttttccagagatattcagattgataatcttgatcagattggacagaaaattgcgtacttgggagtcggccat

SEQ ID NO: 385994 - DNA, 140 bp, Artificial Sequence
  Synthetic
atggccgactcccaagtacgcaattttctgtccaatctgatcaagattatcaatctgaatatctctggaaaagactattaaaacatcatccccataacataaaatcctcacagcttggctggagacccagcatggcgtat

SEQ ID NO: 385995 - DNA, 140 bp, Artificial Sequence
  Synthetic
aggccctggctgctgatatgaaaattgaccaaaagagatttaatttggttggatgaaaatggtttgctgctaggagttcatcctagattggcccagagaattttatttaatactgttatggaccttttgggacagcggtg

SEQ ID NO: 385996 - DNA, 140 bp, Artificial Sequence
  Synthetic
caccgctgtcccaaaaggtccataacagtattaaataaaattctctgggccaatctaggatgaactcctagcagcaaaccattttcatccaaccaaattaaatctcttttggtcaattttcatatcagcagccagggcct

SEQ ID NO: 385997 - DNA, 140 bp, Artificial Sequence
  Synthetic
atacgccatgctgggtctcctaggagttcatcctagattggcccagagaattttatttaatactgttatgatggaaaattgttctgacctagatgttgtctttacaacttgtccaaaagacgtacttgggagtcggccat

SEQ ID NO: 385998 - DNA, 140 bp, Artificial Sequence
  Synthetic
atggccgactcccaagtacgtcttttggacaagttgtaaagacaacatctaggtcagaacaattttccatcataacagtattaaataaaattctctgggccaatctaggatgaactcctaggagacccagcatggcgtat

SEQ ID NO: 385999 - DNA, 140 bp, Artificial Sequence
  Synthetic
atacgccatgctgggtctccttatgggcagatctcatttcttatgcacatttacatttaattctaataacaaagagtacacctttcctatcactttgtcatcaacctctaatcctcctcacgtacttgggagtcggccat

SEQ ID NO: 386000 - DNA, 140 bp, Artificial Sequence
  Synthetic
atggccgactcccaagtacgtgaggaggattagaggttgatgacaaagtgataggaaaggtgtactctttgttattagaattaaatgtaaatgtgcataagaaatgagatctgcccataaggagacccagcatggcgtat

SEQ ID NO: 386001 - DNA, 140 bp, Artificial Sequence
  Synthetic
aggccctggctgctgatatgtttgtattatgtgttttctaaaatatttggaaagtctccagttttcttttgtcaagctctgaggatcctttgttatggagatgatgtcttgatagtttttgaccttttgggacagcggtg

SEQ ID NO: 386002 - DNA, 140 bp, Artificial Sequence
  Synthetic
caccgctgtcccaaaaggtcaaaaactatcaagacatcatctccataacaaaggatcctcagagcttgacaaaagaaaactggagactttccaaatattttagaaaacacataatacaaacatatcagcagccagggcct

SEQ ID NO: 386003 - DNA, 140 bp, Artificial Sequence
  Synthetic
aggccctggctgctgatatgattttattattttgttcagtcctgtttggagaaagaaatgatagaatatagacttaaatcatatgattggtggagaatgaggttttatgatcagtgctttgaccttttgggacagcggtg

SEQ ID NO: 386004 - DNA, 140 bp, Artificial Sequence
  Synthetic
caccgctgtcccaaaaggtcaaagcactgatcataaaacctcattctccaccaatcatatgatttaagtctatattctatcatttctttctccaaacaggactgaacaaaataataaaatcatatcagcagccagggcct

SEQ ID NO: 386005 - DNA, 140 bp, Artificial Sequence
  Synthetic
atacgccatgctgggtctcctattttttccaaatgactaacacaaatcctgagcaaaaatgtataactgcattggcttcaatatgtcagatgttttgtttttggagaggggacttggtttcgtacttgggagtcggccat

SEQ ID NO: 386006 - DNA, 140 bp, Artificial Sequence
  Synthetic
atggccgactcccaagtacgaaaccaagtcccctctccaaaaacaaaacatctgacatattgaagccaatgcagttatacatttttgctcaggatttgtgttagtcatttggaaaaaataggagacccagcatggcgtat

SEQ ID NO: 386007 - DNA, 140 bp, Artificial Sequence
  Synthetic
aggccctggctgctgatatggagtccatggtgaggggacttgatacctcaccgccgtttgcctaggctataggctaaatttccctttccctgtccttcccctattcccctttgttttggtgaccttttgggacagcggtg

SEQ ID NO: 386008 - DNA, 140 bp, Artificial Sequence
  Synthetic
caccgctgtcccaaaaggtcaccaaaacaaaggggaataggggaaggacagggaaagggaaatttagcctatagcctaggcaaacggcggtgaggtatcaagtcccctcaccatggactccatatcagcagccagggcct

SEQ ID NO: 386009 - DNA, 140 bp, Artificial Sequence
  Synthetic
aggccctggctgctgatatgtgtaaatattaattcctgcaggttcagggttctttaatctgtttctctataagaacactcacctttcacgctttctgtcttctttcttccagggctctccgaccttttgggacagcggtg

SEQ ID NO: 386010 - DNA, 140 bp, Artificial Sequence
  Synthetic
caccgctgtcccaaaaggtcggagagccctggaagaaagaagacagaaagcgtgaaaggtgagtgttcttatagagaaacagattaaagaaccctgaacctgcaggaattaatatttacacatatcagcagccagggcct

SEQ ID NO: 386011 - DNA, 140 bp, Artificial Sequence
  Synthetic
aggccctggctgctgatatgggtgaaattattgtataatgagcagttcgccgtccaaggtttgttgagataccatacatatgcaagatttggtattgagattcaagttcagataaaccccgaccttttgggacagcggtg

SEQ ID NO: 386012 - DNA, 140 bp, Artificial Sequence
  Synthetic
caccgctgtcccaaaaggtcggggtttatctgaacttgaatctcaataccaaatcttgcatatgtatggtatctcaacaaaccttggacggcgaactgctcattatacaataatttcacccatatcagcagccagggcct

SEQ ID NO: 386013 - DNA, 140 bp, Artificial Sequence
  Synthetic
aggccctggctgctgatatgaagttatggttcgatagcatccttgactgtttatcctcatggtttgttaaattgcaacatcaacaatgtggttagaataaaggttccatttatttatactgaccttttgggacagcggtg

SEQ ID NO: 386014 - DNA, 140 bp, Artificial Sequence
  Synthetic
caccgctgtcccaaaaggtcagtataaataaatggaacctttattctaaccacattgttgatgttgcaatttaacaaaccatgaggataaacagtcaaggatgctatcgaaccataacttcatatcagcagccagggcct

SEQ ID NO: 386015 - DNA, 140 bp, Artificial Sequence
  Synthetic
atacgccatgctgggtctccattgcaacatcaacaatgtggttagaataaaggttccatttatttatactagaggtgcttatcattttaaagatccacagtacccagtttgggaattgaccgtacttgggagtcggccat

SEQ ID NO: 386016 - DNA, 140 bp, Artificial Sequence
  Synthetic
atggccgactcccaagtacggtcaattcccaaactgggtactgtggatctttaaaatgataagcacctctagtataaataaatggaacctttattctaaccacattgttgatgttgcaatggagacccagcatggcgtat

SEQ ID NO: 386017 - DNA, 140 bp, Artificial Sequence
  Synthetic
aggccctggctgctgatatgcagattgcaaattacaatcattctgatgaatatttgtcctttagttgttatttgtctgtcacagaacaatcagagttctattttcctagagctccattaagaccttttgggacagcggtg

SEQ ID NO: 386018 - DNA, 140 bp, Artificial Sequence
  Synthetic
caccgctgtcccaaaaggtcttaatggagctctaggaaaatagaactctgattgttctgtgacagacaaataacaactaaaggacaaatattcatcagaatgattgtaatttgcaatctgcatatcagcagccagggcct

SEQ ID NO: 386019 - DNA, 140 bp, Artificial Sequence
  Synthetic
aggccctggctgctgatatgcattgacagctggactgttctttggggccttatgtggtgtttgcctctgaggtactcaggggcatttaggtttttcctcattcttaaacaataatgaatagaccttttgggacagcggtg

SEQ ID NO: 386020 - DNA, 140 bp, Artificial Sequence
  Synthetic
caccgctgtcccaaaaggtctattcattattgtttaagaatgaggaaaaacctaaatgcccctgagtacctcagaggcaaacaccacataaggccccaaagaacagtccagctgtcaatgcatatcagcagccagggcct

SEQ ID NO: 386021 - DNA, 140 bp, Artificial Sequence
  Synthetic
atacgccatgctgggtctccgttgataaacccggttctaaaaagactcagggggagaagtttttcttgatccattctgctgactggctcactacacatgctctttttcatgaagttgcaacgtacttgggagtcggccat

SEQ ID NO: 386022 - DNA, 140 bp, Artificial Sequence
  Synthetic
atggccgactcccaagtacgttgcaacttcatgaaaaagagcatgtgtagtgagccagtcagcagaatggatcaagaaaaacttctccccctgagtctttttagaaccgggtttatcaacggagacccagcatggcgtat

SEQ ID NO: 386023 - DNA, 140 bp, Artificial Sequence
  Synthetic
aggccctggctgctgatatgtctcttttttatactgaggagcatgaaataatgaaattttcttggagaggagtgactgctgacactagggctctgagaagatttggattctctatggctggaccttttgggacagcggtg

SEQ ID NO: 386024 - DNA, 140 bp, Artificial Sequence
  Synthetic
caccgctgtcccaaaaggtccagccatagagaatccaaatcttctcagagccctagtgtcagcagtcactcctctccaagaaaatttcattatttcatgctcctcagtataaaaaagagacatatcagcagccagggcct

SEQ ID NO: 386025 - DNA, 140 bp, Artificial Sequence
  Synthetic
aggccctggctgctgatatggctcaagaatcttggatctataaatcaggctatggtgacaagatgtgagccagttgtttgctatttgtatggcaaaagagggggaggaaagagtttaactgaccttttgggacagcggtg

SEQ ID NO: 386026 - DNA, 140 bp, Artificial Sequence
  Synthetic
caccgctgtcccaaaaggtcagttaaactctttcctccccctcttttgccatacaaatagcaaacaactggctcacatcttgtcaccatagcctgatttatagatccaagattcttgagccatatcagcagccagggcct

SEQ ID NO: 386027 - DNA, 140 bp, Artificial Sequence
  Synthetic
atacgccatgctgggtctccaattgtttcattaatcgaaaagttcacaagcaacaaatattggtctaaagtgaattttccacatggaatgttggatcttgaagaaattgctgccaactctcgtacttgggagtcggccat

SEQ ID NO: 386028 - DNA, 140 bp, Artificial Sequence
  Synthetic
atggccgactcccaagtacgagagttggcagcaatttcttcaagatccaacattccatgtggaaaattcactttagaccaatatttgttgcttgtgaacttttcgattaatgaaacaattggagacccagcatggcgtat

SEQ ID NO: 386029 - DNA, 140 bp, Artificial Sequence
  Synthetic
aggccctggctgctgatatggctaaatccaaagaaaattaatttagcagatagaatgcttggactgtctggagtgcaggaaattaaagaacagggtgttggattgatatcagagtgtagagaccttttgggacagcggtg

SEQ ID NO: 386030 - DNA, 140 bp, Artificial Sequence
  Synthetic
caccgctgtcccaaaaggtctctacactctgatatcaatccaacaccctgttctttaatttcctgcactccagacagtccaagcattctatctgctaaattaattttctttggatttagccatatcagcagccagggcct

SEQ ID NO: 386031 - DNA, 140 bp, Artificial Sequence
  Synthetic
aggccctggctgctgatatgagatttgatttggcttgatgataatggaatgtttttgggtttgcatcccaggctggctcaaagaattttatttaatacaacaatgatggaaaattgctcagaccttttgggacagcggtg

SEQ ID NO: 386032 - DNA, 140 bp, Artificial Sequence
  Synthetic
caccgctgtcccaaaaggtctgagcaattttccatcattgttgtattaaataaaattctttgagccagcctgggatgcaaacccaaaaacattccattatcatcaagccaaatcaaatctcatatcagcagccagggcct

SEQ ID NO: 386033 - DNA, 140 bp, Artificial Sequence
  Synthetic
aggccctggctgctgatatgttccaattggttaagagacatttgttcaggaattactatttttaaaagttttaaggatgccatatattggttatatacaaaattgaaggatttttatgatgaccttttgggacagcggtg

SEQ ID NO: 386034 - DNA, 140 bp, Artificial Sequence
  Synthetic
caccgctgtcccaaaaggtcatcataaaaatccttcaattttgtatataaccaatatatggcatccttaaaacttttaaaaatagtaattcctgaacaaatgtctcttaaccaattggaacatatcagcagccagggcct

SEQ ID NO: 386035 - DNA, 140 bp, Artificial Sequence
  Synthetic
aggccctggctgctgatatgagggaatattcagattagattgccatggtattcttatttgtatgccgtgtctggagcactggatggcttgggagataagacagattctacatttggattggaccttttgggacagcggtg

SEQ ID NO: 386036 - DNA, 140 bp, Artificial Sequence
  Synthetic
caccgctgtcccaaaaggtccaatccaaatgtagaatctgtcttatctcccaagccatccagtgctccagacacggcatacaaataagaataccatggcaatctaatctgaatattccctcatatcagcagccagggcct

SEQ ID NO: 386037 - DNA, 140 bp, Artificial Sequence
  Synthetic
aggccctggctgctgatatggtttctattcagattgcaaattacaatcattctgatgaatatttgtcctttagttgttacttatctgtcacagaacaatcagagttctattttcctagaggaccttttgggacagcggtg

SEQ ID NO: 386038 - DNA, 140 bp, Artificial Sequence
  Synthetic
caccgctgtcccaaaaggtcctctaggaaaatagaactctgattgttctgtgacagataagtaacaactaaaggacaaatattcatcagaatgattgtaatttgcaatctgaatagaaaccatatcagcagccagggcct

SEQ ID NO: 386039 - DNA, 140 bp, Artificial Sequence
  Synthetic
aggccctggctgctgatatgattgcagctggagatttggagtcatcggtggatgatcctagatcagaggaggatagaagatttgagagtcatatagaatgtaggaaaccatataaagaatgaccttttgggacagcggtg

SEQ ID NO: 386040 - DNA, 140 bp, Artificial Sequence
  Synthetic
caccgctgtcccaaaaggtcattctttatatggtttcctacattctatatgactctcaaatcttctatcctcctctgatctaggatcatccaccgatgactccaaatctccagctgcaatcatatcagcagccagggcct

SEQ ID NO: 386041 - DNA, 140 bp, Artificial Sequence
  Synthetic
aggccctggctgctgatatgaattcctgcaggttcagggttctttaatctgtttctctataagaacactcacttttcacgctttctgtcttctcttttccagggctctccccttgccctagaccttttgggacagcggtg

SEQ ID NO: 386042 - DNA, 140 bp, Artificial Sequence
  Synthetic
caccgctgtcccaaaaggtctagggcaaggggagagccctggaaaagagaagacagaaagcgtgaaaagtgagtgttcttatagagaaacagattaaagaaccctgaacctgcaggaattcatatcagcagccagggcct

SEQ ID NO: 386043 - DNA, 140 bp, Artificial Sequence
  Synthetic
atacgccatgctgggtctcctgttttgttaagagtggaatcctgctttatgtcatacaacaattaaaccaagatgagcactcccacataattggtttgttgagagttatgaattatgcagcgtacttgggagtcggccat

SEQ ID NO: 386044 - DNA, 140 bp, Artificial Sequence
  Synthetic
atggccgactcccaagtacgctgcataattcataactctcaacaaaccaattatgtgggagtgctcatcttggtttaattgttgtatgacataaagcaggattccactcttaacaaaacaggagacccagcatggcgtat

SEQ ID NO: 386045 - DNA, 140 bp, Artificial Sequence
  Synthetic
aggccctggctgctgatatgaagacatgtcatgtgttgatcttgttatggataatcacaatgtttcattatctgaactgcttagttcactggtgatgacagttgaaattagaaaacaaaagaccttttgggacagcggtg

SEQ ID NO: 386046 - DNA, 140 bp, Artificial Sequence
  Synthetic
caccgctgtcccaaaaggtcttttgttttctaatttcaactgtcatcaccagtgaactaagcagttcagataatgaaacattgtgattatccataacaagatcaacacatgacatgtcttcatatcagcagccagggcct

SEQ ID NO: 386047 - DNA, 140 bp, Artificial Sequence
  Synthetic
atacgccatgctgggtctccatattggctgttcagttatctcatgtggcaaagttttttccaaaatgttagaaacagtttttaattggcaaatggactccagaatgatggagttgagaaccgtacttgggagtcggccat

SEQ ID NO: 386048 - DNA, 140 bp, Artificial Sequence
  Synthetic
atggccgactcccaagtacggttctcaactccatcattctggagtccatttgccaattaaaaactgtttctaacattttggaaaaaactttgccacatgagataactgaacagccaatatggagacccagcatggcgtat

SEQ ID NO: 386049 - DNA, 140 bp, Artificial Sequence
  Synthetic
aggccctggctgctgatatggtgaattttccacatgggatgttggatcttgaagaaattgctgccagttctaaagattttccaaatatgtctgagacagatttgtgtttcctgttgcattgaccttttgggacagcggtg

SEQ ID NO: 386050 - DNA, 140 bp, Artificial Sequence
  Synthetic
caccgctgtcccaaaaggtcaatgcaacaggaaacacaaatctgtctcagacatatttggaaaatctttagaactggcagcaatttcttcaagatccaacatcccatgtggaaaattcaccatatcagcagccagggcct

SEQ ID NO: 386051 - DNA, 140 bp, Artificial Sequence
  Synthetic
atacgccatgctgggtctccgtgggagctattacaacaattgaggatccagttttagcaaagaaagtgcctgagacatttcctgaattgaagcctggagagtctagacatacatcagatccgtacttgggagtcggccat

SEQ ID NO: 386052 - DNA, 140 bp, Artificial Sequence
  Synthetic
atggccgactcccaagtacggatctgatgtatgtctagactctccaggcttcaattcaggaaatgtctcaggcactttctttgctaaaactggatcctcaattgttgtaatagctcccacggagacccagcatggcgtat

SEQ ID NO: 386053 - DNA, 140 bp, Artificial Sequence
  Synthetic
aggccctggctgctgatatgttgaacctgagaaaaatatttatactaaacctgtggcctcggattattgggatggttacagcggacaattggtttgtattattgatgatattggacaaaagaccttttgggacagcggtg

SEQ ID NO: 386054 - DNA, 140 bp, Artificial Sequence
  Synthetic
caccgctgtcccaaaaggtcttttgtccaatatcatcaataatacaaaccaattgtccgctgtaaccatcccaataatccgaggccacaggtttagtataaatatttttctcaggttcaacatatcagcagccagggcct

SEQ ID NO: 386055 - DNA, 140 bp, Artificial Sequence
  Synthetic
atacgccatgctgggtctcccaatgagattgaatatggcttctcttgaggagaagggcagacatttttcctctccttttataatagcaacttcaaattggtcaaatccaagtccaaaaaccgtacttgggagtcggccat

SEQ ID NO: 386056 - DNA, 140 bp, Artificial Sequence
  Synthetic
atggccgactcccaagtacggtttttggacttggatttgaccaatttgaagttgctattataaaaggagaggaaaaatgtctgcccttctcctcaagagaagccatattcaatctcattgggagacccagcatggcgtat

SEQ ID NO: 386057 - DNA, 140 bp, Artificial Sequence
  Synthetic
aggccctggctgctgatatgtgatgacagttgaaattaggaaacaaaatatgagtgaattcatggagttgtggtctcagggaatctcagatgatgacaatgatagtgcagtagctgagttgaccttttgggacagcggtg

SEQ ID NO: 386058 - DNA, 140 bp, Artificial Sequence
  Synthetic
caccgctgtcccaaaaggtcaactcagctactgcactatcattgtcatcatctgagattccctgagaccacaactccatgaattcactcatattttgtttcctaatttcaactgtcatcacatatcagcagccagggcct

SEQ ID NO: 386059 - DNA, 140 bp, Artificial Sequence
  Synthetic
aggccctggctgctgatatgccacaaagaggaagaaccaattccagctgaaggggtttaccatggcgtgaccaagcccaaacaggtgattaaattagatgcagatccagtagagtctcaggaccttttgggacagcggtg

SEQ ID NO: 386060 - DNA, 140 bp, Artificial Sequence
  Synthetic
caccgctgtcccaaaaggtcctgagactctactggatctgcatctaatttaatcacctgtttgggcttggtcacgccatggtaaaccccttcagctggaattggttcttcctctttgtggcatatcagcagccagggcct

SEQ ID NO: 386061 - DNA, 140 bp, Artificial Sequence
  Synthetic
aggccctggctgctgatatgatgttgttctaatgaaggttcccacaattcccaagtttagagatattactcagcattttattaagaaaggagatgtacctagagccctgaatcgcttggcgaccttttgggacagcggtg

SEQ ID NO: 386062 - DNA, 140 bp, Artificial Sequence
  Synthetic
caccgctgtcccaaaaggtcgccaagcgattcagggctctaggtacatctcctttcttaataaaatgctgagtaatatctctaaacttgggaattgtgggaaccttcattagaacaacatcatatcagcagccagggcct

SEQ ID NO: 386063 - DNA, 140 bp, Artificial Sequence
  Synthetic
atacgccatgctgggtctcctgatggagttttatttcaatagaggtggaacttactattcaatttcagctggcaatgttgttattcaatctttagatgtggggttccaagatgttgttttcgtacttgggagtcggccat

SEQ ID NO: 386064 - DNA, 140 bp, Artificial Sequence
  Synthetic
atggccgactcccaagtacgaaaacaacatcttggaaccccacatctaaagattgaataacaacattgccagctgaaattgaatagtaagttccacctctattgaaataaaactccatcaggagacccagcatggcgtat

SEQ ID NO: 386065 - DNA, 140 bp, Artificial Sequence
  Synthetic
atacgccatgctgggtctccgttaggttcaataccagaagaacaggaaatattcaaattaggttgccttggtactcctatctttatgctgtctcaggggcactggatgggcttggagacacgtacttgggagtcggccat

SEQ ID NO: 386066 - DNA, 140 bp, Artificial Sequence
  Synthetic
atggccgactcccaagtacgtgtctccaagcccatccagtgcccctgagacagcataaagataggagtaccaaggcaacctaatttgaatatttcctgttcttctggtattgaacctaacggagacccagcatggcgtat

SEQ ID NO: 386067 - DNA, 140 bp, Artificial Sequence
  Synthetic
aggccctggctgctgatatgtccaatggctgtaatgttgtctaaatattcattacctattgtggaagaaccagaggattacaaggaagcttctattttttatcaaaataagatagtaggcgaccttttgggacagcggtg

SEQ ID NO: 386068 - DNA, 140 bp, Artificial Sequence
  Synthetic
caccgctgtcccaaaaggtcgcctactatcttattttgataaaaaatagaagcttccttgtaatcctctggttcttccacaataggtaatgaatatttagacaacattacagccattggacatatcagcagccagggcct

SEQ ID NO: 386069 - DNA, 140 bp, Artificial Sequence
  Synthetic
atacgccatgctgggtctcctatggcagtgatgctgtcaaagtattctcttcctattgttgatgagccagatgattataaagatgtttctgtctttttccaaaataaaattttgggtaagcgtacttgggagtcggccat

SEQ ID NO: 386070 - DNA, 140 bp, Artificial Sequence
  Synthetic
atggccgactcccaagtacgcttacccaaaattttattttggaaaaagacagaaacatctttataatcatctggctcatcaacaataggaagagaatactttgacagcatcactgccataggagacccagcatggcgtat

SEQ ID NO: 386071 - DNA, 140 bp, Artificial Sequence
  Synthetic
aggccctggctgctgatatggataaaaatgtgcctcaattaaagccagtttcagaattgacttttcttaaaagatcctttaatttggtagaggacagaattagacctgcaatttcagaaagaccttttgggacagcggtg

SEQ ID NO: 386072 - DNA, 140 bp, Artificial Sequence
  Synthetic
caccgctgtcccaaaaggtctttctgaaattgcaggtctaattctgtcctctaccaaattaaaggatcttttaagaaaagtcaattctgaaactggctttaattgaggcacatttttatccatatcagcagccagggcct

SEQ ID NO: 386073 - DNA, 140 bp, Artificial Sequence
  Synthetic
atacgccatgctgggtctccgtctgagttttattttcctagagcacccttaaacactaatgctatgatgtcatcagaaacaatgatggacagaattgctcttggtgatcttgaatcctcacgtacttgggagtcggccat

SEQ ID NO: 386074 - DNA, 140 bp, Artificial Sequence
  Synthetic
atggccgactcccaagtacgtgaggattcaagatcaccaagagcaattctgtccatcattgtttctgatgacatcatagcattagtgtttaagggtgctctaggaaaataaaactcagacggagacccagcatggcgtat

SEQ ID NO: 386075 - DNA, 140 bp, Artificial Sequence
  Synthetic
aggccctggctgctgatatgtttatgaccagtgtttcatttgtgacctttcatgatttgtttaaacaaattttcttaaaatttctgaggtttgtttatttcttttatcagtaaataaaaagaccttttgggacagcggtg

SEQ ID NO: 386076 - DNA, 140 bp, Artificial Sequence
  Synthetic
caccgctgtcccaaaaggtctttttatttactgataaaagaaataaacaaacctcagaaattttaagaaaatttgtttaaacaaatcatgaaaggtcacaaatgaaacactggtcataaacatatcagcagccagggcct

SEQ ID NO: 386077 - DNA, 140 bp, Artificial Sequence
  Synthetic
atacgccatgctgggtctcccttcaagaggggtctccggaggtttccggagcccctcttggaagtccatggtgaggggacttgatacctcaccgccgtttgcctaggctataggctaaatcgtacttgggagtcggccat

SEQ ID NO: 386078 - DNA, 140 bp, Artificial Sequence
  Synthetic
atggccgactcccaagtacgatttagcctatagcctaggcaaacggcggtgaggtatcaagtcccctcaccatggacttccaagaggggctccggaaacctccggagacccctcttgaagggagacccagcatggcgtat

SEQ ID NO: 386079 - DNA, 140 bp, Artificial Sequence
  Synthetic
aggccctggctgctgatatggctgtaggagtctaaattggggacgcagatgtttgggacgtcaccttgcagtgttaacttggctctcatgaacctctttgatcttccacaaggggtaggcgaccttttgggacagcggtg

SEQ ID NO: 386080 - DNA, 140 bp, Artificial Sequence
  Synthetic
caccgctgtcccaaaaggtcgcctaccccttgtggaagatcaaagaggttcatgagagccaagttaacactgcaaggtgacgtcccaaacatctgcgtccccaatttagactcctacagccatatcagcagccagggcct

SEQ ID NO: 386081 - DNA, 140 bp, Artificial Sequence
  Synthetic
aggccctggctgctgatatgcagggctgtctctaggtttaatctcaagacctctctgtgcttagggcaaacaccatttggccttaaatgggatcctgtgagagggggtcccctccattgagaccttttgggacagcggtg

SEQ ID NO: 386082 - DNA, 140 bp, Artificial Sequence
  Synthetic
caccgctgtcccaaaaggtctcaatggaggggaccccctctcacaggatcccatttaaggccaaatggtgtttgccctaagcacagagaggtcttgagattaaacctagagacagccctgcatatcagcagccagggcct

SEQ ID NO: 386083 - DNA, 140 bp, Artificial Sequence
  Synthetic
aggccctggctgctgatatggtttaatgaccagtgctttgtttgtgacctttcatgatttgtttaaacaaattttcttaaaatttctgaggtttgtttattttatcttttcagtaaataagaccttttgggacagcggtg

SEQ ID NO: 386084 - DNA, 140 bp, Artificial Sequence
  Synthetic
caccgctgtcccaaaaggtcttatttactgaaaagataaaataaacaaacctcagaaattttaagaaaatttgtttaaacaaatcatgaaaggtcacaaacaaagcactggtcattaaaccatatcagcagccagggcct

SEQ ID NO: 386085 - DNA, 140 bp, Artificial Sequence
  Synthetic
aggccctggctgctgatatgaaacctggttctaagaaaactcagggggagaagtttttcttgattcattctgctgattggctcactacacatgctctctttcatgaagttgcaaaattgggaccttttgggacagcggtg

SEQ ID NO: 386086 - DNA, 140 bp, Artificial Sequence
  Synthetic
caccgctgtcccaaaaggtcccaattttgcaacttcatgaaagagagcatgtgtagtgagccaatcagcagaatgaatcaagaaaaacttctccccctgagttttcttagaaccaggtttcatatcagcagccagggcct

SEQ ID NO: 386087 - DNA, 140 bp, Artificial Sequence
  Synthetic
atacgccatgctgggtctccatgtggtgaaactgctgtacaatgagcagtttgccgtccaaggtttgttgagataccatacttatgcaagatttggcattgagattcaagttcagataaacgtacttgggagtcggccat

SEQ ID NO: 386088 - DNA, 140 bp, Artificial Sequence
  Synthetic
atggccgactcccaagtacgtttatctgaacttgaatctcaatgccaaatcttgcataagtatggtatctcaacaaaccttggacggcaaactgctcattgtacagcagtttcaccacatggagacccagcatggcgtat

SEQ ID NO: 386089 - DNA, 140 bp, Artificial Sequence
  Synthetic
atacgccatgctgggtctcctcccacaccctttcagcaaggaggactaatctgtgccatggttcctggtgaccaaagttatggttcaatagcatccttgactgtttatcctcatggtctgcgtacttgggagtcggccat

SEQ ID NO: 386090 - DNA, 140 bp, Artificial Sequence
  Synthetic
atggccgactcccaagtacgcagaccatgaggataaacagtcaaggatgctattgaaccataactttggtcaccaggaaccatggcacagattagtcctccttgctgaaagggtgtgggaggagacccagcatggcgtat

SEQ ID NO: 386091 - DNA, 140 bp, Artificial Sequence
  Synthetic
aggccctggctgctgatatgaccaaagttatggttcaatagcatccttgactgtttatcctcatggtctgttaaattgcaatatcaacaatgtagttagaataaaggttccatttatttagaccttttgggacagcggtg

SEQ ID NO: 386092 - DNA, 140 bp, Artificial Sequence
  Synthetic
caccgctgtcccaaaaggtctaaataaatggaacctttattctaactacattgttgatattgcaatttaacagaccatgaggataaacagtcaaggatgctattgaaccataactttggtcatatcagcagccagggcct

SEQ ID NO: 386093 - DNA, 140 bp, Artificial Sequence
  Synthetic
aggccctggctgctgatatgatgtcttttgctttggatcaggaagattggaagtctgatccttcccaaggtggtggaattaaaattactcatttcactacctggacatccattccaacctgaccttttgggacagcggtg

SEQ ID NO: 386094 - DNA, 140 bp, Artificial Sequence
  Synthetic
caccgctgtcccaaaaggtcaggttggaatggatgtccaggtagtgaaatgagtaattttaattccaccaccttgggaaggatcagacttccaatcttcctgatccaaagcaaaagacatcatatcagcagccagggcct

SEQ ID NO: 386095 - DNA, 140 bp, Artificial Sequence
  Synthetic
aggccctggctgctgatatgtagctgctcagtttccatttaatgcttcagattcagttgggcaacaaattaaagttataccagtggacccatactttttccagatgacaaacactaatccgaccttttgggacagcggtg

SEQ ID NO: 386096 - DNA, 140 bp, Artificial Sequence
  Synthetic
caccgctgtcccaaaaggtcggattagtgtttgtcatctggaaaaagtatgggtccactggtataactttaatttgttgcccaactgaatctgaagcattaaatggaaactgagcagctacatatcagcagccagggcct

SEQ ID NO: 386097 - DNA, 140 bp, Artificial Sequence
  Synthetic
atacgccatgctgggtctcctgatcaaaaatgtataacagccttggcctctatttgtcagatgttctgcttttggaggggagatcttgttttcgattttcaggtttttccaaccaaatatcgtacttgggagtcggccat

SEQ ID NO: 386098 - DNA, 140 bp, Artificial Sequence
  Synthetic
atggccgactcccaagtacgatatttggttggaaaaacctgaaaatcgaaaacaagatctcccctccaaaagcagaacatctgacaaatagaggccaaggctgttatacatttttgatcaggagacccagcatggcgtat

SEQ ID NO: 386099 - DNA, 140 bp, Artificial Sequence
  Synthetic
aggccctggctgctgatatgaaggaccctcaatatcctgtttgggagttgactattagagtttggtctgagctaaatattggaactggcacctccgcttacacatcactgaatgtgctgggaccttttgggacagcggtg

SEQ ID NO: 386100 - DNA, 140 bp, Artificial Sequence
  Synthetic
caccgctgtcccaaaaggtcccagcacattcagtgatgtgtaagcggaggtgccagttccaatatttagctcagaccaaactctaatagtcaactcccaaacaggatattgagggtccttcatatcagcagccagggcct

SEQ ID NO: 386101 - DNA, 140 bp, Artificial Sequence
  Synthetic
aggccctggctgctgatatggggcgtgcccccgcaagactgctagccgagtagtgttgggtcgcgaaaggccttgtggtactgcctgatagggtgcttgcgagtgccccgggaggtctcggaccttttgggacagcggtg

SEQ ID NO: 386102 - DNA, 140 bp, Artificial Sequence
  Synthetic
caccgctgtcccaaaaggtccgagacctcccggggcactcgcaagcaccctatcaggcagtaccacaaggcctttcgcgacccaacactactcggctagcagtcttgcgggggcacgccccatatcagcagccagggcct

SEQ ID NO: 386103 - DNA, 140 bp, Artificial Sequence
  Synthetic
atacgccatgctgggtctccagccttttttcatttggttccaatcagaagatccagctgatcaacaccaacggcagctggcatatcaataggacagccttgaactgcaatgatagccttccgtacttgggagtcggccat

SEQ ID NO: 386104 - DNA, 140 bp, Artificial Sequence
  Synthetic
atggccgactcccaagtacggaaggctatcattgcagttcaaggctgtcctattgatatgccagctgccgttggtgttgatcagctggatcttctgattggaaccaaatgaaaaaaggctggagacccagcatggcgtat

SEQ ID NO: 386105 - DNA, 140 bp, Artificial Sequence
  Synthetic
atacgccatgctgggtctcctaccgcagacattccaagtggcccacttacatgctcccactggcagcggcaagagcaccaaagtgccggctgcatacgcagcccaggggtataaggtgctcgtacttgggagtcggccat

SEQ ID NO: 386106 - DNA, 140 bp, Artificial Sequence
  Synthetic
atggccgactcccaagtacgagcaccttatacccctgggctgcgtatgcagccggcactttggtgctcttgccgctgccagtgggagcatgtaagtgggccacttggaatgtctgcggtaggagacccagcatggcgtat

SEQ ID NO: 386107 - DNA, 140 bp, Artificial Sequence
  Synthetic
aggccctggctgctgatatggcgcgcgacgaggaagacttccgagcggtcgcaacctcgaggtagacgtcagcctatccccaaggcgcgtcggcccgagggcaggacctgggctcagcccgaccttttgggacagcggtg

SEQ ID NO: 386108 - DNA, 140 bp, Artificial Sequence
  Synthetic
caccgctgtcccaaaaggtcgggctgagcccaggtcctgccctcgggccgacgcgccttggggataggctgacgtctacctcgaggttgcgaccgctcggaagtcttcctcgtcgcgcgccatatcagcagccagggcct

SEQ ID NO: 386109 - DNA, 140 bp, Artificial Sequence
  Synthetic
aggccctggctgctgatatgaactcactccaatcccggctgcgtcccagttggacttgtccaactggttcgtcgccggctacagcgggggagacatatatcacagcgtgtctcgtgcccggaccttttgggacagcggtg

SEQ ID NO: 386110 - DNA, 140 bp, Artificial Sequence
  Synthetic
caccgctgtcccaaaaggtccgggcacgagacacgctgtgatatatgtctcccccgctgtagccggcgacgaaccagttggacaagtccaactgggacgcagccgggattggagtgagttcatatcagcagccagggcct

SEQ ID NO: 386111 - DNA, 140 bp, Artificial Sequence
  Synthetic
aggccctggctgctgatatgcatgatcgctggtgctcactggggagtcctggcgggcatggcgtatttctccatggtggggaactgggcgaaggtcctagcagtgctgttgctgtttgccgaccttttgggacagcggtg

SEQ ID NO: 386112 - DNA, 140 bp, Artificial Sequence
  Synthetic
caccgctgtcccaaaaggtcggcaaacagcaacagcactgctaggaccttcgcccagttccccaccatggagaaatacgccatgcccgccaggactccccagtgagcaccagcgatcatgcatatcagcagccagggcct

SEQ ID NO: 386113 - DNA, 140 bp, Artificial Sequence
  Synthetic
aggccctggctgctgatatgtgatcaacaccaacggcagttggcacatcaatagcacggccctgaactgcaatgagagcctcaacaccggctggctagcagggctcttttactacaacaagaccttttgggacagcggtg

SEQ ID NO: 386114 - DNA, 140 bp, Artificial Sequence
  Synthetic
caccgctgtcccaaaaggtcttgttgtagtaaaagagccctgctagccagccggtgttgaggctctcattgcagttcagggccgtgctattgatgtgccaactgccgttggtgttgatcacatatcagcagccagggcct

SEQ ID NO: 386115 - DNA, 140 bp, Artificial Sequence
  Synthetic
aggccctggctgctgatatgtagaccgtgcaccatgagcacgaatcctaaacctcaaagaaaaaccaaacgtaacaccaaccgtcgcccacaggacgtcaagttcccgggtggcggtcaggaccttttgggacagcggtg

SEQ ID NO: 386116 - DNA, 140 bp, Artificial Sequence
  Synthetic
caccgctgtcccaaaaggtcctgaccgccacccgggaacttgacgtcctgtgggcgacggttggtgttacgtttggtttttctttgaggtttaggattcgtgctcatggtgcacggtctacatatcagcagccagggcct

SEQ ID NO: 386117 - DNA, 140 bp, Artificial Sequence
  Synthetic
aggccctggctgctgatatgaaccatctcactcctctccgggactgggcgcacaacggcctacgagatctggccgtggctgtggagccagtcatcttttcccagatggagaccaagctcagaccttttgggacagcggtg

SEQ ID NO: 386118 - DNA, 140 bp, Artificial Sequence
  Synthetic
caccgctgtcccaaaaggtctgagcttggtctccatctgggaaaagatgactggctccacagccacggccagatctcgtaggccgttgtgcgcccagtcccggagaggagtgagatggttcatatcagcagccagggcct

SEQ ID NO: 386119 - DNA, 140 bp, Artificial Sequence
  Synthetic
aggccctggctgctgatatggtgcggctccggcccctggattacacccaggtgcctggtcaactacccgtataggctttggcattatccttgtaccatcaactacaccgtgtttaaagtcgaccttttgggacagcggtg

SEQ ID NO: 386120 - DNA, 140 bp, Artificial Sequence
  Synthetic
caccgctgtcccaaaaggtcgactttaaacacggtgtagttgatggtacaaggataatgccaaagcctatacgggtagttgaccaggcacctgggtgtaatccaggggccggagccgcaccatatcagcagccagggcct

SEQ ID NO: 386121 - DNA, 140 bp, Artificial Sequence
  Synthetic
atacgccatgctgggtctccgtcttaattgtgatgctactctttgccggcgttgacggggacacctatacgacagggggggcggcagccaaaggagcgcaaaagttcacggcctttttcacgtacttgggagtcggccat

SEQ ID NO: 386122 - DNA, 140 bp, Artificial Sequence
  Synthetic
atggccgactcccaagtacgtgaaaaaggccgtgaacttttgcgctcctttggctgccgccccccctgtcgtataggtgtccccgtcaacgccggcaaagagtagcatcacaattaagacggagacccagcatggcgtat

SEQ ID NO: 386123 - DNA, 140 bp, Artificial Sequence
  Synthetic
aggccctggctgctgatatgcttagccgcgctgttctacacacacaggttcaacgcgtccgggtgcccagagcgtatggccagatgtcgccgcattgatgagttcagtcaggggtggggtgaccttttgggacagcggtg

SEQ ID NO: 386124 - DNA, 140 bp, Artificial Sequence
  Synthetic
caccgctgtcccaaaaggtcaccccacccctgactgaactcatcaatgcggcgacatctggccatacgctctgggcacccggacgcgttgaacctgtgtgtgtagaacagcgcggctaagcatatcagcagccagggcct

SEQ ID NO: 386125 - DNA, 140 bp, Artificial Sequence
  Synthetic
aggccctggctgctgatatgctccgcatcatcggccattaacagcggcgcagggaccgcccctcctgaccagtcccctgacgacggagacgcgggatccgacgttgagtcgtgctcctccgaccttttgggacagcggtg

SEQ ID NO: 386126 - DNA, 140 bp, Artificial Sequence
  Synthetic
caccgctgtcccaaaaggtcggaggagcacgactcaacgtcggatcccgcgtctccgtcgtcaggggactggtcaggaggggcggtccctgcgccgctgttaatggccgatgatgcggagcatatcagcagccagggcct

SEQ ID NO: 386127 - DNA, 140 bp, Artificial Sequence
  Synthetic
atacgccatgctgggtctcctcagaatccaccgtatcttctgtcctggcggagcttgctacgaagaccttcagcagctccgtatcatcggccgtcgacagcggcacagcgaccgcccctccgtacttgggagtcggccat

SEQ ID NO: 386128 - DNA, 140 bp, Artificial Sequence
  Synthetic
atggccgactcccaagtacggaggggcggtcgctgtgccgctgtcgacggccgatgatacggagctgctgaaggtcttcgtagcaagctccgccaggacagaagatacggtggattctgaggagacccagcatggcgtat

SEQ ID NO: 386129 - DNA, 140 bp, Artificial Sequence
  Synthetic
atacgccatgctgggtctccgctttggtgcctacatgtccaaggcccatggggtcgatcctaatgttaggactggagtgagaacaattaccactggcagccccatcacgtactccacctacgtacttgggagtcggccat

SEQ ID NO: 386130 - DNA, 140 bp, Artificial Sequence
  Synthetic
atggccgactcccaagtacgtaggtggagtacgtgatggggctgccagtggtaattgttctcactccagtcctaacattaggatcgaccccatgggccttggacatgtaggcaccaaagcggagacccagcatggcgtat

SEQ ID NO: 386131 - DNA, 140 bp, Artificial Sequence
  Synthetic
aggccctggctgctgatatgttggcggcgtcctggctgctttggccgcgtattgcctatcaacaggctgcgtggtcatagtgggcagggttgtcttgtccgggaagccggcaattgtaccgaccttttgggacagcggtg

SEQ ID NO: 386132 - DNA, 140 bp, Artificial Sequence
  Synthetic
caccgctgtcccaaaaggtcggtacaattgccggcttcccggacaagacaaccctgcccactatgaccacgcagcctgttgataggcaatacgcggccaaagcagccaggacgccgccaacatatcagcagccagggcct

SEQ ID NO: 386133 - DNA, 140 bp, Artificial Sequence
  Synthetic
atacgccatgctgggtctccacattaacaggactgccctaaactgcaatgactccctccacctgggttctttgcttcgctgttctacgtacacagtttcaactcgaccggatgcacagagcgtacttgggagtcggccat

SEQ ID NO: 386134 - DNA, 140 bp, Artificial Sequence
  Synthetic
atggccgactcccaagtacgctctgtgcatccggtcgagttgaaactgtgtacgtagaacagcgaagcaaagaacccaggtggagggagtcattgcagtttagggcagtcctgttaatgtggagacccagcatggcgtat

SEQ ID NO: 386135 - DNA, 140 bp, Artificial Sequence
  Synthetic
aggccctggctgctgatatgggggagctaaacactccaggccaataggccgtctctttttttttttttttttttttttttttttttttttttttttttttttttttttttttttttttttgaccttttgggacagcggtg

SEQ ID NO: 386136 - DNA, 140 bp, Artificial Sequence
  Synthetic
caccgctgtcccaaaaggtcaaaaaaaaaaaaaaaaaaaaaaaaaaaaaaaaaaaaaaaaaaaaaaaaaaaaaaaaaaaaaaaaagagacggcctattggcctggagtgtttagctcccccatatcagcagccagggcct

SEQ ID NO: 386137 - DNA, 140 bp, Artificial Sequence
  Synthetic
atacgccatgctgggtctccgtagggtcggcgattgtctcctatgcatcaaatgggagtatgtcctgttgctctttttcctcctggcggacgcgcgcgtctgctcttgcttgtggatgatcgtacttgggagtcggccat

SEQ ID NO: 386138 - DNA, 140 bp, Artificial Sequence
  Synthetic
atggccgactcccaagtacgatcatccacaagcaagagcagacgcgcgcgtccgccaggaggaaaaagagcaacaggacatactcccatttgatgcataggagacaatcgccgaccctacggagacccagcatggcgtat

SEQ ID NO: 386139 - DNA, 140 bp, Artificial Sequence
  Synthetic
atacgccatgctgggtctccgtccttataggcctggtgttcttcaccttgtcaccgcactacaaagcattcctcgctaagctcatatggtggctacaatacttcatcaccagagccgaggcgtacttgggagtcggccat

SEQ ID NO: 386140 - DNA, 140 bp, Artificial Sequence
  Synthetic
atggccgactcccaagtacgcctcggctctggtgatgaagtattgtagccaccatatgagcttagcgaggaatgctttgtagtgcggtgacaaggtgaagaacaccaggcctataaggacggagacccagcatggcgtat

SEQ ID NO: 386141 - DNA, 140 bp, Artificial Sequence
  Synthetic
aggccctggctgctgatatgagcatcactgatggcatttacagcctctatcaccagcccgctcaccacccaaagcaccctcctgtttaacatcttgggggggtgggtggccgcccaactcgaccttttgggacagcggtg

SEQ ID NO: 386142 - DNA, 140 bp, Artificial Sequence
  Synthetic
caccgctgtcccaaaaggtcgagttgggcggccacccacccccccaagatgttaaacaggagggtgctttgggtggtgagcgggctggtgatagaggctgtaaatgccatcagtgatgctcatatcagcagccagggcct

SEQ ID NO: 386143 - DNA, 140 bp, Artificial Sequence
  Synthetic
aggccctggctgctgatatggctgcccgcttccacctccacggccccctcctgtgcctccgcctcggaagaagcggacggtggtcctcaccgaatcaaccgtgtcctctgccttggccgagaccttttgggacagcggtg

SEQ ID NO: 386144 - DNA, 140 bp, Artificial Sequence
  Synthetic
caccgctgtcccaaaaggtctcggccaaggcagaggacacggttgattcggtgaggaccaccgtccgcttcttccgaggcggaggcacaggagggggccgtggaggtggaagcgggcagccatatcagcagccagggcct

SEQ ID NO: 386145 - DNA, 140 bp, Artificial Sequence
  Synthetic
aggccctggctgctgatatggcagtgcttgccaaaggcagaagaaagtcacatttgacagactgcaagttctggacagccattaccaggacgtgctcaaggaggttaaagcagcggcgtcgaccttttgggacagcggtg

SEQ ID NO: 386146 - DNA, 140 bp, Artificial Sequence
  Synthetic
caccgctgtcccaaaaggtcgacgccgctgctttaacctccttgagcacgtcctggtaatggctgtccagaacttgcagtctgtcaaatgtgactttcttctgcctttggcaagcactgccatatcagcagccagggcct

SEQ ID NO: 386147 - DNA, 140 bp, Artificial Sequence
  Synthetic
aggccctggctgctgatatgcctgctcctgctggcgttaccaccacgagcatacgccatggaccgggagatggctgcatcgtgcggaggcgcggttttcataggtctgatactcttgaccgaccttttgggacagcggtg

SEQ ID NO: 386148 - DNA, 140 bp, Artificial Sequence
  Synthetic
caccgctgtcccaaaaggtcggtcaagagtatcagacctatgaaaaccgcgcctccgcacgatgcagccatctcccggtccatggcgtatgctcgtggtggtaacgccagcaggagcaggcatatcagcagccagggcct

SEQ ID NO: 386149 - DNA, 140 bp, Artificial Sequence
  Synthetic
aggccctggctgctgatatgtggctgcatcgtgcggaggcgcggttttcataggtctgatactcttgaccttgtcaccacactataaagtgttcctcgctaggctcatatggtggttacagaccttttgggacagcggtg

SEQ ID NO: 386150 - DNA, 140 bp, Artificial Sequence
  Synthetic
caccgctgtcccaaaaggtctgtaaccaccatatgagcctagcgaggaacactttatagtgtggtgacaaggtcaagagtatcagacctatgaaaaccgcgcctccgcacgatgcagccacatatcagcagccagggcct

SEQ ID NO: 386151 - DNA, 140 bp, Artificial Sequence
  Synthetic
aggccctggctgctgatatgcagggtcccgcaagccatcttggacatgatcgctggtgcccactggggagtcctagcgggcatagcgtatttctccatggtggggaactgggcgaaggtcgaccttttgggacagcggtg

SEQ ID NO: 386152 - DNA, 140 bp, Artificial Sequence
  Synthetic
caccgctgtcccaaaaggtcgaccttcgcccagttccccaccatggagaaatacgctatgcccgctaggactccccagtgggcaccagcgatcatgtccaagatggcttgcgggaccctgcatatcagcagccagggcct

SEQ ID NO: 386153 - DNA, 140 bp, Artificial Sequence
  Synthetic
atacgccatgctgggtctcccgggcgccaagcaggatatccagctgatcaacaccaacggcagttggcacatcaaccgcacggccttgaactgtaatgcgagcctcgacactggctgggtcgtacttgggagtcggccat

SEQ ID NO: 386154 - DNA, 140 bp, Artificial Sequence
  Synthetic
atggccgactcccaagtacgacccagccagtgtcgaggctcgcattacagttcaaggccgtgcggttgatgtgccaactgccgttggtgttgatcagctggatatcctgcttggcgcccgggagacccagcatggcgtat

SEQ ID NO: 386155 - DNA, 140 bp, Artificial Sequence
  Synthetic
atacgccatgctgggtctccattagctacgccaacggaagtggccccgaacaccgcccctactgctggcactatcccccaaggccttgcggcattgtgccagcacaaaacgtgtgtggcccgtacttgggagtcggccat

SEQ ID NO: 386156 - DNA, 140 bp, Artificial Sequence
  Synthetic
atggccgactcccaagtacgggccacacacgttttgtgctggcacaatgccgcaaggccttgggggatagtgccagcagtaggggcggtgttcggggccacttccgttggcgtagctaatggagacccagcatggcgtat

SEQ ID NO: 386157 - DNA, 140 bp, Artificial Sequence
  Synthetic
aggccctggctgctgatatgtgtgcccgcaaggagcgtgtgtggcccggtatactgcttcactcccagccccgtggtggtgggaacgaccgacaggtcgggcgcgcctacctacgactgggaccttttgggacagcggtg

SEQ ID NO: 386158 - DNA, 140 bp, Artificial Sequence
  Synthetic
caccgctgtcccaaaaggtcccagtcgtaggtaggcgcgcccgacctgtcggtcgttcccaccaccacggggctgggagtgaagcagtataccgggccacacacgctccttgcgggcacacatatcagcagccagggcct

SEQ ID NO: 386159 - DNA, 140 bp, Artificial Sequence
  Synthetic
aggccctggctgctgatatgggataaacccgctcaatgcctggagatttgggcgtgcccccgcaagactgctagccgagtagtgttgggtcgcgaaaggccttgtggtactgcctgataggaccttttgggacagcggtg

SEQ ID NO: 386160 - DNA, 140 bp, Artificial Sequence
  Synthetic
caccgctgtcccaaaaggtcctatcaggcagtaccacaaggcctttcgcgacccaacactactcggctagcagtcttgcgggggcacgcccaaatctccaggcattgagcgggtttatcccatatcagcagccagggcct

SEQ ID NO: 386161 - DNA, 140 bp, Artificial Sequence
  Synthetic
aggccctggctgctgatatgctagccgagtagtgttgggtcgcgaaaggccttgtggtactgcctgatagggtgcttgcgagtgccccgggaggtctcgtagaccgtgcaccatgagcacgaccttttgggacagcggtg

SEQ ID NO: 386162 - DNA, 140 bp, Artificial Sequence
  Synthetic
caccgctgtcccaaaaggtcgtgctcatggtgcacggtctacgagacctcccggggcactcgcaagcaccctatcaggcagtaccacaaggcctttcgcgacccaacactactcggctagcatatcagcagccagggcct

SEQ ID NO: 386163 - DNA, 140 bp, Artificial Sequence
  Synthetic
aggccctggctgctgatatgctgcctgggaaccccgcgatagcatcactgatggcattcacagcctctatcaccagcccgctcaccacccaacataccctcctgtttaacatcttggggggaccttttgggacagcggtg

SEQ ID NO: 386164 - DNA, 140 bp, Artificial Sequence
  Synthetic
caccgctgtcccaaaaggtccccccaagatgttaaacaggagggtatgttgggtggtgagcgggctggtgatagaggctgtgaatgccatcagtgatgctatcgcggggttcccaggcagcatatcagcagccagggcct

SEQ ID NO: 386165 - DNA, 140 bp, Artificial Sequence
  Synthetic
aggccctggctgctgatatgggcgccggcatcgctggcgcggctgttggcagcataggccttgggaaggtgcttgtggacatcctggcgggttatggagcaggggtggcaggcgcactcggaccttttgggacagcggtg

SEQ ID NO: 386166 - DNA, 140 bp, Artificial Sequence
  Synthetic
caccgctgtcccaaaaggtccgagtgcgcctgccacccctgctccataacccgccaggatgtccacaagcaccttcccaaggcctatgctgccaacagccgcgccagcgatgccggcgcccatatcagcagccagggcct

SEQ ID NO: 386167 - DNA, 140 bp, Artificial Sequence
  Synthetic
aggccctggctgctgatatgcacattaataggactgccctgaactgcaatgactccctccacaccgggttctttgccgcgttgttctacgcaggtaagttcaattcgtccgggtgctcaggaccttttgggacagcggtg

SEQ ID NO: 386168 - DNA, 140 bp, Artificial Sequence
  Synthetic
caccgctgtcccaaaaggtcctgagcacccggacgaattgaacttacctgcgtagaacaacgcggcaaagaacccggtgtggagggagtcattgcagttcagggcagtcctattaatgtgcatatcagcagccagggcct

SEQ ID NO: 386169 - DNA, 140 bp, Artificial Sequence
  Synthetic
aggccctggctgctgatatggcactacgcgcctcggccgtgtggtatcgtacccgcgtcgcaggtgtgtggtccagtgtattgcttcaccccaagccctgttgtggtggggacgaccgatgaccttttgggacagcggtg

SEQ ID NO: 386170 - DNA, 140 bp, Artificial Sequence
  Synthetic
caccgctgtcccaaaaggtcatcggtcgtccccaccacaacagggcttggggtgaagcaatacactggaccacacacctgcgacgcgggtacgataccacacggccgaggcgcgtagtgccatatcagcagccagggcct

SEQ ID NO: 386171 - DNA, 140 bp, Artificial Sequence
  Synthetic
aggccctggctgctgatatgtgggactggatatgcacggtgttgactgacttcaagacctggctccagtccaagctcctgccacggttaccgggagtccctttcctctcatgccaacgtggaccttttgggacagcggtg

SEQ ID NO: 386172 - DNA, 140 bp, Artificial Sequence
  Synthetic
caccgctgtcccaaaaggtccacgttggcatgagaggaaagggactcccggtaaccgtggcaggagcttggactggagccaggtcttgaagtcagtcaacaccgtgcatatccagtcccacatatcagcagccagggcct

SEQ ID NO: 386173 - DNA, 140 bp, Artificial Sequence
  Synthetic
aggccctggctgctgatatgtctggaagacagggacaggtccgagctcagcccgttgctgctgtccaccacacagtggcaggtccttccgtgctccttcacgaccctgccagccttgtccgaccttttgggacagcggtg

SEQ ID NO: 386174 - DNA, 140 bp, Artificial Sequence
  Synthetic
caccgctgtcccaaaaggtcggacaaggctggcagggtcgtgaaggagcacggaaggacctgccactgtgtggtggacagcagcaacgggctgagctcggacctgtccctgtcttccagacatatcagcagccagggcct

SEQ ID NO: 386175 - DNA, 140 bp, Artificial Sequence
  Synthetic
aggccctggctgctgatatgccaggtcgggctcaaccaattcccggttgggtcacagctcccatgtgagcccgaaccggatgtaacagtgctcacttccatgctcaccgacccctcccacgaccttttgggacagcggtg

SEQ ID NO: 386176 - DNA, 140 bp, Artificial Sequence
  Synthetic
caccgctgtcccaaaaggtcgtgggaggggtcggtgagcatggaagtgagcactgttacatccggttcgggctcacatgggagctgtgacccaaccgggaattggttgagcccgacctggcatatcagcagccagggcct

SEQ ID NO: 386177 - DNA, 140 bp, Artificial Sequence
  Synthetic
atacgccatgctgggtctcccgttggctacccgtgatattgctgaagagcttggcggcgaatgggctgaccgcttcctcgtgctttacggtatcgccgctcccgattcgcagcgcatcgccgtacttgggagtcggccat

SEQ ID NO: 386178 - DNA, 140 bp, Artificial Sequence
  Synthetic
atggccgactcccaagtacggcgatgcgctgcgaatcgggagcggcgataccgtaaagcacgaggaagcggtcagcccattcgccgccaagctcttcagcaatatcacgggtagccaacgggagacccagcatggcgtat

SEQ ID NO: 386179 - DNA, 140 bp, Artificial Sequence
  Synthetic
aggccctggctgctgatatgtgactgctgacaatcttaaatgcccatgccaggtcccatcgcccgaatttttcacagaactggacggggtgcgcctgcacaggtttgcgcccccttgcaagaccttttgggacagcggtg

SEQ ID NO: 386180 - DNA, 140 bp, Artificial Sequence
  Synthetic
caccgctgtcccaaaaggtcttgcaagggggcgcaaacctgtgcaggcgcaccccgtccagttctgtgaaaaattcgggcgatgggacctggcatgggcatttaagattgtcagcagtcacatatcagcagccagggcct

SEQ ID NO: 386181 - DNA, 140 bp, Artificial Sequence
  Synthetic
aggccctggctgctgatatgtgccagggccctggcgcatggcgtccgggttctggaggacggcgtgaactatgcaacagggaatctgcccggttgctctttctctatcttcctcttggccgaccttttgggacagcggtg

SEQ ID NO: 386182 - DNA, 140 bp, Artificial Sequence
  Synthetic
caccgctgtcccaaaaggtcggccaagaggaagatagagaaagagcaaccgggcagattccctgttgcatagttcacgccgtcctccagaacccggacgccatgcgccagggccctggcacatatcagcagccagggcct

SEQ ID NO: 386183 - DNA, 140 bp, Artificial Sequence
  Synthetic
aggccctggctgctgatatggaccagaggccttattgctggcactacgcacctccaccgtgtggtatcgtacccgcgtcggaggtgtgtggtccagtgtattgcttcaccccaagccctggaccttttgggacagcggtg

SEQ ID NO: 386184 - DNA, 140 bp, Artificial Sequence
  Synthetic
caccgctgtcccaaaaggtccagggcttggggtgaagcaatacactggaccacacacctccgacgcgggtacgataccacacggtggaggtgcgtagtgccagcaataaggcctctggtccatatcagcagccagggcct

SEQ ID NO: 386185 - DNA, 140 bp, Artificial Sequence
  Synthetic
aggccctggctgctgatatgggactccttcgatccgcttgtggcggaggaggatgagcgggagatctccgtaccctcagaaatcctgcggaagtctcggagattcactccggccctgcctgaccttttgggacagcggtg

SEQ ID NO: 386186 - DNA, 140 bp, Artificial Sequence
  Synthetic
caccgctgtcccaaaaggtcaggcagggccggagtgaatctccgagacttccgcaggatttctgagggtacggagatctcccgctcatcctcctccgccacaagcggatcgaaggagtcccatatcagcagccagggcct

SEQ ID NO: 386187 - DNA, 140 bp, Artificial Sequence
  Synthetic
aggccctggctgctgatatgggacgtgcaatacctgtacggtatagggtcagcggtcgcctccgctgtaatcaaatgggagtatgtcatgctgctcttccttctcctggcggacgcacgcgaccttttgggacagcggtg

SEQ ID NO: 386188 - DNA, 140 bp, Artificial Sequence
  Synthetic
caccgctgtcccaaaaggtcgcgtgcgtccgccaggagaaggaagagcagcatgacatactcccatttgattacagcggaggcgaccgctgaccctataccgtacaggtattgcacgtcccatatcagcagccagggcct

SEQ ID NO: 386189 - DNA, 140 bp, Artificial Sequence
  Synthetic
aggccctggctgctgatatgcggactacgtccctccggtggtacacgggtgcccattgccacctaccaaggcccctccaataccacctccacggagaaagaggacggttgtcctgactgagaccttttgggacagcggtg

SEQ ID NO: 386190 - DNA, 140 bp, Artificial Sequence
  Synthetic
caccgctgtcccaaaaggtctcagtcaggacaaccgtcctctttctccgtggaggtggtattggaggggccttggtaggtggcaatgggcacccgtgtaccaccggagggacgtagtccgcatatcagcagccagggcct

SEQ ID NO: 386191 - DNA, 140 bp, Artificial Sequence
  Synthetic
aggccctggctgctgatatgtcaacgtccgggggggccgcgatgccatcatcctcctcacgtgtgcggtccactcagagctaatttttgacatcaccaaaatcttgctcgccatactcgggaccttttgggacagcggtg

SEQ ID NO: 386192 - DNA, 140 bp, Artificial Sequence
  Synthetic
caccgctgtcccaaaaggtcccgagtatggcgagcaagattttggtgatgtcaaaaattagctctgagtggaccgcacacgtgaggaggatgatggcatcgcggcccccccggacgttgacatatcagcagccagggcct

SEQ ID NO: 386193 - DNA, 140 bp, Artificial Sequence
  Synthetic
atacgccatgctgggtctccgttgaggtccgccgtgtaggggaacaccattacatcactggaatgacccaggataacctgaaatgcccatgtcaagttccatcaccggagtttttcacggcgtacttgggagtcggccat

SEQ ID NO: 386194 - DNA, 140 bp, Artificial Sequence
  Synthetic
atggccgactcccaagtacgccgtgaaaaactccggtgatggaacttgacatgggcatttcaggttatcctgggtcattccagtgatgtaatggtgttcccctacacggcggacctcaacggagacccagcatggcgtat

SEQ ID NO: 386195 - DNA, 140 bp, Artificial Sequence
  Synthetic
aggccctggctgctgatatgttctcgtatgatacccgctgcttcgactccacagtcactgagagcgacatccgtacggaggaggcaatctaccaatgttgtgacctggacccccaggcccgaccttttgggacagcggtg

SEQ ID NO: 386196 - DNA, 140 bp, Artificial Sequence
  Synthetic
caccgctgtcccaaaaggtcgggcctgggggtccaggtcacaacattggtagattgcctcctccgtacggatgtcgctctcagtgactgtggagtcgaagcagcgggtatcatacgagaacatatcagcagccagggcct

SEQ ID NO: 386197 - DNA, 140 bp, Artificial Sequence
  Synthetic
atacgccatgctgggtctcctaggccattcctgtttttttttttcccttttttttttttttttttttcccctttttggggggggcccccttttcccccaacccggggggggggggggggccgtacttgggagtcggccat

SEQ ID NO: 386198 - DNA, 140 bp, Artificial Sequence
  Synthetic
atggccgactcccaagtacggccccccccccccccccgggttgggggaaaagggggccccccccaaaaaggggaaaaaaaaaaaaaaaaaaaagggaaaaaaaaaaacaggaatggcctaggagacccagcatggcgtat

SEQ ID NO: 386199 - DNA, 140 bp, Artificial Sequence
  Synthetic
atacgccatgctgggtctcccagctggtcaacgccaacggcagttggcacatcaatagcacggccttgaactgtaatgagagccttgacactggctggatagcggggctcttctatcacccgtacttgggagtcggccat

SEQ ID NO: 386200 - DNA, 140 bp, Artificial Sequence
  Synthetic
atggccgactcccaagtacgggtgatagaagagccccgctatccagccagtgtcaaggctctcattacagttcaaggccgtgctattgatgtgccaactgccgttggcgttgaccagctgggagacccagcatggcgtat

SEQ ID NO: 386201 - DNA, 140 bp, Artificial Sequence
  Synthetic
aggccctggctgctgatatgctgtaatgagagccttgacactggctggatagcggggctcttctatcaccacaaattcaactcttcaggttgccccgagaggatggccagctgcagacccgaccttttgggacagcggtg

SEQ ID NO: 386202 - DNA, 140 bp, Artificial Sequence
  Synthetic
caccgctgtcccaaaaggtcgggtctgcagctggccatcctctcggggcaacctgaagagttgaatttgtggtgatagaagagccccgctatccagccagtgtcaaggctctcattacagcatatcagcagccagggcct

SEQ ID NO: 386203 - DNA, 140 bp, Artificial Sequence
  Synthetic
aggccctggctgctgatatgcctgctactccatagaaccactggatctacctccaatcattcaaagactccatggccttagcgcattctcactccacagttactctccaggtgaaatcaagaccttttgggacagcggtg

SEQ ID NO: 386204 - DNA, 140 bp, Artificial Sequence
  Synthetic
caccgctgtcccaaaaggtcttgatttcacctggagagtaactgtggagtgagaatgcgctaaggccatggagtctttgaatgattggaggtagatccagtggttctatggagtagcaggcatatcagcagccagggcct

SEQ ID NO: 386205 - DNA, 140 bp, Artificial Sequence
  Synthetic
atacgccatgctgggtctccacagggggggcggcaggccgcagcacgttcagcctgaccagcctctttgcacctggggcctctcagaaaatccagcttataaacaccaatggcagctggccgtacttgggagtcggccat

SEQ ID NO: 386206 - DNA, 140 bp, Artificial Sequence
  Synthetic
atggccgactcccaagtacggccagctgccattggtgtttataagctggattttctgagaggccccaggtgcaaagaggctggtcaggctgaacgtgctgcggcctgccgccccccctgtggagacccagcatggcgtat

SEQ ID NO: 386207 - DNA, 140 bp, Artificial Sequence
  Synthetic
aggccctggctgctgatatgattgccgcgctgttctacacacacaggttcaactcatccggatgcccagagcgcatggccagctgccgccccatcgacaagtttgctcaggggtggggtcgaccttttgggacagcggtg

SEQ ID NO: 386208 - DNA, 140 bp, Artificial Sequence
  Synthetic
caccgctgtcccaaaaggtcgaccccacccctgagcaaacttgtcgatggggcggcagctggccatgcgctctgggcatccggatgagttgaacctgtgtgtgtagaacagcgcggcaatcatatcagcagccagggcct

SEQ ID NO: 386209 - DNA, 140 bp, Artificial Sequence
  Synthetic
aggccctggctgctgatatgagtggatgaaccggctgatagcgttcgcttcgcggggtaaccacgtctcccccacgcactacgtgcctgagagcgacgctgcagcgcgtgttacccagatgaccttttgggacagcggtg

SEQ ID NO: 386210 - DNA, 140 bp, Artificial Sequence
  Synthetic
caccgctgtcccaaaaggtcatctgggtaacacgcgctgcagcgtcgctctcaggcacgtagtgcgtgggggagacgtggttaccccgcgaagcgaacgctatcagccggttcatccactcatatcagcagccagggcct

SEQ ID NO: 386211 - DNA, 140 bp, Artificial Sequence
  Synthetic
aggccctggctgctgatatgtatgccttctatggcgtatggccgctgctcctgctcctgctggcgttaccgccacgagcatatgccatggaccgagagatggctgcatcgtgtggaggcggaccttttgggacagcggtg

SEQ ID NO: 386212 - DNA, 140 bp, Artificial Sequence
  Synthetic
caccgctgtcccaaaaggtccgcctccacacgatgcagccatctctcggtccatggcatatgctcgtggcggtaacgccagcaggagcaggagcagcggccatacgccatagaaggcatacatatcagcagccagggcct

SEQ ID NO: 386213 - DNA, 140 bp, Artificial Sequence
  Synthetic
atacgccatgctgggtctccacctcttcaactgggcagtaaggaccaagctcaaactcactccaatcccggctgcgtcccagttggatttatccagctggttcgttgctggttacagcggcgtacttgggagtcggccat

SEQ ID NO: 386214 - DNA, 140 bp, Artificial Sequence
  Synthetic
atggccgactcccaagtacgccgctgtaaccagcaacgaaccagctggataaatccaactgggacgcagccgggattggagtgagtttgagcttggtccttactgcccagttgaagaggtggagacccagcatggcgtat

SEQ ID NO: 386215 - DNA, 140 bp, Artificial Sequence
  Synthetic
aggccctggctgctgatatgttccttacctggtagcgtaccaagccaccgtgtgcgctagggctcaagcccctcccccatcgtgggaccagatgtggaagtgtttgatccgcctcaagccgaccttttgggacagcggtg

SEQ ID NO: 386216 - DNA, 140 bp, Artificial Sequence
  Synthetic
caccgctgtcccaaaaggtcggcttgaggcggatcaaacacttccacatctggtcccacgatgggggaggggcttgagccctagcgcacacggtggcttggtacgctaccaggtaaggaacatatcagcagccagggcct

SEQ ID NO: 386217 - DNA, 140 bp, Artificial Sequence
  Synthetic
aggccctggctgctgatatgcgatgaacggggagctaaacactccaggccaataggccatcctgtttttttccctttttttttttcttttttttttttttttttttttttttttttttttgaccttttgggacagcggtg

SEQ ID NO: 386218 - DNA, 140 bp, Artificial Sequence
  Synthetic
caccgctgtcccaaaaggtcaaaaaaaaaaaaaaaaaaaaaaaaaaaaaaaaaagaaaaaaaaaaagggaaaaaaacaggatggcctattggcctggagtgtttagctccccgttcatcgcatatcagcagccagggcct

SEQ ID NO: 386219 - DNA, 140 bp, Artificial Sequence
  Synthetic
atacgccatgctgggtctccgattgaacaagatggattgcacgcaggttctccggccgcttgggtggagaggctattcggctatgactgggcacaacagacaatcggctgctctgatgcccgtacttgggagtcggccat

SEQ ID NO: 386220 - DNA, 140 bp, Artificial Sequence
  Synthetic
atggccgactcccaagtacgggcatcagagcagccgattgtctgttgtgcccagtcatagccgaatagcctctccacccaagcggccggagaacctgcgtgcaatccatcttgttcaatcggagacccagcatggcgtat

SEQ ID NO: 386221 - DNA, 140 bp, Artificial Sequence
  Synthetic
aggccctggctgctgatatggacccggactacgtccctccggtggtacacgggtgcccactgccacctaccaaggcccctccaataccacctccacggagaaaaaggacggttgtcctgagaccttttgggacagcggtg

SEQ ID NO: 386222 - DNA, 140 bp, Artificial Sequence
  Synthetic
caccgctgtcccaaaaggtctcaggacaaccgtcctttttctccgtggaggtggtattggaggggccttggtaggtggcagtgggcacccgtgtaccaccggagggacgtagtccgggtccatatcagcagccagggcct

SEQ ID NO: 386223 - DNA, 140 bp, Artificial Sequence
  Synthetic
aggccctggctgctgatatggatttcgactcggtgatagactgcaacacgtgtgtcacccagacagtcgatttcagccttgaccctaccttcaccattgagacaaccacgctccctcagggaccttttgggacagcggtg

SEQ ID NO: 386224 - DNA, 140 bp, Artificial Sequence
  Synthetic
caccgctgtcccaaaaggtccctgagggagcgtggttgtctcaatggtgaaggtagggtcaaggctgaaatcgactgtctgggtgacacacgtgttgcagtctatcaccgagtcgaaatccatatcagcagccagggcct

SEQ ID NO: 386225 - DNA, 140 bp, Artificial Sequence
  Synthetic
aggccctggctgctgatatgtgaccaggcctccgacgacggcgacaaagaatccgacgttgagtcgtactcctccatgcccccccttgagggggagccgggggaccccgatctcagcgacgaccttttgggacagcggtg

SEQ ID NO: 386226 - DNA, 140 bp, Artificial Sequence
  Synthetic
caccgctgtcccaaaaggtcgtcgctgagatcggggtcccccggctccccctcaagggggggcatggaggagtacgactcaacgtcggattctttgtcgccgtcgtcggaggcctggtcacatatcagcagccagggcct

SEQ ID NO: 386227 - DNA, 140 bp, Artificial Sequence
  Synthetic
aggccctggctgctgatatggaggagtacgtggaggttacgcgggtgggggatttccactacgtgacgggcatgaccactgacaacgtaaaatgcccatgccaggtcccggcccccgaatgaccttttgggacagcggtg

SEQ ID NO: 386228 - DNA, 140 bp, Artificial Sequence
  Synthetic
caccgctgtcccaaaaggtcattcgggggccgggacctggcatgggcattttacgttgtcagtggtcatgcccgtcacgtagtggaaatcccccacccgcgtaacctccacgtactcctccatatcagcagccagggcct

SEQ ID NO: 386229 - DNA, 140 bp, Artificial Sequence
  Synthetic
atacgccatgctgggtctcctgaataccaatggcagctggcacatcaacaggactgccctgaactgcaatgactccctccagactgggttccttgccgcgctgttctacacgcacaagttcgtacttgggagtcggccat

SEQ ID NO: 386230 - DNA, 140 bp, Artificial Sequence
  Synthetic
atggccgactcccaagtacgaacttgtgcgtgtagaacagcgcggcaaggaacccagtctggagggagtcattgcagttcagggcagtcctgttgatgtgccagctgccattggtattcaggagacccagcatggcgtat

SEQ ID NO: 386231 - DNA, 140 bp, Artificial Sequence
  Synthetic
aggccctggctgctgatatgcttagagaacttggtggtcctcaatgcagcggctgtggccggaacacatggcattctttccttccttgtgttcttctgtgccgcctggtatattaagggcgaccttttgggacagcggtg

SEQ ID NO: 386232 - DNA, 140 bp, Artificial Sequence
  Synthetic
caccgctgtcccaaaaggtcgcccttaatataccaggcggcacagaagaacacaaggaaggaaagaatgccatgtgttccggccacagccgctgcattgaggaccaccaagttctctaagcatatcagcagccagggcct

SEQ ID NO: 386233 - DNA, 140 bp, Artificial Sequence
  Synthetic
aggccctggctgctgatatgagcaactcgttgctacgtcatcataatctagtgtattccaccacctcacgcagtgcttgccaaaggcagaagaaagtcacatttgacagactgcaagttcgaccttttgggacagcggtg

SEQ ID NO: 386234 - DNA, 140 bp, Artificial Sequence
  Synthetic
caccgctgtcccaaaaggtcgaacttgcagtctgtcaaatgtgactttcttctgcctttggcaagcactgcgtgaggtggtggaatacactagattatgatgacgtagcaacgagttgctcatatcagcagccagggcct

SEQ ID NO: 386235 - DNA, 140 bp, Artificial Sequence
  Synthetic
aggccctggctgctgatatgggggtaaggaccatcaccacgggcgcccccatcacgtactccacctatggcaagttccttgccgacggtggttgctccgggggcgcctatgacatcataagaccttttgggacagcggtg

SEQ ID NO: 386236 - DNA, 140 bp, Artificial Sequence
  Synthetic
caccgctgtcccaaaaggtcttatgatgtcataggcgcccccggagcaaccaccgtcggcaaggaacttgccataggtggagtacgtgatgggggcgcccgtggtgatggtccttacccccatatcagcagccagggcct

SEQ ID NO: 386237 - DNA, 140 bp, Artificial Sequence
  Synthetic
aggccctggctgctgatatgtactctccaggtgaaatcaatagggtggccgcatgcctcagaaaacttggggttccgcccttgcgagcttggagacaccgggcccggagcgtccgcgctagaccttttgggacagcggtg

SEQ ID NO: 386238 - DNA, 140 bp, Artificial Sequence
  Synthetic
caccgctgtcccaaaaggtctagcgcggacgctccgggcccggtgtctccaagctcgcaagggcggaaccccaagttttctgaggcatgcggccaccctattgatttcacctggagagtacatatcagcagccagggcct

SEQ ID NO: 386239 - DNA, 140 bp, Artificial Sequence
  Synthetic
atacgccatgctgggtctccaactgggcagtaagaacaaagctcaaactcactccaatagcggccgctagccagctggacttgtccggctggttcacggctggctacagcgggggagacacgtacttgggagtcggccat

SEQ ID NO: 386240 - DNA, 140 bp, Artificial Sequence
  Synthetic
atggccgactcccaagtacgtgtctcccccgctgtagccagccgtgaaccagccggacaagtccagctggctagcggccgctattggagtgagtttgagctttgttcttactgcccagttggagacccagcatggcgtat

SEQ ID NO: 386241 - DNA, 140 bp, Artificial Sequence
  Synthetic
aggccctggctgctgatatgttgtggatgatgttactcatatcccaagcggaggcagctttggagaaccttgtactactcaatgcggcgtctctggccgggacgcacggtcttgcgtcctgaccttttgggacagcggtg

SEQ ID NO: 386242 - DNA, 140 bp, Artificial Sequence
  Synthetic
caccgctgtcccaaaaggtcaggacgcaagaccgtgcgtcccggccagagacgccgcattgagtagtacaaggttctccaaagctgcctccgcttgggatatgagtaacatcatccacaacatatcagcagccagggcct

SEQ ID NO: 386243 - DNA, 140 bp, Artificial Sequence
  Synthetic
aggccctggctgctgatatgtggcgcatggcgtccgggttctggaagacggcgtgaactatgcaacagggaatcttcctggttgctctttctctatcttccttctggccttgctctcttggaccttttgggacagcggtg

SEQ ID NO: 386244 - DNA, 140 bp, Artificial Sequence
  Synthetic
caccgctgtcccaaaaggtccaagagagcaaggccagaaggaagatagagaaagagcaaccaggaagattccctgttgcatagttcacgccgtcttccagaacccggacgccatgcgccacatatcagcagccagggcct

SEQ ID NO: 386245 - DNA, 140 bp, Artificial Sequence
  Synthetic
aggccctggctgctgatatggtccagtgtattgtttcactccaagccctgttgtggtggggacgaccgaccgcttcggcgtccctacgtacagctggggggagaatgaaacggacgtgctgaccttttgggacagcggtg

SEQ ID NO: 386246 - DNA, 140 bp, Artificial Sequence
  Synthetic
caccgctgtcccaaaaggtcagcacgtccgtttcattctccccccagctgtacgtagggacgccgaagcggtcggtcgtccccaccacaacagggcttggagtgaaacaatacactggaccatatcagcagccagggcct

SEQ ID NO: 386247 - DNA, 140 bp, Artificial Sequence
  Synthetic
atacgccatgctgggtctcccgcatggcttgactgctatcttccagaccggtgccaagcagaacatccagctgatcaatagcaacggcagttggcacatcaatcgcacggctttgaactgcgtacttgggagtcggccat

SEQ ID NO: 386248 - DNA, 140 bp, Artificial Sequence
  Synthetic
atggccgactcccaagtacgcagttcaaagccgtgcgattgatgtgccaactgccgttgctattgatcagctggatgttctgcttggcaccggtctggaagatagcagtcaagccatgcgggagacccagcatggcgtat

SEQ ID NO: 386249 - DNA, 140 bp, Artificial Sequence
  Synthetic
aggccctggctgctgatatggttcctcgctaagctcatatggtggttacaatattttatcaccagagccgaggcgcatttgcaagtgtgggtcccccccctcaacgttcgggggggccgcgaccttttgggacagcggtg

SEQ ID NO: 386250 - DNA, 140 bp, Artificial Sequence
  Synthetic
caccgctgtcccaaaaggtcgcggcccccccgaacgttgaggggggggacccacacttgcaaatgcgcctcggctctggtgataaaatattgtaaccaccatatgagcttagcgaggaaccatatcagcagccagggcct

SEQ ID NO: 386251 - DNA, 140 bp, Artificial Sequence
  Synthetic
aggccctggctgctgatatggtccgggatataccatgtcacgaacgactgctccaactcaagcattgtgtttgaggcagcggacttgatcatgcatacccccgggtgcgtgccctgcgttgaccttttgggacagcggtg

SEQ ID NO: 386252 - DNA, 140 bp, Artificial Sequence
  Synthetic
caccgctgtcccaaaaggtcaacgcagggcacgcacccgggggtatgcatgatcaagtccgctgcctcaaacacaatgcttgagttggagcagtcgttcgtgacatggtatatcccggaccatatcagcagccagggcct

SEQ ID NO: 386253 - DNA, 140 bp, Artificial Sequence
  Synthetic
aggccctggctgctgatatggagtcctggcgggccttgcctactattccatggtggggaactgggctaaggttctgattgtgatgctactctttgccggcgttgacgggagcacctacgtgaccttttgggacagcggtg

SEQ ID NO: 386254 - DNA, 140 bp, Artificial Sequence
  Synthetic
caccgctgtcccaaaaggtcacgtaggtgctcccgtcaacgccggcaaagagtagcatcacaatcagaaccttagcccagttccccaccatggaatagtaggcaaggcccgccaggactccatatcagcagccagggcct

SEQ ID NO: 386255 - DNA, 140 bp, Artificial Sequence
  Synthetic
atacgccatgctgggtctcctctatcaccatattacaaacaccacatcagctggtgcgtgtggtggcttcagtattttctaactagagtagaagcgcaactgcacgagtgggttcccccccgtacttgggagtcggccat

SEQ ID NO: 386256 - DNA, 140 bp, Artificial Sequence
  Synthetic
atggccgactcccaagtacgggggggaacccactcgtgcagttgcgcttctactctagttagaaaatactgaagccaccacacgcaccagctgatgtggtgtttgtaatatggtgatagaggagacccagcatggcgtat

SEQ ID NO: 386257 - DNA, 140 bp, Artificial Sequence
  Synthetic
aggccctggctgctgatatggccagttgtctgcgccttccttgaaggcgacatgcactacccatcatgactccccagacgctgacctcattgaggccaacctcctgtggcggcaggagatgaccttttgggacagcggtg

SEQ ID NO: 386258 - DNA, 140 bp, Artificial Sequence
  Synthetic
caccgctgtcccaaaaggtcatctcctgccgccacaggaggttggcctcaatgaggtcagcgtctggggagtcatgatgggtagtgcatgtcgccttcaaggaaggcgcagacaactggccatatcagcagccagggcct

SEQ ID NO: 386259 - DNA, 140 bp, Artificial Sequence
  Synthetic
aggccctggctgctgatatggggcggaaacatcacccgcgtggagtcagagaacaaggtagtaattctggactctttcgacccgcttcgagcggaggaggatgagagggaagtatccgttgaccttttgggacagcggtg

SEQ ID NO: 386260 - DNA, 140 bp, Artificial Sequence
  Synthetic
caccgctgtcccaaaaggtcaacggatacttccctctcatcctcctccgctcgaagcgggtcgaaagagtccagaattactaccttgttctctgactccacgcgggtgatgtttccgccccatatcagcagccagggcct

SEQ ID NO: 386261 - DNA, 140 bp, Artificial Sequence
  Synthetic
aggccctggctgctgatatgactctttcgacccgcttcgagcggaggaggatgagagggaagtatccgttccggcggagatcctgcggaaatccaggaagttccccccggcgatgcccatgaccttttgggacagcggtg

SEQ ID NO: 386262 - DNA, 140 bp, Artificial Sequence
  Synthetic
caccgctgtcccaaaaggtcatgggcatcgccggggggaacttcctggatttccgcaggatctccgccggaacggatacttccctctcatcctcctccgctcgaagcgggtcgaaagagtcatatcagcagccagggcct

SEQ ID NO: 386263 - DNA, 140 bp, Artificial Sequence
  Synthetic
atacgccatgctgggtctcctacaacaaattcaattcttcaggctgtcccgagagattggcgagctgccgaccccttaccgattttgaccagggctggggccctatcagttatgctaatgcgtacttgggagtcggccat

SEQ ID NO: 386264 - DNA, 140 bp, Artificial Sequence
  Synthetic
atggccgactcccaagtacgcattagcataactgatagggccccagccctggtcaaaatcggtaaggggtcggcagctcgccaatctctcgggacagcctgaagaattgaatttgttgtaggagacccagcatggcgtat

SEQ ID NO: 386265 - DNA, 140 bp, Artificial Sequence
  Synthetic
aggccctggctgctgatatgaccccttaccgattttgaccagggctggggccctatcagttatgctaatggaagcggccccgaccaacgcccctactgctggcactaccccccaaaaccagaccttttgggacagcggtg

SEQ ID NO: 386266 - DNA, 140 bp, Artificial Sequence
  Synthetic
caccgctgtcccaaaaggtctggttttggggggtagtgccagcagtaggggcgttggtcggggccgcttccattagcataactgatagggccccagccctggtcaaaatcggtaaggggtcatatcagcagccagggcct

SEQ ID NO: 386267 - DNA, 140 bp, Artificial Sequence
  Synthetic
aggccctggctgctgatatgcagggctggggccctatcagctatgccaacggaagcggccccgatcaccgcccctactgctggcactaccccccaaagccttgtggtatcgtgccagcacgaccttttgggacagcggtg

SEQ ID NO: 386268 - DNA, 140 bp, Artificial Sequence
  Synthetic
caccgctgtcccaaaaggtcgtgctggcacgataccacaaggctttggggggtagtgccagcagtaggggcggtgatcggggccgcttccgttggcatagctgatagggccccagccctgcatatcagcagccagggcct

SEQ ID NO: 386269 - DNA, 140 bp, Artificial Sequence
  Synthetic
aggccctggctgctgatatgcccctactgctggcactaccccccaaagccttgtggtatcgtgccagcacaaaacgtatgcggcccggtgtattgcttcactcccagccccgtggtggtggaccttttgggacagcggtg

SEQ ID NO: 386270 - DNA, 140 bp, Artificial Sequence
  Synthetic
caccgctgtcccaaaaggtccaccaccacggggctgggagtgaagcaatacaccgggccgcatacgttttgtgctggcacgataccacaaggctttggggggtagtgccagcagtaggggcatatcagcagccagggcct

SEQ ID NO: 386271 - DNA, 140 bp, Artificial Sequence
  Synthetic
atacgccatgctgggtctcccacattaacaggactgctctgaactgcaatgactccctcaacaccgggtttctcgctgcgttgttctacgcacataagttcaactcgtccggatgcccagcgtacttgggagtcggccat

SEQ ID NO: 386272 - DNA, 140 bp, Artificial Sequence
  Synthetic
atggccgactcccaagtacgctgggcatccggacgagttgaacttatgtgcgtagaacaacgcagcgagaaacccggtgttgagggagtcattgcagttcagagcagtcctgttaatgtgggagacccagcatggcgtat

SEQ ID NO: 386273 - DNA, 140 bp, Artificial Sequence
  Synthetic
aggccctggctgctgatatgtctcgctgcgttgttctacgcacataagttcaactcgtccggatgcccagagcgcatggccagctgccactccatcgacgagttcgcccaggggtggggtgaccttttgggacagcggtg

SEQ ID NO: 386274 - DNA, 140 bp, Artificial Sequence
  Synthetic
caccgctgtcccaaaaggtcaccccacccctgggcgaactcgtcgatggagtggcagctggccatgcgctctgggcatccggacgagttgaacttatgtgcgtagaacaacgcagcgagacatatcagcagccagggcct

SEQ ID NO: 386275 - DNA, 140 bp, Artificial Sequence
  Synthetic
aggccctggctgctgatatgattccaagtggcacatctgcacgctcctactggcagcggcaagagcactaaagtgccggctgcgtatgcagcccaagggtacaaggtgctcgtcctgaacgaccttttgggacagcggtg

SEQ ID NO: 386276 - DNA, 140 bp, Artificial Sequence
  Synthetic
caccgctgtcccaaaaggtcgttcaggacgagcaccttgtacccttgggctgcatacgcagccggcactttagtgctcttgccgctgccagtaggagcgtgcagatgtgccacttggaatcatatcagcagccagggcct

SEQ ID NO: 386277 - DNA, 140 bp, Artificial Sequence
  Synthetic
aggccctggctgctgatatggcctcacccacatagatgcccacttcttgtcccagactaagcaggcaggagacaacttcccctacctggtagcataccaagccacagtgtgcgccagggcgaccttttgggacagcggtg

SEQ ID NO: 386278 - DNA, 140 bp, Artificial Sequence
  Synthetic
caccgctgtcccaaaaggtcgccctggcgcacactgtggcttggtatgctaccaggtaggggaagttgtctcctgcctgcttagtctgggacaagaagtgggcatctatgtgggtgaggccatatcagcagccagggcct

SEQ ID NO: 386279 - DNA, 140 bp, Artificial Sequence
  Synthetic
aggccctggctgctgatatgcgcatttgcaagtgtgggtcccccccctcaacgttcgggggggccgcgatgccatcatcctcctcacgtgcgcggcctacccagagctaacctttgagatgaccttttgggacagcggtg

SEQ ID NO: 386280 - DNA, 140 bp, Artificial Sequence
  Synthetic
caccgctgtcccaaaaggtcatctcaaaggttagctctgggtaggccgcgcacgtgaggaggatgatggcatcgcggcccccccgaacgttgaggggggggacccacacttgcaaatgcgcatatcagcagccagggcct

SEQ ID NO: 386281 - DNA, 140 bp, Artificial Sequence
  Synthetic
atacgccatgctgggtctcccgaaggtcctggtagtgctgctgctatttgccggcgtcgacgcggacacctacaccaccgggggcagcgccggtcgcactgtggcgggactcagtagcctcgtacttgggagtcggccat

SEQ ID NO: 386282 - DNA, 140 bp, Artificial Sequence
  Synthetic
atggccgactcccaagtacgaggctactgagtcccgccacagtgcgaccggcgctgcccccggtggtgtaggtgtccgcgtcgacgccggcaaatagcagcagcactaccaggaccttcgggagacccagcatggcgtat

SEQ ID NO: 386283 - DNA, 140 bp, Artificial Sequence
  Synthetic
aggccctggctgctgatatggatgtgtccgtcataccgaccagcggagacgtcgttgtcgtggcaacagacgctctaatgacgggctataccggcgactttgactcagtgatcgactgtagaccttttgggacagcggtg

SEQ ID NO: 386284 - DNA, 140 bp, Artificial Sequence
  Synthetic
caccgctgtcccaaaaggtctacagtcgatcactgagtcaaagtcgccggtatagcccgtcattagagcgtctgttgccacgacaacgacgtctccgctggtcggtatgacggacacatccatatcagcagccagggcct

SEQ ID NO: 386285 - DNA, 140 bp, Artificial Sequence
  Synthetic
aggccctggctgctgatatgacaagaggcctcctagggtgcataatcaccagcctgaccggccgggacaaaaaccaagtggagggcgaggtccagattgtgtcaactgctgcccagacctgaccttttgggacagcggtg

SEQ ID NO: 386286 - DNA, 140 bp, Artificial Sequence
  Synthetic
caccgctgtcccaaaaggtcaggtctgggcagcagttgacacaatctggacctcgccctccacttggtttttgtcccggccggtcaggctggtgattatgcaccctaggaggcctcttgtcatatcagcagccagggcct

SEQ ID NO: 386287 - DNA, 140 bp, Artificial Sequence
  Synthetic
atacgccatgctgggtctccgctgccctttgctccgcgttatacgtcggagacgcgtgcggggcagtgtttttggtaggtcaaatgttcacctatagccctcgccggcataatgttgtgccgtacttgggagtcggccat

SEQ ID NO: 386288 - DNA, 140 bp, Artificial Sequence
  Synthetic
atggccgactcccaagtacggcacaacattatgccggcgagggctataggtgaacatttgacctaccaaaaacactgccccgcacgcgtctccgacgtataacgcggagcaaagggcagcggagacccagcatggcgtat

SEQ ID NO: 386289 - DNA, 140 bp, Artificial Sequence
  Synthetic
aggccctggctgctgatatggactacacgattacccggtggggtcgcaattaccttgcgagcctgaaccggacgtggccgtgctgacgtccatgctcactgatccctcccacataacggcgaccttttgggacagcggtg

SEQ ID NO: 386290 - DNA, 140 bp, Artificial Sequence
  Synthetic
caccgctgtcccaaaaggtcgccgttatgtgggagggatcagtgagcatggacgtcagcacggccacgtccggttcaggctcgcaaggtaattgcgaccccaccgggtaatcgtgtagtccatatcagcagccagggcct

SEQ ID NO: 386291 - DNA, 140 bp, Artificial Sequence
  Synthetic
aggccctggctgctgatatgggggtcctggcgggccttgcctactattccatggtggggaactgggctaaggtgttgatcgtgatgctgctcttcgccggcgttgacgggaggataggctgaccttttgggacagcggtg

SEQ ID NO: 386292 - DNA, 140 bp, Artificial Sequence
  Synthetic
caccgctgtcccaaaaggtcagcctatcctcccgtcaacgccggcgaagagcagcatcacgatcaacaccttagcccagttccccaccatggaatagtaggcaaggcccgccaggacccccatatcagcagccagggcct

SEQ ID NO: 386293 - DNA, 140 bp, Artificial Sequence
  Synthetic
atacgccatgctgggtctccgcacatcaacaggactgctctggactgcaaagcctccctccagactgggtttcttgctgggctgctctacgcgaaaaagttcaacacgtccggatgcttgcgtacttgggagtcggccat

SEQ ID NO: 386294 - DNA, 140 bp, Artificial Sequence
  Synthetic
atggccgactcccaagtacgcaagcatccggacgtgttgaactttttcgcgtagagcagcccagcaagaaacccagtctggagggaggctttgcagtccagagcagtcctgttgatgtgcggagacccagcatggcgtat

SEQ ID NO: 386295 - DNA, 140 bp, Artificial Sequence
  Synthetic
atacgccatgctgggtctccggcactacgcaccacgacggtgtggtatcatacccgcgtcgcaggtgtgcggtccagtctattgtttcaccccaagccccgttgtggtggggacgaccgacgtacttgggagtcggccat

SEQ ID NO: 386296 - DNA, 140 bp, Artificial Sequence
  Synthetic
atggccgactcccaagtacgtcggtcgtccccaccacaacggggcttggggtgaaacaatagactggaccgcacacctgcgacgcgggtatgataccacaccgtcgtggtgcgtagtgccggagacccagcatggcgtat

SEQ ID NO: 386297 - DNA, 140 bp, Artificial Sequence
  Synthetic
atacgccatgctgggtctcctgctcctcaacaacacgcggccgccacaaggtaactggttcggctgtacatggatgaatagtactgggttcaccaagacctgcggaggccccccctgcaacgtacttgggagtcggccat

SEQ ID NO: 386298 - DNA, 140 bp, Artificial Sequence
  Synthetic
atggccgactcccaagtacgttgcagggggggcctccgcaggtcttggtgaacccagtactattcatccatgtacagccgaaccagttaccttgtggcggccgcgtgttgttgaggagcaggagacccagcatggcgtat

SEQ ID NO: 386299 - DNA, 140 bp, Artificial Sequence
  Synthetic
atacgccatgctgggtctccggccacatactggccgtcgtattacaacgttggtgcgggccggcccgccacctttgtgaggtctgttgcacagaacggtcattctcagattgcgcccaagcgtacttgggagtcggccat

SEQ ID NO: 386300 - DNA, 140 bp, Artificial Sequence
  Synthetic
atggccgactcccaagtacgcttgggcgcaatctgagaatgaccgttctgtgcaacagacctcacaaaggtggcgggccggcccgcaccaacgttgtaatacgacggccagtatgtggccggagacccagcatggcgtat

SEQ ID NO: 386301 - DNA, 140 bp, Artificial Sequence
  Synthetic
aggccctggctgctgatatgttgaactgcaatgatagcctcaacaccggctggatagcagggcttctctattacaacaaattcaactcttcaggctgtcctgagaggttggccagctgccgaccttttgggacagcggtg

SEQ ID NO: 386302 - DNA, 140 bp, Artificial Sequence
  Synthetic
caccgctgtcccaaaaggtcggcagctggccaacctctcaggacagcctgaagagttgaatttgttgtaatagagaagccctgctatccagccggtgttgaggctatcattgcagttcaacatatcagcagccagggcct

SEQ ID NO: 386303 - DNA, 140 bp, Artificial Sequence
  Synthetic
atacgccatgctgggtctccttacaacaaattcaactcttcaggctgtcctgagaggttggccagctgccgaccccttaccgattttgaccagggctggggccctatcagtcatgccaaccgtacttgggagtcggccat

SEQ ID NO: 386304 - DNA, 140 bp, Artificial Sequence
  Synthetic
atggccgactcccaagtacggttggcatgactgatagggccccagccctggtcaaaatcggtaaggggtcggcagctggccaacctctcaggacagcctgaagagttgaatttgttgtaaggagacccagcatggcgtat

SEQ ID NO: 386305 - DNA, 140 bp, Artificial Sequence
  Synthetic
aggccctggctgctgatatggaacgactgctccaactcaagcattgtgtatgaggcagcggacatgatcatgcacacccccgggtgcgtgccctgcgttcgggagaacaactcctcccgcgaccttttgggacagcggtg

SEQ ID NO: 386306 - DNA, 140 bp, Artificial Sequence
  Synthetic
caccgctgtcccaaaaggtcgcgggaggagttgttctcccgaacgcagggcacgcacccgggggtgtgcatgatcatgtccgctgcctcatacacaatgcttgagttggagcagtcgttccatatcagcagccagggcct

SEQ ID NO: 386307 - DNA, 140 bp, Artificial Sequence
  Synthetic
aggccctggctgctgatatggctgccagggccctggcgcatggcgtccgggttctggaggacggcgtgaactatgcaacagggaatctgcccggttgctccttttctatcttccttttgggaccttttgggacagcggtg

SEQ ID NO: 386308 - DNA, 140 bp, Artificial Sequence
  Synthetic
caccgctgtcccaaaaggtcccaaaaggaagatagaaaaggagcaaccgggcagattccctgttgcatagttcacgccgtcctccagaacccggacgccatgcgccagggccctggcagccatatcagcagccagggcct

SEQ ID NO: 386309 - DNA, 140 bp, Artificial Sequence
  Synthetic
aggccctggctgctgatatgcggcgtactgacaactagctgtggtaacaccctcacttgctacatcaaggcccgagcagcctgtcgagccgcagggctccgggactgcaccatgctcgtggaccttttgggacagcggtg

SEQ ID NO: 386310 - DNA, 140 bp, Artificial Sequence
  Synthetic
caccgctgtcccaaaaggtccacgagcatggtgcagtcccggagccctgcggctcgacaggctgctcgggccttgatgtagcaagtgagggtgttaccacagctagttgtcagtacgccgcatatcagcagccagggcct

SEQ ID NO: 386311 - DNA, 140 bp, Artificial Sequence
  Synthetic
aggccctggctgctgatatgtgtggcgacgacttagtcgttatctgtgaaagtgagggggtccaggaggacgcagcgagcctgagagccttcacggaggctatgaccaggtactccgctcgaccttttgggacagcggtg

SEQ ID NO: 386312 - DNA, 140 bp, Artificial Sequence
  Synthetic
caccgctgtcccaaaaggtcgagcggagtacctggtcatagcctccgtgaaggctctcaggctcgctgcgtcctcctggaccccctcactttcacagataacgactaagtcgtcgccacacatatcagcagccagggcct

SEQ ID NO: 386313 - DNA, 140 bp, Artificial Sequence
  Synthetic
aggccctggctgctgatatgcctactgctggcactaccccccaaagccttgtggtatcgtgccagcacggaacgtgtgtggcccagtgtattgcttcacccctagccccgtggtggtggggaccttttgggacagcggtg

SEQ ID NO: 386314 - DNA, 140 bp, Artificial Sequence
  Synthetic
caccgctgtcccaaaaggtccccaccaccacggggctaggggtgaagcaatacactgggccacacacgttccgtgctggcacgataccacaaggctttggggggtagtgccagcagtaggcatatcagcagccagggcct

SEQ ID NO: 386315 - DNA, 140 bp, Artificial Sequence
  Synthetic
atacgccatgctgggtctccacatcaacaggactgccctgaattgcaatgaatccctcaacaccgggtggcttgccgcgctgttctacacacacaagttcaactcgtctgggtgcccagacgtacttgggagtcggccat

SEQ ID NO: 386316 - DNA, 140 bp, Artificial Sequence
  Synthetic
atggccgactcccaagtacgtctgggcacccagacgagttgaacttgtgtgtgtagaacagcgcggcaagccacccggtgttgagggattcattgcaattcagggcagtcctgttgatgtggagacccagcatggcgtat

SEQ ID NO: 386317 - DNA, 140 bp, Artificial Sequence
  Synthetic
aggccctggctgctgatatgcggacgtcttcgtcctcaacaacaccaggccaccgttgggcaattggttcggttgcacctggatgaactcatctggatttaccaaagtgtgcggagcgccgaccttttgggacagcggtg

SEQ ID NO: 386318 - DNA, 140 bp, Artificial Sequence
  Synthetic
caccgctgtcccaaaaggtcggcgctccgcacactttggtaaatccagatgagttcatccaggtgcaaccgaaccaattgcccaacggtggcctggtgttgttgaggacgaagacgtccgcatatcagcagccagggcct

SEQ ID NO: 386319 - DNA, 140 bp, Artificial Sequence
  Synthetic
aggccctggctgctgatatgctttgactaccggcctcatccacctccaccagaacatcgtggacgtgcaatatttgtacggggtggggtcaagcattgtgtcctgggccatcaagtgggagaccttttgggacagcggtg

SEQ ID NO: 386320 - DNA, 140 bp, Artificial Sequence
  Synthetic
caccgctgtcccaaaaggtctcccacttgatggcccaggacacaatgcttgaccccaccccgtacaaatattgcacgtccacgatgttctggtggaggtggatgaggccggtagtcaaagcatatcagcagccagggcct

SEQ ID NO: 386321 - DNA, 140 bp, Artificial Sequence
  Synthetic
aggccctggctgctgatatgggggtaaacactccggcctcttaggccatctcctgtttttttttttttttttttttttttttttttttttttttttttttttttttttttttttttttttgaccttttgggacagcggtg

SEQ ID NO: 386322 - DNA, 140 bp, Artificial Sequence
  Synthetic
caccgctgtcccaaaaggtcaaaaaaaaaaaaaaaaaaaaaaaaaaaaaaaaaaaaaaaaaaaaaaaaaaaaaaaaaaaaaaaaacaggagatggcctaagaggccggagtgtttacccccatatcagcagccagggcct

SEQ ID NO: 386323 - DNA, 140 bp, Artificial Sequence
  Synthetic
aggccctggctgctgatatgtcttctgtgctgcctggtacatcaagggcaggctggtccctggggcggcatatgctctctatggcgtatggccgctgctcctgctcctgctggcgttaccgaccttttgggacagcggtg

SEQ ID NO: 386324 - DNA, 140 bp, Artificial Sequence
  Synthetic
caccgctgtcccaaaaggtcggtaacgccagcaggagcaggagcagcggccatacgccatagagagcatatgccgccccagggaccagcctgcccttgatgtaccaggcagcacagaagacatatcagcagccagggcct

SEQ ID NO: 386325 - DNA, 140 bp, Artificial Sequence
  Synthetic
atacgccatgctgggtctccaaccatctcacccctcttcgggactgggcgcacaacagcctgcaagatctggccgtggctgtagaaccagtcgtcttttcccagatggagaccaagctcacgtacttgggagtcggccat

SEQ ID NO: 386326 - DNA, 140 bp, Artificial Sequence
  Synthetic
atggccgactcccaagtacgtgagcttggtctccatctgggaaaagacgactggttctacagccacggccagatcttgcaggctgttgtgcgcccagtcccgaagaggggtgagatggttggagacccagcatggcgtat

SEQ ID NO: 386327 - DNA, 140 bp, Artificial Sequence
  Synthetic
aggccctggctgctgatatggcaggctggtccctggggcggcatatgccctctacggcgtatggccgctactcctgctcctgctggcgttaccaccacgagcatacgccatggaccgggagaccttttgggacagcggtg

SEQ ID NO: 386328 - DNA, 140 bp, Artificial Sequence
  Synthetic
caccgctgtcccaaaaggtctcccggtccatggcgtatgctcgtggtggtaacgccagcaggagcaggagtagcggccatacgccgtagagggcatatgccgccccagggaccagcctgccatatcagcagccagggcct

SEQ ID NO: 386329 - DNA, 140 bp, Artificial Sequence
  Synthetic
atacgccatgctgggtctcctggttgtgctatctcctgaccttgggggaagccatgatccaggagtgggtaccacccatgcaggtgcgtggcggccgcgatggcatcatatgggccgccacgtacttgggagtcggccat

SEQ ID NO: 386330 - DNA, 140 bp, Artificial Sequence
  Synthetic
atggccgactcccaagtacgtggcggcccatatgatgccatcgcggccgccacgcacctgcatgggtggtacccactcctggatcatggcttcccccaaggtcaggagatagcacaaccaggagacccagcatggcgtat

SEQ ID NO: 386331 - DNA, 140 bp, Artificial Sequence
  Synthetic
atacgccatgctgggtctccgcttccggaagcaccccaaagccacctacaccaaatgcggttcgggaccttggttgacacctaggtgcatggttgactacccgtataggctttggcattacgtacttgggagtcggccat

SEQ ID NO: 386332 - DNA, 140 bp, Artificial Sequence
  Synthetic
atggccgactcccaagtacgtaatgccaaagcctatacgggtagtcaaccatgcacctaggtgtcaaccaaggtcccgaaccgcatttggtgtaggtggctttggggtgcttccggaagcggagacccagcatggcgtat

SEQ ID NO: 386333 - DNA, 140 bp, Artificial Sequence
  Synthetic
atacgccatgctgggtctccagtagctcaggtgctccggatcccacaagccatcttggacatgatcgctggtgctcactggggagtcctggcgggcatagcgtatttctccatggtggggcgtacttgggagtcggccat

SEQ ID NO: 386334 - DNA, 140 bp, Artificial Sequence
  Synthetic
atggccgactcccaagtacgccccaccatggagaaatacgctatgcccgccaggactccccagtgagcaccagcgatcatgtccaagatggcttgtgggatccggagcacctgagctactggagacccagcatggcgtat

SEQ ID NO: 386335 - DNA, 140 bp, Artificial Sequence
  Synthetic
aggccctggctgctgatatggtgctcactggggagtcctggcgggcatagcgtatttctccatggtggggaactgggcgaaggtcctggtagtgctgctgctatttgccggcgtcgacgcgaccttttgggacagcggtg

SEQ ID NO: 386336 - DNA, 140 bp, Artificial Sequence
  Synthetic
caccgctgtcccaaaaggtcgcgtcgacgccggcaaatagcagcagcactaccaggaccttcgcccagttccccaccatggagaaatacgctatgcccgccaggactccccagtgagcaccatatcagcagccagggcct

SEQ ID NO: 386337 - DNA, 140 bp, Artificial Sequence
  Synthetic
aggccctggctgctgatatgcctacgagaccttgcggtggcagttgagcccgtcgtcttctctgatatggagaccaaggttatcacctggggggcagacaccgcggcgtgtggggacatcgaccttttgggacagcggtg

SEQ ID NO: 386338 - DNA, 140 bp, Artificial Sequence
  Synthetic
caccgctgtcccaaaaggtcgatgtccccacacgccgcggtgtctgccccccaggtgataaccttggtctccatatcagagaagacgacgggctcaactgccaccgcaaggtctcgtaggcatatcagcagccagggcct

SEQ ID NO: 386339 - DNA, 140 bp, Artificial Sequence
  Synthetic
aggccctggctgctgatatgcacatggtgtcgaccctaacatcagaactggggtaaggaccatcaccacgggcgcccccatcacgtactccacctatggcaagttccttgccgacggtgggaccttttgggacagcggtg

SEQ ID NO: 386340 - DNA, 140 bp, Artificial Sequence
  Synthetic
caccgctgtcccaaaaggtcccaccgtcggcaaggaacttgccataggtggagtacgtgatgggggcgcccgtggtgatggtccttaccccagttctgatgttagggtcgacaccatgtgcatatcagcagccagggcct

SEQ ID NO: 386341 - DNA, 140 bp, Artificial Sequence
  Synthetic
aggccctggctgctgatatgtcggttgtacctggatgaactcaactggattcaccaaagtgtgcggagcgcccccttgtgtcatcggaggggtgggcaacaacaccttgcactgccccacgaccttttgggacagcggtg

SEQ ID NO: 386342 - DNA, 140 bp, Artificial Sequence
  Synthetic
caccgctgtcccaaaaggtcgtggggcagtgcaaggtgttgttgcccacccctccgatgacacaagggggcgctccgcacactttggtgaatccagttgagttcatccaggtacaaccgacatatcagcagccagggcct

SEQ ID NO: 386343 - DNA, 140 bp, Artificial Sequence
  Synthetic
aggccctggctgctgatatggagagatccccttctatggcaaagccatccccatcgagaccatcaaggggggaaggcatctcattttctgccattccaagaagaaatgtgacgagctcgcgaccttttgggacagcggtg

SEQ ID NO: 386344 - DNA, 140 bp, Artificial Sequence
  Synthetic
caccgctgtcccaaaaggtcgcgagctcgtcacatttcttcttggaatggcagaaaatgagatgccttccccccttgatggtctcgatggggatggctttgccatagaaggggatctctccatatcagcagccagggcct

SEQ ID NO: 386345 - DNA, 140 bp, Artificial Sequence
  Synthetic
aggccctggctgctgatatgtgttggcgttgccccagcgggcatacgcgctggacacggaggtggccgcgtcgtgtggcggcgttgttcttgtcgggttgatggcgctgactctgtcaccgaccttttgggacagcggtg

SEQ ID NO: 386346 - DNA, 140 bp, Artificial Sequence
  Synthetic
caccgctgtcccaaaaggtcggtgacagagtcagcgccatcaacccgacaagaacaacgccgccacacgacgcggccacctccgtgtccagcgcgtatgcccgctggggcaacgccaacacatatcagcagccagggcct

SEQ ID NO: 386347 - DNA, 140 bp, Artificial Sequence
  Synthetic
aggccctggctgctgatatggcataccaggctacagtgtgcgccagggcccaggctccacctccatcgtgggatcaaatgtggaagtgtctcatacggctaaagcctacgctgcacgggcgaccttttgggacagcggtg

SEQ ID NO: 386348 - DNA, 140 bp, Artificial Sequence
  Synthetic
caccgctgtcccaaaaggtcgcccgtgcagcgtaggctttagccgtatgagacacttccacatttgatcccacgatggaggtggagcctgggccctggcgcacactgtagcctggtatgccatatcagcagccagggcct

SEQ ID NO: 386349 - DNA, 140 bp, Artificial Sequence
  Synthetic
aggccctggctgctgatatgggatacagtacttagcaggcttgtccactctgcctgggaaccccgcaatagcatcactgatggcattcacagcctccatcaccagcccgctgaccacccagaccttttgggacagcggtg

SEQ ID NO: 386350 - DNA, 140 bp, Artificial Sequence
  Synthetic
caccgctgtcccaaaaggtctgggtggtcagcgggctggtgatggaggctgtgaatgccatcagtgatgctattgcggggttcccaggcagagtggacaagcctgctaagtactgtatcccatatcagcagccagggcct

SEQ ID NO: 386351 - DNA, 140 bp, Artificial Sequence
  Synthetic
aggccctggctgctgatatgggcgggaacatcacccgcgtggagtcagagaataaggtggtaattttggactctttcgacccgcttcgagcggaggaggatgagagggaagtatccgttcgaccttttgggacagcggtg

SEQ ID NO: 386352 - DNA, 140 bp, Artificial Sequence
  Synthetic
caccgctgtcccaaaaggtcgaacggatacttccctctcatcctcctccgctcgaagcgggtcgaaagagtccaaaattaccaccttattctctgactccacgcgggtgatgttcccgcccatatcagcagccagggcct

SEQ ID NO: 386353 - DNA, 140 bp, Artificial Sequence
  Synthetic
atacgccatgctgggtctccgatttgtggcaccgggggagcgcccctccggcatgttcgactcgtccgtcctctgtgagtgctatgacgcgggctgtgcttggtatgagctcacgcccgccgtacttgggagtcggccat

SEQ ID NO: 386354 - DNA, 140 bp, Artificial Sequence
  Synthetic
atggccgactcccaagtacggcgggcgtgagctcataccaagcacagcccgcgtcatagcactcacagaggacggacgagtcgaacatgccggaggggcgctcccccggtgccacaaatcggagacccagcatggcgtat

SEQ ID NO: 386355 - DNA, 140 bp, Artificial Sequence
  Synthetic
atacgccatgctgggtctcctgaataccaatggcagctggcacatcaacaggactgccctaaactgtaatgattccctccagactgggttcattgccgcgttgttctacgcacacagtttcgtacttgggagtcggccat

SEQ ID NO: 386356 - DNA, 140 bp, Artificial Sequence
  Synthetic
atggccgactcccaagtacgaaactgtgtgcgtagaacaacgcggcaatgaacccagtctggagggaatcattacagtttagggcagtcctgttgatgtgccagctgccattggtattcaggagacccagcatggcgtat

SEQ ID NO: 386357 - DNA, 140 bp, Artificial Sequence
  Synthetic
aggccctggctgctgatatgtccagaccaactggcaaaaactcgaggccttctgggcgaagcatatgtggaacttcatcagtgggatacaatacttggcgggcctgtcaacgttgcctgggaccttttgggacagcggtg

SEQ ID NO: 386358 - DNA, 140 bp, Artificial Sequence
  Synthetic
caccgctgtcccaaaaggtcccaggcaacgttgacaggcccgccaagtattgtatcccactgatgaagttccacatatgcttcgcccagaaggcctcgagtttttgccagttggtctggacatatcagcagccagggcct

SEQ ID NO: 386359 - DNA, 140 bp, Artificial Sequence
  Synthetic
aggccctggctgctgatatgggctctggcactacccctgcactgtcaactttaccatcttcaaggttaggatgtatgtggggggcgtggagcacaggctcagtgctgcatgcaattggacgaccttttgggacagcggtg

SEQ ID NO: 386360 - DNA, 140 bp, Artificial Sequence
  Synthetic
caccgctgtcccaaaaggtcgtccaattgcatgcagcactgagcctgtgctccacgccccccacatacatcctaaccttgaagatggtaaagttgacagtgcaggggtagtgccagagcccatatcagcagccagggcct

SEQ ID NO: 386361 - DNA, 140 bp, Artificial Sequence
  Synthetic
aggccctggctgctgatatgtgccacaactgcctgggattccctttgtgtcctgccagcgcgggtataggggggtctggcgaggggacggcatcatgcacactcgctgccactgtggagcgaccttttgggacagcggtg

SEQ ID NO: 386362 - DNA, 140 bp, Artificial Sequence
  Synthetic
caccgctgtcccaaaaggtcgctccacagtggcagcgagtgtgcatgatgccgtcccctcgccagacccccctatacccgcgctggcaggacacaaagggaatcccaggcagttgtggcacatatcagcagccagggcct

SEQ ID NO: 386363 - DNA, 140 bp, Artificial Sequence
  Synthetic
aggccctggctgctgatatggtcttccacggcgccggctcaaagaccctagccggcccaaaaggtccaatcacccaaatgtacaccaatgtagaccaagacctcgtcggctggcaggcgcgaccttttgggacagcggtg

SEQ ID NO: 386364 - DNA, 140 bp, Artificial Sequence
  Synthetic
caccgctgtcccaaaaggtcgcgcctgccagccgacgaggtcttggtctacattggtgtacatttgggtgattggaccttttgggccggctagggtctttgagccggcgccgtggaagaccatatcagcagccagggcct

SEQ ID NO: 386365 - DNA, 140 bp, Artificial Sequence
  Synthetic
aggccctggctgctgatatgaatcctggcgggccttgcttactattccatggcggggaactgggctaaggtcttgcttgtgatgctactctttgccggcgttgacggtcacacgtccgtcgaccttttgggacagcggtg

SEQ ID NO: 386366 - DNA, 140 bp, Artificial Sequence
  Synthetic
caccgctgtcccaaaaggtcgacggacgtgtgaccgtcaacgccggcaaagagtagcatcacaagcaagaccttagcccagttccccgccatggaatagtaagcaaggcccgccaggattcatatcagcagccagggcct

SEQ ID NO: 386367 - DNA, 140 bp, Artificial Sequence
  Synthetic
atacgccatgctgggtctccacatcaacagaacggccctaaattgcaatgacaccctcaacaccgggttcatcaaagcgctgttctacgcaaaaaccagtaacctcaacttaaccggatgcgtacttgggagtcggccat

SEQ ID NO: 386368 - DNA, 140 bp, Artificial Sequence
  Synthetic
atggccgactcccaagtacgcatccggttaagttgaggttactggtttttgcgtagaacagcgctttgatgaacccggtgttgagggtgtcattgcaatttagggccgttctgttgatgtggagacccagcatggcgtat

SEQ ID NO: 386369 - DNA, 140 bp, Artificial Sequence
  Synthetic
atacgccatgctgggtctcctcgatgcgatcacctatacctccggggggagtgccgctcatgccgcgtatgggctcagcagtcttttcaatgtgggctctcgacaaaacctccagctaatcgtacttgggagtcggccat

SEQ ID NO: 386370 - DNA, 140 bp, Artificial Sequence
  Synthetic
atggccgactcccaagtacgattagctggaggttttgtcgagagcccacattgaaaagactgctgagcccatacgcggcatgagcggcactccccccggaggtataggtgatcgcatcgaggagacccagcatggcgtat

SEQ ID NO: 386371 - DNA, 140 bp, Artificial Sequence
  Synthetic
atacgccatgctgggtctccggggtcccatcactcacgcttcggtaacaccacttgaccagagaccatattgctggcactacgcaccccgtccgtgcggtattgaacccgcgtcacgggtcgtacttgggagtcggccat

SEQ ID NO: 386372 - DNA, 140 bp, Artificial Sequence
  Synthetic
atggccgactcccaagtacgacccgtgacgcgggttcaataccgcacggacggggtgcgtagtgccagcaatatggtctctggtcaagtggtgttaccgaagcgtgagtgatgggaccccggagacccagcatggcgtat

SEQ ID NO: 386373 - DNA, 140 bp, Artificial Sequence
  Synthetic
atacgccatgctgggtctccgtgctgctcctcaacagctcgcggccaccgcagggcagctggttcggctgtacatggatgaatagcaccgggttcaccaagacgtgtggggcccccccttcgtacttgggagtcggccat

SEQ ID NO: 386374 - DNA, 140 bp, Artificial Sequence
  Synthetic
atggccgactcccaagtacgaagggggggccccacacgtcttggtgaacccggtgctattcatccatgtacagccgaaccagctgccctgcggtggccgcgagctgttgaggagcagcacggagacccagcatggcgtat

SEQ ID NO: 386375 - DNA, 140 bp, Artificial Sequence
  Synthetic
atacgccatgctgggtctcccggagcgcctccatgtaacatcggaggggcgggcaaccgcaccttgctctgccccactgactgcttccgcaagcatccggaggccacatattcccgatgtcgtacttgggagtcggccat

SEQ ID NO: 386376 - DNA, 140 bp, Artificial Sequence
  Synthetic
atggccgactcccaagtacgacatcgggaatatgtggcctccggatgcttgcggaagcagtcagtggggcagagcaaggtgcggttgcccgcccctccgatgttacatggaggcgctccgggagacccagcatggcgtat

SEQ ID NO: 386377 - DNA, 140 bp, Artificial Sequence
  Synthetic
atacgccatgctgggtctcccaacagagtggcaggtactgccctgctccttcaccaccctaccggccctgtccactggcttgatccatctccaccagaacattgtggacatacaatacttcgtacttgggagtcggccat

SEQ ID NO: 386378 - DNA, 140 bp, Artificial Sequence
  Synthetic
atggccgactcccaagtacgaagtattgtatgtccacaatgttctggtggagatggatcaagccagtggacagggccggtagggtggtgaaggagcagggcagtacctgccactctgttgggagacccagcatggcgtat

SEQ ID NO: 386379 - DNA, 140 bp, Artificial Sequence
  Synthetic
aggccctggctgctgatatgagtacaccggaattgccaggacgaccgggtcctttcttggatcaacccgctcaatgcctggagatttgggcgtgcccccgcgagactgctagccgagtaggaccttttgggacagcggtg

SEQ ID NO: 386380 - DNA, 140 bp, Artificial Sequence
  Synthetic
caccgctgtcccaaaaggtcctactcggctagcagtctcgcgggggcacgcccaaatctccaggcattgagcgggttgatccaagaaaggacccggtcgtcctggcaattccggtgtactcatatcagcagccagggcct

SEQ ID NO: 386381 - DNA, 140 bp, Artificial Sequence
  Synthetic
aggccctggctgctgatatgggtcctcaatgcggcgtctgtggccggagtgcatggcattttctccttccttgtgttcttctgtgctgcctggtacatcaagggcaggttggtccccgcagaccttttgggacagcggtg

SEQ ID NO: 386382 - DNA, 140 bp, Artificial Sequence
  Synthetic
caccgctgtcccaaaaggtctgcggggaccaacctgcccttgatgtaccaggcagcacagaagaacacaaggaaggagaaaatgccatgcactccggccacagacgccgcattgaggacccatatcagcagccagggcct

SEQ ID NO: 386383 - DNA, 140 bp, Artificial Sequence
  Synthetic
aggccctggctgctgatatgccaagctcattacgtggggggcggacaccgccgcatgcggtgacatcatcaacggcttgcccgtctctgcccgcaggggccgagagatactgctcgggccgaccttttgggacagcggtg

SEQ ID NO: 386384 - DNA, 140 bp, Artificial Sequence
  Synthetic
caccgctgtcccaaaaggtcggcccgagcagtatctctcggcccctgcgggcagagacgggcaagccgttgatgatgtcaccgcatgcggcggtgtccgccccccacgtaatgagcttggcatatcagcagccagggcct

SEQ ID NO: 386385 - DNA, 140 bp, Artificial Sequence
  Synthetic
aggccctggctgctgatatgtggtgcctacatgtccaaggcccatgggatcgatcctaacatcaggactggggtgaggacaattaccactggcagccccatcacgtactccacctacggcgaccttttgggacagcggtg

SEQ ID NO: 386386 - DNA, 140 bp, Artificial Sequence
  Synthetic
caccgctgtcccaaaaggtcgccgtaggtggagtacgtgatggggctgccagtggtaattgtcctcaccccagtcctgatgttaggatcgatcccatgggccttggacatgtaggcaccacatatcagcagccagggcct

SEQ ID NO: 386387 - DNA, 140 bp, Artificial Sequence
  Synthetic
aggccctggctgctgatatggggcgctgtggcgggtggctgctgaggagtacgtggaggttacgcgggtgggggatttccactacgtgacgggcatgaccactgacaacgtaaagtgcccgaccttttgggacagcggtg

SEQ ID NO: 386388 - DNA, 140 bp, Artificial Sequence
  Synthetic
caccgctgtcccaaaaggtcgggcactttacgttgtcagtggtcatgcccgtcacgtagtggaaatcccccacccgcgtaacctccacgtactcctcagcagccacccgccacagcgccccatatcagcagccagggcct

SEQ ID NO: 386389 - DNA, 140 bp, Artificial Sequence
  Synthetic
aggccctggctgctgatatgttcctggtcgggctcaatcaatacctggttgggtcacagctcccatgcgagcccgaaccggacgtagcagtgctcacttccatgctcaccgacccctcccgaccttttgggacagcggtg

SEQ ID NO: 386390 - DNA, 140 bp, Artificial Sequence
  Synthetic
caccgctgtcccaaaaggtcgggaggggtcggtgagcatggaagtgagcactgctacgtccggttcgggctcgcatgggagctgtgacccaaccaggtattgattgagcccgaccaggaacatatcagcagccagggcct

SEQ ID NO: 386391 - DNA, 140 bp, Artificial Sequence
  Synthetic
aggccctggctgctgatatgaattggacggggtgcgcctacataggtttgcgcccccctgcaagcccttgctgcgggaggaggtatcattcagagtgggactccacgagtacccggtggggaccttttgggacagcggtg

SEQ ID NO: 386392 - DNA, 140 bp, Artificial Sequence
  Synthetic
caccgctgtcccaaaaggtccccaccgggtactcgtggagtcccactctgaatgatacctcctcccgcagcaagggcttgcaggggggcgcaaacctatgtaggcgcaccccgtccaattcatatcagcagccagggcct

SEQ ID NO: 386393 - DNA, 140 bp, Artificial Sequence
  Synthetic
aggccctggctgctgatatgggtgcggctgttggcagcataggccttgggaaggtgcttgtggacatcctggcgggctacggagcaggggtggcaggcgcactcgtggcctttaaggtcagaccttttgggacagcggtg

SEQ ID NO: 386394 - DNA, 140 bp, Artificial Sequence
  Synthetic
caccgctgtcccaaaaggtctgaccttaaaggccacgagtgcgcctgccacccctgctccgtagcccgccaggatgtccacaagcaccttcccaaggcctatgctgccaacagccgcacccatatcagcagccagggcct

SEQ ID NO: 386395 - DNA, 140 bp, Artificial Sequence
  Synthetic
atacgccatgctgggtctccccaaggccccccccataccaccgccacggaggaagaggacgattgtcctgacagaatccatcgcgtcttctgccctggcggagctcgctaggaagaccttcgtacttgggagtcggccat

SEQ ID NO: 386396 - DNA, 140 bp, Artificial Sequence
  Synthetic
atggccgactcccaagtacgaaggtcttcctagcgagctccgccagggcagaagacgcgatggattctgtcaggacaatcgtcctcttcctccgtggcggtggtatggggggggccttggggagacccagcatggcgtat

SEQ ID NO: 386397 - DNA, 140 bp, Artificial Sequence
  Synthetic
aggccctggctgctgatatgtggttctggttctgcctactcctgctcgctgcaggggtaggcatctacctcctccccaaccgatgaaggttggggtaaacactccggcctcttaggccatgaccttttgggacagcggtg

SEQ ID NO: 386398 - DNA, 140 bp, Artificial Sequence
  Synthetic
caccgctgtcccaaaaggtcatggcctaagaggccggagtgtttaccccaaccttcatcggttggggaggaggtagatgcctacccctgcagcgagcaggagtaggcagaaccagaaccacatatcagcagccagggcct

SEQ ID NO: 386399 - DNA, 140 bp, Artificial Sequence
  Synthetic
aggccctggctgctgatatgcctccccaaccgatgaaggttggggtaaacactccggcctcttaggccatctcccgagttttttttttcccttttttttttttttttttttaaaccccccgaccttttgggacagcggtg

SEQ ID NO: 386400 - DNA, 140 bp, Artificial Sequence
  Synthetic
caccgctgtcccaaaaggtcggggggtttaaaaaaaaaaaaaaaaaaaagggaaaaaaaaaactcgggagatggcctaagaggccggagtgtttaccccaaccttcatcggttggggaggcatatcagcagccagggcct

SEQ ID NO: 386401 - DNA, 140 bp, Artificial Sequence
  Synthetic
aggccctggctgctgatatgacccgcgtcgcaggtgtgtggtccagtgtattgcttcaccccaagccctgttgtggtggggacgaccgatcgtttcggcgcccccacgtataactggggggaccttttgggacagcggtg

SEQ ID NO: 386402 - DNA, 140 bp, Artificial Sequence
  Synthetic
caccgctgtcccaaaaggtccccccagttatacgtgggggcgccgaaacgatcggtcgtccccaccacaacagggcttggggtgaagcaatacactggaccacacacctgcgacgcgggtcatatcagcagccagggcct

SEQ ID NO: 386403 - DNA, 140 bp, Artificial Sequence
  Synthetic
aggccctggctgctgatatgccattggggagtcctagcgggccttgcctactattccatggtggggaactgggctaaggttctgattgtgatgctactctttgccggcgttgacgggggagaccttttgggacagcggtg

SEQ ID NO: 386404 - DNA, 140 bp, Artificial Sequence
  Synthetic
caccgctgtcccaaaaggtctcccccgtcaacgccggcaaagagtagcatcacaatcagaaccttagcccagttccccaccatggaatagtaggcaaggcccgctaggactccccaatggcatatcagcagccagggcct

SEQ ID NO: 386405 - DNA, 140 bp, Artificial Sequence
  Synthetic
aggccctggctgctgatatgtgccctcaactgcaatgactccctccagactgggtttcttgccgcgctgttctacaagcataggttcaacgcgtccggatgcccagagcgcatggccagcgaccttttgggacagcggtg

SEQ ID NO: 386406 - DNA, 140 bp, Artificial Sequence
  Synthetic
caccgctgtcccaaaaggtcgctggccatgcgctctgggcatccggacgcgttgaacctatgcttgtagaacagcgcggcaagaaacccagtctggagggagtcattgcagttgagggcacatatcagcagccagggcct

SEQ ID NO: 386407 - DNA, 140 bp, Artificial Sequence
  Synthetic
atacgccatgctgggtctcctgatgcggacacctatgtcaccggggggggtgccgctagggacatgattggctttgtcaaattctttagtcctggtgccaagcagggtattcagctgatccgtacttgggagtcggccat

SEQ ID NO: 386408 - DNA, 140 bp, Artificial Sequence
  Synthetic
atggccgactcccaagtacggatcagctgaataccctgcttggcaccaggactaaagaatttgacaaagccaatcatgtccctagcggcaccccccccggtgacataggtgtccgcatcaggagacccagcatggcgtat

SEQ ID NO: 386409 - DNA, 140 bp, Artificial Sequence
  Synthetic
aggccctggctgctgatatggctttgtcaaattctttagtcctggtgccaagcagggtattcagctgatcaacaccaacggcagctggcacatcaatcgtacggccctgagctgtaatgcgaccttttgggacagcggtg

SEQ ID NO: 386410 - DNA, 140 bp, Artificial Sequence
  Synthetic
caccgctgtcccaaaaggtcgcattacagctcagggccgtacgattgatgtgccagctgccgttggtgttgatcagctgaataccctgcttggcaccaggactaaagaatttgacaaagccatatcagcagccagggcct

SEQ ID NO: 386411 - DNA, 140 bp, Artificial Sequence
  Synthetic
aggccctggctgctgatatgcactacgcgcctcgaccgtgcggtattgtacccgcgtcacaggtgtgtggtccagtgtattgtttcaccccaagccctgttgtggtggggacgaccgatcgaccttttgggacagcggtg

SEQ ID NO: 386412 - DNA, 140 bp, Artificial Sequence
  Synthetic
caccgctgtcccaaaaggtcgatcggtcgtccccaccacaacagggcttggggtgaaacaatacactggaccacacacctgtgacgcgggtacaataccgcacggtcgaggcgcgtagtgcatatcagcagccagggcct

SEQ ID NO: 386413 - DNA, 140 bp, Artificial Sequence
  Synthetic
aggccctggctgctgatatgcatctacaggtttgtgactccaggagaacggccctcgggcatgttcgattcctcggtcctgtgtgagtgctatgacgcgggctgtgcttggtacgagctcgaccttttgggacagcggtg

SEQ ID NO: 386414 - DNA, 140 bp, Artificial Sequence
  Synthetic
caccgctgtcccaaaaggtcgagctcgtaccaagcacagcccgcgtcatagcactcacacaggaccgaggaatcgaacatgcccgagggccgttctcctggagtcacaaacctgtagatgcatatcagcagccagggcct

SEQ ID NO: 386415 - DNA, 140 bp, Artificial Sequence
  Synthetic
aggccctggctgctgatatgaagtgggagtacgtcgttctcttgtttctcctgcttgcagacgcgcgcatctgctcctgcttgtggatgatgctactcatatcccaagcggaggcagcttgaccttttgggacagcggtg

SEQ ID NO: 386416 - DNA, 140 bp, Artificial Sequence
  Synthetic
caccgctgtcccaaaaggtcaagctgcctccgcttgggatatgagtagcatcatccacaagcaggagcagatgcgcgcgtctgcaagcaggagaaacaagagaacgacgtactcccacttcatatcagcagccagggcct

SEQ ID NO: 386417 - DNA, 140 bp, Artificial Sequence
  Synthetic
aggccctggctgctgatatggacggcagactccccacaacgcagcttcgacgtcacatcgatctgcttgtcgggagcgccaccctctgctcggccctctacgtgggggacttgtgcgggtgaccttttgggacagcggtg

SEQ ID NO: 386418 - DNA, 140 bp, Artificial Sequence
  Synthetic
caccgctgtcccaaaaggtcacccgcacaagtcccccacgtagagggccgagcagagggtggcgctcccgacaagcagatcgatgtgacgtcgaagctgcgttgtggggagtctgccgtccatatcagcagccagggcct

SEQ ID NO: 386419 - DNA, 140 bp, Artificial Sequence
  Synthetic
atacgccatgctgggtctccatactgagcctgatagctcggaccagaggccttattgctggcactacgcgcctcgaaagtgcggcatcgtacctgcgtcggaggtgtgcggtccagtgtacgtacttgggagtcggccat

SEQ ID NO: 386420 - DNA, 140 bp, Artificial Sequence
  Synthetic
atggccgactcccaagtacgtacactggaccgcacacctccgacgcaggtacgatgccgcactttcgaggcgcgtagtgccagcaataaggcctctggtccgagctatcaggctcagtatggagacccagcatggcgtat

SEQ ID NO: 386421 - DNA, 140 bp, Artificial Sequence
  Synthetic
atacgccatgctgggtctccggcgaaggtcctggtagtgctgctgctatttgccggcgccgacgcgacaaccaccgtctccgggggaagtgctgcccacggcgcgtccatcattaccagtcgtacttgggagtcggccat

SEQ ID NO: 386422 - DNA, 140 bp, Artificial Sequence
  Synthetic
atggccgactcccaagtacgactggtaatgatggacgcgccgtgggcagcacttcccccggagacggtggttgtcgcgtcggcgccggcaaatagcagcagcactaccaggaccttcgccggagacccagcatggcgtat

SEQ ID NO: 386423 - DNA, 140 bp, Artificial Sequence
  Synthetic
aggccctggctgctgatatggggaagtcctctaccgggagttcgatgagatggaagagtgctctcagcacttgccgtacatcgagcaagggatgatgctcgccgagcagttcaagcagaagaccttttgggacagcggtg

SEQ ID NO: 386424 - DNA, 140 bp, Artificial Sequence
  Synthetic
caccgctgtcccaaaaggtcttctgcttgaactgctcggcgagcatcatcccttgctcgatgtacggcaagtgctgagagcactcttccatctcatcgaactcccggtagaggacttccccatatcagcagccagggcct

SEQ ID NO: 386425 - DNA, 140 bp, Artificial Sequence
  Synthetic
aggccctggctgctgatatgctttacctggtcacgaggcacgccgatgtcattcccgtgcgccggcggggtgatagcaggggcagcctgctttcgccccggcctatctcttacttgaaaggaccttttgggacagcggtg

SEQ ID NO: 386426 - DNA, 140 bp, Artificial Sequence
  Synthetic
caccgctgtcccaaaaggtcctttcaagtaagagataggccggggcgaaagcaggctgcccctgctatcaccccgccggcgcacgggaatgacatcggcgtgcctcgtgaccaggtaaagcatatcagcagccagggcct

SEQ ID NO: 386427 - DNA, 140 bp, Artificial Sequence
  Synthetic
aggccctggctgctgatatgtaccgggagttcgatgagatggaggagtgcgcctcacacctcccttacatcgaacagggaatgcagctcgctgagcagttcaaacagaaagcgctcgggtgaccttttgggacagcggtg

SEQ ID NO: 386428 - DNA, 140 bp, Artificial Sequence
  Synthetic
caccgctgtcccaaaaggtcacccgagcgctttctgtttgaactgctcagcgagctgcattccctgttcgatgtaagggaggtgtgaggcgcactcctccatctcatcgaactcccggtacatatcagcagccagggcct

SEQ ID NO: 386429 - DNA, 140 bp, Artificial Sequence
  Synthetic
aggccctggctgctgatatgcaccacacagtggcaggtccttccgtgttccttcacaaccctgccagccttgtccaccggcctcatccacctccaccagaacattgtggacgtgcaatacgaccttttgggacagcggtg

SEQ ID NO: 386430 - DNA, 140 bp, Artificial Sequence
  Synthetic
caccgctgtcccaaaaggtcgtattgcacgtccacaatgttctggtggaggtggatgaggccggtggacaaggctggcagggttgtgaaggaacacggaaggacctgccactgtgtggtgcatatcagcagccagggcct

SEQ ID NO: 386431 - DNA, 140 bp, Artificial Sequence
  Synthetic
atacgccatgctgggtctccgcacatcaacaggactgccttaaactgcaacgactccctccagactgggtttcttgcctcgctgttctacgcgcacaggttcaacgcgtccgggtgcccacgtacttgggagtcggccat

SEQ ID NO: 386432 - DNA, 140 bp, Artificial Sequence
  Synthetic
atggccgactcccaagtacgtgggcacccggacgcgttgaacctgtgcgcgtagaacagcgaggcaagaaacccagtctggagggagtcgttgcagtttaaggcagtcctgttgatgtgcggagacccagcatggcgtat

SEQ ID NO: 386433 - DNA, 140 bp, Artificial Sequence
  Synthetic
aggccctggctgctgatatggcgacaaccaccgtcagcggggggactgctgctcggaccacgtctggcttagccagcctcttcagtccgggcgccaagcaggacatccagctgatcaacagaccttttgggacagcggtg

SEQ ID NO: 386434 - DNA, 140 bp, Artificial Sequence
  Synthetic
caccgctgtcccaaaaggtctgttgatcagctggatgtcctgcttggcgcccggactgaagaggctggctaagccagacgtggtccgagcagcagtccccccgctgacggtggttgtcgccatatcagcagccagggcct

SEQ ID NO: 386435 - DNA, 140 bp, Artificial Sequence
  Synthetic
aggccctggctgctgatatgcgtcgtgtggcggcgttgttcttgtcgggttaatggcgctgactctgtcgccgcattataagcgctatatcagctggtgcttatggtggcttcagtatttgaccttttgggacagcggtg

SEQ ID NO: 386436 - DNA, 140 bp, Artificial Sequence
  Synthetic
caccgctgtcccaaaaggtcaaatactgaagccaccataagcaccagctgatatagcgcttataatgcggcgacagagtcagcgccattaacccgacaagaacaacgccgccacacgacgcatatcagcagccagggcct

SEQ ID NO: 386437 - DNA, 140 bp, Artificial Sequence
  Synthetic
atacgccatgctgggtctcccttccttgtgttcttctgtgccgcctggtacatcaaaggcaggctggtccctggggcggcatatgctctttatggcgtgtggccgctgctcctgctcttgcgtacttgggagtcggccat

SEQ ID NO: 386438 - DNA, 140 bp, Artificial Sequence
  Synthetic
atggccgactcccaagtacgcaagagcaggagcagcggccacacgccataaagagcatatgccgccccagggaccagcctgcctttgatgtaccaggcggcacagaagaacacaaggaagggagacccagcatggcgtat

SEQ ID NO: 386439 - DNA, 140 bp, Artificial Sequence
  Synthetic
aggccctggctgctgatatgcattgccgcgttgttctacacacacaagttcaattcgtccggatgcctggagcgcatggccagctgccgccccatcgacgagttcgatcaggggtggggtgaccttttgggacagcggtg

SEQ ID NO: 386440 - DNA, 140 bp, Artificial Sequence
  Synthetic
caccgctgtcccaaaaggtcaccccacccctgatcgaactcgtcgatggggcggcagctggccatgcgctccaggcatccggacgaattgaacttgtgtgtgtagaacaacgcggcaatgcatatcagcagccagggcct

SEQ ID NO: 386441 - DNA, 140 bp, Artificial Sequence
  Synthetic
aggccctggctgctgatatgtggagagatccccttctatggcaaagccatccccatcgagaccatcaagggggggaggcatctcatcttctgccattccaagaagaaatgtgacgagctcgaccttttgggacagcggtg

SEQ ID NO: 386442 - DNA, 140 bp, Artificial Sequence
  Synthetic
caccgctgtcccaaaaggtcgagctcgtcacatttcttcttggaatggcagaagatgagatgcctcccccccttgatggtctcgatggggatggctttgccatagaaggggatctctccacatatcagcagccagggcct

SEQ ID NO: 386443 - DNA, 140 bp, Artificial Sequence
  Synthetic
aggccctggctgctgatatgtccacagtcccctcctgtgcctccgcctcggaagaagcggacggtggtcctcaccgaatcaaccctatctactgccttggccgaacttgccaccaaaagtgaccttttgggacagcggtg

SEQ ID NO: 386444 - DNA, 140 bp, Artificial Sequence
  Synthetic
caccgctgtcccaaaaggtcacttttggtggcaagttcggccaaggcagtagatagggttgattcggtgaggaccaccgtccgcttcttccgaggcggaggcacaggaggggactgtggacatatcagcagccagggcct

SEQ ID NO: 386445 - DNA, 140 bp, Artificial Sequence
  Synthetic
atacgccatgctgggtctccgtatagggtcggcggttgtctccttcgcaatcaaatgggagtacatcctgttgctcttctttctcctggcagacgcgcgcttttgtgcttgcttgtggatcgtacttgggagtcggccat

SEQ ID NO: 386446 - DNA, 140 bp, Artificial Sequence
  Synthetic
atggccgactcccaagtacgatccacaagcaagcacaaaagcgcgcgtctgccaggagaaagaagagcaacaggatgtactcccatttgattgcgaaggagacaaccgccgaccctatacggagacccagcatggcgtat

SEQ ID NO: 386447 - DNA, 140 bp, Artificial Sequence
  Synthetic
aggccctggctgctgatatgaccaagcggagacggctggagcgcggcttgtcgtgctcgccaccgctacgcctccgggatcggtcaccgtgccacacccaaacatcgaggaggtggccctgaccttttgggacagcggtg

SEQ ID NO: 386448 - DNA, 140 bp, Artificial Sequence
  Synthetic
caccgctgtcccaaaaggtcagggccacctcctcgatgtttgggtgtggcacggtgaccgatcccggaggcgtagcggtggcgagcacgacaagccgcgctccagccgtctccgcttggtcatatcagcagccagggcct

SEQ ID NO: 386449 - DNA, 140 bp, Artificial Sequence
  Synthetic
aggccctggctgctgatatggcatcatcaccagcctcacaggccgggacaagaaccaagtcgagggggaggttcaagtggtttccaccgcaacacaatctttcctggcgacctgcgtcaagaccttttgggacagcggtg

SEQ ID NO: 386450 - DNA, 140 bp, Artificial Sequence
  Synthetic
caccgctgtcccaaaaggtcttgacgcaggtcgccaggaaagattgtgttgcggtggaaaccacttgaacctccccctcgacttggttcttgtcccggcctgtgaggctggtgatgatgccatatcagcagccagggcct

SEQ ID NO: 386451 - DNA, 140 bp, Artificial Sequence
  Synthetic
aggccctggctgctgatatgaccccgcaatagcatcattgatggcattcacagcctctatcaccagcccgctcaccacccaaagtaccctcctgtttaacatcttgggggggtgggtggcgaccttttgggacagcggtg

SEQ ID NO: 386452 - DNA, 140 bp, Artificial Sequence
  Synthetic
caccgctgtcccaaaaggtcgccacccacccccccaagatgttaaacaggagggtactttgggtggtgagcgggctggtgatagaggctgtgaatgccatcaatgatgctattgcggggtcatatcagcagccagggcct

SEQ ID NO: 386453 - DNA, 140 bp, Artificial Sequence
  Synthetic
aggccctggctgctgatatggccaccctctgttcggccctttacgtgggggatctgtgcgggtctgtctttcttgtcggccaactgttcaccttctctcccaggcgccactggacgacgcgaccttttgggacagcggtg

SEQ ID NO: 386454 - DNA, 140 bp, Artificial Sequence
  Synthetic
caccgctgtcccaaaaggtcgcgtcgtccagtggcgcctgggagagaaggtgaacagttggccgacaagaaagacagacccgcacagatcccccacgtaaagggccgaacagagggtggccatatcagcagccagggcct

SEQ ID NO: 386455 - DNA, 140 bp, Artificial Sequence
  Synthetic
aggccctggctgctgatatgcggctggatagcggggcttttctattacaacaacttcaactcttcaggctgccccgagaggttggccagttgccgacccctcacccattttgcccagggcgaccttttgggacagcggtg

SEQ ID NO: 386456 - DNA, 140 bp, Artificial Sequence
  Synthetic
caccgctgtcccaaaaggtcgccctgggcaaaatgggtgaggggtcggcaactggccaacctctcggggcagcctgaagagttgaagttgttgtaatagaaaagccccgctatccagccgcatatcagcagccagggcct

SEQ ID NO: 386457 - DNA, 140 bp, Artificial Sequence
  Synthetic
atacgccatgctgggtctcctggggccctatcggctatgccaatggaagcggccccgaccaacgcccatattgctggcactatcccccaaggccttgcggcattgtgcgcgcgaaggaagcgtacttgggagtcggccat

SEQ ID NO: 386458 - DNA, 140 bp, Artificial Sequence
  Synthetic
atggccgactcccaagtacgcttccttcgcgcgcacaatgccgcaaggccttgggggatagtgccagcaatatgggcgttggtcggggccgcttccattggcatagccgatagggccccaggagacccagcatggcgtat

SEQ ID NO: 386459 - DNA, 140 bp, Artificial Sequence
  Synthetic
aggccctggctgctgatatgctcacttccatgcttaccgacccctcccacattacagcagagacggctaagcgtaggctggccagggggtctcccccctccttggccagttcctcagctagaccttttgggacagcggtg

SEQ ID NO: 386460 - DNA, 140 bp, Artificial Sequence
  Synthetic
caccgctgtcccaaaaggtctagctgaggaactggccaaggaggggggagaccccctggccagcctacgcttagccgtctctgctgtaatgtgggaggggtcggtaagcatggaagtgagcatatcagcagccagggcct

SEQ ID NO: 386461 - DNA, 140 bp, Artificial Sequence
  Synthetic
atacgccatgctgggtctccccggcggagatcctgcggaaatccaaaagatttcccccggcgatgcctatatgggcacgtccagattacaaccctccactgctagagtcctggaaggatccgtacttgggagtcggccat

SEQ ID NO: 386462 - DNA, 140 bp, Artificial Sequence
  Synthetic
atggccgactcccaagtacggatccttccaggactctagcagtggagggttgtaatctggacgtgcccatataggcatcgccgggggaaatcttttggatttccgcaggatctccgccggggagacccagcatggcgtat

SEQ ID NO: 386463 - DNA, 140 bp, Artificial Sequence
  Synthetic
aggccctggctgctgatatgatgggcacgtccagattacaaccctccactgctagagtcctggaaggatccggactacgtccctccggtggtacatggatgtccactgccacctatcaaagaccttttgggacagcggtg

SEQ ID NO: 386464 - DNA, 140 bp, Artificial Sequence
  Synthetic
caccgctgtcccaaaaggtctttgataggtggcagtggacatccatgtaccaccggagggacgtagtccggatccttccaggactctagcagtggagggttgtaatctggacgtgcccatcatatcagcagccagggcct

SEQ ID NO: 386465 - DNA, 140 bp, Artificial Sequence
  Synthetic
aggccctggctgctgatatggcccactggggtgtcctagcgggccttgcctactattccatggtggggaactgggctaaggtcttgattgtgatgctactctttgctggcgttgacgggcgaccttttgggacagcggtg

SEQ ID NO: 386466 - DNA, 140 bp, Artificial Sequence
  Synthetic
caccgctgtcccaaaaggtcgcccgtcaacgccagcaaagagtagcatcacaatcaagaccttagcccagttccccaccatggaatagtaggcaaggcccgctaggacaccccagtgggccatatcagcagccagggcct

SEQ ID NO: 386467 - DNA, 140 bp, Artificial Sequence
  Synthetic
atacgccatgctgggtctccccaccgttgtcaccggggggatggccgctcagaccacgtatggacttaccagccttttccagcggggccccaagcagaacatccagctggtcaacaccaacgtacttgggagtcggccat

SEQ ID NO: 386468 - DNA, 140 bp, Artificial Sequence
  Synthetic
atggccgactcccaagtacgttggtgttgaccagctggatgttctgcttggggccccgctggaaaaggctggtaagtccatacgtggtctgagcggccatccccccggtgacaacggtggggagacccagcatggcgtat

SEQ ID NO: 386469 - DNA, 140 bp, Artificial Sequence
  Synthetic
atacgccatgctgggtctcccttattgctggcactatgcaccccaaccgtgcggtattgtacccgcgtcgcaggtgtgtggcccagtgtattgcttcaccccgagtcctgttgtggtgggcgtacttgggagtcggccat

SEQ ID NO: 386470 - DNA, 140 bp, Artificial Sequence
  Synthetic
atggccgactcccaagtacgcccaccacaacaggactcggggtgaagcaatacactgggccacacacctgcgacgcgggtacaataccgcacggttggggtgcatagtgccagcaataagggagacccagcatggcgtat

SEQ ID NO: 386471 - DNA, 140 bp, Artificial Sequence
  Synthetic
aggccctggctgctgatatgaaccggtgaaggttgggataatcactccggcctcttaggccatctctggtggttttttttttctttttttttttttttttttttttttttttttttttttgaccttttgggacagcggtg

SEQ ID NO: 386472 - DNA, 140 bp, Artificial Sequence
  Synthetic
caccgctgtcccaaaaggtcaaaaaaaaaaaaaaaaaaaaaaaaaaaaaaaaaaaaagaaaaaaaaaaccaccagagatggcctaagaggccggagtgattatcccaaccttcaccggttcatatcagcagccagggcct

SEQ ID NO: 386473 - DNA, 140 bp, Artificial Sequence
  Synthetic
aggccctggctgctgatatggagtcctggcgggcctcgcctacttttccatggtggggaactgggctaaggttttgattgttctgctactctttgccggcgttgacgggcagacccgcgtgaccttttgggacagcggtg

SEQ ID NO: 386474 - DNA, 140 bp, Artificial Sequence
  Synthetic
caccgctgtcccaaaaggtcacgcgggtctgcccgtcaacgccggcaaagagtagcagaacaatcaaaaccttagcccagttccccaccatggaaaagtaggcgaggcccgccaggactccatatcagcagccagggcct

SEQ ID NO: 386475 - DNA, 140 bp, Artificial Sequence
  Synthetic
atacgccatgctgggtctcccacattaacaggactgccctgaactgcaatgactccctcaacactgggttcatagccgcgctgttctatacaaataggttcaactcgtccggatgccctgcgtacttgggagtcggccat

SEQ ID NO: 386476 - DNA, 140 bp, Artificial Sequence
  Synthetic
atggccgactcccaagtacgcagggcatccggacgagttgaacctatttgtatagaacagcgcggctatgaacccagtgttgagggagtcattgcagttcagggcagtcctgttaatgtgggagacccagcatggcgtat

SEQ ID NO: 386477 - DNA, 140 bp, Artificial Sequence
  Synthetic
aggccctggctgctgatatggcccactggggagtcctagcgggcatagcgtatttctccatggtggggaactgggcgaaggtcctgctagtgctgttgctgtttgccggcgtcgatgcgagaccttttgggacagcggtg

SEQ ID NO: 386478 - DNA, 140 bp, Artificial Sequence
  Synthetic
caccgctgtcccaaaaggtctcgcatcgacgccggcaaacagcaacagcactagcaggaccttcgcccagttccccaccatggagaaatacgctatgcccgctaggactccccagtgggccatatcagcagccagggcct

SEQ ID NO: 386479 - DNA, 140 bp, Artificial Sequence
  Synthetic
atacgccatgctgggtctccgcacctacgtcaccggggggagttccgctcacgccgcgttgggagtcgccagtcttttcactcagggcgccaagcagaatgtccagctggttaacaccaacgtacttgggagtcggccat

SEQ ID NO: 386480 - DNA, 140 bp, Artificial Sequence
  Synthetic
atggccgactcccaagtacgttggtgttaaccagctggacattctgcttggcgccctgagtgaaaagactggcgactcccaacgcggcgtgagcggaactccccccggtgacgtaggtgcggagacccagcatggcgtat

SEQ ID NO: 386481 - DNA, 140 bp, Artificial Sequence
  Synthetic
aggccctggctgctgatatgtcgtggcaacagacgctctaatgacgggctttaccggcgactttgactcagtgatcgactgcaacacatgtgtcacccagacagtcgatttcagcttggagaccttttgggacagcggtg

SEQ ID NO: 386482 - DNA, 140 bp, Artificial Sequence
  Synthetic
caccgctgtcccaaaaggtctccaagctgaaatcgactgtctgggtgacacatgtgttgcagtcgatcactgagtcaaagtcgccggtaaagcccgtcattagagcgtctgttgccacgacatatcagcagccagggcct

SEQ ID NO: 386483 - DNA, 140 bp, Artificial Sequence
  Synthetic
aggccctggctgctgatatgatatgctttctatggcgtgtggccgctgctcctgctcttgctggcgctaccaccacgagcatacgccatggaccgggagatggctgcatcgtgcggaggcgaccttttgggacagcggtg

SEQ ID NO: 386484 - DNA, 140 bp, Artificial Sequence
  Synthetic
caccgctgtcccaaaaggtcgcctccgcacgatgcagccatctcccggtccatggcgtatgctcgtggtggtagcgccagcaagagcaggagcagcggccacacgccatagaaagcatatcatatcagcagccagggcct

SEQ ID NO: 386485 - DNA, 140 bp, Artificial Sequence
  Synthetic
aggccctggctgctgatatgcttgtattactcaatgcggcgtctttggccgggacgcatggtcttgtgtccttcctcgtgtttttctgctttgcatggcatctgaagggtaggtgggcgcgaccttttgggacagcggtg

SEQ ID NO: 386486 - DNA, 140 bp, Artificial Sequence
  Synthetic
caccgctgtcccaaaaggtcgcgcccacctacccttcagatgccatgcaaagcagaaaaacacgaggaaggacacaagaccatgcgtcccggccaaagacgccgcattgagtaatacaagcatatcagcagccagggcct

SEQ ID NO: 386487 - DNA, 140 bp, Artificial Sequence
  Synthetic
aggccctggctgctgatatgtagtggtctgcggaaccggtgagtacaccggaattgccaggacgaccgggtcctttcttggataaacccgctcaatgcctggagatttgggcgtgcccccgaccttttgggacagcggtg

SEQ ID NO: 386488 - DNA, 140 bp, Artificial Sequence
  Synthetic
caccgctgtcccaaaaggtcgggggcacgcccaaatctccaggcattgagcgggtttatccaagaaaggacccggtcgtcctggcaattccggtgtactcaccggttccgcagaccactacatatcagcagccagggcct

SEQ ID NO: 386489 - DNA, 140 bp, Artificial Sequence
  Synthetic
aggccctggctgctgatatgggctgttggcagcataggccttgggaaggtgcttgtggacatcctggcgggctatggggcaggagtggcaggcgcactcgtggcctttaaggtcatgagtgaccttttgggacagcggtg

SEQ ID NO: 386490 - DNA, 140 bp, Artificial Sequence
  Synthetic
caccgctgtcccaaaaggtcactcatgaccttaaaggccacgagtgcgcctgccactcctgccccatagcccgccaggatgtccacaagcaccttcccaaggcctatgctgccaacagcccatatcagcagccagggcct

SEQ ID NO: 386491 - DNA, 140 bp, Artificial Sequence
  Synthetic
aggccctggctgctgatatggcagcgggtcgagttcctggtgaatacctggaaatcaaagaaatgccctatgggcttctcatatgacacccgctgctttgactcaacggtcactgagaatgaccttttgggacagcggtg

SEQ ID NO: 386492 - DNA, 140 bp, Artificial Sequence
  Synthetic
caccgctgtcccaaaaggtcattctcagtgaccgttgagtcaaagcagcgggtgtcatatgagaagcccatagggcatttctttgatttccaggtattcaccaggaactcgacccgctgccatatcagcagccagggcct

SEQ ID NO: 386493 - DNA, 140 bp, Artificial Sequence
  Synthetic
aggccctggctgctgatatgcgtgtggcggcgttgttcttgtcgggttaatggcgctgactctgtcaccatattacaagcgctatatcagctggtgcttgtggtggcttcagtattttctgaccttttgggacagcggtg

SEQ ID NO: 386494 - DNA, 140 bp, Artificial Sequence
  Synthetic
caccgctgtcccaaaaggtcagaaaatactgaagccaccacaagcaccagctgatatagcgcttgtaatatggtgacagagtcagcgccattaacccgacaagaacaacgccgccacacgcatatcagcagccagggcct

SEQ ID NO: 386495 - DNA, 140 bp, Artificial Sequence
  Synthetic
aggccctggctgctgatatgggggcgtaccatgtcacgaacgactgctccaactcaagcatagtgtatgaggcagcggacatgatcatgcacacccccgggtgcgtgccctgcgttcggggaccttttgggacagcggtg

SEQ ID NO: 386496 - DNA, 140 bp, Artificial Sequence
  Synthetic
caccgctgtcccaaaaggtccccgaacgcagggcacgcacccgggggtgtgcatgatcatgtccgctgcctcatacactatgcttgagttggagcagtcgttcgtgacatggtacgcccccatatcagcagccagggcct

SEQ ID NO: 386497 - DNA, 140 bp, Artificial Sequence
  Synthetic
atacgccatgctgggtctccacggggatacctatgtgacaggagggacgagcggccgcgccaccgccgggttcgtgtccctctttgcatccggaccaactcagagaatccagcttgtaaacgtacttgggagtcggccat

SEQ ID NO: 386498 - DNA, 140 bp, Artificial Sequence
  Synthetic
atggccgactcccaagtacgtttacaagctggattctctgagttggtccggatgcaaagagggacacgaacccggcggtggcgcggccgctcgtccctcctgtcacataggtatccccgtggagacccagcatggcgtat

SEQ ID NO: 386499 - DNA, 140 bp, Artificial Sequence
  Synthetic
aggccctggctgctgatatgatcacccccttctgaggccagctcctcggctagccagctgtccgctccatctctcaaggcaacttgcactgtcaaccatgactcccctgacgccgagctcgaccttttgggacagcggtg

SEQ ID NO: 386500 - DNA, 140 bp, Artificial Sequence
  Synthetic
caccgctgtcccaaaaggtcgagctcggcgtcaggggagtcatggttgacagtgcaagttgccttgagagatggagcggacagctggctagccgaggagctggcctcagaagggggtgatcatatcagcagccagggcct

SEQ ID NO: 386501 - DNA, 140 bp, Artificial Sequence
  Synthetic
aggccctggctgctgatatgcgctcagggatggggtcctatcacctacaccgagcccgaggacctggaccagaggccttactgctggcactacgcacctagaaagtgcggcatcatacccgaccttttgggacagcggtg

SEQ ID NO: 386502 - DNA, 140 bp, Artificial Sequence
  Synthetic
caccgctgtcccaaaaggtcgggtatgatgccgcactttctaggtgcgtagtgccagcagtaaggcctctggtccaggtcctcgggctcggtgtaggtgataggaccccatccctgagcgcatatcagcagccagggcct

SEQ ID NO: 386503 - DNA, 140 bp, Artificial Sequence
  Synthetic
atacgccatgctgggtctccggagagcgttgcgacttggaggacagggacagatcggagctcagcccgctgctgctgtctacaacagagtggcaagtgttgccctgttccttcaccacctcgtacttgggagtcggccat

SEQ ID NO: 386504 - DNA, 140 bp, Artificial Sequence
  Synthetic
atggccgactcccaagtacgaggtggtgaaggaacagggcaacacttgccactctgttgtagacagcagcagcgggctgagctccgatctgtccctgtcctccaagtcgcaacgctctccggagacccagcatggcgtat

SEQ ID NO: 386505 - DNA, 140 bp, Artificial Sequence
  Synthetic
aggccctggctgctgatatgtgtccaccaccggagagatccctttttacggcaaggctatccccctcgaggtaatcaagggggggagacatctcatcttctgtcactcaaagaagaagtggaccttttgggacagcggtg

SEQ ID NO: 386506 - DNA, 140 bp, Artificial Sequence
  Synthetic
caccgctgtcccaaaaggtccacttcttctttgagtgacagaagatgagatgtctcccccccttgattacctcgagggggatagccttgccgtaaaaagggatctctccggtggtggacacatatcagcagccagggcct

SEQ ID NO: 386507 - DNA, 140 bp, Artificial Sequence
  Synthetic
aggccctggctgctgatatgtggtccctggggcggcatacgccctctacggcgtgtggccgctgctcctgctcctgctggcgttaccaccgcgagcatatgccatggaccgggagatggcgaccttttgggacagcggtg

SEQ ID NO: 386508 - DNA, 140 bp, Artificial Sequence
  Synthetic
caccgctgtcccaaaaggtcgccatctcccggtccatggcatatgctcgcggtggtaacgccagcaggagcaggagcagcggccacacgccgtagagggcgtatgccgccccagggaccacatatcagcagccagggcct

SEQ ID NO: 386509 - DNA, 140 bp, Artificial Sequence
  Synthetic
atacgccatgctgggtctcctttatcaccagggccgaggcgcatgtgcaagtgtggaccccccccctcaacgttcgggggggccgtgatgccatcatcctcctcacttgcgcggtccacccgtacttgggagtcggccat

SEQ ID NO: 386510 - DNA, 140 bp, Artificial Sequence
  Synthetic
atggccgactcccaagtacgggtggaccgcgcaagtgaggaggatgatggcatcacggcccccccgaacgttgagggggggggtccacacttgcacatgcgcctcggccctggtgataaaggagacccagcatggcgtat

SEQ ID NO: 386511 - DNA, 140 bp, Artificial Sequence
  Synthetic
atacgccatgctgggtctccgcaggggtaggcatctacctcctccccaaccgatgaacctagtcacggttagctgggaggttgtatccgtttcccgaagcccccggtgctgctaccgcctcgtacttgggagtcggccat

SEQ ID NO: 386512 - DNA, 140 bp, Artificial Sequence
  Synthetic
atggccgactcccaagtacgaggcggtagcagcaccgggggcttcgggaaacggatacaacctcccagctaaccgtgactaggttcatcggttggggaggaggtagatgcctacccctgcggagacccagcatggcgtat

SEQ ID NO: 386513 - DNA, 140 bp, Artificial Sequence
  Synthetic
aggccctggctgctgatatgaggtcatcacctggggggcagacaccgcggcgtgtggggacatcatctcgggcctacccgtctccgcccgaagggggagggagatacttctaggaccggcgaccttttgggacagcggtg

SEQ ID NO: 386514 - DNA, 140 bp, Artificial Sequence
  Synthetic
caccgctgtcccaaaaggtcgccggtcctagaagtatctccctcccccttcgggcggagacgggtaggcccgagatgatgtccccacacgccgcggtgtctgccccccaggtgatgacctcatatcagcagccagggcct

SEQ ID NO: 386515 - DNA, 140 bp, Artificial Sequence
  Synthetic
aggccctggctgctgatatggtacgagacggccgataccatcctacactctccggggtgtgtcccttgcgttcgtgagggcaacgcctcgagatgttgggtggcagtggcccctacggtggaccttttgggacagcggtg

SEQ ID NO: 386516 - DNA, 140 bp, Artificial Sequence
  Synthetic
caccgctgtcccaaaaggtccaccgtaggggccactgccacccaacatctcgaggcgttgccctcacgaacgcaagggacacaccccggagagtgtaggatggtatcggccgtctcgtaccatatcagcagccagggcct

SEQ ID NO: 386517 - DNA, 140 bp, Artificial Sequence
  Synthetic
atacgccatgctgggtctccgatcaacagcagcggcagttggcacatcaatcgcacggccttgaattgtaatgcgagcctcgacaccggctggatagcggggctcgtctattaccataaacgtacttgggagtcggccat

SEQ ID NO: 386518 - DNA, 140 bp, Artificial Sequence
  Synthetic
atggccgactcccaagtacgtttatggtaatagacgagccccgctatccagccggtgtcgaggctcgcattacaattcaaggccgtgcgattgatgtgccaactgccgctgctgttgatcggagacccagcatggcgtat

SEQ ID NO: 386519 - DNA, 140 bp, Artificial Sequence
  Synthetic
aggccctggctgctgatatgggggcggacaccgcggcgtgtggggacatcatctcgggtctgcccgtttccgcccgaagggggagggagatacttctgggaccggccgatagctttgaaggaccttttgggacagcggtg

SEQ ID NO: 386520 - DNA, 140 bp, Artificial Sequence
  Synthetic
caccgctgtcccaaaaggtccttcaaagctatcggccggtcccagaagtatctccctcccccttcgggcggaaacgggcagacccgagatgatgtccccacacgccgcggtgtccgcccccatatcagcagccagggcct

SEQ ID NO: 386521 - DNA, 140 bp, Artificial Sequence
  Synthetic
aggccctggctgctgatatgcctgaacccgtccgttgccgctaccttaggttttggggcgtatatgtctaaggcacatggtgtcgaccctaacatcagaactggggtaaggaccatcaccgaccttttgggacagcggtg

SEQ ID NO: 386522 - DNA, 140 bp, Artificial Sequence
  Synthetic
caccgctgtcccaaaaggtcggtgatggtccttaccccagttctgatgttagggtcgacaccatgtgccttagacatatacgccccaaaacctaaggtagcggcaacggacgggttcaggcatatcagcagccagggcct

SEQ ID NO: 386523 - DNA, 140 bp, Artificial Sequence
  Synthetic
aggccctggctgctgatatgcctacgagatctggccgtggctgtagagccagtcgtcttttcccagatggagaccaagctcattacatggggggcggacaccgccgcatgcggtgacatcgaccttttgggacagcggtg

SEQ ID NO: 386524 - DNA, 140 bp, Artificial Sequence
  Synthetic
caccgctgtcccaaaaggtcgatgtcaccgcatgcggcggtgtccgccccccatgtaatgagcttggtctccatctgggaaaagacgactggctctacagccacggccagatctcgtaggcatatcagcagccagggcct

SEQ ID NO: 386525 - DNA, 140 bp, Artificial Sequence
  Synthetic
aggccctggctgctgatatggtcgggctcaaccagtatctggtcgggtcgcagcttccgtgtgagcccgagccggacgtgacaacgctcacctccatgctcatcgacccctcccacatcagaccttttgggacagcggtg

SEQ ID NO: 386526 - DNA, 140 bp, Artificial Sequence
  Synthetic
caccgctgtcccaaaaggtctgatgtgggaggggtcgatgagcatggaggtgagcgttgtcacgtccggctcgggctcacacggaagctgcgacccgaccagatactggttgagcccgaccatatcagcagccagggcct

SEQ ID NO: 386527 - DNA, 140 bp, Artificial Sequence
  Synthetic
aggccctggctgctgatatggtagcgtaccaggctacagtgtgcgccagggcgcaggccccacctccatcgtgggatcaaatgtggaagtgtctcatacggctaaagcctacgctgcacggaccttttgggacagcggtg

SEQ ID NO: 386528 - DNA, 140 bp, Artificial Sequence
  Synthetic
caccgctgtcccaaaaggtccgtgcagcgtaggctttagccgtatgagacacttccacatttgatcccacgatggaggtggggcctgcgccctggcgcacactgtagcctggtacgctaccatatcagcagccagggcct

SEQ ID NO: 386529 - DNA, 140 bp, Artificial Sequence
  Synthetic
aggccctggctgctgatatgacggcagttggcacatcaatagcacggccctgaactgcaacgacagccttaacaccggctgggtagcagggcttttctatcaccacaaattcaactcttcgaccttttgggacagcggtg

SEQ ID NO: 386530 - DNA, 140 bp, Artificial Sequence
  Synthetic
caccgctgtcccaaaaggtcgaagagttgaatttgtggtgatagaaaagccctgctacccagccggtgttaaggctgtcgttgcagttcagggccgtgctattgatgtgccaactgccgtcatatcagcagccagggcct

SEQ ID NO: 386531 - DNA, 140 bp, Artificial Sequence
  Synthetic
aggccctggctgctgatatggattgtttccgcaagcatccggaagctacgtactctcggtgcggctccggtccctggcttacacctaggtgtctggtcgactacccgtataggctttggcgaccttttgggacagcggtg

SEQ ID NO: 386532 - DNA, 140 bp, Artificial Sequence
  Synthetic
caccgctgtcccaaaaggtcgccaaagcctatacgggtagtcgaccagacacctaggtgtaagccagggaccggagccgcaccgagagtacgtagcttccggatgcttgcggaaacaatccatatcagcagccagggcct

SEQ ID NO: 386533 - DNA, 140 bp, Artificial Sequence
  Synthetic
aggccctggctgctgatatgactccccagatgccgacctcatcgaggccaacctcctgtggcgacaggagatgggcggaaacatcacccgcgtggagtcagagaataaggtagtaattctgaccttttgggacagcggtg

SEQ ID NO: 386534 - DNA, 140 bp, Artificial Sequence
  Synthetic
caccgctgtcccaaaaggtcagaattactaccttattctctgactccacgcgggtgatgtttccgcccatctcctgtcgccacaggaggttggcctcgatgaggtcggcatctggggagtcatatcagcagccagggcct

SEQ ID NO: 386535 - DNA, 140 bp, Artificial Sequence
  Synthetic
aggccctggctgctgatatgaggcccctccaataccacctccacggaggaagaggacggttgtcctgacagaatccactgtgtcttctgccctggcggagcttgctacaaagaccttcgggaccttttgggacagcggtg

SEQ ID NO: 386536 - DNA, 140 bp, Artificial Sequence
  Synthetic
caccgctgtcccaaaaggtcccgaaggtctttgtagcaagctccgccagggcagaagacacagtggattctgtcaggacaaccgtcctcttcctccgtggaggtggtattggaggggcctcatatcagcagccagggcct

SEQ ID NO: 386537 - DNA, 140 bp, Artificial Sequence
  Synthetic
atacgccatgctgggtctccggtgtgcgcgcgacgaggaagacttccgaacggtcccagccacgtggaagacgccagcccatccccaaagatcggcgctccactggcaggtcctggggaccgtacttgggagtcggccat

SEQ ID NO: 386538 - DNA, 140 bp, Artificial Sequence
  Synthetic
atggccgactcccaagtacggtccccaggacctgccagtggagcgccgatctttggggatgggctggcgtcttccacgtggctgggaccgttcggaagtcttcctcgtcgcgcgcacaccggagacccagcatggcgtat

SEQ ID NO: 386539 - DNA, 140 bp, Artificial Sequence
  Synthetic
atacgccatgctgggtctcccccccggcatagatcacgcaatttgggcaaggtcatcgataccctcacgtgtggttttgccgacctcatggggtacatacccgtcgttggcgccccagttcgtacttgggagtcggccat

SEQ ID NO: 386540 - DNA, 140 bp, Artificial Sequence
  Synthetic
atggccgactcccaagtacgaactggggcgccaacgacgggtatgtaccccatgaggtcggcaaaaccacacgtgagggtatcgatgaccttgcccaaattgcgtgatctatgccgggggggagacccagcatggcgtat

SEQ ID NO: 386541 - DNA, 140 bp, Artificial Sequence
  Synthetic
atacgccatgctgggtctcctactagctctcttgtcttgtatatctgtaccagtatccgctgtggaggtcaagaacaccagtcagacctacatggccaccaatgattgctctaacagcagcgtacttgggagtcggccat

SEQ ID NO: 386542 - DNA, 140 bp, Artificial Sequence
  Synthetic
atggccgactcccaagtacgctgctgttagagcaatcattggtggccatgtaggtctgactggtgttcttgacctccacagcggatactggtacagatatacaagacaagagagctagtaggagacccagcatggcgtat

SEQ ID NO: 386543 - DNA, 140 bp, Artificial Sequence
  Synthetic
atacgccatgctgggtctccgggatgtttgtggcgcggccatgatagcggcccaagcagtcatcatttcgccggagcgccacgcttttgttcaggactgcaactgttccatttacccgggcgtacttgggagtcggccat

SEQ ID NO: 386544 - DNA, 140 bp, Artificial Sequence
  Synthetic
atggccgactcccaagtacgcccgggtaaatggaacagttgcagtcctgaacaaaagcgtggcgctccggcgaaatgatgactgcttgggccgctatcatggccgcgccacaaacatcccggagacccagcatggcgtat

SEQ ID NO: 386545 - DNA, 140 bp, Artificial Sequence
  Synthetic
atacgccatgctgggtctccctggacatcatcaccggagcgcactggggcgtaatgttcggcctagcctacttctctatgcagggggcgtgggccaaggtcgtcgtcatcctcctattgacgtacttgggagtcggccat

SEQ ID NO: 386546 - DNA, 140 bp, Artificial Sequence
  Synthetic
atggccgactcccaagtacgtcaataggaggatgacgacgaccttggcccacgccccctgcatagagaagtaggctaggccgaacattacgccccagtgcgctccggtgatgatgtccagggagacccagcatggcgtat

SEQ ID NO: 386547 - DNA, 140 bp, Artificial Sequence
  Synthetic
atacgccatgctgggtctcctcaactcatcaacaccaacggcagctggcacatcaaccgcactgccttgaattgcaatgattcattgcaaacggggttcattgcgtcgttgttctatgtccgtacttgggagtcggccat

SEQ ID NO: 386548 - DNA, 140 bp, Artificial Sequence
  Synthetic
atggccgactcccaagtacggacatagaacaacgacgcaatgaaccccgtttgcaatgaatcattgcaattcaaggcagtgcggttgatgtgccagctgccgttggtgttgatgagttgaggagacccagcatggcgtat

SEQ ID NO: 386549 - DNA, 140 bp, Artificial Sequence
  Synthetic
atacgccatgctgggtctccttaccaacgacgaggacatgaggccctattgctggcattatccacccaaaccatgtggcattgttcctgctcggaccgtgtgtggcccagtgtattgcttcgtacttgggagtcggccat

SEQ ID NO: 386550 - DNA, 140 bp, Artificial Sequence
  Synthetic
atggccgactcccaagtacgaagcaatacactgggccacacacggtccgagcaggaacaatgccacatggtttgggtggataatgccagcaatagggcctcatgtcctcgtcgttggtaaggagacccagcatggcgtat

SEQ ID NO: 386551 - DNA, 140 bp, Artificial Sequence
  Synthetic
atacgccatgctgggtctcccggcctccgcggggcgcttggtttggatgcacgtggatgaatggcactgggttcactaagacttgcggcgcaccaccttgccgcataagaccagacttcacgtacttgggagtcggccat

SEQ ID NO: 386552 - DNA, 140 bp, Artificial Sequence
  Synthetic
atggccgactcccaagtacgtgaagtctggtcttatgcggcaaggtggtgcgccgcaagtcttagtgaacccagtgccattcatccacgtgcatccaaaccaagcgccccgcggaggccgggagacccagcatggcgtat

SEQ ID NO: 386553 - DNA, 140 bp, Artificial Sequence
  Synthetic
atacgccatgctgggtctcccctggttgattacccctatagattgtggcattacccgtgtactgtcaactttaccatcttcaaaatacggatgttcatagggggagtcgagcataggctccgtacttgggagtcggccat

SEQ ID NO: 386554 - DNA, 140 bp, Artificial Sequence
  Synthetic
atggccgactcccaagtacggagcctatgctcgactccccctatgaacatccgtattttgaagatggtaaagttgacagtacacgggtaatgccacaatctataggggtaatcaaccaggggagacccagcatggcgtat

SEQ ID NO: 386555 - DNA, 140 bp, Artificial Sequence
  Synthetic
atacgccatgctgggtctcctactaccttgcacctactctgacatgccggctttatctaccggtctcttacacctccaccaaaacattgtggacgtgcagtacctgtatggcctatcgcccgtacttgggagtcggccat

SEQ ID NO: 386556 - DNA, 140 bp, Artificial Sequence
  Synthetic
atggccgactcccaagtacgggcgataggccatacaggtactgcacgtccacaatgttttggtggaggtgtaagagaccggtagataaagccggcatgtcagagtaggtgcaaggtagtaggagacccagcatggcgtat

SEQ ID NO: 386557 - DNA, 140 bp, Artificial Sequence
  Synthetic
atacgccatgctgggtctccctggggcaagccgaggcggcgctggagaagctagtcattttgcatgcggccagcgccgcaagctttaatggcataatctgcttcaccatcttcttcatagcgtacttgggagtcggccat

SEQ ID NO: 386558 - DNA, 140 bp, Artificial Sequence
  Synthetic
atggccgactcccaagtacgctatgaagaagatggtgaagcagattatgccattaaagcttgcggcgctggccgcatgcaaaatgactagcttctccagcgccgcctcggcttgccccagggagacccagcatggcgtat

SEQ ID NO: 386559 - DNA, 140 bp, Artificial Sequence
  Synthetic
atacgccatgctgggtctccctatgcccttaatacaacagaacaggggcaactgggcttggtccttctagtggtcatatcagtccttacactcagcccggcttataagatcctcctctgccgtacttgggagtcggccat

SEQ ID NO: 386560 - DNA, 140 bp, Artificial Sequence
  Synthetic
atggccgactcccaagtacggcagaggaggatcttataagccgggctgagtgtaaggactgatatgaccactagaaggaccaagcccagttgcccctgttctgttgtattaagggcatagggagacccagcatggcgtat

SEQ ID NO: 386561 - DNA, 140 bp, Artificial Sequence
  Synthetic
atacgccatgctgggtctcccacatcaacaggactgccctaagttgcaatgattctctcaacaccgggtgggttgccgcgctgttctacacccacagtttcaactcgtccgggtgcccagcgtacttgggagtcggccat

SEQ ID NO: 386562 - DNA, 140 bp, Artificial Sequence
  Synthetic
atggccgactcccaagtacgctgggcacccggacgagttgaaactgtgggtgtagaacagcgcggcaacccacccggtgttgagagaatcattgcaacttagggcagtcctgttgatgtgggagacccagcatggcgtat

SEQ ID NO: 386563 - DNA, 140 bp, Artificial Sequence
  Synthetic
atacgccatgctgggtctcctatgggccgccgtcatactctgtccgggcatagtgtttgacataaccaagtggctcctggcagtcttaggacctggtcacctccttaggagtgtcctaaccgtacttgggagtcggccat

SEQ ID NO: 386564 - DNA, 140 bp, Artificial Sequence
  Synthetic
atggccgactcccaagtacggttaggacactcctaaggaggtgaccaggtcctaagactgccaggagccacttggttatgtcaaacactatgcccggacagagtatgacggcggcccataggagacccagcatggcgtat

SEQ ID NO: 386565 - DNA, 140 bp, Artificial Sequence
  Synthetic
aggccctggctgctgatatgtggctcctggcagtcttaggacctggtcacctccttaggagtgtcctaacaagcgtgccatacttcgtcagggcgcaagctctgttgaggatatgcgctggaccttttgggacagcggtg

SEQ ID NO: 386566 - DNA, 140 bp, Artificial Sequence
  Synthetic
caccgctgtcccaaaaggtccagcgcatatcctcaacagagcttgcgccctgacgaagtatggcacgcttgttaggacactcctaaggaggtgaccaggtcctaagactgccaggagccacatatcagcagccagggcct

SEQ ID NO: 386567 - DNA, 140 bp, Artificial Sequence
  Synthetic
aggccctggctgctgatatgtggccaccagggatggcaaactccccacaacgcagcttcgacgccacatcgatctgcttgtcgggagcgccaccctctgttcggccctctacgtgggggagaccttttgggacagcggtg

SEQ ID NO: 386568 - DNA, 140 bp, Artificial Sequence
  Synthetic
caccgctgtcccaaaaggtctcccccacgtagagggccgaacagagggtggcgctcccgacaagcagatcgatgtggcgtcgaagctgcgttgtggggagtttgccatccctggtggccacatatcagcagccagggcct

SEQ ID NO: 386569 - DNA, 140 bp, Artificial Sequence
  Synthetic
aggccctggctgctgatatgaagtggcccatctacatgctcccactggcagcggcaagagcaccaaggtgccggctgcgtatgcggcccaggggtacaaggtgctcgttttgaacccatcgaccttttgggacagcggtg

SEQ ID NO: 386570 - DNA, 140 bp, Artificial Sequence
  Synthetic
caccgctgtcccaaaaggtcgatgggttcaaaacgagcaccttgtacccctgggccgcatacgcagccggcaccttggtgctcttgccgctgccagtgggagcatgtagatgggccacttcatatcagcagccagggcct

SEQ ID NO: 386571 - DNA, 140 bp, Artificial Sequence
  Synthetic
aggccctggctgctgatatggcggttttcataggactggcactcttgaccttgtcaccatactacaaaatgttcctcgccagactcatatggtggttacaatatcttatcaccagagtcggaccttttgggacagcggtg

SEQ ID NO: 386572 - DNA, 140 bp, Artificial Sequence
  Synthetic
caccgctgtcccaaaaggtccgactctggtgataagatattgtaaccaccatatgagtctggcgaggaacattttgtagtatggtgacaaggtcaagagtgccagtcctatgaaaaccgccatatcagcagccagggcct

SEQ ID NO: 386573 - DNA, 140 bp, Artificial Sequence
  Synthetic
aggccctggctgctgatatggcatcatcaccagcctcacaggccgggacaagaaccaggtcgagggggaggttcaagtggtttctaccgcgacacaatctttcctggcgacctgcatcaagaccttttgggacagcggtg

SEQ ID NO: 386574 - DNA, 140 bp, Artificial Sequence
  Synthetic
caccgctgtcccaaaaggtcttgatgcaggtcgccaggaaagattgtgtcgcggtagaaaccacttgaacctccccctcgacctggttcttgtcccggcctgtgaggctggtgatgatgccatatcagcagccagggcct

SEQ ID NO: 386575 - DNA, 140 bp, Artificial Sequence
  Synthetic
atacgccatgctgggtctccgatcaccaaacatttgctcgccatattcggtcctctcatggtgctccaggctggcttgaccaaggtgccgtacttcgtacgcgctcagggccttattcgtcgtacttgggagtcggccat

SEQ ID NO: 386576 - DNA, 140 bp, Artificial Sequence
  Synthetic
atggccgactcccaagtacgacgaataaggccctgagcgcgtacgaagtacggcaccttggtcaagccagcctggagcaccatgagaggaccgaatatggcgagcaaatgtttggtgatcggagacccagcatggcgtat

SEQ ID NO: 386577 - DNA, 140 bp, Artificial Sequence
  Synthetic
aggccctggctgctgatatgtagaccaggacctcgtcggctggcaggcgccccccggggcgcgttccttgacaccatgcacctgtggcagctcggacctttacttggtcacgaggcatgcgaccttttgggacagcggtg

SEQ ID NO: 386578 - DNA, 140 bp, Artificial Sequence
  Synthetic
caccgctgtcccaaaaggtcgcatgcctcgtgaccaagtaaaggtccgagctgccacaggtgcatggtgtcaaggaacgcgccccggggggcgcctgccagccgacgaggtcctggtctacatatcagcagccagggcct

SEQ ID NO: 386579 - DNA, 140 bp, Artificial Sequence
  Synthetic
atacgccatgctgggtctccctgtgaacctgaaccagatgtgtctgtgctgacctcgatgttgagggacccttcccacatcaccgccgaggcggcagcgcgccgccttgcgcgcgggtcccgtacttgggagtcggccat

SEQ ID NO: 386580 - DNA, 140 bp, Artificial Sequence
  Synthetic
atggccgactcccaagtacgggacccgcgcgcaaggcggcgcgctgccgcctcggcggtgatgtgggaagggtccctcaacatcgaggtcagcacagacacatctggttcaggttcacagggagacccagcatggcgtat

SEQ ID NO: 386581 - DNA, 140 bp, Artificial Sequence
  Synthetic
atacgccatgctgggtctccacggtcggtagcgttgtcatctgcggcaggatcgtgacctcgggcaaacccgtgctggtacctgacagagaagtgctctaccaacaattcgacgagatggcgtacttgggagtcggccat

SEQ ID NO: 386582 - DNA, 140 bp, Artificial Sequence
  Synthetic
atggccgactcccaagtacgccatctcgtcgaattgttggtagagcacttctctgtcaggtaccagcacgggtttgcccgaggtcacgatcctgccgcagatgacaacgctaccgaccgtggagacccagcatggcgtat

SEQ ID NO: 386583 - DNA, 140 bp, Artificial Sequence
  Synthetic
aggccctggctgctgatatgcctactgctggcactaccccccaaaaccttgtggtattgtgcccgcaaagagcgtgtgtggcccggtatattgcttcactcccagccccgtggtggtggggaccttttgggacagcggtg

SEQ ID NO: 386584 - DNA, 140 bp, Artificial Sequence
  Synthetic
caccgctgtcccaaaaggtccccaccaccacggggctgggagtgaagcaatataccgggccacacacgctctttgcgggcacaataccacaaggttttggggggtagtgccagcagtaggcatatcagcagccagggcct

SEQ ID NO: 386585 - DNA, 140 bp, Artificial Sequence
  Synthetic
aggccctggctgctgatatgcgcctactattccatggtggggaactgggctaaggtcttgattgtgatgctactctttgccggcgtcgacgggagaacccaagtgacgggagcacaggcagaccttttgggacagcggtg

SEQ ID NO: 386586 - DNA, 140 bp, Artificial Sequence
  Synthetic
caccgctgtcccaaaaggtctgcctgtgctcccgtcacttgggttctcccgtcgacgccggcaaagagtagcatcacaatcaagaccttagcccagttccccaccatggaatagtaggcgcatatcagcagccagggcct

SEQ ID NO: 386587 - DNA, 140 bp, Artificial Sequence
  Synthetic
atacgccatgctgggtctccccctgagttgcaacgactccctcaaaactggcttccttgccgcgctgttctacacacataagttcaacgcggctggatgcccggagcgcatggccagctgcgtacttgggagtcggccat

SEQ ID NO: 386588 - DNA, 140 bp, Artificial Sequence
  Synthetic
atggccgactcccaagtacgcagctggccatgcgctccgggcatccagccgcgttgaacttatgtgtgtagaacagcgcggcaaggaagccagttttgagggagtcgttgcaactcagggggagacccagcatggcgtat

SEQ ID NO: 386589 - DNA, 140 bp, Artificial Sequence
  Synthetic
atacgccatgctgggtctccgcggaaatccaggaagttccctccggcgctgcccatatgggcgcgcccggactacaaccctccattgttagagtcctggaaagacccggactacgtccctcgtacttgggagtcggccat

SEQ ID NO: 386590 - DNA, 140 bp, Artificial Sequence
  Synthetic
atggccgactcccaagtacgagggacgtagtccgggtctttccaggactctaacaatggagggttgtagtccgggcgcgcccatatgggcagcgccggagggaacttcctggatttccgcggagacccagcatggcgtat

SEQ ID NO: 386591 - DNA, 140 bp, Artificial Sequence
  Synthetic
aggccctggctgctgatatggccgtacttcgtgcgcgctcaagggctcatacgtgcatgcatgttggtgcggaaggtcgctgggggccattatgtccaaatggctctcatgaagctggccgaccttttgggacagcggtg

SEQ ID NO: 386592 - DNA, 140 bp, Artificial Sequence
  Synthetic
caccgctgtcccaaaaggtcggccagcttcatgagagccatttggacataatggcccccagcgaccttccgcaccaacatgcatgcacgtatgagcccttgagcgcgcacgaagtacggccatatcagcagccagggcct

SEQ ID NO: 386593 - DNA, 140 bp, Artificial Sequence
  Synthetic
aggccctggctgctgatatgggccgtggctgtggagccagtcgtcttctcccgaatggagaccaaactcatcacgtggggggctgacaccgctgcatgcggtgacatcatcaacggcttggaccttttgggacagcggtg

SEQ ID NO: 386594 - DNA, 140 bp, Artificial Sequence
  Synthetic
caccgctgtcccaaaaggtccaagccgttgatgatgtcaccgcatgcagcggtgtcagccccccacgtgatgagtttggtctccattcgggagaagacgactggctccacagccacggcccatatcagcagccagggcct

SEQ ID NO: 386595 - DNA, 140 bp, Artificial Sequence
  Synthetic
aggccctggctgctgatatgatgggcacgcccggattacaatcctccactgctagagtcttggaagaacccggactacgtccctccagtggtacacgggtgcccattgccacctatcaaggaccttttgggacagcggtg

SEQ ID NO: 386596 - DNA, 140 bp, Artificial Sequence
  Synthetic
caccgctgtcccaaaaggtccttgataggtggcaatgggcacccgtgtaccactggagggacgtagtccgggttcttccaagactctagcagtggaggattgtaatccgggcgtgcccatcatatcagcagccagggcct

SEQ ID NO: 386597 - DNA, 140 bp, Artificial Sequence
  Synthetic
atacgccatgctgggtctccacgggcggtcgaggatgagagggaagtatccgtggcggcggagatcctgcggaaaccgaaaaagttccccccagcgatgcccatatgggcacgcccgagccgtacttgggagtcggccat

SEQ ID NO: 386598 - DNA, 140 bp, Artificial Sequence
  Synthetic
atggccgactcccaagtacggctcgggcgtgcccatatgggcatcgctggggggaactttttcggtttccgcaggatctccgccgccacggatacttccctctcatcctcgaccgcccgtggagacccagcatggcgtat

SEQ ID NO: 386599 - DNA, 140 bp, Artificial Sequence
  Synthetic
atacgccatgctgggtctccccggcgtcgacgcggaaacccgtgtcaccgggggaagtgccgcctacgccacgcggagttttgctagtctcttccaaacaggcgccaggcagaacatccacgtacttgggagtcggccat

SEQ ID NO: 386600 - DNA, 140 bp, Artificial Sequence
  Synthetic
atggccgactcccaagtacgtggatgttctgcctggcgcctgtttggaagagactagcaaaactccgcgtggcgtaggcggcacttcccccggtgacacgggtttccgcgtcgacgccggggagacccagcatggcgtat

SEQ ID NO: 386601 - DNA, 140 bp, Artificial Sequence
  Synthetic
aggccctggctgctgatatgggacgttaagttcccgggtggcggccagatcgttggcggagtttacttgttgccgcgcaggggccccagagtgggtgtgcgcgcgacgaggaagacttccgaccttttgggacagcggtg

SEQ ID NO: 386602 - DNA, 140 bp, Artificial Sequence
  Synthetic
caccgctgtcccaaaaggtcggaagtcttcctcgtcgcgcgcacacccactctggggcccctgcgcggcaacaagtaaactccgccaacgatctggccgccacccgggaacttaacgtcccatatcagcagccagggcct

SEQ ID NO: 386603 - DNA, 140 bp, Artificial Sequence
  Synthetic
atacgccatgctgggtctccgagcggtcgcaacctcgcgggaggcgtcagcctattcccaaggcccgccgacccgagggaaggtcctgggcgcagcccgggtacccttggcccctctatgcgtacttgggagtcggccat

SEQ ID NO: 386604 - DNA, 140 bp, Artificial Sequence
  Synthetic
atggccgactcccaagtacgcatagaggggccaagggtacccgggctgcgcccaggaccttccctcgggtcggcgggccttgggaataggctgacgcctcccgcgaggttgcgaccgctcggagacccagcatggcgtat

SEQ ID NO: 386605 - DNA, 140 bp, Artificial Sequence
  Synthetic
atacgccatgctgggtctcctaaggtcatcgataccctcacgtgtggcttcgccgacctcatggggtacatcccgctcgtcggcgctcctctagggggcgctgccagagctctggcacatcgtacttgggagtcggccat

SEQ ID NO: 386606 - DNA, 140 bp, Artificial Sequence
  Synthetic
atggccgactcccaagtacgatgtgccagagctctggcagcgccccctagaggagcgccgacgagcgggatgtaccccatgaggtcggcgaagccacacgtgagggtatcgatgaccttaggagacccagcatggcgtat

SEQ ID NO: 386607 - DNA, 140 bp, Artificial Sequence
  Synthetic
atacgccatgctgggtctcctccctgcttcggccgtcggagtgcgcaactcttcgggggtgtaccatgtcaccaatgattgccccaatgcgtccgttgtgtacgagacggagaacctgatcgtacttgggagtcggccat

SEQ ID NO: 386608 - DNA, 140 bp, Artificial Sequence
  Synthetic
atggccgactcccaagtacgatcaggttctccgtctcgtacacaacggacgcattggggcaatcattggtgacatggtacacccccgaagagttgcgcactccgacggccgaagcagggaggagacccagcatggcgtat

SEQ ID NO: 386609 - DNA, 140 bp, Artificial Sequence
  Synthetic
aggccctggctgctgatatgagatcaccggacatgtcaagaacgggacgatgaggatcgtcggtcccaggacctgcaggaacatgtggagtgggaccttccccatcaacgcctacacaacgaccttttgggacagcggtg

SEQ ID NO: 386610 - DNA, 140 bp, Artificial Sequence
  Synthetic
caccgctgtcccaaaaggtcgttgtgtaggcgttgatggggaaggtcccactccacatgttcctgcaggtcctgggaccgacgatcctcatcgtcccgttcttgacatgtccggtgatctcatatcagcagccagggcct

SEQ ID NO: 386611 - DNA, 140 bp, Artificial Sequence
  Synthetic
atacgccatgctgggtctcccccgtcagtgaggttcggcgtcgtgtcgactcgattgtcggggccgctgcgttctgttcggctatgtatgtaggggacctatgcggctccatcttccttgcgtacttgggagtcggccat

SEQ ID NO: 386612 - DNA, 140 bp, Artificial Sequence
  Synthetic
atggccgactcccaagtacgcaaggaagatggagccgcataggtcccctacatacatagccgaacagaacgcagcggccccgacaatcgagtcgacacgacgccgaacctcactgacgggggagacccagcatggcgtat

SEQ ID NO: 386613 - DNA, 140 bp, Artificial Sequence
  Synthetic
aggccctggctgctgatatggttctgttcggctatgtatgtaggggacctatgcggctccatcttccttgttggccagatcttcaccttctctcccaggcaccattggacgacgcaagacgaccttttgggacagcggtg

SEQ ID NO: 386614 - DNA, 140 bp, Artificial Sequence
  Synthetic
caccgctgtcccaaaaggtcgtcttgcgtcgtccaatggtgcctgggagagaaggtgaagatctggccaacaaggaagatggagccgcataggtcccctacatacatagccgaacagaaccatatcagcagccagggcct

SEQ ID NO: 386615 - DNA, 140 bp, Artificial Sequence
  Synthetic
atacgccatgctgggtctcctactccggatcccacaagctatcgtggatatgatagctggtgcccactggggtgtcctagcgggcctggcatactactccatggtggggaactgggctaacgtacttgggagtcggccat

SEQ ID NO: 386616 - DNA, 140 bp, Artificial Sequence
  Synthetic
atggccgactcccaagtacgttagcccagttccccaccatggagtagtatgccaggcccgctaggacaccccagtgggcaccagctatcatatccacgatagcttgtgggatccggagtaggagacccagcatggcgtat

SEQ ID NO: 386617 - DNA, 140 bp, Artificial Sequence
  Synthetic
aggccctggctgctgatatgtcctcggctagccagctgtctgctccatctctcaaggcaacttgcaccgccaaccatgactcccctgacgccgagctcatagaggctaacctcctgtggagaccttttgggacagcggtg

SEQ ID NO: 386618 - DNA, 140 bp, Artificial Sequence
  Synthetic
caccgctgtcccaaaaggtctccacaggaggttagcctctatgagctcggcgtcaggggagtcatggttggcggtgcaagttgccttgagagatggagcagacagctggctagccgaggacatatcagcagccagggcct

SEQ ID NO: 386619 - DNA, 140 bp, Artificial Sequence
  Synthetic
atacgccatgctgggtctccgccccaggcgctaagcaaaagatccagctcataaataccaacggcagctggcacatcaacagaactgccttgaactgtaatgaaagcttggatactggctcgtacttgggagtcggccat

SEQ ID NO: 386620 - DNA, 140 bp, Artificial Sequence
  Synthetic
atggccgactcccaagtacgagccagtatccaagctttcattacagttcaaggcagttctgttgatgtgccagctgccgttggtatttatgagctggatcttttgcttagcgcctggggcggagacccagcatggcgtat

SEQ ID NO: 386621 - DNA, 140 bp, Artificial Sequence
  Synthetic
atacgccatgctgggtctccacccatcactcacgaggggaatgctagtgatgaccagcggccatattgttggcactatgccctacgcccgtgtggcattgtgccagcgaaaaaggtttgccgtacttgggagtcggccat

SEQ ID NO: 386622 - DNA, 140 bp, Artificial Sequence
  Synthetic
atggccgactcccaagtacggcaaacctttttcgctggcacaatgccacacgggcgtagggcatagtgccaacaatatggccgctggtcatcactagcattcccctcgtgagtgatgggtggagacccagcatggcgtat

SEQ ID NO: 386623 - DNA, 140 bp, Artificial Sequence
  Synthetic
aggccctggctgctgatatggggggcccactggggagtcctggcgggccttgcctactattccatggcggggaactgggctaaggttttgattgtgatgctactttttgccggcgttgacgaccttttgggacagcggtg

SEQ ID NO: 386624 - DNA, 140 bp, Artificial Sequence
  Synthetic
caccgctgtcccaaaaggtcgtcaacgccggcaaaaagtagcatcacaatcaaaaccttagcccagttccccgccatggaatagtaggcaaggcccgccaggactccccagtgggccccccatatcagcagccagggcct

SEQ ID NO: 386625 - DNA, 140 bp, Artificial Sequence
  Synthetic
atacgccatgctgggtctcctgctcctcaacaactctaggccgccaatggggaattggtttgggtgtacgtggatgaattctagtggcttcaccaagacgtgcggggctccggcctgcaacgtacttgggagtcggccat

SEQ ID NO: 386626 - DNA, 140 bp, Artificial Sequence
  Synthetic
atggccgactcccaagtacgttgcaggccggagccccgcacgtcttggtgaagccactagaattcatccacgtacacccaaaccaattccccattggcggcctagagttgttgaggagcaggagacccagcatggcgtat

SEQ ID NO: 386627 - DNA, 140 bp, Artificial Sequence
  Synthetic
atacgccatgctgggtctccgtaaacatccggatgccacatacagcaggtgcggctctggtccctggcttacccctcgatgcttggtagactacccatacaggctctggcactacccctgcgtacttgggagtcggccat

SEQ ID NO: 386628 - DNA, 140 bp, Artificial Sequence
  Synthetic
atggccgactcccaagtacgcaggggtagtgccagagcctgtatgggtagtctaccaagcatcgaggggtaagccagggaccagagccgcacctgctgtatgtggcatccggatgtttacggagacccagcatggcgtat

SEQ ID NO: 386629 - DNA, 140 bp, Artificial Sequence
  Synthetic
atacgccatgctgggtctccttggacgacagggatcgggccgagttgagccctctgttgctgtccactacgcaatggcaggtcctcccctgctcattcacaacactgcccgccctgtcaacgtacttgggagtcggccat

SEQ ID NO: 386630 - DNA, 140 bp, Artificial Sequence
  Synthetic
atggccgactcccaagtacgttgacagggcgggcagtgttgtgaatgagcaggggaggacctgccattgcgtagtggacagcaacagagggctcaactcggcccgatccctgtcgtccaaggagacccagcatggcgtat

SEQ ID NO: 386631 - DNA, 140 bp, Artificial Sequence
  Synthetic
atacgccatgctgggtctccgctcctcttcttgctgctagcagatgctcgcatttgtgcctgcttgtggatgatgcttctcatatctcaggtagaggcggcgctggagaacttgatagttcgtacttgggagtcggccat

SEQ ID NO: 386632 - DNA, 140 bp, Artificial Sequence
  Synthetic
atggccgactcccaagtacgaactatcaagttctccagcgccgcctctacctgagatatgagaagcatcatccacaagcaggcacaaatgcgagcatctgctagcagcaagaagaggagcggagacccagcatggcgtat

SEQ ID NO: 386633 - DNA, 140 bp, Artificial Sequence
  Synthetic
atacgccatgctgggtctccagtcctagcgggccttgcctactattccatggcggggaactgggctaaggttctgattgtgatgctactcttcgctggcgtcgacgggagacagaccacgcgtacttgggagtcggccat

SEQ ID NO: 386634 - DNA, 140 bp, Artificial Sequence
  Synthetic
atggccgactcccaagtacgcgtggtctgtctcccgtcgacgccagcgaagagtagcatcacaatcagaaccttagcccagttccccgccatggaatagtaggcaaggcccgctaggactggagacccagcatggcgtat

SEQ ID NO: 386635 - DNA, 140 bp, Artificial Sequence
  Synthetic
atacgccatgctgggtctcccctattccgtctatgggatgtggccactgctcctgcttctcctggcgttgccccaacgggcatacgccttggatcaggagttggccgcgtcgtgtggggccgtacttgggagtcggccat

SEQ ID NO: 386636 - DNA, 140 bp, Artificial Sequence
  Synthetic
atggccgactcccaagtacggccccacacgacgcggccaactcctgatccaaggcgtatgcccgttggggcaacgccaggagaagcaggagcagtggccacatcccatagacggaataggggagacccagcatggcgtat

SEQ ID NO: 386637 - DNA, 140 bp, Artificial Sequence
  Synthetic
atacgccatgctgggtctccacatcaacaggaccgccttaaactgcaatgactccctcaagactgggtttgtggcttcgctgttctacgctcacaggttcaacgcgtctggatgcccagacgtacttgggagtcggccat

SEQ ID NO: 386638 - DNA, 140 bp, Artificial Sequence
  Synthetic
atggccgactcccaagtacgtctgggcatccagacgcgttgaacctgtgagcgtagaacagcgaagccacaaacccagtcttgagggagtcattgcagtttaaggcggtcctgttgatgtggagacccagcatggcgtat

SEQ ID NO: 386639 - DNA, 140 bp, Artificial Sequence
  Synthetic
atacgccatgctgggtctccgaggcgctcctacaggtttgggtccccccgctcaacgcccgaggagggcgcgacggagtcgtactgctcacgtgtgtgctccacccgcacttgctctttgcgtacttgggagtcggccat

SEQ ID NO: 386640 - DNA, 140 bp, Artificial Sequence
  Synthetic
atggccgactcccaagtacgcaaagagcaagtgcgggtggagcacacacgtgagcagtacgactccgtcgcgccctcctcgggcgttgagcggggggacccaaacctgtaggagcgcctcggagacccagcatggcgtat

SEQ ID NO: 386641 - DNA, 140 bp, Artificial Sequence
  Synthetic
atacgccatgctgggtctccgccagtctgctcaaggtaccgtacttcgtgcgtgcccacggtctcattaggctctgcatgctggtgcgcaagacagcgggcggtcagtatgtgcagatggcgtacttgggagtcggccat

SEQ ID NO: 386642 - DNA, 140 bp, Artificial Sequence
  Synthetic
atggccgactcccaagtacgccatctgcacatactgaccgcccgctgtcttgcgcaccagcatgcagagcctaatgagaccgtgggcacgcacgaagtacggtaccttgagcagactggcggagacccagcatggcgtat

SEQ ID NO: 386643 - DNA, 140 bp, Artificial Sequence
  Synthetic
atacgccatgctgggtctcccactgaacccgtcatcttctcccggatggaaatcaagactatcacctggggggcggatactgcggcttgtggagacatcatcaacgggctgcctgtttcccgtacttgggagtcggccat

SEQ ID NO: 386644 - DNA, 140 bp, Artificial Sequence
  Synthetic
atggccgactcccaagtacgggaaacaggcagcccgttgatgatgtctccacaagccgcagtatccgccccccaggtgatagtcttgatttccatccgggagaagatgacgggttcagtgggagacccagcatggcgtat

SEQ ID NO: 386645 - DNA, 140 bp, Artificial Sequence
  Synthetic
atacgccatgctgggtctccggggtctcttgggctgcatcatcaccagcctcaccggtcgggacaaaaatcaagtggagggggaagtccagattgtgtctaccgcaacccagacgttcttcgtacttgggagtcggccat

SEQ ID NO: 386646 - DNA, 140 bp, Artificial Sequence
  Synthetic
atggccgactcccaagtacgaagaacgtctgggttgcggtagacacaatctggacttccccctccacttgatttttgtcccgaccggtgaggctggtgatgatgcagcccaagagaccccggagacccagcatggcgtat

SEQ ID NO: 386647 - DNA, 140 bp, Artificial Sequence
  Synthetic
atacgccatgctgggtctccgtggaccaggatttggtgggctggccagcgcctcagggagcgcgctccctgacgccgtgcacatgcggcgcctcggatctgtacttggtcacgaggcacgcgtacttgggagtcggccat

SEQ ID NO: 386648 - DNA, 140 bp, Artificial Sequence
  Synthetic
atggccgactcccaagtacgcgtgcctcgtgaccaagtacagatccgaggcgccgcatgtgcacggcgtcagggagcgcgctccctgaggcgctggccagcccaccaaatcctggtccacggagacccagcatggcgtat

SEQ ID NO: 386649 - DNA, 140 bp, Artificial Sequence
  Synthetic
aggccctggctgctgatatggtggggtcgcaaaggcggtcgactttgtgcccgttgaatccctagagaccaccatgaggtccccagtgtttaccgacaattccagccctccgacagtgccgaccttttgggacagcggtg

SEQ ID NO: 386650 - DNA, 140 bp, Artificial Sequence
  Synthetic
caccgctgtcccaaaaggtcggcactgtcggagggctggaattgtcggtaaacactggggacctcatggtggtctctagggattcaacgggcacaaagtcgaccgcctttgcgaccccaccatatcagcagccagggcct

SEQ ID NO: 386651 - DNA, 140 bp, Artificial Sequence
  Synthetic
atacgccatgctgggtctccttccttgctaggctcatatggtggctacaatatcttgtcaccagagccgaagcacttttgcaagtgtggatcccccctctcaacgttcgagggggccgcgcgtacttgggagtcggccat

SEQ ID NO: 386652 - DNA, 140 bp, Artificial Sequence
  Synthetic
atggccgactcccaagtacgcgcggccccctcgaacgttgagaggggggatccacacttgcaaaagtgcttcggctctggtgacaagatattgtagccaccatatgagcctagcaaggaaggagacccagcatggcgtat

SEQ ID NO: 386653 - DNA, 140 bp, Artificial Sequence
  Synthetic
aggccctggctgctgatatgagcacttttgcaagtgtggatcccccctctcaacgttcgagggggccgcgatgccatcatcctcctcatgtgcgcggtccacccggggttagtctttgacgaccttttgggacagcggtg

SEQ ID NO: 386654 - DNA, 140 bp, Artificial Sequence
  Synthetic
caccgctgtcccaaaaggtcgtcaaagactaaccccgggtggaccgcgcacatgaggaggatgatggcatcgcggccccctcgaacgttgagaggggggatccacacttgcaaaagtgctcatatcagcagccagggcct

SEQ ID NO: 386655 - DNA, 140 bp, Artificial Sequence
  Synthetic
atacgccatgctgggtctcctgcaacacctgtgtcgtccagacagtcgatttcagcctagaccctacattctctattgagacttccaccgtgccccaggacgccgtgtcccgctcccaaccgtacttgggagtcggccat

SEQ ID NO: 386656 - DNA, 140 bp, Artificial Sequence
  Synthetic
atggccgactcccaagtacggttgggagcgggacacggcgtcctggggcacggtggaagtctcaatagagaatgtagggtctaggctgaaatcgactgtctggacgacacaggtgttgcaggagacccagcatggcgtat

SEQ ID NO: 386657 - DNA, 140 bp, Artificial Sequence
  Synthetic
atacgccatgctgggtctcccccggggagcggccgtctggcatgtttgactccgtggtcctctgtgagtgctatgacgcgggttgtgcttggtatgagcttacacccgccgagaccacggcgtacttgggagtcggccat

SEQ ID NO: 386658 - DNA, 140 bp, Artificial Sequence
  Synthetic
atggccgactcccaagtacgccgtggtctcggcgggtgtaagctcataccaagcacaacccgcgtcatagcactcacagaggaccacggagtcaaacatgccagacggccgctccccgggggagacccagcatggcgtat

SEQ ID NO: 386659 - DNA, 140 bp, Artificial Sequence
  Synthetic
atacgccatgctgggtctccccacttcctgtctcagacgaaacagagcggggaaaatttcccctacctagtcgcataccaagccaccgtgtgcgctagagctaaagctcctcccccgtcacgtacttgggagtcggccat

SEQ ID NO: 386660 - DNA, 140 bp, Artificial Sequence
  Synthetic
atggccgactcccaagtacgtgacgggggaggagctttagctctagcgcacacggtggcttggtatgcgactaggtaggggaaattttccccgctctgtttcgtctgagacaggaagtggggagacccagcatggcgtat

SEQ ID NO: 386661 - DNA, 140 bp, Artificial Sequence
  Synthetic
aggccctggctgctgatatgtcgcataccaagccaccgtgtgcgctagagctaaagctcctcccccgtcatgggaccaaatgtggaagtgcttgatacggctcaagcccaccctcactgggaccttttgggacagcggtg

SEQ ID NO: 386662 - DNA, 140 bp, Artificial Sequence
  Synthetic
caccgctgtcccaaaaggtcccagtgagggtgggcttgagccgtatcaagcacttccacatttggtcccatgacgggggaggagctttagctctagcgcacacggtggcttggtatgcgacatatcagcagccagggcct

SEQ ID NO: 386663 - DNA, 140 bp, Artificial Sequence
  Synthetic
atacgccatgctgggtctcccgtatttctccatggtggggaactgggcgaaggtcttggtagtgctgttgctatttgccggcgtcgatgcgggaaccaccgtcaccgggggagttgccgccgtacttgggagtcggccat

SEQ ID NO: 386664 - DNA, 140 bp, Artificial Sequence
  Synthetic
atggccgactcccaagtacggcggcaactcccccggtgacggtggttcccgcatcgacgccggcaaatagcaacagcactaccaagaccttcgcccagttccccaccatggagaaatacgggagacccagcatggcgtat

SEQ ID NO: 386665 - DNA, 140 bp, Artificial Sequence
  Synthetic
atacgccatgctgggtctccactaaggtaccagctgcgtatgcagctcaagggtacaaggtgctcgttttgaacccatctgttgccgccaccctggggtttggggcatacatggctaaggcgtacttgggagtcggccat

SEQ ID NO: 386666 - DNA, 140 bp, Artificial Sequence
  Synthetic
atggccgactcccaagtacgccttagccatgtatgccccaaaccccagggtggcggcaacagatgggttcaaaacgagcaccttgtacccttgagctgcatacgcagctggtaccttagtggagacccagcatggcgtat

SEQ ID NO: 386667 - DNA, 140 bp, Artificial Sequence
  Synthetic
atacgccatgctgggtctccgaggtcgtcactagcacgtgggtgctggtgggcggcgtcctggccgctttggccgcttactgcctgtctacaggcagcgtggtcatagtgggcaggataacgtacttgggagtcggccat

SEQ ID NO: 386668 - DNA, 140 bp, Artificial Sequence
  Synthetic
atggccgactcccaagtacgttatcctgcccactatgaccacgctgcctgtagacaggcagtaagcggccaaagcggccaggacgccgcccaccagcacccacgtgctagtgacgacctcggagacccagcatggcgtat

SEQ ID NO: 386669 - DNA, 140 bp, Artificial Sequence
  Synthetic
atacgccatgctgggtctccctgaactgcaatgatagccttaacaccggctttatagcagggctcatgtattaccacaaattcaactcttcgggctgttccgagaggatggccagctgcccgtacttgggagtcggccat

SEQ ID NO: 386670 - DNA, 140 bp, Artificial Sequence
  Synthetic
atggccgactcccaagtacgggcagctggccatcctctcggaacagcccgaagagttgaatttgtggtaatacatgagccctgctataaagccggtgttaaggctatcattgcagttcagggagacccagcatggcgtat

SEQ ID NO: 386671 - DNA, 140 bp, Artificial Sequence
  Synthetic
atacgccatgctgggtctccgacctcttaccgattttgcccagggctggggtcctatcagtcatgctaacggaaccggccttgaccaacgcccctactgttggcactatgctccaaaacccgtacttgggagtcggccat

SEQ ID NO: 386672 - DNA, 140 bp, Artificial Sequence
  Synthetic
atggccgactcccaagtacgggttttggagcatagtgccaacagtaggggcgttggtcaaggccggttccgttagcatgactgataggaccccagccctgggcaaaatcggtaagaggtcggagacccagcatggcgtat

SEQ ID NO: 386673 - DNA, 140 bp, Artificial Sequence
  Synthetic
atacgccatgctgggtctccacggctggagcgcggctcgtcgtgctcgccaccgctacgcccccgggatcagtcaccgtgccacattccaacattcaggaggtggctctatccaccactgcgtacttgggagtcggccat

SEQ ID NO: 386674 - DNA, 140 bp, Artificial Sequence
  Synthetic
atggccgactcccaagtacgcagtggtggatagagccacctcctgaatgttggaatgtggcacggtgactgatcccgggggcgtagcggtggcgagcacgacgagccgcgctccagccgtggagacccagcatggcgtat

SEQ ID NO: 386675 - DNA, 140 bp, Artificial Sequence
  Synthetic
atacgccatgctgggtctcctagcgtcgctgatgtcgtttacagccgcggtgacgagtccactaaccacccagcaaaccctcctctttaacatccttggggggtgggtggccgcccagctcgtacttgggagtcggccat

SEQ ID NO: 386676 - DNA, 140 bp, Artificial Sequence
  Synthetic
atggccgactcccaagtacgagctgggcggccacccaccccccaaggatgttaaagaggagggtttgctgggtggttagtggactcgtcaccgcggctgtaaacgacatcagcgacgctaggagacccagcatggcgtat

SEQ ID NO: 386677 - DNA, 140 bp, Artificial Sequence
  Synthetic
atacgccatgctgggtctcccggcacgtgggccctggcgagggcgcggtgcagtggatgaaccgactgatagcgtttgcttctcggggtaaccacgtctcccctacacactatgtgccagcgtacttgggagtcggccat

SEQ ID NO: 386678 - DNA, 140 bp, Artificial Sequence
  Synthetic
atggccgactcccaagtacgctggcacatagtgtgtaggggagacgtggttaccccgagaagcaaacgctatcagtcggttcatccactgcaccgcgccctcgccagggcccacgtgccgggagacccagcatggcgtat

SEQ ID NO: 386679 - DNA, 140 bp, Artificial Sequence
  Synthetic
atacgccatgctgggtctcctgctgagcgacttcaagagttggctgaaggccaaacttatgccgcaactgcccgggatcccattcgtatcctgtcaacgcgggtaccgtggggtctggcgcgtacttgggagtcggccat

SEQ ID NO: 386680 - DNA, 140 bp, Artificial Sequence
  Synthetic
atggccgactcccaagtacgcgccagaccccacggtacccgcgttgacaggatacgaatgggatcccgggcagttgcggcataagtttggccttcagccaactcttgaagtcgctcagcaggagacccagcatggcgtat

SEQ ID NO: 386681 - DNA, 140 bp, Artificial Sequence
  Synthetic
atacgccatgctgggtctccgggcgaaggcatcatgcacgcccgttgcccgtgtggagccgatataactggtcatgtcaaaaacggttcgatgagaatcgtcggccctaagacttgcagccgtacttgggagtcggccat

SEQ ID NO: 386682 - DNA, 140 bp, Artificial Sequence
  Synthetic
atggccgactcccaagtacggctgcaagtcttagggccgacgattctcatcgaaccgtttttgacatgaccagttatatcggctccacacgggcaacgggcgtgcatgatgccttcgcccggagacccagcatggcgtat

SEQ ID NO: 386683 - DNA, 140 bp, Artificial Sequence
  Synthetic
atacgccatgctgggtctcccagaggagtatgtggaggtaaggcggctgggggatttccattacatcacgggggtgaccactgataagatcaagtgtccatgccaggtcccctcgcccgacgtacttgggagtcggccat

SEQ ID NO: 386684 - DNA, 140 bp, Artificial Sequence
  Synthetic
atggccgactcccaagtacgtcgggcgaggggacctggcatggacacttgatcttatcagtggtcacccccgtgatgtaatggaaatcccccagccgccttacctccacatactcctctgggagacccagcatggcgtat

SEQ ID NO: 386685 - DNA, 140 bp, Artificial Sequence
  Synthetic
atacgccatgctgggtctcctacttggtggggtcccagttgccctgcgagcccgagccagacgtagctgtactgacatcaatgcttacagacccctcccacatcactgcagagacggcggcgtacttgggagtcggccat

SEQ ID NO: 386686 - DNA, 140 bp, Artificial Sequence
  Synthetic
atggccgactcccaagtacgccgccgtctctgcagtgatgtgggaggggtctgtaagcattgatgtcagtacagctacgtctggctcgggctcgcagggcaactgggaccccaccaagtaggagacccagcatggcgtat

SEQ ID NO: 386687 - DNA, 140 bp, Artificial Sequence
  Synthetic
atacgccatgctgggtctccctctccagacgctgacctcataacagccaacctcctgtggaggcaggagatgggggggaacattaccagagtggagtcggagaataagatcgtcatcctgcgtacttgggagtcggccat

SEQ ID NO: 386688 - DNA, 140 bp, Artificial Sequence
  Synthetic
atggccgactcccaagtacgcaggatgacgatcttattctccgactccactctggtaatgttcccccccatctcctgcctccacaggaggttggctgttatgaggtcagcgtctggagagggagacccagcatggcgtat

SEQ ID NO: 386689 - DNA, 140 bp, Artificial Sequence
  Synthetic
atacgccatgctgggtctccagtctacagtatcatctgctctggctgagcttgccactaagacctttggcagctctacaacctcaggcgtgacaagtggtgaagcggccgaatcgtcccccgtacttgggagtcggccat

SEQ ID NO: 386690 - DNA, 140 bp, Artificial Sequence
  Synthetic
atggccgactcccaagtacgggggacgattcggccgcttcaccacttgtcacgcctgaggttgtagagctgccaaaggtcttagtggcaagctcagccagagcagatgatactgtagactggagacccagcatggcgtat

SEQ ID NO: 386691 - DNA, 140 bp, Artificial Sequence
  Synthetic
atacgccatgctgggtctcctcttggtctaccgtaagcagtgatggcggtacggaggacgtcgtgtgctgctcgatgtcctactcgtggacgggcgccctaattacgccctgtgccgcagcgtacttgggagtcggccat

SEQ ID NO: 386692 - DNA, 140 bp, Artificial Sequence
  Synthetic
atggccgactcccaagtacgctgcggcacagggcgtaattagggcgcccgtccacgagtaggacatcgagcagcacacgacgtcctccgtaccgccatcactgcttacggtagaccaagaggagacccagcatggcgtat

SEQ ID NO: 386693 - DNA, 140 bp, Artificial Sequence
  Synthetic
atacgccatgctgggtctccaggaaaccaaactccccatcaacgcactgagtaactcgctgctgcgccaccacaatttggtgtattccaccacctctcgcagcgctggccagaggcagaacgtacttgggagtcggccat

SEQ ID NO: 386694 - DNA, 140 bp, Artificial Sequence
  Synthetic
atggccgactcccaagtacgttctgcctctggccagcgctgcgagaggtggtggaatacaccaaattgtggtggcgcagcagcgagttactcagtgcgttgatggggagtttggtttcctggagacccagcatggcgtat

SEQ ID NO: 386695 - DNA, 140 bp, Artificial Sequence
  Synthetic
atacgccatgctgggtctcctccgtagaggaggcatgtagcctgacgcccccgcactccgccagatcaaaatttggctatggggcgaaggatgtccgaagccattccagtaaggccataccgtacttgggagtcggccat

SEQ ID NO: 386696 - DNA, 140 bp, Artificial Sequence
  Synthetic
atggccgactcccaagtacggtatggccttactggaatggcttcggacatccttcgccccatagccaaattttgatctggcggagtgcgggggcgtcaggctacatgcctcctctacggaggagacccagcatggcgtat

SEQ ID NO: 386697 - DNA, 140 bp, Artificial Sequence
  Synthetic
aggccctggctgctgatatgatttggctatggggcgaaggatgtccgaagccattccagtaaggccatacgccacattaactccgtgtggcaagaccttctggaggacaatacaacacctgaccttttgggacagcggtg

SEQ ID NO: 386698 - DNA, 140 bp, Artificial Sequence
  Synthetic
caccgctgtcccaaaaggtcaggtgttgtattgtcctccagaaggtcttgccacacggagttaatgtggcgtatggccttactggaatggcttcggacatccttcgccccatagccaaatcatatcagcagccagggcct

SEQ ID NO: 386699 - DNA, 140 bp, Artificial Sequence
  Synthetic
atacgccatgctgggtctcctgcgcgtatgcgagaagagggctttgtatgacgtagtcaaacagctccccattgccgtgatgggaacctcctacgggttccagtactcaccagcgcagcgcgtacttgggagtcggccat

SEQ ID NO: 386700 - DNA, 140 bp, Artificial Sequence
  Synthetic
atggccgactcccaagtacgcgctgcgctggtgagtactggaacccgtaggaggttcccatcacggcaatggggagctgtttgactacgtcatacaaagccctcttctcgcatacgcgcaggagacccagcatggcgtat

SEQ ID NO: 386701 - DNA, 140 bp, Artificial Sequence
  Synthetic
atacgccatgctgggtctcctttcctatgacacccgttgctttgactcgacagtcactgaggctgatatccgtacggaggaagacctctaccaatcttgtgacctggtccctgaggcccgcgtacttgggagtcggccat

SEQ ID NO: 386702 - DNA, 140 bp, Artificial Sequence
  Synthetic
atggccgactcccaagtacgcgggcctcagggaccaggtcacaagattggtagaggtcttcctccgtacggatatcagcctcagtgactgtcgagtcaaagcaacgggtgtcataggaaaggagacccagcatggcgtat

SEQ ID NO: 386703 - DNA, 140 bp, Artificial Sequence
  Synthetic
atacgccatgctgggtctcctgcagcctgtcgagctgcaaagctccgggactgcactatgctcgtgtgcggcgacgacctcgtcgttatctgtgagagcgccggtgtccaggaggacgctcgtacttgggagtcggccat

SEQ ID NO: 386704 - DNA, 140 bp, Artificial Sequence
  Synthetic
atggccgactcccaagtacgagcgtcctcctggacaccggcgctctcacagataacgacgaggtcgtcgccgcacacgagcatagtgcagtcccggagctttgcagctcgacaggctgcaggagacccagcatggcgtat

SEQ ID NO: 386705 - DNA, 140 bp, Artificial Sequence
  Synthetic
aggccctggctgctgatatggcgacgacctcgtcgttatctgtgagagcgccggtgtccaggaggacgctgcgaacctgagagccttcacggaggctatgaccaggtactccgcccccccgaccttttgggacagcggtg

SEQ ID NO: 386706 - DNA, 140 bp, Artificial Sequence
  Synthetic
caccgctgtcccaaaaggtcgggggggcggagtacctggtcatagcctccgtgaaggctctcaggttcgcagcgtcctcctggacaccggcgctctcacagataacgacgaggtcgtcgccatatcagcagccagggcct

SEQ ID NO: 386707 - DNA, 140 bp, Artificial Sequence
  Synthetic
atacgccatgctgggtctccctgacccgtgatcctgagactcccctcgcgcgtgccgcttgggaaacagcaagacacactccagtgaactcctggctaggcaacatcatcatgtttgccccgtacttgggagtcggccat

SEQ ID NO: 386708 - DNA, 140 bp, Artificial Sequence
  Synthetic
atggccgactcccaagtacggggcaaacatgatgatgttgcctagccaggagttcactggagtgtgtcttgctgtttcccaagcggcacgcgcgaggggagtctcaggatcacgggtcagggagacccagcatggcgtat

SEQ ID NO: 386709 - DNA, 140 bp, Artificial Sequence
  Synthetic
aggccctggctgctgatatgagggtggctgcatgcctcaggaaacttggggttccgcccttgcgagcttggagacaccgggcccggagcgtccgcgccacactcctatcccagggggggagaccttttgggacagcggtg

SEQ ID NO: 386710 - DNA, 140 bp, Artificial Sequence
  Synthetic
caccgctgtcccaaaaggtctccccccctgggataggagtgtggcgcggacgctccgggcccggtgtctccaagctcgcaagggcggaaccccaagtttcctgaggcatgcagccaccctcatatcagcagccagggcct

SEQ ID NO: 386711 - DNA, 140 bp, Artificial Sequence
  Synthetic
atacgccatgctgggtctcctggcacatcaataggacggccttgaactgcaacagtagccttgaaaccggctgggtagcagggctactctattacaataaatacaacttatcaggctgtccgtacttgggagtcggccat

SEQ ID NO: 386712 - DNA, 140 bp, Artificial Sequence
  Synthetic
atggccgactcccaagtacggacagcctgataagttgtatttattgtaatagagtagccctgctacccagccggtttcaaggctactgttgcagttcaaggccgtcctattgatgtgccaggagacccagcatggcgtat

SEQ ID NO: 386713 - DNA, 140 bp, Artificial Sequence
  Synthetic
atacgccatgctgggtctcctccctgcttcggccgtcgaagtgcgcaactcttcggggatctaccatgtcaccaatgattgccccaatgcgtctgttgtgtacgagacagatagcttgatcgtacttgggagtcggccat

SEQ ID NO: 386714 - DNA, 140 bp, Artificial Sequence
  Synthetic
atggccgactcccaagtacgatcaagctatctgtctcgtacacaacagacgcattggggcaatcattggtgacatggtagatccccgaagagttgcgcacttcgacggccgaagcagggaggagacccagcatggcgtat

SEQ ID NO: 386715 - DNA, 140 bp, Artificial Sequence
  Synthetic
atacgccatgctgggtctccggtcttggcgggtcttgcctactattccatggcgggaaactgggctaaggttttgattgtgatgctactttttgccggcgttgacgggaagaccatgatacgtacttgggagtcggccat

SEQ ID NO: 386716 - DNA, 140 bp, Artificial Sequence
  Synthetic
atggccgactcccaagtacgtatcatggtcttcccgtcaacgccggcaaaaagtagcatcacaatcaaaaccttagcccagtttcccgccatggaatagtaggcaagacccgccaagaccggagacccagcatggcgtat

SEQ ID NO: 386717 - DNA, 140 bp, Artificial Sequence
  Synthetic
atacgccatgctgggtctccggtgctgggtctcccttagtcctactgttgccgctaaggatccgggcgtccccgtcaacgagattcggcgtcacgtcgacctgattgtcggggccgctgccgtacttgggagtcggccat

SEQ ID NO: 386718 - DNA, 140 bp, Artificial Sequence
  Synthetic
atggccgactcccaagtacggcagcggccccgacaatcaggtcgacgtgacgccgaatctcgttgacggggacgcccggatccttagcggcaacagtaggactaagggagacccagcaccggagacccagcatggcgtat

SEQ ID NO: 386719 - DNA, 140 bp, Artificial Sequence
  Synthetic
atacgccatgctgggtctccattctgttcggctatgtatgtaggggacttatgcggttccatcttcctcgttggccagcttttcaccctctcccctaggcgccactggacaacacaagaccgtacttgggagtcggccat

SEQ ID NO: 386720 - DNA, 140 bp, Artificial Sequence
  Synthetic
atggccgactcccaagtacggtcttgtgttgtccagtggcgcctaggggagagggtgaaaagctggccaacgaggaagatggaaccgcataagtcccctacatacatagccgaacagaatggagacccagcatggcgtat

SEQ ID NO: 386721 - DNA, 140 bp, Artificial Sequence
  Synthetic
atacgccatgctgggtctcctccaccggccccagccaaaatatccagctcataaactccaatggcagctggcacattaacaggactgccctgaattgcaatgacagcctgcacaccggctcgtacttgggagtcggccat

SEQ ID NO: 386722 - DNA, 140 bp, Artificial Sequence
  Synthetic
atggccgactcccaagtacgagccggtgtgcaggctgtcattgcaattcagggcagtcctgttaatgtgccagctgccattggagtttatgagctggatattttggctggggccggtggaggagacccagcatggcgtat

SEQ ID NO: 386723 - DNA, 140 bp, Artificial Sequence
  Synthetic
atacgccatgctgggtctccgcccatcacttacggggggaaagctagtaacgaccagcggccgtattgctggcactatgccccacgcccgtgcggtatcgtgccggcgaaagaggtttgccgtacttgggagtcggccat

SEQ ID NO: 386724 - DNA, 140 bp, Artificial Sequence
  Synthetic
atggccgactcccaagtacggcaaacctctttcgccggcacgataccgcacgggcgtggggcatagtgccagcaatacggccgctggtcgttactagctttccccccgtaagtgatgggcggagacccagcatggcgtat

SEQ ID NO: 386725 - DNA, 140 bp, Artificial Sequence
  Synthetic
atacgccatgctgggtctcctgctccttaacaactctaggccgccaatagggaattggttcgggtgtacgtggatgaattccactggtttcaccaagacgtgcggggctcctgcctgtaacgtacttgggagtcggccat

SEQ ID NO: 386726 - DNA, 140 bp, Artificial Sequence
  Synthetic
atggccgactcccaagtacgttacaggcaggagccccgcacgtcttggtgaaaccagtggaattcatccacgtacacccgaaccaattccctattggcggcctagagttgttaaggagcaggagacccagcatggcgtat

SEQ ID NO: 386727 - DNA, 140 bp, Artificial Sequence
  Synthetic
atacgccatgctgggtctccgcagacatccggacgcaacatacgctaagtgcggctctggcccttggcttaaccctcgatgcatggtggactacccttacaggctctggcactatccctgcgtacttgggagtcggccat

SEQ ID NO: 386728 - DNA, 140 bp, Artificial Sequence
  Synthetic
atggccgactcccaagtacgcagggatagtgccagagcctgtaagggtagtccaccatgcatcgagggttaagccaagggccagagccgcacttagcgtatgttgcgtccggatgtctgcggagacccagcatggcgtat

SEQ ID NO: 386729 - DNA, 140 bp, Artificial Sequence
  Synthetic
atacgccatgctgggtctccccaacttgtaaacactaacggcagctggcacatcaataggactgccctcaattgcaatgactcccttaacaccgggttccttgccgcgctgttctacacccgtacttgggagtcggccat

SEQ ID NO: 386730 - DNA, 140 bp, Artificial Sequence
  Synthetic
atggccgactcccaagtacgggtgtagaacagcgcggcaaggaacccggtgttaagggagtcattgcaattgagggcagtcctattgatgtgccagctgccgttagtgtttacaagttggggagacccagcatggcgtat

SEQ ID NO: 386731 - DNA, 140 bp, Artificial Sequence
  Synthetic
atacgccatgctgggtctccacatctcggaccagaggccctattgctggcactacgcgcctcgaccgtgtggtatcgtacccgcgtcgcaggtgtgtggtccggtgtattgcttcacccccgtacttgggagtcggccat

SEQ ID NO: 386732 - DNA, 140 bp, Artificial Sequence
  Synthetic
atggccgactcccaagtacgggggtgaagcaatacaccggaccacacacctgcgacgcgggtacgataccacacggtcgaggcgcgtagtgccagcaatagggcctctggtccgagatgtggagacccagcatggcgtat

SEQ ID NO: 386733 - DNA, 140 bp, Artificial Sequence
  Synthetic
atacgccatgctgggtctccgctccttttcttgctgttagcagatgcccgcatttgtgcctgcctttggatgatgcttctcatatcccaggtagaggcggcgctggagaacctgatagtccgtacttgggagtcggccat

SEQ ID NO: 386734 - DNA, 140 bp, Artificial Sequence
  Synthetic
atggccgactcccaagtacggactatcaggttctccagcgccgcctctacctgggatatgagaagcatcatccaaaggcaggcacaaatgcgggcatctgctaacagcaagaaaaggagcggagacccagcatggcgtat

SEQ ID NO: 386735 - DNA, 140 bp, Artificial Sequence
  Synthetic
atacgccatgctgggtctcctctactccgtctacggaatgtggccgctgctcctgcttctcctggcgttgccccaacgggcgtacgccttggatcaggagttggccgcgtcgtgtggggccgtacttgggagtcggccat

SEQ ID NO: 386736 - DNA, 140 bp, Artificial Sequence
  Synthetic
atggccgactcccaagtacggccccacacgacgcggccaactcctgatccaaggcgtacgcccgttggggcaacgccaggagaagcaggagcagcggccacattccgtagacggagtagaggagacccagcatggcgtat

SEQ ID NO: 386737 - DNA, 140 bp, Artificial Sequence
  Synthetic
atacgccatgctgggtctccagtacatggcccgcggcatctggtggctgcagtacatgctgaccagagcggaggcgctcctgcacgtctgggtcccctcgctcaacgcccggggagggcgcgtacttgggagtcggccat

SEQ ID NO: 386738 - DNA, 140 bp, Artificial Sequence
  Synthetic
atggccgactcccaagtacgcgccctccccgggcgttgagcgaggggacccagacgtgcaggagcgcctccgctctggtcagcatgtactgcagccaccagatgccgcgggccatgtactggagacccagcatggcgtat

SEQ ID NO: 386739 - DNA, 140 bp, Artificial Sequence
  Synthetic
atacgccatgctgggtctcccaccgagcccgtcatcttctcccggatggagatcaagactatcacctggggggcagacaccgcggcctgtggagacatcatcaacgggctgcctgtttctcgtacttgggagtcggccat

SEQ ID NO: 386740 - DNA, 140 bp, Artificial Sequence
  Synthetic
atggccgactcccaagtacgagaaacaggcagcccgttgatgatgtctccacaggccgcggtgtctgccccccaggtgatagtcttgatctccatccgggagaagatgacgggctcggtgggagacccagcatggcgtat

SEQ ID NO: 386741 - DNA, 140 bp, Artificial Sequence
  Synthetic
aggccctggctgctgatatgccgggagatggctgcatcgtgcggaggcgcggtttttgtaggtctggtactcttgaccttgtcaccatactacaaagtgttcctcgctaagctcatatgggaccttttgggacagcggtg

SEQ ID NO: 386742 - DNA, 140 bp, Artificial Sequence
  Synthetic
caccgctgtcccaaaaggtcccatatgagcttagcgaggaacactttgtagtatggtgacaaggtcaagagtaccagacctacaaaaaccgcgcctccgcacgatgcagccatctcccggcatatcagcagccagggcct

SEQ ID NO: 386743 - DNA, 140 bp, Artificial Sequence
  Synthetic
atacgccatgctgggtctccggggcaggggtggcgactcctcgcgcctatcacggcctactcccagcagacgcgaggcctacttggttgcatcatcactagtctcacaggtcgggacaagcgtacttgggagtcggccat

SEQ ID NO: 386744 - DNA, 140 bp, Artificial Sequence
  Synthetic
atggccgactcccaagtacgcttgtcccgacctgtgagactagtgatgatgcaaccaagtaggcctcgcgtctgctgggagtaggccgtgataggcgcgaggagtcgccacccctgccccggagacccagcatggcgtat

SEQ ID NO: 386745 - DNA, 140 bp, Artificial Sequence
  Synthetic
atacgccatgctgggtctccctgaacccgtctgttgctgccaccttagggttcggtgcttatatgtcaaaggcccatgggattgacccaaacgtcaggaccggcgtgaggaccattaccacgtacttgggagtcggccat

SEQ ID NO: 386746 - DNA, 140 bp, Artificial Sequence
  Synthetic
atggccgactcccaagtacgtggtaatggtcctcacgccggtcctgacgtttgggtcaatcccatgggcctttgacatataagcaccgaaccctaaggtggcagcaacagacgggttcagggagacccagcatggcgtat

SEQ ID NO: 386747 - DNA, 140 bp, Artificial Sequence
  Synthetic
atacgccatgctgggtctccagtggacgccacctcgattctgggcatagggaccgtcttggaccaagcggagacggcgggggttaggctcactgtccttgccaccgctacaccacctggccgtacttgggagtcggccat

SEQ ID NO: 386748 - DNA, 140 bp, Artificial Sequence
  Synthetic
atggccgactcccaagtacggccaggtggtgtagcggtggcaaggacagtgagcctaacccccgccgtctccgcttggtccaagacggtccctatgcccagaatcgaggtggcgtccactggagacccagcatggcgtat

SEQ ID NO: 386749 - DNA, 140 bp, Artificial Sequence
  Synthetic
atacgccatgctgggtctccgggggaggcatctcattttctgtcattccaagaagaagtgcgacgagctcgctgcaaagctggtcggtctgggcgtcaacgcggtggccttttaccgtggcgtacttgggagtcggccat

SEQ ID NO: 386750 - DNA, 140 bp, Artificial Sequence
  Synthetic
atggccgactcccaagtacgccacggtaaaaggccaccgcgttgacgcccagaccgaccagctttgcagcgagctcgtcgcacttcttcttggaatgacagaaaatgagatgcctcccccggagacccagcatggcgtat

SEQ ID NO: 386751 - DNA, 140 bp, Artificial Sequence
  Synthetic
aggccctggctgctgatatggcatcttccgggctgccgtgtgcacccggggggttgcgaaggcggtggactttgtgcccgttgagtctatggaaaccaccatgcggtctccggtcttcacgaccttttgggacagcggtg

SEQ ID NO: 386752 - DNA, 140 bp, Artificial Sequence
  Synthetic
caccgctgtcccaaaaggtcgtgaagaccggagaccgcatggtggtttccatagactcaacgggcacaaagtccaccgccttcgcaaccccccgggtgcacacggcagcccggaagatgccatatcagcagccagggcct

SEQ ID NO: 386753 - DNA, 140 bp, Artificial Sequence
  Synthetic
aggccctggctgctgatatgccatggtggggaactgggcgaagaccctggtagtgctgttgctgtttgccagcgttgatgcggaaaccaccgtcaccggggggacagctgctcgaattacgaccttttgggacagcggtg

SEQ ID NO: 386754 - DNA, 140 bp, Artificial Sequence
  Synthetic
caccgctgtcccaaaaggtcgtaattcgagcagctgtccccccggtgacggtggtttccgcatcaacgctggcaaacagcaacagcactaccagggtcttcgcccagttccccaccatggcatatcagcagccagggcct

SEQ ID NO: 386755 - DNA, 140 bp, Artificial Sequence
  Synthetic
aggccctggctgctgatatggtgttgacgtccatgctcactgatccctcccacataacagcagagacggccaagagaaggttggcgaggggatcacccccttctatggccagctcttcgggaccttttgggacagcggtg

SEQ ID NO: 386756 - DNA, 140 bp, Artificial Sequence
  Synthetic
caccgctgtcccaaaaggtcccgaagagctggccatagaagggggtgatcccctcgccaaccttctcttggccgtctctgctgttatgtgggagggatcagtgagcatggacgtcaacaccatatcagcagccagggcct

SEQ ID NO: 386757 - DNA, 140 bp, Artificial Sequence
  Synthetic
aggccctggctgctgatatgaacgcgagccttgacaccggctggctagcggggctcttctacgtcaacaaattcaactcttcaggctgttctgagaggttggccagctgcaaacccctcggaccttttgggacagcggtg

SEQ ID NO: 386758 - DNA, 140 bp, Artificial Sequence
  Synthetic
caccgctgtcccaaaaggtccgaggggtttgcagctggccaacctctcagaacagcctgaagagttgaatttgttgacgtagaagagccccgctagccagccggtgtcaaggctcgcgttcatatcagcagccagggcct

SEQ ID NO: 386759 - DNA, 140 bp, Artificial Sequence
  Synthetic
atacgccatgctgggtctccgagtttgatgagatggaggagtgcgccgcccacgtcccctacctcgagcaggggatgcatttggctggacagttcaagcagaaagctctcgggttgctcccgtacttgggagtcggccat

SEQ ID NO: 386760 - DNA, 140 bp, Artificial Sequence
  Synthetic
atggccgactcccaagtacgggagcaacccgagagctttctgcttgaactgtccagccaaatgcatcccctgctcgaggtaggggacgtgggcggcgcactcctccatctcatcaaactcggagacccagcatggcgtat

SEQ ID NO: 386761 - DNA, 140 bp, Artificial Sequence
  Synthetic
atacgccatgctgggtctcctggcagaaactcgagtccttctgggctaagcacatgtggaacttcgttagcgggatacaatacctggcgggcctgtcaacgctgcccgggaaccccgctacgtacttgggagtcggccat

SEQ ID NO: 386762 - DNA, 140 bp, Artificial Sequence
  Synthetic
atggccgactcccaagtacgtagcggggttcccgggcagcgttgacaggcccgccaggtattgtatcccgctaacgaagttccacatgtgcttagcccagaaggactcgagtttctgccaggagacccagcatggcgtat

SEQ ID NO: 386763 - DNA, 140 bp, Artificial Sequence
  Synthetic
atacgccatgctgggtctccggctacggggctggtgtggcgggggccctcgtggctttcaaaatcatgagcggggagacccccaccaccgaggatctagtcaaccttctgcctgccatcccgtacttgggagtcggccat

SEQ ID NO: 386764 - DNA, 140 bp, Artificial Sequence
  Synthetic
atggccgactcccaagtacgggatggcaggcagaaggttgactagatcctcggtggtgggggtctccccgctcatgattttgaaagccacgagggcccccgccacaccagccccgtagccggagacccagcatggcgtat

SEQ ID NO: 386765 - DNA, 140 bp, Artificial Sequence
  Synthetic
aggccctggctgctgatatggacgcggggcgagcgttgtgatctggaagacagggacaggtccgagctcagtccgctgctgctgtccactacgcagtggcaggtcctcccatgctccttcgaccttttgggacagcggtg

SEQ ID NO: 386766 - DNA, 140 bp, Artificial Sequence
  Synthetic
caccgctgtcccaaaaggtcgaaggagcatgggaggacctgccactgcgtagtggacagcagcagcggactgagctcggacctgtccctgtcttccagatcacaacgctcgccccgcgtccatatcagcagccagggcct

SEQ ID NO: 386767 - DNA, 140 bp, Artificial Sequence
  Synthetic
atacgccatgctgggtctccactcagcttctgaaaaggctccacgtgtggataagctcggattgcatcgccccgtgtgctagttcttggcttaaagatgtctgggactggatatgcgaggcgtacttgggagtcggccat

SEQ ID NO: 386768 - DNA, 140 bp, Artificial Sequence
  Synthetic
atggccgactcccaagtacgcctcgcatatccagtcccagacatctttaagccaagaactagcacacggggcgatgcaatccgagcttatccacacgtggagccttttcagaagctgagtggagacccagcatggcgtat

SEQ ID NO: 386769 - DNA, 140 bp, Artificial Sequence
  Synthetic
atacgccatgctgggtctccgggcgagggcatcgtgcacactcgttgcccgtgtggggccaatataactggacatgtcaagaacggttcgatgagaatcgtcgggcctaagacttgcagccgtacttgggagtcggccat

SEQ ID NO: 386770 - DNA, 140 bp, Artificial Sequence
  Synthetic
atggccgactcccaagtacggctgcaagtcttaggcccgacgattctcatcgaaccgttcttgacatgtccagttatattggccccacacgggcaacgagtgtgcacgatgccctcgcccggagacccagcatggcgtat

SEQ ID NO: 386771 - DNA, 140 bp, Artificial Sequence
  Synthetic
atacgccatgctgggtctccctctccagacgctgacctcatagaagccaacctcctgtggagacaggagatgggggggaacatcactagggtggagtcggagaacaagattgtcgttctgcgtacttgggagtcggccat

SEQ ID NO: 386772 - DNA, 140 bp, Artificial Sequence
  Synthetic
atggccgactcccaagtacgcagaacgacaatcttgttctccgactccaccctagtgatgttcccccccatctcctgtctccacaggaggttggcttctatgaggtcagcgtctggagagggagacccagcatggcgtat

SEQ ID NO: 386773 - DNA, 140 bp, Artificial Sequence
  Synthetic
atacgccatgctgggtctccacggcgtatgcccagcagacacggggcctcttagggtgtataattaccagcctgaccggccgggacaagaaccaagtcgagggcgaggtccagattgtgtcgtacttgggagtcggccat

SEQ ID NO: 386774 - DNA, 140 bp, Artificial Sequence
  Synthetic
atggccgactcccaagtacgacacaatctggacctcgccctcgacttggttcttgtcccggccggtcaggctggtaattatacaccctaagaggccccgtgtctgctgggcatacgccgtggagacccagcatggcgtat

SEQ ID NO: 386775 - DNA, 140 bp, Artificial Sequence
  Synthetic
atacgccatgctgggtctcctatgggcacggccagattataatcctccccttgtggaaccgtggaagcgcccggactatgagccacccttagtccacgggtgccccctaccacctcccaacgtacttgggagtcggccat

SEQ ID NO: 386776 - DNA, 140 bp, Artificial Sequence
  Synthetic
atggccgactcccaagtacgttgggaggtggtagggggcacccgtggactaagggtggctcatagtccgggcgcttccacggttccacaaggggaggattataatctggccgtgcccataggagacccagcatggcgtat

SEQ ID NO: 386777 - DNA, 140 bp, Artificial Sequence
  Synthetic
atacgccatgctgggtctcctgtcatccagatgtataccaatgtagaccaagatcttgtaggctggcccgccccctacggtgcccgctcattaacaccctgcacatgcggctcctcggaccgtacttgggagtcggccat

SEQ ID NO: 386778 - DNA, 140 bp, Artificial Sequence
  Synthetic
atggccgactcccaagtacggtccgaggagccgcatgtgcagggtgttaatgagcgggcaccgtagggggcgggccagcctacaagatcttggtctacattggtatacatctggatgacaggagacccagcatggcgtat

SEQ ID NO: 386779 - DNA, 140 bp, Artificial Sequence
  Synthetic
aggccctggctgctgatatggctcctcggggggtccgctgctgtgccccgcgggacacgccgtaggcatattcagggccgcggtgtgcacccgtggagtggctaaggcggtggactttatgaccttttgggacagcggtg

SEQ ID NO: 386780 - DNA, 140 bp, Artificial Sequence
  Synthetic
caccgctgtcccaaaaggtcataaagtccaccgccttagccactccacgggtgcacaccgcggccctgaatatgcctacggcgtgtcccgcggggcacagcagcggaccccccgaggagccatatcagcagccagggcct

SEQ ID NO: 386781 - DNA, 140 bp, Artificial Sequence
  Synthetic
atacgccatgctgggtctccaggaagccaagctccctatcaacgcattgagcaactcgctgctgcgccaccacaacttggtgtattccaccacctctcgcagcgctggccagagacagaacgtacttgggagtcggccat

SEQ ID NO: 386782 - DNA, 140 bp, Artificial Sequence
  Synthetic
atggccgactcccaagtacgttctgtctctggccagcgctgcgagaggtggtggaatacaccaagttgtggtggcgcagcagcgagttgctcaatgcgttgatagggagcttggcttcctggagacccagcatggcgtat

SEQ ID NO: 386783 - DNA, 140 bp, Artificial Sequence
  Synthetic
atacgccatgctgggtctccggaggaggatgagagggaagtgtccgttgcggcggagatcctgcggaagaccaggaaattccccgcagcgatgcccgtatgggcacgcccggactacaaccgtacttgggagtcggccat

SEQ ID NO: 386784 - DNA, 140 bp, Artificial Sequence
  Synthetic
atggccgactcccaagtacggttgtagtccgggcgtgcccatacgggcatcgctgcggggaatttcctggtcttccgcaggatctccgccgcaacggacacttccctctcatcctcctccggagacccagcatggcgtat

SEQ ID NO: 386785 - DNA, 140 bp, Artificial Sequence
  Synthetic
atacgccatgctgggtctccgggcggaaacatcacccgcgtggagtcagagaataaggtagtggttctggactctttcgaaccgcttcgagcggaggcagacgagagggaaatatccgtccgtacttgggagtcggccat

SEQ ID NO: 386786 - DNA, 140 bp, Artificial Sequence
  Synthetic
atggccgactcccaagtacggacggatatttccctctcgtctgcctccgctcgaagcggttcgaaagagtccagaaccactaccttattctctgactccacgcgggtgatgtttccgcccggagacccagcatggcgtat

SEQ ID NO: 386787 - DNA, 140 bp, Artificial Sequence
  Synthetic
atacgccatgctgggtctcccggactatgtccctccagtggtacatgggtgtccattaccacccgctaaggcccctccagtgccacctccaaggagaaagaggacgattgccttgacagacgtacttgggagtcggccat

SEQ ID NO: 386788 - DNA, 140 bp, Artificial Sequence
  Synthetic
atggccgactcccaagtacgtctgtcaaggcaatcgtcctctttctccttggaggtggcactggaggggccttagcgggtggtaatggacacccatgtaccactggagggacatagtccgggagacccagcatggcgtat

SEQ ID NO: 386789 - DNA, 140 bp, Artificial Sequence
  Synthetic
aggccctggctgctgatatggatagatcagagcttagcccgctgctgctgtctacaacagagtggcaggtattgccctgttccttcaccaccctaccggctctgtccaccggcttgatccgaccttttgggacagcggtg

SEQ ID NO: 386790 - DNA, 140 bp, Artificial Sequence
  Synthetic
caccgctgtcccaaaaggtcggatcaagccggtggacagagccggtagggtggtgaaggaacagggcaatacctgccactctgttgtagacagcagcagcgggctaagctctgatctatccatatcagcagccagggcct

SEQ ID NO: 386791 - DNA, 140 bp, Artificial Sequence
  Synthetic
atacgccatgctgggtctccccactctgtgggtacggatggtcctcatgacccattttttctccatactcatagctcaggagcaccttggaaaggctctagattgtgaaatctatggagccgtacttgggagtcggccat

SEQ ID NO: 386792 - DNA, 140 bp, Artificial Sequence
  Synthetic
atggccgactcccaagtacggctccatagatttcacaatctagagcctttccaaggtgctcctgagctatgagtatggagaaaaaatgggtcatgaggaccatccgtacccacagagtggggagacccagcatggcgtat

SEQ ID NO: 386793 - DNA, 140 bp, Artificial Sequence
  Synthetic
atacgccatgctgggtctccgaagtgtcgcccgcggcgcgtttggaattaccactctttttagccctggcgccaagcagaacatccggctaatcaacaccaatggcagttggcacatcaacgtacttgggagtcggccat

SEQ ID NO: 386794 - DNA, 140 bp, Artificial Sequence
  Synthetic
atggccgactcccaagtacgttgatgtgccaactgccattggtgttgattagccggatgttctgcttggcgccagggctaaaaagagtggtaattccaaacgcgccgcgggcgacacttcggagacccagcatggcgtat

SEQ ID NO: 386795 - DNA, 140 bp, Artificial Sequence
  Synthetic
atacgccatgctgggtctccgttcacgggcggttacagcgggggagacatttatcacagcgtgtctcatgcccggccccgtttgttcctctggtgcctactcctactttcagtaggggtacgtacttgggagtcggccat

SEQ ID NO: 386796 - DNA, 140 bp, Artificial Sequence
  Synthetic
atggccgactcccaagtacgtacccctactgaaagtaggagtaggcaccagaggaacaaacggggccgggcatgagacacgctgtgataaatgtctcccccgctgtaaccgcccgtgaacggagacccagcatggcgtat

SEQ ID NO: 386797 - DNA, 140 bp, Artificial Sequence
  Synthetic
aggccctggctgctgatatgtctacgggatgtggcctctcctcctgctcctgttggcgttgccccagcgggcatacgcactggacacggaggtggccgcgtcgtgtggcggcgttgtcctgaccttttgggacagcggtg

SEQ ID NO: 386798 - DNA, 140 bp, Artificial Sequence
  Synthetic
caccgctgtcccaaaaggtcaggacaacgccgccacacgacgcggccacctccgtgtccagtgcgtatgcccgctggggcaacgccaacaggagcaggaggagaggccacatcccgtagacatatcagcagccagggcct

SEQ ID NO: 386799 - DNA, 140 bp, Artificial Sequence
  Synthetic
atacgccatgctgggtctcctctccgggggaagtgccggccgcagcacggctggacttgttgggctcttctcaccaggcgcccggcagaacatccagctgatcaacaccaacggcagttgcgtacttgggagtcggccat

SEQ ID NO: 386800 - DNA, 140 bp, Artificial Sequence
  Synthetic
atggccgactcccaagtacgcaactgccgttggtgttgatcagctggatgttctgccgggcgcctggtgagaagagcccaacaagtccagccgtgctgcggccggcacttcccccggagaggagacccagcatggcgtat

SEQ ID NO: 386801 - DNA, 140 bp, Artificial Sequence
  Synthetic
aggccctggctgctgatatggagaggttggccagctgccgaccccttgccgactttgaccagggctggggccctatcagttataccaacggaagcggccccgaccaacgcccctactgctgaccttttgggacagcggtg

SEQ ID NO: 386802 - DNA, 140 bp, Artificial Sequence
  Synthetic
caccgctgtcccaaaaggtcagcagtaggggcgttggtcggggccgcttccgttggtataactgatagggccccagccctggtcaaagtcggcaaggggtcggcagctggccaacctctccatatcagcagccagggcct

SEQ ID NO: 386803 - DNA, 140 bp, Artificial Sequence
  Synthetic
aggccctggctgctgatatgtctgctccgctatgtacgtgggggatctctgcggatctgttttccttgtctcccagctgttcaccttctcgcctcgccggcatgagacagtacaggactggaccttttgggacagcggtg

SEQ ID NO: 386804 - DNA, 140 bp, Artificial Sequence
  Synthetic
caccgctgtcccaaaaggtccagtcctgtactgtctcatgccggcgaggcgagaaggtgaacagctgggagacaaggaaaacagatccgcagagatcccccacgtacatagcggagcagacatatcagcagccagggcct

SEQ ID NO: 386805 - DNA, 140 bp, Artificial Sequence
  Synthetic
atacgccatgctgggtctccttttgattgtgatgctactctttgccggcgttgacgggtccacctacgcgacaggggcggcgacaggccgttccacccacgggctggtgggccttttttccgtacttgggagtcggccat

SEQ ID NO: 386806 - DNA, 140 bp, Artificial Sequence
  Synthetic
atggccgactcccaagtacggaaaaaaggcccaccagcccgtgggtggaacggcctgtcgccgcccctgtcgcgtaggtggacccgtcaacgccggcaaagagtagcatcacaatcaaaaggagacccagcatggcgtat

SEQ ID NO: 386807 - DNA, 140 bp, Artificial Sequence
  Synthetic
aggccctggctgctgatatgggatccggatctcagcgacgggtcatggtcgacggtcagtagtgaggctggcacggaggatgtcgtgtgctgctcaatgtcttactcctggacaggcgcagaccttttgggacagcggtg

SEQ ID NO: 386808 - DNA, 140 bp, Artificial Sequence
  Synthetic
caccgctgtcccaaaaggtctgcgcctgtccaggagtaagacattgagcagcacacgacatcctccgtgccagcctcactactgaccgtcgaccatgacccgtcgctgagatccggatcccatatcagcagccagggcct

SEQ ID NO: 386809 - DNA, 140 bp, Artificial Sequence
  Synthetic
aggccctggctgctgatatgcttgccgcgctgttctacacatccaggttcaactcgtccggatgcccagagcgtatggccagctgccgctccattgacaagttcgatcaggggtggggtcgaccttttgggacagcggtg

SEQ ID NO: 386810 - DNA, 140 bp, Artificial Sequence
  Synthetic
caccgctgtcccaaaaggtcgaccccacccctgatcgaacttgtcaatggagcggcagctggccatacgctctgggcatccggacgagttgaacctggatgtgtagaacagcgcggcaagcatatcagcagccagggcct

SEQ ID NO: 386811 - DNA, 140 bp, Artificial Sequence
  Synthetic
aggccctggctgctgatatgacaaagctcaaactcactccaatagcggccgctggccagctggacttgtccggctggttcacggctggctacagcgggggagacatttatcacagcgtgtgaccttttgggacagcggtg

SEQ ID NO: 386812 - DNA, 140 bp, Artificial Sequence
  Synthetic
caccgctgtcccaaaaggtcacacgctgtgataaatgtctcccccgctgtagccagccgtgaaccagccggacaagtccagctggccagcggccgctattggagtgagtttgagctttgtcatatcagcagccagggcct

SEQ ID NO: 386813 - DNA, 140 bp, Artificial Sequence
  Synthetic
atacgccatgctgggtctccgtagaccaagacctcgggggctggaccgctcctcaagtgctcggctcactgacaccctggagctgcggctcctcggacctttacctggtcacgaggcatgcgtacttgggagtcggccat

SEQ ID NO: 386814 - DNA, 140 bp, Artificial Sequence
  Synthetic
atggccgactcccaagtacgcatgcctcgtgaccaggtaaaggtccgaggagccgcagctccagggtgtcagtgagccgagcacttgaggagcggtccagcccccgaggtcttggtctacggagacccagcatggcgtat

SEQ ID NO: 386815 - DNA, 140 bp, Artificial Sequence
  Synthetic
atacgccatgctgggtctccctgtcccatgggacatgccgtgggcattttcagggccgcggtgtgcacccgtggggtcgcaaaggcggtcgactttgtgcccgttgagtccttagagacccgtacttgggagtcggccat

SEQ ID NO: 386816 - DNA, 140 bp, Artificial Sequence
  Synthetic
atggccgactcccaagtacgggtctctaaggactcaacgggcacaaagtcgaccgcctttgcgaccccacgggtgcacaccgcggccctgaaaatgcccacggcatgtcccatgggacagggagacccagcatggcgtat

SEQ ID NO: 386817 - DNA, 140 bp, Artificial Sequence
  Synthetic
aggccctggctgctgatatgatcaccaagctcttgctcgccatactcggcccgctcatggtactccaggctggtataaccaaagtgccgtactttgtgcgcgcccacgggctcattcgtggaccttttgggacagcggtg

SEQ ID NO: 386818 - DNA, 140 bp, Artificial Sequence
  Synthetic
caccgctgtcccaaaaggtccacgaatgagcccgtgggcgcgcacaaagtacggcactttggttataccagcctggagtaccatgagcgggccgagtatggcgagcaagagcttggtgatcatatcagcagccagggcct

SEQ ID NO: 386819 - DNA, 140 bp, Artificial Sequence
  Synthetic
aggccctggctgctgatatggccagctggacttgtccggctggttcacggctggttacagcgggggagacatttatcacagcgtgtctcgtgcccggccccgctggttctggttttgcctgaccttttgggacagcggtg

SEQ ID NO: 386820 - DNA, 140 bp, Artificial Sequence
  Synthetic
caccgctgtcccaaaaggtcaggcaaaaccagaaccagcggggccgggcacgagacacgctgtgataaatgtctcccccgctgtaaccagccgtgaaccagccggacaagtccagctggccatatcagcagccagggcct

SEQ ID NO: 386821 - DNA, 140 bp, Artificial Sequence
  Synthetic
atacgccatgctgggtctcccaacaccaacggcagttggcacatcaataggacggccttgaactgcaatgagagcatcaacactggctgggtagcggggctcttctactaccataaattccgtacttgggagtcggccat

SEQ ID NO: 386822 - DNA, 140 bp, Artificial Sequence
  Synthetic
atggccgactcccaagtacggaatttatggtagtagaagagccccgctacccagccagtgttgatgctctcattgcagttcaaggccgtcctattgatgtgccaactgccgttggtgttgggagacccagcatggcgtat

SEQ ID NO: 386823 - DNA, 140 bp, Artificial Sequence
  Synthetic
aggccctggctgctgatatgactcctgcttgccgcaggggtaggcatctacctcctccccaaccggtgaaggttggggtaaacactccggcctcttaggccattcctgttttttttttttgaccttttgggacagcggtg

SEQ ID NO: 386824 - DNA, 140 bp, Artificial Sequence
  Synthetic
caccgctgtcccaaaaggtcaaaaaaaaaaaacaggaatggcctaagaggccggagtgtttaccccaaccttcaccggttggggaggaggtagatgcctacccctgcggcaagcaggagtcatatcagcagccagggcct

SEQ ID NO: 386825 - DNA, 140 bp, Artificial Sequence
  Synthetic
atacgccatgctgggtctcctagcatcgctgatgtcgtttacggccgcagtgacgagtccactaaccactcagcagaccctcctctttaacatcttgggggggtggctggctgcccagctcgtacttgggagtcggccat

SEQ ID NO: 386826 - DNA, 140 bp, Artificial Sequence
  Synthetic
atggccgactcccaagtacgagctgggcagccagccacccccccaagatgttaaagaggagggtctgctgagtggttagtggactcgtcactgcggccgtaaacgacatcagcgatgctaggagacccagcatggcgtat

SEQ ID NO: 386827 - DNA, 140 bp, Artificial Sequence
  Synthetic
aggccctggctgctgatatgctcaccacccaaaataccctcctgtttaacatcttggggggatgggtggctgcccaactcgctccccccagcgctgcttcggctttcgtgggcgccggcagaccttttgggacagcggtg

SEQ ID NO: 386828 - DNA, 140 bp, Artificial Sequence
  Synthetic
caccgctgtcccaaaaggtctgccggcgcccacgaaagccgaagcagcgctggggggagcgagttgggcagccacccatccccccaagatgttaaacaggagggtattttgggtggtgagcatatcagcagccagggcct

SEQ ID NO: 386829 - DNA, 140 bp, Artificial Sequence
  Synthetic
aggccctggctgctgatatggaataaggtagtaatcctagactcttttgaccagctccgggcggaagaggatgagagggaaatatccgttgaggcggagatcctccggaaaaccaggaaggaccttttgggacagcggtg

SEQ ID NO: 386830 - DNA, 140 bp, Artificial Sequence
  Synthetic
caccgctgtcccaaaaggtccttcctggttttccggaggatctccgcctcaacggatatttccctctcatcctcttccgcccggagctggtcaaaagagtctaggattactaccttattccatatcagcagccagggcct

SEQ ID NO: 386831 - DNA, 140 bp, Artificial Sequence
  Synthetic
atacgccatgctgggtctcctacctggtggggtcccagttgccctgcgagcccgagccagacgtagcagcattaacatcaatgcttacagacccttcccacatcactgcaaagacggcggcgtacttgggagtcggccat

SEQ ID NO: 386832 - DNA, 140 bp, Artificial Sequence
  Synthetic
atggccgactcccaagtacgccgccgtctttgcagtgatgtgggaagggtctgtaagcattgatgttaatgctgctacgtctggctcgggctcgcagggcaactgggaccccaccaggtaggagacccagcatggcgtat

SEQ ID NO: 386833 - DNA, 140 bp, Artificial Sequence
  Synthetic
aggccctggctgctgatatgagatcaccggacatgtcaaaaatggctccatgaggattgttgggccaaaaacctgcagcaacacgtggcatggaacattccccatcaacgcatacaccacgaccttttgggacagcggtg

SEQ ID NO: 386834 - DNA, 140 bp, Artificial Sequence
  Synthetic
caccgctgtcccaaaaggtcgtggtgtatgcgttgatggggaatgttccatgccacgtgttgctgcaggtttttggcccaacaatcctcatggagccatttttgacatgtccggtgatctcatatcagcagccagggcct

SEQ ID NO: 386835 - DNA, 140 bp, Artificial Sequence
  Synthetic
aggccctggctgctgatatgacggcagttggcacgtcaatagaacagccttgaactgcaatgaaagcctcaacaccggctggttagcaggccttttctaccataacaaattcaactcttcgaccttttgggacagcggtg

SEQ ID NO: 386836 - DNA, 140 bp, Artificial Sequence
  Synthetic
caccgctgtcccaaaaggtcgaagagttgaatttgttatggtagaaaaggcctgctaaccagccggtgttgaggctttcattgcagttcaaggctgttctattgacgtgccaactgccgtcatatcagcagccagggcct

SEQ ID NO: 386837 - DNA, 140 bp, Artificial Sequence
  Synthetic
aggccctggctgctgatatgccaagctcatcacgtggggggcagacaccgccgcgtgcggtgacatcatcaacggcttgcccgtctccgcccgtaggggccgggagatactgctcggaccgaccttttgggacagcggtg

SEQ ID NO: 386838 - DNA, 140 bp, Artificial Sequence
  Synthetic
caccgctgtcccaaaaggtcggtccgagcagtatctcccggcccctacgggcggagacgggcaagccgttgatgatgtcaccgcacgcggcggtgtctgccccccacgtgatgagcttggcatatcagcagccagggcct

SEQ ID NO: 386839 - DNA, 140 bp, Artificial Sequence
  Synthetic
aggccctggctgctgatatggccttgtccaccggcctcatccacctccaccagaacatcgtggacgtgcagtacttgtacggggtggggtcaagcatcgcgtcctgggccattaagtggggaccttttgggacagcggtg

SEQ ID NO: 386840 - DNA, 140 bp, Artificial Sequence
  Synthetic
caccgctgtcccaaaaggtccccacttaatggcccaggacgcgatgcttgaccccaccccgtacaagtactgcacgtccacgatgttctggtggaggtggatgaggccggtggacaaggccatatcagcagccagggcct

SEQ ID NO: 386841 - DNA, 140 bp, Artificial Sequence
  Synthetic
atacgccatgctgggtctcccgcggccataaggtctctcacagagaggctttacatcgggggcccacttaccaattctaagggacaaaactgcggctatcggcgatgccgcgcaagcggccgtacttgggagtcggccat

SEQ ID NO: 386842 - DNA, 140 bp, Artificial Sequence
  Synthetic
atggccgactcccaagtacggccgcttgcgcggcatcgccgatagccgcagttttgtcccttagaattggtaagtgggcccccgatgtaaagcctctctgtgagagaccttatggccgcgggagacccagcatggcgtat

SEQ ID NO: 386843 - DNA, 140 bp, Artificial Sequence
  Synthetic
aggccctggctgctgatatggtaggggtaggcatctacctccttcccaaccgatagacggttgggcaaccactccaggcctttaggccctatttaaacactccaggcctttaggccccgtgaccttttgggacagcggtg

SEQ ID NO: 386844 - DNA, 140 bp, Artificial Sequence
  Synthetic
caccgctgtcccaaaaggtcacggggcctaaaggcctggagtgtttaaatagggcctaaaggcctggagtggttgcccaaccgtctatcggttgggaaggaggtagatgcctacccctaccatatcagcagccagggcct

SEQ ID NO: 386845 - DNA, 140 bp, Artificial Sequence
  Synthetic
aggccctggctgctgatatgacgaggcacgccgatgtcattcccgtgcgccggcggggtgatagcaggggcagcctgctttcgccccggcccatttcctacttgaaaggctcctcggggggaccttttgggacagcggtg

SEQ ID NO: 386846 - DNA, 140 bp, Artificial Sequence
  Synthetic
caccgctgtcccaaaaggtccccccgaggagcctttcaagtaggaaatgggccggggcgaaagcaggctgcccctgctatcaccccgccggcgcacgggaatgacatcggcgtgcctcgtcatatcagcagccagggcct

SEQ ID NO: 386847 - DNA, 140 bp, Artificial Sequence
  Synthetic
aggccctggctgctgatatgtagccgagtagtgttgggtcgcgaaaggccttgtggtactgcctgatagggtgcttgcgagtgccccgggaggtctcgtagaccgtgcaccgtttaaaccgaccttttgggacagcggtg

SEQ ID NO: 386848 - DNA, 140 bp, Artificial Sequence
  Synthetic
caccgctgtcccaaaaggtcggtttaaacggtgcacggtctacgagacctcccggggcactcgcaagcaccctatcaggcagtaccacaaggcctttcgcgacccaacactactcggctacatatcagcagccagggcct

SEQ ID NO: 386849 - DNA, 140 bp, Artificial Sequence
  Synthetic
atacgccatgctgggtctccaccacgaacaagcacttctgtttccccggtgatgtcgtatagactgcttgcgtggttgaaagcgacggatccgttatccgcttatgtacttcgagaagcccgtacttgggagtcggccat

SEQ ID NO: 386850 - DNA, 140 bp, Artificial Sequence
  Synthetic
atggccgactcccaagtacgggcttctcgaagtacataagcggataacggatccgtcgctttcaaccacgcaagcagtctatacgacatcaccggggaaacagaagtgcttgttcgtggtggagacccagcatggcgtat

SEQ ID NO: 386851 - DNA, 140 bp, Artificial Sequence
  Synthetic
atacgccatgctgggtctccggactatgtccccccagtggtgcatgggtgcccattaccacctactaagacccctccaataccacctccacggaggaaaaggacggttgtcctgaccgagcgtacttgggagtcggccat

SEQ ID NO: 386852 - DNA, 140 bp, Artificial Sequence
  Synthetic
atggccgactcccaagtacgctcggtcaggacaaccgtccttttcctccgtggaggtggtattggaggggtcttagtaggtggtaatgggcacccatgcaccactggggggacatagtccggagacccagcatggcgtat

SEQ ID NO: 386853 - DNA, 140 bp, Artificial Sequence
  Synthetic
atacgccatgctgggtctccccaggctgcgttggcggcctacctatggctaacgccatgggacgctagttgtgaacaaggtgtgaagagcctattgagctacataagaatcctccggccccgtacttgggagtcggccat

SEQ ID NO: 386854 - DNA, 140 bp, Artificial Sequence
  Synthetic
atggccgactcccaagtacggggccggaggattcttatgtagctcaataggctcttcacaccttgttcacaactagcgtcccatggcgttagccataggtaggccgccaacgcagcctggggagacccagcatggcgtat

SEQ ID NO: 386855 - DNA, 140 bp, Artificial Sequence
  Synthetic
atacgccatgctgggtctccccgtgtttccttttattttattgtggctgcttatggtgacaatcacagattgttatcataaagcgaattggattggccatccggtgaaagtgagactcatcgtacttgggagtcggccat

SEQ ID NO: 386856 - DNA, 140 bp, Artificial Sequence
  Synthetic
atggccgactcccaagtacgatgagtctcactttcaccggatggccaatccaattcgctttatgataacaatctgtgattgtcaccataagcagccacaataaaataaaaggaaacacggggagacccagcatggcgtat

SEQ ID NO: 386857 - DNA, 140 bp, Artificial Sequence
  Synthetic
atacgccatgctgggtctcctatacgagatggaggacgcgatcctgcatttgccggggtgcgtgccctgcgttcgcgagggcaacacctcccgatgttggatggcgctctcccccactctcgtacttgggagtcggccat

SEQ ID NO: 386858 - DNA, 140 bp, Artificial Sequence
  Synthetic
atggccgactcccaagtacgagagtgggggagagcgccatccaacatcgggaggtgttgccctcgcgaacgcagggcacgcaccccggcaaatgcaggatcgcgtcctccatctcgtataggagacccagcatggcgtat

SEQ ID NO: 386859 - DNA, 140 bp, Artificial Sequence
  Synthetic
atacgccatgctgggtctccagaagacgccaaaaacataaagaaaggcccggcgccattctatcctctagaggatggaaccgctggagagcaactgcataaggctatgaagagatacgcccgtacttgggagtcggccat

SEQ ID NO: 386860 - DNA, 140 bp, Artificial Sequence
  Synthetic
atggccgactcccaagtacgggcgtatctcttcatagccttatgcagttgctctccagcggttccatcctctagaggatagaatggcgccgggcctttctttatgtttttggcgtcttctggagacccagcatggcgtat

SEQ ID NO: 386861 - DNA, 140 bp, Artificial Sequence
  Synthetic
atacgccatgctgggtctccctttgcggagctcttttcctcgtgggtcaactgtttaccttctctccccgcaaacactggactactcaggactgcaactgttccatctatgcaggccatgcgtacttgggagtcggccat

SEQ ID NO: 386862 - DNA, 140 bp, Artificial Sequence
  Synthetic
atggccgactcccaagtacgcatggcctgcatagatggaacagttgcagtcctgagtagtccagtgtttgcggggagagaaggtaaacagttgacccacgaggaaaagagctccgcaaagggagacccagcatggcgtat

SEQ ID NO: 386863 - DNA, 140 bp, Artificial Sequence
  Synthetic
atacgccatgctgggtctcctatgattgccggatcccactggggcgttctagcggggttggcttactattccatggctggcaactgggctaaggtggtggttgtgttgctgctcttcgcgcgtacttgggagtcggccat

SEQ ID NO: 386864 - DNA, 140 bp, Artificial Sequence
  Synthetic
atggccgactcccaagtacgcgcgaagagcagcaacacaaccaccaccttagcccagttgccagccatggaatagtaagccaaccccgctagaacgccccagtgggatccggcaatcataggagacccagcatggcgtat

SEQ ID NO: 386865 - DNA, 140 bp, Artificial Sequence
  Synthetic
atacgccatgctgggtctccttgtcaacagtaatggcagttggcatatcaaccgcactgccttgaattgcaacgacagccttaacaccggctttctcgcaggcctgttctatacccacagcgtacttgggagtcggccat

SEQ ID NO: 386866 - DNA, 140 bp, Artificial Sequence
  Synthetic
atggccgactcccaagtacgctgtgggtatagaacaggcctgcgagaaagccggtgttaaggctgtcgttgcaattcaaggcagtgcggttgatatgccaactgccattactgttgacaaggagacccagcatggcgtat

SEQ ID NO: 386867 - DNA, 140 bp, Artificial Sequence
  Synthetic
atacgccatgctgggtctccactttgtaagggctcacgcgttgattaagatctgtagcctggtacgaggggtcgtgcatggcaggtactgccaaatggctctactgaagctgggggctctcgtacttgggagtcggccat

SEQ ID NO: 386868 - DNA, 140 bp, Artificial Sequence
  Synthetic
atggccgactcccaagtacgagagcccccagcttcagtagagccatttggcagtacctgccatgcacgacccctcgtaccaggctacagatcttaatcaacgcgtgagcccttacaaagtggagacccagcatggcgtat

SEQ ID NO: 386869 - DNA, 140 bp, Artificial Sequence
  Synthetic
atacgccatgctgggtctccggacagaacatcgaggaccagcggccatactgctggcactaccctccgcgaccatgcggggtggtgccggcgagtaccatctgcggcccggtttactgttcgtacttgggagtcggccat

SEQ ID NO: 386870 - DNA, 140 bp, Artificial Sequence
  Synthetic
atggccgactcccaagtacgaacagtaaaccgggccgcagatggtactcgccggcaccaccccgcatggtcgcggagggtagtgccagcagtatggccgctggtcctcgatgttctgtccggagacccagcatggcgtat

SEQ ID NO: 386871 - DNA, 140 bp, Artificial Sequence
  Synthetic
atacgccatgctgggtctcccagaccgcccggcggggcatggtttggttgcacgtggatgaacggcactgggttcaccaagacatgtggaggccctccatgtaacatcggaggttcgggccgtacttgggagtcggccat

SEQ ID NO: 386872 - DNA, 140 bp, Artificial Sequence
  Synthetic
atggccgactcccaagtacggcccgaacctccgatgttacatggagggcctccacatgtcttggtgaacccagtgccgttcatccacgtgcaaccaaaccatgccccgccgggcggtctgggagacccagcatggcgtat

SEQ ID NO: 386873 - DNA, 140 bp, Artificial Sequence
  Synthetic
atacgccatgctgggtctcctggactatccatacaggctctggcattacccttgcaccgtcaattataccatcttcaagatcaggatgtatgtgggaggggtcgagcacaggttggacgccgtacttgggagtcggccat

SEQ ID NO: 386874 - DNA, 140 bp, Artificial Sequence
  Synthetic
atggccgactcccaagtacggcgtccaacctgtgctcgacccctcccacatacatcctgatcttgaagatggtataattgacggtgcaagggtaatgccagagcctgtatggatagtccaggagacccagcatggcgtat

SEQ ID NO: 386875 - DNA, 140 bp, Artificial Sequence
  Synthetic
atacgccatgctgggtctccccctgctccttcaccaccttgcccgccatatcgaccggcctgatccacctgcaccaaaacatcgtggacgtgcagtacctatacgggatagggtcggccgcgtacttgggagtcggccat

SEQ ID NO: 386876 - DNA, 140 bp, Artificial Sequence
  Synthetic
atggccgactcccaagtacgcggccgaccctatcccgtataggtactgcacgtccacgatgttttggtgcaggtggatcaggccggtcgatatggcgggcaaggtggtgaaggagcagggggagacccagcatggcgtat

SEQ ID NO: 386877 - DNA, 140 bp, Artificial Sequence
  Synthetic
aggccctggctgctgatatgcaccaaactgctgctggccgtcttcggacccctttggattcttcaagccagtttgcttaaagtaccctactttgtgcgcgttcaaggccttctccggatcgaccttttgggacagcggtg

SEQ ID NO: 386878 - DNA, 140 bp, Artificial Sequence
  Synthetic
caccgctgtcccaaaaggtcgatccggagaaggccttgaacgcgcacaaagtagggtactttaagcaaactggcttgaagaatccaaaggggtccgaagacggccagcagcagtttggtgcatatcagcagccagggcct

SEQ ID NO: 386879 - DNA, 140 bp, Artificial Sequence
  Synthetic
atacgccatgctgggtctcctcaggcggaggcagccttggagaacctgattgtgcttaacgcggcatcactggccggggtgcacggcaccatggcctttctcatctttttctgtgccgcgcgtacttgggagtcggccat

SEQ ID NO: 386880 - DNA, 140 bp, Artificial Sequence
  Synthetic
atggccgactcccaagtacgcgcggcacagaaaaagatgagaaaggccatggtgccgtgcaccccggccagtgatgccgcgttaagcacaatcaggttctccaaggctgcctccgcctgaggagacccagcatggcgtat

SEQ ID NO: 386881 - DNA, 140 bp, Artificial Sequence
  Synthetic
atacgccatgctgggtctccccttcaaccaggagatggctgcgtcatgtggaggcgtcgtccttgtctgcctgacccttctctccctgacaccaatatacaagagactaatcattctgaccgtacttgggagtcggccat

SEQ ID NO: 386882 - DNA, 140 bp, Artificial Sequence
  Synthetic
atggccgactcccaagtacggtcagaatgattagtctcttgtatattggtgtcagggagagaagggtcaggcagacaaggacgacgcctccacatgacgcagccatctcctggttgaaggggagacccagcatggcgtat

SEQ ID NO: 386883 - DNA, 140 bp, Artificial Sequence
  Synthetic
atacgccatgctgggtctccctcatgtgtgtgctccacccgcacctggtgtttgacatcactaagtatctattggctgtccttgggcccgcttggattctacaagctagccttttgaaggcgtacttgggagtcggccat

SEQ ID NO: 386884 - DNA, 140 bp, Artificial Sequence
  Synthetic
atggccgactcccaagtacgccttcaaaaggctagcttgtagaatccaagcgggcccaaggacagccaatagatacttagtgatgtcaaacaccaggtgcgggtggagcacacacatgagggagacccagcatggcgtat

SEQ ID NO: 386885 - DNA, 140 bp, Artificial Sequence
  Synthetic
atacgccatgctgggtctccggcatggacgggcacctacatatatgatcatctctcgccgctgcgcggctgggcccacaacgggctgcgcgacctcgctgttgcggtggagcccgtggtgcgtacttgggagtcggccat

SEQ ID NO: 386886 - DNA, 140 bp, Artificial Sequence
  Synthetic
atggccgactcccaagtacgcaccacgggctccaccgcaacagcgaggtcgcgcagcccgttgtgggcccagccgcgcagcggcgagagatgatcatatatgtaggtgcccgtccatgccggagacccagcatggcgtat

SEQ ID NO: 386887 - DNA, 140 bp, Artificial Sequence
  Synthetic
atacgccatgctgggtctccaagtactcctgggaccggctgacagcctaaccagcaaaggctggcggcttctggcgccgataacagcatatgcccagcaaacaagaggcctaatgggatgcgtacttgggagtcggccat

SEQ ID NO: 386888 - DNA, 140 bp, Artificial Sequence
  Synthetic
atggccgactcccaagtacgcatcccattaggcctcttgtttgctgggcatatgctgttatcggcgccagaagccgccagcctttgctggttaggctgtcagccggtcccaggagtacttggagacccagcatggcgtat

SEQ ID NO: 386889 - DNA, 140 bp, Artificial Sequence
  Synthetic
atacgccatgctgggtctcccacatcaacaggactgccctgaactgcaatgactcccttcagactgggttcatcgccgcgctgttctacgcaaacaagttcaactcgtctgggtgctcagcgtacttgggagtcggccat

SEQ ID NO: 386890 - DNA, 140 bp, Artificial Sequence
  Synthetic
atggccgactcccaagtacgctgagcacccagacgagttgaacttgtttgcgtagaacagcgcggcgatgaacccagtctgaagggagtcattgcagttcagggcagtcctgttgatgtgggagacccagcatggcgtat

SEQ ID NO: 386891 - DNA, 140 bp, Artificial Sequence
  Synthetic
atacgccatgctgggtctcctcgccggcgcggcgacagcaggggagctctgttgagccctcggtctgtgtcctacttcaaaggttcgtccggcggcccactgctctgctcctccggacaccgtacttgggagtcggccat

SEQ ID NO: 386892 - DNA, 140 bp, Artificial Sequence
  Synthetic
atggccgactcccaagtacggtgtccggaggagcagagcagtgggccgccggacgaacctttgaagtaggacacagaccgagggctcaacagagctcccctgctgtcgccgcgccggcgaggagacccagcatggcgtat

SEQ ID NO: 386893 - DNA, 140 bp, Artificial Sequence
  Synthetic
aggccctggctgctgatatggtccagtgtattgcttcaccccgagccctgttgtggtggggacgaccgatcgttccggcgcccctacgtatacctggggggagaatgagacggacgtgctgaccttttgggacagcggtg

SEQ ID NO: 386894 - DNA, 140 bp, Artificial Sequence
  Synthetic
caccgctgtcccaaaaggtcagcacgtccgtctcattctccccccaggtatacgtaggggcgccggaacgatcggtcgtccccaccacaacagggctcggggtgaagcaatacactggaccatatcagcagccagggcct

SEQ ID NO: 386895 - DNA, 140 bp, Artificial Sequence
  Synthetic
atacgccatgctgggtctcctatacactgacaattccacccctccagccgtacctcagacctttcaggtagcgcacctgcacgccccaacggggagcgggaaaagcactaaggtgccagccgtacttgggagtcggccat

SEQ ID NO: 386896 - DNA, 140 bp, Artificial Sequence
  Synthetic
atggccgactcccaagtacggctggcaccttagtgcttttcccgctccccgttggggcgtgcaggtgcgctacctgaaaggtctgaggtacggctggaggggtggaattgtcagtgtataggagacccagcatggcgtat

SEQ ID NO: 386897 - DNA, 140 bp, Artificial Sequence
  Synthetic
atacgccatgctgggtctcccctaacatcaggaccggggtgcggaccattaccacaggggcccccattacatactccacctacggcaagttccttgctgacgggggttgttcgggaggggcgtacttgggagtcggccat

SEQ ID NO: 386898 - DNA, 140 bp, Artificial Sequence
  Synthetic
atggccgactcccaagtacgcccctcccgaacaacccccgtcagcaaggaacttgccgtaggtggagtatgtaatgggggcccctgtggtaatggtccgcaccccggtcctgatgttaggggagacccagcatggcgtat

SEQ ID NO: 386899 - DNA, 140 bp, Artificial Sequence
  Synthetic
atacgccatgctgggtctccacttgtcgtgctcgccaccgccacaccaccaggatcagtcaccgtgccccacccgaacatagaggaggtggcgttgaccaatgagggggaaatccccttccgtacttgggagtcggccat

SEQ ID NO: 386900 - DNA, 140 bp, Artificial Sequence
  Synthetic
atggccgactcccaagtacggaaggggatttccccctcattggtcaacgccacctcctctatgttcgggtggggcacggtgactgatcctggtggtgtggcggtggcgagcacgacaagtggagacccagcatggcgtat

SEQ ID NO: 386901 - DNA, 140 bp, Artificial Sequence
  Synthetic
atacgccatgctgggtctccctctcgggatcaacgccgttgcctactacagagggcttgatgtctccgttataccaaccagcggggacgtcgtcgtcgtggcgaccgacgccttgatgaccgtacttgggagtcggccat

SEQ ID NO: 386902 - DNA, 140 bp, Artificial Sequence
  Synthetic
atggccgactcccaagtacggtcatcaaggcgtcggtcgccacgacgacgacgtccccgctggttggtataacggagacatcaagccctctgtagtaggcaacggcgttgatcccgagagggagacccagcatggcgtat

SEQ ID NO: 386903 - DNA, 140 bp, Artificial Sequence
  Synthetic
atacgccatgctgggtctccacactgccccaggacgcggtgtcccgtgcgcagcggcggggtaggaccgggagggggaggctcggcgtctacaggttcgtgtcgccgggggagcgaccatcgtacttgggagtcggccat

SEQ ID NO: 386904 - DNA, 140 bp, Artificial Sequence
  Synthetic
atggccgactcccaagtacgatggtcgctcccccggcgacacgaacctgtagacgccgagcctccccctcccggtcctaccccgccgctgcgcacgggacaccgcgtcctggggcagtgtggagacccagcatggcgtat

SEQ ID NO: 386905 - DNA, 140 bp, Artificial Sequence
  Synthetic
atacgccatgctgggtctcctctaaatacaccaggattgcccgtgtgccaggaccacctggaattttgggaaggtgttttcacaggccttacccacattgacgcacactttctctctcagcgtacttgggagtcggccat

SEQ ID NO: 386906 - DNA, 140 bp, Artificial Sequence
  Synthetic
atggccgactcccaagtacgctgagagagaaagtgtgcgtcaatgtgggtaaggcctgtgaaaacaccttcccaaaattccaggtggtcctggcacacgggcaatcctggtgtatttagaggagacccagcatggcgtat

SEQ ID NO: 386907 - DNA, 140 bp, Artificial Sequence
  Synthetic
atacgccatgctgggtctccagtgcttgatcaggctaaaacctaccttgcacgggcccacccccctactgtacagactgggagctgtccagaatgaagtgactctgacgcacccagtaaccgtacttgggagtcggccat

SEQ ID NO: 386908 - DNA, 140 bp, Artificial Sequence
  Synthetic
atggccgactcccaagtacggttactgggtgcgtcagagtcacttcattctggacagctcccagtctgtacagtaggggggtgggcccgtgcaaggtaggttttagcctgatcaagcactggagacccagcatggcgtat

SEQ ID NO: 386909 - DNA, 140 bp, Artificial Sequence
  Synthetic
aggccctggctgctgatatgggcagacactgcggcgtgcggggacatcatctcgggtctacctgtttccgcccgaaggggaagggagctgctcctgggaccggccgacagttttaagggggaccttttgggacagcggtg

SEQ ID NO: 386910 - DNA, 140 bp, Artificial Sequence
  Synthetic
caccgctgtcccaaaaggtcccccttaaaactgtcggccggtcccaggagcagctcccttccccttcgggcggaaacaggtagacccgagatgatgtccccgcacgccgcagtgtctgcccatatcagcagccagggcct

SEQ ID NO: 386911 - DNA, 140 bp, Artificial Sequence
  Synthetic
atacgccatgctgggtctccgcgacgggcagcgtggtcatagtgggcagggtagtcctttccaacaaacccgcggtcatacctgacagagaagtcctctaccaggagtttgatgagatggcgtacttgggagtcggccat

SEQ ID NO: 386912 - DNA, 140 bp, Artificial Sequence
  Synthetic
atggccgactcccaagtacgccatctcatcaaactcctggtagaggacttctctgtcaggtatgaccgcgggtttgttggaaaggactaccctgcccactatgaccacgctgcccgtcgcggagacccagcatggcgtat

SEQ ID NO: 386913 - DNA, 140 bp, Artificial Sequence
  Synthetic
atacgccatgctgggtctccttagtatgagtgtcgtgcagcctccaggacccccccctcccgggagagccatagtggtctgcggaaccggtgagtacaccggaattgccaggacgaccggcgtacttgggagtcggccat

SEQ ID NO: 386914 - DNA, 140 bp, Artificial Sequence
  Synthetic
atggccgactcccaagtacgccggtcgtcctggcaattccggtgtactcaccggttccgcagaccactatggctctcccgggaggggggggtcctggaggctgcacgacactcatactaaggagacccagcatggcgtat

SEQ ID NO: 386915 - DNA, 140 bp, Artificial Sequence
  Synthetic
atacgccatgctgggtctccggccgaagcagctgctcccatcgtgcaatccaactggcagaaggtcgagaccttttgggcgaaacacatgtggaacttcattagtgggatacaatacctacgtacttgggagtcggccat

SEQ ID NO: 386916 - DNA, 140 bp, Artificial Sequence
  Synthetic
atggccgactcccaagtacgtaggtattgtatcccactaatgaagttccacatgtgtttcgcccaaaaggtctcgaccttctgccagttggattgcacgatgggagcagctgcttcggccggagacccagcatggcgtat

SEQ ID NO: 386917 - DNA, 140 bp, Artificial Sequence
  Synthetic
atacgccatgctgggtctcctcaatatcctgggaggctgggtggctgcccagctcgcagccccgagcgctgcctcggcattcgtgggcgccggcattgtcggcgccgccgttggtagcatcgtacttgggagtcggccat

SEQ ID NO: 386918 - DNA, 140 bp, Artificial Sequence
  Synthetic
atggccgactcccaagtacgatgctaccaacggcggcgccgacaatgccggcgcccacgaatgccgaggcagcgctcggggctgcgagctgggcagccacccagcctcccaggatattgaggagacccagcatggcgtat

SEQ ID NO: 386919 - DNA, 140 bp, Artificial Sequence
  Synthetic
atacgccatgctgggtctccactgaagacctagtcaacctgctgccggccatcctatcgcctggagcccttgtggtaggcgtcgtgtgcgcagccatactgcgccgccacgtgggcccagcgtacttgggagtcggccat

SEQ ID NO: 386920 - DNA, 140 bp, Artificial Sequence
  Synthetic
atggccgactcccaagtacgctgggcccacgtggcggcgcagtatggctgcgcacacgacgcctaccacaagggctccaggcgataggatggccggcagcaggttgactaggtcttcagtggagacccagcatggcgtat

SEQ ID NO: 386921 - DNA, 140 bp, Artificial Sequence
  Synthetic
atacgccatgctgggtctccgcgcgtcacagccatcctcagttctctcacagtcacccaactgttgaggcgacttcacacatggatcaatgaggactgcaccacgccgtgctccggttcccgtacttgggagtcggccat

SEQ ID NO: 386922 - DNA, 140 bp, Artificial Sequence
  Synthetic
atggccgactcccaagtacgggaaccggagcacggcgtggtgcagtcctcattgatccatgtgtgaagtcgcctcaacagttgggtgactgtgagagaactgaggatggctgtgacgcgcggagacccagcatggcgtat

SEQ ID NO: 386923 - DNA, 140 bp, Artificial Sequence
  Synthetic
atacgccatgctgggtctcctgtcctgccaacgcgggtacaggggggtttggcggggggacggtattatgaacaccacctgcccctgcggagcgcagctaacaggacatgtcaagaatggcgtacttgggagtcggccat

SEQ ID NO: 386924 - DNA, 140 bp, Artificial Sequence
  Synthetic
atggccgactcccaagtacgccattcttgacatgtcctgttagctgcgctccgcaggggcaggtggtgttcataataccgtccccccgccaaacccccctgtacccgcgttggcaggacaggagacccagcatggcgtat

SEQ ID NO: 386925 - DNA, 140 bp, Artificial Sequence
  Synthetic
atacgccatgctgggtctccccgaactactcgcgcgcgttgtggcgggtgtctgcagaggaatacgtggaagtgaggcgagtgggcgatttccactacgtgacgggcatgacaacagacacgtacttgggagtcggccat

SEQ ID NO: 386926 - DNA, 140 bp, Artificial Sequence
  Synthetic
atggccgactcccaagtacgtgtctgttgtcatgcccgtcacgtagtggaaatcgcccactcgcctcacttccacgtattcctctgcagacacccgccacaacgcgcgcgagtagttcggggagacccagcatggcgtat

SEQ ID NO: 386927 - DNA, 140 bp, Artificial Sequence
  Synthetic
atacgccatgctgggtctccagacgaggtcagcttccaagttggcctcaactcctatgtggtggggtctcagctgccttgtgaacccgagccggacgtagctgtactaacgtctatgctccgtacttgggagtcggccat

SEQ ID NO: 386928 - DNA, 140 bp, Artificial Sequence
  Synthetic
atggccgactcccaagtacggagcatagacgttagtacagctacgtccggctcgggttcacaaggcagctgagaccccaccacataggagttgaggccaacttggaagctgacctcgtctggagacccagcatggcgtat

SEQ ID NO: 386929 - DNA, 140 bp, Artificial Sequence
  Synthetic
aggccctggctgctgatatgcccctactgctggcactaccctccaagaccttgtggtattgtgcccgcaaagaacgtgtgtggcccggtatattgcttcactcccagccctgtggcggtggaccttttgggacagcggtg

SEQ ID NO: 386930 - DNA, 140 bp, Artificial Sequence
  Synthetic
caccgctgtcccaaaaggtccaccgccacagggctgggagtgaagcaatataccgggccacacacgttctttgcgggcacaataccacaaggtcttggagggtagtgccagcagtaggggcatatcagcagccagggcct

SEQ ID NO: 386931 - DNA, 140 bp, Artificial Sequence
  Synthetic
aggccctggctgctgatatggggatcaaatgtggaagtgtctcatacggctaaagcctacgctgcacgggccaacacccctgctgtataggctaggagccgttcaaaatgaggtcaccctgaccttttgggacagcggtg

SEQ ID NO: 386932 - DNA, 140 bp, Artificial Sequence
  Synthetic
caccgctgtcccaaaaggtcagggtgacctcattttgaacggctcctagcctatacagcaggggtgttggcccgtgcagcgtaggctttagccgtatgagacacttccacatttgatccccatatcagcagccagggcct

SEQ ID NO: 386933 - DNA, 140 bp, Artificial Sequence
  Synthetic
atacgccatgctgggtctccaggaagaccaagaaatttcctcctagcttgcccgtctgggcttcacccagctacaacccaccattgctcgagtcatggaaaaaacccgactacgagccgccgtacttgggagtcggccat

SEQ ID NO: 386934 - DNA, 140 bp, Artificial Sequence
  Synthetic
atggccgactcccaagtacggcggctcgtagtcgggttttttccatgactcgagcaatggtgggttgtagctgggtgaagcccagacgggcaagctaggaggaaatttcttggtcttcctggagacccagcatggcgtat

SEQ ID NO: 386935 - DNA, 140 bp, Artificial Sequence
  Synthetic
atacgccatgctgggtctccagctcttgctgagcttgcggagaagtcctttggccagtcgacaacttcgggagtcgccagcggcacgtcgtcctcggcgccggaggaggagccccgcgagcgtacttgggagtcggccat

SEQ ID NO: 386936 - DNA, 140 bp, Artificial Sequence
  Synthetic
atggccgactcccaagtacgctcgcggggctcctcctccggcgccgaggacgacgtgccgctggcgactcccgaagttgtcgactggccaaaggacttctccgcaagctcagcaagagctggagacccagcatggcgtat

SEQ ID NO: 386937 - DNA, 140 bp, Artificial Sequence
  Synthetic
aggccctggctgctgatatgggaatgcagctcgccgagcaattcaagcagaaggcgctcgggttgctgcaaacagccaccaagcaagcggaggctgctgctcccgtggtggagtccaagtgaccttttgggacagcggtg

SEQ ID NO: 386938 - DNA, 140 bp, Artificial Sequence
  Synthetic
caccgctgtcccaaaaggtcacttggactccaccacgggagcagcagcctccgcttgcttggtggctgtttgcagcaacccgagcgccttctgcttgaattgctcggcgagctgcattcccatatcagcagccagggcct

SEQ ID NO: 386939 - DNA, 140 bp, Artificial Sequence
  Synthetic
atacgccatgctgggtctccgctccaccagcggtactgaagatgtcgtctgctgctccatgtcctactcatggacgggagccttggtgaccccgtgcgccgcagaggagaccaagctgcccgtacttgggagtcggccat

SEQ ID NO: 386940 - DNA, 140 bp, Artificial Sequence
  Synthetic
atggccgactcccaagtacgggcagcttggtctcctctgcggcgcacggggtcaccaaggctcccgtccatgagtaggacatggagcagcagacgacatcttcagtaccgctggtggagcggagacccagcatggcgtat

SEQ ID NO: 386941 - DNA, 140 bp, Artificial Sequence
  Synthetic
atacgccatgctgggtctccagactccaagtccttgatagccattacaaggacgtggtaaaggagataaaggcaaaggcgtccacagtcaaggcaaacttgctatccgttgaggaagcatcgtacttgggagtcggccat

SEQ ID NO: 386942 - DNA, 140 bp, Artificial Sequence
  Synthetic
atggccgactcccaagtacgatgcttcctcaacggatagcaagtttgccttgactgtggacgcctttgcctttatctcctttaccacgtccttgtaatggctatcaaggacttggagtctggagacccagcatggcgtat

SEQ ID NO: 386943 - DNA, 140 bp, Artificial Sequence
  Synthetic
atacgccatgctgggtctccgtggcaagacttgctggaggacaaccaaacacctattgacactaccatcatggcaaaaaatgaggttttctgcgtccaaccagaaaagggcggtaggaagcgtacttgggagtcggccat

SEQ ID NO: 386944 - DNA, 140 bp, Artificial Sequence
  Synthetic
atggccgactcccaagtacgcttcctaccgcccttttctggttggacgcagaaaacctcattttttgccatgatggtagtgtcaataggtgtttggttgtcctccagcaagtcttgccacggagacccagcatggcgtat

SEQ ID NO: 386945 - DNA, 140 bp, Artificial Sequence
  Synthetic
atacgccatgctgggtctccgctcctacgggttccagtactcaccagcgcagcgagtcgattacctggtcaaagcctggaaatcaaagaaaacccccatgggtttctcctatgacactcgcgtacttgggagtcggccat

SEQ ID NO: 386946 - DNA, 140 bp, Artificial Sequence
  Synthetic
atggccgactcccaagtacgcgagtgtcataggagaaacccatgggggttttctttgatttccaggctttgaccaggtaatcgactcgctgcgctggtgagtactggaacccgtaggagcggagacccagcatggcgtat

SEQ ID NO: 386947 - DNA, 140 bp, Artificial Sequence
  Synthetic
atacgccatgctgggtctccctcactgagagattgtacgtcggagggcccctgactaattcaaaaggggagaactgcggctatcgcaggtgtcgtgccagcggcgtcctgaccactagctcgtacttgggagtcggccat

SEQ ID NO: 386948 - DNA, 140 bp, Artificial Sequence
  Synthetic
atggccgactcccaagtacgagctagtggtcaggacgccgctggcacgacacctgcgatagccgcagttctccccttttgaattagtcaggggccctccgacgtacaatctctcagtgagggagacccagcatggcgtat

SEQ ID NO: 386949 - DNA, 140 bp, Artificial Sequence
  Synthetic
aggccctggctgctgatatgtcacggaggctatgaccaggtactcggccccccccggggacccgccccaaccggaatacgacctggagtgcataacatcatgctcctccaacgtatcagtgaccttttgggacagcggtg

SEQ ID NO: 386950 - DNA, 140 bp, Artificial Sequence
  Synthetic
caccgctgtcccaaaaggtcactgatacgttggaggagcatgatgttatgcactccaggtcgtattccggttggggcgggtccccggggggggccgagtacctggtcatagcctccgtgacatatcagcagccagggcct

SEQ ID NO: 386951 - DNA, 140 bp, Artificial Sequence
  Synthetic
atacgccatgctgggtctccaactcctggcttggcaacatcataatgtttgcccccacactgtgggtgaggatggtcttgatgacccacttcttttctatcctcattgctcaggagcaaccgtacttgggagtcggccat

SEQ ID NO: 386952 - DNA, 140 bp, Artificial Sequence
  Synthetic
atggccgactcccaagtacggttgctcctgagcaatgaggatagaaaagaagtgggtcatcaagaccatcctcacccacagtgtgggggcaaacattatgatgttgccaagccaggagttggagacccagcatggcgtat

SEQ ID NO: 386953 - DNA, 140 bp, Artificial Sequence
  Synthetic
aggccctggctgctgatatggcccgctcactgacaccttgcacctgcggctcctcggacctttatctggtcacgaggcatgccgatgtcattcccgtgcgccggcggggtgatagcaggggaccttttgggacagcggtg

SEQ ID NO: 386954 - DNA, 140 bp, Artificial Sequence
  Synthetic
caccgctgtcccaaaaggtcccctgctatcaccccgccggcgcacgggaatgacatcggcatgcctcgtgaccagataaaggtccgaggagccgcaggtgcaaggtgtcagtgagcgggccatatcagcagccagggcct

SEQ ID NO: 386955 - DNA, 140 bp, Artificial Sequence
  Synthetic
atacgccatgctgggtctccttcactccacagttactctccaagtgaaatcaatagggtggccgcttgcctcaggaaacttggggtgccgcccttgcgaacctggagacaccgagcccgacgtacttgggagtcggccat

SEQ ID NO: 386956 - DNA, 140 bp, Artificial Sequence
  Synthetic
atggccgactcccaagtacgtcgggctcggtgtctccaggttcgcaagggcggcaccccaagtttcctgaggcaagcggccaccctattgatttcacttggagagtaactgtggagtgaaggagacccagcatggcgtat

SEQ ID NO: 386957 - DNA, 140 bp, Artificial Sequence
  Synthetic
aggccctggctgctgatatggccccgaccagcgcccctattgctggcactaccccccaagaccttgtggtattgtgcccgcaaagagcgtgtgtggcccggtatattgcttcactcccaggaccttttgggacagcggtg

SEQ ID NO: 386958 - DNA, 140 bp, Artificial Sequence
  Synthetic
caccgctgtcccaaaaggtcctgggagtgaagcaatataccgggccacacacgctctttgcgggcacaataccacaaggtcttggggggtagtgccagcaataggggcgctggtcggggccatatcagcagccagggcct

SEQ ID NO: 386959 - DNA, 140 bp, Artificial Sequence
  Synthetic
atacgccatgctgggtctcctgccagccgctgcacagttggacttgtccaattggttcacggccggtttcagcgggggggacatatatcacagcgtgtcccatgctcggccccgcctcttcgtacttgggagtcggccat

SEQ ID NO: 386960 - DNA, 140 bp, Artificial Sequence
  Synthetic
atggccgactcccaagtacgaagaggcggggccgagcatgggacacgctgtgatatatgtcccccccgctgaaaccggccgtgaaccaattggacaagtccaactgtgcagcggctggcaggagacccagcatggcgtat

SEQ ID NO: 386961 - DNA, 140 bp, Artificial Sequence
  Synthetic
atacgccatgctgggtctccccaaccgataggtggggagttaaacactccagcctcataggctaatcctgttttttttttttttttttttttttttttttttccttttccttttcttttccgtacttgggagtcggccat

SEQ ID NO: 386962 - DNA, 140 bp, Artificial Sequence
  Synthetic
atggccgactcccaagtacggaaaagaaaaggaaaaggaaaaaaaaaaaaaaaaaaaaaaaaaaaaaaaacaggattagcctatgaggctggagtgtttaactccccacctatcggttggggagacccagcatggcgtat

SEQ ID NO: 386963 - DNA, 140 bp, Artificial Sequence
  Synthetic
aggccctggctgctgatatgaaggtccgtgagccgcttgactgcagagagtgctgatactggcctctctgcagatcaagtactactagtccctttagtgagggttaattcaattcttgaagaccttttgggacagcggtg

SEQ ID NO: 386964 - DNA, 140 bp, Artificial Sequence
  Synthetic
caccgctgtcccaaaaggtcttcaagaattgaattaaccctcactaaagggactagtagtacttgatctgcagagaggccagtatcagcactctctgcagtcaagcggctcacggaccttcatatcagcagccagggcct

SEQ ID NO: 386965 - DNA, 140 bp, Artificial Sequence
  Synthetic
atacgccatgctgggtctccaacccctatttgtttatttttctaaatacattcaaatatgtatccgctcatgagacaataaccctgataaatgcttcaataatattgaaaaaggaagagtcgtacttgggagtcggccat

SEQ ID NO: 386966 - DNA, 140 bp, Artificial Sequence
  Synthetic
atggccgactcccaagtacgactcttcctttttcaatattattgaagcatttatcagggttattgtctcatgagcggatacatatttgaatgtatttagaaaaataaacaaataggggttggagacccagcatggcgtat

SEQ ID NO: 386967 - DNA, 140 bp, Artificial Sequence
  Synthetic
atacgccatgctgggtctccctgaagatcagttgggtgcacgagtgggttacatcgaactggatctcaacagcggtaagatccttgagagttttcgccccgaagaacgttttccaatgatcgtacttgggagtcggccat

SEQ ID NO: 386968 - DNA, 140 bp, Artificial Sequence
  Synthetic
atggccgactcccaagtacgatcattggaaaacgttcttcggggcgaaaactctcaaggatcttaccgctgttgagatccagttcgatgtaacccactcgtgcacccaactgatcttcagggagacccagcatggcgtat

SEQ ID NO: 386969 - DNA, 140 bp, Artificial Sequence
  Synthetic
atacgccatgctgggtctccgggtggctcctgtccccccgaggctctcgcccttcgtggggccccactgacccccggcataggtcgcgcaatttgggtaaagtcatcgataccctcacgtcgtacttgggagtcggccat

SEQ ID NO: 386970 - DNA, 140 bp, Artificial Sequence
  Synthetic
atggccgactcccaagtacgacgtgagggtatcgatgactttacccaaattgcgcgacctatgccgggggtcagtggggccccacgaagggcgagagcctcggggggacaggagccacccggagacccagcatggcgtat

SEQ ID NO: 386971 - DNA, 140 bp, Artificial Sequence
  Synthetic
atacgccatgctgggtctccgttgagtactcaccagtcacagaaaagcatcttacggatggcatgacagtaagagaattatgcagtgctgccataaccatgagtgataacactgcggccacgtacttgggagtcggccat

SEQ ID NO: 386972 - DNA, 140 bp, Artificial Sequence
  Synthetic
atggccgactcccaagtacgtggccgcagtgttatcactcatggttatggcagcactgcataattctcttactgtcatgccatccgtaagatgcttttctgtgactggtgagtactcaacggagacccagcatggcgtat

SEQ ID NO: 386973 - DNA, 140 bp, Artificial Sequence
  Synthetic
atacgccatgctgggtctccgatcaattacgcaacagggaatttgcctggttgctctttctctatctttctcttggctcttctatcatgcatctctataccggtctctgccttagaggtccgtacttgggagtcggccat

SEQ ID NO: 386974 - DNA, 140 bp, Artificial Sequence
  Synthetic
atggccgactcccaagtacggacctctaaggcagagaccggtatagagatgcatgatagaagagccaagagaaagatagagaaagagcaaccaggcaaattccctgttgcgtaattgatcggagacccagcatggcgtat

SEQ ID NO: 386975 - DNA, 140 bp, Artificial Sequence
  Synthetic
atacgccatgctgggtctccgaatgaagccataccaaacgacgagcgtgacaccacgatgcctgcagcaatggcaacaacgttgcgcaaactattaactggcgaactacttactctagctcgtacttgggagtcggccat

SEQ ID NO: 386976 - DNA, 140 bp, Artificial Sequence
  Synthetic
atggccgactcccaagtacgagctagagtaagtagttcgccagttaatagtttgcgcaacgttgttgccattgctgcaggcatcgtggtgtcacgctcgtcgtttggtatggcttcattcggagacccagcatggcgtat

SEQ ID NO: 386977 - DNA, 140 bp, Artificial Sequence
  Synthetic
atacgccatgctgggtctcccatgtgagcgagcgggcaatcttagtcgctgctggacaccggtcacgccaaacgtggccgtgagccagcccggcgccctcactagaggcttgcgggcacacgtacttgggagtcggccat

SEQ ID NO: 386978 - DNA, 140 bp, Artificial Sequence
  Synthetic
atggccgactcccaagtacgtgtgcccgcaagcctctagtgagggcgccgggctggctcacggccacgtttggcgtgaccggtgtccagcagcgactaagattgcccgctcgctcacatgggagacccagcatggcgtat

SEQ ID NO: 386979 - DNA, 140 bp, Artificial Sequence
  Synthetic
atacgccatgctgggtctccgagccggtgagcgtgggtctcgcggtatcattgcagcactggggccagatggtaagccctcccgtatcgtagttatctacacgacggggagtcaggcaaccgtacttgggagtcggccat

SEQ ID NO: 386980 - DNA, 140 bp, Artificial Sequence
  Synthetic
atggccgactcccaagtacggttgcctgactccccgtcgtgtagataactacgatacgggagggcttaccatctggccccagtgctgcaatgataccgcgagacccacgctcaccggctcggagacccagcatggcgtat

SEQ ID NO: 386981 - DNA, 140 bp, Artificial Sequence
  Synthetic
atacgccatgctgggtctccccgcagcaccatacatttgtccaggactgcaactgctccatatacccggggcatgttacgggacaccgcatggcctgggatatgatgatgaactggtcaccgtacttgggagtcggccat

SEQ ID NO: 386982 - DNA, 140 bp, Artificial Sequence
  Synthetic
atggccgactcccaagtacggtgaccagttcatcatcatatcccaggccatgcggtgtcccgtaacatgccccgggtatatggagcagttgcagtcctggacaaatgtatggtgctgcggggagacccagcatggcgtat

SEQ ID NO: 386983 - DNA, 140 bp, Artificial Sequence
  Synthetic
aggccctggctgctgatatggcggagtatacttgttgccgcgcaggggccccaggttgggtgtgcgcacgacaaggaagacttcggagcggtcccagccacgtgggagacgccagcccatgaccttttgggacagcggtg

SEQ ID NO: 386984 - DNA, 140 bp, Artificial Sequence
  Synthetic
caccgctgtcccaaaaggtcatgggctggcgtctcccacgtggctgggaccgctccgaagtcttccttgtcgtgcgcacacccaacctggggcccctgcgcggcaacaagtatactccgccatatcagcagccagggcct

SEQ ID NO: 386985 - DNA, 140 bp, Artificial Sequence
  Synthetic
atacgccatgctgggtctccttaaaacttcatttttaatttaaaaggatctaggtgaagatcctttttgataatctcatgaccaaaatcccttaacgtgagttttcgttccactgagcgtcgtacttgggagtcggccat

SEQ ID NO: 386986 - DNA, 140 bp, Artificial Sequence
  Synthetic
atggccgactcccaagtacgacgctcagtggaacgaaaactcacgttaagggattttggtcatgagattatcaaaaaggatcttcacctagatccttttaaattaaaaatgaagttttaaggagacccagcatggcgtat

SEQ ID NO: 386987 - DNA, 140 bp, Artificial Sequence
  Synthetic
atacgccatgctgggtctcccttcgccatgcaaggagcgtgggcgaaggtcatcgccatcctcctgctgacagcaggagtggatgcggccacttatgtcaccggggggaatgcaggccgtcgtacttgggagtcggccat

SEQ ID NO: 386988 - DNA, 140 bp, Artificial Sequence
  Synthetic
atggccgactcccaagtacgacggcctgcattccccccggtgacataagtggccgcatccactcctgctgtcagcaggaggatggcgatgaccttcgcccacgctccttgcatggcgaagggagacccagcatggcgtat

SEQ ID NO: 386989 - DNA, 140 bp, Artificial Sequence
  Synthetic
atacgccatgctgggtctccttgtttgccggatcaagagctaccaactctttttccgaaggtaactggcttcagcagagcgcagataccaaatactgtccttctagtgtagccgtagttacgtacttgggagtcggccat

SEQ ID NO: 386990 - DNA, 140 bp, Artificial Sequence
  Synthetic
atggccgactcccaagtacgtaactacggctacactagaaggacagtatttggtatctgcgctctgctgaagccagttaccttcggaaaaagagttggtagctcttgatccggcaaacaaggagacccagcatggcgtat

SEQ ID NO: 386991 - DNA, 140 bp, Artificial Sequence
  Synthetic
atacgccatgctgggtctccactgcaatgacagcctgaacaccggcttcattgcggccttgttttacagccaccggttcaattcctcgggatgcccccagcgcctggccgcttgtcgcagcgtacttgggagtcggccat

SEQ ID NO: 386992 - DNA, 140 bp, Artificial Sequence
  Synthetic
atggccgactcccaagtacgctgcgacaagcggccaggcgctgggggcatcccgaggaattgaaccggtggctgtaaaacaaggccgcaatgaagccggtgttcaggctgtcattgcagtggagacccagcatggcgtat

SEQ ID NO: 386993 - DNA, 140 bp, Artificial Sequence
  Synthetic
atacgccatgctgggtctccggttggactcaagacgatagttaccggataaggcgcagcggtcgggctgaacggggggttcgtgcacacagcccagcttggagcgaacgacctacaccgacgtacttgggagtcggccat

SEQ ID NO: 386994 - DNA, 140 bp, Artificial Sequence
  Synthetic
atggccgactcccaagtacgtcggtgtaggtcgttcgctccaagctgggctgtgtgcacgaaccccccgttcagcccgaccgctgcgccttatccggtaactatcgtcttgagtccaaccggagacccagcatggcgtat

SEQ ID NO: 386995 - DNA, 140 bp, Artificial Sequence
  Synthetic
atacgccatgctgggtctcccagtgcggcgtagttccagccacgaccgtgtgtggcccagtttactgtttcacccccagccccgtagtggtgggcacgaccgacaagctcgggatacccacgtacttgggagtcggccat

SEQ ID NO: 386996 - DNA, 140 bp, Artificial Sequence
  Synthetic
atggccgactcccaagtacgtgggtatcccgagcttgtcggtcgtgcccaccactacggggctgggggtgaaacagtaaactgggccacacacggtcgtggctggaactacgccgcactgggagacccagcatggcgtat

SEQ ID NO: 386997 - DNA, 140 bp, Artificial Sequence
  Synthetic
atacgccatgctgggtctcccgcacgagggagcttccagggggaaacgcctggtatctttatagtcctgtcgggtttcgccacctctgacttgagcgtcgatttttgtgatgctcgtcagcgtacttgggagtcggccat

SEQ ID NO: 386998 - DNA, 140 bp, Artificial Sequence
  Synthetic
atggccgactcccaagtacgctgacgagcatcacaaaaatcgacgctcaagtcagaggtggcgaaacccgacaggactataaagataccaggcgtttccccctggaagctccctcgtgcgggagacccagcatggcgtat

SEQ ID NO: 386999 - DNA, 140 bp, Artificial Sequence
  Synthetic
atacgccatgctgggtctccgtttaccaagacctgcggcgcaccaccttgccgcattaggagagatttcaatgccagcgaggacttgttatgtccaacggactgtttcaggaaacatccccgtacttgggagtcggccat

SEQ ID NO: 387000 - DNA, 140 bp, Artificial Sequence
  Synthetic
atggccgactcccaagtacggggatgtttcctgaaacagtccgttggacataacaagtcctcgctggcattgaaatctctcctaatgcggcaaggtggtgcgccgcaggtcttggtaaacggagacccagcatggcgtat

SEQ ID NO: 387001 - DNA, 140 bp, Artificial Sequence
  Synthetic
atacgccatgctgggtctcccaacaacgtcctctgagcccgccccctctgtctgcctcccagactccgacgccgagtcctgttcttccatgccccccctggagggggagcctggggatcccgtacttgggagtcggccat

SEQ ID NO: 387002 - DNA, 140 bp, Artificial Sequence
  Synthetic
atggccgactcccaagtacgggatccccaggctccccctccagggggggcatggaagaacaggactcggcgtcggagtctgggaggcagacagagggggcgggctcagaggacgttgttgggagacccagcatggcgtat

SEQ ID NO: 387003 - DNA, 140 bp, Artificial Sequence
  Synthetic
atacgccatgctgggtctcctgattctgtggataaccgtattaccgcctttgagtgagctgataccgctcgccgcagccgaacgaccgagcgcagcgagtcagtgagcgaggaagcggaacgtacttgggagtcggccat

SEQ ID NO: 387004 - DNA, 140 bp, Artificial Sequence
  Synthetic
atggccgactcccaagtacgttccgcttcctcgctcactgactcgctgcgctcggtcgttcggctgcggcgagcggtatcagctcactcaaaggcggtaatacggttatccacagaatcaggagacccagcatggcgtat

SEQ ID NO: 387005 - DNA, 140 bp, Artificial Sequence
  Synthetic
atacgccatgctgggtctccacaccatctttaagatacggttgttcgtgggaggggttgagcacaggctccaagctgcttgcaacttcacccgcggggatcgctgtggcctagaggatagcgtacttgggagtcggccat

SEQ ID NO: 387006 - DNA, 140 bp, Artificial Sequence
  Synthetic
atggccgactcccaagtacgctatcctctaggccacagcgatccccgcgggtgaagttgcaagcagcttggagcctgtgctcaacccctcccacgaacaaccgtatcttaaagatggtgtggagacccagcatggcgtat

SEQ ID NO: 387007 - DNA, 140 bp, Artificial Sequence
  Synthetic
atacgccatgctgggtctccgccagtatacactccgctatcgctacgtgactgggtcatggctgcgccccgacacccgccaacacccgctgacgcgccctgacgggcttgtctgctcccgcgtacttgggagtcggccat

SEQ ID NO: 387008 - DNA, 140 bp, Artificial Sequence
  Synthetic
atggccgactcccaagtacgcgggagcagacaagcccgtcagggcgcgtcagcgggtgttggcgggtgtcggggcgcagccatgacccagtcacgtagcgatagcggagtgtatactggcggagacccagcatggcgtat

SEQ ID NO: 387009 - DNA, 140 bp, Artificial Sequence
  Synthetic
atacgccatgctgggtctcccatctccaccagaacattgtggatgtccaatacttgtatggcctttccctggccatcacgaagtatatggtcaagtgggaatgggtggttctcctctttccgtacttgggagtcggccat

SEQ ID NO: 387010 - DNA, 140 bp, Artificial Sequence
  Synthetic
atggccgactcccaagtacggaaagaggagaaccacccattcccacttgaccatatacttcgtgatggccagggaaaggccatacaagtattggacatccacaatgttctggtggagatgggagacccagcatggcgtat

SEQ ID NO: 387011 - DNA, 140 bp, Artificial Sequence
  Synthetic
atacgccatgctgggtctcccatcagcgtggtcgtgaagcgattcacagatgtctgcctgttcatccgcgtccagctcgttgagtttctccagaagcgttaatgtctggcttctgataaacgtacttgggagtcggccat

SEQ ID NO: 387012 - DNA, 140 bp, Artificial Sequence
  Synthetic
atggccgactcccaagtacgtttatcagaagccagacattaacgcttctggagaaactcaacgagctggacgcggatgaacaggcagacatctgtgaatcgcttcacgaccacgctgatgggagacccagcatggcgtat

SEQ ID NO: 387013 - DNA, 140 bp, Artificial Sequence
  Synthetic
atacgccatgctgggtctcccagtgctgctagttccaacggccccctgtacttcatcctgttcttcatagcggcgtggtacatcaagggtcggattacaccgatgaccgcctacggtctccgtacttgggagtcggccat

SEQ ID NO: 387014 - DNA, 140 bp, Artificial Sequence
  Synthetic
atggccgactcccaagtacggagaccgtaggcggtcatcggtgtaatccgacccttgatgtaccacgccgctatgaagaacaggatgaagtacagggggccgttggaactagcagcactgggagacccagcatggcgtat

SEQ ID NO: 387015 - DNA, 140 bp, Artificial Sequence
  Synthetic
atacgccatgctgggtctccagaggcggccgggagaaggttggcgaggggatcacccccctctgtggccagctcctcggctagccagctgtccgctccatctctcaaggcaacttgcacccgtacttgggagtcggccat

SEQ ID NO: 387016 - DNA, 140 bp, Artificial Sequence
  Synthetic
atggccgactcccaagtacgggtgcaagttgccttgagagatggagcggacagctggctagccgaggagctggccacagaggggggtgatcccctcgccaaccttctcccggccgcctctggagacccagcatggcgtat

SEQ ID NO: 387017 - DNA, 140 bp, Artificial Sequence
  Synthetic
atacgccatgctgggtctccaggatgctcacgatacgggttactgatgatgaacatgcccggttactggaacgttgtgagggtaaacaactggcggtatggatgcggcgggaccagagaacgtacttgggagtcggccat

SEQ ID NO: 387018 - DNA, 140 bp, Artificial Sequence
  Synthetic
atggccgactcccaagtacgttctctggtcccgccgcatccataccgccagttgtttaccctcacaacgttccagtaaccgggcatgttcatcatcagtaacccgtatcgtgagcatcctggagacccagcatggcgtat

SEQ ID NO: 387019 - DNA, 140 bp, Artificial Sequence
  Synthetic
atacgccatgctgggtctcctgatcataactgctttcacccttaccccggcatacaggctactcctcagtcggagcctgtggtggctgtgctatatgctggtcttggcagaggcccaaatcgtacttgggagtcggccat

SEQ ID NO: 387020 - DNA, 140 bp, Artificial Sequence
  Synthetic
atggccgactcccaagtacgatttgggcctctgccaagaccagcatatagcacagccaccacaggctccgactgaggagtagcctgtatgccggggtaagggtgaaagcagttatgatcaggagacccagcatggcgtat

SEQ ID NO: 387021 - DNA, 140 bp, Artificial Sequence
  Synthetic
atacgccatgctgggtctccgcagggcgctgacttccgcgtttccagactttacgaaacacggaaaccgaagaccattcatgttgttgctcaggtcgcagacgttttgcagcagcagtcgcgtacttgggagtcggccat

SEQ ID NO: 387022 - DNA, 140 bp, Artificial Sequence
  Synthetic
atggccgactcccaagtacgcgactgctgctgcaaaacgtctgcgacctgagcaacaacatgaatggtcttcggtttccgtgtttcgtaaagtctggaaacgcggaagtcagcgccctgcggagacccagcatggcgtat

SEQ ID NO: 387023 - DNA, 140 bp, Artificial Sequence
  Synthetic
atacgccatgctgggtctcctggctgctggcaatcctcggccccggctacctccttagggaggttttgatgggtgtgccgtattttgtcagggcgcatgccatcctgagggcctgtgctacgtacttgggagtcggccat

SEQ ID NO: 387024 - DNA, 140 bp, Artificial Sequence
  Synthetic
atggccgactcccaagtacgtagcacaggccctcaggatggcatgcgccctgacaaaatacggcacacccatcaaaacctccctaaggaggtagccggggccgaggattgccagcagccaggagacccagcatggcgtat

SEQ ID NO: 387025 - DNA, 140 bp, Artificial Sequence
  Synthetic
atacgccatgctgggtctccggactgggccgctaacggcctacgggacctggcggtcgctgtagaacccatcatcttcagtcccatggagaggaaggttattgtctggggggcagagacacgtacttgggagtcggccat

SEQ ID NO: 387026 - DNA, 140 bp, Artificial Sequence
  Synthetic
atggccgactcccaagtacgtgtctctgccccccagacaataaccttcctctccatgggactgaagatgatgggttctacagcgaccgccaggtcccgtaggccgttagcggcccagtccggagacccagcatggcgtat

SEQ ID NO: 387027 - DNA, 140 bp, Artificial Sequence
  Synthetic
atacgccatgctgggtctccgactcctcgccccaatcacagcatacgcgcagcagacgcggggggtgatgggggcgatagttgtcagtctgactggtcgtgacaagaatgaggtggaaggcgtacttgggagtcggccat

SEQ ID NO: 387028 - DNA, 140 bp, Artificial Sequence
  Synthetic
atggccgactcccaagtacgccttccacctcattcttgtcacgaccagtcagactgacaactatcgcccccatcaccccccgcgtctgctgcgcgtatgctgtgattggggcgaggagtcggagacccagcatggcgtat

SEQ ID NO: 387029 - DNA, 140 bp, Artificial Sequence
  Synthetic
atacgccatgctgggtctccagacctgcctgaaaccgaactgcccgctgttctgcagccggtcgcggaggccatggatgcgatcgctgcggccgatcttagccagacgagcgggttcggccgtacttgggagtcggccat

SEQ ID NO: 387030 - DNA, 140 bp, Artificial Sequence
  Synthetic
atggccgactcccaagtacggccgaacccgctcgtctggctaagatcggccgcagcgatcgcatccatggcctccgcgaccggctgcagaacagcgggcagttcggtttcaggcaggtctggagacccagcatggcgtat

SEQ ID NO: 387031 - DNA, 140 bp, Artificial Sequence
  Synthetic
atacgccatgctgggtctccacaccgtcagtgcgtccgtcgcgcaggctctcgatgagctgatgctttgggccgaggactgccccgaagtccggcacctcgtgcacgcggatttcggctccgtacttgggagtcggccat

SEQ ID NO: 387032 - DNA, 140 bp, Artificial Sequence
  Synthetic
atggccgactcccaagtacggagccgaaatccgcgtgcacgaggtgccggacttcggggcagtcctcggcccaaagcatcagctcatcgagagcctgcgcgacggacgcactgacggtgtggagacccagcatggcgtat

SEQ ID NO: 387033 - DNA, 140 bp, Artificial Sequence
  Synthetic
atacgccatgctgggtctcctggaggccgtggttggcttgtatggagcagcagacgcgctacttcgagcggaggcatccggagcttgcaggatcgccgcggctccgggcgtatatgctcccgtacttgggagtcggccat

SEQ ID NO: 387034 - DNA, 140 bp, Artificial Sequence
  Synthetic
atggccgactcccaagtacgggagcatatacgcccggagccgcggcgatcctgcaagctccggatgcctccgctcgaagtagcgcgtctgctgctccatacaagccaaccacggcctccaggagacccagcatggcgtat

SEQ ID NO: 387035 - DNA, 140 bp, Artificial Sequence
  Synthetic
atacgccatgctgggtctcccgggactgtcgggcgtacacaaatcgcccgcagaagcgcggccgtctggaccgatggctgtgtagaagttctcgccgatagtggaaaccgacgccccagccgtacttgggagtcggccat

SEQ ID NO: 387036 - DNA, 140 bp, Artificial Sequence
  Synthetic
atggccgactcccaagtacggctggggcgtcggtttccactatcggcgagaacttctacacagccatcggtccagacggccgcgcttctgcgggcgatttgtgtacgcccgacagtcccgggagacccagcatggcgtat

SEQ ID NO: 387037 - DNA, 140 bp, Artificial Sequence
  Synthetic
atacgccatgctgggtctcccccccaccctaacattgaggaggtggccctgcccactgagggcgagattcccttttacggcagggccatacccatctcatacgtcaaagggggtcggcatcgtacttgggagtcggccat

SEQ ID NO: 387038 - DNA, 140 bp, Artificial Sequence
  Synthetic
atggccgactcccaagtacgatgccgaccccctttgacgtatgagatgggtatggccctgccgtaaaagggaatctcgccctcagtgggcagggccacctcctcaatgttagggtgggggggagacccagcatggcgtat

SEQ ID NO: 387039 - DNA, 140 bp, Artificial Sequence
  Synthetic
aggccctggctgctgatatgccactgcaggactgggcccacgcgggcctacgagaccttgcggtggcagttgagcccgtcgtcttctctgacatggagaccaagatcatcacctgggggggaccttttgggacagcggtg

SEQ ID NO: 387040 - DNA, 140 bp, Artificial Sequence
  Synthetic
caccgctgtcccaaaaggtcccccccaggtgatgatcttggtctccatgtcagagaagacgacgggctcaactgccaccgcaaggtctcgtaggcccgcgtgggcccagtcctgcagtggcatatcagcagccagggcct

SEQ ID NO: 387041 - DNA, 140 bp, Artificial Sequence
  Synthetic
atacgccatgctgggtctccccgtgataccatccgcgggcgacgtcgtggtgtgcagcaccgatgcccttatgaccggatacaccggtgactttgacagtgtcattgactgcaacacagccgtacttgggagtcggccat

SEQ ID NO: 387042 - DNA, 140 bp, Artificial Sequence
  Synthetic
atggccgactcccaagtacggctgtgttgcagtcaatgacactgtcaaagtcaccggtgtatccggtcataagggcatcggtgctgcacaccacgacgtcgcccgcggatggtatcacggggagacccagcatggcgtat

SEQ ID NO: 387043 - DNA, 140 bp, Artificial Sequence
  Synthetic
atacgccatgctgggtctccaccgggagagggaagcacggcatctataggttcgtctcgccaggtgagcggccctcgggcatcttcgactccgtggtgctctgtgagtgctacgacgccgcgtacttgggagtcggccat

SEQ ID NO: 387044 - DNA, 140 bp, Artificial Sequence
  Synthetic
atggccgactcccaagtacgcggcgtcgtagcactcacagagcaccacggagtcgaagatgcccgagggccgctcacctggcgagacgaacctatagatgccgtgcttccctctcccggtggagacccagcatggcgtat

SEQ ID NO: 387045 - DNA, 140 bp, Artificial Sequence
  Synthetic
atacgccatgctgggtctccgccagcgtcgatgcaaaaacctacaccaccggggggagtgtcgctcagggcgcgtctgggttcgtctcttttctttctgtgggcgcccagcagaagatcccgtacttgggagtcggccat

SEQ ID NO: 387046 - DNA, 140 bp, Artificial Sequence
  Synthetic
atggccgactcccaagtacgggatcttctgctgggcgcccacagaaagaaaagagacgaacccagacgcgccctgagcgacactccccccggtggtgtaggtttttgcatcgacgctggcggagacccagcatggcgtat

SEQ ID NO: 387047 - DNA, 140 bp, Artificial Sequence
  Synthetic
atacgccatgctgggtctccttgggagggagtctttactggtttgactaacatagacgcacacatgctatctcaaactaagcagggaggggaaaacttcccctacctagtggcctaccaacgtacttgggagtcggccat

SEQ ID NO: 387048 - DNA, 140 bp, Artificial Sequence
  Synthetic
atggccgactcccaagtacgttggtaggccactaggtaggggaagttttcccctccctgcttagtttgagatagcatgtgtgcgtctatgttagtcaaaccagtaaagactccctcccaaggagacccagcatggcgtat

SEQ ID NO: 387049 - DNA, 140 bp, Artificial Sequence
  Synthetic
atacgccatgctgggtctcctattatacaggctaggggctgtccagaatgagatcactttaacccaccccataaccaagtacattatggcatgcatgtcagcagacctggaagtcatcaccgtacttgggagtcggccat

SEQ ID NO: 387050 - DNA, 140 bp, Artificial Sequence
  Synthetic
atggccgactcccaagtacggtgatgacttccaggtctgctgacatgcatgccataatgtacttggttatggggtgggttaaagtgatctcattctggacagcccctagcctgtataataggagacccagcatggcgtat

SEQ ID NO: 387051 - DNA, 140 bp, Artificial Sequence
  Synthetic
aggccctggctgctgatatggccccgtggtggtgggaacgaccgatagagcgggcgcgcctacctacaactggggtgaaaatgatacggacgttctcatcctcaataacaccaggccaccgaccttttgggacagcggtg

SEQ ID NO: 387052 - DNA, 140 bp, Artificial Sequence
  Synthetic
caccgctgtcccaaaaggtcggtggcctggtgttattgaggatgagaacgtccgtatcattttcaccccagttgtaggtaggcgcgcccgctctatcggtcgttcccaccaccacggggccatatcagcagccagggcct

SEQ ID NO: 387053 - DNA, 140 bp, Artificial Sequence
  Synthetic
atacgccatgctgggtctccaaaccagccgttataccggatagagaggcaatgtaccaacaatttgatgagatggaggagtgctcctcccgcattccatacatgtcagaggcacaggccacgtacttgggagtcggccat

SEQ ID NO: 387054 - DNA, 140 bp, Artificial Sequence
  Synthetic
atggccgactcccaagtacgtggcctgtgcctctgacatgtatggaatgcgggaggagcactcctccatctcatcaaattgttggtacattgcctctctatccggtataacggctggtttggagacccagcatggcgtat

SEQ ID NO: 387055 - DNA, 140 bp, Artificial Sequence
  Synthetic
atacgccatgctgggtctcctgaacagttttggaacaagcacatgtggaacttcgtgagcgggattcaatacctagccggcttatcaactttgccaggcaatcccgctgtcgccacactgcgtacttgggagtcggccat

SEQ ID NO: 387056 - DNA, 140 bp, Artificial Sequence
  Synthetic
atggccgactcccaagtacgcagtgtggcgacagcgggattgcctggcaaagttgataagccggctaggtattgaatcccgctcacgaagttccacatgtgcttgttccaaaactgttcaggagacccagcatggcgtat

SEQ ID NO: 387057 - DNA, 140 bp, Artificial Sequence
  Synthetic
atacgccatgctgggtctcccagctgctaccgcctttgtcgtcagcggcatagccggagcggcggttggcagtatagggctgggcaaggtcctcgttgacatccttgcagggtacggggccgtacttgggagtcggccat

SEQ ID NO: 387058 - DNA, 140 bp, Artificial Sequence
  Synthetic
atggccgactcccaagtacggccccgtaccctgcaaggatgtcaacgaggaccttgcccagccctatactgccaaccgccgctccggctatgccgctgacgacaaaggcggtagcagctgggagacccagcatggcgtat

SEQ ID NO: 387059 - DNA, 140 bp, Artificial Sequence
  Synthetic
atacgccatgctgggtctccgccctggtggttggggtgatctgcgcggccatcttgcgcagacatgtagggccgggagagggggccgtgcagtggatgaacagactgatcgcgttcgcctcgtacttgggagtcggccat

SEQ ID NO: 387060 - DNA, 140 bp, Artificial Sequence
  Synthetic
atggccgactcccaagtacgaggcgaacgcgatcagtctgttcatccactgcacggccccctctcccggccctacatgtctgcgcaagatggccgcgcagatcaccccaaccaccagggcggagacccagcatggcgtat

SEQ ID NO: 387061 - DNA, 140 bp, Artificial Sequence
  Synthetic
aggccctggctgctgatatgcccatttcttgtcccagactaagcaggcaggagacaacttcccctacctggtagcataccaggctacggtgtgcgccagggctcaggctccacctccatcgaccttttgggacagcggtg

SEQ ID NO: 387062 - DNA, 140 bp, Artificial Sequence
  Synthetic
caccgctgtcccaaaaggtcgatggaggtggagcctgagccctggcgcacaccgtagcctggtatgctaccaggtaggggaagttgtctcctgcctgcttagtctgggacaagaaatgggcatatcagcagccagggcct

SEQ ID NO: 387063 - DNA, 140 bp, Artificial Sequence
  Synthetic
atacgccatgctgggtctcctcaacaccactaagtgtccgtgcggggccctgatatctggtcatgtgaaaaacgggaccatgagaattgtaggcccaaagatgtgctctaacacctggcacgtacttgggagtcggccat

SEQ ID NO: 387064 - DNA, 140 bp, Artificial Sequence
  Synthetic
atggccgactcccaagtacgtgccaggtgttagagcacatctttgggcctacaattctcatggtcccgtttttcacatgaccagatatcagggccccgcacggacacttagtggtgttgaggagacccagcatggcgtat

SEQ ID NO: 387065 - DNA, 140 bp, Artificial Sequence
  Synthetic
atacgccatgctgggtctccgactaccaccgtcaccggggggagtgttgctaggggagcatctatgatctccaacttgttcaatccgggcgcccagcagaatatccagctggtcaacgcccgtacttgggagtcggccat

SEQ ID NO: 387066 - DNA, 140 bp, Artificial Sequence
  Synthetic
atggccgactcccaagtacgggcgttgaccagctggatattctgctgggcgcccggattgaacaagttggagatcatagatgctcccctagcaacactccccccggtgacggtggtagtcggagacccagcatggcgtat

SEQ ID NO: 387067 - DNA, 140 bp, Artificial Sequence
  Synthetic
atacgccatgctgggtctccgtctcaattgccatgtgagccagagcccgacgtgacagtcctaacatcacttctaactgatccatctcacataaccgctgaggcagctaagcgcaggttacgtacttgggagtcggccat

SEQ ID NO: 387068 - DNA, 140 bp, Artificial Sequence
  Synthetic
atggccgactcccaagtacgtaacctgcgcttagctgcctcagcggttatgtgagatggatcagttagaagtgatgttaggactgtcacgtcgggctctggctcacatggcaattgagacggagacccagcatggcgtat

SEQ ID NO: 387069 - DNA, 140 bp, Artificial Sequence
  Synthetic
atacgccatgctgggtctcccggacctcatagaggccaatctcctatggagacagtgcatgggaggcaacatcacgagagtggaagccgaaaacaaagttgtggtccttgactcattcgacgtacttgggagtcggccat

SEQ ID NO: 387070 - DNA, 140 bp, Artificial Sequence
  Synthetic
atggccgactcccaagtacgtcgaatgagtcaaggaccacaactttgttttcggcttccactctcgtgatgttgcctcccatgcactgtctccataggagattggcctctatgaggtccgggagacccagcatggcgtat

SEQ ID NO: 387071 - DNA, 140 bp, Artificial Sequence
  Synthetic
aggccctggctgctgatatgtggactgtctaccacggggccggaacaaggaccctcgcgtcatctaagggtcctgttatccagatgtataccaatgtagaccaagacctcgtgggctggcgaccttttgggacagcggtg

SEQ ID NO: 387072 - DNA, 140 bp, Artificial Sequence
  Synthetic
caccgctgtcccaaaaggtcgccagcccacgaggtcttggtctacattggtatacatctggataacaggacccttagatgacgcgagggtccttgttccggccccgtggtagacagtccacatatcagcagccagggcct

SEQ ID NO: 387073 - DNA, 140 bp, Artificial Sequence
  Synthetic
atacgccatgctgggtctccccggactataaccctccccttctggagtcttggaaaagaccagattatgatcctccccaggtctcggggtgtccattaccacccaaggctctcccaccaacgtacttgggagtcggccat

SEQ ID NO: 387074 - DNA, 140 bp, Artificial Sequence
  Synthetic
atggccgactcccaagtacgttggtgggagagccttgggtggtaatggacaccccgagacctggggaggatcataatctggtcttttccaagactccagaaggggagggttatagtccggggagacccagcatggcgtat

SEQ ID NO: 387075 - DNA, 140 bp, Artificial Sequence
  Synthetic
aggccctggctgctgatatgcattatccttgtactgtcaactacaccttgttcaaagttaggatgtacgtgggaggggtcgagcacaggctggaagttgcttgcaactggacgcggggcggaccttttgggacagcggtg

SEQ ID NO: 387076 - DNA, 140 bp, Artificial Sequence
  Synthetic
caccgctgtcccaaaaggtccgccccgcgtccagttgcaagcaacttccagcctgtgctcgacccctcccacgtacatcctaactttgaacaaggtgtagttgacagtacaaggataatgcatatcagcagccagggcct

SEQ ID NO: 387077 - DNA, 140 bp, Artificial Sequence
  Synthetic
atacgccatgctgggtctcccccttcgaatgacgccgcggattctgcagtcggtactagtactgatgcagcgtcgctggccgaggaagaaggggacagtgggtcagaagtggattcgttccgtacttgggagtcggccat

SEQ ID NO: 387078 - DNA, 140 bp, Artificial Sequence
  Synthetic
atggccgactcccaagtacggaacgaatccacttctgacccactgtccccttcttcctcggccagcgacgctgcatcagtactagtaccgactgcagaatccgcggcgtcattcgaagggggagacccagcatggcgtat

SEQ ID NO: 387079 - DNA, 140 bp, Artificial Sequence
  Synthetic
atacgccatgctgggtctccccatgtcctacagttggacaggggcactcataacaccatgcaatgcagaagaggaaaaactgcccattagccccttgagcaatagcttgctacgccatcacgtacttgggagtcggccat

SEQ ID NO: 387080 - DNA, 140 bp, Artificial Sequence
  Synthetic
atggccgactcccaagtacgtgatggcgtagcaagctattgctcaaggggctaatgggcagtttttcctcttctgcattgcatggtgttatgagtgcccctgtccaactgtaggacatggggagacccagcatggcgtat

SEQ ID NO: 387081 - DNA, 140 bp, Artificial Sequence
  Synthetic
aggccctggctgctgatatgtccttcctcgtgtttttctgctttgcatggtatctgaagggtaggtgggtgcccggagtggcctacgccgtctacgggatgtggcctctcctcctgctccgaccttttgggacagcggtg

SEQ ID NO: 387082 - DNA, 140 bp, Artificial Sequence
  Synthetic
caccgctgtcccaaaaggtcggagcaggaggagaggccacatcccgtagacggcgtaggccactccgggcacccacctacccttcagataccatgcaaagcagaaaaacacgaggaaggacatatcagcagccagggcct

SEQ ID NO: 387083 - DNA, 140 bp, Artificial Sequence
  Synthetic
atacgccatgctgggtctccgtggctgagatgaaggagaaagcttcttcagtgaaggcagatcttctctcttttgaggcggcttgtcgcttaacaccgccccattcagcgcgttccaagtcgtacttgggagtcggccat

SEQ ID NO: 387084 - DNA, 140 bp, Artificial Sequence
  Synthetic
atggccgactcccaagtacgacttggaacgcgctgaatggggcggtgttaagcgacaagccgcctcaaaagagagaagatctgccttcactgaagaagctttctccttcatctcagccacggagacccagcatggcgtat

SEQ ID NO: 387085 - DNA, 140 bp, Artificial Sequence
  Synthetic
atacgccatgctgggtctccaccaactacagtcatggcaaaaaacgaggtgttcacggtggtaccatctaagggggggaaaaagcctgccaggctaatagtgttccccgacctgggagtgcgtacttgggagtcggccat

SEQ ID NO: 387086 - DNA, 140 bp, Artificial Sequence
  Synthetic
atggccgactcccaagtacgcactcccaggtcggggaacactattagcctggcaggctttttcccccccttagatggtaccaccgtgaacacctcgttttttgccatgactgtagttggtggagacccagcatggcgtat

SEQ ID NO: 387087 - DNA, 140 bp, Artificial Sequence
  Synthetic
atacgccatgctgggtctcctcgaattcctggtgaagacctggaaacagaagaaagttcccatggctttctcgtatgacacccgctgctttgattcaactgtaaccgaacatgacatacgcgtacttgggagtcggccat

SEQ ID NO: 387088 - DNA, 140 bp, Artificial Sequence
  Synthetic
atggccgactcccaagtacgcgtatgtcatgttcggttacagttgaatcaaagcagcgggtgtcatacgagaaagccatgggaactttcttctgtttccaggtcttcaccaggaattcgaggagacccagcatggcgtat

SEQ ID NO: 387089 - DNA, 140 bp, Artificial Sequence
  Synthetic
aggccctggctgctgatatgcccagacgctgacctcatcgaggccaacctcctgtggcggcaggagatgggcgggaacatcacccgcgtggagtcagagaataaggtagtaattctggacgaccttttgggacagcggtg

SEQ ID NO: 387090 - DNA, 140 bp, Artificial Sequence
  Synthetic
caccgctgtcccaaaaggtcgtccagaattactaccttattctctgactccacgcgggtgatgttcccgcccatctcctgccgccacaggaggttggcctcgatgaggtcagcgtctgggcatatcagcagccagggcct

SEQ ID NO: 387091 - DNA, 140 bp, Artificial Sequence
  Synthetic
atacgccatgctgggtctccaatagcaagggggagcggtgtggctaccgcagatgccgcgcaagcggcgtctttcccaccagcttaggcaacactatgacatgttacatcaaagcggttgcgtacttgggagtcggccat

SEQ ID NO: 387092 - DNA, 140 bp, Artificial Sequence
  Synthetic
atggccgactcccaagtacgcaaccgctttgatgtaacatgtcatagtgttgcctaagctggtgggaaagacgccgcttgcgcggcatctgcggtagccacaccgctcccccttgctattggagacccagcatggcgtat

SEQ ID NO: 387093 - DNA, 140 bp, Artificial Sequence
  Synthetic
atacgccatgctgggtctccctgcctgagagtcttcacggaggctatgaccaggtactcggctccccccggagacgtccccaaggccgcatatgacctggagcttgttacatcctgttcccgtacttgggagtcggccat

SEQ ID NO: 387094 - DNA, 140 bp, Artificial Sequence
  Synthetic
atggccgactcccaagtacgggaacaggatgtaacaagctccaggtcatatgcggccttggggacgtctccggggggagccgagtacctggtcatagcctccgtgaagactctcaggcagggagacccagcatggcgtat

SEQ ID NO: 387095 - DNA, 140 bp, Artificial Sequence
  Synthetic
aggccctggctgctgatatgcagaccttcctggcaacctgcatcaacggggtgtgttggactgtctaccacggggccggaacaaggaccattgcgtcacccaagggtcctgttatccagagaccttttgggacagcggtg

SEQ ID NO: 387096 - DNA, 140 bp, Artificial Sequence
  Synthetic
caccgctgtcccaaaaggtctctggataacaggacccttgggtgacgcaatggtccttgttccggccccgtggtagacagtccaacacaccccgttgatgcaggttgccaggaaggtctgcatatcagcagccagggcct

SEQ ID NO: 387097 - DNA, 140 bp, Artificial Sequence
  Synthetic
atacgccatgctgggtctccaacactccccagtgaactcctggctcggcaacatcattatgtacgccccaaccctatgggtgaggatagtgatgatgacccatttcttcagcatcttacacgtacttgggagtcggccat

SEQ ID NO: 387098 - DNA, 140 bp, Artificial Sequence
  Synthetic
atggccgactcccaagtacgtgtaagatgctgaagaaatgggtcatcatcactatcctcacccatagggttggggcgtacataatgatgttgccgagccaggagttcactggggagtgttggagacccagcatggcgtat

SEQ ID NO: 387099 - DNA, 140 bp, Artificial Sequence
  Synthetic
atacgccatgctgggtctccgggcttagcgcgttttcactccacacatactctccttgcgaaatcaatagggtggcagcatgcctcagaaagcttggggttccacctctgagagcttggacgtacttgggagtcggccat

SEQ ID NO: 387100 - DNA, 140 bp, Artificial Sequence
  Synthetic
atggccgactcccaagtacgtccaagctctcagaggtggaaccccaagctttctgaggcatgctgccaccctattgatttcgcaaggagagtatgtgtggagtgaaaacgcgctaagcccggagacccagcatggcgtat

SEQ ID NO: 387101 - DNA, 140 bp, Artificial Sequence
  Synthetic
aggccctggctgctgatatgttggctatggggcaaaggacgtccggaacctatccagcaaggccgttaaccacatccgctccgtgtggaaggacttgctggaagacactgagacaccaatgaccttttgggacagcggtg

SEQ ID NO: 387102 - DNA, 140 bp, Artificial Sequence
  Synthetic
caccgctgtcccaaaaggtcattggtgtctcagtgtcttccagcaagtccttccacacggagcggatgtggttaacggccttgctggataggttccggacgtcctttgccccatagccaacatatcagcagccagggcct

SEQ ID NO: 387103 - DNA, 140 bp, Artificial Sequence
  Synthetic
atacgccatgctgggtctccgacatcgggcccgagctgttcgcgctaggctcatcgcccagggagggaaggctgcaatatgcggcaagtacctctttaactgggcggtaaaaacaaagctcgtacttgggagtcggccat

SEQ ID NO: 387104 - DNA, 140 bp, Artificial Sequence
  Synthetic
atggccgactcccaagtacgagctttgtttttaccgcccagttaaagaggtacttgccgcatattgcagccttccctccctgggcgatgagcctagcgcgaacagctcgggcccgatgtcggagacccagcatggcgtat

SEQ ID NO: 387105 - DNA, 140 bp, Artificial Sequence
  Synthetic
atacgccatgctgggtctccgaatgaggggctcggctgggcaggatggcttctgtccccccgaggttcccgtcccacttggggccccactgacccccggcataggtcgcgcaatgtgggtcgtacttgggagtcggccat

SEQ ID NO: 387106 - DNA, 140 bp, Artificial Sequence
  Synthetic
atggccgactcccaagtacgacccacattgcgcgacctatgccgggggtcagtggggccccaagtgggacgggaacctcggggggacagaagccatcctgcccagccgagcccctcattcggagacccagcatggcgtat

SEQ ID NO: 387107 - DNA, 140 bp, Artificial Sequence
  Synthetic
aggccctggctgctgatatgtccggtctctgctgcccaagtgaagaacaccagtagcggttacatggtgacaaatgactgctccaatgacagcatcacctggcagcttgaggccgcggtcgaccttttgggacagcggtg

SEQ ID NO: 387108 - DNA, 140 bp, Artificial Sequence
  Synthetic
caccgctgtcccaaaaggtcgaccgcggcctcaagctgccaggtgatgctgtcattggagcagtcatttgtcaccatgtaaccgctactggtgttcttcacttgggcagcagagaccggacatatcagcagccagggcct

SEQ ID NO: 387109 - DNA, 140 bp, Artificial Sequence
  Synthetic
aggccctggctgctgatatgctctgctccgctctctacgtgggggacttctgcggcggggtgatgctcgcggctcagatgtttatcgtctcgccgcagcaccactggtttgtgcaggaatgaccttttgggacagcggtg

SEQ ID NO: 387110 - DNA, 140 bp, Artificial Sequence
  Synthetic
caccgctgtcccaaaaggtcattcctgcacaaaccagtggtgctgcggcgagacgataaacatctgagccgcgagcatcaccccgccgcagaagtcccccacgtagagagcggagcagagcatatcagcagccagggcct

SEQ ID NO: 387111 - DNA, 140 bp, Artificial Sequence
  Synthetic
  misc_feature (58)..(58): n is a, c, g, or t
  misc_feature (91)..(91): n is a, c, g, or t
atacgccatgctgggtctccgtggcgctcagcagaacattcaactcattaacaccaanggcagttggcacatcaaccgcactgccctgaantgcaatgactccttgaacaccggcttcctcgtacttgggagtcggccat

SEQ ID NO: 387112 - DNA, 140 bp, Artificial Sequence
  Synthetic
  misc_feature (50)..(50): n is a, c, g, or t
  misc_feature (83)..(83): n is a, c, g, or t
atggccgactcccaagtacgaggaagccggtgttcaaggagtcattgcanttcagggcagtgcggttgatgtgccaactgccnttggtgttaatgagttgaatgttctgctgagcgccacggagacccagcatggcgtat

SEQ ID NO: 387113 - DNA, 140 bp, Artificial Sequence
  Synthetic
aggccctggctgctgatatggactccgacgctgagtcctgttcttccatgccccccctggagggggagcctggggatccggatctcagcgacgggtcatggtcgacggtcagtagtgggggaccttttgggacagcggtg

SEQ ID NO: 387114 - DNA, 140 bp, Artificial Sequence
  Synthetic
caccgctgtcccaaaaggtcccccactactgaccgtcgaccatgacccgtcgctgagatccggatccccaggctccccctccagggggggcatggaagaacaggactcagcgtcggagtccatatcagcagccagggcct

SEQ ID NO: 387115 - DNA, 140 bp, Artificial Sequence
  Synthetic
aggccctggctgctgatatgcgcactagagctgacttcaatgccagcacggacctgctgtgccccacggactgttttaggaagcatcctgaagccacttacatcaaatgtggttctgggcgaccttttgggacagcggtg

SEQ ID NO: 387116 - DNA, 140 bp, Artificial Sequence
  Synthetic
caccgctgtcccaaaaggtcgcccagaaccacatttgatgtaagtggcttcaggatgcttcctaaaacagtccgtggggcacagcaggtccgtgctggcattgaagtcagctctagtgcgcatatcagcagccagggcct

SEQ ID NO: 387117 - DNA, 140 bp, Artificial Sequence
  Synthetic
  misc_feature (78)..(78): n is a, c, g, or t
  misc_feature (81)..(81): n is a, c, g, or t
aggccctggctgctgatatgctgttttaggaagcatcctgaagccacttacatcaaatgtggttctgggccctggctnacnccaaggtgtatggtcgactacccctacaggctctggcatgaccttttgggacagcggtg

SEQ ID NO: 387118 - DNA, 140 bp, Artificial Sequence
  Synthetic
  misc_feature (60)..(60): n is a, c, g, or t
  misc_feature (63)..(63): n is a, c, g, or t
caccgctgtcccaaaaggtcatgccagagcctgtaggggtagtcgaccatacaccttggngtnagccagggcccagaaccacatttgatgtaagtggcttcaggatgcttcctaaaacagcatatcagcagccagggcct

SEQ ID NO: 387119 - DNA, 140 bp, Artificial Sequence
  Synthetic
aggccctggctgctgatatggttgcgacttggaggacagggacagaagtcaactgtctcctttgttgcactccaccacggaatgggccattttgccctgctcatactcagacctgcctgcgaccttttgggacagcggtg

SEQ ID NO: 387120 - DNA, 140 bp, Artificial Sequence
  Synthetic
caccgctgtcccaaaaggtcgcaggcaggtctgagtatgagcagggcaaaatggcccattccgtggtggagtgcaacaaaggagacagttgacttctgtccctgtcctccaagtcgcaaccatatcagcagccagggcct

SEQ ID NO: 387121 - DNA, 140 bp, Artificial Sequence
  Synthetic
  misc_feature (24)..(24): n is a, c, g, or t
  misc_feature (29)..(29): n is a, c, g, or t
  misc_feature (113)..(113): n is a, c, g, or t
aggccctggctgctgatatgtggntagtnctcttattcctgctcctagcggacgccagggtctgcgcctgcctgtggatgctcatcttgttgggccaagccgaagcagcactngagaagcgaccttttgggacagcggtg

SEQ ID NO: 387122 - DNA, 140 bp, Artificial Sequence
  Synthetic
  misc_feature (28)..(28): n is a, c, g, or t
  misc_feature (112)..(112): n is a, c, g, or t
  misc_feature (117)..(117): n is a, c, g, or t
caccgctgtcccaaaaggtcgcttctcnagtgctgcttcggcttggcccaacaagatgagcatccacaggcaggcgcagaccctggcgtccgctaggagcaggaataagagnactanccacatatcagcagccagggcct

SEQ ID NO: 387123 - DNA, 140 bp, Artificial Sequence
  Synthetic
  misc_feature (50)..(50): n is a, c, g, or t
atacgccatgctgggtctcctttgtcatctttttcgtggctgcttggcanatcaagggtcgggcggtccccttagctgcctattcccttactggcctatggtccttctgcctactgctcccgtacttgggagtcggccat

SEQ ID NO: 387124 - DNA, 140 bp, Artificial Sequence
  Synthetic
  misc_feature (91)..(91): n is a, c, g, or t
atggccgactcccaagtacgggagcagtaggcagaaggaccataggccagtaagggaataggcagctaaggggaccgcccgacccttgatntgccaagcagccacgaaaaagatgacaaaggagacccagcatggcgtat

SEQ ID NO: 387125 - DNA, 140 bp, Artificial Sequence
  Synthetic
aggccctggctgctgatatgagtcctggcgggccttgcctactattccatggtggggaactgggctaaggtcttgattgtgatgctgctctttgccggcgttgacgggcacacgggcaccgaccttttgggacagcggtg

SEQ ID NO: 387126 - DNA, 140 bp, Artificial Sequence
  Synthetic
caccgctgtcccaaaaggtcggtgcccgtgtgcccgtcaacgccggcaaagagcagcatcacaatcaagaccttagcccagttccccaccatggaatagtaggcaaggcccgccaggactcatatcagcagccagggcct

SEQ ID NO: 387127 - DNA, 140 bp, Artificial Sequence
  Synthetic
  misc_feature (71)..(71): n is a, c, g, or t
atacgccatgctgggtctccggcggccgcgatggcatcatatgggccgccaccatattctgcccgggcttngtgtttgacataaccaagtggcttctggcggtgtttgggcctggttacccgtacttgggagtcggccat

SEQ ID NO: 387128 - DNA, 140 bp, Artificial Sequence
  Synthetic
  misc_feature (70)..(70): n is a, c, g, or t
atggccgactcccaagtacgggtaaccaggcccaaacaccgccagaagccacttggttatgtcaaacacnaagcccgggcagaatatggtggcggcccatatgatgccatcgcggccgccggagacccagcatggcgtat

SEQ ID NO: 387129 - DNA, 140 bp, Artificial Sequence
  Synthetic
atacgccatgctgggtctccgctggcacatcaacaggactgccctgaactgcaatgataccctcaacaccgggttctttgctgcgctgttctacgcacacaagttcaacacgtcaggatgcgtacttgggagtcggccat

SEQ ID NO: 387130 - DNA, 140 bp, Artificial Sequence
  Synthetic
atggccgactcccaagtacgcatcctgacgtgttgaacttgtgtgcgtagaacagcgcagcaaagaacccggtgttgagggtatcattgcagttcagggcagtcctgttgatgtgccagcggagacccagcatggcgtat

SEQ ID NO: 387131 - DNA, 140 bp, Artificial Sequence
  Synthetic
  misc_feature (38)..(38): n is a, c, g, or t
  misc_feature (86)..(86): n is a, c, g, or t
  misc_feature (108)..(108): n is a, c, g, or t
atacgccatgctgggtctccgcggtcgctgtggaaccnatcatcttcagcccgatggagaagaaagtcatcgtctggggggcagantcggccgcatgcggggacattntacatggactcccgtacttgggagtcggccat

SEQ ID NO: 387132 - DNA, 140 bp, Artificial Sequence
  Synthetic
  misc_feature (33)..(33): n is a, c, g, or t
  misc_feature (55)..(55): n is a, c, g, or t
  misc_feature (103)..(103): n is a, c, g, or t
atggccgactcccaagtacgggagtccatgtanaatgtccccgcatgcggccgantctgccccccagacgatgactttcttctccatcgggctgaagatgatnggttccacagcgaccgcggagacccagcatggcgtat

SEQ ID NO: 387133 - DNA, 140 bp, Artificial Sequence
  Synthetic
aggccctggctgctgatatgactcgagtgccgagggggacttggttggatggcctagcccccctggaactaaatctctggagccgtgcacgtgtggggcggtcgacctgtacctggtcacgaccttttgggacagcggtg

SEQ ID NO: 387134 - DNA, 140 bp, Artificial Sequence
  Synthetic
caccgctgtcccaaaaggtcgtgaccaggtacaggtcgaccgccccacacgtgcacggctccagagatttagttccaggggggctaggccatccaaccaagtccccctcggcactcgagtcatatcagcagccagggcct

SEQ ID NO: 387135 - DNA, 140 bp, Artificial Sequence
  Synthetic
aggccctggctgctgatatgcctactcctgcttgctgcaggggtaggcatctacctccttcccaaccgatgaaggttgggataaacactccggcctcttaggccatttctgtttttttttgaccttttgggacagcggtg

SEQ ID NO: 387136 - DNA, 140 bp, Artificial Sequence
  Synthetic
caccgctgtcccaaaaggtcaaaaaaaaacagaaatggcctaagaggccggagtgtttatcccaaccttcatcggttgggaaggaggtagatgcctacccctgcagcaagcaggagtaggcatatcagcagccagggcct

SEQ ID NO: 387137 - DNA, 140 bp, Artificial Sequence
  Synthetic
aggccctggctgctgatatgccgatgggggctgcacaggcggcgcctatgacatcatcatatgcgatgaatgccactccgtggatgccaccaccattctcggcatcggaacagttcttgagaccttttgggacagcggtg

SEQ ID NO: 387138 - DNA, 140 bp, Artificial Sequence
  Synthetic
caccgctgtcccaaaaggtctcaagaactgttccgatgccgagaatggtggtggcatccacggagtggcattcatcgcatatgatgatgtcataggcgccgcctgtgcagcccccatcggcatatcagcagccagggcct

SEQ ID NO: 387139 - DNA, 140 bp, Artificial Sequence
  Synthetic
aggccctggctgctgatatgtaccatgtcaccaatgattgccctaactcgagtattgtgtacgagacggccgatgccatcctacactctccggggtgtgtcccttgcgttcgcgagggtagaccttttgggacagcggtg

SEQ ID NO: 387140 - DNA, 140 bp, Artificial Sequence
  Synthetic
caccgctgtcccaaaaggtctaccctcgcgaacgcaagggacacaccccggagagtgtaggatggcatcggccgtctcgtacacaatactcgagttagggcaatcattggtgacatggtacatatcagcagccagggcct

SEQ ID NO: 387141 - DNA, 140 bp, Artificial Sequence
  Synthetic
atacgccatgctgggtctcccatcaagggagggagacacttgatcttctgccactcaaagaaaaagtgtgacgagctcgcggcggcccttcggggcatgggcttgaacgctgtggcataccgtacttgggagtcggccat

SEQ ID NO: 387142 - DNA, 140 bp, Artificial Sequence
  Synthetic
atggccgactcccaagtacggtatgccacagcgttcaagcccatgccccgaagggccgccgcgagctcgtcacactttttctttgagtggcagaagatcaagtgtctccctcccttgatgggagacccagcatggcgtat

SEQ ID NO: 387143 - DNA, 140 bp, Artificial Sequence
  Synthetic
atacgccatgctgggtctccgaccaccgtcaggctcagagcgtatttcaacacgcctggcttgcctgtgtgccaagaccatcttgagttttgggaggcggttttcaccggcctcacacaccgtacttgggagtcggccat

SEQ ID NO: 387144 - DNA, 140 bp, Artificial Sequence
  Synthetic
atggccgactcccaagtacggtgtgtgaggccggtgaaaaccgcctcccaaaactcaagatggtcttggcacacaggcaagccaggcgtgttgaaatacgctctgagcctgacggtggtcggagacccagcatggcgtat

SEQ ID NO: 387145 - DNA, 140 bp, Artificial Sequence
  Synthetic
aggccctggctgctgatatgatacttagtagcctatcaggctacagtgtgcgctagagccaaagcccctcccccgtcctgggatgtcatgtggaagtgtttgactcgactcaagcccacggaccttttgggacagcggtg

SEQ ID NO: 387146 - DNA, 140 bp, Artificial Sequence
  Synthetic
caccgctgtcccaaaaggtccgtgggcttgagtcgagtcaaacacttccacatgacatcccaggacgggggaggggctttggctctagcgcacactgtagcctgataggctactaagtatcatatcagcagccagggcct

SEQ ID NO: 387147 - DNA, 140 bp, Artificial Sequence
  Synthetic
aggccctggctgctgatatgggtcactctcacacatcctgtgacgaaatacatcgccacatgcatgcaagccgaccttgaggtcatgaccagtacgtgggtcctagctgggggggtcttggaccttttgggacagcggtg

SEQ ID NO: 387148 - DNA, 140 bp, Artificial Sequence
  Synthetic
caccgctgtcccaaaaggtccaagacccccccagctaggacccacgtactggtcatgacctcaaggtcggcttgcatgcatgtggcgatgtatttcgtcacaggatgtgtgagagtgacccatatcagcagccagggcct

SEQ ID NO: 387149 - DNA, 140 bp, Artificial Sequence
  Synthetic
atacgccatgctgggtctccacccgaggggttgcaaaggcggtggactttgtacccgttgagtctatggaaactactatgcggtccccggtcttcacggacaactcgtcccctccggccgcgtacttgggagtcggccat

SEQ ID NO: 387150 - DNA, 140 bp, Artificial Sequence
  Synthetic
atggccgactcccaagtacgcggccggaggggacgagttgtccgtgaagaccggggaccgcatagtagtttccatagactcaacgggtacaaagtccaccgcctttgcaacccctcgggtggagacccagcatggcgtat

SEQ ID NO: 387151 - DNA, 140 bp, Artificial Sequence
  Synthetic
aggccctggctgctgatatgcttattgcagcaagcctccaaacaggcccaggacatacaacccgctgtgcaggcttcatggcccaaggtggagcaattttgggccaaacacatgtggaacgaccttttgggacagcggtg

SEQ ID NO: 387152 - DNA, 140 bp, Artificial Sequence
  Synthetic
caccgctgtcccaaaaggtcgttccacatgtgtttggcccaaaattgctccaccttgggccatgaagcctgcacagcgggttgtatgtcctgggcctgtttggaggcttgctgcaataagcatatcagcagccagggcct

SEQ ID NO: 387153 - DNA, 140 bp, Artificial Sequence
  Synthetic
atacgccatgctgggtctcccacattaacaggactgctctgaactgcaatgactccctccacactgggttcctcgccgcgctgttctacgtacacaagttcaacgcgtcgggatgcccggcgtacttgggagtcggccat

SEQ ID NO: 387154 - DNA, 140 bp, Artificial Sequence
  Synthetic
atggccgactcccaagtacgccgggcatcccgacgcgttgaacttgtgtacgtagaacagcgcggcgaggaacccagtgtggagggagtcattgcagttcagagcagtcctgttaatgtgggagacccagcatggcgtat

SEQ ID NO: 387155 - DNA, 140 bp, Artificial Sequence
  Synthetic
aggccctggctgctgatatgaccctcacacaccccataaccaaatacatcatggcatgcatgtcggctgacctggaggtcgtcacgagcacctgggtgctggtaggcggagtcctcgcaggaccttttgggacagcggtg

SEQ ID NO: 387156 - DNA, 140 bp, Artificial Sequence
  Synthetic
caccgctgtcccaaaaggtcctgcgaggactccgcctaccagcacccaggtgctcgtgacgacctccaggtcagccgacatgcatgccatgatgtatttggttatggggtgtgtgagggtcatatcagcagccagggcct

SEQ ID NO: 387157 - DNA, 140 bp, Artificial Sequence
  Synthetic
aggccctggctgctgatatgactgacgtattgatgtccatgctaacagatccaacccatattacggcggaggctgcagctcggcgcttagcgcggggatcacccccatctgaggcaagctgaccttttgggacagcggtg

SEQ ID NO: 387158 - DNA, 140 bp, Artificial Sequence
  Synthetic
caccgctgtcccaaaaggtcagcttgcctcagatgggggtgatccccgcgctaagcgccgagctgcagcctccgccgtaatatgggttggatctgttagcatggacatcaatacgtcagtcatatcagcagccagggcct

SEQ ID NO: 387159 - DNA, 140 bp, Artificial Sequence
  Synthetic
aggccctggctgctgatatgcacggcaaggcctatgatgtggacatggtggacgccaacttgttcatggggggcgatgtgactcggatagagtctgagtctaaagtggtcgttctggattgaccttttgggacagcggtg

SEQ ID NO: 387160 - DNA, 140 bp, Artificial Sequence
  Synthetic
caccgctgtcccaaaaggtcaatccagaacgaccactttagactcagactctatccgagtcacatcgccccccatgaacaagttggcgtccaccatgtccacatcataggccttgccgtgcatatcagcagccagggcct

SEQ ID NO: 387161 - DNA, 140 bp, Artificial Sequence
  Synthetic
aggccctggctgctgatatggcaatagcatcactgatggcattcacagcctctatcaccagcccgctcaccacccaacacaccctcctgtttaacatcttgggggggtgggtggccgcccgaccttttgggacagcggtg

SEQ ID NO: 387162 - DNA, 140 bp, Artificial Sequence
  Synthetic
caccgctgtcccaaaaggtcgggcggccacccacccccccaagatgttaaacaggagggtgtgttgggtggtgagcgggctggtgatagaggctgtgaatgccatcagtgatgctattgccatatcagcagccagggcct

SEQ ID NO: 387163 - DNA, 140 bp, Artificial Sequence
  Synthetic
aggccctggctgctgatatgattaccagccgcccaccgttgctggctgcgctcttcccccccccaagaaaaccccgaccccccccccaaggagccgccggacagtgggtctgagggagaggaccttttgggacagcggtg

SEQ ID NO: 387164 - DNA, 140 bp, Artificial Sequence
  Synthetic
caccgctgtcccaaaaggtcctctccctcagacccactgtccggcggctccttggggggggggtcggggttttcttgggggggggaagagcgcagccagcaacggtgggcggctggtaatcatatcagcagccagggcct

SEQ ID NO: 387165 - DNA, 140 bp, Artificial Sequence
  Synthetic
atacgccatgctgggtctcctccggcggtcagacaccccctgacgagttggctctttcggagacaggttctatctcctccatgccccccctcgagggggagcctggggacccagacctggcgtacttgggagtcggccat

SEQ ID NO: 387166 - DNA, 140 bp, Artificial Sequence
  Synthetic
atggccgactcccaagtacgccaggtctgggtccccaggctccccctcgagggggggcatggaggagatagaacctgtctccgaaagagccaactcgtcagggggtgtctgaccgccggaggagacccagcatggcgtat

SEQ ID NO: 387167 - DNA, 140 bp, Artificial Sequence
  Synthetic
atacgccatgctgggtctccgacgagctcgccgcaaaactggtcgcgctgggcatcaacgccgtggcctactaccgcggccttgacgtgtccgtcatcccgaccagtggcgatgttgtcgcgtacttgggagtcggccat

SEQ ID NO: 387168 - DNA, 140 bp, Artificial Sequence
  Synthetic
atggccgactcccaagtacgcgacaacatcgccactggtcgggatgacggacacgtcaaggccgcggtagtaggccacggcgttgatgcccagcgcgaccagttttgcggcgagctcgtcggagacccagcatggcgtat

SEQ ID NO: 387169 - DNA, 140 bp, Artificial Sequence
  Synthetic
aggccctggctgctgatatgactgcaacgacagccttcagaccggctttttagcagggcttatctatcatcacaggttcaactcttcaggctgtagtgagaggttggccagctgccgaccgaccttttgggacagcggtg

SEQ ID NO: 387170 - DNA, 140 bp, Artificial Sequence
  Synthetic
caccgctgtcccaaaaggtcggtcggcagctggccaacctctcactacagcctgaagagttgaacctgtgatgatagataagccctgctaaaaagccggtctgaaggctgtcgttgcagtcatatcagcagccagggcct

SEQ ID NO: 387171 - DNA, 140 bp, Artificial Sequence
  Synthetic
aggccctggctgctgatatgggagggccgtcaaccacatcaagtccgtgtggaaggacctcctggaagactcacaaacaccaattcctacgaccatcatggccaaaaatgaggtgttctggaccttttgggacagcggtg

SEQ ID NO: 387172 - DNA, 140 bp, Artificial Sequence
  Synthetic
caccgctgtcccaaaaggtccagaacacctcatttttggccatgatggtcgtaggaattggtgtttgtgagtcttccaggaggtccttccacacggacttgatgtggttgacggccctcccatatcagcagccagggcct

SEQ ID NO: 387173 - DNA, 140 bp, Artificial Sequence
  Synthetic
aggccctggctgctgatatgcccatatgggcacgcccggattacaaccctccactgttagagtcttggaaagacccggactacgtccctccggtggtacacgggtgcccattgccacctagaccttttgggacagcggtg

SEQ ID NO: 387174 - DNA, 140 bp, Artificial Sequence
  Synthetic
caccgctgtcccaaaaggtctaggtggcaatgggcacccgtgtaccaccggagggacgtagtccgggtctttccaagactctaacagtggagggttgtaatccgggcgtgcccatatgggcatatcagcagccagggcct

SEQ ID NO: 387175 - DNA, 140 bp, Artificial Sequence
  Synthetic
atacgccatgctgggtctcccgcagatactacctgaccagagaccctaccactccaatcgcccgggctgcctgggaaacagtcagacacttccctgtcaattcatggctgggaaacatcacgtacttgggagtcggccat

SEQ ID NO: 387176 - DNA, 140 bp, Artificial Sequence
  Synthetic
atggccgactcccaagtacgtgatgtttcccagccatgaattgacagggaagtgtctgactgtttcccaggcagcccgggcgattggagtggtagggtctctggtcaggtagtatctgcgggagacccagcatggcgtat

SEQ ID NO: 387177 - DNA, 140 bp, Artificial Sequence
  Synthetic
atacgccatgctgggtctcctccagtacgctccaactatatgggttcgtatggtcctgatgacacacttcttctccattctcatggcccaagacaccctggaccagaacctcaactttgacgtacttgggagtcggccat

SEQ ID NO: 387178 - DNA, 140 bp, Artificial Sequence
  Synthetic
atggccgactcccaagtacgtcaaagttgaggttctggtccagggtgtcttgggccatgagaatggagaagaagtgtgtcatcaggaccatacgaacccatatagttggagcgtactggaggagacccagcatggcgtat

SEQ ID NO: 387179 - DNA, 140 bp, Artificial Sequence
  Synthetic
atacgccatgctgggtctcccacgaactgacgcgggtggcttcagccctcagaaaacttggggcgccacccctcagagcgtggaagagtcgggcgcgtgcagtcagggcgtccctcatctcgtacttgggagtcggccat

SEQ ID NO: 387180 - DNA, 140 bp, Artificial Sequence
  Synthetic
atggccgactcccaagtacgagatgagggacgccctgactgcacgcgcccgactcttccacgctctgaggggtggcgccccaagttttctgagggctgaagccacccgcgtcagttcgtgggagacccagcatggcgtat

SEQ ID NO: 387181 - DNA, 140 bp, Artificial Sequence
  Synthetic
atacgccatgctgggtctccgcgtgttgcgtgcccgaccccgcttattactccttagcctactcctactttccgtgggactaggccttttcctactccccgctcggtagagcggcacacacgtacttgggagtcggccat

SEQ ID NO: 387182 - DNA, 140 bp, Artificial Sequence
  Synthetic
atggccgactcccaagtacgtgtgtgccgctctaccgagcggggagtaggaaaaggcctagtcccacggaaagtaggagtaggctaaggagtaataagcggggtcgggcacgcaacacgcggagacccagcatggcgtat

SEQ ID NO: 387183 - DNA, 140 bp, Artificial Sequence
  Synthetic
atacgccatgctgggtctccctagctacactccatagctaactgttctttttttttttttttttttttttttttttttttttttttttttttttttttttttttttttttttttttttttcgtacttgggagtcggccat

SEQ ID NO: 387184 - DNA, 140 bp, Artificial Sequence
  Synthetic
atggccgactcccaagtacgaaaaaaaaaaaaaaaaaaaaaaaaaaaaaaaaaaaaaaaaaaaaaaaaaaaaaaaaaaaaaaaaaaaaaaaaagaacagttagctatggagtgtagctagggagacccagcatggcgtat

SEQ ID NO: 387185 - DNA, 140 bp, Artificial Sequence
  Synthetic
aggccctggctgctgatatggccgcgcaggggccccaggttgggtgtgcgcgcgacaaggaagacttcggagcggtcccagccacgtgggaggcgccagcccatccccaaagatcggcgcgaccttttgggacagcggtg

SEQ ID NO: 387186 - DNA, 140 bp, Artificial Sequence
  Synthetic
caccgctgtcccaaaaggtcgcgccgatctttggggatgggctggcgcctcccacgtggctgggaccgctccgaagtcttccttgtcgcgcgcacacccaacctggggcccctgcgcggccatatcagcagccagggcct

SEQ ID NO: 387187 - DNA, 140 bp, Artificial Sequence
  Synthetic
aggccctggctgctgatatgctaaacgactacccggtggggtcgcaactaccttgcgagcctgaaccggacgtggccgtgttgacgtccatgctcactgatccctcccacataacagcaggaccttttgggacagcggtg

SEQ ID NO: 387188 - DNA, 140 bp, Artificial Sequence
  Synthetic
caccgctgtcccaaaaggtcctgctgttatgtgggagggatcagtgagcatggacgtcaacacggccacgtccggttcaggctcgcaaggtagttgcgaccccaccgggtagtcgtttagcatatcagcagccagggcct

SEQ ID NO: 387189 - DNA, 140 bp, Artificial Sequence
  Synthetic
atacgccatgctgggtctccgtccctcttggggccccactgacccccggcataggtcgcgcaacgtgggtaaggtcatcgataccctaacgtgcggctttgccgacctcatggggtacatcgtacttgggagtcggccat

SEQ ID NO: 387190 - DNA, 140 bp, Artificial Sequence
  Synthetic
atggccgactcccaagtacgatgtaccccatgaggtcggcaaagccgcacgttagggtatcgatgaccttacccacgttgcgcgacctatgccgggggtcagtggggccccaagagggacggagacccagcatggcgtat

SEQ ID NO: 387191 - DNA, 140 bp, Artificial Sequence
  Synthetic
atacgccatgctgggtctcctcccgtcgtaggcgccccgcttggtggcgtcgccagagctctcgcgcatggtgtgagagtcctggaggacggggttaattatgcaacagggaacttacctcgtacttgggagtcggccat

SEQ ID NO: 387192 - DNA, 140 bp, Artificial Sequence
  Synthetic
atggccgactcccaagtacgaggtaagttccctgttgcataattaaccccgtcctccaggactctcacaccatgcgcgagagctctggcgacgccaccaagcggggcgcctacgacgggaggagacccagcatggcgtat

SEQ ID NO: 387193 - DNA, 140 bp, Artificial Sequence
  Synthetic
aggccctggctgctgatatggtgtgagagtcctggaggacggggttaattatgcaacagggaacttacctggttgctccttttctatcttcttgctggccctactgtcctgcatcaccatgaccttttgggacagcggtg

SEQ ID NO: 387194 - DNA, 140 bp, Artificial Sequence
  Synthetic
caccgctgtcccaaaaggtcatggtgatgcaggacagtagggccagcaagaagatagaaaaggagcaaccaggtaagttccctgttgcataattaaccccgtcctccaggactctcacaccatatcagcagccagggcct

SEQ ID NO: 387195 - DNA, 140 bp, Artificial Sequence
  Synthetic
atacgccatgctgggtctccaggatgtagtatgttgttcaatgtcatattcatggacgggggcgcttgttacacccaatgcagcggaagagtccaagctgcccatcaaccccctaagcaacgtacttgggagtcggccat

SEQ ID NO: 387196 - DNA, 140 bp, Artificial Sequence
  Synthetic
atggccgactcccaagtacgttgcttagggggttgatgggcagcttggactcttccgctgcattgggtgtaacaagcgcccccgtccatgaatatgacattgaacaacatactacatcctggagacccagcatggcgtat

SEQ ID NO: 387197 - DNA, 140 bp, Artificial Sequence
  Synthetic
aggccctggctgctgatatggtgttggataccggtctcaccaaacgtggctgtgcagcggccaggcgccctcacgcagggcttgcggacgcacatcgacatggttgtgatgtccgccacggaccttttgggacagcggtg

SEQ ID NO: 387198 - DNA, 140 bp, Artificial Sequence
  Synthetic
caccgctgtcccaaaaggtccgtggcggacatcacaaccatgtcgatgtgcgtccgcaagccctgcgtgagggcgcctggccgctgcacagccacgtttggtgagaccggtatccaacaccatatcagcagccagggcct

SEQ ID NO: 387199 - DNA, 140 bp, Artificial Sequence
  Synthetic
aggccctggctgctgatatggacatgatgatgaactggtcgcccacggccaccatgatcctggcgtacgcgatgcgcgttcccgaggtcatcatagacatcattggcggggctcactggggaccttttgggacagcggtg

SEQ ID NO: 387200 - DNA, 140 bp, Artificial Sequence
  Synthetic
caccgctgtcccaaaaggtccccagtgagccccgccaatgatgtctatgatgacctcgggaacgcgcatcgcgtacgccaggatcatggtggccgtgggcgaccagttcatcatcatgtccatatcagcagccagggcct

SEQ ID NO: 387201 - DNA, 140 bp, Artificial Sequence
  Synthetic
atacgccatgctgggtctccgatgcgcgttcccgaggtcatcatagacatcattggcggggctcactggggcgtcatgttcggcttagcctacttctccatgcagggagcgtgggcgaaacgtacttgggagtcggccat

SEQ ID NO: 387202 - DNA, 140 bp, Artificial Sequence
  Synthetic
atggccgactcccaagtacgtttcgcccacgctccctgcatggagaagtaggctaagccgaacatgacgccccagtgagccccgccaatgatgtctatgatgacctcgggaacgcgcatcggagacccagcatggcgtat

SEQ ID NO: 387203 - DNA, 140 bp, Artificial Sequence
  Synthetic
  misc_feature (43)..(43): n is a, c, g, or t
atacgccatgctgggtctcccgcccggbgctaagcagaacatncagcttattaactccaatggcagttggcatatcaaccgcactgccctgaattgcaatgactccctgaacaccggcttcgtacttgggagtcggccat

SEQ ID NO: 387204 - DNA, 140 bp, Artificial Sequence
  Synthetic
  misc_feature (98)..(98): n is a, c, g, or t
atggccgactcccaagtacgaagccggtgttcagggagtcattgcaattcagggcagtgcggttgatatgccaactgccattggagttaataagctgnatgttctgcttagcbccgggcgggagacccagcatggcgtat

SEQ ID NO: 387205 - DNA, 140 bp, Artificial Sequence
  Synthetic
atacgccatgctgggtctccaacgcctgtccgcctgccgtaatatcgaggcctttcggataggatggggcaccttgcaatacgaggagaatgtcaccaacccagaagatatgagaccatacgtacttgggagtcggccat

SEQ ID NO: 387206 - DNA, 140 bp, Artificial Sequence
  Synthetic
atggccgactcccaagtacgtatggtctcatatcttctgggttggtgacattctcctcgtattgcaaggtgccccatcctatccgaaaggcctcgatattacggcaggcggacaggcgttggagacccagcatggcgtat

SEQ ID NO: 387207 - DNA, 140 bp, Artificial Sequence
  Synthetic
aggccctggctgctgatatgcataacaaattcaactcatcaggctgtcccgaaaggttggccagctgccgacgccttactgattttgctcagggttggggccccattagacatgccaacggaccttttgggacagcggtg

SEQ ID NO: 387208 - DNA, 140 bp, Artificial Sequence
  Synthetic
caccgctgtcccaaaaggtccgttggcatgtctaatggggccccaaccctgagcaaaatcagtaaggcgtcggcagctggccaacctttcgggacagcctgatgagttgaatttgttatgcatatcagcagccagggcct

SEQ ID NO: 387209 - DNA, 140 bp, Artificial Sequence
  Synthetic
aggccctggctgctgatatggggactggatatgcgaggtgctgagcgattttaagacctggctgaaggccaagctcatgccacaactgcctgggattccctttgtgtcctgccaacgcgggaccttttgggacagcggtg

SEQ ID NO: 387210 - DNA, 140 bp, Artificial Sequence
  Synthetic
caccgctgtcccaaaaggtcccgcgttggcaggacacaaagggaatcccaggcagttgtggcatgagcttggccttcagccaggtcttaaaatcgctcagcacctcgcatatccagtccccatatcagcagccagggcct

SEQ ID NO: 387211 - DNA, 140 bp, Artificial Sequence
  Synthetic
  misc_feature (22)..(22): n is a, c, g, or t
atacgccatgctgggtctccancgttgcaacttggaggacagggacagaggtcaagtgtctcctttgttgcactccaccacagagtgggccattttgccctgctcttacacagacttgcccgtacttgggagtcggccat

SEQ ID NO: 387212 - DNA, 140 bp, Artificial Sequence
  Synthetic
  misc_feature (119)..(119): n is a, c, g, or t
atggccgactcccaagtacgggcaagtctgtgtaagagcagggcaaaatggcccactctgtggtggagtgcaacaaaggagacacttgacctctgtccctgtcctccaagttgcaacgntggagacccagcatggcgtat

SEQ ID NO: 387213 - DNA, 140 bp, Artificial Sequence
  Synthetic
  misc_feature (67)..(67): n is a, c, g, or t
atacgccatgctgggtctcctactttgtcatctttttcatagctgcttggtacatcaagggtcgggnggtccctttggctacctattccctcactggcctatggcccttctgcctactgccgtacttgggagtcggccat

SEQ ID NO: 387214 - DNA, 140 bp, Artificial Sequence
  Synthetic
  misc_feature (74)..(74): n is a, c, g, or t
atggccgactcccaagtacggcagtaggcagaagggccataggccagtgagggaataggtagccaaagggaccncccgacccttgatgtaccaagcagctatgaaaaagatgacaaagtaggagacccagcatggcgtat

SEQ ID NO: 387215 - DNA, 140 bp, Artificial Sequence
  Synthetic
aggccctggctgctgatatgggcactacccctgcactgtcaactttaccatcttcaaggttaggatgtatgtggggggtgtggagcacaggctccaagccgcatgcaattggactcgagggaccttttgggacagcggtg

SEQ ID NO: 387216 - DNA, 140 bp, Artificial Sequence
  Synthetic
caccgctgtcccaaaaggtccctcgagtccaattgcatgcggcttggagcctgtgctccacaccccccacatacatcctaaccttgaagatggtaaagttgacagtgcaggggtagtgcccatatcagcagccagggcct

SEQ ID NO: 387217 - DNA, 140 bp, Artificial Sequence
  Synthetic
atacgccatgctgggtctcccgcggtggccgcgatggcatcatatgggccgccaccatattctgcccgggtgtggtgtttgacataaccaagtggctcttggcggtgcttgggcctggttcgtacttgggagtcggccat

SEQ ID NO: 387218 - DNA, 140 bp, Artificial Sequence
  Synthetic
atggccgactcccaagtacgaaccaggcccaagcaccgccaagagccacttggttatgtcaaacaccacacccgggcagaatatggtggcggcccatatgatgccatcgcggccaccgcgggagacccagcatggcgtat

SEQ ID NO: 387219 - DNA, 140 bp, Artificial Sequence
  Synthetic
aggccctggctgctgatatgagagcgttgtgacttggaggacagggatagatcagagctcagtccgctgctgctgtccacaacagagtggcagatactgccctgttccttcaccaccctagaccttttgggacagcggtg

SEQ ID NO: 387220 - DNA, 140 bp, Artificial Sequence
  Synthetic
caccgctgtcccaaaaggtctagggtggtgaaggaacagggcagtatctgccactctgttgtggacagcagcagcggactgagctctgatctatccctgtcctccaagtcacaacgctctcatatcagcagccagggcct

SEQ ID NO: 387221 - DNA, 140 bp, Artificial Sequence
  Synthetic
aggccctggctgctgatatgttggcggtcgccgtggagcctatcatcttcagtccgatggagaagaaggtcatcacctggggagcggagacggctgcatgcggggacatcttacacggacgaccttttgggacagcggtg

SEQ ID NO: 387222 - DNA, 140 bp, Artificial Sequence
  Synthetic
caccgctgtcccaaaaggtcgtccgtgtaagatgtccccgcatgcagccgtctccgctccccaggtgatgaccttcttctccatcggactgaagatgataggctccacggcgaccgccaacatatcagcagccagggcct

SEQ ID NO: 387223 - DNA, 140 bp, Artificial Sequence
  Synthetic
aggccctggctgctgatatgttcgggggggccgcgatgccatcatcctcctcacgtgcgcgatccacccagagctaatctttaccatcactaagatcttgctcgccatactcggtccgctgaccttttgggacagcggtg

SEQ ID NO: 387224 - DNA, 140 bp, Artificial Sequence
  Synthetic
caccgctgtcccaaaaggtcagcggaccgagtatggcgagcaagatcttagtgatggtaaagattagctctgggtggatcgcgcacgtgaggaggatgatggcatcgcggcccccccgaacatatcagcagccagggcct

SEQ ID NO: 387225 - DNA, 140 bp, Artificial Sequence
  Synthetic
aggccctggctgctgatatggctcgccatattcggtccgctcatggtgctccaggctagcataatcaagatgccgtactttgtgcgcgctcaagggctcattcgtgcatgcatgctggtggaccttttgggacagcggtg

SEQ ID NO: 387226 - DNA, 140 bp, Artificial Sequence
  Synthetic
caccgctgtcccaaaaggtccaccagcatgcatgcacgaatgagcccttgagcgcgcacaaagtacggcatcttgattatgctagcctggagcaccatgagcggaccgaatatggcgagccatatcagcagccagggcct

SEQ ID NO: 387227 - DNA, 140 bp, Artificial Sequence
  Synthetic
atacgccatgctgggtctccccggctgtgccccagacctatcaggtcggatacctgcatgccccaactggcagtggaaagagtaccaaagtccctgtcgcgtatgccgctcaggggtatacgtacttgggagtcggccat

SEQ ID NO: 387228 - DNA, 140 bp, Artificial Sequence
  Synthetic
atggccgactcccaagtacgtatacccctgagcggcatacgcgacagggactttggtactctttccactgccagttggggcatgcaggtatccgacctgataggtctggggcacagccggggagacccagcatggcgtat

SEQ ID NO: 387229 - DNA, 140 bp, Artificial Sequence
  Synthetic
aggccctggctgctgatatgcgccccccgggtcagtgacaaccccccatcccaatatagaggaggtagccctcgggcaggagggtgagatccccttctatgggaaggcgattcccctgtcgaccttttgggacagcggtg

SEQ ID NO: 387230 - DNA, 140 bp, Artificial Sequence
  Synthetic
caccgctgtcccaaaaggtcgacaggggaatcgccttcccatagaaggggatctcaccctcctgcccgagggctacctcctctatattgggatggggggttgtcactgacccggggggcgcatatcagcagccagggcct

SEQ ID NO: 387231 - DNA, 140 bp, Artificial Sequence
  Synthetic
aggccctggctgctgatatgctcgggcaggagggtgagatccccttctatgggaaggcgattcccctgtcttacatcaagggagggagacacttgatcttctgccattcaaagaaaaagtgaccttttgggacagcggtg

SEQ ID NO: 387232 - DNA, 140 bp, Artificial Sequence
  Synthetic
caccgctgtcccaaaaggtcactttttctttgaatggcagaagatcaagtgtctccctcccttgatgtaagacaggggaatcgccttcccatagaaggggatctcaccctcctgcccgagcatatcagcagccagggcct

SEQ ID NO: 387233 - DNA, 140 bp, Artificial Sequence
  Synthetic
atacgccatgctgggtctccttacatcaagggagggagacacttgatcttctgccattcaaagaaaaagtgtgacgagctcgcggcggcccttcggggcatgggcttgaacgctgtggcacgtacttgggagtcggccat

SEQ ID NO: 387234 - DNA, 140 bp, Artificial Sequence
  Synthetic
atggccgactcccaagtacgtgccacagcgttcaagcccatgccccgaagggccgccgcgagctcgtcacactttttctttgaatggcagaagatcaagtgtctccctcccttgatgtaaggagacccagcatggcgtat

SEQ ID NO: 387235 - DNA, 140 bp, Artificial Sequence
  Synthetic
aggccctggctgctgatatgggtcgtcgccaccgacgccctcatgacggggtatactggagactttgactccgtgatcgattgcaacgtagcggtcactcaagtcgtagacttcagcttggaccttttgggacagcggtg

SEQ ID NO: 387236 - DNA, 140 bp, Artificial Sequence
  Synthetic
caccgctgtcccaaaaggtccaagctgaagtctacgacttgagtgaccgctacgttgcaatcgatcacggagtcaaagtctccagtataccccgtcatgagggcgtcggtggcgacgacccatatcagcagccagggcct

SEQ ID NO: 387237 - DNA, 140 bp, Artificial Sequence
  Synthetic
atacgccatgctgggtctccggtatgtttccactggtgagcgagcctcaggaatgtttgacagtgtagtgctctgtgagtgctacgacgcaggggctgcgtggtatgagctcacaccagtcgtacttgggagtcggccat

SEQ ID NO: 387238 - DNA, 140 bp, Artificial Sequence
  Synthetic
atggccgactcccaagtacgactggtgtgagctcataccacgcagcccctgcgtcgtagcactcacagagcactacactgtcaaacattcctgaggctcgctcaccagtggaaacataccggagacccagcatggcgtat

SEQ ID NO: 387239 - DNA, 140 bp, Artificial Sequence
  Synthetic
atacgccatgctgggtctcccgaggtcaccctcacacatcctgtgacgaagtacatcgccacatgtatgcaagctgaccttgaggtcatgaccagcacgtgggtcctagctgggggagtccgtacttgggagtcggccat

SEQ ID NO: 387240 - DNA, 140 bp, Artificial Sequence
  Synthetic
atggccgactcccaagtacggactcccccagctaggacccacgtgctggtcatgacctcaaggtcagcttgcatacatgtggcgatgtacttcgtcacaggatgtgtgagggtgacctcgggagacccagcatggcgtat

SEQ ID NO: 387241 - DNA, 140 bp, Artificial Sequence
  Synthetic
atacgccatgctgggtctcctcctcaacgacaggagcacgatcatgcgcacccgtggccaggacccaacgctgcccgagatgcgccgcgtgcggctgctggagatggcggacgcgatggacgtacttgggagtcggccat

SEQ ID NO: 387242 - DNA, 140 bp, Artificial Sequence
  Synthetic
atggccgactcccaagtacgtccatcgcgtccgccatctccagcagccgcacgcggcgcatctcgggcagcgttgggtcctggccacgggtgcgcatgatcgtgctcctgtcgttgaggaggagacccagcatggcgtat

SEQ ID NO: 387243 - DNA, 140 bp, Artificial Sequence
  Synthetic
aggccctggctgctgatatgcgtctgccaggaccatctggagttctgggagagcgtcttcacaggcctcacccacatagatgcccatttcttgtcccagactaagcaggcaggagacaacgaccttttgggacagcggtg

SEQ ID NO: 387244 - DNA, 140 bp, Artificial Sequence
  Synthetic
caccgctgtcccaaaaggtcgttgtctcctgcctgcttagtctgggacaagaaatgggcatctatgtgggtgaggcctgtgaagacgctctcccagaactccagatggtcctggcagacgcatatcagcagccagggcct

SEQ ID NO: 387245 - DNA, 140 bp, Artificial Sequence
  Synthetic
aggccctggctgctgatatgaagatcatgtctggcgagaagccctccatggaggatgtcgtcaacctgctgcccgggattctgtctccgggtgccctggtggtgggagtcatctgcgcgggaccttttgggacagcggtg

SEQ ID NO: 387246 - DNA, 140 bp, Artificial Sequence
  Synthetic
caccgctgtcccaaaaggtcccgcgcagatgactcccaccaccagggcacccggagacagaatcccgggcagcaggttgacgacatcctccatggagggcttctcgccagacatgatcttcatatcagcagccagggcct

SEQ ID NO: 387247 - DNA, 140 bp, Artificial Sequence
  Synthetic
aggccctggctgctgatatgttgaaggttggggtaaacactccgcctcttaggccatttccgttttttttgtttttttcctttttttttctttttttttttccttttttttcccttttccgaccttttgggacagcggtg

SEQ ID NO: 387248 - DNA, 140 bp, Artificial Sequence
  Synthetic
caccgctgtcccaaaaggtcggaaaagggaaaaaaaaggaaaaaaaaaaagaaaaaaaaaggaaaaaaacaaaaaaaacggaaatggcctaagaggcggagtgtttaccccaaccttcaacatatcagcagccagggcct

SEQ ID NO: 387249 - DNA, 140 bp, Artificial Sequence
  Synthetic
  misc_feature (25)..(25): n is a, c, g, or t
aggccctggctgctgatatgtcccnaagatgcccggcctccccttaatctcttgccaaaaggggtacaagggcgtgtgggccggcactggtatcatgaccacacggtgtccttgcggcgcgaccttttgggacagcggtg

SEQ ID NO: 387250 - DNA, 140 bp, Artificial Sequence
  Synthetic
  misc_feature (116)..(116): n is a, c, g, or t
caccgctgtcccaaaaggtcgcgccgcaaggacaccgtgtggtcatgataccagtgccggcccacacgcccttgtaccccttttggcaagagattaaggggaggccgggcatcttngggacatatcagcagccagggcct

SEQ ID NO: 387251 - DNA, 140 bp, Artificial Sequence
  Synthetic
atacgccatgctgggtctcccctatataacaggactgaccactgacaatttgaaagttccctgccaactaccttctccagagtttttttcctgggtggacggagtgcaaatccataggttcgtacttgggagtcggccat

SEQ ID NO: 387252 - DNA, 140 bp, Artificial Sequence
  Synthetic
atggccgactcccaagtacgaacctatggatttgcactccgtccacccaggaaaaaaactctggagaaggtagttggcagggaactttcaaattgtcagtggtcagtcctgttatataggggagacccagcatggcgtat

SEQ ID NO: 387253 - DNA, 140 bp, Artificial Sequence
  Synthetic
atacgccatgctgggtctccccttctccagagtttttttcctgggtggacggagtgcaaatccataggtttgctcccacaccaaagccgtttttccgggatgaggtctcgttttgcgttgcgtacttgggagtcggccat

SEQ ID NO: 387254 - DNA, 140 bp, Artificial Sequence
  Synthetic
atggccgactcccaagtacgcaacgcaaaacgagacctcatcccggaaaaacggctttggtgtgggagcaaacctatggatttgcactccgtccacccaggaaaaaaactctggagaaggggagacccagcatggcgtat

SEQ ID NO: 387255 - DNA, 140 bp, Artificial Sequence
  Synthetic
atacgccatgctgggtctccgatacagacgtattgacgtccatgctaacagatccatcccatatcacggcggaggctgcagcgcggcgcttagcgcgggggtcacccccatctgaggcgacgtacttgggagtcggccat

SEQ ID NO: 387256 - DNA, 140 bp, Artificial Sequence
  Synthetic
atggccgactcccaagtacgtcgcctcagatgggggtgacccccgcgctaagcgccgcgctgcagcctccgccgtgatatgggatggatctgttagcatggacgtcaatacgtctgtatcggagacccagcatggcgtat

SEQ ID NO: 387257 - DNA, 140 bp, Artificial Sequence
  Synthetic
atacgccatgctgggtctccggaggctgcagcgcggcgcttagcgcgggggtcacccccatctgaggcgagctcctcagcgagccaactatcggcaccatcgctgcgagccacctgcacccgtacttgggagtcggccat

SEQ ID NO: 387258 - DNA, 140 bp, Artificial Sequence
  Synthetic
atggccgactcccaagtacgggtgcaggtggctcgcagcgatggtgccgatagttggctcgctgaggagctcgcctcagatgggggtgacccccgcgctaagcgccgcgctgcagcctccggagacccagcatggcgtat

SEQ ID NO: 387259 - DNA, 140 bp, Artificial Sequence
  Synthetic
  misc_feature (56)..(56): n is a, c, g, or t
aggccctggctgctgatatgtgggccatcaagtgggagtacgtcatcctcttgttnctcctgcttgcagacgcgcgcatctgctcctgcttgtggatgatgctactcatatcccaagcgggaccttttgggacagcggtg

SEQ ID NO: 387260 - DNA, 140 bp, Artificial Sequence
  Synthetic
  misc_feature (85)..(85): n is a, c, g, or t
caccgctgtcccaaaaggtcccgcttgggatatgagtagcatcatccacaagcaggagcagatgcgcgcgtctgcaagcaggagnaacaagaggatgacgtactcccacttgatggcccacatatcagcagccagggcct

SEQ ID NO: 387261 - DNA, 140 bp, Artificial Sequence
  Synthetic
aggccctggctgctgatatgctgggcacggcctgattacaacccaccggttgtggaatcgtggaagaggccagattaccaaccacccactgttgcgggctgcgctctccccccctccaaggaccttttgggacagcggtg

SEQ ID NO: 387262 - DNA, 140 bp, Artificial Sequence
  Synthetic
caccgctgtcccaaaaggtccttggagggggggagagcgcagcccgcaacagtgggtggttggtaatctggcctcttccacgattccacaaccggtgggttgtaatcaggccgtgcccagcatatcagcagccagggcct

SEQ ID NO: 387263 - DNA, 140 bp, Artificial Sequence
  Synthetic
atacgccatgctgggtctccttgctggtgtcgatgcacatacccacgtcaccggggggagcgaagctcgagccacgtctgcactcgtcaaccttttcaacgttggccccaagcaaaacatcgtacttgggagtcggccat

SEQ ID NO: 387264 - DNA, 140 bp, Artificial Sequence
  Synthetic
atggccgactcccaagtacgatgttttgcttggggccaacgttgaaaaggttgacgagtgcagacgtggctcgagcttcgctccccccggtgacgtgggtatgtgcatcgacaccagcaaggagacccagcatggcgtat

SEQ ID NO: 387265 - DNA, 140 bp, Artificial Sequence
  Synthetic
  misc_feature (48)..(48): n is a, c, g, or t
atacgccatgctgggtctccagcccccctcaaccggtgactcaggccnttccacgggggcggacgctgccgactccggcggtcggacgccccctgatgaattgactccttcggagacaggcgtacttgggagtcggccat

SEQ ID NO: 387266 - DNA, 140 bp, Artificial Sequence
  Synthetic
  misc_feature (93)..(93): n is a, c, g, or t
atggccgactcccaagtacgcctgtctccgaaggagtcaattcatcagggggcgtccgaccgccggagtcggcagcgtccgcccccgtggaanggcctgagtcaccggttgaggggggctggagacccagcatggcgtat

SEQ ID NO: 387267 - DNA, 140 bp, Artificial Sequence
  Synthetic
atacgccatgctgggtctccgctcccggctcggactcggggtcctggtctacttgctccgaggaggatgactccgtcgtgtgctgctccatgtcatactcctggaccggggctctaataacgtacttgggagtcggccat

SEQ ID NO: 387268 - DNA, 140 bp, Artificial Sequence
  Synthetic
atggccgactcccaagtacgttattagagccccggtccaggagtatgacatggagcagcacacgacggagtcatcctcctcggagcaagtagaccaggaccccgagtccgagccgggagcggagacccagcatggcgtat

SEQ ID NO: 387269 - DNA, 140 bp, Artificial Sequence
  Synthetic
aggccctggctgctgatatgcagctcttcagctagccagttgtctgcgccttccttgaaggcgacatgcactacccgtcatgactccccggacgctgacctcatcgaggccaacctcctggaccttttgggacagcggtg

SEQ ID NO: 387270 - DNA, 140 bp, Artificial Sequence
  Synthetic
caccgctgtcccaaaaggtccaggaggttggcctcgatgaggtcagcgtccggggagtcatgacgggtagtgcatgtcgccttcaaggaaggcgcagacaactggctagctgaagagctgcatatcagcagccagggcct

SEQ ID NO: 387271 - DNA, 140 bp, Artificial Sequence
  Synthetic
aggccctggctgctgatatgcagccccgtggtggtgggaacgaccgacaagttgggcgcgcctacctacaattggggtagcagtgataaggatgtcctcattcttaacaacaccaggccagaccttttgggacagcggtg

SEQ ID NO: 387272 - DNA, 140 bp, Artificial Sequence
  Synthetic
caccgctgtcccaaaaggtctggcctggtgttgttaagaatgaggacatccttatcactgctaccccaattgtaggtaggcgcgcccaacttgtcggtcgttcccaccaccacggggctgcatatcagcagccagggcct

SEQ ID NO: 387273 - DNA, 140 bp, Artificial Sequence
  Synthetic
aggccctggctgctgatatgaccctgacctcggcgtcagggtctgcgagaagatggccctttatgatgtcacacaaaagcttcctcaggcggtgatgggggcttcttatggcttccagtagaccttttgggacagcggtg

SEQ ID NO: 387274 - DNA, 140 bp, Artificial Sequence
  Synthetic
caccgctgtcccaaaaggtctactggaagccataagaagcccccatcaccgcctgaggaagcttttgtgtgacatcataaagggccatcttctcgcagaccctgacgccgaggtcagggtcatatcagcagccagggcct

SEQ ID NO: 387275 - DNA, 140 bp, Artificial Sequence
  Synthetic
aggccctggctgctgatatggggcgctgttcagaatgaagtcaccctgacgcacccaatcaccaaatacatcatgacatgcatgtcggctgacctggaggtcgtcacgagtacctgggtggaccttttgggacagcggtg

SEQ ID NO: 387276 - DNA, 140 bp, Artificial Sequence
  Synthetic
caccgctgtcccaaaaggtccacccaggtactcgtgacgacctccaggtcagccgacatgcatgtcatgatgtatttggtgattgggtgcgtcagggtgacttcattctgaacagcgccccatatcagcagccagggcct

SEQ ID NO: 387277 - DNA, 140 bp, Artificial Sequence
  Synthetic
atacgccatgctgggtctccctccacgtccccgggtgcgtcccgtgcgagaaagtggggaatacatctcggtgctggataccggtctcaccgaatgtggccgtgcagcagcccggcgccccgtacttgggagtcggccat

SEQ ID NO: 387278 - DNA, 140 bp, Artificial Sequence
  Synthetic
atggccgactcccaagtacggggcgccgggctgctgcacggccacattcggtgagaccggtatccagcaccgagatgtattccccactttctcgcacgggacgcacccggggacgtggagggagacccagcatggcgtat

SEQ ID NO: 387279 - DNA, 140 bp, Artificial Sequence
  Synthetic
aggccctggctgctgatatggtgctggataccggtctcaccgaatgtggccgtgcagcagcccggcgccctcacgcagggcttacggacgcacattgacatggttgtgatgtccgccacggaccttttgggacagcggtg

SEQ ID NO: 387280 - DNA, 140 bp, Artificial Sequence
  Synthetic
caccgctgtcccaaaaggtccgtggcggacatcacaaccatgtcaatgtgcgtccgtaagccctgcgtgagggcgccgggctgctgcacggccacattcggtgagaccggtatccagcaccatatcagcagccagggcct

SEQ ID NO: 387281 - DNA, 140 bp, Artificial Sequence
  Synthetic
aggccctggctgctgatatggcgtcatgttcggcttagcctacttctctatgcagggagcgtgggcaaaagtcgttgtcattcttttgctggccgccggggtggacgcgcaaacccatacgaccttttgggacagcggtg

SEQ ID NO: 387282 - DNA, 140 bp, Artificial Sequence
  Synthetic
caccgctgtcccaaaaggtcgtatgggtttgcgcgtccaccccggcggccagcaaaagaatgacaacgacttttgcccacgctccctgcatagagaagtaggctaagccgaacatgacgccatatcagcagccagggcct

SEQ ID NO: 387283 - DNA, 140 bp, Artificial Sequence
  Synthetic
aggccctggctgctgatatgcacatcaacaggactgccttgaactgcaatgactccctccaaactgggttcattgccgcgctggtctacagaaacaagttcaattcgtccggatgcccaggaccttttgggacagcggtg

SEQ ID NO: 387284 - DNA, 140 bp, Artificial Sequence
  Synthetic
caccgctgtcccaaaaggtcctgggcatccggacgaattgaacttgtttctgtagaccagcgcggcaatgaacccagtttggagggagtcattgcagttcaaggcagtcctgttgatgtgcatatcagcagccagggcct

SEQ ID NO: 387285 - DNA, 140 bp, Artificial Sequence
  Synthetic
atacgccatgctgggtctcccacatcaaccgcaccgccctgaactgcaatgactctttgcacaccggcttcctcgcgtcactgttctacacccacagcttcaactcgtcaggatgtcccgcgtacttgggagtcggccat

SEQ ID NO: 387286 - DNA, 140 bp, Artificial Sequence
  Synthetic
atggccgactcccaagtacgcgggacatcctgacgagttgaagctgtgggtgtagaacagtgacgcgaggaagccggtgtgcaaagagtcattgcagttcagggcggtgcggttgatgtgggagacccagcatggcgtat

SEQ ID NO: 387287 - DNA, 140 bp, Artificial Sequence
  Synthetic
aggccctggctgctgatatgcctcgcgtcactgttctacacccacagcttcaactcgtcaggatgtcccgaacgcatgtccgcctgccgcagtatcgaggcctttcgggtgggatggggcgaccttttgggacagcggtg

SEQ ID NO: 387288 - DNA, 140 bp, Artificial Sequence
  Synthetic
caccgctgtcccaaaaggtcgccccatcccacccgaaaggcctcgatactgcggcaggcggacatgcgttcgggacatcctgacgagttgaagctgtgggtgtagaacagtgacgcgaggcatatcagcagccagggcct

SEQ ID NO: 387289 - DNA, 140 bp, Artificial Sequence
  Synthetic
atacgccatgctgggtctcctgtgtggcccagtgtactgtttcacccccagcccagtagtagtgggtacgaccgatagacttggagcgcccacttacacgtggggggagaatgagacagacgtacttgggagtcggccat

SEQ ID NO: 387290 - DNA, 140 bp, Artificial Sequence
  Synthetic
atggccgactcccaagtacgtctgtctcattctccccccacgtgtaagtgggcgctccaagtctatcggtcgtacccactactactgggctgggggtgaaacagtacactgggccacacaggagacccagcatggcgtat

SEQ ID NO: 387291 - DNA, 140 bp, Artificial Sequence
  Synthetic
aggccctggctgctgatatgcattacccctgcacagttaactataccatcttcaaaataaggatgtatgtggggggggtcgagcacaggctcacggctgcgtgcaatttcactcgtgggggaccttttgggacagcggtg

SEQ ID NO: 387292 - DNA, 140 bp, Artificial Sequence
  Synthetic
caccgctgtcccaaaaggtcccccacgagtgaaattgcacgcagccgtgagcctgtgctcgaccccccccacatacatccttattttgaagatggtatagttaactgtgcaggggtaatgcatatcagcagccagggcct

SEQ ID NO: 387293 - DNA, 140 bp, Artificial Sequence
  Synthetic
atacgccatgctgggtctccggggggggtcgagcacaggctcacggctgcgtgcaatttcactcgtggggatcgttgcaacttggaggacagagacagaagtcaactgtctcctttgctgcgtacttgggagtcggccat

SEQ ID NO: 387294 - DNA, 140 bp, Artificial Sequence
  Synthetic
atggccgactcccaagtacgcagcaaaggagacagttgacttctgtctctgtcctccaagttgcaacgatccccacgagtgaaattgcacgcagccgtgagcctgtgctcgaccccccccggagacccagcatggcgtat

SEQ ID NO: 387295 - DNA, 140 bp, Artificial Sequence
  Synthetic
atacgccatgctgggtctccgagtgggtagtactcttattcctgctcttagcggacgccagggtttgcgcctgcttatggatgctcatcttgttgggccaggccgaagcagcactagagacgtacttgggagtcggccat

SEQ ID NO: 387296 - DNA, 140 bp, Artificial Sequence
  Synthetic
atggccgactcccaagtacgtctctagtgctgcttcggcctggcccaacaagatgagcatccataagcaggcgcaaaccctggcgtccgctaagagcaggaataagagtactacccactcggagacccagcatggcgtat

SEQ ID NO: 387297 - DNA, 140 bp, Artificial Sequence
  Synthetic
atacgccatgctgggtctccagttggtcgtcttgcacgctgcgagcgcagctagctgcaatggcttcctatactttgtcatctttttcgtggctgcttggtacatcaagggtcgggtagtcgtacttgggagtcggccat

SEQ ID NO: 387298 - DNA, 140 bp, Artificial Sequence
  Synthetic
atggccgactcccaagtacgactacccgacccttgatgtaccaagcagccacgaaaaagatgacaaagtataggaagccattgcagctagctgcgctcgcagcgtgcaagacgaccaactggagacccagcatggcgtat

SEQ ID NO: 387299 - DNA, 140 bp, Artificial Sequence
  Synthetic
atacgccatgctgggtctcccagataggagcagctctgttggtactgatcactctctttacactcacccccgggtataagacccttctcagccggtttctgtggtggttgtgctatcttccgtacttgggagtcggccat

SEQ ID NO: 387300 - DNA, 140 bp, Artificial Sequence
  Synthetic
atggccgactcccaagtacggaagatagcacaaccaccacagaaaccggctgagaagggtcttatacccgggggtgagtgtaaagagagtgatcagtaccaacagagctgctcctatctgggagacccagcatggcgtat

SEQ ID NO: 387301 - DNA, 140 bp, Artificial Sequence
  Synthetic
atacgccatgctgggtctcctgaccctggcggaagctatggtccaggagtgggcaccacctatgcaggtgcgcggtggccgtgatgggatcatatgggccgtcgccatattctgcccgggcgtacttgggagtcggccat

SEQ ID NO: 387302 - DNA, 140 bp, Artificial Sequence
  Synthetic
atggccgactcccaagtacgcccgggcagaatatggcgacggcccatatgatcccatcacggccaccgcgcacctgcataggtggtgcccactcctggaccatagcttccgccagggtcaggagacccagcatggcgtat

SEQ ID NO: 387303 - DNA, 140 bp, Artificial Sequence
  Synthetic
aggccctggctgctgatatgcgcggtggccgtgatgggatcatatgggccgtcgccatattctgcccgggtgtggtgtttgacataaccaagtggctcttggcggtgcttgggcctgcttgaccttttgggacagcggtg

SEQ ID NO: 387304 - DNA, 140 bp, Artificial Sequence
  Synthetic
caccgctgtcccaaaaggtcaagcaggcccaagcaccgccaagagccacttggttatgtcaaacaccacacccgggcagaatatggcgacggcccatatgatcccatcacggccaccgcgcatatcagcagccagggcct

SEQ ID NO: 387305 - DNA, 140 bp, Artificial Sequence
  Synthetic
atacgccatgctgggtctccatgaccacctcacccctatgtcggattgggctgctaatggcctgcgggacttggcggtcgccgtggagcctatcatcttcagtccgatggagaaaaaagtcgtacttgggagtcggccat

SEQ ID NO: 387306 - DNA, 140 bp, Artificial Sequence
  Synthetic
atggccgactcccaagtacgacttttttctccatcggactgaagatgataggctccacggcgaccgccaagtcccgcaggccattagcagcccaatccgacataggggtgaggtggtcatggagacccagcatggcgtat

SEQ ID NO: 387307 - DNA, 140 bp, Artificial Sequence
  Synthetic
atacgccatgctgggtctccttcccgtgtccgcccgacttggccgggaggtcctccttggcccagctgatggctatacctccaaggggtggagtcttctcgcccccatcactgcttatgccgtacttgggagtcggccat

SEQ ID NO: 387308 - DNA, 140 bp, Artificial Sequence
  Synthetic
atggccgactcccaagtacggcataagcagtgatgggggcgagaagactccaccccttggaggtatagccatcagctgggccaaggaggacctcccggccaagtcgggcggacacgggaaggagacccagcatggcgtat

SEQ ID NO: 387309 - DNA, 140 bp, Artificial Sequence
  Synthetic
aggccctggctgctgatatgacggccttgaactgtaatgcgagcctcgacactggctgggtagcggggctcctctattaccacaaattcaactcttcaggctgccccgagaggatggccagaccttttgggacagcggtg

SEQ ID NO: 387310 - DNA, 140 bp, Artificial Sequence
  Synthetic
caccgctgtcccaaaaggtctggccatcctctcggggcagcctgaagagttgaatttgtggtaatagaggagccccgctacccagccagtgtcgaggctcgcattacagttcaaggccgtcatatcagcagccagggcct

SEQ ID NO: 387311 - DNA, 140 bp, Artificial Sequence
  Synthetic
atacgccatgctgggtctccaagtgctagtgcttaatccctcggtggctgccaccctggggtttggggcgtacttgtccaaggcacatggcatcaatcccaacattaggactggggtcagcgtacttgggagtcggccat

SEQ ID NO: 387312 - DNA, 140 bp, Artificial Sequence
  Synthetic
atggccgactcccaagtacgctgaccccagtcctaatgttgggattgatgccatgtgccttggacaagtacgccccaaaccccagggtggcagccaccgagggattaagcactagcacttggagacccagcatggcgtat

SEQ ID NO: 387313 - DNA, 140 bp, Artificial Sequence
  Synthetic
atacgccatgctgggtctccgactgtgacgaccggggcgcccatcacgtactccacatatggcaaattcctcgccgatgggggctgcgcaggcggcgcctatgacatcatcatatgcgatcgtacttgggagtcggccat

SEQ ID NO: 387314 - DNA, 140 bp, Artificial Sequence
  Synthetic
atggccgactcccaagtacgatcgcatatgatgatgtcataggcgccgcctgcgcagcccccatcggcgaggaatttgccatatgtggagtacgtgatgggcgccccggtcgtcacagtcggagacccagcatggcgtat

SEQ ID NO: 387315 - DNA, 140 bp, Artificial Sequence
  Synthetic
aggccctggctgctgatatgggcaacaacaccttgcactgccccactgactgtttccgcaagcatccggaagctacatactctcggtgtggctccggtccctggatcacgcccaggtgccgaccttttgggacagcggtg

SEQ ID NO: 387316 - DNA, 140 bp, Artificial Sequence
  Synthetic
caccgctgtcccaaaaggtcggcacctgggcgtgatccagggaccggagccacaccgagagtatgtagcttccggatgcttgcggaaacagtcagtggggcagtgcaaggtgttgttgcccatatcagcagccagggcct

SEQ ID NO: 387317 - DNA, 140 bp, Artificial Sequence
  Synthetic
aggccctggctgctgatatgggtcgtcgccaccgacgccctcatgacggggtttactggagactttgactccgtgatcgactgcaacgtagcggtcactcaagttgtagacttcagcttggaccttttgggacagcggtg

SEQ ID NO: 387318 - DNA, 140 bp, Artificial Sequence
  Synthetic
caccgctgtcccaaaaggtccaagctgaagtctacaacttgagtgaccgctacgttgcagtcgatcacggagtcaaagtctccagtaaaccccgtcatgagggcgtcggtggcgacgacccatatcagcagccagggcct

SEQ ID NO: 387319 - DNA, 140 bp, Artificial Sequence
  Synthetic
aggccctggctgctgatatgtgtgccaagaccatcttgagttttgggaggcagttttcaccggcctcacacacatagatgcccacttcctttcccaaacaaagcaatcgggggaaaatttgaccttttgggacagcggtg

SEQ ID NO: 387320 - DNA, 140 bp, Artificial Sequence
  Synthetic
caccgctgtcccaaaaggtcaaattttcccccgattgctttgtttgggaaaggaagtgggcatctatgtgtgtgaggccggtgaaaactgcctcccaaaactcaagatggtcttggcacacatatcagcagccagggcct

SEQ ID NO: 387321 - DNA, 140 bp, Artificial Sequence
  Synthetic
aggccctggctgctgatatgcggccgcttgcacgttaaccagcgagccgtcgttgcaccggacaaggaggtcctctatgaggcttttgatgagatggaggaatgtgcctctagagcggctgaccttttgggacagcggtg

SEQ ID NO: 387322 - DNA, 140 bp, Artificial Sequence
  Synthetic
caccgctgtcccaaaaggtcagccgctctagaggcacattcctccatctcatcaaaagcctcatagaggacctccttgtccggtgcaacgacggctcgctggttaacgtgcaagcggccgcatatcagcagccagggcct

SEQ ID NO: 387323 - DNA, 140 bp, Artificial Sequence
  Synthetic
atacgccatgctgggtctcctcctctatgaggcttttgatgagatggaggaatgtgcctctagagcggctctcattgaagaggggcagcggatagccgagatgctgaagtccaagatccacgtacttgggagtcggccat

SEQ ID NO: 387324 - DNA, 140 bp, Artificial Sequence
  Synthetic
atggccgactcccaagtacgtggatcttggacttcagcatctcggctatccgctgcccctcttcaatgagagccgctctagaggcacattcctccatctcatcaaaagcctcatagaggaggagacccagcatggcgtat

SEQ ID NO: 387325 - DNA, 140 bp, Artificial Sequence
  Synthetic
atacgccatgctgggtctccctcattgaagaggggcagcggatagccgagatgctgaagtccaagatccaaggcttattgcagcaagcttccaaacaagctcaagacatacaacccgctgcgtacttgggagtcggccat

SEQ ID NO: 387326 - DNA, 140 bp, Artificial Sequence
  Synthetic
atggccgactcccaagtacgcagcgggttgtatgtcttgagcttgtttggaagcttgctgcaataagccttggatcttggacttcagcatctcggctatccgctgcccctcttcaatgagggagacccagcatggcgtat

SEQ ID NO: 387327 - DNA, 140 bp, Artificial Sequence
  Synthetic
aggccctggctgctgatatgctacgtgacggagtcggatgcgtcgcagcgtgtgacccaactacttggctcccttaccataaccagcctgctcaggagactccacaactggattactgaagaccttttgggacagcggtg

SEQ ID NO: 387328 - DNA, 140 bp, Artificial Sequence
  Synthetic
caccgctgtcccaaaaggtcttcagtaatccagttgtggagtctcctgagcaggctggttatggtaagggagccaagtagttgggtcacacgctgcgacgcatccgactccgtcacgtagcatatcagcagccagggcct

SEQ ID NO: 387329 - DNA, 140 bp, Artificial Sequence
  Synthetic
atacgccatgctgggtctcccagctgatcaacaccaacggcagttggcacatcaacaggacggccttgaactgtaatgaaagccttcagaccggctggatagcagggcttttctatcacacgtacttgggagtcggccat

SEQ ID NO: 387330 - DNA, 140 bp, Artificial Sequence
  Synthetic
atggccgactcccaagtacgtgtgatagaaaagccctgctatccagccggtctgaaggctttcattacagttcaaggccgtcctgttgatgtgccaactgccgttggtgttgatcagctgggagacccagcatggcgtat

SEQ ID NO: 387331 - DNA, 140 bp, Artificial Sequence
  Synthetic
atacgccatgctgggtctcctgcccccataccgaagccgttttttcgggatgaggtctcgttctgcgttgggcttaattcatttgtcgtcgggtctcagctcccttgcgatcctgaacctcgtacttgggagtcggccat

SEQ ID NO: 387332 - DNA, 140 bp, Artificial Sequence
  Synthetic
atggccgactcccaagtacgaggttcaggatcgcaagggagctgagacccgacgacaaatgaattaagcccaacgcagaacgagacctcatcccgaaaaaacggcttcggtatgggggcaggagacccagcatggcgtat

SEQ ID NO: 387333 - DNA, 140 bp, Artificial Sequence
  Synthetic
atacgccatgctgggtctccgacacagacgtattgacgtccatgctaacagacccatcccatatcacggcggagactgcagcgcggcgtttggcacgggggtcacccccgtccgaggcaacgtacttgggagtcggccat

SEQ ID NO: 387334 - DNA, 140 bp, Artificial Sequence
  Synthetic
atggccgactcccaagtacgttgcctcggacgggggtgacccccgtgccaaacgccgcgctgcagtctccgccgtgatatgggatgggtctgttagcatggacgtcaatacgtctgtgtcggagacccagcatggcgtat

SEQ ID NO: 387335 - DNA, 140 bp, Artificial Sequence
  Synthetic
aggccctggctgctgatatggggcgggaacatcacccgcgtggagtcagagaacaaggtagtaattctggactctttcgagccgcttcaagcggaggaggatgagagggaagtatccgttgaccttttgggacagcggtg

SEQ ID NO: 387336 - DNA, 140 bp, Artificial Sequence
  Synthetic
caccgctgtcccaaaaggtcaacggatacttccctctcatcctcctccgcttgaagcggctcgaaagagtccagaattactaccttgttctctgactccacgcgggtgatgttcccgccccatatcagcagccagggcct

SEQ ID NO: 387337 - DNA, 140 bp, Artificial Sequence
  Synthetic
aggccctggctgctgatatgacccacggcaaggcctatgatgtggacatggtggatgccaacctgttcatggggggcgatgtgacccggatagagtctgagtccaaagtggtcgttctgggaccttttgggacagcggtg

SEQ ID NO: 387338 - DNA, 140 bp, Artificial Sequence
  Synthetic
caccgctgtcccaaaaggtcccagaacgaccactttggactcagactctatccgggtcacatcgccccccatgaacaggttggcatccaccatgtccacatcataggccttgccgtgggtcatatcagcagccagggcct

SEQ ID NO: 387339 - DNA, 140 bp, Artificial Sequence
  Synthetic
atacgccatgctgggtctccttgaggtcgagcccagtgacaccatcgagaatgtcaaggccaagatccaagacaaggaaggcatcccacctgaccagcagaggctgatattcgcgggcaacgtacttgggagtcggccat

SEQ ID NO: 387340 - DNA, 140 bp, Artificial Sequence
  Synthetic
atggccgactcccaagtacgttgcccgcgaatatcagcctctgctggtcaggtgggatgccttccttgtcttggatcttggccttgacattctcgatggtgtcactgggctcgacctcaaggagacccagcatggcgtat

SEQ ID NO: 387341 - DNA, 140 bp, Artificial Sequence
  Synthetic
atacgccatgctgggtctccagccccccccaagcggcgattcaggcctttccacgggggcggacgcagccgattccggcagtcggacgccccccgatgagttggccctttcggagacaggcgtacttgggagtcggccat

SEQ ID NO: 387342 - DNA, 140 bp, Artificial Sequence
  Synthetic
atggccgactcccaagtacgcctgtctccgaaagggccaactcatcggggggcgtccgactgccggaatcggctgcgtccgcccccgtggaaaggcctgaatcgccgcttggggggggctggagacccagcatggcgtat

SEQ ID NO: 387343 - DNA, 140 bp, Artificial Sequence
  Synthetic
atacgccatgctgggtctccgattccggcagtcggacgccccccgatgagttggccctttcggagacaggttccatctcctccatgccccctctcgagggggagcctggagatccagactcgtacttgggagtcggccat

SEQ ID NO: 387344 - DNA, 140 bp, Artificial Sequence
  Synthetic
atggccgactcccaagtacgagtctggatctccaggctccccctcgagagggggcatggaggagatggaacctgtctccgaaagggccaactcatcggggggcgtccgactgccggaatcggagacccagcatggcgtat

SEQ ID NO: 387345 - DNA, 140 bp, Artificial Sequence
  Synthetic
atacgccatgctgggtctccctctgcaagatccaagtatgggtttggggctaaggaggtccgcagcttgtccgggagagccgttaaccacatcaagtccgtgtggaaggacctcctggaacgtacttgggagtcggccat

SEQ ID NO: 387346 - DNA, 140 bp, Artificial Sequence
  Synthetic
atggccgactcccaagtacgttccaggaggtccttccacacggacttgatgtggttaacggctctcccggacaagctgcggacctccttagccccaaacccatacttggatcttgcagagggagacccagcatggcgtat

SEQ ID NO: 387347 - DNA, 140 bp, Artificial Sequence
  Synthetic
aggccctggctgctgatatgggcttttacagctgccgtcaccagcccactaaccactagccaaactctcctcttcaacattttgggggggtgggtggctgcccagctcgcagcccccggtgaccttttgggacagcggtg

SEQ ID NO: 387348 - DNA, 140 bp, Artificial Sequence
  Synthetic
caccgctgtcccaaaaggtcaccgggggctgcgagctgggcagccacccacccccccaaaatgttgaagaggagagtttggctagtggttagtgggctggtgacggcagctgtaaaagcccatatcagcagccagggcct

SEQ ID NO: 387349 - DNA, 140 bp, Artificial Sequence
  Synthetic
atacgccatgctgggtctccctcccccgctcagcgggtggagtttctcttgaaggcatgggcggaaaagaaagaccctatgggtttttcgtatgatacccgatgctttgactcaaccgtccgtacttgggagtcggccat

SEQ ID NO: 387350 - DNA, 140 bp, Artificial Sequence
  Synthetic
atggccgactcccaagtacggacggttgagtcaaagcatcgggtatcatacgaaaaacccatagggtctttcttttccgcccatgccttcaagagaaactccacccgctgagcgggggagggagacccagcatggcgtat

SEQ ID NO: 387351 - DNA, 140 bp, Artificial Sequence
  Synthetic
aggccctggctgctgatatggcctgtcgagctgcaaagctccaggactgcacgatgctcgtgtgcggagacgaccttgtcgttatctgtgaaagcgcgggaacccaagaggacgcggcgagaccttttgggacagcggtg

SEQ ID NO: 387352 - DNA, 140 bp, Artificial Sequence
  Synthetic
caccgctgtcccaaaaggtctcgccgcgtcctcttgggttcccgcgctttcacagataacgacaaggtcgtctccgcacacgagcatcgtgcagtcctggagctttgcagctcgacaggccatatcagcagccagggcct

SEQ ID NO: 387353 - DNA, 140 bp, Artificial Sequence
  Synthetic
aggccctggctgctgatatggctctcatgaccggctataccggcgacttcgactcggtgatagactgcaacacgtgtgtcacccagacagtcgacttcagccttgaccctaccttcaccagaccttttgggacagcggtg

SEQ ID NO: 387354 - DNA, 140 bp, Artificial Sequence
  Synthetic
caccgctgtcccaaaaggtctggtgaaggtagggtcaaggctgaagtcgactgtctgggtgacacacgtgttgcagtctatcaccgagtcgaagtcgccggtatagccggtcatgagagccatatcagcagccagggcct

SEQ ID NO: 387355 - DNA, 140 bp, Artificial Sequence
  Synthetic
atacgccatgctgggtctcctgagatgtacggagcggtgtactccgtgagtcccttggacctcccagccataattgaaaggttacacgggcttgacgctttctctctgcacacatacactcgtacttgggagtcggccat

SEQ ID NO: 387356 - DNA, 140 bp, Artificial Sequence
  Synthetic
atggccgactcccaagtacgagtgtatgtgtgcagagagaaagcgtcaagcccgtgtaacctttcaattatggctgggaggtccaagggactcacggagtacaccgctccgtacatctcaggagacccagcatggcgtat

SEQ ID NO: 387357 - DNA, 140 bp, Artificial Sequence
  Synthetic
aggccctggctgctgatatgttttttttttttttttttttttttttttttttttttttttttttttttttttttttttttttttttttttttttttttttttttttttttttttttttttgaccttttgggacagcggtg

SEQ ID NO: 387358 - DNA, 140 bp, Artificial Sequence
  Synthetic
caccgctgtcccaaaaggtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacatatcagcagccagggcct

SEQ ID NO: 387359 - DNA, 140 bp, Artificial Sequence
  Synthetic
aggccctggctgctgatatgggagggggagcctggggatccggatctcagcgacgggtcatggtcgacggttagtagtggggctgacacggaggatgtcgtgtgctgctcaatgtcttatgaccttttgggacagcggtg

SEQ ID NO: 387360 - DNA, 140 bp, Artificial Sequence
  Synthetic
caccgctgtcccaaaaggtcataagacattgagcagcacacgacatcctccgtgtcagccccactactaaccgtcgaccatgacccgtcgctgagatccggatccccaggctccccctcccatatcagcagccagggcct

SEQ ID NO: 387361 - DNA, 140 bp, Artificial Sequence
  Synthetic
atacgccatgctgggtctccccagcagctagtctagagtggcggaatacgtctggcctctatgtccttaccaacgactgttccaatagcagtattgtgtatgaggccgatgacgttattccgtacttgggagtcggccat

SEQ ID NO: 387362 - DNA, 140 bp, Artificial Sequence
  Synthetic
atggccgactcccaagtacggaataacgtcatcggcctcatacacaatactgctattggaacagtcgttggtaaggacatagaggccagacgtattccgccactctagactagctgctggggagacccagcatggcgtat

SEQ ID NO: 387363 - DNA, 140 bp, Artificial Sequence
  Synthetic
aggccctggctgctgatatggcaattgctccatctaccctggtaccatcactggacaccgcatggcatgggacatgatgatgaactggtcgcccacggctaccatgatcttggcgtacgcgaccttttgggacagcggtg

SEQ ID NO: 387364 - DNA, 140 bp, Artificial Sequence
  Synthetic
caccgctgtcccaaaaggtcgcgtacgccaagatcatggtagccgtgggcgaccagttcatcatcatgtcccatgccatgcggtgtccagtgatggtaccagggtagatggagcaattgccatatcagcagccagggcct

SEQ ID NO: 387365 - DNA, 140 bp, Artificial Sequence
  Synthetic
aggccctggctgctgatatggcgtcatgttcggcttggcctacttctctatgcagggagcgtgggcgaaagtcgttgtcatccttctgttggccgccggggtggacgcgcgcacccatacgaccttttgggacagcggtg

SEQ ID NO: 387366 - DNA, 140 bp, Artificial Sequence
  Synthetic
caccgctgtcccaaaaggtcgtatgggtgcgcgcgtccaccccggcggccaacagaaggatgacaacgactttcgcccacgctccctgcatagagaagtaggccaagccgaacatgacgccatatcagcagccagggcct

SEQ ID NO: 387367 - DNA, 140 bp, Artificial Sequence
  Synthetic
atacgccatgctgggtctcccccatcacttatgttgagcctgacagcccggaccaaaggccttattgctggcattacgcgcctcggaagtgtggtatcgtacccgcgtcgcaggtgtgtgcgtacttgggagtcggccat

SEQ ID NO: 387368 - DNA, 140 bp, Artificial Sequence
  Synthetic
atggccgactcccaagtacgcacacacctgcgacgcgggtacgataccacacttccgaggcgcgtaatgccagcaataaggcctttggtccgggctgtcaggctcaacataagtgatgggggagacccagcatggcgtat

SEQ ID NO: 387369 - DNA, 140 bp, Artificial Sequence
  Synthetic
aggccctggctgctgatatggaatacgtggaaataaggcaggtgggggacttccactacgtgacgggcatgactgctgacaatcttaaatgcccatgccaggtcccatcgcccgaattttgaccttttgggacagcggtg

SEQ ID NO: 387370 - DNA, 140 bp, Artificial Sequence
  Synthetic
caccgctgtcccaaaaggtcaaaattcgggcgatgggacctggcatgggcatttaagattgtcagcagtcatgcccgtcacgtagtggaagtcccccacctgccttatttccacgtattccatatcagcagccagggcct

SEQ ID NO: 387371 - DNA, 140 bp, Artificial Sequence
  Synthetic
atacgccatgctgggtctccaggttagcaaggggatcgcctccttctgtggccagctcctcggccagccagctgtccgctccatctctcaaggcaacttgcactaccaaccacgactccccgtacttgggagtcggccat

SEQ ID NO: 387372 - DNA, 140 bp, Artificial Sequence
  Synthetic
atggccgactcccaagtacggggagtcgtggttggtagtgcaagttgccttgagagatggagcggacagctggctggccgaggagctggccacagaaggaggcgatccccttgctaacctggagacccagcatggcgtat

SEQ ID NO: 387373 - DNA, 140 bp, Artificial Sequence
  Synthetic
aggccctggctgctgatatggagtggcagatactgccctgttccttcaccaccctaccggctctgtccactggcttgatccatctccatcagaacatcgtggacgtgcaatacctgtacggaccttttgggacagcggtg

SEQ ID NO: 387374 - DNA, 140 bp, Artificial Sequence
  Synthetic
caccgctgtcccaaaaggtccgtacaggtattgcacgtccacgatgttctgatggagatggatcaagccagtggacagagccggtagggtggtgaaggaacagggcagtatctgccactccatatcagcagccagggcct

SEQ ID NO: 387375 - DNA, 140 bp, Artificial Sequence
  Synthetic
aggccctggctgctgatatgcaccacgagcttatgccatggaccgggagatggctgcatcatgtggaggcgtggtccttgcaggcctggcattcttgaccttgtcaccatactacaaagtgaccttttgggacagcggtg

SEQ ID NO: 387376 - DNA, 140 bp, Artificial Sequence
  Synthetic
caccgctgtcccaaaaggtcactttgtagtatggtgacaaggtcaagaatgccaggcctgcaaggaccacgcctccacatgatgcagccatctcccggtccatggcataagctcgtggtgcatatcagcagccagggcct

SEQ ID NO: 387377 - DNA, 140 bp, Artificial Sequence
  Synthetic
atacgccatgctgggtctccaggcgtacatgcaagtgtgggtcccccctctcaacgttcggggaggccgcgatgccatcatcctcctcacgtgcgcggtccacccggggctaatttttgacgtacttgggagtcggccat

SEQ ID NO: 387378 - DNA, 140 bp, Artificial Sequence
  Synthetic
atggccgactcccaagtacgtcaaaaattagccccgggtggaccgcgcacgtgaggaggatgatggcatcgcggcctccccgaacgttgagaggggggacccacacttgcatgtacgcctggagacccagcatggcgtat

SEQ ID NO: 387379 - DNA, 140 bp, Artificial Sequence
  Synthetic
aggccctggctgctgatatgatcaactccgtgtggaaagaccttctggaagacagtgtaacaccaatagataccaccatcatggccaagaacgaggttttctgcgttcagcctgagaagggaccttttgggacagcggtg

SEQ ID NO: 387380 - DNA, 140 bp, Artificial Sequence
  Synthetic
caccgctgtcccaaaaggtcccttctcaggctgaacgcagaaaacctcgttcttggccatgatggtggtatctattggtgttacactgtcttccagaaggtctttccacacggagttgatcatatcagcagccagggcct

SEQ ID NO: 387381 - DNA, 140 bp, Artificial Sequence
  Synthetic
aggccctggctgctgatatgcaggggtggcgactcctcgcgcccatcacggcctactcccaacagacgcggggcctacttggttgtatcatcactagcctcacaggccgggacaagaaccgaccttttgggacagcggtg

SEQ ID NO: 387382 - DNA, 140 bp, Artificial Sequence
  Synthetic
caccgctgtcccaaaaggtcggttcttgtcccggcctgtgaggctagtgatgatacaaccaagtaggccccgcgtctgttgggagtaggccgtgatgggcgcgaggagtcgccacccctgcatatcagcagccagggcct

SEQ ID NO: 387383 - DNA, 140 bp, Artificial Sequence
  Synthetic
aggccctggctgctgatatgatgaccacctcacccctatgtcggattgggctgctagtggcctgcgggacctggcggtcgccgttgagcctatcatcttcagtccgatggagaagaaagtgaccttttgggacagcggtg

SEQ ID NO: 387384 - DNA, 140 bp, Artificial Sequence
  Synthetic
caccgctgtcccaaaaggtcactttcttctccatcggactgaagatgataggctcaacggcgaccgccaggtcccgcaggccactagcagcccaatccgacataggggtgaggtggtcatcatatcagcagccagggcct

SEQ ID NO: 387385 - DNA, 140 bp, Artificial Sequence
  Synthetic
atacgccatgctgggtctcccagtccttcctcggaacatccatctcgggggttttgtggactgtctaccatggagctggcaacaagactctggccggctcacggggtccggtcacgcagacgtacttgggagtcggccat

SEQ ID NO: 387386 - DNA, 140 bp, Artificial Sequence
  Synthetic
atggccgactcccaagtacgtctgcgtgaccggaccccgtgagccggccagagtcttgttgccagctccatggtagacagtccacaaaacccccgagatggatgttccgaggaaggactgggagacccagcatggcgtat

SEQ ID NO: 387387 - DNA, 140 bp, Artificial Sequence
  Synthetic
aggccctggctgctgatatgactaaatctttggagccgtgcacgtgtggagcggtcgacctgtacctggtcacgcggaacgctgatgtcatcccggctcgaagacgcggggacaaacggggaccttttgggacagcggtg

SEQ ID NO: 387388 - DNA, 140 bp, Artificial Sequence
  Synthetic
caccgctgtcccaaaaggtccccgtttgtccccgcgtcttcgagccgggatgacatcagcgttccgcgtgaccaggtacaggtcgaccgctccacacgtgcacggctccaaagatttagtcatatcagcagccagggcct

SEQ ID NO: 387389 - DNA, 140 bp, Artificial Sequence
  Synthetic
aggccctggctgctgatatgcactcgacatcgtcacgcggtcccccacctttagtgacaacagcacaccacctgctgtgccccagacctatcaggtcgggtacttgcatgccccgactgggaccttttgggacagcggtg

SEQ ID NO: 387390 - DNA, 140 bp, Artificial Sequence
  Synthetic
caccgctgtcccaaaaggtcccagtcggggcatgcaagtacccgacctgataggtctggggcacagcaggtggtgtgctgttgtcactaaaggtgggggaccgcgtgacgatgtcgagtgcatatcagcagccagggcct

SEQ ID NO: 387391 - DNA, 140 bp, Artificial Sequence
  Synthetic
aggccctggctgctgatatgagcggacatgatcatgcatacccccgggtgcgtgccctgcgttcgggagaacaactcctcccgctgctgggtagcgctcactcccacgctcgcggccagggaccttttgggacagcggtg

SEQ ID NO: 387392 - DNA, 140 bp, Artificial Sequence
  Synthetic
caccgctgtcccaaaaggtccctggccgcgagcgtgggagtgagcgctacccagcagcgggaggagttgttctcccgaacgcagggcacgcacccgggggtatgcatgatcatgtccgctcatatcagcagccagggcct

SEQ ID NO: 387393 - DNA, 140 bp, Artificial Sequence
  Synthetic
atacgccatgctgggtctcctcgatgcggggaccgacgtctccggaggagttgccgcccgcgacacttacacatttactaggttcttcagtgtaggccccaagcagaacatccagctgatcgtacttgggagtcggccat

SEQ ID NO: 387394 - DNA, 140 bp, Artificial Sequence
  Synthetic
atggccgactcccaagtacgatcagctggatgttctgcttggggcctacactgaagaacctagtaaatgtgtaagtgtcgcgggcggcaactcctccggagacgtcggtccccgcatcgaggagacccagcatggcgtat

SEQ ID NO: 387395 - DNA, 140 bp, Artificial Sequence
  Synthetic
aggccctggctgctgatatgggggcccattggggagtcctagcgggccttgcctactattccatggtggggaactgggctaaggttctgattgtgatgctactctttgccggcgttgacggaccttttgggacagcggtg

SEQ ID NO: 387396 - DNA, 140 bp, Artificial Sequence
  Synthetic
caccgctgtcccaaaaggtccgtcaacgccggcaaagagtagcatcacaatcagaaccttagcccagttccccaccatggaatagtaggcaaggcccgctaggactccccaatgggcccccatatcagcagccagggcct

SEQ ID NO: 387397 - DNA, 140 bp, Artificial Sequence
  Synthetic
atacgccatgctgggtctccgcacggctgcgattgctggtttcttcacacagggccccaggcagagcatccaactgatcaacaccaacggcagttggcacatcaataggacggccttgaacgtacttgggagtcggccat

SEQ ID NO: 387398 - DNA, 140 bp, Artificial Sequence
  Synthetic
atggccgactcccaagtacgttcaaggccgtcctattgatgtgccaactgccgttggtgttgatcagttggatgctctgcctggggccctgtgtgaagaaaccagcaatcgcagccgtgcggagacccagcatggcgtat

SEQ ID NO: 387399 - DNA, 140 bp, Artificial Sequence
  Synthetic
aggccctggctgctgatatgttcttcacggaggtggacggagtgcggttgcacaggtacgctccggcgtgcaaacctctcctacgggaggaggtcgtgttccaggtcgggctcaaccaatgaccttttgggacagcggtg

SEQ ID NO: 387400 - DNA, 140 bp, Artificial Sequence
  Synthetic
caccgctgtcccaaaaggtcattggttgagcccgacctggaacacgacctcctcccgtaggagaggtttgcacgccggagcgtacctgtgcaaccgcactccgtccacctccgtgaagaacatatcagcagccagggcct

SEQ ID NO: 387401 - DNA, 140 bp, Artificial Sequence
  Synthetic
aggccctggctgctgatatgggcgcgttccttgacaccatgcacctgcggcagctcggacctttacttggtcacgaggcatgccgatgtcattccggtgcgccggcggggcgacagcagggaccttttgggacagcggtg

SEQ ID NO: 387402 - DNA, 140 bp, Artificial Sequence
  Synthetic
caccgctgtcccaaaaggtccctgctgtcgccccgccggcgcaccggaatgacatcggcatgcctcgtgaccaagtaaaggtccgagctgccgcaggtgcatggtgtcaaggaacgcgcccatatcagcagccagggcct

SEQ ID NO: 387403 - DNA, 140 bp, Artificial Sequence
  Synthetic
aggccctggctgctgatatgtttcacgaccctgccagccttgtccactggcctcatccacctccaccagaacattgtggacgtgcagtacttgtacggggtggggtcaagcattgcgtccgaccttttgggacagcggtg

SEQ ID NO: 387404 - DNA, 140 bp, Artificial Sequence
  Synthetic
caccgctgtcccaaaaggtcggacgcaatgcttgaccccaccccgtacaagtactgcacgtccacaatgttctggtggaggtggatgaggccagtggacaaggctggcagggtcgtgaaacatatcagcagccagggcct

SEQ ID NO: 387405 - DNA, 140 bp, Artificial Sequence
  Synthetic
atacgccatgctgggtctccctatatttataaccatctcactcctcttcgggactgggcgcataacggcctacgagatctggccgtggctgtagagccagtcgtcttttcccagatggagcgtacttgggagtcggccat

SEQ ID NO: 387406 - DNA, 140 bp, Artificial Sequence
  Synthetic
atggccgactcccaagtacgctccatctgggaaaagacgactggctctacagccacggccagatctcgtaggccgttatgcgcccagtcccgaagaggagtgagatggttataaatatagggagacccagcatggcgtat

SEQ ID NO: 387407 - DNA, 140 bp, Artificial Sequence
  Synthetic
atacgccatgctgggtctcctgataacatcttgctcctcaaatgtgtctgtggcgctgggcccacaaggccgccgcagatactacctgaccagagaccctaccactccaatcgcccgggccgtacttgggagtcggccat

SEQ ID NO: 387408 - DNA, 140 bp, Artificial Sequence
  Synthetic
atggccgactcccaagtacggcccgggcgattggagtggtagggtctctggtcaggtagtatctgcggcggccttgtgggcccagcgccacagacacatttgaggagcaagatgttatcaggagacccagcatggcgtat

SEQ ID NO: 387409 - DNA, 140 bp, Artificial Sequence
  Synthetic
atacgccatgctgggtctccaagcggctgggaggaggttggcaaggggatcgcccccttctgtggccagctcttcggccagccagctgtctgcaccatctctcaaggcaacttgcaccaccgtacttgggagtcggccat

SEQ ID NO: 387410 - DNA, 140 bp, Artificial Sequence
  Synthetic
atggccgactcccaagtacggtggtgcaagttgccttgagagatggtgcagacagctggctggccgaagagctggccacagaagggggcgatccccttgccaacctcctcccagccgcttggagacccagcatggcgtat

SEQ ID NO: 387411 - DNA, 140 bp, Artificial Sequence
  Synthetic
atacgccatgctgggtctcctactttctttcctggtggctccatcttagccctagtcacggctagctgtgaaaggtccgtgagccgcatgactgcagagagtgccgtaactggtctctctcgtacttgggagtcggccat

SEQ ID NO: 387412 - DNA, 140 bp, Artificial Sequence
  Synthetic
atggccgactcccaagtacgagagagaccagttacggcactctctgcagtcatgcggctcacggacctttcacagctagccgtgactagggctaagatggagccaccaggaaagaaagtaggagacccagcatggcgtat

SEQ ID NO: 387413 - DNA, 140 bp, Artificial Sequence
  Synthetic
atacgccatgctgggtctccgtcgggagggatggcggcccaaaccgtccacaggttcacgtccatctttagtaaagggccgtcccagacaatccagcttgtaaacaccaacggcagctggcgtacttgggagtcggccat

SEQ ID NO: 387414 - DNA, 140 bp, Artificial Sequence
  Synthetic
atggccgactcccaagtacgccagctgccgttggtgtttacaagctggattgtctgggacggccctttactaaagatggacgtgaacctgtggacggtttgggccgccatccctcccgacggagacccagcatggcgtat

SEQ ID NO: 387415 - DNA, 140 bp, Artificial Sequence
  Synthetic
atacgccatgctgggtctcctccggtctctgctgtccaagtgaagaacaccagcaacgcctatatggcgactaacgactgttccaatgacagcatcacttggcagcttgaggccgcagtccgtacttgggagtcggccat

SEQ ID NO: 387416 - DNA, 140 bp, Artificial Sequence
  Synthetic
atggccgactcccaagtacggactgcggcctcaagctgccaagtgatgctgtcattggaacagtcgttagtcgccatataggcgttgctggtgttcttcacttggacagcagagaccggaggagacccagcatggcgtat

SEQ ID NO: 387417 - DNA, 140 bp, Artificial Sequence
  Synthetic
atacgccatgctgggtctccgcatgtctatgttccatcatttgaaccacgtggcccccgggactctgtgatcatcctcctggtcctgtttcagccccacctggtctttgacattacaaaacgtacttgggagtcggccat

SEQ ID NO: 387418 - DNA, 140 bp, Artificial Sequence
  Synthetic
atggccgactcccaagtacgttttgtaatgtcaaagaccaggtggggctgaaacaggaccaggaggatgatcacagagtcccgggggccacgtggttcaaatgatggaacatagacatgcggagacccagcatggcgtat

SEQ ID NO: 387419 - DNA, 140 bp, Artificial Sequence
  Synthetic
atacgccatgctgggtctccgactgggagcgctgctgggcgcactaccagtagcctggccagcgccttctcccctggcgctcggcagaacattcagctcattaataccaatggtagctggcgtacttgggagtcggccat

SEQ ID NO: 387420 - DNA, 140 bp, Artificial Sequence
  Synthetic
atggccgactcccaagtacgccagctaccattggtattaatgagctgaatgttctgccgagcgccaggggagaaggcgctggccaggctactggtagtgcgcccagcagcgctcccagtcggagacccagcatggcgtat

SEQ ID NO: 387421 - DNA, 140 bp, Artificial Sequence
  Synthetic
atacgccatgctgggtctccagcgcctgtccgcctgtcgcaacatcgaggacttccggataggatggggcgccctgcaatacgacgacaatgtcaccaatccagaagatatgaggccatacgtacttgggagtcggccat

SEQ ID NO: 387422 - DNA, 140 bp, Artificial Sequence
  Synthetic
atggccgactcccaagtacgtatggcctcatatcttctggattggtgacattgtcgtcgtattgcagggcgccccatcctatccggaagtcctcgatgttgcgacaggcggacaggcgctggagacccagcatggcgtat

SEQ ID NO: 387423 - DNA, 140 bp, Artificial Sequence
  Synthetic
atacgccatgctgggtctcctacatcttggcccttttgggacccctctacatacttcaggcttcactgttgcgcacgccttacttcgtgagggctcatgtgctgatcaagatctgtagcccgtacttgggagtcggccat

SEQ ID NO: 387424 - DNA, 140 bp, Artificial Sequence
  Synthetic
atggccgactcccaagtacgggctacagatcttgatcagcacatgagccctcacgaagtaaggcgtgcgcaacagtgaagcctgaagtatgtagaggggtcccaaaagggccaagatgtaggagacccagcatggcgtat

SEQ ID NO: 387425 - DNA, 140 bp, Artificial Sequence
  Synthetic
aggccctggctgctgatatgatgtcatggtgggcgctgccgcgttctgctcagctatgtacgtgggggacctgtgcgggggcctcttcctcgttgggcagctcttcacgttcaggcctcggaccttttgggacagcggtg

SEQ ID NO: 387426 - DNA, 140 bp, Artificial Sequence
  Synthetic
caccgctgtcccaaaaggtccgaggcctgaacgtgaagagctgcccaacgaggaagaggcccccgcacaggtcccccacgtacatagctgagcagaacgcggcagcgcccaccatgacatcatatcagcagccagggcct

SEQ ID NO: 387427 - DNA, 140 bp, Artificial Sequence
  Synthetic
aggccctggctgctgatatgtgtcttcctattgaacagcacccgaccaccgtcggggtcatggtttggctgcacgtggatgaactccactggcttcaccaagacctgcggcgcaccacccgaccttttgggacagcggtg

SEQ ID NO: 387428 - DNA, 140 bp, Artificial Sequence
  Synthetic
caccgctgtcccaaaaggtcgggtggtgcgccgcaggtcttggtgaagccagtggagttcatccacgtgcagccaaaccatgaccccgacggtggtcgggtgctgttcaataggaagacacatatcagcagccagggcct

SEQ ID NO: 387429 - DNA, 140 bp, Artificial Sequence
  Synthetic
aggccctggctgctgatatggcggttttcataggtctggcactcttgaccttgtcaccacactataaggtgttcctcgctaggctcatatggtggttgcaatattttatcaccagaaccggaccttttgggacagcggtg

SEQ ID NO: 387430 - DNA, 140 bp, Artificial Sequence
  Synthetic
caccgctgtcccaaaaggtccggttctggtgataaaatattgcaaccaccatatgagcctagcgaggaacaccttatagtgtggtgacaaggtcaagagtgccagacctatgaaaaccgccatatcagcagccagggcct

SEQ ID NO: 387431 - DNA, 140 bp, Artificial Sequence
  Synthetic
atacgccatgctgggtctccggccttggctcacgccaaagtgtctggttgactacccctacaggctctggcattacccttgcacagtcaattactccaccttcaagatcaggatgtatgtcgtacttgggagtcggccat

SEQ ID NO: 387432 - DNA, 140 bp, Artificial Sequence
  Synthetic
atggccgactcccaagtacgacatacatcctgatcttgaaggtggagtaattgactgtgcaagggtaatgccagagcctgtaggggtagtcaaccagacactttggcgtgagccaaggccggagacccagcatggcgtat

SEQ ID NO: 387433 - DNA, 140 bp, Artificial Sequence
  Synthetic
aggccctggctgctgatatgcgaacgactgctccaacgcaagcattgtgtatgaggcagcggacatgatcatgcacgtccccgggtgcgtgccctgcgttcgggagggcaactcctcccggaccttttgggacagcggtg

SEQ ID NO: 387434 - DNA, 140 bp, Artificial Sequence
  Synthetic
caccgctgtcccaaaaggtccgggaggagttgccctcccgaacgcagggcacgcacccggggacgtgcatgatcatgtccgctgcctcatacacaatgcttgcgttggagcagtcgttcgcatatcagcagccagggcct

SEQ ID NO: 387435 - DNA, 140 bp, Artificial Sequence
  Synthetic
atacgccatgctgggtctcccactccaccacggaatgggccattttgccctgctctttctcagacttgcccgctttgtcgactggtcttctccacctccaccaaaatatcgtggacgtaccgtacttgggagtcggccat

SEQ ID NO: 387436 - DNA, 140 bp, Artificial Sequence
  Synthetic
atggccgactcccaagtacggtacgtccacgatattttggtggaggtggagaagaccagtcgacaaagcgggcaagtctgagaaagagcagggcaaaatggcccattccgtggtggagtgggagacccagcatggcgtat

SEQ ID NO: 387437 - DNA, 140 bp, Artificial Sequence
  Synthetic
aggccctggctgctgatatgtattttgtcatctttctcgtggctgcttggcacatcaagggtagggtggtccccttggctgcttattcccttactggcctgtggccgttctgcctactgcgaccttttgggacagcggtg

SEQ ID NO: 387438 - DNA, 140 bp, Artificial Sequence
  Synthetic
caccgctgtcccaaaaggtcgcagtaggcagaacggccacaggccagtaagggaataagcagccaaggggaccaccctacccttgatgtgccaagcagccacgagaaagatgacaaaatacatatcagcagccagggcct

SEQ ID NO: 387439 - DNA, 140 bp, Artificial Sequence
  Synthetic
aggccctggctgctgatatgatgaccacctcacccctatgtcggattgggctgctagcggcctgcgggacttggcggtcgctgtggagcctatcatcttcagtccgatggagaagaaagtgaccttttgggacagcggtg

SEQ ID NO: 387440 - DNA, 140 bp, Artificial Sequence
  Synthetic
caccgctgtcccaaaaggtcactttcttctccatcggactgaagatgataggctccacagcgaccgccaagtcccgcaggccgctagcagcccaatccgacataggggtgaggtggtcatcatatcagcagccagggcct

SEQ ID NO: 387441 - DNA, 140 bp, Artificial Sequence
  Synthetic
atacgccatgctgggtctccttcccgtgtccgcccgactcggtcgggagatcctccttggcccagctgatggctacacctccaaggggtggaagcttctcgcccccatcaccgcttacgccgtacttgggagtcggccat

SEQ ID NO: 387442 - DNA, 140 bp, Artificial Sequence
  Synthetic
atggccgactcccaagtacggcgtaagcggtgatgggggcgagaagcttccaccccttggaggtgtagccatcagctgggccaaggaggatctcccgaccgagtcgggcggacacgggaaggagacccagcatggcgtat

SEQ ID NO: 387443 - DNA, 140 bp, Artificial Sequence
  Synthetic
aggccctggctgctgatatgcacgcggaacgctgatgtcatcccggctcgaagacgcggggacaagcggggagcgctgctctccccgagacccctttcgaccttgaaggggtcctcgggggaccttttgggacagcggtg

SEQ ID NO: 387444 - DNA, 140 bp, Artificial Sequence
  Synthetic
caccgctgtcccaaaaggtcccccgaggaccccttcaaggtcgaaaggggtctcggggagagcagcgctccccgcttgtccccgcgtcttcgagccgggatgacatcagcgttccgcgtgcatatcagcagccagggcct

SEQ ID NO: 387445 - DNA, 140 bp, Artificial Sequence
  Synthetic
aggccctggctgctgatatggaggcggctctggagaacctcatagtgctcaatgcggcatccttggccggggcgcacggtctcgtgtctttcctcgtgttcttctgcttcgcgtggtatcgaccttttgggacagcggtg

SEQ ID NO: 387446 - DNA, 140 bp, Artificial Sequence
  Synthetic
caccgctgtcccaaaaggtcgataccacgcgaagcagaagaacacgaggaaagacacgagaccgtgcgccccggccaaggatgccgcattgagcactatgaggttctccagagccgcctccatatcagcagccagggcct

SEQ ID NO: 387447 - DNA, 140 bp, Artificial Sequence
  Synthetic
atacgccatgctgggtctcccagatttctctcaggggtggggcccaatctcatatgcgaacgtgagtggtccatctgaagacagaccgtattgctggcactaccctcccaaaccatgtgtcgtacttgggagtcggccat

SEQ ID NO: 387448 - DNA, 140 bp, Artificial Sequence
  Synthetic
atggccgactcccaagtacgacacatggtttgggagggtagtgccagcaatacggtctgtcttcagatggaccactcacgttcgcatatgagattgggccccacccctgagagaaatctgggagacccagcatggcgtat

SEQ ID NO: 387449 - DNA, 140 bp, Artificial Sequence
  Synthetic
aggccctggctgctgatatgccgtgctccggctcgtggctgagggatgtttgggactggatatgcacggtgttgagtgacttcaagacctggctccagtccaagctcctgccgcggttgcgaccttttgggacagcggtg

SEQ ID NO: 387450 - DNA, 140 bp, Artificial Sequence
  Synthetic
caccgctgtcccaaaaggtcgcaaccgcggcaggagcttggactggagccaggtcttgaagtcactcaacaccgtgcatatccagtcccaaacatccctcagccacgagccggagcacggcatatcagcagccagggcct

SEQ ID NO: 387451 - DNA, 140 bp, Artificial Sequence
  Synthetic
aggccctggctgctgatatgctacgtgacggagtcggatgcgtcgcagcgtgtcacccaactgcttggctctctcactataactagtctactcaggagacttcacaactggatcactgaggaccttttgggacagcggtg

SEQ ID NO: 387452 - DNA, 140 bp, Artificial Sequence
  Synthetic
caccgctgtcccaaaaggtcctcagtgatccagttgtgaagtctcctgagtagactagttatagtgagagagccaagcagttgggtgacacgctgcgacgcatccgactccgtcacgtagcatatcagcagccagggcct

SEQ ID NO: 387453 - DNA, 140 bp, Artificial Sequence
  Synthetic
atacgccatgctgggtctccgaaggccagtgcttgccgaaacccgcgttaaacttcaagaccgccatctggagagtggcggcctcagagtacgcggaagtgacgcagcacggatcatatgcgtacttgggagtcggccat

SEQ ID NO: 387454 - DNA, 140 bp, Artificial Sequence
  Synthetic
atggccgactcccaagtacgcatatgatccgtgctgcgtcacttccgcgtactctgaggccgccactctccagatggcggtcttgaagtttaacgcgggtttcggcaagcactggccttcggagacccagcatggcgtat

SEQ ID NO: 387455 - DNA, 140 bp, Artificial Sequence
  Synthetic
atacgccatgctgggtctccggctatggggcaaaggacgtccggagcctatccagcaaggccgtacgccacatcaactccgtgtggaaagacctgctggaagacactgagacaccaattgcgtacttgggagtcggccat

SEQ ID NO: 387456 - DNA, 140 bp, Artificial Sequence
  Synthetic
atggccgactcccaagtacgcaattggtgtctcagtgtcttccagcaggtctttccacacggagttgatgtggcgtacggccttgctggataggctccggacgtcctttgccccatagccggagacccagcatggcgtat

SEQ ID NO: 387457 - DNA, 140 bp, Artificial Sequence
  Synthetic
aggccctggctgctgatatgacaccaccatcatggcaaaaaatgaggttttctgtgtccaaccagagaagggaggccgcaagccagctcgccttatcgtgttcccagacttgggggttcggaccttttgggacagcggtg

SEQ ID NO: 387458 - DNA, 140 bp, Artificial Sequence
  Synthetic
caccgctgtcccaaaaggtccgaacccccaagtctgggaacacgataaggcgagctggcttgcggcctcccttctctggttggacacagaaaacctcattttttgccatgatggtggtgtcatatcagcagccagggcct

SEQ ID NO: 387459 - DNA, 140 bp, Artificial Sequence
  Synthetic
atacgccatgctgggtctccgagcaccataggagatgccctccaacagctggccatcaagtcctttggccagccccccccaagcggcgattcaggcctttccacgggggcggacgccgcccgtacttgggagtcggccat

SEQ ID NO: 387460 - DNA, 140 bp, Artificial Sequence
  Synthetic
atggccgactcccaagtacgggcggcgtccgcccccgtggaaaggcctgaatcgccgcttggggggggctggccaaaggacttgatggccagctgttggagggcatctcctatggtgctcggagacccagcatggcgtat

SEQ ID NO: 387461 - DNA, 140 bp, Artificial Sequence
  Synthetic
  misc_feature (82)..(82): n is a, c, g, or t
aggccctggctgctgatatgtccagtcttttctgacaactcaacgcctcctgctgtgccccagacataccaagtcgcgcacntgcacgcgccgacggggagcggcaagagcaccaaggttgaccttttgggacagcggtg

SEQ ID NO: 387462 - DNA, 140 bp, Artificial Sequence
  Synthetic
  misc_feature (59)..(59): n is a, c, g, or t
caccgctgtcccaaaaggtcaaccttggtgctcttgccgctccccgtcggcgcgtgcangtgcgcgacttggtatgtctggggcacagcaggaggcgttgagttgtcagaaaagactggacatatcagcagccagggcct

SEQ ID NO: 387463 - DNA, 140 bp, Artificial Sequence
  Synthetic
aggccctggctgctgatatggctatatcagctggtgcttatggtggcttcagtatttcctgaccagagcagaagcgctactgcacgtgtgggttccccccctcaacgtccgaggggggcggaccttttgggacagcggtg

SEQ ID NO: 387464 - DNA, 140 bp, Artificial Sequence
  Synthetic
caccgctgtcccaaaaggtccgcccccctcggacgttgagggggggaacccacacgtgcagtagcgcttctgctctggtcaggaaatactgaagccaccataagcaccagctgatatagccatatcagcagccagggcct

SEQ ID NO: 387465 - DNA, 140 bp, Artificial Sequence
  Synthetic
aggccctggctgctgatatgactgaggaggacgagcggaacctgagagccttcacggaggctatgaccaggtattctgcccctcctggtgacccccccagaccggaatatgacctggagcgaccttttgggacagcggtg

SEQ ID NO: 387466 - DNA, 140 bp, Artificial Sequence
  Synthetic
caccgctgtcccaaaaggtcgctccaggtcatattccggtctgggggggtcaccaggaggggcagaatacctggtcatagcctccgtgaaggctctcaggttccgctcgtcctcctcagtcatatcagcagccagggcct

SEQ ID NO: 387467 - DNA, 140 bp, Artificial Sequence
  Synthetic
aggccctggctgctgatatgcccagcttccgcttatgaagtgcgcaacgtgtccggggtgtaccatgtcacgaacgactgctccaactcaagcattgtgtatgaggcagcggacatgatcgaccttttgggacagcggtg

SEQ ID NO: 387468 - DNA, 140 bp, Artificial Sequence
  Synthetic
caccgctgtcccaaaaggtcgatcatgtccgctgcctcatacacaatgcttgagttggagcagtcgttcgtgacatggtacaccccggacacgttgcgcacttcataagcggaagctgggcatatcagcagccagggcct

SEQ ID NO: 387469 - DNA, 140 bp, Artificial Sequence
  Synthetic
aggccctggctgctgatatggcacaggctcaacgccgcatgcaattggactcgaggagagcgttgtgacttggaggacagggataggtcagagcttagcccgctgctgctgtctacgacagaccttttgggacagcggtg

SEQ ID NO: 387470 - DNA, 140 bp, Artificial Sequence
  Synthetic
caccgctgtcccaaaaggtctgtcgtagacagcagcagcgggctaagctctgacctatccctgtcctccaagtcacaacgctctcctcgagtccaattgcatgcggcgttgagcctgtgccatatcagcagccagggcct

SEQ ID NO: 387471 - DNA, 140 bp, Artificial Sequence
  Synthetic
atacgccatgctgggtctccccaatgactgtgctaatgacagcatcacctggcagctcgacgctgcggtcctccacgtccccgggtgcgtcccgtgcgagaaggtgggggacacatctcgcgtacttgggagtcggccat

SEQ ID NO: 387472 - DNA, 140 bp, Artificial Sequence
  Synthetic
atggccgactcccaagtacgcgagatgtgtcccccaccttctcgcacgggacgcacccggggacgtggaggaccgcagcgtcgagctgccaggtgatgctgtcattagcacagtcattggggagacccagcatggcgtat

SEQ ID NO: 387473 - DNA, 140 bp, Artificial Sequence
  Synthetic
atacgccatgctgggtctcctcacgcgaggcttgcggacgcacatagacatggtggtaatgtccgccacgctctgctccgctctctacgtgggggacctttgtggtggggtgatgctcgccgtacttgggagtcggccat

SEQ ID NO: 387474 - DNA, 140 bp, Artificial Sequence
  Synthetic
atggccgactcccaagtacggcgagcatcaccccaccacaaaggtcccccacgtagagagcggagcagagcgtggcggacattaccaccatgtctatgtgcgtccgcaagcctcgcgtgaggagacccagcatggcgtat

SEQ ID NO: 387475 - DNA, 140 bp, Artificial Sequence
  Synthetic
aggccctggctgctgatatggagtggcaggtattgccctgttccttcaccaccctaccggctctgtccactggtttgatccatctccatcagaacatcgtggacgtgcaatacctgtacggaccttttgggacagcggtg

SEQ ID NO: 387476 - DNA, 140 bp, Artificial Sequence
  Synthetic
caccgctgtcccaaaaggtccgtacaggtattgcacgtccacgatgttctgatggagatggatcaaaccagtggacagagccggtagggtggtgaaggaacagggcaatacctgccactccatatcagcagccagggcct

SEQ ID NO: 387477 - DNA, 140 bp, Artificial Sequence
  Synthetic
atacgccatgctgggtctcctggtttgatccatctccatcagaacatcgtggacgtgcaatacctgtacggtatagggtcagcggttgtctcctttgcaatcaaatgggagtatatcctgcgtacttgggagtcggccat

SEQ ID NO: 387478 - DNA, 140 bp, Artificial Sequence
  Synthetic
atggccgactcccaagtacgcaggatatactcccatttgattgcaaaggagacaaccgctgaccctataccgtacaggtattgcacgtccacgatgttctgatggagatggatcaaaccaggagacccagcatggcgtat

SEQ ID NO: 387479 - DNA, 140 bp, Artificial Sequence
  Synthetic
atacgccatgctgggtctccgatgcgcgtccccgaggtcatcatagacatcattagcggggctcactggggcgtcatgtttggcttggcctacttctctatgcagggagcgtgggcgaaacgtacttgggagtcggccat

SEQ ID NO: 387480 - DNA, 140 bp, Artificial Sequence
  Synthetic
atggccgactcccaagtacgtttcgcccacgctccctgcatagagaagtaggccaagccaaacatgacgccccagtgagccccgctaatgatgtctatgatgacctcggggacgcgcatcggagacccagcatggcgtat

SEQ ID NO: 387481 - DNA, 140 bp, Artificial Sequence
  Synthetic
atacgccatgctgggtctccgcgtcatgtttggcttggcctacttctctatgcagggagcgtgggcgaaagtcgttgtcatccttctgctggccgctggggtcgacgcgggcacctatgccgtacttgggagtcggccat

SEQ ID NO: 387482 - DNA, 140 bp, Artificial Sequence
  Synthetic
atggccgactcccaagtacggcataggtgcccgcgtcgaccccagcggccagcagaaggatgacaacgactttcgcccacgctccctgcatagagaagtaggccaagccaaacatgacgcggagacccagcatggcgtat

SEQ ID NO: 387483 - DNA, 140 bp, Artificial Sequence
  Synthetic
atacgccatgctgggtctcccacatcaaccgcactgccctgaactgcaatgaatccctgaacaccggctttcttgcggccctgttctacgccaaccgcttcaactcgtcaggatgtcctgcgtacttgggagtcggccat

SEQ ID NO: 387484 - DNA, 140 bp, Artificial Sequence
  Synthetic
atggccgactcccaagtacgcaggacatcctgacgagttgaagcggttggcgtagaacagggccgcaagaaagccggtgttcagggattcattgcagttcagggcagtgcggttgatgtgggagacccagcatggcgtat

SEQ ID NO: 387485 - DNA, 140 bp, Artificial Sequence
  Synthetic
atacgccatgctgggtctccaacgcctgtccgcctgccgtaatatcgaggacttccggataggatggggcacattgcaatacgagaataatgtcaccaattcagaggatatgagaccatacgtacttgggagtcggccat

SEQ ID NO: 387486 - DNA, 140 bp, Artificial Sequence
  Synthetic
atggccgactcccaagtacgtatggtctcatatcctctgaattggtgacattattctcgtattgcaatgtgccccatcctatccggaagtcctcgatattacggcaggcggacaggcgttggagacccagcatggcgtat

SEQ ID NO: 387487 - DNA, 140 bp, Artificial Sequence
  Synthetic
aggccctggctgctgatatgtccatgctccggttcctggctaagggacatctgggactggatatgcgaggtgctgagcgattttaagacctggctgaaggccaagctcatgccgcaactggaccttttgggacagcggtg

SEQ ID NO: 387488 - DNA, 140 bp, Artificial Sequence
  Synthetic
caccgctgtcccaaaaggtccagttgcggcatgagcttggccttcagccaggtcttaaaatcgctcagcacctcgcatatccagtcccagatgtcccttagccaggaaccggagcatggacatatcagcagccagggcct

SEQ ID NO: 387489 - DNA, 140 bp, Artificial Sequence
  Synthetic
aggccctggctgctgatatgcatcactaaaatcttgctcgccatactcggtccgctcatggtgctccaggctggcataaccagggtgccgtacttcgtgcgcgcccacgggctcattcgtgaccttttgggacagcggtg

SEQ ID NO: 387490 - DNA, 140 bp, Artificial Sequence
  Synthetic
caccgctgtcccaaaaggtcacgaatgagcccgtgggcgcgcacgaagtacggcaccctggttatgccagcctggagcaccatgagcggaccgagtatggcgagcaagattttagtgatgcatatcagcagccagggcct

SEQ ID NO: 387491 - DNA, 140 bp, Artificial Sequence
  Synthetic
aggccctggctgctgatatgttggacatgatcgctggtgcccactggggagtcctggcgggcatagcgtatttctccatggtggggaactgggcgaaggtcatggtagtgctgctgctatgaccttttgggacagcggtg

SEQ ID NO: 387492 - DNA, 140 bp, Artificial Sequence
  Synthetic
caccgctgtcccaaaaggtcatagcagcagcactaccatgaccttcgcccagttccccaccatggagaaatacgctatgcccgccaggactccccagtgggcaccagcgatcatgtccaacatatcagcagccagggcct

SEQ ID NO: 387493 - DNA, 140 bp, Artificial Sequence
  Synthetic
aggccctggctgctgatatgtgtcttcctattgaacagcacccgaccaccgtcgggctcgtggttcggctgcacgtggatgaactccactggtttcaccaaaacatgcggtgcaccacctgaccttttgggacagcggtg

SEQ ID NO: 387494 - DNA, 140 bp, Artificial Sequence
  Synthetic
caccgctgtcccaaaaggtcaggtggtgcaccgcatgttttggtgaaaccagtggagttcatccacgtgcagccgaaccacgagcccgacggtggtcgggtgctgttcaataggaagacacatatcagcagccagggcct

SEQ ID NO: 387495 - DNA, 140 bp, Artificial Sequence
  Synthetic
aggccctggctgctgatatggggcctacttggctgcatcatcactagcctcacaggccgggacaagaaccaggtcgagggggaggtccaagtggtctccaccgcaacacaatctttcctggaccttttgggacagcggtg

SEQ ID NO: 387496 - DNA, 140 bp, Artificial Sequence
  Synthetic
caccgctgtcccaaaaggtccaggaaagattgtgttgcggtggagaccacttggacctccccctcgacctggttcttgtcccggcctgtgaggctagtgatgatgcagccaagtaggccccatatcagcagccagggcct

SEQ ID NO: 387497 - DNA, 140 bp, Artificial Sequence
  Synthetic
aggccctggctgctgatatgatcgttgcgacttggaggacagagacaggagtcaactgtctcctttgttgcactccaccacggaatgggccattttaccctgcacttactcagacctgccgaccttttgggacagcggtg

SEQ ID NO: 387498 - DNA, 140 bp, Artificial Sequence
  Synthetic
caccgctgtcccaaaaggtcggcaggtctgagtaagtgcagggtaaaatggcccattccgtggtggagtgcaacaaaggagacagttgactcctgtctctgtcctccaagtcgcaacgatcatatcagcagccagggcct

SEQ ID NO: 387499 - DNA, 140 bp, Artificial Sequence
  Synthetic
atacgccatgctgggtctcctattttgtcatcttcttcgtggctgcttggtacatcaagggccgggcggtccccttggctacctattccctcaccggtctatggtctttctgcctactgccgtacttgggagtcggccat

SEQ ID NO: 387500 - DNA, 140 bp, Artificial Sequence
  Synthetic
atggccgactcccaagtacggcagtaggcagaaagaccatagaccggtgagggaataggtagccaaggggaccgcccggcccttgatgtaccaagcagccacgaagaagatgacaaaataggagacccagcatggcgtat

SEQ ID NO: 387501 - DNA, 140 bp, Artificial Sequence
  Synthetic
aggccctggctgctgatatgccccttggctacctattccctcaccggtctatggtctttctgcctactgctcctggcattgccccaacaggcttatgcgtatgatacatctgcgcacggagaccttttgggacagcggtg

SEQ ID NO: 387502 - DNA, 140 bp, Artificial Sequence
  Synthetic
caccgctgtcccaaaaggtctccgtgcgcagatgtatcatacgcataagcctgttggggcaatgccaggagcagtaggcagaaagaccatagaccggtgagggaataggtagccaaggggcatatcagcagccagggcct

SEQ ID NO: 387503 - DNA, 140 bp, Artificial Sequence
  Synthetic
aggccctggctgctgatatggcagttggcacatcaataggacggccttgaactgcaatgatagcctcagcaccggctggatagcaggccttttctaccgctacaaattcaactcttcagggaccttttgggacagcggtg

SEQ ID NO: 387504 - DNA, 140 bp, Artificial Sequence
  Synthetic
caccgctgtcccaaaaggtccctgaagagttgaatttgtagcggtagaaaaggcctgctatccagccggtgctgaggctatcattgcagttcaaggccgtcctattgatgtgccaactgccatatcagcagccagggcct

SEQ ID NO: 387505 - DNA, 140 bp, Artificial Sequence
  Synthetic
atacgccatgctgggtctccgcgacaagacagaacaggccggggaaattcaggtcctgtctacagtcactcagtccttcctcggaacatccatcgcgggggtcttatggactgtctatcacgtacttgggagtcggccat

SEQ ID NO: 387506 - DNA, 140 bp, Artificial Sequence
  Synthetic
atggccgactcccaagtacgtgatagacagtccataagacccccgcgatggatgttccgaggaaggactgagtgactgtagacaggacctgaatttccccggcctgttctgtcttgtcgcggagacccagcatggcgtat

SEQ ID NO: 387507 - DNA, 140 bp, Artificial Sequence
  Synthetic
atacgccatgctgggtctcctacctgtccaaggcacatggcatcaatcccaatatcaggactggagtcaggactgtgacgaccggagcggccatcacgtactccacatacggcaaattcccgtacttgggagtcggccat

SEQ ID NO: 387508 - DNA, 140 bp, Artificial Sequence
  Synthetic
atggccgactcccaagtacgggaatttgccgtatgtggagtacgtgatggccgctccggtcgtcacagtcctgactccagtcctgatattgggattgatgccatgtgccttggacaggtaggagacccagcatggcgtat

SEQ ID NO: 387509 - DNA, 140 bp, Artificial Sequence
  Synthetic
aggccctggctgctgatatggactgtgacgaccggagcggccatcacgtactccacatacggcaaattcctcgccgatgggggctgctcgggcggcgcttatgatatcatcatatgcgatgaccttttgggacagcggtg

SEQ ID NO: 387510 - DNA, 140 bp, Artificial Sequence
  Synthetic
caccgctgtcccaaaaggtcatcgcatatgatgatatcataagcgccgcccgagcagcccccatcggcgaggaatttgccgtatgtggagtacgtgatggccgctccggtcgtcacagtccatatcagcagccagggcct

SEQ ID NO: 387511 - DNA, 140 bp, Artificial Sequence
  Synthetic
atacgccatgctgggtctccctgggagagcgtctttacaggattaaccaacatagatgctcacttcctgtctcagactaaacaggcgggggacaactatccctacctggtagcatatcagcgtacttgggagtcggccat

SEQ ID NO: 387512 - DNA, 140 bp, Artificial Sequence
  Synthetic
atggccgactcccaagtacgctgatatgctaccaggtagggatagttgtcccccgcctgtttagtctgagacaggaagtgagcatctatgttggttaatcctgtaaagacgctctcccagggagacccagcatggcgtat

SEQ ID NO: 387513 - DNA, 140 bp, Artificial Sequence
  Synthetic
atacgccatgctgggtctccccgcgccacggctagtcttaccagcctcttcagctcaggcgccaggcagaacatccagctgatcaactccaacggcagctggcacatcaataggacggcccgtacttgggagtcggccat

SEQ ID NO: 387514 - DNA, 140 bp, Artificial Sequence
  Synthetic
atggccgactcccaagtacgggccgtcctattgatgtgccagctgccgttggagttgatcagctggatgttctgcctggcgcctgagctgaagaggctggtaagactagccgtggcgcggggagacccagcatggcgtat

SEQ ID NO: 387515 - DNA, 140 bp, Artificial Sequence
  Synthetic
atacgccatgctgggtctccacgtagccagcgccgggggcgtacgggtaggggaagactgggcatttataggtacgtgtccactggtgagcgagcctcgggaatgtttgacagcgtagtgcgtacttgggagtcggccat

SEQ ID NO: 387516 - DNA, 140 bp, Artificial Sequence
  Synthetic
atggccgactcccaagtacgcactacgctgtcaaacattcccgaggctcgctcaccagtggacacgtacctataaatgcccagtcttcccctacccgtacgcccccggcgctggctacgtggagacccagcatggcgtat

SEQ ID NO: 387517 - DNA, 140 bp, Artificial Sequence
  Synthetic
aggccctggctgctgatatgccgtggctgtagagccagtcgtcttctcccaaatggagaccaagctcatcacgtggggggcagacaccgccgcgtgcggtgacatcatcaacggcttgccgaccttttgggacagcggtg

SEQ ID NO: 387518 - DNA, 140 bp, Artificial Sequence
  Synthetic
caccgctgtcccaaaaggtcggcaagccgttgatgatgtcaccgcacgcggcggtgtctgccccccacgtgatgagcttggtctccatttgggagaagacgactggctctacagccacggcatatcagcagccagggcct

SEQ ID NO: 387519 - DNA, 140 bp, Artificial Sequence
  Synthetic
aggccctggctgctgatatggctcattgacgccctgcacctgcggctcctcggacctttacctggtcacgaggcacgccgatgtcattcccgtgcgccggcggggtgatagcaggggcaggaccttttgggacagcggtg

SEQ ID NO: 387520 - DNA, 140 bp, Artificial Sequence
  Synthetic
caccgctgtcccaaaaggtcctgcccctgctatcaccccgccggcgcacgggaatgacatcggcgtgcctcgtgaccaggtaaaggtccgaggagccgcaggtgcagggcgtcaatgagccatatcagcagccagggcct

SEQ ID NO: 387521 - DNA, 140 bp, Artificial Sequence
  Synthetic
atacgccatgctgggtctcccccttaccataactagtctgcttagaagactccacaattggattaccgagggctgccccatcccgtgcagcggctcgtggctccgcgatgtatgggactgcgtacttgggagtcggccat

SEQ ID NO: 387522 - DNA, 140 bp, Artificial Sequence
  Synthetic
atggccgactcccaagtacgcagtcccatacatcgcggagccacgagccgctgcacgggatggggcagccctcggtaatccaattgtggagtcttctaagcagactagttatggtaagggggagacccagcatggcgtat

SEQ ID NO: 387523 - DNA, 140 bp, Artificial Sequence
  Synthetic
aggccctggctgctgatatgtcccaaagatgcctggcctcccctttgtctcttgccaaaaggggtacaagggcgtatgggccggcactggtatcatgaccacacggtgtccttgcggcgcgaccttttgggacagcggtg

SEQ ID NO: 387524 - DNA, 140 bp, Artificial Sequence
  Synthetic
caccgctgtcccaaaaggtcgcgccgcaaggacaccgtgtggtcatgataccagtgccggcccatacgcccttgtaccccttttggcaagagacaaaggggaggccaggcatctttgggacatatcagcagccagggcct

SEQ ID NO: 387525 - DNA, 140 bp, Artificial Sequence
  Synthetic
aggccctggctgctgatatggagggtggcggcctcagagtacgcggaggtgacgcaacacgggtcatactcctatataacaggactgaccacagacaacctgaaagttccttgccaactagaccttttgggacagcggtg

SEQ ID NO: 387526 - DNA, 140 bp, Artificial Sequence
  Synthetic
caccgctgtcccaaaaggtctagttggcaaggaactttcaggttgtctgtggtcagtcctgttatataggagtatgacccgtgttgcgtcacctccgcgtactctgaggccgccaccctccatatcagcagccagggcct

SEQ ID NO: 387527 - DNA, 140 bp, Artificial Sequence
  Synthetic
atacgccatgctgggtctccggagaccgcagcgcggcgcttggcgcgggggtcacccccatctgaggcaagctcctcagcgagccagttatcggcgccatcgctgcgagccacctgcacccgtacttgggagtcggccat

SEQ ID NO: 387528 - DNA, 140 bp, Artificial Sequence
  Synthetic
atggccgactcccaagtacgggtgcaggtggctcgcagcgatggcgccgataactggctcgctgaggagcttgcctcagatgggggtgacccccgcgccaagcgccgcgctgcggtctccggagacccagcatggcgtat

SEQ ID NO: 387529 - DNA, 140 bp, Artificial Sequence
  Synthetic
atacgccatgctgggtctccttgggcgcggccagactacaacccaccgcttgtggaatcacggaagaagccagactatcaaccgcccactgttgcgggctgtgctctccccccccctaagcgtacttgggagtcggccat

SEQ ID NO: 387530 - DNA, 140 bp, Artificial Sequence
  Synthetic
atggccgactcccaagtacgcttagggggggggagagcacagcccgcaacagtgggcggttgatagtctggcttcttccgtgattccacaagcggtgggttgtagtctggccgcgcccaaggagacccagcatggcgtat

SEQ ID NO: 387531 - DNA, 140 bp, Artificial Sequence
  Synthetic
aggccctggctgctgatatgcagactatcaaccgcccactgttgcgggctgtgctctccccccccctaagaagaccccgacgccccccccaaggaggcgccggacagtgggtctgagtgagaccttttgggacagcggtg

SEQ ID NO: 387532 - DNA, 140 bp, Artificial Sequence
  Synthetic
caccgctgtcccaaaaggtctcactcagacccactgtccggcgcctccttggggggggcgtcggggtcttcttagggggggggagagcacagcccgcaacagtgggcggttgatagtctgcatatcagcagccagggcct

SEQ ID NO: 387533 - DNA, 140 bp, Artificial Sequence
  Synthetic
aggccctggctgctgatatgtcgctgttgcgataccacaacaaggtgtactgtaccacatcaaagagcgcctcactgagggctaaaaaggtaacttttgataggatgcaagtgctcgacggaccttttgggacagcggtg

SEQ ID NO: 387534 - DNA, 140 bp, Artificial Sequence
  Synthetic
caccgctgtcccaaaaggtccgtcgagcacttgcatcctatcaaaagttacctttttagccctcagtgaggcgctctttgatgtggtacagtacaccttgttgtggtatcgcaacagcgacatatcagcagccagggcct

SEQ ID NO: 387535 - DNA, 140 bp, Artificial Sequence
  Synthetic
aggccctggctgctgatatgcaggggtggcgacttcttgcgcctatcacggcctacgcccaacagacacgaggcctacttggctgcatcatcactagcctcacaggccgggacaagaaccgaccttttgggacagcggtg

SEQ ID NO: 387536 - DNA, 140 bp, Artificial Sequence
  Synthetic
caccgctgtcccaaaaggtcggttcttgtcccggcctgtgaggctagtgatgatgcagccaagtaggcctcgtgtctgttgggcgtaggccgtgataggcgcaagaagtcgccacccctgcatatcagcagccagggcct

SEQ ID NO: 387537 - DNA, 140 bp, Artificial Sequence
  Synthetic
aggccctggctgctgatatgcggcgcccgcgggcgccaggtcatttacaccatgcacctgtggtgccagcgacctctacctagtgactaggaatgcagatgtgatccccgcgcggcgtaggaccttttgggacagcggtg

SEQ ID NO: 387538 - DNA, 140 bp, Artificial Sequence
  Synthetic
caccgctgtcccaaaaggtcctacgccgcgcggggatcacatctgcattcctagtcactaggtagaggtcgctggcaccacaggtgcatggtgtaaatgacctggcgcccgcgggcgccgcatatcagcagccagggcct

SEQ ID NO: 387539 - DNA, 140 bp, Artificial Sequence
  Synthetic
aggccctggctgctgatatgagtcctggcgggccttgcctactattccatggtggggaactgggctaaggttttgattgtgatgctactttttgccggcgttgacgggagtacccacgtggaccttttgggacagcggtg

SEQ ID NO: 387540 - DNA, 140 bp, Artificial Sequence
  Synthetic
caccgctgtcccaaaaggtccacgtgggtactcccgtcaacgccggcaaaaagtagcatcacaatcaaaaccttagcccagttccccaccatggaatagtaggcaaggcccgccaggactcatatcagcagccagggcct

SEQ ID NO: 387541 - DNA, 140 bp, Artificial Sequence
  Synthetic
aggccctggctgctgatatgcttgccgcgctgttttacgcacgcaagttcaactcgtctggatgcccagagcgcatggccagctgcagccccattgacaagtttgctcaaggatggggtcgaccttttgggacagcggtg

SEQ ID NO: 387542 - DNA, 140 bp, Artificial Sequence
  Synthetic
caccgctgtcccaaaaggtcgaccccatccttgagcaaacttgtcaatggggctgcagctggccatgcgctctgggcatccagacgagttgaacttgcgtgcgtaaaacagcgcggcaagcatatcagcagccagggcct

SEQ ID NO: 387543 - DNA, 140 bp, Artificial Sequence
  Synthetic
atacgccatgctgggtctccacagcgtgtcgcgtgcccgaccccgcttattactccttagcctactcctactttccgtaggggtaggcctcttcctactccccgctcggtagagcggcaccgtacttgggagtcggccat

SEQ ID NO: 387544 - DNA, 140 bp, Artificial Sequence
  Synthetic
atggccgactcccaagtacggtgccgctctaccgagcggggagtaggaagaggcctacccctacggaaagtaggagtaggctaaggagtaataagcggggtcgggcacgcgacacgctgtggagacccagcatggcgtat

SEQ ID NO: 387545 - DNA, 140 bp, Artificial Sequence
  Synthetic
atacgccatgctgggtctcctgggtagcgctcactcccacgctcgcggccaggaacagcagtatccccaccacgacgatacggcgccatgtcgacttgctcgttggggtagctgctttcccgtacttgggagtcggccat

SEQ ID NO: 387546 - DNA, 140 bp, Artificial Sequence
  Synthetic
atggccgactcccaagtacgggaaagcagctaccccaacgagcaagtcgacatggcgccgtatcgtcgtggtggggatactgctgttcctggccgcgagcgtgggagtgagcgctacccaggagacccagcatggcgtat

SEQ ID NO: 387547 - DNA, 140 bp, Artificial Sequence
  Synthetic
aggccctggctgctgatatgtatgccttctatggcgtatggccgctgctcctgctcctgttggcattaccaccacgagcttacgccatggaccgggagatggctgcatcgtgcggaggcggaccttttgggacagcggtg

SEQ ID NO: 387548 - DNA, 140 bp, Artificial Sequence
  Synthetic
caccgctgtcccaaaaggtccgcctccgcacgatgcagccatctcccggtccatggcgtaagctcgtggtggtaatgccaacaggagcaggagcagcggccatacgccatagaaggcatacatatcagcagccagggcct

SEQ ID NO: 387549 - DNA, 140 bp, Artificial Sequence
  Synthetic
atacgccatgctgggtctcccaacaggacagccctgaactgcaacgattccctcaacaccgggtttattgcctcgctgttttacacgcacaggttcaactcgtccggatgcccagagcgccgtacttgggagtcggccat

SEQ ID NO: 387550 - DNA, 140 bp, Artificial Sequence
  Synthetic
atggccgactcccaagtacggcgctctgggcatccggacgagttgaacctgtgcgtgtaaaacagcgaggcaataaacccggtgttgagggaatcgttgcagttcagggctgtcctgttgggagacccagcatggcgtat

SEQ ID NO: 387551 - DNA, 140 bp, Artificial Sequence
  Synthetic
atacgccatgctgggtctcccatgcatgctggtgcggaaagtcgccgggggccactacgtccaaatggccttcgtgaaactggccgcactgacaggcacgtacgtctatgaccatcttaccgtacttgggagtcggccat

SEQ ID NO: 387552 - DNA, 140 bp, Artificial Sequence
  Synthetic
atggccgactcccaagtacggtaagatggtcatagacgtacgtgcctgtcagtgcggccagtttcacgaaggccatttggacgtagtggcccccggcgactttccgcaccagcatgcatgggagacccagcatggcgtat

SEQ ID NO: 387553 - DNA, 140 bp, Artificial Sequence
  Synthetic
aggccctggctgctgatatgcccggtctctgctgtccaagtgaagaacaccagtgacatctacatggtgactaatgactgttccaatgacagcatcacctggcagctccagaccgcggtcgaccttttgggacagcggtg

SEQ ID NO: 387554 - DNA, 140 bp, Artificial Sequence
  Synthetic
caccgctgtcccaaaaggtcgaccgcggtctggagctgccaggtgatgctgtcattggaacagtcattagtcaccatgtagatgtcactggtgttcttcacttggacagcagagaccgggcatatcagcagccagggcct

SEQ ID NO: 387555 - DNA, 140 bp, Artificial Sequence
  Synthetic
aggccctggctgctgatatggtgctggataccggtctcaccaaacgtggctgtgcggcagcgcggcgccctcacgcagggcttgcggacgcacatcgacatggttgtgatgtccgccacagaccttttgggacagcggtg

SEQ ID NO: 387556 - DNA, 140 bp, Artificial Sequence
  Synthetic
caccgctgtcccaaaaggtctgtggcggacatcacaaccatgtcgatgtgcgtccgcaagccctgcgtgagggcgccgcgctgccgcacagccacgtttggtgagaccggtatccagcaccatatcagcagccagggcct

SEQ ID NO: 387557 - DNA, 140 bp, Artificial Sequence
  Synthetic
aggccctggctgctgatatgggcctacttggttgcatcatcactagcctcacaggccgggacaagaaccaggtcgagggggaggttcaagtggtttccaccgcaacacaatctttcctgggaccttttgggacagcggtg

SEQ ID NO: 387558 - DNA, 140 bp, Artificial Sequence
  Synthetic
caccgctgtcccaaaaggtcccaggaaagattgtgttgcggtggaaaccacttgaacctccccctcgacctggttcttgtcccggcctgtgaggctagtgatgatgcaaccaagtaggcccatatcagcagccagggcct

SEQ ID NO: 387559 - DNA, 140 bp, Artificial Sequence
  Synthetic
aggccctggctgctgatatggcaattgctccatctatcctggcaccatcactggacatcgtatggcatgggacatgatgatgaactggtcgcccacgaccaccatgatcctcgcgtacgcgaccttttgggacagcggtg

SEQ ID NO: 387560 - DNA, 140 bp, Artificial Sequence
  Synthetic
caccgctgtcccaaaaggtcgcgtacgcgaggatcatggtggtcgtgggcgaccagttcatcatcatgtcccatgccatacgatgtccagtgatggtgccaggatagatggagcaattgccatatcagcagccagggcct

SEQ ID NO: 387561 - DNA, 140 bp, Artificial Sequence
  Synthetic
atacgccatgctgggtctccgtcgctgtcatccttctgttgaccgctggggttgacgcgcacaccgtcacagttgggggtagcgccgggttcaccacctcaagcctcaccgcccttttcgcgtacttgggagtcggccat

SEQ ID NO: 387562 - DNA, 140 bp, Artificial Sequence
  Synthetic
atggccgactcccaagtacgcgaaaagggcggtgaggcttgaggtggtgaacccggcgctacccccaactgtgacggtgtgcgcgtcaaccccagcggtcaacagaaggatgacagcgacggagacccagcatggcgtat

SEQ ID NO: 387563 - DNA, 140 bp, Artificial Sequence
  Synthetic
atacgccatgctgggtctcccatcgcgtccctgttctacgccaagaacttcaactcgtcaggatgtcccgaacgcatgtccgcctgccgtaatatcgaggccttccggataggatggggccgtacttgggagtcggccat

SEQ ID NO: 387564 - DNA, 140 bp, Artificial Sequence
  Synthetic
atggccgactcccaagtacggccccatcctatccggaaggcctcgatattacggcaggcggacatgcgttcgggacatcctgacgagttgaagttcttggcgtagaacagggacgcgatgggagacccagcatggcgtat

SEQ ID NO: 387565 - DNA, 140 bp, Artificial Sequence
  Synthetic
atacgccatgctgggtctccctgctggcattatccaccaaaacagtgtggcatagtccccgcgaggtctgtgtccggcccagtgtactgtttcacccccagcccagtggtagtgggcacgcgtacttgggagtcggccat

SEQ ID NO: 387566 - DNA, 140 bp, Artificial Sequence
  Synthetic
atggccgactcccaagtacgcgtgcccactaccactgggctgggggtgaaacagtacactgggccggacacagacctcgcggggactatgccacactgttttggtggataatgccagcagggagacccagcatggcgtat

SEQ ID NO: 387567 - DNA, 140 bp, Artificial Sequence
  Synthetic
aggccctggctgctgatatgctgtccgctccatctctcaaggcaacttgcaccaccaaccatgactcccctgacgccgagctcatagaggctaacctcctgtggaggcaggagatgggcggaccttttgggacagcggtg

SEQ ID NO: 387568 - DNA, 140 bp, Artificial Sequence
  Synthetic
caccgctgtcccaaaaggtccgcccatctcctgcctccacaggaggttagcctctatgagctcggcgtcaggggagtcatggttggtggtgcaagttgccttgagagatggagcggacagcatatcagcagccagggcct

SEQ ID NO: 387569 - DNA, 140 bp, Artificial Sequence
  Synthetic
atacgccatgctgggtctccaatacatgtatggtctgtcacctgccctcacaaaatatgtcgttcgttgggagtgggtagtactcctgttcctgctcctagcggacgccagggtctgcgccgtacttgggagtcggccat

SEQ ID NO: 387570 - DNA, 140 bp, Artificial Sequence
  Synthetic
atggccgactcccaagtacggcgcagaccctggcgtccgctaggagcaggaacaggagtactacccactcccaacgaacgacatattttgtgagggcaggtgacagaccatacatgtattggagacccagcatggcgtat

SEQ ID NO: 387571 - DNA, 140 bp, Artificial Sequence
  Synthetic
atacgccatgctgggtctcccgaggcaggactggcaggggtaggggaggcatctacaggtttgtgactccaggagaacggccctcgggcatgttcgattcctcggtcctgtgtgagtgctcgtacttgggagtcggccat

SEQ ID NO: 387572 - DNA, 140 bp, Artificial Sequence
  Synthetic
atggccgactcccaagtacgagcactcacacaggaccgaggaatcgaacatgcccgagggccgttctcctggagtcacaaacctgtagatgcctcccctacccctgccagtcctgcctcgggagacccagcatggcgtat

SEQ ID NO: 387573 - DNA, 140 bp, Artificial Sequence
  Synthetic
atacgccatgctgggtctcccttggcccgggaaagggcccaattacccaaatgtacaccaatgtagaccaggacctcgttggctggcagcggcctccgggtcgcgttccttgacaccatgcgtacttgggagtcggccat

SEQ ID NO: 387574 - DNA, 140 bp, Artificial Sequence
  Synthetic
atggccgactcccaagtacgcatggtgtcaaggaacgcgacccggaggccgctgccagccaacgaggtcctggtctacattggtgtacatttgggtaattgggccctttcccgggccaagggagacccagcatggcgtat

SEQ ID NO: 387575 - DNA, 140 bp, Artificial Sequence
  Synthetic
atacgccatgctgggtctcctgtggtggccgtgatggcatcatatgggtcgccaccatactttgcccgggcgtggtgtttgacataaccaagtggctcttggcggtgcttgggtctagttcgtacttgggagtcggccat

SEQ ID NO: 387576 - DNA, 140 bp, Artificial Sequence
  Synthetic
atggccgactcccaagtacgaactagacccaagcaccgccaagagccacttggttatgtcaaacaccacgcccgggcaaagtatggtggcgacccatatgatgccatcacggccaccacaggagacccagcatggcgtat

SEQ ID NO: 387577 - DNA, 140 bp, Artificial Sequence
  Synthetic
aggccctggctgctgatatgggctacacctccaaggggtggaggcttctcgcccccatcactgcttacgcccagcagacacggggtctcttgggcaccatagtggtgagcatgacggggcgaccttttgggacagcggtg

SEQ ID NO: 387578 - DNA, 140 bp, Artificial Sequence
  Synthetic
caccgctgtcccaaaaggtcgccccgtcatgctcaccactatggtgcccaagagaccccgtgtctgctgggcgtaagcagtgatgggggcgagaagcctccaccccttggaggtgtagcccatatcagcagccagggcct

SEQ ID NO: 387579 - DNA, 140 bp, Artificial Sequence
  Synthetic
atacgccatgctgggtctccgaatgccatgctgtggatgctaccaccattctcggcatcggaacagttcttgaccaagcagagacagccggggtcaggctaactgtgctggccacggccacgtacttgggagtcggccat

SEQ ID NO: 387580 - DNA, 140 bp, Artificial Sequence
  Synthetic
atggccgactcccaagtacgtggccgtggccagcacagttagcctgaccccggctgtctctgcttggtcaagaactgttccgatgccgagaatggtggtagcatccacagcatggcattcggagacccagcatggcgtat

SEQ ID NO: 387581 - DNA, 140 bp, Artificial Sequence
  Synthetic
atacgccatgctgggtctccctcggccatgagggtgagatctccttctatgggaaggcaattcccctgtcttacatcaagggagggagacatttgatcttttgccactcaaagaaaaagtcgtacttgggagtcggccat

SEQ ID NO: 387582 - DNA, 140 bp, Artificial Sequence
  Synthetic
atggccgactcccaagtacgactttttctttgagtggcaaaagatcaaatgtctccctcccttgatgtaagacaggggaattgccttcccatagaaggagatctcaccctcatggccgagggagacccagcatggcgtat

SEQ ID NO: 387583 - DNA, 140 bp, Artificial Sequence
  Synthetic
aggccctggctgctgatatgccggctcgtggctcagggatgtttgggactggatatgcacggtgttgactgacttcaagacctggctccagtccaagctcctgccacggctgccgggagtgaccttttgggacagcggtg

SEQ ID NO: 387584 - DNA, 140 bp, Artificial Sequence
  Synthetic
caccgctgtcccaaaaggtcactcccggcagccgtggcaggagcttggactggagccaggtcttgaagtcagtcaacaccgtgcatatccagtcccaaacatccctgagccacgagccggcatatcagcagccagggcct

SEQ ID NO: 387585 - DNA, 140 bp, Artificial Sequence
  Synthetic
aggccctggctgctgatatgtcctctatgaggcttttgacgagatggaggaatgtgcctctagagcggctctcattgaggaggggcagcgcatagctgagatgctgaagtccaagatccagaccttttgggacagcggtg

SEQ ID NO: 387586 - DNA, 140 bp, Artificial Sequence
  Synthetic
caccgctgtcccaaaaggtctggatcttggacttcagcatctcagctatgcgctgcccctcctcaatgagagccgctctagaggcacattcctccatctcgtcaaaagcctcatagaggacatatcagcagccagggcct

SEQ ID NO: 387587 - DNA, 140 bp, Artificial Sequence
  Synthetic
aggccctggctgctgatatgggcagccccatcacgtactccacctacggcaagttccttgccgacggcgggtgctcagggggtgcttatgacataataatttgtgacgagtgccactccagaccttttgggacagcggtg

SEQ ID NO: 387588 - DNA, 140 bp, Artificial Sequence
  Synthetic
caccgctgtcccaaaaggtctggagtggcactcgtcacaaattattatgtcataagcaccccctgagcacccgccgtcggcaaggaacttgccgtaggtggagtacgtgatggggctgcccatatcagcagccagggcct

SEQ ID NO: 387589 - DNA, 140 bp, Artificial Sequence
  Synthetic
atacgccatgctgggtctcccaaccgtcgtctccgggggaagtgctgcccgcgacatgcagggacttgctagcctcttctcaccaggcgcccgacagaacgtccagctggtcaacaccaacgtacttgggagtcggccat

SEQ ID NO: 387590 - DNA, 140 bp, Artificial Sequence
  Synthetic
atggccgactcccaagtacgttggtgttgaccagctggacgttctgtcgggcgcctggtgagaagaggctagcaagtccctgcatgtcgcgggcagcacttcccccggagacgacggttgggagacccagcatggcgtat

SEQ ID NO: 387591 - DNA, 140 bp, Artificial Sequence
  Synthetic
aggccctggctgctgatatggggctggggccctatcagtcatgccaacggaagcggccccgaccaacgcccctactgctggcactaccccccaaaaccttgtggtattgtgcccgcgaaggaccttttgggacagcggtg

SEQ ID NO: 387592 - DNA, 140 bp, Artificial Sequence
  Synthetic
caccgctgtcccaaaaggtccttcgcgggcacaataccacaaggttttggggggtagtgccagcagtaggggcgttggtcggggccgcttccgttggcatgactgatagggccccagccccatatcagcagccagggcct

SEQ ID NO: 387593 - DNA, 140 bp, Artificial Sequence
  Synthetic
aggccctggctgctgatatgtatgacacccgctgttttgactcaacagtcactgagaatgacatccgtattgaggagtcaatctaccaatgttgtgacttggcccccgaagccagacagggaccttttgggacagcggtg

SEQ ID NO: 387594 - DNA, 140 bp, Artificial Sequence
  Synthetic
caccgctgtcccaaaaggtccctgtctggcttcgggggccaagtcacaacattggtagattgactcctcaatacggatgtcattctcagtgactgttgagtcaaaacagcgggtgtcatacatatcagcagccagggcct

SEQ ID NO: 387595 - DNA, 140 bp, Artificial Sequence
  Synthetic
aggccctggctgctgatatgacgccgacctcatcgaggccaacctcctgtggcggcaggagatgggcgggaacatcacccgcgtggagtcggagaacaaggtagtaattctagactctttgaccttttgggacagcggtg

SEQ ID NO: 387596 - DNA, 140 bp, Artificial Sequence
  Synthetic
caccgctgtcccaaaaggtcaaagagtctagaattactaccttgttctccgactccacgcgggtgatgttcccgcccatctcctgccgccacaggaggttggcctcgatgaggtcggcgtcatatcagcagccagggcct

SEQ ID NO: 387597 - DNA, 140 bp, Artificial Sequence
  Synthetic
aggccctggctgctgatatgaacgaccgacaggtcgggcgcgcctacctacaactggggtgaaaatgaaacggacgtcttcgtccttaacaacaccaggccaccgctgggcaattggttcgaccttttgggacagcggtg

SEQ ID NO: 387598 - DNA, 140 bp, Artificial Sequence
  Synthetic
caccgctgtcccaaaaggtcgaaccaattgcccagcggtggcctggtgttgttaaggacgaagacgtccgtttcattttcaccccagttgtaggtaggcgcgcccgacctgtcggtcgttcatatcagcagccagggcct

SEQ ID NO: 387599 - DNA, 140 bp, Artificial Sequence
  Synthetic
aggccctggctgctgatatgcggacgtcttcgtccttaacaacaccaggccaccgctgggcaattggttcggttgtacctggatgaactcaactggattcaccaaagtgtgcggagcgccgaccttttgggacagcggtg

SEQ ID NO: 387600 - DNA, 140 bp, Artificial Sequence
  Synthetic
caccgctgtcccaaaaggtcggcgctccgcacactttggtgaatccagttgagttcatccaggtacaaccgaaccaattgcccagcggtggcctggtgttgttaaggacgaagacgtccgcatatcagcagccagggcct

SEQ ID NO: 387601 - DNA, 140 bp, Artificial Sequence
  Synthetic
atacgccatgctgggtctcccccttaccataactagcctgctcagaagactccacaattggattactgaggattgccccatcccgtgcgccggctcatggctgcgcgatgtatgggactgcgtacttgggagtcggccat

SEQ ID NO: 387602 - DNA, 140 bp, Artificial Sequence
  Synthetic
atggccgactcccaagtacgcagtcccatacatcgcgcagccatgagccggcgcacgggatggggcaatcctcagtaatccaattgtggagtcttctgagcaggctagttatggtaagggggagacccagcatggcgtat

SEQ ID NO: 387603 - DNA, 140 bp, Artificial Sequence
  Synthetic
atacgccatgctgggtctccaaacctgcatgaacacctggcaggggacttttcccatcaattgttacacggagggccagtgcatgccgaagcccgcaccaaactttaagaccgccatctgcgtacttgggagtcggccat

SEQ ID NO: 387604 - DNA, 140 bp, Artificial Sequence
  Synthetic
atggccgactcccaagtacgcagatggcggtcttaaagtttggtgcgggcttcggcatgcactggccctccgtgtaacaattgatgggaaaagtcccctgccaggtgttcatgcaggtttggagacccagcatggcgtat

SEQ ID NO: 387605 - DNA, 140 bp, Artificial Sequence
  Synthetic
atacgccatgctgggtctccccttctccagagttcttctcttgggtggacggagtgcaaatccacaggtttgctcccacaccaaagccgtttttccgggatgaggtctcgttctgcgtcgcgtacttgggagtcggccat

SEQ ID NO: 387606 - DNA, 140 bp, Artificial Sequence
  Synthetic
atggccgactcccaagtacgcgacgcagaacgagacctcatcccggaaaaacggctttggtgtgggagcaaacctgtggatttgcactccgtccacccaagagaagaactctggagaaggggagacccagcatggcgtat

SEQ ID NO: 387607 - DNA, 140 bp, Artificial Sequence
  Synthetic
aggccctggctgctgatatgtgctcccacaccaaagccgtttttccgggatgaggtctcgttctgcgtcgggctcaactcattcgttgtcgggtctcaacttccttgcgatcctgagcccgaccttttgggacagcggtg

SEQ ID NO: 387608 - DNA, 140 bp, Artificial Sequence
  Synthetic
caccgctgtcccaaaaggtcgggctcaggatcgcaaggaagttgagacccgacaacgaatgagttgagcccgacgcagaacgagacctcatcccggaaaaacggctttggtgtgggagcacatatcagcagccagggcct

SEQ ID NO: 387609 - DNA, 140 bp, Artificial Sequence
  Synthetic
atacgccatgctgggtctcccagattaccaaccgcccactgttgcgggctgtgctctccccccccccaagaagaccccgacgcctcccccaaggagacgccggacagtgggtttgagcgacgtacttgggagtcggccat

SEQ ID NO: 387610 - DNA, 140 bp, Artificial Sequence
  Synthetic
atggccgactcccaagtacgtcgctcaaacccactgtccggcgtctccttgggggaggcgtcggggtcttcttggggggggggagagcacagcccgcaacagtgggcggttggtaatctgggagacccagcatggcgtat

SEQ ID NO: 387611 - DNA, 140 bp, Artificial Sequence
  Synthetic
aggccctggctgctgatatgaagaccccgacgcctcccccaaggagacgccggacagtgggtttgagcgagagcaccattggagatgccctccaacagctggccgccaagaccttcggccgaccttttgggacagcggtg

SEQ ID NO: 387612 - DNA, 140 bp, Artificial Sequence
  Synthetic
caccgctgtcccaaaaggtcggccgaaggtcttggcggccagctgttggagggcatctccaatggtgctctcgctcaaacccactgtccggcgtctccttgggggaggcgtcggggtcttcatatcagcagccagggcct

SEQ ID NO: 387613 - DNA, 140 bp, Artificial Sequence
  Synthetic
atacgccatgctgggtctcctggagcctgagcaggtagagcttcaacctcccccccaggggggggaggcagctcccggctcggactcggggtcctggtctacttgctccgaggaggatgacgtacttgggagtcggccat

SEQ ID NO: 387614 - DNA, 140 bp, Artificial Sequence
  Synthetic
atggccgactcccaagtacgtcatcctcctcggagcaagtagaccaggaccccgagtccgagccgggagctgcctcccccccctgggggggaggttgaagctctacctgctcaggctccaggagacccagcatggcgtat

SEQ ID NO: 387615 - DNA, 140 bp, Artificial Sequence
  Synthetic
aggccctggctgctgatatgtataccaatgtagaccaagacctcgtgggctggcccgctcctcaaggtgcccgctcattgacaccctgcacctgcggctcctcggacctttacctggtcagaccttttgggacagcggtg

SEQ ID NO: 387616 - DNA, 140 bp, Artificial Sequence
  Synthetic
caccgctgtcccaaaaggtctgaccaggtaaaggtccgaggagccgcaggtgcagggtgtcaatgagcgggcaccttgaggagcgggccagcccacgaggtcttggtctacattggtatacatatcagcagccagggcct

SEQ ID NO: 387617 - DNA, 140 bp, Artificial Sequence
  Synthetic
aggccctggctgctgatatgcgaggcacgccgatgtcattcccgtgcgccggcggggtgatagcaggggcagcctgctttcgccccggcccatctcctacttgaaaggctcctcgggggggaccttttgggacagcggtg

SEQ ID NO: 387618 - DNA, 140 bp, Artificial Sequence
  Synthetic
caccgctgtcccaaaaggtcccccccgaggagcctttcaagtaggagatgggccggggcgaaagcaggctgcccctgctatcaccccgccggcgcacgggaatgacatcggcgtgcctcgcatatcagcagccagggcct

SEQ ID NO: 387619 - DNA, 140 bp, Artificial Sequence
  Synthetic
atacgccatgctgggtctccacatcaataggactgccctgaactgcaatgactctctccaaactgggttccttgccgcactattctacgcacacaggttcaactcatccggatgcccagacgtacttgggagtcggccat

SEQ ID NO: 387620 - DNA, 140 bp, Artificial Sequence
  Synthetic
atggccgactcccaagtacgtctgggcatccggatgagttgaacctgtgtgcgtagaatagtgcggcaaggaacccagtttggagagagtcattgcagttcagggcagtcctattgatgtggagacccagcatggcgtat

SEQ ID NO: 387621 - DNA, 140 bp, Artificial Sequence
  Synthetic
aggccctggctgctgatatgtgaaatgtacggatcggtgtactccgtgagtcctttggacctcccagccataattgaaaggttacacgggcttgacgccttttctctgcacacatactctgaccttttgggacagcggtg

SEQ ID NO: 387622 - DNA, 140 bp, Artificial Sequence
  Synthetic
caccgctgtcccaaaaggtcagagtatgtgtgcagagaaaaggcgtcaagcccgtgtaacctttcaattatggctgggaggtccaaaggactcacggagtacaccgatccgtacatttcacatatcagcagccagggcct

SEQ ID NO: 387623 - DNA, 140 bp, Artificial Sequence
  Synthetic
atacgccatgctgggtctccctttctgtaggggtaggcctctttttactccccgctcggtagagcggcatacattagctacactccatagctaacagtttctctttttttttttttccttcgtacttgggagtcggccat

SEQ ID NO: 387624 - DNA, 140 bp, Artificial Sequence
  Synthetic
atggccgactcccaagtacgaaggaaaaaaaaaaaaagagaaactgttagctatggagtgtagctaatgtatgccgctctaccgagcggggagtaaaaagaggcctacccctacagaaagggagacccagcatggcgtat

SEQ ID NO: 387625 - DNA, 140 bp, Artificial Sequence
  Synthetic
aggccctggctgctgatatgttcatgaaactggccgcgctgacaggcacgtacgtttatgaccatctcactccactgcgggactgggcccacgcgggcctacgagaccttgcggtggcaggaccttttgggacagcggtg

SEQ ID NO: 387626 - DNA, 140 bp, Artificial Sequence
  Synthetic
caccgctgtcccaaaaggtcctgccaccgcaaggtctcgtaggcccgcgtgggcccagtcccgcagtggagtgagatggtcataaacgtacgtgcctgtcagcgcggccagtttcatgaacatatcagcagccagggcct

SEQ ID NO: 387627 - DNA, 140 bp, Artificial Sequence
  Synthetic
atacgccatgctgggtctccagtaccactggtttgtgcaagaatgcaattgctccatctaccctggcaccatcactggacaccgcatggcatgggacatgatgatgaactggtcgcccaccgtacttgggagtcggccat

SEQ ID NO: 387628 - DNA, 140 bp, Artificial Sequence
  Synthetic
atggccgactcccaagtacggtgggcgaccagttcatcatcatgtcccatgccatgcggtgtccagtgatggtgccagggtagatggagcaattgcattcttgcacaaaccagtggtactggagacccagcatggcgtat

SEQ ID NO: 387629 - DNA, 140 bp, Artificial Sequence
  Synthetic
aggccctggctgctgatatgacatcgttagcggggctcactggggcgtcatgttcggcttggcctacttctctatgcagggagcgtgggcgaaggtcattgtcatccttctgctggccgcgaccttttgggacagcggtg

SEQ ID NO: 387630 - DNA, 140 bp, Artificial Sequence
  Synthetic
caccgctgtcccaaaaggtcgcggccagcagaaggatgacaatgaccttcgcccacgctccctgcatagagaagtaggccaagccgaacatgacgccccagtgagccccgctaacgatgtcatatcagcagccagggcct

SEQ ID NO: 387631 - DNA, 140 bp, Artificial Sequence
  Synthetic
aggccctggctgctgatatggcgcctgtttgtggatgatgctgctgatagcccaggccgaggccgccctagagaacctggtggtcctcaatgcggcgtccgtggccggagcgcatggcatgaccttttgggacagcggtg

SEQ ID NO: 387632 - DNA, 140 bp, Artificial Sequence
  Synthetic
caccgctgtcccaaaaggtcatgccatgcgctccggccacggacgccgcattgaggaccaccaggttctctagggcggcctcggcctgggctatcagcagcatcatccacaaacaggcgccatatcagcagccagggcct

SEQ ID NO: 387633 - DNA, 140 bp, Artificial Sequence
  Synthetic
atacgccatgctgggtctccggttgctccttttctatcttcttgctggctctactgtcctgcatcactgttccggtctctgccgcccaagtgaagaacaccagcagcagctacatggtgacgtacttgggagtcggccat

SEQ ID NO: 387634 - DNA, 140 bp, Artificial Sequence
  Synthetic
atggccgactcccaagtacgtcaccatgtagctgctgctggtgttcttcacttgggcggcagagaccggaacagtgatgcaggacagtagagccagcaagaagatagaaaaggagcaaccggagacccagcatggcgtat

SEQ ID NO: 387635 - DNA, 140 bp, Artificial Sequence
  Synthetic
aggccctggctgctgatatgggcctcgcctactattccatggtggggaactgggccaaggtcttgattgtgatgctactctttgccggcgttgacggacaggggacccgcgtgacggggggaccttttgggacagcggtg

SEQ ID NO: 387636 - DNA, 140 bp, Artificial Sequence
  Synthetic
caccgctgtcccaaaaggtccccccgtcacgcgggtcccctgtccgtcaacgccggcaaagagtagcatcacaatcaagaccttggcccagttccccaccatggaatagtaggcgaggcccatatcagcagccagggcct

SEQ ID NO: 387637 - DNA, 140 bp, Artificial Sequence
  Synthetic
atacgccatgctgggtctccgtgctggataccggtctcgccaaacgtagccgtccggcagcccggcgccctcacgcagggcttgcggacacacatcgatatggttgtgatgtccgctacgcgtacttgggagtcggccat

SEQ ID NO: 387638 - DNA, 140 bp, Artificial Sequence
  Synthetic
atggccgactcccaagtacgcgtagcggacatcacaaccatatcgatgtgtgtccgcaagccctgcgtgagggcgccgggctgccggacggctacgtttggcgagaccggtatccagcacggagacccagcatggcgtat

SEQ ID NO: 387639 - DNA, 140 bp, Artificial Sequence
  Synthetic
atacgccatgctgggtctccctttgctccgctctctatgtgggggacttttgcggcggggtgatgctcgcagcccagatgttcattgtctcaccgcaaacccattggtttgttcaggagtcgtacttgggagtcggccat

SEQ ID NO: 387640 - DNA, 140 bp, Artificial Sequence
  Synthetic
atggccgactcccaagtacgactcctgaacaaaccaatgggtttgcggtgagacaatgaacatctgggctgcgagcatcaccccgccgcaaaagtcccccacatagagagcggagcaaagggagacccagcatggcgtat

SEQ ID NO: 387641 - DNA, 140 bp, Artificial Sequence
  Synthetic
atacgccatgctgggtctcccatcttcaagataagaatgtatgtagggggggttgagcacaggctcacggccgcatgcaacttcactcgtggggatcgctgcgacttggaggacagggaccgtacttgggagtcggccat

SEQ ID NO: 387642 - DNA, 140 bp, Artificial Sequence
  Synthetic
atggccgactcccaagtacggtccctgtcctccaagtcgcagcgatccccacgagtgaagttgcatgcggccgtgagcctgtgctcaaccccccctacatacattcttatcttgaagatgggagacccagcatggcgtat

SEQ ID NO: 387643 - DNA, 140 bp, Artificial Sequence
  Synthetic
aggccctggctgctgatatggcgtcatgttcggcttagcctacttctctatgcagggagcgtgggcgaaagtcgttgtcatccttatgctagccgcaggggtggacgcgacccaaaccatgaccttttgggacagcggtg

SEQ ID NO: 387644 - DNA, 140 bp, Artificial Sequence
  Synthetic
caccgctgtcccaaaaggtcatggtttgggtcgcgtccacccctgcggctagcataaggatgacaacgactttcgcccacgctccctgcatagagaagtaggctaagccgaacatgacgccatatcagcagccagggcct

SEQ ID NO: 387645 - DNA, 140 bp, Artificial Sequence
  Synthetic
aggccctggctgctgatatgttgatgtgtccgtcataccgactagcggagacgtcgttgtcgtggcaacagacgctctaatgacgggctttaccggcgactttgactcagtgatcgactggaccttttgggacagcggtg

SEQ ID NO: 387646 - DNA, 140 bp, Artificial Sequence
  Synthetic
caccgctgtcccaaaaggtccagtcgatcactgagtcaaagtcgccggtaaagcccgtcattagagcgtctgttgccacgacaacgacgtctccgctagtcggtatgacggacacatcaacatatcagcagccagggcct

SEQ ID NO: 387647 - DNA, 140 bp, Artificial Sequence
  Synthetic
aggccctggctgctgatatgtaatacatgtgtcacccaaacagtcgatttcagcttggaccccaccttcaccattgagacgacgaccgtgccccaagacgcggtgtcgcgctcgcagcgggaccttttgggacagcggtg

SEQ ID NO: 387648 - DNA, 140 bp, Artificial Sequence
  Synthetic
caccgctgtcccaaaaggtcccgctgcgagcgcgacaccgcgtcttggggcacggtcgtcgtctcaatggtgaaggtggggtccaagctgaaatcgactgtttgggtgacacatgtattacatatcagcagccagggcct

SEQ ID NO: 387649 - DNA, 140 bp, Artificial Sequence
  Synthetic
atacgccatgctgggtctccgtcaaccgcactgccttgaattgcaatgactccctgcagaccggttttctcgcggccctgttttacgtccaccgcttcaactcgtcaggatgtcccgaaccgtacttgggagtcggccat

SEQ ID NO: 387650 - DNA, 140 bp, Artificial Sequence
  Synthetic
atggccgactcccaagtacggttcgggacatcctgacgagttgaagcggtggacgtaaaacagggccgcgagaaaaccggtctgcagggagtcattgcaattcaaggcagtgcggttgacggagacccagcatggcgtat

SEQ ID NO: 387651 - DNA, 140 bp, Artificial Sequence
  Synthetic
aggccctggctgctgatatgccaggcgccactggacaacgcaagactgcaactgttctatctatcccggccatataacgggtcaccgcatggcatgggatatgatgatgaactggtccccgaccttttgggacagcggtg

SEQ ID NO: 387652 - DNA, 140 bp, Artificial Sequence
  Synthetic
caccgctgtcccaaaaggtcggggaccagttcatcatcatatcccatgccatgcggtgacccgttatatggccgggatagatagaacagttgcagtcttgcgttgtccagtggcgcctggcatatcagcagccagggcct

SEQ ID NO: 387653 - DNA, 140 bp, Artificial Sequence
  Synthetic
atacgccatgctgggtctccctgcagtacgaggataacatcaccaacccagaggatatgagaccatattgttggcactacccaccaggacagtgcggcatagtccccgcgaagtctgtgtcgtacttgggagtcggccat

SEQ ID NO: 387654 - DNA, 140 bp, Artificial Sequence
  Synthetic
atggccgactcccaagtacgacacagacttcgcggggactatgccgcactgtcctggtgggtagtgccaacaatatggtctcatatcctctgggttggtgatgttatcctcgtactgcagggagacccagcatggcgtat

SEQ ID NO: 387655 - DNA, 140 bp, Artificial Sequence
  Synthetic
aggccctggctgctgatatgtggaaaaagcctgactacgaaccacctgtggtccatggctgcccgcttccacctccacagtcccctcctgtgcctccgcctcgaaagaagcggacggtgggaccttttgggacagcggtg

SEQ ID NO: 387656 - DNA, 140 bp, Artificial Sequence
  Synthetic
caccgctgtcccaaaaggtcccaccgtccgcttctttcgaggcggaggcacaggaggggactgtggaggtggaagcgggcagccatggaccacaggtggttcgtagtcaggctttttccacatatcagcagccagggcct

SEQ ID NO: 387657 - DNA, 140 bp, Artificial Sequence
  Synthetic
aggccctggctgctgatatgcttcctattgaacagcacccgtccaccgcgggggtcatggttcggctgcacgtggatgaattccgctggtttcaccaagacttgcggcgcaccaccttgcgaccttttgggacagcggtg

SEQ ID NO: 387658 - DNA, 140 bp, Artificial Sequence
  Synthetic
caccgctgtcccaaaaggtcgcaaggtggtgcgccgcaagtcttggtgaaaccagcggaattcatccacgtgcagccgaaccatgacccccgcggtggacgggtgctgttcaataggaagcatatcagcagccagggcct

SEQ ID NO: 387659 - DNA, 140 bp, Artificial Sequence
  Synthetic
atacgccatgctgggtctccttttggcgttgcttgggcctgcttacctcttaagggccgctttgacacatgtgccgtacttcgtcagagctcacgctctgataagggtatgcgctttggtcgtacttgggagtcggccat

SEQ ID NO: 387660 - DNA, 140 bp, Artificial Sequence
  Synthetic
atggccgactcccaagtacgaccaaagcgcatacccttatcagagcgtgagctctgacgaagtacggcacatgtgtcaaagcggcccttaagaggtaagcaggcccaagcaacgccaaaaggagacccagcatggcgtat

SEQ ID NO: 387661 - DNA, 140 bp, Artificial Sequence
  Synthetic
atacgccatgctgggtctcccctggctcacgccaaggtgcctggtcgattacccctacaggctttggcattacccttgcacagtcaactttaccatcttcaagataaggatgtacgtgggcgtacttgggagtcggccat

SEQ ID NO: 387662 - DNA, 140 bp, Artificial Sequence
  Synthetic
atggccgactcccaagtacgcccacgtacatccttatcttgaagatggtaaagttgactgtgcaagggtaatgccaaagcctgtaggggtaatcgaccaggcaccttggcgtgagccaggggagacccagcatggcgtat

SEQ ID NO: 387663 - DNA, 140 bp, Artificial Sequence
  Synthetic
atacgccatgctgggtctcctgggccgctagcggcctgcgcgacttagcggtcgccgtggaacccatcatcttcagtccgatggagaagaaggtcatcgtctggggagcggagacggctgcgtacttgggagtcggccat

SEQ ID NO: 387664 - DNA, 140 bp, Artificial Sequence
  Synthetic
atggccgactcccaagtacgcagccgtctccgctccccagacgatgaccttcttctccatcggactgaagatgatgggttccacggcgaccgctaagtcgcgcaggccgctagcggcccaggagacccagcatggcgtat

SEQ ID NO: 387665 - DNA, 140 bp, Artificial Sequence
  Synthetic
atacgccatgctgggtctcccaccatactataagctactcctcgctaagctcatatggtggttgcaatatcttatcaccagagctgaggcgcagctgcaagtgtggatcccccccctcaacgtacttgggagtcggccat

SEQ ID NO: 387666 - DNA, 140 bp, Artificial Sequence
  Synthetic
atggccgactcccaagtacgttgaggggggggatccacacttgcagctgcgcctcagctctggtgataagatattgcaaccaccatatgagcttagcgaggagtagcttatagtatggtgggagacccagcatggcgtat

SEQ ID NO: 387667 - DNA, 140 bp, Artificial Sequence
  Synthetic
atacgccatgctgggtctcctccaccacagaatgggccattttgccctgcactttctcagacctgcccgccctgtcgactggccttctccacctccaccaaaacatcgtggacgtacaatcgtacttgggagtcggccat

SEQ ID NO: 387668 - DNA, 140 bp, Artificial Sequence
  Synthetic
atggccgactcccaagtacgattgtacgtccacgatgttttggtggaggtggagaaggccagtcgacagggcgggcaggtctgagaaagtgcagggcaaaatggcccattctgtggtggaggagacccagcatggcgtat

SEQ ID NO: 387669 - DNA, 140 bp, Artificial Sequence
  Synthetic
atacgccatgctgggtctccccttgctcccatcactgcttatgcccagcaaacacgaggcctcctgggcgccatagtggtgagtatgacggggcgtgacaggacagaacaggccggggaacgtacttgggagtcggccat

SEQ ID NO: 387670 - DNA, 140 bp, Artificial Sequence
  Synthetic
atggccgactcccaagtacgttccccggcctgttctgtcctgtcacgccccgtcatactcaccactatggcgcccaggaggcctcgtgtttgctgggcataagcagtgatgggagcaaggggagacccagcatggcgtat

SEQ ID NO: 387671 - DNA, 140 bp, Artificial Sequence
  Synthetic
aggccctggctgctgatatgggatacaatacttagcaggcttgtccactctgcctgggaaccccgcaatagcatcactgatggcattcacagcctctatcaccagcccgctcaccacccagaccttttgggacagcggtg

SEQ ID NO: 387672 - DNA, 140 bp, Artificial Sequence
  Synthetic
caccgctgtcccaaaaggtctgggtggtgagcgggctggtgatagaggctgtgaatgccatcagtgatgctattgcggggttcccaggcagagtggacaagcctgctaagtattgtatcccatatcagcagccagggcct

SEQ ID NO: 387673 - DNA, 140 bp, Artificial Sequence
  Synthetic
atacgccatgctgggtctcccttggccgcctactctcttactggcctatggtccttctgcctactgcttctagcattgccccaacaggcttatgcttatgacgcacctatgcatggacagcgtacttgggagtcggccat

SEQ ID NO: 387674 - DNA, 140 bp, Artificial Sequence
  Synthetic
atggccgactcccaagtacgctgtccatgcataggtgcgtcataagcataagcctgttggggcaatgctagaagcagtaggcagaaggaccataggccagtaagagagtaggcggccaagggagacccagcatggcgtat

SEQ ID NO: 387675 - DNA, 140 bp, Artificial Sequence
  Synthetic
aggccctggctgctgatatgaatgacagcctcaccaccggctggctagcagggcttctctaccaccacaaattcaactcttcaggctgtcccgagagaatggccagctgtcaacctctcagaccttttgggacagcggtg

SEQ ID NO: 387676 - DNA, 140 bp, Artificial Sequence
  Synthetic
caccgctgtcccaaaaggtctgagaggttgacagctggccattctctcgggacagcctgaagagttgaatttgtggtggtagagaagccctgctagccagccggtggtgaggctgtcattcatatcagcagccagggcct

SEQ ID NO: 387677 - DNA, 140 bp, Artificial Sequence
  Synthetic
aggccctggctgctgatatggcgagcttggagacaccgggcccggagcgtccgcgctaggcttctgtccagaggaggcagggctgccatatgtggcaagtacctcttcaactgggcagtagaccttttgggacagcggtg

SEQ ID NO: 387678 - DNA, 140 bp, Artificial Sequence
  Synthetic
caccgctgtcccaaaaggtctactgcccagttgaagaggtacttgccacatatggcagccctgcctcctctggacagaagcctagcgcggacgctccgggcccggtgtctccaagctcgccatatcagcagccagggcct

SEQ ID NO: 387679 - DNA, 140 bp, Artificial Sequence
  Synthetic
atacgccatgctgggtctccgctgtaccccagacctaccaggtggggtacttgcacgccccaactggcagcgggaagagtaccaaagtccctgtcgcatatgccgctcagggatacaaagcgtacttgggagtcggccat

SEQ ID NO: 387680 - DNA, 140 bp, Artificial Sequence
  Synthetic
atggccgactcccaagtacgctttgtatccctgagcggcatatgcgacagggactttggtactcttcccgctgccagttggggcgtgcaagtaccccacctggtaggtctggggtacagcggagacccagcatggcgtat

SEQ ID NO: 387681 - DNA, 140 bp, Artificial Sequence
  Synthetic
aggccctggctgctgatatgtccactgtgtcttctgccttggcggagctcgccacaaagaccttcggcagctccgaatcgtcggccgtcgacagcggcacggcgaccgcccctcctgaccgaccttttgggacagcggtg

SEQ ID NO: 387682 - DNA, 140 bp, Artificial Sequence
  Synthetic
caccgctgtcccaaaaggtcggtcaggaggggcggtcgccgtgccgctgtcgacggccgacgattcggagctgccgaaggtctttgtggcgagctccgccaaggcagaagacacagtggacatatcagcagccagggcct

SEQ ID NO: 387683 - DNA, 140 bp, Artificial Sequence
  Synthetic
atacgccatgctgggtctcctagccagcgccggggccgtacaggcagaggaaggctaggcatttataggtatgtatctactggtgaacgagcctcagggatgtttgacagtgtagtgctccgtacttgggagtcggccat

SEQ ID NO: 387684 - DNA, 140 bp, Artificial Sequence
  Synthetic
atggccgactcccaagtacggagcactacactgtcaaacatccctgaggctcgttcaccagtagatacatacctataaatgcctagccttcctctgcctgtacggccccggcgctggctaggagacccagcatggcgtat

SEQ ID NO: 387685 - DNA, 140 bp, Artificial Sequence
  Synthetic
aggccctggctgctgatatgccctgctgtggcttccatgatggcattcagtgctgccctcaccagtccgttgtcaaccagcaccactatccttctcaacattttgggaggctggctggcggaccttttgggacagcggtg

SEQ ID NO: 387686 - DNA, 140 bp, Artificial Sequence
  Synthetic
caccgctgtcccaaaaggtccgccagccagcctcccaaaatgttgagaaggatagtggtgctggttgacaacggactggtgagggcagcactgaatgccatcatggaagccacagcagggcatatcagcagccagggcct

SEQ ID NO: 387687 - DNA, 140 bp, Artificial Sequence
  Synthetic
aggccctggctgctgatatgttctgggcgaagcatatgtggaacttcatcagtgggatacaatatctggcgggcctgtcgacgttgcctggtaaccccgccattgcatcgttgatggcttgaccttttgggacagcggtg

SEQ ID NO: 387688 - DNA, 140 bp, Artificial Sequence
  Synthetic
caccgctgtcccaaaaggtcaagccatcaacgatgcaatggcggggttaccaggcaacgtcgacaggcccgccagatattgtatcccactgatgaagttccacatatgcttcgcccagaacatatcagcagccagggcct

SEQ ID NO: 387689 - DNA, 140 bp, Artificial Sequence
  Synthetic
atacgccatgctgggtctccttgtaccatcctaacagacttcaaaaattggctaaccgccaagttgttcccaaagatgcccggcctcccctttatctcttgccaaaagggatataagggtcgtacttgggagtcggccat

SEQ ID NO: 387690 - DNA, 140 bp, Artificial Sequence
  Synthetic
atggccgactcccaagtacgacccttatatcccttttggcaagagataaaggggaggccgggcatctttgggaacaacttggcggttagccaatttttgaagtctgttaggatggtacaaggagacccagcatggcgtat

SEQ ID NO: 387691 - DNA, 140 bp, Artificial Sequence
  Synthetic
atacgccatgctgggtctcccttgcatgaatgtttggcaggggacctttcccatcaattgttacacggagggccagtgtatgccgaaacccgcgccaaacttcaagaccgccgtctggagcgtacttgggagtcggccat

SEQ ID NO: 387692 - DNA, 140 bp, Artificial Sequence
  Synthetic
atggccgactcccaagtacgctccagacggcggtcttgaagtttggcgcgggtttcggcatacactggccctccgtgtaacaattgatgggaaaggtcccctgccaaacattcatgcaagggagacccagcatggcgtat

SEQ ID NO: 387693 - DNA, 140 bp, Artificial Sequence
  Synthetic
aggccctggctgctgatatgggccagtgtatgccgaaacccgcgccaaacttcaagaccgccgtctggagggtggcggcctcagagtacgcagaggtgacacggcacgggtcatactcctgaccttttgggacagcggtg

SEQ ID NO: 387694 - DNA, 140 bp, Artificial Sequence
  Synthetic
caccgctgtcccaaaaggtcaggagtatgacccgtgccgtgtcacctctgcgtactctgaggccgccaccctccagacggcggtcttgaagtttggcgcgggtttcggcatacactggcccatatcagcagccagggcct

SEQ ID NO: 387695 - DNA, 140 bp, Artificial Sequence
  Synthetic
atacgccatgctgggtctccgacgggggagttggcaggccaaaccacccgtggctttgcatccctcttttcatctggggcgtctcagaagatccagctcataaacaccaacggcagctggcgtacttgggagtcggccat

SEQ ID NO: 387696 - DNA, 140 bp, Artificial Sequence
  Synthetic
atggccgactcccaagtacgccagctgccgttggtgtttatgagctggatcttctgagacgccccagatgaaaagagggatgcaaagccacgggtggtttggcctgccaactcccccgtcggagacccagcatggcgtat

SEQ ID NO: 387697 - DNA, 140 bp, Artificial Sequence
  Synthetic
atacgccatgctgggtctcccatggcgaggcctatgacgtggatatggtggatgccaacctgttcatgaggggcgaggtgacccggatagagtccgagtccaaagtggtcattctggactcgtacttgggagtcggccat

SEQ ID NO: 387698 - DNA, 140 bp, Artificial Sequence
  Synthetic
atggccgactcccaagtacgagtccagaatgaccactttggactcggactctatccgggtcacctcgcccctcatgaacaggttggcatccaccatatccacgtcataggcctcgccatgggagacccagcatggcgtat

SEQ ID NO: 387699 - DNA, 140 bp, Artificial Sequence
  Synthetic
atacgccatgctgggtctccggcacggcctgactacaatccgccgcttgtggagtcgtggaagagaccggattaccaaccgcccactgttgcgggctgtgctctcccccctcccaagaagcgtacttgggagtcggccat

SEQ ID NO: 387700 - DNA, 140 bp, Artificial Sequence
  Synthetic
atggccgactcccaagtacgcttcttgggaggggggagagcacagcccgcaacagtgggcggttggtaatccggtctcttccacgactccacaagcggcggattgtagtcaggccgtgccggagacccagcatggcgtat

SEQ ID NO: 387701 - DNA, 140 bp, Artificial Sequence
  Synthetic
atacgccatgctgggtctcccccccccgagcggcgagtcaggtctttctacgggggcggacgccgccgactctggcggtcggacgccccccgatgagtcggccctttcggagacgggttccgtacttgggagtcggccat

SEQ ID NO: 387702 - DNA, 140 bp, Artificial Sequence
  Synthetic
atggccgactcccaagtacggaacccgtctccgaaagggccgactcatcggggggcgtccgaccgccagagtcggcggcgtccgcccccgtagaaagacctgactcgccgctcgggggggggagacccagcatggcgtat

SEQ ID NO: 387703 - DNA, 140 bp, Artificial Sequence
  Synthetic
aggccctggctgctgatatggcggttttcgtaggtctggtactcctgaccttgtcaccacactacaaggcattcctcgctaagctcatatggtggttacaatattttatcaccagagctggaccttttgggacagcggtg

SEQ ID NO: 387704 - DNA, 140 bp, Artificial Sequence
  Synthetic
caccgctgtcccaaaaggtccagctctggtgataaaatattgtaaccaccatatgagcttagcgaggaatgccttgtagtgtggtgacaaggtcaggagtaccagacctacgaaaaccgccatatcagcagccagggcct

SEQ ID NO: 387705 - DNA, 140 bp, Artificial Sequence
  Synthetic
aggccctggctgctgatatgcgtcaagttcccgggtggcggtcagatcgttggtggagtttacttgttgccgcgcaggggccctagattgggtgtgcgcgcgacgaggaagacttccgaggaccttttgggacagcggtg

SEQ ID NO: 387706 - DNA, 140 bp, Artificial Sequence
  Synthetic
caccgctgtcccaaaaggtcctcggaagtcttcctcgtcgcgcgcacacccaatctagggcccctgcgcggcaacaagtaaactccaccaacgatctgaccgccacccgggaacttgacgcatatcagcagccagggcct

SEQ ID NO: 387707 - DNA, 140 bp, Artificial Sequence
  Synthetic
atacgccatgctgggtctccagaccaaaattcccgcccgcgctccccatatgggcgagacctgattacaacccacctttactggagacttggaaagcccctgattacaatcccccgacggcgtacttgggagtcggccat

SEQ ID NO: 387708 - DNA, 140 bp, Artificial Sequence
  Synthetic
atggccgactcccaagtacgccgtcgggggattgtaatcaggggctttccaagtctccagtaaaggtgggttgtaatcaggtctcgcccatatggggagcgcgggcgggaattttggtctggagacccagcatggcgtat

SEQ ID NO: 387709 - DNA, 140 bp, Artificial Sequence
  Synthetic
atacgccatgctgggtctccctccacgtccccgggtgcgtcccgtgcgagaaagtgggcaacacatcacggtgctggataccggtctcaccaaacgtggctgtccggcagcccggcgccccgtacttgggagtcggccat

SEQ ID NO: 387710 - DNA, 140 bp, Artificial Sequence
  Synthetic
atggccgactcccaagtacggggcgccgggctgccggacagccacgtttggtgagaccggtatccagcaccgtgatgtgttgcccactttctcgcacgggacgcacccggggacgtggagggagacccagcatggcgtat

SEQ ID NO: 387711 - DNA, 140 bp, Artificial Sequence
  Synthetic
aggccctggctgctgatatgtcacgcagggcttgcgggcgcacatcgacatggttgtgatgtccgccacgctttgctccgctctccacgtgggggacctctgcggcggggtgatgctcgcgaccttttgggacagcggtg

SEQ ID NO: 387712 - DNA, 140 bp, Artificial Sequence
  Synthetic
caccgctgtcccaaaaggtcgcgagcatcaccccgccgcagaggtcccccacgtggagagcggagcaaagcgtggcggacatcacaaccatgtcgatgtgcgcccgcaagccctgcgtgacatatcagcagccagggcct

SEQ ID NO: 387713 - DNA, 140 bp, Artificial Sequence
  Synthetic
atacgccatgctgggtctccaactggggctgttgccgcgagcaacgctagaggcctcgccagtttgttcacttctggacctaagcagaacattcagctcattaacaccaatggcagttggcgtacttgggagtcggccat

SEQ ID NO: 387714 - DNA, 140 bp, Artificial Sequence
  Synthetic
atggccgactcccaagtacgccaactgccattggtgttaatgagctgaatgttctgcttaggtccagaagtgaacaaactggcgaggcctctagcgttgctcgcggcaacagccccagttggagacccagcatggcgtat

SEQ ID NO: 387715 - DNA, 140 bp, Artificial Sequence
  Synthetic
aggccctggctgctgatatgagcatcactgatggcattcacagcctctatcaccagcccgctcaccacccaacataccctcctgtttaacatcttggggggatgggtggccgcccaactcgaccttttgggacagcggtg

SEQ ID NO: 387716 - DNA, 140 bp, Artificial Sequence
  Synthetic
caccgctgtcccaaaaggtcgagttgggcggccacccatccccccaagatgttaaacaggagggtatgttgggtggtgagcgggctggtgatagaggctgtgaatgccatcagtgatgctcatatcagcagccagggcct

SEQ ID NO: 387717 - DNA, 140 bp, Artificial Sequence
  Synthetic
atacgccatgctgggtctccttgctggcactatccaccaaaccagtgtggcattgtcccggcgcagtcagtgtgtggcccagtgtactgtttcacccccagcccagtggtagtgggcacacgtacttgggagtcggccat

SEQ ID NO: 387718 - DNA, 140 bp, Artificial Sequence
  Synthetic
atggccgactcccaagtacgtgtgcccactaccactgggctgggggtgaaacagtacactgggccacacactgactgcgccgggacaatgccacactggtttggtggatagtgccagcaaggagacccagcatggcgtat

SEQ ID NO: 387719 - DNA, 140 bp, Artificial Sequence
  Synthetic
atacgccatgctgggtctccagcagaatgtccagctaatgaacaccaacggcagttggcacatcaatcgcactgccttgaactgcaatgcgagcctcgacactggctggctggcggggctcgtacttgggagtcggccat

SEQ ID NO: 387720 - DNA, 140 bp, Artificial Sequence
  Synthetic
atggccgactcccaagtacgagccccgccagccagccagtgtcgaggctcgcattgcagttcaaggcagtgcgattgatgtgccaactgccgttggtgttcattagctggacattctgctggagacccagcatggcgtat

SEQ ID NO: 387721 - DNA, 140 bp, Artificial Sequence
  Synthetic
atacgccatgctgggtctcctgcagagctcgctcgcaagtcgtttccaccgccctcggcacagtcacaggagagctcaggattgggatccacggctgctagttcccagagcccggagtcccgtacttgggagtcggccat

SEQ ID NO: 387722 - DNA, 140 bp, Artificial Sequence
  Synthetic
atggccgactcccaagtacgggactccgggctctgggaactagcagccgtggatcccaatcctgagctctcctgtgactgtgccgagggcggtggaaacgacttgcgagcgagctctgcaggagacccagcatggcgtat

SEQ ID NO: 387723 - DNA, 140 bp, Artificial Sequence
  Synthetic
aggccctggctgctgatatgcgctctgtcgactggccttcttcacctccaccaaaatatcgtggacgtacaatacatgtatggcctgtcacctgcccttacaaaatatgtcgttcgatgggaccttttgggacagcggtg

SEQ ID NO: 387724 - DNA, 140 bp, Artificial Sequence
  Synthetic
caccgctgtcccaaaaggtcccatcgaacgacatattttgtaagggcaggtgacaggccatacatgtattgtacgtccacgatattttggtggaggtgaagaaggccagtcgacagagcgcatatcagcagccagggcct

SEQ ID NO: 387725 - DNA, 140 bp, Artificial Sequence
  Synthetic
aggccctggctgctgatatgaatacatgtatggcctgtcacctgcccttacaaaatatgtcgttcgatgggagtgggtggtactcttattcctgctcctagcggacgccagggtctgcgcgaccttttgggacagcggtg

SEQ ID NO: 387726 - DNA, 140 bp, Artificial Sequence
  Synthetic
caccgctgtcccaaaaggtcgcgcagaccctggcgtccgctaggagcaggaataagagtaccacccactcccatcgaacgacatattttgtaagggcaggtgacaggccatacatgtattcatatcagcagccagggcct

SEQ ID NO: 387727 - DNA, 140 bp, Artificial Sequence
  Synthetic
aggccctggctgctgatatgcggactacgtccctccggtggtacacgggtgcccattgccacctaccaaggcccctccaataccacctccacggagaaagaggacagttgtcctgacagagaccttttgggacagcggtg

SEQ ID NO: 387728 - DNA, 140 bp, Artificial Sequence
  Synthetic
caccgctgtcccaaaaggtctctgtcaggacaactgtcctctttctccgtggaggtggtattggaggggccttggtaggtggcaatgggcacccgtgtaccaccggagggacgtagtccgcatatcagcagccagggcct

SEQ ID NO: 387729 - DNA, 140 bp, Artificial Sequence
  Synthetic
atacgccatgctgggtctccactccaatggcagttggcacatcaacaggacggctctgaactgtaatgacagcctcaacaccggctggctagcagggcttctctactaccacaaattcaacgtacttgggagtcggccat

SEQ ID NO: 387730 - DNA, 140 bp, Artificial Sequence
  Synthetic
atggccgactcccaagtacgttgaatttgtggtagtagagaagccctgctagccagccggtgttgaggctgtcattacagttcagagccgtcctgttgatgtgccaactgccattggagtggagacccagcatggcgtat

SEQ ID NO: 387731 - DNA, 140 bp, Artificial Sequence
  Synthetic
atacgccatgctgggtctcctattttgtcatctttttcgtggctgcttggtacatcaagggtcgggcagtccccctggctgcctattccctcactggcctatggcccttctgcctactgccgtacttgggagtcggccat

SEQ ID NO: 387732 - DNA, 140 bp, Artificial Sequence
  Synthetic
atggccgactcccaagtacggcagtaggcagaagggccataggccagtgagggaataggcagccagggggactgcccgacccttgatgtaccaagcagccacgaaaaagatgacaaaataggagacccagcatggcgtat

SEQ ID NO: 387733 - DNA, 140 bp, Artificial Sequence
  Synthetic
atacgccatgctgggtctccttgcccagggctggggtcctatcgggtacgctaatgggagcggccccgaccatcggccctactgttggcactaccctccaaaaccttgtggtattgtgcccgtacttgggagtcggccat

SEQ ID NO: 387734 - DNA, 140 bp, Artificial Sequence
  Synthetic
atggccgactcccaagtacgggcacaataccacaaggttttggagggtagtgccaacagtagggccgatggtcggggccgctcccattagcgtacccgataggaccccagccctgggcaaggagacccagcatggcgtat

SEQ ID NO: 387735 - DNA, 140 bp, Artificial Sequence
  Synthetic
atacgccatgctgggtctccggggtataaaaccctcctcagccggagtctgtggtggctgtgctatctcctgaccctgggggaggccatggttcaggagtgggcaccacccatgcaggcgcgtacttgggagtcggccat

SEQ ID NO: 387736 - DNA, 140 bp, Artificial Sequence
  Synthetic
atggccgactcccaagtacgcgcctgcatgggtggtgcccactcctgaaccatggcctcccccagggtcaggagatagcacagccaccacagactccggctgaggagggttttataccccggagacccagcatggcgtat

SEQ ID NO: 387737 - DNA, 140 bp, Artificial Sequence
  Synthetic
atacgccatgctgggtctccacctcctgagagatgctttgacgagcgtgccgtacttcgtcagagctcacgctctgctgagaatgtgcactatggtgaagcacctcgcggggggtaggtacgtacttgggagtcggccat

SEQ ID NO: 387738 - DNA, 140 bp, Artificial Sequence
  Synthetic
atggccgactcccaagtacgtacctaccccccgcgaggtgcttcaccatagtgcacattctcagcagagcgtgagctctgacgaagtacggcacgctcgtcaaagcatctctcaggaggtggagacccagcatggcgtat

SEQ ID NO: 387739 - DNA, 140 bp, Artificial Sequence
  Synthetic
aggccctggctgctgatatggcctcctagggtgcataatcaccagcctgactggccgggacaaaaaccaagtggagggtgaggtccagattgtgtcaactgctgcccaaactttcctggcgaccttttgggacagcggtg

SEQ ID NO: 387740 - DNA, 140 bp, Artificial Sequence
  Synthetic
caccgctgtcccaaaaggtcgccaggaaagtttgggcagcagttgacacaatctggacctcaccctccacttggtttttgtcccggccagtcaggctggtgattatgcaccctaggaggccatatcagcagccagggcct

SEQ ID NO: 387741 - DNA, 140 bp, Artificial Sequence
  Synthetic
atacgccatgctgggtctcccagtccttcctcggaacatccatttcgggggtcttgtggactgtttaccacggaactggcaataagaccctagccggctcacggggcccggtcacacagacgtacttgggagtcggccat

SEQ ID NO: 387742 - DNA, 140 bp, Artificial Sequence
  Synthetic
atggccgactcccaagtacgtctgtgtgaccgggccccgtgagccggctagggtcttattgccagttccgtggtaaacagtccacaagacccccgaaatggatgttccgaggaaggactgggagacccagcatggcgtat

SEQ ID NO: 387743 - DNA, 140 bp, Artificial Sequence
  Synthetic
atacgccatgctgggtctccaccaaatctttggagccgtgcacgtgtggagcggtcgacctatacctggtcacgcggaacgctgatgtcatcccggctcgaagacgcggggacaagcgggcgtacttgggagtcggccat

SEQ ID NO: 387744 - DNA, 140 bp, Artificial Sequence
  Synthetic
atggccgactcccaagtacgcccgcttgtccccgcgtcttcgagccgggatgacatcagcgttccgcgtgaccaggtataggtcgaccgctccacacgtgcacggctccaaagatttggtggagacccagcatggcgtat

SEQ ID NO: 387745 - DNA, 140 bp, Artificial Sequence
  Synthetic
aggccctggctgctgatatgtgtgtgctctcggggcgtggctaagtccatagatttcatccccgttgaggcgctcgacatcgtcacgcggtctcccacctttagcgacaacagcacaccagaccttttgggacagcggtg

SEQ ID NO: 387746 - DNA, 140 bp, Artificial Sequence
  Synthetic
caccgctgtcccaaaaggtctggtgtgctgttgtcgctaaaggtgggagaccgcgtgacgatgtcgagcgcctcaacggggatgaaatctatggacttagccacgccccgagagcacacacatatcagcagccagggcct

SEQ ID NO: 387747 - DNA, 140 bp, Artificial Sequence
  Synthetic
aggccctggctgctgatatgtgcggctcctcggacctttacctggtcacgaggcacgccgatgtcattcccgtgcgccggcggggtgatagcaggggcagcctgctttcgccccggcccagaccttttgggacagcggtg

SEQ ID NO: 387748 - DNA, 140 bp, Artificial Sequence
  Synthetic
caccgctgtcccaaaaggtctgggccggggcgaaagcaggctgcccctgctatcaccccgccggcgcacgggaatgacatcggcgtgcctcgtgaccaggtaaaggtccgaggagccgcacatatcagcagccagggcct

SEQ ID NO: 387749 - DNA, 140 bp, Artificial Sequence
  Synthetic
atacgccatgctgggtctccactccacaacatcccgcagcgctgcgattcgccagaagaaggtaacctttgataggatccaacttctggatcagcactaccatgacaccctcaaggagatcgtacttgggagtcggccat

SEQ ID NO: 387750 - DNA, 140 bp, Artificial Sequence
  Synthetic
atggccgactcccaagtacgatctccttgagggtgtcatggtagtgctgatccagaagttggatcctatcaaaggttaccttcttctggcgaatcgcagcgctgcgggatgttgtggagtggagacccagcatggcgtat

SEQ ID NO: 387751 - DNA, 140 bp, Artificial Sequence
  Synthetic
aggccctggctgctgatatgaagctgaccttgaggtcatgaccagcacgtgggtcctggctgggggagtcttggcagccgtcgccgcgtattggttggcgaccgggtgtgtttccatcatgaccttttgggacagcggtg

SEQ ID NO: 387752 - DNA, 140 bp, Artificial Sequence
  Synthetic
caccgctgtcccaaaaggtcatgatggaaacacacccggtcgccaaccaatacgcggcgacggctgccaagactcccccagccaggacccacgtgctggtcatgacctcaaggtcagcttcatatcagcagccagggcct

SEQ ID NO: 387753 - DNA, 140 bp, Artificial Sequence
  Synthetic
aggccctggctgctgatatgcgttgtcaactagcaccactatccttctcaacatcttgggaggctggctggcgtcccaaattgcgccgcccgcgggggccaccggcttcgtcgtcagtgggaccttttgggacagcggtg

SEQ ID NO: 387754 - DNA, 140 bp, Artificial Sequence
  Synthetic
caccgctgtcccaaaaggtcccactgacgacgaagccggtggcccccgcgggcggcgcaatttgggacgccagccagcctcccaagatgttgagaaggatagtggtgctagttgacaacgcatatcagcagccagggcct

SEQ ID NO: 387755 - DNA, 140 bp, Artificial Sequence
  Synthetic
aggccctggctgctgatatgccatcggcagtgttggactggggaaggtcctcgtggacatccttgcagggtatggcgcgggcgtggcgggagctcttgtagcattcaagatcatgagcgggaccttttgggacagcggtg

SEQ ID NO: 387756 - DNA, 140 bp, Artificial Sequence
  Synthetic
caccgctgtcccaaaaggtcccgctcatgatcttgaatgctacaagagctcccgccacgcccgcgccataccctgcaaggatgtccacgaggaccttccccagtccaacactgccgatggcatatcagcagccagggcct

SEQ ID NO: 387757 - DNA, 140 bp, Artificial Sequence
  Synthetic
atacgccatgctgggtctcctattgattgtgctgctacttttttccggcgttgacggggaaactgtcgtgtcggggggggtagctgcccagagcgccagcagcctcacggccctctttaccgtacttgggagtcggccat

SEQ ID NO: 387758 - DNA, 140 bp, Artificial Sequence
  Synthetic
atggccgactcccaagtacggtaaagagggccgtgaggctgctggcgctctgggcagctaccccccccgacacgacagtttccccgtcaacgccggaaaaaagtagcagcacaatcaataggagacccagcatggcgtat

SEQ ID NO: 387759 - DNA, 140 bp, Artificial Sequence
  Synthetic
atacgccatgctgggtctccccatcacttacgctgagcctcatgacccggaccagaggccctattgctggcactacgcgcctcgaccgtgcggtattgtacccgcgtcggaagtgtgtggcgtacttgggagtcggccat

SEQ ID NO: 387760 - DNA, 140 bp, Artificial Sequence
  Synthetic
atggccgactcccaagtacgccacacacttccgacgcgggtacaataccgcacggtcgaggcgcgtagtgccagcaatagggcctctggtccgggtcatgaggctcagcgtaagtgatggggagacccagcatggcgtat

SEQ ID NO: 387761 - DNA, 140 bp, Artificial Sequence
  Synthetic
aggccctggctgctgatatgctactgcccgccatcctctcgcctggagcccttgtggtcggtgtggtttgcgcagcaatactacgccggcacgttggcccgggcgagggagcagtgcaatgaccttttgggacagcggtg

SEQ ID NO: 387762 - DNA, 140 bp, Artificial Sequence
  Synthetic
caccgctgtcccaaaaggtcattgcactgctccctcgcccgggccaacgtgccggcgtagtattgctgcgcaaaccacaccgaccacaagggctccaggcgagaggatggcgggcagtagcatatcagcagccagggcct

SEQ ID NO: 387763 - DNA, 140 bp, Artificial Sequence
  Synthetic
atacgccatgctgggtctccccatcggagtatatgctccccaagaccaagttcccgccagccctaccggcctgggcacggcctgattacaacccgccacttgtggaatcatggaagaggccgtacttgggagtcggccat

SEQ ID NO: 387764 - DNA, 140 bp, Artificial Sequence
  Synthetic
atggccgactcccaagtacggcctcttccatgattccacaagtggcgggttgtaatcaggccgtgcccaggccggtagggctggcgggaacttggtcttggggagcatatactccgatggggagacccagcatggcgtat

SEQ ID NO: 387765 - DNA, 140 bp, Artificial Sequence
  Synthetic
aggccctggctgctgatatgcggttttcacaggtctgatactcttgaccttgtcaccacactataaagtgctcctcgctaggctcatatggtggttgcaatattttatcaccagggccgagaccttttgggacagcggtg

SEQ ID NO: 387766 - DNA, 140 bp, Artificial Sequence
  Synthetic
caccgctgtcccaaaaggtctcggccctggtgataaaatattgcaaccaccatatgagcctagcgaggagcactttatagtgtggtgacaaggtcaagagtatcagacctgtgaaaaccgcatatcagcagccagggcct

SEQ ID NO: 387767 - DNA, 140 bp, Artificial Sequence
  Synthetic
aggccctggctgctgatatgatcttccttctggcacttctttcgtgcctgaccgttcccgcctcggctgtgcattatcacaacacctcgggcatctatcacatcactaatgactgccccagaccttttgggacagcggtg

SEQ ID NO: 387768 - DNA, 140 bp, Artificial Sequence
  Synthetic
caccgctgtcccaaaaggtctggggcagtcattagtgatgtgatagatgcccgaggtgttgtgataatgcacagccgaggcgggaacggtcaggcacgaaagaagtgccagaaggaagatcatatcagcagccagggcct

SEQ ID NO: 387769 - DNA, 140 bp, Artificial Sequence
  Synthetic
atacgccatgctgggtctccgcatcttggcgggcctagcctattattctatgcagggcaactgggccaaggtcgctattgtcatgattatgttttcaggggtcgatgctgaaacatatgtcgtacttgggagtcggccat

SEQ ID NO: 387770 - DNA, 140 bp, Artificial Sequence
  Synthetic
atggccgactcccaagtacgacatatgtttcagcatcgacccctgaaaacataatcatgacaatagcgaccttggcccagttgccctgcatagaataataggctaggcccgccaagatgcggagacccagcatggcgtat

SEQ ID NO: 387771 - DNA, 140 bp, Artificial Sequence
  Synthetic
aggccctggctgctgatatgccccaggcccgtctcctacttaaagggctcttcgggtggtccactgctctgcccctcggggcacgctgtaggcatcttccgggctgctgtgtgcacccgggaccttttgggacagcggtg

SEQ ID NO: 387772 - DNA, 140 bp, Artificial Sequence
  Synthetic
caccgctgtcccaaaaggtcccgggtgcacacagcagcccggaagatgcctacagcgtgccccgaggggcagagcagtggaccacccgaagagccctttaagtaggagacgggcctggggcatatcagcagccagggcct

SEQ ID NO: 387773 - DNA, 140 bp, Artificial Sequence
  Synthetic
aggccctggctgctgatatgcacatcaacagtactgccctgaactgcaatgagtccataaacaccgggttcatagctgggttgttttattaccataagttcaactctactggatgtcctcgaccttttgggacagcggtg

SEQ ID NO: 387774 - DNA, 140 bp, Artificial Sequence
  Synthetic
caccgctgtcccaaaaggtcgaggacatccagtagagttgaacttatggtaataaaacaacccagctatgaacccggtgtttatggactcattgcagttcagggcagtactgttgatgtgcatatcagcagccagggcct

SEQ ID NO: 387775 - DNA, 140 bp, Artificial Sequence
  Synthetic
atacgccatgctgggtctccctggcactacgcacctagaccttgtagtgttgtcccggcatcaagtgtctgcggccctgtgtactgcttcacaccatcgccagtggtcgtaggcactactcgtacttgggagtcggccat

SEQ ID NO: 387776 - DNA, 140 bp, Artificial Sequence
  Synthetic
atggccgactcccaagtacgagtagtgcctacgaccactggcgatggtgtgaagcagtacacagggccgcagacacttgatgccgggacaacactacaaggtctaggtgcgtagtgccagggagacccagcatggcgtat

SEQ ID NO: 387777 - DNA, 140 bp, Artificial Sequence
  Synthetic
aggccctggctgctgatatggccagggatcagcttgaacaggcccttgattgcgagatctacggagcctgctactccatagaaccactggatctacctccaatcattcaaagactccatggaccttttgggacagcggtg

SEQ ID NO: 387778 - DNA, 140 bp, Artificial Sequence
  Synthetic
caccgctgtcccaaaaggtccatggagtctttgaatgattggaggtagatccagtggttctatggagtagcaggctccgtagatctcgcaatcaagggcctgttcaagctgatccctggccatatcagcagccagggcct

SEQ ID NO: 387779 - DNA, 140 bp, Artificial Sequence
  Synthetic
aggccctggctgctgatatggtgcgttgccctttggctgatgctgatggtatcacaagcagaagcagccttggagaaccttgtcacgctgaacgccgtcgctgctgctgggacacatggtgaccttttgggacagcggtg

SEQ ID NO: 387780 - DNA, 140 bp, Artificial Sequence
  Synthetic
caccgctgtcccaaaaggtcaccatgtgtcccagcagcagcgacggcgttcagcgtgacaaggttctccaaggctgcttctgcttgtgataccatcagcatcagccaaagggcaacgcaccatatcagcagccagggcct

SEQ ID NO: 387781 - DNA, 140 bp, Artificial Sequence
  Synthetic
aggccctggctgctgatatgacagcgtgtctcgtgcccggccccgctggttctggttttgcctactcctgcttgctgcaggggtaggcatctacctccttcccaaccgatgaaggttggggaccttttgggacagcggtg

SEQ ID NO: 387782 - DNA, 140 bp, Artificial Sequence
  Synthetic
caccgctgtcccaaaaggtccccaaccttcatcggttgggaaggaggtagatgcctacccctgcagcaagcaggagtaggcaaaaccagaaccagcggggccgggcacgagacacgctgtcatatcagcagccagggcct

SEQ ID NO: 387783 - DNA, 140 bp, Artificial Sequence
  Synthetic
aggccctggctgctgatatgagcgctactctcggcgctggggtcttggccctcttcggcttctttaccttatcaccctggtacaagcattggatcggccgcctcatgtggtggaaccagtgaccttttgggacagcggtg

SEQ ID NO: 387784 - DNA, 140 bp, Artificial Sequence
  Synthetic
caccgctgtcccaaaaggtcactggttccaccacatgaggcggccgatccaatgcttgtaccagggtgataaggtaaagaagccgaagagggccaagaccccagcgccgagagtagcgctcatatcagcagccagggcct

SEQ ID NO: 387785 - DNA, 140 bp, Artificial Sequence
  Synthetic
atacgccatgctgggtctccggttgctccttttctatcttcttgctggccttgttgtcctgcatcaccaccccggtctctgctgcccaagtgaagaacactagtgacatctacatggtgacgtacttgggagtcggccat

SEQ ID NO: 387786 - DNA, 140 bp, Artificial Sequence
  Synthetic
atggccgactcccaagtacgtcaccatgtagatgtcactagtgttcttcacttgggcagcagagaccggggtggtgatgcaggacaacaaggccagcaagaagatagaaaaggagcaaccggagacccagcatggcgtat

SEQ ID NO: 387787 - DNA, 140 bp, Artificial Sequence
  Synthetic
atacgccatgctgggtctcctcacgcagggcttgcggacgcacatcgacatggtcgtgatgtccgccacgctctgctccgctctctacgtgggggatctctgcggcggggtgatgctcgccgtacttgggagtcggccat

SEQ ID NO: 387788 - DNA, 140 bp, Artificial Sequence
  Synthetic
atggccgactcccaagtacggcgagcatcaccccgccgcagagatcccccacgtagagagcggagcagagcgtggcggacatcacgaccatgtcgatgtgcgtccgcaagccctgcgtgaggagacccagcatggcgtat

SEQ ID NO: 387789 - DNA, 140 bp, Artificial Sequence
  Synthetic
aggccctggctgctgatatggtggggaactgggcgaaggtcctggtagtgctgctgctattcgccggcgttgacgcggatacccatgtcaccggggcagttgccggtggcaccgtagcgagaccttttgggacagcggtg

SEQ ID NO: 387790 - DNA, 140 bp, Artificial Sequence
  Synthetic
caccgctgtcccaaaaggtctcgctacggtgccaccggcaactgccccggtgacatgggtatccgcgtcaacgccggcgaatagcagcagcactaccaggaccttcgcccagttccccaccatatcagcagccagggcct

SEQ ID NO: 387791 - DNA, 140 bp, Artificial Sequence
  Synthetic
atacgccatgctgggtctccctggtcctaagcagaacattcagctcattaacaccaatggcagttggcacatcaaccgcactgccttgaactgcaatgactccttgaacaccggctttatcgtacttgggagtcggccat

SEQ ID NO: 387792 - DNA, 140 bp, Artificial Sequence
  Synthetic
atggccgactcccaagtacgataaagccggtgttcaaggagtcattgcagttcaaggcagtgcggttgatgtgccaactgccattggtgttaatgagctgaatgttctgcttaggaccagggagacccagcatggcgtat

SEQ ID NO: 387793 - DNA, 140 bp, Artificial Sequence
  Synthetic
atacgccatgctgggtctcccagcctcaacaccggctttatagcaggcctcttatacgccaatagattcaactcctcaggctgtcccgagagaatggccagctgtcagcctctttccgctcgtacttgggagtcggccat

SEQ ID NO: 387794 - DNA, 140 bp, Artificial Sequence
  Synthetic
atggccgactcccaagtacgagcggaaagaggctgacagctggccattctctcgggacagcctgaggagttgaatctattggcgtataagaggcctgctataaagccggtgttgaggctgggagacccagcatggcgtat

SEQ ID NO: 387795 - DNA, 140 bp, Artificial Sequence
  Synthetic
atacgccatgctgggtctcctttgcccagggctggggctctatcgggtacgccagtggaagcaacagcgaacatcgcccctactgctggcactactcgccaaaaccttgcggtattgtgccgtacttgggagtcggccat

SEQ ID NO: 387796 - DNA, 140 bp, Artificial Sequence
  Synthetic
atggccgactcccaagtacggcacaataccgcaaggttttggcgagtagtgccagcagtaggggcgatgttcgctgttgcttccactggcgtacccgatagagccccagccctgggcaaaggagacccagcatggcgtat

SEQ ID NO: 387797 - DNA, 140 bp, Artificial Sequence
  Synthetic
atacgccatgctgggtctccgcggcccagtgtactgtttcacccccagcccagtagtggtgggcacgaccgatagacttggagtgcctacttacacgtggggagagaatgagacagatgtcgtacttgggagtcggccat

SEQ ID NO: 387798 - DNA, 140 bp, Artificial Sequence
  Synthetic
atggccgactcccaagtacgacatctgtctcattctctccccacgtgtaagtaggcactccaagtctatcggtcgtgcccaccactactgggctgggggtgaaacagtacactgggccgcggagacccagcatggcgtat

SEQ ID NO: 387799 - DNA, 140 bp, Artificial Sequence
  Synthetic
aggccctggctgctgatatgcttcctattgaacagcacccgaccaccggtggggtcatggtttggctgcacgtggatgaactccactggtttcaccaagacttgtggcgcaccaccttgcgaccttttgggacagcggtg

SEQ ID NO: 387800 - DNA, 140 bp, Artificial Sequence
  Synthetic
caccgctgtcccaaaaggtcgcaaggtggtgcgccacaagtcttggtgaaaccagtggagttcatccacgtgcagccaaaccatgaccccaccggtggtcgggtgctgttcaataggaagcatatcagcagccagggcct

SEQ ID NO: 387801 - DNA, 140 bp, Artificial Sequence
  Synthetic
aggccctggctgctgatatggttcaaggccttctccgggtctgcgcgttggcgcggaagatggccgggggccattacgtgcaaatggctgtcatcaagctaggggcgcttactggcacctgaccttttgggacagcggtg

SEQ ID NO: 387802 - DNA, 140 bp, Artificial Sequence
  Synthetic
caccgctgtcccaaaaggtcaggtgccagtaagcgcccctagcttgatgacagccatttgcacgtaatggcccccggccatcttccgcgccaacgcgcagacccggagaaggccttgaaccatatcagcagccagggcct

SEQ ID NO: 387803 - DNA, 140 bp, Artificial Sequence
  Synthetic
atacgccatgctgggtctccccggtgctttgccctaggggccacgctgtcgggatcttccgggcagctgtgtgctctcggggcgtggctaagtccatagatttcatccccgttgagacaccgtacttgggagtcggccat

SEQ ID NO: 387804 - DNA, 140 bp, Artificial Sequence
  Synthetic
atggccgactcccaagtacggtgtctcaacggggatgaaatctatggacttagccacgccccgagagcacacagctgcccggaagatcccgacagcgtggcccctagggcaaagcaccggggagacccagcatggcgtat

SEQ ID NO: 387805 - DNA, 140 bp, Artificial Sequence
  Synthetic
aggccctggctgctgatatgcggtgtgcacccgtggagtggctaaggcggtggactttatccctgtggagagcctagagacaaccatgaggtccccggtgttcacggacaactcctctccgaccttttgggacagcggtg

SEQ ID NO: 387806 - DNA, 140 bp, Artificial Sequence
  Synthetic
caccgctgtcccaaaaggtcggagaggagttgtccgtgaacaccggggacctcatggttgtctctaggctctccacagggataaagtccaccgccttagccactccacgggtgcacaccgcatatcagcagccagggcct

SEQ ID NO: 387807 - DNA, 140 bp, Artificial Sequence
  Synthetic
atacgccatgctgggtctcctactagtgcttaacccctcggtggctgccaccttggggtttggggcgtacttgtccaaggcacatggcatcaatcccaacattaggactggagtcagaaccgtacttgggagtcggccat

SEQ ID NO: 387808 - DNA, 140 bp, Artificial Sequence
  Synthetic
atggccgactcccaagtacggttctgactccagtcctaatgttgggattgatgccatgtgccttggacaagtacgccccaaaccccaaggtggcagccaccgaggggttaagcactagtaggagacccagcatggcgtat

SEQ ID NO: 387809 - DNA, 140 bp, Artificial Sequence
  Synthetic
aggccctggctgctgatatgtgtgacgaccggagaggccatcacgtactccacgtatggcaaattcctcgctgatgggggctgctcaggcggcgcctatgacatcatcatatgcgatgaagaccttttgggacagcggtg

SEQ ID NO: 387810 - DNA, 140 bp, Artificial Sequence
  Synthetic
caccgctgtcccaaaaggtcttcatcgcatatgatgatgtcataggcgccgcctgagcagcccccatcagcgaggaatttgccatacgtggagtacgtgatggcctctccggtcgtcacacatatcagcagccagggcct

SEQ ID NO: 387811 - DNA, 140 bp, Artificial Sequence
  Synthetic
aggccctggctgctgatatgggtcaccctcacgcaccctgtgacaaaatacattgccacatgcatgcaagctgaccttgaggtcatgaccagcacgtggatccttgccgggggagtcctggaccttttgggacagcggtg

SEQ ID NO: 387812 - DNA, 140 bp, Artificial Sequence
  Synthetic
caccgctgtcccaaaaggtccaggactcccccggcaaggatccacgtgctggtcatgacctcaaggtcagcttgcatgcatgtggcaatgtattttgtcacagggtgcgtgagggtgacccatatcagcagccagggcct

SEQ ID NO: 387813 - DNA, 140 bp, Artificial Sequence
  Synthetic
aggccctggctgctgatatgttcattagcggcattcaatacctcgcaggactgtcaacactgccaggaaatcccgctgtggcctccatgatggcattcagtgccgccctcaccagcccgtgaccttttgggacagcggtg

SEQ ID NO: 387814 - DNA, 140 bp, Artificial Sequence
  Synthetic
caccgctgtcccaaaaggtcacgggctggtgagggcggcactgaatgccatcatggaggccacagcgggatttcctggcagtgttgacagtcctgcgaggtattgaatgccgctaatgaacatatcagcagccagggcct

SEQ ID NO: 387815 - DNA, 140 bp, Artificial Sequence
  Synthetic
atacgccatgctgggtctcccacatcaataggactgccttaaactgcaatgactccctccatactgggttccttgccgcactgttctacacacacaagctcaactcgtccggatgcccagcgtacttgggagtcggccat

SEQ ID NO: 387816 - DNA, 140 bp, Artificial Sequence
  Synthetic
atggccgactcccaagtacgctgggcatccggacgagttgagcttgtgtgtgtagaacagtgcggcaaggaacccagtatggagggagtcattgcagtttaaggcagtcctattgatgtgggagacccagcatggcgtat

SEQ ID NO: 387817 - DNA, 140 bp, Artificial Sequence
  Synthetic
aggccctggctgctgatatgcgtgacggagtcggatgcgtcgcagcgtgtgacccaactgcttggctcccttactataactagcctactcagaagactccacaattggattactgaggacgaccttttgggacagcggtg

SEQ ID NO: 387818 - DNA, 140 bp, Artificial Sequence
  Synthetic
caccgctgtcccaaaaggtcgtcctcagtaatccaattgtggagtcttctgagtaggctagttatagtaagggagccaagcagttgggtcacacgctgcgacgcatccgactccgtcacgcatatcagcagccagggcct

SEQ ID NO: 387819 - DNA, 140 bp, Artificial Sequence
  Synthetic
atacgccatgctgggtctcctgccccatcccatgcgccggctcgtggctccgcgatgtgtgggactgggtttgcagcatcctaacagacttcaaaaactggctgacctccaagttgttcccgtacttgggagtcggccat

SEQ ID NO: 387820 - DNA, 140 bp, Artificial Sequence
  Synthetic
atggccgactcccaagtacgggaacaacttggaggtcagccagtttttgaagtctgttaggatgctgcaaacccagtcccacacatcgcggagccacgagccggcgcatgggatggggcaggagacccagcatggcgtat

SEQ ID NO: 387821 - DNA, 140 bp, Artificial Sequence
  Synthetic
atacgccatgctgggtctcccatctctggcaatgtccgcctgggctctatgagaatcacagggcctaaaacctgcatgaacacttggcaggggaccttccctatcaattgttacacggagcgtacttgggagtcggccat

SEQ ID NO: 387822 - DNA, 140 bp, Artificial Sequence
  Synthetic
atggccgactcccaagtacgctccgtgtaacaattgatagggaaggtcccctgccaagtgttcatgcaggttttaggccctgtgattctcatagagcccaggcggacattgccagagatgggagacccagcatggcgtat

SEQ ID NO: 387823 - DNA, 140 bp, Artificial Sequence
  Synthetic
aggccctggctgctgatatgggaagccggccatcattcccgacagggaagttctctaccaggagttcgatgagatggaagagtgcgcctcacacctcccttacatcgagcagggaatgcagaccttttgggacagcggtg

SEQ ID NO: 387824 - DNA, 140 bp, Artificial Sequence
  Synthetic
caccgctgtcccaaaaggtctgcattccctgctcgatgtaagggaggtgtgaggcgcactcttccatctcatcgaactcctggtagagaacttccctgtcgggaatgatggccggcttcccatatcagcagccagggcct

SEQ ID NO: 387825 - DNA, 140 bp, Artificial Sequence
  Synthetic
atacgccatgctgggtctcctcccacaccaaagccgttcttccgggatgaggtctcgttttgcgttgggctcaactcgtttgtcgtcgggtctcagcttccttgtgaccctgaacccgaccgtacttgggagtcggccat

SEQ ID NO: 387826 - DNA, 140 bp, Artificial Sequence
  Synthetic
atggccgactcccaagtacggtcgggttcagggtcacaaggaagctgagacccgacgacaaacgagttgagcccaacgcaaaacgagacctcatcccggaagaacggctttggtgtgggaggagacccagcatggcgtat

SEQ ID NO: 387827 - DNA, 140 bp, Artificial Sequence
  Synthetic
aggccctggctgctgatatgttcttctgtgctgcctggtacatcaagggcaggctggtccctggagcggcttatgccctttatggtgtgtggccactgctcctgctcctgctggcgctgcgaccttttgggacagcggtg

SEQ ID NO: 387828 - DNA, 140 bp, Artificial Sequence
  Synthetic
caccgctgtcccaaaaggtcgcagcgccagcaggagcaggagcagtggccacacaccataaagggcataagccgctccagggaccagcctgcccttgatgtaccaggcagcacagaagaacatatcagcagccagggcct

SEQ ID NO: 387829 - DNA, 140 bp, Artificial Sequence
  Synthetic
aggccctggctgctgatatggggaccgcgcagaactgtcgcccttgctcttgtccaccacccagtggcaggtccttccctgttcatttacacccctcccagccctctccactggcctgatgaccttttgggacagcggtg

SEQ ID NO: 387830 - DNA, 140 bp, Artificial Sequence
  Synthetic
caccgctgtcccaaaaggtcatcaggccagtggagagggctgggaggggtgtaaatgaacagggaaggacctgccactgggtggtggacaagagcaagggcgacagttctgcgcggtccccatatcagcagccagggcct

SEQ ID NO: 387831 - DNA, 140 bp, Artificial Sequence
  Synthetic
aggccctggctgctgatatgggcacggcctgattacaacccaccgcttgtggagtcgtggaagaggccagattaccaaccgcccactgttgcgggctgtgctctccccccccccaagaaggaccttttgggacagcggtg

SEQ ID NO: 387832 - DNA, 140 bp, Artificial Sequence
  Synthetic
caccgctgtcccaaaaggtccttcttggggggggggagagcacagcccgcaacagtgggcggttggtaatctggcctcttccacgactccacaagcggtgggttgtaatcaggccgtgcccatatcagcagccagggcct

SEQ ID NO: 387833 - DNA, 140 bp, Artificial Sequence
  Synthetic
aggccctggctgctgatatgcgcttgcgagtgccccgggaggtctcgtagaccgtgcaccatgagcacgaatcctaaacctcaaagaaaaaccaaacgtaacaccaaccgccgcccaatggaccttttgggacagcggtg

SEQ ID NO: 387834 - DNA, 140 bp, Artificial Sequence
  Synthetic
caccgctgtcccaaaaggtccattgggcggcggttggtgttacgtttggtttttctttgaggtttaggattcgtgctcatggtgcacggtctacgagacctcccggggcactcgcaagcgcatatcagcagccagggcct

SEQ ID NO: 387835 - DNA, 140 bp, Artificial Sequence
  Synthetic
atacgccatgctgggtctccgagggcccatgttcaacagcaagggccagtcctgcgggtacaggcgttgccgcgccagcggggtgctcaccactagcatggggaacaccatcacatgctacgtacttgggagtcggccat

SEQ ID NO: 387836 - DNA, 140 bp, Artificial Sequence
  Synthetic
atggccgactcccaagtacgtagcatgtgatggtgttccccatgctagtggtgagcaccccgctggcgcggcaacgcctgtacccgcaggactggcccttgctgttgaacatgggccctcggagacccagcatggcgtat

SEQ ID NO: 387837 - DNA, 140 bp, Artificial Sequence
  Synthetic
aggccctggctgctgatatgctgctgggtggcccttactcctaccgtcgcagcgccatacatcggcgcaccgcttgagtccttacggagtcatgtggatttgatggtgggggccgccactgaccttttgggacagcggtg

SEQ ID NO: 387838 - DNA, 140 bp, Artificial Sequence
  Synthetic
caccgctgtcccaaaaggtcagtggcggcccccaccatcaaatccacatgactccgtaaggactcaagcggtgcgccgatgtatggcgctgcgacggtaggagtaagggccacccagcagcatatcagcagccagggcct

SEQ ID NO: 387839 - DNA, 140 bp, Artificial Sequence
  Synthetic
atacgccatgctgggtctcccagcgctgcttcggctttcgtaggcgctggcatcgctggtgcggccgttggcagcataggccttgggaaggtgcttgtggacatcctggcaggttatggacgtacttgggagtcggccat

SEQ ID NO: 387840 - DNA, 140 bp, Artificial Sequence
  Synthetic
atggccgactcccaagtacgtccataacctgccaggatgtccacaagcaccttcccaaggcctatgctgccaacggccgcaccagcgatgccagcgcctacgaaagccgaagcagcgctgggagacccagcatggcgtat

SEQ ID NO: 387841 - DNA, 140 bp, Artificial Sequence
  Synthetic
aggccctggctgctgatatgcatataaataggactgcccttaactgcaatgacagcttaaacactgggttcttggctagcttgttctacacccacaagtttaacagctcagggtgttccggaccttttgggacagcggtg

SEQ ID NO: 387842 - DNA, 140 bp, Artificial Sequence
  Synthetic
caccgctgtcccaaaaggtccggaacaccctgagctgttaaacttgtgggtgtagaacaagctagccaagaacccagtgtttaagctgtcattgcagttaagggcagtcctatttatatgcatatcagcagccagggcct

SEQ ID NO: 387843 - DNA, 140 bp, Artificial Sequence
  Synthetic
aggccctggctgctgatatgagttcgatgagatggaagagtgcgcctcacacctcccttacatcgaacagggaatgcagctcgccgagcagttcaagcagaaggcgctcgggttgctgcagaccttttgggacagcggtg

SEQ ID NO: 387844 - DNA, 140 bp, Artificial Sequence
  Synthetic
caccgctgtcccaaaaggtctgcagcaacccgagcgccttctgcttgaactgctcggcgagctgcattccctgttcgatgtaagggaggtgtgaggcgcactcttccatctcatcgaactcatatcagcagccagggcct

SEQ ID NO: 387845 - DNA, 140 bp, Artificial Sequence
  Synthetic
aggccctggctgctgatatgagcatcattgatggcattcacagcctctatcaccagcccgctcactacccaaaacacccttttgtttaacatcctgggggggtgggtggcctcccaactcgaccttttgggacagcggtg

SEQ ID NO: 387846 - DNA, 140 bp, Artificial Sequence
  Synthetic
caccgctgtcccaaaaggtcgagttgggaggccacccacccccccaggatgttaaacaaaagggtgttttgggtagtgagcgggctggtgatagaggctgtgaatgccatcaatgatgctcatatcagcagccagggcct

SEQ ID NO: 387847 - DNA, 140 bp, Artificial Sequence
  Synthetic
atacgccatgctgggtctccggtttccccttttctatcttcttgctggccctgttgtcctgcatcaccgttccggtctctgctgcccaggtgaagaataccagtagcagctacatggtgacgtacttgggagtcggccat

SEQ ID NO: 387848 - DNA, 140 bp, Artificial Sequence
  Synthetic
atggccgactcccaagtacgtcaccatgtagctgctactggtattcttcacctgggcagcagagaccggaacggtgatgcaggacaacagggccagcaagaagatagaaaaggggaaaccggagacccagcatggcgtat

SEQ ID NO: 387849 - DNA, 140 bp, Artificial Sequence
  Synthetic
  misc_feature (68)..(68): n is a, c, g, or t
  misc_feature (86)..(86): n is a, c, g, or t
aggccctggctgctgatatgatcaccgggttccgcagacatgtggatgtcatggtgggcgctgccgcnttctgctcagctatgtangtgggggacctgtgcggaagcctcttccttgttggaccttttgggacagcggtg

SEQ ID NO: 387850 - DNA, 140 bp, Artificial Sequence
  Synthetic
  misc_feature (55)..(55): n is a, c, g, or t
  misc_feature (73)..(73): n is a, c, g, or t
caccgctgtcccaaaaggtccaacaaggaagaggcttccgcacaggtcccccacntacatagctgagcagaangcggcagcgcccaccatgacatccacatgtctgcggaacccggtgatcatatcagcagccagggcct

SEQ ID NO: 387851 - DNA, 140 bp, Artificial Sequence
  Synthetic
atacgccatgctgggtctccgtgttgggtgccagtctcgccaaacatggctgtgcggcagcccggtgccctcacgcagggtctgcggacgcacatcgatatggttgtgatgtccgccacccgtacttgggagtcggccat

SEQ ID NO: 387852 - DNA, 140 bp, Artificial Sequence
  Synthetic
atggccgactcccaagtacgggtggcggacatcacaaccatatcgatgtgcgtccgcagaccctgcgtgagggcaccgggctgccgcacagccatgtttggcgagactggcacccaacacggagacccagcatggcgtat

SEQ ID NO: 387853 - DNA, 140 bp, Artificial Sequence
  Synthetic
atacgccatgctgggtctccgtatcaggattcgccggcctcctcacgcagggctccaagcagaacatccagctgatcaactccaatggcagctggcacatcaataggacggccctgaactcgtacttgggagtcggccat

SEQ ID NO: 387854 - DNA, 140 bp, Artificial Sequence
  Synthetic
atggccgactcccaagtacgagttcagggccgtcctattgatgtgccagctgccattggagttgatcagctggatgttctgcttggagccctgcgtgaggaggccggcgaatcctgatacggagacccagcatggcgtat

SEQ ID NO: 387855 - DNA, 140 bp, Artificial Sequence
  Synthetic
atacgccatgctgggtctcctgccgattttgcccagggctggggccctatcgggtacgccaatggaagcggccccgaccatcgcccctactgctggcactaccccccaaaaccttgtggtcgtacttgggagtcggccat

SEQ ID NO: 387856 - DNA, 140 bp, Artificial Sequence
  Synthetic
atggccgactcccaagtacgaccacaaggttttggggggtagtgccagcagtaggggcgatggtcggggccgcttccattggcgtacccgatagggccccagccctgggcaaaatcggcaggagacccagcatggcgtat

SEQ ID NO: 387857 - DNA, 140 bp, Artificial Sequence
  Synthetic
aggccctggctgctgatatggcgtcatgttcggcttggcctacttctctatgcagggagcgtgggcgaaggtcattgtcatccttctgctggccgctggggtggacgcgggcaccaccacgaccttttgggacagcggtg

SEQ ID NO: 387858 - DNA, 140 bp, Artificial Sequence
  Synthetic
caccgctgtcccaaaaggtcgtggtggtgcccgcgtccaccccagcggccagcagaaggatgacaatgaccttcgcccacgctccctgcatagagaagtaggccaagccgaacatgacgccatatcagcagccagggcct

SEQ ID NO: 387859 - DNA, 140 bp, Artificial Sequence
  Synthetic
atacgccatgctgggtctccgtatgaccaccaacaacgtgaaatgcccatgccaggtcccggctcccgaattcttcacagaggtggatggggtgcggttgcacaggtacgctccggcgtgcgtacttgggagtcggccat

SEQ ID NO: 387860 - DNA, 140 bp, Artificial Sequence
  Synthetic
atggccgactcccaagtacgcacgccggagcgtacctgtgcaaccgcaccccatccacctctgtgaagaattcgggagccgggacctggcatgggcatttcacgttgttggtggtcatacggagacccagcatggcgtat

SEQ ID NO: 387861 - DNA, 140 bp, Artificial Sequence
  Synthetic
atacgccatgctgggtctccggacccgcatcaccggggggagtgttgctcaaaccacgggttttgtcgccagtctctttcggtcaggtccacagcagaaaatccacctgattaacaccaacgtacttgggagtcggccat

SEQ ID NO: 387862 - DNA, 140 bp, Artificial Sequence
  Synthetic
atggccgactcccaagtacgttggtgttaatcaggtggattttctgctgtggacctgaccgaaagagactggcgacaaaacccgtggtttgagcaacactccccccggtgatgcgggtccggagacccagcatggcgtat

SEQ ID NO: 387863 - DNA, 140 bp, Artificial Sequence
  Synthetic
atacgccatgctgggtctcccacatcaaccgtactgccttgaattgcaatgactccttgaacaccggctttctcgcggccttgttctacaccaaccgctttaactcgtcagggtgtccagcgtacttgggagtcggccat

SEQ ID NO: 387864 - DNA, 140 bp, Artificial Sequence
  Synthetic
atggccgactcccaagtacgctggacaccctgacgagttaaagcggttggtgtagaacaaggccgcgagaaagccggtgttcaaggagtcattgcaattcaaggcagtacggttgatgtgggagacccagcatggcgtat

SEQ ID NO: 387865 - DNA, 140 bp, Artificial Sequence
  Synthetic
atacgccatgctgggtctccctgctggcactaccccccaaagccgtgtggcgtagtccccgcgaggtctgtgtgtggcccagtgtactgtttcacccccagcccggtagtagtgggcacgcgtacttgggagtcggccat

SEQ ID NO: 387866 - DNA, 140 bp, Artificial Sequence
  Synthetic
atggccgactcccaagtacgcgtgcccactactaccgggctgggggtgaaacagtacactgggccacacacagacctcgcggggactacgccacacggctttggggggtagtgccagcagggagacccagcatggcgtat

SEQ ID NO: 387867 - DNA, 140 bp, Artificial Sequence
  Synthetic
atacgccatgctgggtctccgggcgggaacatcacccgtgtggagtcggagaagaaggtagtaatcctggattccttcgaaccgcttcgagcagaggaggacgagagggaaatgtccgttcgtacttgggagtcggccat

SEQ ID NO: 387868 - DNA, 140 bp, Artificial Sequence
  Synthetic
atggccgactcccaagtacgaacggacatttccctctcgtcctcctctgctcgaagcggttcgaaggaatccaggattactaccttcttctccgactccacacgggtgatgttcccgcccggagacccagcatggcgtat

SEQ ID NO: 387869 - DNA, 140 bp, Artificial Sequence
  Synthetic
atacgccatgctgggtctccctcccatgtcagattgggccgctacgggcctccgcgatttggcggtggccctagagccagttgtgttctcgcccatggagaagaaagtcatcgtctggggcgtacttgggagtcggccat

SEQ ID NO: 387870 - DNA, 140 bp, Artificial Sequence
  Synthetic
atggccgactcccaagtacgccccagacgatgactttcttctccatgggcgagaacacaactggctctagggccaccgccaaatcgcggaggcccgtagcggcccaatctgacatgggagggagacccagcatggcgtat

SEQ ID NO: 387871 - DNA, 140 bp, Artificial Sequence
  Synthetic
aggccctggctgctgatatgtgccgcaccagagctgacttcaacgccagcacggacttgttgtgccctacggattgttttaggaagcatcctgatgccacttatattaagtgtggttctggaccttttgggacagcggtg

SEQ ID NO: 387872 - DNA, 140 bp, Artificial Sequence
  Synthetic
caccgctgtcccaaaaggtccagaaccacacttaatataagtggcatcaggatgcttcctaaaacaatccgtagggcacaacaagtccgtgctggcgttgaagtcagctctggtgcggcacatatcagcagccagggcct

SEQ ID NO: 387873 - DNA, 140 bp, Artificial Sequence
  Synthetic
atacgccatgctgggtctccgaccgcccctcctgaccagtcttccgacaacggcgacacaggatccgacgctgagtcgtactcctccatgcccccccttgagggagagccgggggatccccgtacttgggagtcggccat

SEQ ID NO: 387874 - DNA, 140 bp, Artificial Sequence
  Synthetic
atggccgactcccaagtacggggatcccccggctctccctcaagggggggcatggaggagtacgactcagcgtcggatcctgtgtcgccgttgtcggaagactggtcaggaggggcggtcggagacccagcatggcgtat

SEQ ID NO: 387875 - DNA, 140 bp, Artificial Sequence
  Synthetic
aggccctggctgctgatatgccttggatcacgcccaggtgcctggtccactatccttacaggctttggcattatccctgcactctcaactacaccatgttcaaagtcagaatgtatgtgggaccttttgggacagcggtg

SEQ ID NO: 387876 - DNA, 140 bp, Artificial Sequence
  Synthetic
caccgctgtcccaaaaggtcccacatacattctgactttgaacatggtgtagttgagagtgcagggataatgccaaagcctgtaaggatagtggaccaggcacctgggcgtgatccaaggcatatcagcagccagggcct

SEQ ID NO: 387877 - DNA, 140 bp, Artificial Sequence
  Synthetic
aggccctggctgctgatatgagggggggttgagcacaggctcacggccgcatgcaacttcactcgtggggatcgctgcgacttggaggacagggacaggagtcagctgtctcctctgttggaccttttgggacagcggtg

SEQ ID NO: 387878 - DNA, 140 bp, Artificial Sequence
  Synthetic
caccgctgtcccaaaaggtccaacagaggagacagctgactcctgtccctgtcctccaagtcgcagcgatccccacgagtgaagttgcatgcggccgtgagcctgtgctcaaccccccctcatatcagcagccagggcct

SEQ ID NO: 387879 - DNA, 140 bp, Artificial Sequence
  Synthetic
atacgccatgctgggtctccaatacatgtatggcctctcacctgctatcacaaaatacgtcgttcgatgggagtgggtggtactcttattcctgctcttagcggacgccagagtctgcgccgtacttgggagtcggccat

SEQ ID NO: 387880 - DNA, 140 bp, Artificial Sequence
  Synthetic
atggccgactcccaagtacggcgcagactctggcgtccgctaagagcaggaataagagtaccacccactcccatcgaacgacgtattttgtgatagcaggtgagaggccatacatgtattggagacccagcatggcgtat

SEQ ID NO: 387881 - DNA, 140 bp, Artificial Sequence
  Synthetic
atacgccatgctgggtctcctattttgccatcttcttcgtggcagcttggcacatcaggggtcgggtggtccccttgaccacctattgcctcactggcctatggcccttctgcctactgccgtacttgggagtcggccat

SEQ ID NO: 387882 - DNA, 140 bp, Artificial Sequence
  Synthetic
atggccgactcccaagtacggcagtaggcagaagggccataggccagtgaggcaataggtggtcaaggggaccacccgacccctgatgtgccaagctgccacgaagaagatggcaaaataggagacccagcatggcgtat

SEQ ID NO: 387883 - DNA, 140 bp, Artificial Sequence
  Synthetic
atacgccatgctgggtctccggggtataagaccctcctcggccagtgtctgtggtggttgtgctatctcctgaccctgggggaagccatgattcaggagtgggtaccacccatgcaggtgcgtacttgggagtcggccat

SEQ ID NO: 387884 - DNA, 140 bp, Artificial Sequence
  Synthetic
atggccgactcccaagtacgcacctgcatgggtggtacccactcctgaatcatggcttcccccagggtcaggagatagcacaaccaccacagacactggccgaggagggtcttataccccggagacccagcatggcgtat

SEQ ID NO: 387885 - DNA, 140 bp, Artificial Sequence
  Synthetic
aggccctggctgctgatatgtgaccctgggggaagccatgattcaggagtgggtaccacccatgcaggtgcgcggcggccgcgatggcatcgcgtgggccgtcactatattctgcccggggaccttttgggacagcggtg

SEQ ID NO: 387886 - DNA, 140 bp, Artificial Sequence
  Synthetic
caccgctgtcccaaaaggtccccgggcagaatatagtgacggcccacgcgatgccatcgcggccgccgcgcacctgcatgggtggtacccactcctgaatcatggcttcccccagggtcacatatcagcagccagggcct

SEQ ID NO: 387887 - DNA, 140 bp, Artificial Sequence
  Synthetic
atacgccatgctgggtctccgccatcgttgtcatgctgaccattctgacactgtctccgcactacaagttatggctggctaggggactgtggtggttgtgctatctcctgaccctgggggcgtacttgggagtcggccat

SEQ ID NO: 387888 - DNA, 140 bp, Artificial Sequence
  Synthetic
atggccgactcccaagtacgcccccagggtcaggagatagcacaaccaccacagtcccctagccagccataacttgtagtgcggagacagtgtcagaatggtcagcatgacaacgatggcggagacccagcatggcgtat

SEQ ID NO: 387889 - DNA, 140 bp, Artificial Sequence
  Synthetic
aggccctggctgctgatatgaaccatctcactccccttcgggactgggcgcacaacggcctacgagatctggccgtggctgtagagccagtcgtcttttcccagatggagaccaagctcagaccttttgggacagcggtg

SEQ ID NO: 387890 - DNA, 140 bp, Artificial Sequence
  Synthetic
caccgctgtcccaaaaggtctgagcttggtctccatctgggaaaagacgactggctctacagccacggccagatctcgtaggccgttgtgcgcccagtcccgaaggggagtgagatggttcatatcagcagccagggcct

SEQ ID NO: 387891 - DNA, 140 bp, Artificial Sequence
  Synthetic
aggccctggctgctgatatgttacgtggggggcagacaccgccgcatgcggcgatatcatcgatggcttgcccgtctctgcccgtaggggccgggagatactgcttggaccggctgataggaccttttgggacagcggtg

SEQ ID NO: 387892 - DNA, 140 bp, Artificial Sequence
  Synthetic
caccgctgtcccaaaaggtcctatcagccggtccaagcagtatctcccggcccctacgggcagagacgggcaagccatcgatgatatcgccgcatgcggcggtgtctgccccccacgtaacatatcagcagccagggcct

SEQ ID NO: 387893 - DNA, 140 bp, Artificial Sequence
  Synthetic
aggccctggctgctgatatggtgacaggacagaacaggccggggaagtccaaatcctgtccacagtctctcagtccttcctcggaacaaccatctcgggggttttgtggactgtttaccagaccttttgggacagcggtg

SEQ ID NO: 387894 - DNA, 140 bp, Artificial Sequence
  Synthetic
caccgctgtcccaaaaggtctggtaaacagtccacaaaacccccgagatggttgttccgaggaaggactgagagactgtggacaggatttggacttccccggcctgttctgtcctgtcaccatatcagcagccagggcct

SEQ ID NO: 387895 - DNA, 140 bp, Artificial Sequence
  Synthetic
aggccctggctgctgatatgtataccaatgtagaccaagacctcgtaggctggcccgctccccaaggtgcccgctcattgacaccctgcacttgcggctcctcggacctctacctggtcagaccttttgggacagcggtg

SEQ ID NO: 387896 - DNA, 140 bp, Artificial Sequence
  Synthetic
caccgctgtcccaaaaggtctgaccaggtagaggtccgaggagccgcaagtgcagggtgtcaatgagcgggcaccttggggagcgggccagcctacgaggtcttggtctacattggtatacatatcagcagccagggcct

SEQ ID NO: 387897 - DNA, 140 bp, Artificial Sequence
  Synthetic
atacgccatgctgggtctcctgtgtgctctcggggcgtggccaaatccatcgatttcatccccgttgagacactcgacgttgttacaaggtctcccactttcagtgacaacagcacgccacgtacttgggagtcggccat

SEQ ID NO: 387898 - DNA, 140 bp, Artificial Sequence
  Synthetic
atggccgactcccaagtacgtggcgtgctgttgtcactgaaagtgggagaccttgtaacaacgtcgagtgtctcaacggggatgaaatcgatggatttggccacgccccgagagcacacaggagacccagcatggcgtat

SEQ ID NO: 387899 - DNA, 140 bp, Artificial Sequence
  Synthetic
atacgccatgctgggtctcccacatagacgcccacttcctctcccaaacaaagcaagcgggggagaacttcgcgtacctagtagcctaccaagctacggtgtgcgccagagccaaggccccgtacttgggagtcggccat

SEQ ID NO: 387900 - DNA, 140 bp, Artificial Sequence
  Synthetic
atggccgactcccaagtacggggccttggctctggcgcacaccgtagcttggtaggctactaggtacgcgaagttctcccccgcttgctttgtttgggagaggaagtgggcgtctatgtgggagacccagcatggcgtat

SEQ ID NO: 387901 - DNA, 140 bp, Artificial Sequence
  Synthetic
aggccctggctgctgatatgcacatcaacaggactgccctgaactgcaatgactccctccagactgggttccttgctgcgctgttttacgcacacaagttcaactcgtccggatgcccaggaccttttgggacagcggtg

SEQ ID NO: 387902 - DNA, 140 bp, Artificial Sequence
  Synthetic
caccgctgtcccaaaaggtcctgggcatccggacgagttgaacttgtgtgcgtaaaacagcgcagcaaggaacccagtctggagggagtcattgcagttcagggcagtcctgttgatgtgcatatcagcagccagggcct

SEQ ID NO: 387903 - DNA, 140 bp, Artificial Sequence
  Synthetic
aggccctggctgctgatatggagttcgatgagatggaagagtgcgcctcacacctcccttacatcgaacagggaatgcagctcgccgagcagttcaaacagaaggcgctcgggttgctgcgaccttttgggacagcggtg

SEQ ID NO: 387904 - DNA, 140 bp, Artificial Sequence
  Synthetic
caccgctgtcccaaaaggtcgcagcaacccgagcgccttctgtttgaactgctcggcgagctgcattccctgttcgatgtaagggaggtgtgaggcgcactcttccatctcatcgaactccatatcagcagccagggcct

SEQ ID NO: 387905 - DNA, 140 bp, Artificial Sequence
  Synthetic
aggccctggctgctgatatgcactaaggtgccggctgcgtatgcagcccaagggtacaaggtgctcgtcctgaacccgtccgttgccgccaccttaggttttggggcgtatatgtctaaggaccttttgggacagcggtg

SEQ ID NO: 387906 - DNA, 140 bp, Artificial Sequence
  Synthetic
caccgctgtcccaaaaggtccttagacatatacgccccaaaacctaaggtggcggcaacggacgggttcaggacgagcaccttgtacccttgggctgcatacgcagccggcaccttagtgcatatcagcagccagggcct

SEQ ID NO: 387907 - DNA, 140 bp, Artificial Sequence
  Synthetic
aggccctggctgctgatatggcctactcctgctcgctgcaggggtaggcatctacctcctccccaaccgatgaaggttggggtaaacactccggcctcttaggccatttcctgtttttttgaccttttgggacagcggtg

SEQ ID NO: 387908 - DNA, 140 bp, Artificial Sequence
  Synthetic
caccgctgtcccaaaaggtcaaaaaaacaggaaatggcctaagaggccggagtgtttaccccaaccttcatcggttggggaggaggtagatgcctacccctgcagcgagcaggagtaggccatatcagcagccagggcct

SEQ ID NO: 387909 - DNA, 140 bp, Artificial Sequence
  Synthetic
aggccctggctgctgatatgctcagctgctgaagaggctccaccagtggatcaatgaggactgctccacgccatgctccggctcgtggctaagggatgtttgggactggatatgcacggtgaccttttgggacagcggtg

SEQ ID NO: 387910 - DNA, 140 bp, Artificial Sequence
  Synthetic
caccgctgtcccaaaaggtcaccgtgcatatccagtcccaaacatcccttagccacgagccggagcatggcgtggagcagtcctcattgatccactggtggagcctcttcagcagctgagcatatcagcagccagggcct

SEQ ID NO: 387911 - DNA, 140 bp, Artificial Sequence
  Synthetic
aggccctggctgctgatatgggagacggcatcatgcaaaccacctgcccatgtggagcacagattgccggacatgtcaaaaacggttccatgaggatcgttgggcctagaacctgcagcagaccttttgggacagcggtg

SEQ ID NO: 387912 - DNA, 140 bp, Artificial Sequence
  Synthetic
caccgctgtcccaaaaggtctgctgcaggttctaggcccaacgatcctcatggaaccgtttttgacatgtccggcaatctgtgctccacatgggcaggtggtttgcatgatgccgtctcccatatcagcagccagggcct

SEQ ID NO: 387913 - DNA, 140 bp, Artificial Sequence
  Synthetic
atacgccatgctgggtctccctgtaatgagagcctcaacaccggctggatagcagggctcttctatcacaacagattcaactcttcaggctgtcctgagaggatggccagctgcaaacctcgtacttgggagtcggccat

SEQ ID NO: 387914 - DNA, 140 bp, Artificial Sequence
  Synthetic
atggccgactcccaagtacgaggtttgcagctggccatcctctcaggacagcctgaagagttgaatctgttgtgatagaagagccctgctatccagccggtgttgaggctctcattacagggagacccagcatggcgtat

SEQ ID NO: 387915 - DNA, 140 bp, Artificial Sequence
  Synthetic
atacgccatgctgggtctccagaacgtccagctggtcaactccaacggcagttggcatatcaatagcacggccctgaactgtaatgacagcctcaacaccggctggctagcggggctcttcgtacttgggagtcggccat

SEQ ID NO: 387916 - DNA, 140 bp, Artificial Sequence
  Synthetic
atggccgactcccaagtacgaagagccccgctagccagccggtgttgaggctgtcattacagttcagggccgtgctattgatatgccaactgccgttggagttgaccagctggacgttctggagacccagcatggcgtat

SEQ ID NO: 387917 - DNA, 140 bp, Artificial Sequence
  Synthetic
atacgccatgctgggtctccctccacgtccccgggtgcgtcccgtgtgagagggtggacaataatacatcccggtgctggataccggtctcaccaaacatagctgtgcagcggcccggcgcgtacttgggagtcggccat

SEQ ID NO: 387918 - DNA, 140 bp, Artificial Sequence
  Synthetic
atggccgactcccaagtacgcgccgggccgctgcacagctatgtttggtgagaccggtatccagcaccgggatgtattattgtccaccctctcacacgggacgcacccggggacgtggagggagacccagcatggcgtat

SEQ ID NO: 387919 - DNA, 140 bp, Artificial Sequence
  Synthetic
aggccctggctgctgatatgcggagacccacgtcaccgggggaagtgccggttacaccgcgagcacattcgccggcctctttagcccgggcgccaggcagaacatccagctcatcaactcgaccttttgggacagcggtg

SEQ ID NO: 387920 - DNA, 140 bp, Artificial Sequence
  Synthetic
caccgctgtcccaaaaggtcgagttgatgagctggatgttctgcctggcgcccgggctaaagaggccggcgaatgtgctcgcggtgtaaccggcacttcccccggtgacgtgggtctccgcatatcagcagccagggcct

SEQ ID NO: 387921 - DNA, 140 bp, Artificial Sequence
  Synthetic
atacgccatgctgggtctcctcaggttgtgctgagagaatggccagctgccgatccctcactgattttgaccagggctggggccccatcagctatgccaatggaagcggtcccgaccatccgtacttgggagtcggccat

SEQ ID NO: 387922 - DNA, 140 bp, Artificial Sequence
  Synthetic
atggccgactcccaagtacggatggtcgggaccgcttccattggcatagctgatggggccccagccctggtcaaaatcagtgagggatcggcagctggccattctctcagcacaacctgaggagacccagcatggcgtat

SEQ ID NO: 387923 - DNA, 140 bp, Artificial Sequence
  Synthetic
atacgccatgctgggtctcccactgttgggggggctgccgcgtccaccgccaattccatcgccggccttctcagccgaggccccaggcagaatcttcagctcattaactccaatggcagtcgtacttgggagtcggccat

SEQ ID NO: 387924 - DNA, 140 bp, Artificial Sequence
  Synthetic
atggccgactcccaagtacgactgccattggagttaatgagctgaagattctgcctggggcctcggctgagaaggccggcgatggaattggcggtggacgcggcagcccccccaacagtgggagacccagcatggcgtat

SEQ ID NO: 387925 - DNA, 140 bp, Artificial Sequence
  Synthetic
atacgccatgctgggtctcctggcacatcaaccgcactgctctgaactgccatgactccttgcaaactggcttcatcacggcactgttctacgcccgccacttcaactcgtcgggatgcccgtacttgggagtcggccat

SEQ ID NO: 387926 - DNA, 140 bp, Artificial Sequence
  Synthetic
atggccgactcccaagtacgggcatcccgacgagttgaagtggcgggcgtagaacagtgccgtgatgaagccagtttgcaaggagtcatggcagttcagagcagtgcggttgatgtgccaggagacccagcatggcgtat

SEQ ID NO: 387927 - DNA, 140 bp, Artificial Sequence
  Synthetic
aggccctggctgctgatatgatgtcctatacatggacaggcgccctgatcacgccatgcgctgcggaggaaagcaagctgcccatcaatgcgttgagcaactctttgctgcgtcaccacagaccttttgggacagcggtg

SEQ ID NO: 387928 - DNA, 140 bp, Artificial Sequence
  Synthetic
caccgctgtcccaaaaggtctgtggtgacgcagcaaagagttgctcaacgcattgatgggcagcttgctttcctccgcagcgcatggcgtgatcagggcgcctgtccatgtataggacatcatatcagcagccagggcct

SEQ ID NO: 387929 - DNA, 140 bp, Artificial Sequence
  Synthetic
atacgccatgctgggtctccagatgtcttcctattgaacagcactcgaccaccgcaggggccgtggttcggctgcacatggatgaactccactggtttcactaagacttgcggtgcgccacgtacttgggagtcggccat

SEQ ID NO: 387930 - DNA, 140 bp, Artificial Sequence
  Synthetic
atggccgactcccaagtacgtggcgcaccgcaagtcttagtgaaaccagtggagttcatccatgtgcagccgaaccacggcccctgcggtggtcgagtgctgttcaataggaagacatctggagacccagcatggcgtat

SEQ ID NO: 387931 - DNA, 140 bp, Artificial Sequence
  Synthetic
aggccctggctgctgatatggctgcacatggatgaactccactggtttcactaagacttgcggtgcgccaccatgtcgtactagagctgacttcaacgccagcacggacctgctgtgcccgaccttttgggacagcggtg

SEQ ID NO: 387932 - DNA, 140 bp, Artificial Sequence
  Synthetic
caccgctgtcccaaaaggtcgggcacagcaggtccgtgctggcgttgaagtcagctctagtacgacatggtggcgcaccgcaagtcttagtgaaaccagtggagttcatccatgtgcagccatatcagcagccagggcct

SEQ ID NO: 387933 - DNA, 140 bp, Artificial Sequence
  Synthetic
atacgccatgctgggtctcctggagtatctcttgaaagcatgggcggaaaagaaggaccccatgggtttttcgtatgatacccgatgcttcgactcaaccgtcactgagagagacatcagcgtacttgggagtcggccat

SEQ ID NO: 387934 - DNA, 140 bp, Artificial Sequence
  Synthetic
atggccgactcccaagtacgctgatgtctctctcagtgacggttgagtcgaagcatcgggtatcatacgaaaaacccatggggtccttcttttccgcccatgctttcaagagatactccaggagacccagcatggcgtat

SEQ ID NO: 387935 - DNA, 140 bp, Artificial Sequence
  Synthetic
atacgccatgctgggtctcccgaccttgtcgttatctgtgagagcgcgggaacccaagaggatgcggcgagcctacgagtcttcacggaggctatgactaggtactctgccccccccgggcgtacttgggagtcggccat

SEQ ID NO: 387936 - DNA, 140 bp, Artificial Sequence
  Synthetic
atggccgactcccaagtacgcccggggggggcagagtacctagtcatagcctccgtgaagactcgtaggctcgccgcatcctcttgggttcccgcgctctcacagataacgacaaggtcgggagacccagcatggcgtat

SEQ ID NO: 387937 - DNA, 140 bp, Artificial Sequence
  Synthetic
atacgccatgctgggtctccagaagctggttgtcttgcacgccgcaagtgcggccagttgcaatggccctctatattttgtcatcttctttgtagctgcctggtatttcaagggtcgggtcgtacttgggagtcggccat

SEQ ID NO: 387938 - DNA, 140 bp, Artificial Sequence
  Synthetic
atggccgactcccaagtacgacccgacccttgaaataccaggcagctacaaagaagatgacaaaatatagagggccattgcaactggccgcacttgcggcgtgcaagacaaccagcttctggagacccagcatggcgtat

SEQ ID NO: 387939 - DNA, 140 bp, Artificial Sequence
  Synthetic
atacgccatgctgggtctccgggcagataggtgcgactctgttgatattgatcaccctttttacactcaccccggggtataagaccctcctcagccggtttctgtggtggttgtgctacccgtacttgggagtcggccat

SEQ ID NO: 387940 - DNA, 140 bp, Artificial Sequence
  Synthetic
atggccgactcccaagtacgggtagcacaaccaccacagaaaccggctgaggagggtcttataccccggggtgagtgtaaaaagggtgatcaatatcaacagagtcgcacctatctgcccggagacccagcatggcgtat

SEQ ID NO: 387941 - DNA, 140 bp, Artificial Sequence
  Synthetic
aggccctggctgctgatatgtcatcacatggggggcggacaccgccgcgtgcggtgacatcatcaatggcttgcccgtctccgcccgtaggggccgagagatactgctcgggccagccgagaccttttgggacagcggtg

SEQ ID NO: 387942 - DNA, 140 bp, Artificial Sequence
  Synthetic
caccgctgtcccaaaaggtctcggctggcccgagcagtatctctcggcccctacgggcggagacgggcaagccattgatgatgtcaccgcacgcggcggtgtccgccccccatgtgatgacatatcagcagccagggcct

SEQ ID NO: 387943 - DNA, 140 bp, Artificial Sequence
  Synthetic
atacgccatgctgggtctccgggtgtagtgtttgacataaccaagtggctcttggcaatacttgggcctgcttgcctcctaggagatgctttgacgcgcgtgccgtacttcgtcagagctcgtacttgggagtcggccat

SEQ ID NO: 387944 - DNA, 140 bp, Artificial Sequence
  Synthetic
atggccgactcccaagtacgagctctgacgaagtacggcacgcgcgtcaaagcatctcctaggaggcaagcaggcccaagtattgccaagagccacttggttatgtcaaacactacacccggagacccagcatggcgtat

SEQ ID NO: 387945 - DNA, 140 bp, Artificial Sequence
  Synthetic
atacgccatgctgggtctcctctatgatcacctcagccccatgtcggactgggccgctaatggcctgcgggaccttgcggtcgccgtagaacctatcatcttcagtccgatggagaagaacgtacttgggagtcggccat

SEQ ID NO: 387946 - DNA, 140 bp, Artificial Sequence
  Synthetic
atggccgactcccaagtacgttcttctccatcggactgaagatgataggttctacggcgaccgcaaggtcccgcaggccattagcggcccagtccgacatggggctgaggtgatcatagaggagacccagcatggcgtat

SEQ ID NO: 387947 - DNA, 140 bp, Artificial Sequence
  Synthetic
aggccctggctgctgatatgcctcttcctactccccgctcggtagagcggcacacactaggtacactccatagctaactgttccttttttttttttttttttttttttttttttttttttgaccttttgggacagcggtg

SEQ ID NO: 387948 - DNA, 140 bp, Artificial Sequence
  Synthetic
caccgctgtcccaaaaggtcaaaaaaaaaaaaaaaaaaaaaaaaaaaaaaaaaaaaggaacagttagctatggagtgtacctagtgtgtgccgctctaccgagcggggagtaggaagaggcatatcagcagccagggcct

SEQ ID NO: 387949 - DNA, 140 bp, Artificial Sequence
  Synthetic
atacgccatgctgggtctccggaaaatgcctacccctacggtaagtaggagtaggcaaagcagcaaatggcgggttcgggcacgcgacacgctgtgataaatgtcgttcccgccgacacccgtacttgggagtcggccat

SEQ ID NO: 387950 - DNA, 140 bp, Artificial Sequence
  Synthetic
atggccgactcccaagtacgggtgtcggcgggaacgacatttatcacagcgtgtcgcgtgcccgaacccgccatttgctgctttgcctactcctacttaccgtaggggtaggcattttccggagacccagcatggcgtat

SEQ ID NO: 387951 - DNA, 140 bp, Artificial Sequence
  Synthetic
atacgccatgctgggtctccattctggcctttcctccttgggcaatgagtttggcgcgtactgctcgtgcccgatgtctccacgctcgtaggggggggatcccaagctttctgagagccccgtacttgggagtcggccat

SEQ ID NO: 387952 - DNA, 140 bp, Artificial Sequence
  Synthetic
atggccgactcccaagtacggggctctcagaaagcttgggatcccccccctacgagcgtggagacatcgggcacgagcagtacgcgccaaactcattgcccaaggaggaaaggccagaatggagacccagcatggcgtat

SEQ ID NO: 387953 - DNA, 140 bp, Artificial Sequence
  Synthetic
atacgccatgctgggtctcctggcagtggaaagagcaccaaagtccctgtcgcatacgcctcccaggggtataaagtgctagtgcttaatccctcggtggctgccaccctggggtttgggcgtacttgggagtcggccat

SEQ ID NO: 387954 - DNA, 140 bp, Artificial Sequence
  Synthetic
atggccgactcccaagtacgcccaaaccccagggtggcagccaccgagggattaagcactagcactttatacccctgggaggcgtatgcgacagggactttggtgctctttccactgccaggagacccagcatggcgtat

SEQ ID NO: 387955 - DNA, 140 bp, Artificial Sequence
  Synthetic
aggccctggctgctgatatggaatcctggcgggccttgcctactactccatggcggggaactgggctaaggttttgattgtgatgctgctctttgctggcgttgatggggaaacccatgtgaccttttgggacagcggtg

SEQ ID NO: 387956 - DNA, 140 bp, Artificial Sequence
  Synthetic
caccgctgtcccaaaaggtcacatgggtttccccatcaacgccagcaaagagcagcatcacaatcaaaaccttagcccagttccccgccatggagtagtaggcaaggcccgccaggattccatatcagcagccagggcct

SEQ ID NO: 387957 - DNA, 140 bp, Artificial Sequence
  Synthetic
atacgccatgctgggtctcctgagtaggtagccccgtacatttcaaagtctagggctctttcaagctgctcctgggcttgcagtatggaaaagaagtgggttatcaacaccatgcggacccgtacttgggagtcggccat

SEQ ID NO: 387958 - DNA, 140 bp, Artificial Sequence
  Synthetic
atggccgactcccaagtacgggtccgcatggtgttgataacccacttcttttccatactgcaagcccaggagcagcttgaaagagccctagactttgaaatgtacggggctacctactcaggagacccagcatggcgtat

SEQ ID NO: 387959 - DNA, 140 bp, Artificial Sequence
  Synthetic
aggccctggctgctgatatgtctgggagagcctctttacgggactaaccaatatagacgctcacttcctatcccagaccaagcaggcgggtgacaactatccatacctggtagcttatcagaccttttgggacagcggtg

SEQ ID NO: 387960 - DNA, 140 bp, Artificial Sequence
  Synthetic
caccgctgtcccaaaaggtctgataagctaccaggtatggatagttgtcacccgcctgcttggtctgggataggaagtgagcgtctatattggttagtcccgtaaagaggctctcccagacatatcagcagccagggcct

SEQ ID NO: 387961 - DNA, 140 bp, Artificial Sequence
  Synthetic
atacgccatgctgggtctcccacattaacaggactgccctgaactgcaatgacacccttcacactgggttcattgctgcgctgttctacacacacagattcaactcgtcaggatgcccagcgtacttgggagtcggccat

SEQ ID NO: 387962 - DNA, 140 bp, Artificial Sequence
  Synthetic
atggccgactcccaagtacgctgggcatcctgacgagttgaatctgtgtgtgtagaacagcgcagcaatgaacccagtgtgaagggtgtcattgcagttcagggcagtcctgttaatgtgggagacccagcatggcgtat

SEQ ID NO: 387963 - DNA, 140 bp, Artificial Sequence
  Synthetic
atacgccatgctgggtctcccccgggtgaggtaatagtacctcttacccgctccgtcgcatgccacggagacgtttgaggagcaagatgaaatcagctccaagtcgtaggtgggctgtggcgtacttgggagtcggccat

SEQ ID NO: 387964 - DNA, 140 bp, Artificial Sequence
  Synthetic
atggccgactcccaagtacgccacagcccacctacgacttggagctgatttcatcttgctcctcaaacgtctccgtggcatgcgacggagcgggtaagaggtactattacctcacccgggggagacccagcatggcgtat

SEQ ID NO: 387965 - DNA, 140 bp, Artificial Sequence
  Synthetic
atacgccatgctgggtctccaaatcgtctccacagacaaggaaagacgggtttttgagacccgcagctctgctggctgcggtggccttgatgtaacaggttattgtgttgccaaagctggcgtacttgggagtcggccat

SEQ ID NO: 387966 - DNA, 140 bp, Artificial Sequence
  Synthetic
atggccgactcccaagtacgccagctttggcaacacaataacctgttacatcaaggccaccgcagccagcagagctgcgggtctcaaaaacccgtctttccttgtctgtggagacgatttggagacccagcatggcgtat

SEQ ID NO: 387967 - DNA, 140 bp, Artificial Sequence
  Synthetic
aggccctggctgctgatatgttccttacctggtagcgtaccaagccaccgtgtgcgctagggctcaagcccctcccccatcgtgggaccagatgtggaagtgcttgatccgcctcaagccgaccttttgggacagcggtg

SEQ ID NO: 387968 - DNA, 140 bp, Artificial Sequence
  Synthetic
caccgctgtcccaaaaggtcggcttgaggcggatcaagcacttccacatctggtcccacgatgggggaggggcttgagccctagcgcacacggtggcttggtacgctaccaggtaaggaacatatcagcagccagggcct

SEQ ID NO: 387969 - DNA, 140 bp, Artificial Sequence
  Synthetic
aggccctggctgctgatatgctttgtgggcgctggtttagctggcgccgccatcggcagtgttggactggggaaggttctcgtggacatccttgcggggtatggcgcgggcgtggcgggggaccttttgggacagcggtg

SEQ ID NO: 387970 - DNA, 140 bp, Artificial Sequence
  Synthetic
caccgctgtcccaaaaggtcccccgccacgcccgcgccataccccgcaaggatgtccacgagaaccttccccagtccaacactgccgatggcggcgccagctaaaccagcgcccacaaagcatatcagcagccagggcct

SEQ ID NO: 387971 - DNA, 140 bp, Artificial Sequence
  Synthetic
atacgccatgctgggtctccgattgccttccgagcctctggttcaaggtcacaacattggtatatcccctcctccgtcctgatgtcatgttcggtgacagtagagtcaaagcaacgagtgcgtacttgggagtcggccat

SEQ ID NO: 387972 - DNA, 140 bp, Artificial Sequence
  Synthetic
atggccgactcccaagtacgcactcgttgctttgactctactgtcaccgaacatgacatcaggacggaggaggggatataccaatgttgtgaccttgaaccagaggctcggaaggcaatcggagacccagcatggcgtat

SEQ ID NO: 387973 - DNA, 140 bp, Artificial Sequence
  Synthetic
atacgccatgctgggtctcctcgttgcaattgacaacttctgtatcacgtcatatagggcgcgtttctcacagacccgcacccccagatcaggatagacgatgagacgggcaggtttgcgcgtacttgggagtcggccat

SEQ ID NO: 387974 - DNA, 140 bp, Artificial Sequence
  Synthetic
atggccgactcccaagtacgcgcaaacctgcccgtctcatcgtctatcctgatctgggggtgcgggtctgtgagaaacgcgccctatatgacgtgatacagaagttgtcaattgcaacgaggagacccagcatggcgtat

SEQ ID NO: 387975 - DNA, 140 bp, Artificial Sequence
  Synthetic
atacgccatgctgggtctcccggatctggttcatggctttgctggacaaggaacgaacatcctttgcactatacccgtacttcgaccggccggagtggggggggacaagagagcatgcttcgtacttgggagtcggccat

SEQ ID NO: 387976 - DNA, 140 bp, Artificial Sequence
  Synthetic
atggccgactcccaagtacgaagcatgctctcttgtccccccccactccggccggtcgaagtacgggtatagtgcaaaggatgttcgttccttgtccagcaaagccatgaaccagatccgggagacccagcatggcgtat

SEQ ID NO: 387977 - DNA, 140 bp, Artificial Sequence
  Synthetic
atacgccatgctgggtctcccaatgagatcaccctcacacatcctgtgacgaaatacatcgccacttgcatgcaagccgaccttgagatcatgaccagcacgtgggtcttggctgggggacgtacttgggagtcggccat

SEQ ID NO: 387978 - DNA, 140 bp, Artificial Sequence
  Synthetic
atggccgactcccaagtacgtcccccagccaagacccacgtgctggtcatgatctcaaggtcggcttgcatgcaagtggcgatgtatttcgtcacaggatgtgtgagggtgatctcattgggagacccagcatggcgtat

SEQ ID NO: 387979 - DNA, 140 bp, Artificial Sequence
  Synthetic
atacgccatgctgggtctccggtaaccttcttctgacgtgcggcggcgcttcgagatgacgtagagtagacaagattgtggtgtctcagcaacgagttgctgagtggactgataggtagtcgtacttgggagtcggccat

SEQ ID NO: 387980 - DNA, 140 bp, Artificial Sequence
  Synthetic
atggccgactcccaagtacgactacctatcagtccactcagcaactcgttgctgagacaccacaatcttgtctactctacgtcatctcgaagcgccgccgcacgtcagaagaaggttaccggagacccagcatggcgtat

SEQ ID NO: 387981 - DNA, 140 bp, Artificial Sequence
  Synthetic
atacgccatgctgggtctccccgtgcaggcctcatggcccaaggtggagcaattctgggccaaacacatgtggaacttcatcagtggcattcaatacctcgctggactgtcaacattgcccgtacttgggagtcggccat

SEQ ID NO: 387982 - DNA, 140 bp, Artificial Sequence
  Synthetic
atggccgactcccaagtacgggcaatgttgacagtccagcgaggtattgaatgccactgatgaagttccacatgtgtttggcccagaattgctccaccttgggccatgaggcctgcacggggagacccagcatggcgtat

SEQ ID NO: 387983 - DNA, 140 bp, Artificial Sequence
  Synthetic
atacgccatgctgggtctccagtgccgcggacacattcgacccatcgagcttgattgtcctctttctgcgggggggaggcactggtgcgggacgagttggtggcaaggcacacccgtgaacgtacttgggagtcggccat

SEQ ID NO: 387984 - DNA, 140 bp, Artificial Sequence
  Synthetic
atggccgactcccaagtacgttcacgggtgtgccttgccaccaactcgtcccgcaccagtgcctcccccccgcagaaagaggacaatcaagctcgatgggtcgaatgtgtccgcggcactggagacccagcatggcgtat

SEQ ID NO: 387985 - DNA, 140 bp, Artificial Sequence
  Synthetic
atacgccatgctgggtctcctttcttgaagcactctgccggtatcgagagctctgtgtcgtcttcttcggccctcaggggctcgaaagagtcaaggatcaccaccttcgtctcggactctcgtacttgggagtcggccat

SEQ ID NO: 387986 - DNA, 140 bp, Artificial Sequence
  Synthetic
atggccgactcccaagtacgagagtccgagacgaaggtggtgatccttgactctttcgagcccctgagggccgaagaagacgacacagagctctcgataccggcagagtgcttcaagaaaggagacccagcatggcgtat

SEQ ID NO: 387987 - DNA, 140 bp, Artificial Sequence
  Synthetic
atacgccatgctgggtctccgtgacggagctgagagctggctggcagaggagctagcttccgatggaggtgaaccgcgcgcaaggcgccgggccgctgtggcggcggtgatgtgagcaggcgtacttgggagtcggccat

SEQ ID NO: 387988 - DNA, 140 bp, Artificial Sequence
  Synthetic
atggccgactcccaagtacgcctgctcacatcaccgccgccacagcggcccggcgccttgcgcgcggttcacctccatcggaagctagctcctctgccagccagctctcagctccgtcacggagacccagcatggcgtat

SEQ ID NO: 387989 - DNA, 140 bp, Artificial Sequence
  Synthetic
atacgccatgctgggtctcctcgtccctcagaaggggcttacaaggaggagcatagcggtggagcctcactccgtctaactcggtgaagaactctggcgctggcacctggcatgggatttcgtacttgggagtcggccat

SEQ ID NO: 387990 - DNA, 140 bp, Artificial Sequence
  Synthetic
atggccgactcccaagtacgaaatcccatgccaggtgccagcgccagagttcttcaccgagttagacggagtgaggctccaccgctatgctcctccttgtaagccccttctgagggacgaggagacccagcatggcgtat

SEQ ID NO: 387991 - DNA, 140 bp, Artificial Sequence
  Synthetic
atacgccatgctgggtctccattgtgcgcggggacgggtgtactcggcccagtggtgtattcattgatggggaaggtgccatgccacatgttagcgcagaggcctgatcctgctatcctccgtacttgggagtcggccat

SEQ ID NO: 387992 - DNA, 140 bp, Artificial Sequence
  Synthetic
atggccgactcccaagtacggaggatagcaggatcaggcctctgcgctaacatgtggcatggcaccttccccatcaatgaatacaccactgggccgagtacacccgtccccgcgcacaatggagacccagcatggcgtat

SEQ ID NO: 387993 - DNA, 140 bp, Artificial Sequence
  Synthetic
aggccctggctgctgatatggtttgcccccacaccaaagccgtttctccgggatgaggtcacgttctgcgttgggcttaattcatttgtcgtcgggtctcagcttccttgtgatcctgaagaccttttgggacagcggtg

SEQ ID NO: 387994 - DNA, 140 bp, Artificial Sequence
  Synthetic
caccgctgtcccaaaaggtcttcaggatcacaaggaagctgagacccgacgacaaatgaattaagcccaacgcagaacgtgacctcatcccggagaaacggctttggtgtgggggcaaaccatatcagcagccagggcct

SEQ ID NO: 387995 - DNA, 140 bp, Artificial Sequence
  Synthetic
atacgccatgctgggtctccatgagagaaagggtatgcctggcaccttgggcatgatcttggccgaaagccaggtcttaaagtcactaagtacgatacagacccagtcccagatgtcatgcgtacttgggagtcggccat

SEQ ID NO: 387996 - DNA, 140 bp, Artificial Sequence
  Synthetic
atggccgactcccaagtacgcatgacatctgggactgggtctgtatcgtacttagtgactttaagacctggctttcggccaagatcatgcccaaggtgccaggcataccctttctctcatggagacccagcatggcgtat

SEQ ID NO: 387997 - DNA, 140 bp, Artificial Sequence
  Synthetic
atacgccatgctgggtctcccaagctcctcagcaagccagctatcagcgccttcgctgcgagccacctgcaccacctatggcagggcccatgatgtggacatggtggatgcaaacctgttcgtacttgggagtcggccat

SEQ ID NO: 387998 - DNA, 140 bp, Artificial Sequence
  Synthetic
atggccgactcccaagtacgaacaggtttgcatccaccatgtccacatcatgggccctgccataggtggtgcaggtggctcgcagcgaaggcgctgatagctggcttgctgaggagcttgggagacccagcatggcgtat

SEQ ID NO: 387999 - DNA, 140 bp, Artificial Sequence
  Synthetic
atacgccatgctgggtctccacttttgctgccgcgtcgctctcggggacatagtgtgttggtgatacatggttcccccgagatgcgaacgctatgagtctgttcatccactgcactgctccgtacttgggagtcggccat

SEQ ID NO: 388000 - DNA, 140 bp, Artificial Sequence
  Synthetic
atggccgactcccaagtacggagcagtgcagtggatgaacagactcatagcgttcgcatctcgggggaaccatgtatcaccaacacactatgtccccgagagcgacgcggcagcaaaagtggagacccagcatggcgtat

SEQ ID NO: 388001 - DNA, 140 bp, Artificial Sequence
  Synthetic
atacgccatgctgggtctcccatggggggcggtgaggtttggatagagtccgagtccaaggtggtcgtcctggactcactcgactcaatggccgaggaaaagagcgacctcgagccttcccgtacttgggagtcggccat

SEQ ID NO: 388002 - DNA, 140 bp, Artificial Sequence
  Synthetic
atggccgactcccaagtacgggaaggctcgaggtcgctcttttcctcggccattgagtcgagtgagtccaggacgaccaccttggactcggactctatccaaacctcaccgccccccatgggagacccagcatggcgtat

SEQ ID NO: 388003 - DNA, 140 bp, Artificial Sequence
  Synthetic
atacgccatgctgggtctccctctgtggtagggagctctcctcccatgattttgaaggccactagggcgccggagaccccagccccatacccggcaagcacgtcaagcaacaccctgccacgtacttgggagtcggccat

SEQ ID NO: 388004 - DNA, 140 bp, Artificial Sequence
  Synthetic
atggccgactcccaagtacgtggcagggtgttgcttgacgtgcttgccgggtatggggctggggtctccggcgccctagtggccttcaaaatcatgggaggagagctccctaccacagagggagacccagcatggcgtat

SEQ ID NO: 388005 - DNA, 140 bp, Artificial Sequence
  Synthetic
aggccctggctgctgatatgggggaggcacctcattttctgccattccaagaagaaatgtgatgagctcgccgcaaagctgtcgggcctcggacttaatgctgtagcatattaccggggtgaccttttgggacagcggtg

SEQ ID NO: 388006 - DNA, 140 bp, Artificial Sequence
  Synthetic
caccgctgtcccaaaaggtcaccccggtaatatgctacagcattaagtccgaggcccgacagctttgcggcgagctcatcacatttcttcttggaatggcagaaaatgaggtgcctcccccatatcagcagccagggcct

SEQ ID NO: 388007 - DNA, 140 bp, Artificial Sequence
  Synthetic
aggccctggctgctgatatgaagaagaccccgacgcctcccccaaggagacgccggacagtgggtttgagtgagagcgttgtagcagaagccctccaacagctggccattaagtcctttggaccttttgggacagcggtg

SEQ ID NO: 388008 - DNA, 140 bp, Artificial Sequence
  Synthetic
caccgctgtcccaaaaggtccaaaggacttaatggccagctgttggagggcttctgctacaacgctctcactcaaacccactgtccggcgtctccttgggggaggcgtcggggtcttcttcatatcagcagccagggcct

SEQ ID NO: 388009 - DNA, 140 bp, Artificial Sequence
  Synthetic
aggccctggctgctgatatgaacttctcgtacctaactgcctaccaagccactgtgtgcgcccgcgcgcaggctcctcccccaagttgggacgagatgtggaagtgtctcgtgcggcttagaccttttgggacagcggtg

SEQ ID NO: 388010 - DNA, 140 bp, Artificial Sequence
  Synthetic
caccgctgtcccaaaaggtctaagccgcacgagacacttccacatctcgtcccaacttgggggaggagcctgcgcgcgggcgcacacagtggcttggtaggcagttaggtacgagaagttcatatcagcagccagggcct

SEQ ID NO: 388011 - DNA, 140 bp, Artificial Sequence
  Synthetic
atacgccatgctgggtctcctgttaaagaacatagtctggttggttgtgagggggctggttacagaggcggtgaaggccataagggaagccacggcagggttgcctggcagtgtggagagcgtacttgggagtcggccat

SEQ ID NO: 388012 - DNA, 140 bp, Artificial Sequence
  Synthetic
atggccgactcccaagtacgctctccacactgccaggcaaccctgccgtggcttcccttatggccttcaccgcctctgtaaccagccccctcacaaccaaccagactatgttctttaacaggagacccagcatggcgtat

SEQ ID NO: 388013 - DNA, 140 bp, Artificial Sequence
  Synthetic
atacgccatgctgggtctccaggttctacctcctccatgccccccctcgagggggagcctggggatccagacctggagcctgagcgggtagagccacaacctcccccccaggggggggggcgtacttgggagtcggccat

SEQ ID NO: 388014 - DNA, 140 bp, Artificial Sequence
  Synthetic
atggccgactcccaagtacgcccccccccctgggggggaggttgtggctctacccgctcaggctccaggtctggatccccaggctccccctcgagggggggcatggaggaggtagaacctggagacccagcatggcgtat

SEQ ID NO: 388015 - DNA, 140 bp, Artificial Sequence
  Synthetic
atacgccatgctgggtctccgcttcttgttggctcgccctttgcagcaagccgaggactttgtccttgaattgctgagcgatagcctgtgcttgctcgatgtaaggagcagactgggaaccgtacttgggagtcggccat

SEQ ID NO: 388016 - DNA, 140 bp, Artificial Sequence
  Synthetic
atggccgactcccaagtacggttcccagtctgctccttacatcgagcaagcacaggctatcgctcagcaattcaaggacaaagtcctcggcttgctgcaaagggcgagccaacaagaagcggagacccagcatggcgtat

SEQ ID NO: 388017 - DNA, 140 bp, Artificial Sequence
  Synthetic
atacgccatgctgggtctcccgactccgtcgtgtgctgctccatgtcatactcctggacaggggctctgataactccttgtagccccgaagaggaaaagttgccggtcaaccccttgagccgtacttgggagtcggccat

SEQ ID NO: 388018 - DNA, 140 bp, Artificial Sequence
  Synthetic
atggccgactcccaagtacggctcaaggggttgaccggcaacttttcctcttcggggctacaaggagttatcagagcccctgtccaggagtatgacatggagcagcacacgacggagtcgggagacccagcatggcgtat

SEQ ID NO: 388019 - DNA, 140 bp, Artificial Sequence
  Synthetic
atacgccatgctgggtctcctactgataaacagtaggctgcgagggctgctagaacaccaccaaccagcacccaggcgctcgtggtgacttccaagtcagctgacatgcaagccatgatgcgtacttgggagtcggccat

SEQ ID NO: 388020 - DNA, 140 bp, Artificial Sequence
  Synthetic
atggccgactcccaagtacgcatcatggcttgcatgtcagctgacttggaagtcaccacgagcgcctgggtgctggttggtggtgttctagcagccctcgcagcctactgtttatcagtaggagacccagcatggcgtat

SEQ ID NO: 388021 - DNA, 140 bp, Artificial Sequence
  Synthetic
atacgccatgctgggtctccgacatttccacatctcatcccaacatggtgggctcgcctttgcacgagcgcagacagtggcttgatatgccaccaagtatgcaaagtttaggccctgctgcgtacttgggagtcggccat

SEQ ID NO: 388022 - DNA, 140 bp, Artificial Sequence
  Synthetic
atggccgactcccaagtacgcagcagggcctaaactttgcatacttggtggcatatcaagccactgtctgcgctcgtgcaaaggcgagcccaccatgttgggatgagatgtggaaatgtcggagacccagcatggcgtat

SEQ ID NO: 388023 - DNA, 140 bp, Artificial Sequence
  Synthetic
atacgccatgctgggtctccgacaggtatgctctcagtcgcactgtggtctcagcaggttgtaggtcataccaggaacaacctgcgtcatagcactcacatagcaccaccgagtcaaacacgtacttgggagtcggccat

SEQ ID NO: 388024 - DNA, 140 bp, Artificial Sequence
  Synthetic
atggccgactcccaagtacgtgtttgactcggtggtgctatgtgagtgctatgacgcaggttgttcctggtatgacctacaacctgctgagaccacagtgcgactgagagcatacctgtcggagacccagcatggcgtat

SEQ ID NO: 388025 - DNA, 140 bp, Artificial Sequence
  Synthetic
atacgccatgctgggtctccaaccgtgcgtgtctcaatggagaaagtggggtctagactgaagtcgacgtactgctccacagccacgttacagtctataacggtgtcaaaatcccctgtacgtacttgggagtcggccat

SEQ ID NO: 388026 - DNA, 140 bp, Artificial Sequence
  Synthetic
atggccgactcccaagtacgtacaggggattttgacaccgttatagactgtaacgtggctgtggagcagtacgtcgacttcagtctagaccccactttctccattgagacacgcacggttggagacccagcatggcgtat

SEQ ID NO: 388027 - DNA, 140 bp, Artificial Sequence
  Synthetic
atacgccatgctgggtctccccatccctctgagcttgctggccagctcgtcacatttttcctttgaatggcagaatacaaggtgtcttcctcccttgatcattgccagtgggagggctttcgtacttgggagtcggccat

SEQ ID NO: 388028 - DNA, 140 bp, Artificial Sequence
  Synthetic
atggccgactcccaagtacgaaagccctcccactggcaatgatcaagggaggaagacaccttgtattctgccattcaaaggaaaaatgtgacgagctggccagcaagctcagagggatggggagacccagcatggcgtat

SEQ ID NO: 388029 - DNA, 140 bp, Artificial Sequence
  Synthetic
atacgccatgctgggtctccggggttgaggaggacgagcggaacctgagagccttcgcgcaggctatgaccaggtactccgcccctcctggtgaccctcccagaccggaatacgacctggcgtacttgggagtcggccat

SEQ ID NO: 388030 - DNA, 140 bp, Artificial Sequence
  Synthetic
atggccgactcccaagtacgccaggtcgtattccggtctgggagggtcaccaggaggggcggagtacctggtcatagcctgcgcgaaggctctcaggttccgctcgtcctcctcaaccccggagacccagcatggcgtat

SEQ ID NO: 388031 - DNA, 140 bp, Artificial Sequence
  Synthetic
atacgccatgctgggtctccgtcagcctcaccccggctgtctctgcttgatccagcaccgtgcctatacccagtatggaggtagcgtcttgcgcgtgacattcatcgcagatgatcacgtcgtacttgggagtcggccat

SEQ ID NO: 388032 - DNA, 140 bp, Artificial Sequence
  Synthetic
atggccgactcccaagtacgacgtgatcatctgcgatgaatgtcacgcgcaagacgctacctccatactgggtataggcacggtgctggatcaagcagagacagccggggtgaggctgacggagacccagcatggcgtat

SEQ ID NO: 388033 - DNA, 140 bp, Artificial Sequence
  Synthetic
atacgccatgctgggtctccgttggggtcaatcccataggcttttgacatgtacgtgccaaaacccagggtagccgctaccgatggatttagcactaggacagaatatccctgtgcaacacgtacttgggagtcggccat

SEQ ID NO: 388034 - DNA, 140 bp, Artificial Sequence
  Synthetic
atggccgactcccaagtacgtgttgcacagggatattctgtcctagtgctaaatccatcggtagcggctaccctgggttttggcacgtacatgtcaaaagcctatgggattgaccccaacggagacccagcatggcgtat

SEQ ID NO: 388035 - DNA, 140 bp, Artificial Sequence
  Synthetic
atacgccatgctgggtctcctaaaagatggagacctgacctgcgtactcagagtttccactggtatgaactgcagggcttttgcgacacctctggtgcacactgccgccctgaagatccccgtacttgggagtcggccat

SEQ ID NO: 388036 - DNA, 140 bp, Artificial Sequence
  Synthetic
atggccgactcccaagtacggggatcttcagggcggcagtgtgcaccagaggtgtcgcaaaagccctgcagttcataccagtggaaactctgagtacgcaggtcaggtctccatcttttaggagacccagcatggcgtat

SEQ ID NO: 388037 - DNA, 140 bp, Artificial Sequence
  Synthetic
atacgccatgctgggtctcccggcgggcggggaggacgtcggcctcacgcgtcaccaggtacaggtcggaagaaccgcacgtgcaggggtcaagggacttggtccccgcaggcgctggcccgtacttgggagtcggccat

SEQ ID NO: 388038 - DNA, 140 bp, Artificial Sequence
  Synthetic
atggccgactcccaagtacgggccagcgcctgcggggaccaagtcccttgacccctgcacgtgcggttcttccgacctgtacctggtgacgcgtgaggccgacgtcctccccgcccgccgggagacccagcatggcgtat

SEQ ID NO: 388039 - DNA, 140 bp, Artificial Sequence
  Synthetic
atacgccatgctgggtctccgaccccccctactgtcgtacccaagaaggtctgggtggccgtggacagcacctgcacctcaccagtcaccacgttcttatccctacctgtcaggctggtgcgtacttgggagtcggccat

SEQ ID NO: 388040 - DNA, 140 bp, Artificial Sequence
  Synthetic
atggccgactcccaagtacgcaccagcctgacaggtagggataagaacgtggtgactggtgaggtgcaggtgctgtccacggccacccagaccttcttgggtacgacagtagggggggtcggagacccagcatggcgtat

SEQ ID NO: 388041 - DNA, 140 bp, Artificial Sequence
  Synthetic
atacgccatgctgggtctccacaactcgcggcccaaccgcgccgaaacgggcaacccgcacaagatgtctccgcaggctgctgtgtctgcaccccaggtgataaccttaatctccataggcgtacttgggagtcggccat

SEQ ID NO: 388042 - DNA, 140 bp, Artificial Sequence
  Synthetic
atggccgactcccaagtacgcctatggagattaaggttatcacctggggtgcagacacagcagcctgcggagacatcttgtgcgggttgcccgtttcggcgcggttgggccgcgagttgtggagacccagcatggcgtat

SEQ ID NO: 388043 - DNA, 140 bp, Artificial Sequence
  Synthetic
aggccctggctgctgatatgcggagcgcctccttgtgacatcggaggggtgggcaacaacaccttatactgccccactgactgcttccgcaaacatccggaagccacatactctcggtgtgaccttttgggacagcggtg

SEQ ID NO: 388044 - DNA, 140 bp, Artificial Sequence
  Synthetic
caccgctgtcccaaaaggtcacaccgagagtatgtggcttccggatgtttgcggaagcagtcagtggggcagtataaggtgttgttgcccacccctccgatgtcacaaggaggcgctccgcatatcagcagccagggcct

SEQ ID NO: 388045 - DNA, 140 bp, Artificial Sequence
  Synthetic
atacgccatgctgggtctcccaccggccaaccgtcagcacggccatttggacgtacttccctcccattgcagagcgcaccaacatgcagatacgaatcaacacgtgggcgcggacaaagtcgtacttgggagtcggccat

SEQ ID NO: 388046 - DNA, 140 bp, Artificial Sequence
  Synthetic
atggccgactcccaagtacgactttgtccgcgcccacgtgttgattcgtatctgcatgttggtgcgctctgcaatgggagggaagtacgtccaaatggccgtgctgacggttggccggtgggagacccagcatggcgtat

SEQ ID NO: 388047 - DNA, 140 bp, Artificial Sequence
  Synthetic
aggccctggctgctgatatgcctccggtggtacatgggtgcccattgccacctactaaggcccctccaataccacctccacggaggaaaaggacggttgtcctgacagaatctactgtgtgaccttttgggacagcggtg

SEQ ID NO: 388048 - DNA, 140 bp, Artificial Sequence
  Synthetic
caccgctgtcccaaaaggtcacacagtagattctgtcaggacaaccgtccttttcctccgtggaggtggtattggaggggccttagtaggtggcaatgggcacccatgtaccaccggaggcatatcagcagccagggcct

SEQ ID NO: 388049 - DNA, 140 bp, Artificial Sequence
  Synthetic
atacgccatgctgggtctcctgctagtaaaatcacactgtcccgactacctcgaacaagcaggggggggacccatacttgcaaggcggcctcacccctgcatatggcatactggttccaccgtacttgggagtcggccat

SEQ ID NO: 388050 - DNA, 140 bp, Artificial Sequence
  Synthetic
atggccgactcccaagtacggtggaaccagtatgccatatgcaggggtgaggccgccttgcaagtatgggtcccccccctgcttgttcgaggtagtcgggacagtgtgattttactagcaggagacccagcatggcgtat

SEQ ID NO: 388051 - DNA, 140 bp, Artificial Sequence
  Synthetic
atacgccatgctgggtctccacctcatggggtacatccccgtcgtaggcgccccgcttggtggcgtcgccagagctctcgcgcacggcgtgagagtcctggaggacggggttaattttgccgtacttgggagtcggccat

SEQ ID NO: 388052 - DNA, 140 bp, Artificial Sequence
  Synthetic
atggccgactcccaagtacggcaaaattaaccccgtcctccaggactctcacgccgtgcgcgagagctctggcgacgccaccaagcggggcgcctacgacggggatgtaccccatgaggtggagacccagcatggcgtat

SEQ ID NO: 388053 - DNA, 140 bp, Artificial Sequence
  Synthetic
atacgccatgctgggtctcctccaagcgtaagcacgctgagggagcaggaggtcgagcagggctaggggccacaggcctgtcaaaccataggttatcagcggaacgagcttcccccggatcgtacttgggagtcggccat

SEQ ID NO: 388054 - DNA, 140 bp, Artificial Sequence
  Synthetic
atggccgactcccaagtacgatccgggggaagctcgttccgctgataacctatggtttgacaggcctgtggcccctagccctgctcgacctcctgctccctcagcgtgcttacgcttggaggagacccagcatggcgtat

SEQ ID NO: 388055 - DNA, 140 bp, Artificial Sequence
  Synthetic
atacgccatgctgggtctccgcctgagaaatcagtaacatcatccagagggccacacacacgcgtgcgtccgccagaacgaggatcacctcctgcagcttgtcccacttgagagcccagccgtacttgggagtcggccat

SEQ ID NO: 388056 - DNA, 140 bp, Artificial Sequence
  Synthetic
atggccgactcccaagtacggctgggctctcaagtgggacaagctgcaggaggtgatcctcgttctggcggacgcacgcgtgtgtgtggccctctggatgatgttactgatttctcaggcggagacccagcatggcgtat

SEQ ID NO: 388057 - DNA, 140 bp, Artificial Sequence
  Synthetic
atacgccatgctgggtctcccgttggcataatatcgctctgtcagcttgaatggagcagtggttgaacgagactgccctctgctagatgttctacacagcgctctcccctcgaggacaagcgtacttgggagtcggccat

SEQ ID NO: 388058 - DNA, 140 bp, Artificial Sequence
  Synthetic
atggccgactcccaagtacgcttgtcctcgaggggagagcgctgtgtagaacatctagcagagggcagtctcgttcaaccactgctccattcaagctgacagagcgatattatgccaacgggagacccagcatggcgtat

SEQ ID NO: 388059 - DNA, 140 bp, Artificial Sequence
  Synthetic
aggccctggctgctgatatgagcggggctcactggggcgtcatgttcggcctagcctacttctccatgcagggagcgtgggcgaaggtcgttgtcatccttctgctgaccgctggggtgggaccttttgggacagcggtg

SEQ ID NO: 388060 - DNA, 140 bp, Artificial Sequence
  Synthetic
caccgctgtcccaaaaggtcccaccccagcggtcagcagaaggatgacaacgaccttcgcccacgctccctgcatggagaagtaggctaggccgaacatgacgccccagtgagccccgctcatatcagcagccagggcct

SEQ ID NO: 388061 - DNA, 140 bp, Artificial Sequence
  Synthetic
atacgccatgctgggtctcctctctaggtctgtgcttggcgtaagccagggcccggtgcccgtgcgggataacgaccgtagttggtgcttcctgaaacaatcggatgccgttttaacctgcgtacttgggagtcggccat

SEQ ID NO: 388062 - DNA, 140 bp, Artificial Sequence
  Synthetic
atggccgactcccaagtacgcaggttaaaacggcatccgattgtttcaggaagcaccaactacggtcgttatcccgcacgggcaccgggccctggcttacgccaagcacagacctagagaggagacccagcatggcgtat

SEQ ID NO: 388063 - DNA, 140 bp, Artificial Sequence
  Synthetic
atacgccatgctgggtctccttcaccagcctcttcacgcgtggccctcaacagcagattcagctcatcaacaccaatggcagttggcacatcaaccgcactgccctgaattgcaatgactcgtacttgggagtcggccat

SEQ ID NO: 388064 - DNA, 140 bp, Artificial Sequence
  Synthetic
atggccgactcccaagtacgagtcattgcaattcagggcagtgcggttgatgtgccaactgccattggtgttgatgagctgaatctgctgttgagggccacgcgtgaagaggctggtgaaggagacccagcatggcgtat

SEQ ID NO: 388065 - DNA, 140 bp, Artificial Sequence
  Synthetic
atacgccatgctgggtctccggctgcccgtgtaacggccatactctcatctctgactgtgacatccctcctgaggcggttgcacaagtggatcaatgaagactgccccactccgtgtgaccgtacttgggagtcggccat

SEQ ID NO: 388066 - DNA, 140 bp, Artificial Sequence
  Synthetic
atggccgactcccaagtacggtcacacggagtggggcagtcttcattgatccacttgtgcaaccgcctcaggagggatgtcacagtcagagatgagagtatggccgttacacgggcagccggagacccagcatggcgtat

SEQ ID NO: 388067 - DNA, 140 bp, Artificial Sequence
  Synthetic
atacgccatgctgggtctccaagcaccgcgctaccccccgagagttagaggtcaacaagaagacatctgagtcgttgtcaggtttggatattcttggcaggcctttaatatcagtggtcccgtacttgggagtcggccat

SEQ ID NO: 388068 - DNA, 140 bp, Artificial Sequence
  Synthetic
atggccgactcccaagtacgggaccactgatattaaaggcctgccaagaatatccaaacctgacaacgactcagatgtcttcttgttgacctctaactctcggggggtagcgcggtgcttggagacccagcatggcgtat

SEQ ID NO: 388069 - DNA, 140 bp, Artificial Sequence
  Synthetic
aggccctggctgctgatatgtcggataggatggggcaccttgcaatacgaggataatgtcaccaacccagaagatatgagaccatactgctggcactacccaccaaaacaatgtggcatagaccttttgggacagcggtg

SEQ ID NO: 388070 - DNA, 140 bp, Artificial Sequence
  Synthetic
caccgctgtcccaaaaggtctatgccacattgttttggtgggtagtgccagcagtatggtctcatatcttctgggttggtgacattatcctcgtattgcaaggtgccccatcctatccgacatatcagcagccagggcct

SEQ ID NO: 388071 - DNA, 140 bp, Artificial Sequence
  Synthetic
atacgccatgctgggtctccagtgaggagtgaccctgcatttatgttagcatctgtcaatggcccccaggccactaactttaaacagatgggcttacagctggacattcggtcaggcgaccgtacttgggagtcggccat

SEQ ID NO: 388072 - DNA, 140 bp, Artificial Sequence
  Synthetic
atggccgactcccaagtacggtcgcctgaccgaatgtccagctgtaagcccatctgtttaaagttagtggcctgggggccattgacagatgctaacataaatgcagggtcactcctcactggagacccagcatggcgtat

SEQ ID NO: 388073 - DNA, 140 bp, Artificial Sequence
  Synthetic
atacgccatgctgggtctccgcgagaatgagacagatgtcttcctattgaacagcacccgaccaccgcgggggtcatggttcggctgcacgtggatgaactccactggcttcaccaagaccgtacttgggagtcggccat

SEQ ID NO: 388074 - DNA, 140 bp, Artificial Sequence
  Synthetic
atggccgactcccaagtacggtcttggtgaagccagtggagttcatccacgtgcagccgaaccatgacccccgcggtggtcgggtgctgttcaataggaagacatctgtctcattctcgcggagacccagcatggcgtat

SEQ ID NO: 388075 - DNA, 140 bp, Artificial Sequence
  Synthetic
atacgccatgctgggtctccgggtcatggttcggctgcacgtggatgaactccactggcttcaccaagacttgtggcgcaccaccttgccgcactagagctgacttcaacgccagcacggcgtacttgggagtcggccat

SEQ ID NO: 388076 - DNA, 140 bp, Artificial Sequence
  Synthetic
atggccgactcccaagtacgccgtgctggcgttgaagtcagctctagtgcggcaaggtggtgcgccacaagtcttggtgaagccagtggagttcatccacgtgcagccgaaccatgacccggagacccagcatggcgtat

SEQ ID NO: 388077 - DNA, 140 bp, Artificial Sequence
  Synthetic
atacgccatgctgggtctccttgtggcgcaccaccttgccgcactagagctgacttcaacgccagcacggacctgttgtgccccacggactgttttaggaagcatcctgaagccacttaccgtacttgggagtcggccat

SEQ ID NO: 388078 - DNA, 140 bp, Artificial Sequence
  Synthetic
atggccgactcccaagtacggtaagtggcttcaggatgcttcctaaaacagtccgtggggcacaacaggtccgtgctggcgttgaagtcagctctagtgcggcaaggtggtgcgccacaaggagacccagcatggcgtat

SEQ ID NO: 388079 - DNA, 140 bp, Artificial Sequence
  Synthetic
aggccctggctgctgatatggagccgcggtgtgcacccgtggagtggctaaggcggtggactttatccccgtagagagcctagagacaaccatgaggtccccggtgttcacagacaattcgaccttttgggacagcggtg

SEQ ID NO: 388080 - DNA, 140 bp, Artificial Sequence
  Synthetic
caccgctgtcccaaaaggtcgaattgtctgtgaacaccggggacctcatggttgtctctaggctctctacggggataaagtccaccgccttagccactccacgggtgcacaccgcggctccatatcagcagccagggcct

SEQ ID NO: 388081 - DNA, 140 bp, Artificial Sequence
  Synthetic
atacgccatgctgggtctccgtagagagcctagagacaaccatgaggtccccggtgttcacagacaattcctccccaccagcagtgccccagtgctaccaggtggcccacctgcatgctccgtacttgggagtcggccat

SEQ ID NO: 388082 - DNA, 140 bp, Artificial Sequence
  Synthetic
atggccgactcccaagtacggagcatgcaggtgggccacctggtagcactggggcactgctggtggggaggaattgtctgtgaacaccggggacctcatggttgtctctaggctctctacggagacccagcatggcgtat

SEQ ID NO: 388083 - DNA, 140 bp, Artificial Sequence
  Synthetic
atacgccatgctgggtctcccgccccacgaccaggtcaaagaacgtatgggggtacgcgtagttctcagatatcactagcccgattgcgggggagcagttgttctagtatagggttgccacgtacttgggagtcggccat

SEQ ID NO: 388084 - DNA, 140 bp, Artificial Sequence
  Synthetic
atggccgactcccaagtacgtggcaaccctatactagaacaactgctcccccgcaatcgggctagtgatatctgagaactacgcgtacccccatacgttctttgacctggtcgtggggcgggagacccagcatggcgtat

SEQ ID NO: 388085 - DNA, 140 bp, Artificial Sequence
  Synthetic
atacgccatgctgggtctcccacggccccgaaggcgtcatcgaccaattcacgactcgtgtccgttggcggggccaccaacatattgacatgtattgcctagctgcgccaggtcacaccacgtacttgggagtcggccat

SEQ ID NO: 388086 - DNA, 140 bp, Artificial Sequence
  Synthetic
atggccgactcccaagtacgtggtgtgacctggcgcagctaggcaatacatgtcaatatgttggtggccccgccaacggacacgagtcgtgaattggtcgatgacgccttcggggccgtgggagacccagcatggcgtat

SEQ ID NO: 388087 - DNA, 140 bp, Artificial Sequence
  Synthetic
atacgccatgctgggtctcccgtcgtcggcctcatacacaatgctcctgttggagcagtcgttggtaagcattatatggccagacgcattcctgtactccagactggacgcggggcaagtcgtacttgggagtcggccat

SEQ ID NO: 388088 - DNA, 140 bp, Artificial Sequence
  Synthetic
atggccgactcccaagtacgacttgccccgcgtccagtctggagtacaggaatgcgtctggccatataatgcttaccaacgactgctccaacaggagcattgtgtatgaggccgacgacgggagacccagcatggcgtat

SEQ ID NO: 388089 - DNA, 140 bp, Artificial Sequence
  Synthetic
aggccctggctgctgatatgtcaagggtcgggcggtccccttggccgcctattccctcactggcctatggcccttctgcctactggtcctagcactgccccaacaggcttatgcttatgagaccttttgggacagcggtg

SEQ ID NO: 388090 - DNA, 140 bp, Artificial Sequence
  Synthetic
caccgctgtcccaaaaggtctcataagcataagcctgttggggcagtgctaggaccagtaggcagaagggccataggccagtgagggaataggcggccaaggggaccgcccgacccttgacatatcagcagccagggcct

SEQ ID NO: 388091 - DNA, 140 bp, Artificial Sequence
  Synthetic
  misc_feature (42)..(42): n is a, c, g, or t
atacgccatgctgggtctcctgcatctgtgcacggacagatnggcgcggttctgttgatactgattaccctctttacactcaccccgggttataagactcttctcagccggtgcctgtggcgtacttgggagtcggccat

SEQ ID NO: 388092 - DNA, 140 bp, Artificial Sequence
  Synthetic
  misc_feature (99)..(99): n is a, c, g, or t
atggccgactcccaagtacgccacaggcaccggctgagaagagtcttataacccggggtgagtgtaaagagggtaatcagtatcaacagaaccgcgccnatctgtccgtgcacagatgcaggagacccagcatggcgtat

SEQ ID NO: 388093 - DNA, 140 bp, Artificial Sequence
  Synthetic
atacgccatgctgggtctccgcgagggctcttgcgacgccccctacaggggcgccgatgagcggaatgtaccccatgaggtcggcaaatccgcacgttagggtatcgatgaccttacccacgtacttgggagtcggccat

SEQ ID NO: 388094 - DNA, 140 bp, Artificial Sequence
  Synthetic
atggccgactcccaagtacgtgggtaaggtcatcgataccctaacgtgcggatttgccgacctcatggggtacattccgctcatcggcgcccctgtagggggcgtcgcaagagccctcgcggagacccagcatggcgtat

SEQ ID NO: 388095 - DNA, 140 bp, Artificial Sequence
  Synthetic
atacgccatgctgggtctccgaggggccaagggtacccgggctgggcccaggaccggccctcgcgcgggcgtgccttgggggtaggctgacgccgtccgcgaggttgtgatcgctcggaacgtacttgggagtcggccat

SEQ ID NO: 388096 - DNA, 140 bp, Artificial Sequence
  Synthetic
atggccgactcccaagtacgttccgagcgatcacaacctcgcggacggcgtcagcctacccccaaggcacgcccgcgcgagggccggtcctgggcccagcccgggtacccttggcccctcggagacccagcatggcgtat

SEQ ID NO: 388097 - DNA, 140 bp, Artificial Sequence
  Synthetic
atacgccatgctgggtctcccttcgtcagagctcacgctctgctgaggatgtgcactgtggtgaggcacctcgcggggggtaggtacgtccagatggcgctattagcccttggtaggtggcgtacttgggagtcggccat

SEQ ID NO: 388098 - DNA, 140 bp, Artificial Sequence
  Synthetic
atggccgactcccaagtacgccacctaccaagggctaatagcgccatctggacgtacctaccccccgcgaggtgcctcaccacagtgcacatcctcagcagagcgtgagctctgacgaagggagacccagcatggcgtat

SEQ ID NO: 388099 - DNA, 140 bp, Artificial Sequence
  Synthetic
atacgccatgctgggtctcctcgcggggggtaggtacgtccagatggcgctattagcccttggtaggtggaccggcacttacatctatgaccacctcacccctatgtcggattgggctgccgtacttgggagtcggccat

SEQ ID NO: 388100 - DNA, 140 bp, Artificial Sequence
  Synthetic
atggccgactcccaagtacggcagcccaatccgacataggggtgaggtggtcatagatgtaagtgccggtccacctaccaagggctaatagcgccatctggacgtacctaccccccgcgaggagacccagcatggcgtat

SEQ ID NO: 388101 - DNA, 140 bp, Artificial Sequence
  Synthetic
atacgccatgctgggtctccggcggcggagtgtgtttctttttgtttgtcttttaggtttaggaagtgtgctcatgttgcacggtctacgagacctcccggggcactcgcaagcaccctacgtacttgggagtcggccat

SEQ ID NO: 388102 - DNA, 140 bp, Artificial Sequence
  Synthetic
atggccgactcccaagtacgtagggtgcttgcgagtgccccgggaggtctcgtagaccgtgcaacatgagcacacttcctaaacctaaaagacaaacaaaaagaaacacactccgccgccggagacccagcatggcgtat

SEQ ID NO: 388103 - DNA, 140 bp, Artificial Sequence
  Synthetic
atacgccatgctgggtctccaaaggacccggtcatcccggcgattccggtgtactcaccggttccgcagaccactatggctctcccggaaggggggggcctggaggctgcacgacactcgcgtacttgggagtcggccat

SEQ ID NO: 388104 - DNA, 140 bp, Artificial Sequence
  Synthetic
atggccgactcccaagtacgcgagtgtcgtgcagcctccaggccccccccttccgggagagccatagtggtctgcggaaccggtgagtacaccggaatcgccgggatgaccgggtcctttggagacccagcatggcgtat

SEQ ID NO: 388105 - DNA, 140 bp, Artificial Sequence
  Synthetic
atacgccatgctgggtctccgtcagcatgacggggcgcgacaagacagaacaggccggggaaatccaaatcctgtccacggtcacccagtccttcctcggaacatccattgcgggggtcccgtacttgggagtcggccat

SEQ ID NO: 388106 - DNA, 140 bp, Artificial Sequence
  Synthetic
atggccgactcccaagtacgggacccccgcaatggatgttccgaggaaggactgggtgaccgtggacaggatttggatttccccggcctgttctgtcttgtcgcgccccgtcatgctgacggagacccagcatggcgtat

SEQ ID NO: 388107 - DNA, 140 bp, Artificial Sequence
  Synthetic
atacgccatgctgggtctccgcccagccctcctgggaccaaatctttggagccgtgcacgtgtggagcggtcgacctgtacctggtcacgcggaacgctgatgtcatcccggctcgaagacgtacttgggagtcggccat

SEQ ID NO: 388108 - DNA, 140 bp, Artificial Sequence
  Synthetic
atggccgactcccaagtacgtcttcgagccgggatgacatcagcgttccgcgtgaccaggtacaggtcgaccgctccacacgtgcacggctccaaagatttggtcccaggagggctgggcggagacccagcatggcgtat

SEQ ID NO: 388109 - DNA, 140 bp, Artificial Sequence
  Synthetic
aggccctggctgctgatatgctgtcaactttaccatcttcaaggttaggatgtatgtggggggcgtggagcacaggctcgacgccgcatgcaactggacccgaggagagcgttgtgacttgaccttttgggacagcggtg

SEQ ID NO: 388110 - DNA, 140 bp, Artificial Sequence
  Synthetic
caccgctgtcccaaaaggtcaagtcacaacgctctcctcgggtccagttgcatgcggcgtcgagcctgtgctccacgccccccacatacatcctaaccttgaagatggtaaagttgacagcatatcagcagccagggcct

SEQ ID NO: 388111 - DNA, 140 bp, Artificial Sequence
  Synthetic
aggccctggctgctgatatgcatcatcatatgcgatgaatgccacgccgtggatgctaccaccatcctcggcatcggaacagttcttgaccaagcagagacagccggggtcaggctaactgaccttttgggacagcggtg

SEQ ID NO: 388112 - DNA, 140 bp, Artificial Sequence
  Synthetic
caccgctgtcccaaaaggtcagttagcctgaccccggctgtctctgcttggtcaagaactgttccgatgccgaggatggtggtagcatccacggcgtggcattcatcgcatatgatgatgcatatcagcagccagggcct

SEQ ID NO: 388113 - DNA, 140 bp, Artificial Sequence
  Synthetic
atacgccatgctgggtctccctcaaggagatgtagtggtcgtcgccaccgacgccctcatgacggggtatactggagactttgacaccgtgatcgactgcaacgtagcggtcactcaagtcgtacttgggagtcggccat

SEQ ID NO: 388114 - DNA, 140 bp, Artificial Sequence
  Synthetic
atggccgactcccaagtacgacttgagtgaccgctacgttgcagtcgatcacggtgtcaaagtctccagtataccccgtcatgagggcgtcggtggcgacgaccactacatctccttgagggagacccagcatggcgtat

SEQ ID NO: 388115 - DNA, 140 bp, Artificial Sequence
  Synthetic
atacgccatgctgggtctccctcaagacgctgtctcacgtagccagcgccgggggcgcacaggtagaggaagattgggtatttataggtatgtttccactggtgagcgagcctcaggaatcgtacttgggagtcggccat

SEQ ID NO: 388116 - DNA, 140 bp, Artificial Sequence
  Synthetic
atggccgactcccaagtacgattcctgaggctcgctcaccagtggaaacatacctataaatacccaatcttcctctacctgtgcgcccccggcgctggctacgtgagacagcgtcttgagggagacccagcatggcgtat

SEQ ID NO: 388117 - DNA, 140 bp, Artificial Sequence
  Synthetic
aggccctggctgctgatatgttgagcccgtcgtcttctctgacatggagaccaagatcatcacctggggggcagacaccgcggcgtgcggggacatcatcttgggtctgcccgtctccgcgaccttttgggacagcggtg

SEQ ID NO: 388118 - DNA, 140 bp, Artificial Sequence
  Synthetic
caccgctgtcccaaaaggtcgcggagacgggcagacccaagatgatgtccccgcacgccgcggtgtctgccccccaggtgatgatcttggtctccatgtcagagaagacgacgggctcaacatatcagcagccagggcct

SEQ ID NO: 388119 - DNA, 140 bp, Artificial Sequence
  Synthetic
aggccctggctgctgatatgccggcacgttggcccgggcgagggagcagtgcagtggatgaaccggctgatagccttcgcctcccgggggaaccatgtttcccccacgcactacgtgccggaccttttgggacagcggtg

SEQ ID NO: 388120 - DNA, 140 bp, Artificial Sequence
  Synthetic
caccgctgtcccaaaaggtccggcacgtagtgcgtgggggaaacatggttcccccgggaggcgaaggctatcagccggttcatccactgcactgctccctcgcccgggccaacgtgccggcatatcagcagccagggcct

SEQ ID NO: 388121 - DNA, 140 bp, Artificial Sequence
  Synthetic
atacgccatgctgggtctcctgggctctgttaccaacgaggtcaccctcacacatcctgtgacaaaatacatcgccacatgcatgcaagctgaccttgaggtcatgaccagcacgtgggtcgtacttgggagtcggccat

SEQ ID NO: 388122 - DNA, 140 bp, Artificial Sequence
  Synthetic
atggccgactcccaagtacgacccacgtgctggtcatgacctcaaggtcagcttgcatgcatgtggcgatgtattttgtcacaggatgtgtgagggtgacctcgttggtaacagagcccaggagacccagcatggcgtat

SEQ ID NO: 388123 - DNA, 140 bp, Artificial Sequence
  Synthetic
atacgccatgctgggtctccggtgtgtttccatcatcggccgtttgcacatcaaccagcgagccgtcgttgcaccggacaaggaggtcctctatgaggcttttgatgagatggaggaatgcgtacttgggagtcggccat

SEQ ID NO: 388124 - DNA, 140 bp, Artificial Sequence
  Synthetic
atggccgactcccaagtacgcattcctccatctcatcaaaagcctcatagaggacctccttgtccggtgcaacgacggctcgctggttgatgtgcaaacggccgatgatggaaacacaccggagacccagcatggcgtat

SEQ ID NO: 388125 - DNA, 140 bp, Artificial Sequence
  Synthetic
atacgccatgctgggtctcctatcaacactgccagggaaccctgctgtagcttccatgatggcattcagtgccgccctcaccagtccgttgtcaactagcaccactatccttctcaacatcgtacttgggagtcggccat

SEQ ID NO: 388126 - DNA, 140 bp, Artificial Sequence
  Synthetic
atggccgactcccaagtacgatgttgagaaggatagtggtgctagttgacaacggactggtgagggcggcactgaatgccatcatggaagctacagcagggttccctggcagtgttgataggagacccagcatggcgtat

SEQ ID NO: 388127 - DNA, 140 bp, Artificial Sequence
  Synthetic
atacgccatgctgggtctccttacccggtagggtcgcagttgccttgcgagcctgaaccggacgtggctgtgttaacgtccatgctcactgatccatctcatataacggcagaggcggctcgtacttgggagtcggccat

SEQ ID NO: 388128 - DNA, 140 bp, Artificial Sequence
  Synthetic
atggccgactcccaagtacgagccgcctctgccgttatatgagatggatcagtgagcatggacgttaacacagccacgtccggttcaggctcgcaaggcaactgcgaccctaccgggtaaggagacccagcatggcgtat

SEQ ID NO: 388129 - DNA, 140 bp, Artificial Sequence
  Synthetic
aggccctggctgctgatatgggtaaggtgctggtggacatcctggcagggtatggtgcgggcatttcgggggctctcgtcgcattcaagatcatgtctggcgagaagccctccatggagggaccttttgggacagcggtg

SEQ ID NO: 388130 - DNA, 140 bp, Artificial Sequence
  Synthetic
caccgctgtcccaaaaggtccctccatggagggcttctcgccagacatgatcttgaatgcgacgagagcccccgaaatgcccgcaccataccctgccaggatgtccaccagcaccttacccatatcagcagccagggcct

SEQ ID NO: 388131 - DNA, 140 bp, Artificial Sequence
  Synthetic
aggccctggctgctgatatgtgcaaatccataggtttgctcccacgccaaagccgtttttccgggatgaggtctcgttcagcgttgggctcaattcatttgtcgtcgggtctcagcttccgaccttttgggacagcggtg

SEQ ID NO: 388132 - DNA, 140 bp, Artificial Sequence
  Synthetic
caccgctgtcccaaaaggtcggaagctgagacccgacgacaaatgaattgagcccaacgctgaacgagacctcatcccggaaaaacggctttggcgtgggagcaaacctatggatttgcacatatcagcagccagggcct

SEQ ID NO: 388133 - DNA, 140 bp, Artificial Sequence
  Synthetic
aggccctggctgctgatatgatgccaacctgttcatggggggcgatgtgacccggatagagtccgagtccaaagtggttgttctggactctctcgacccaatggccgaagaaaggagcgagaccttttgggacagcggtg

SEQ ID NO: 388134 - DNA, 140 bp, Artificial Sequence
  Synthetic
caccgctgtcccaaaaggtctcgctcctttcttcggccattgggtcgagagagtccagaacaaccactttggactcggactctatccgggtcacatcgccccccatgaacaggttggcatcatatcagcagccagggcct

SEQ ID NO: 388135 - DNA, 140 bp, Artificial Sequence
  Synthetic
aggccctggctgctgatatggtggagggcgaggtccagattgtgtcaactgctgcccagactttcctggcaacatgtatcaatggggtatgctggactgtctaccacggggccggaacgagaccttttgggacagcggtg

SEQ ID NO: 388136 - DNA, 140 bp, Artificial Sequence
  Synthetic
caccgctgtcccaaaaggtctcgttccggccccgtggtagacagtccagcataccccattgatacatgttgccaggaaagtctgggcagcagttgacacaatctggacctcgccctccaccatatcagcagccagggcct

SEQ ID NO: 388137 - DNA, 140 bp, Artificial Sequence
  Synthetic
atacgccatgctgggtctccgaaccgtggaaaagggcagattaccaaccgcccgccgttgcgggctgtgctctccccccccctaagaaaaccccgaccccccccccaaggaaaccccggacgtacttgggagtcggccat

SEQ ID NO: 388138 - DNA, 140 bp, Artificial Sequence
  Synthetic
atggccgactcccaagtacgtccggggtttccttggggggggggtcggggttttcttagggggggggagagcacagcccgcaacggcgggcggttggtaatctgcccttttccacggttcggagacccagcatggcgtat

SEQ ID NO: 388139 - DNA, 140 bp, Artificial Sequence
  Synthetic
atacgccatgctgggtctcccagtgggtctgaacgagagcactatagcagatgccctccagcagctggccattaaaaccttcggccagccccctccaagcggggattcaggcctctctaccgtacttgggagtcggccat

SEQ ID NO: 388140 - DNA, 140 bp, Artificial Sequence
  Synthetic
atggccgactcccaagtacggtagagaggcctgaatccccgcttggagggggctggccgaaggttttaatggccagctgctggagggcatctgctatagtgctctcgttcagacccactgggagacccagcatggcgtat

SEQ ID NO: 388141 - DNA, 140 bp, Artificial Sequence
  Synthetic
atacgccatgctgggtctccgggggcggacgccgccgattccggcggtcagacgccccctgatgagttggctcattcggagacaggttccatctcctccatgccccccctcgagggggagcgtacttgggagtcggccat

SEQ ID NO: 388142 - DNA, 140 bp, Artificial Sequence
  Synthetic
atggccgactcccaagtacgctccccctcgagggggggcatggaggagatggaacctgtctccgaatgagccaactcatcagggggcgtctgaccgccggaatcggcggcgtccgcccccggagacccagcatggcgtat

SEQ ID NO: 388143 - DNA, 140 bp, Artificial Sequence
  Synthetic
atacgccatgctgggtctccccaaaaatgaggtgttctgcgtggaccccaccaaggggggtaagaaagcagctcgccttatcgtttaccctgacctcggtgtcagggtctgcgagaaaatcgtacttgggagtcggccat

SEQ ID NO: 388144 - DNA, 140 bp, Artificial Sequence
  Synthetic
atggccgactcccaagtacgattttctcgcagaccctgacaccgaggtcagggtaaacgataaggcgagctgctttcttaccccccttggtggggtccacgcagaacacctcatttttggggagacccagcatggcgtat

SEQ ID NO: 388145 - DNA, 140 bp, Artificial Sequence
  Synthetic
atacgccatgctgggtctccgccccaagcagaatatccagctgatcaacaccaacggcagttggcacatcaatcgcactgccttgaactgcaatgcgagcctcgaaactggctggatagccgtacttgggagtcggccat

SEQ ID NO: 388146 - DNA, 140 bp, Artificial Sequence
  Synthetic
atggccgactcccaagtacggctatccagccagtttcgaggctcgcattgcagttcaaggcagtgcgattgatgtgccaactgccgttggtgttgatcagctggatattctgcttggggcggagacccagcatggcgtat

SEQ ID NO: 388147 - DNA, 140 bp, Artificial Sequence
  Synthetic
aggccctggctgctgatatgagccctccgacgacggcgacgcgggatccgacgttgagtcgtactcctccatgcccccccttgagggagagccgggggaccccgatctcagcgacgggtcgaccttttgggacagcggtg

SEQ ID NO: 388148 - DNA, 140 bp, Artificial Sequence
  Synthetic
caccgctgtcccaaaaggtcgacccgtcgctgagatcggggtcccccggctctccctcaagggggggcatggaggagtacgactcaacgtcggatcccgcgtcgccgtcgtcggagggctcatatcagcagccagggcct

SEQ ID NO: 388149 - DNA, 140 bp, Artificial Sequence
  Synthetic
aggccctggctgctgatatgggcgcgcctacctacaattggggtagtaatgacacggacgtcttcgtccttaataacaccaggccaccgttgggcaattggttcggttgcacctggatgagaccttttgggacagcggtg

SEQ ID NO: 388150 - DNA, 140 bp, Artificial Sequence
  Synthetic
caccgctgtcccaaaaggtctcatccaggtgcaaccgaaccaattgcccaacggtggcctggtgttattaaggacgaagacgtccgtgtcattactaccccaattgtaggtaggcgcgcccatatcagcagccagggcct

SEQ ID NO: 388151 - DNA, 140 bp, Artificial Sequence
  Synthetic
aggccctggctgctgatatgtaataacaccaggccaccgttgggcaattggttcggttgcacctggatgaactcatctggatttaccaaagtgtgcggagcgcctccttgtgtcatcggagaccttttgggacagcggtg

SEQ ID NO: 388152 - DNA, 140 bp, Artificial Sequence
  Synthetic
caccgctgtcccaaaaggtctccgatgacacaaggaggcgctccgcacactttggtaaatccagatgagttcatccaggtgcaaccgaaccaattgcccaacggtggcctggtgttattacatatcagcagccagggcct

SEQ ID NO: 388153 - DNA, 140 bp, Artificial Sequence
  Synthetic
aggccctggctgctgatatgccgaccaacgcccctactgctggcactaccccccaaaaccttgcggtattgtgcccgcgaagagcgtgtgtggcccggtgtattgcttcactcccagcccgaccttttgggacagcggtg

SEQ ID NO: 388154 - DNA, 140 bp, Artificial Sequence
  Synthetic
caccgctgtcccaaaaggtcgggctgggagtgaagcaatacaccgggccacacacgctcttcgcgggcacaataccgcaaggttttggggggtagtgccagcagtaggggcgttggtcggcatatcagcagccagggcct

SEQ ID NO: 388155 - DNA, 140 bp, Artificial Sequence
  Synthetic
atacgccatgctgggtctcccggcgtctctggccgggacgcacggtcttgtgtccttcctcgtgtttttctgctttgcatggcatctgaagggtaagtgggtgcccggagtggcctacgccgtacttgggagtcggccat

SEQ ID NO: 388156 - DNA, 140 bp, Artificial Sequence
  Synthetic
atggccgactcccaagtacggcgtaggccactccgggcacccacttacccttcagatgccatgcaaagcagaaaaacacgaggaaggacacaagaccgtgcgtcccggccagagacgccgggagacccagcatggcgtat

SEQ ID NO: 388157 - DNA, 140 bp, Artificial Sequence
  Synthetic
aggccctggctgctgatatgcgtggggggcagacaccgccgcgtgcggtgacatcatcaacggcttgcccgtctctgcccgtagaggccgagagatactgctcgggccagctgatggaatgaccttttgggacagcggtg

SEQ ID NO: 388158 - DNA, 140 bp, Artificial Sequence
  Synthetic
caccgctgtcccaaaaggtcattccatcagctggcccgagcagtatctctcggcctctacgggcagagacgggcaagccgttgatgatgtcaccgcacgcggcggtgtctgccccccacgcatatcagcagccagggcct

SEQ ID NO: 388159 - DNA, 140 bp, Artificial Sequence
  Synthetic
aggccctggctgctgatatgggatgtacgtgggaggggtcgagcacaggctggaagctgcctgcaactggacgcggggcgaacgttgtgatctggaagacagggacaggtccgagctcaggaccttttgggacagcggtg

SEQ ID NO: 388160 - DNA, 140 bp, Artificial Sequence
  Synthetic
caccgctgtcccaaaaggtcctgagctcggacctgtccctgtcttccagatcacaacgttcgccccgcgtccagttgcaggcagcttccagcctgtgctcgacccctcccacgtacatcccatatcagcagccagggcct

SEQ ID NO: 388161 - DNA, 140 bp, Artificial Sequence
  Synthetic
aggccctggctgctgatatgtggtttgtgcaggaatgcaattgctccatctatcctggtgccatcactggacaccgtatggcatgggacatgatgatgaactggtcgcccacgaccaccagaccttttgggacagcggtg

SEQ ID NO: 388162 - DNA, 140 bp, Artificial Sequence
  Synthetic
caccgctgtcccaaaaggtctggtggtcgtgggcgaccagttcatcatcatgtcccatgccatacggtgtccagtgatggcaccaggatagatggagcaattgcattcctgcacaaaccacatatcagcagccagggcct

SEQ ID NO: 388163 - DNA, 140 bp, Artificial Sequence
  Synthetic
aggccctggctgctgatatggtggacgtgcagtacctgtacggggtggggtcaagcatcgcgtcctgggccattaaatgggagtacgtcgttctcctgttccttctgcttgcagacgcgcgaccttttgggacagcggtg

SEQ ID NO: 388164 - DNA, 140 bp, Artificial Sequence
  Synthetic
caccgctgtcccaaaaggtcgcgcgtctgcaagcagaaggaacaggagaacgacgtactcccatttaatggcccaggacgcgatgcttgaccccaccccgtacaggtactgcacgtccaccatatcagcagccagggcct

SEQ ID NO: 388165 - DNA, 140 bp, Artificial Sequence
  Synthetic
atacgccatgctgggtctccttcgccggcatcttcacctccggccctaagcagaacattcagctcattaacaccaatggcagttggcacatcaaccgcactgccctaaattgcaatgattcgtacttgggagtcggccat

SEQ ID NO: 388166 - DNA, 140 bp, Artificial Sequence
  Synthetic
atggccgactcccaagtacgaatcattgcaatttagggcagtgcggttgatgtgccaactgccattggtgttaatgagctgaatgttctgcttagggccggaggtgaagatgccggcgaaggagacccagcatggcgtat

SEQ ID NO: 388167 - DNA, 140 bp, Artificial Sequence
  Synthetic
aggccctggctgctgatatgctctgtcaccatattacaagcgctatatcagctggtgcttatggtggcttcagtattttctgaccagagtagaagcgcaactgcacgtgtgggttcccccgaccttttgggacagcggtg

SEQ ID NO: 388168 - DNA, 140 bp, Artificial Sequence
  Synthetic
caccgctgtcccaaaaggtcgggggaacccacacgtgcagttgcgcttctactctggtcagaaaatactgaagccaccataagcaccagctgatatagcgcttgtaatatggtgacagagcatatcagcagccagggcct

SEQ ID NO: 388169 - DNA, 140 bp, Artificial Sequence
  Synthetic
aggccctggctgctgatatgaagatatgagaccatactgctggcactacccaccaaaacagtgtggcatattccccgcggggtctgtgtgcggcccagtgtactgtttcacccccagcccgaccttttgggacagcggtg

SEQ ID NO: 388170 - DNA, 140 bp, Artificial Sequence
  Synthetic
caccgctgtcccaaaaggtcgggctgggggtgaaacagtacactgggccgcacacagaccccgcggggaatatgccacactgttttggtgggtagtgccagcagtatggtctcatatcttcatatcagcagccagggcct

SEQ ID NO: 388171 - DNA, 140 bp, Artificial Sequence
  Synthetic
atacgccatgctgggtctccctcactataaccagccttctccgtagactccacaactggattaacggggattggacaacaccgtgtgccacaagttggttgagggacgtgtgggattgggcgtacttgggagtcggccat

SEQ ID NO: 388172 - DNA, 140 bp, Artificial Sequence
  Synthetic
atggccgactcccaagtacgcccaatcccacacgtccctcaaccaacttgtggcacacggtgttgtccaatccccgttaatccagttgtggagtctacggagaaggctggttatagtgagggagacccagcatggcgtat

SEQ ID NO: 388173 - DNA, 140 bp, Artificial Sequence
  Synthetic
atacgccatgctgggtctccatcaaatgtggttctgggccctggctcacgccaaggtgcctggtcgactacccctacaggctctggcattacccctgcacagtcaactattccatctttacgtacttgggagtcggccat

SEQ ID NO: 388174 - DNA, 140 bp, Artificial Sequence
  Synthetic
atggccgactcccaagtacgtaaagatggaatagttgactgtgcaggggtaatgccagagcctgtaggggtagtcgaccaggcaccttggcgtgagccagggcccagaaccacatttgatggagacccagcatggcgtat

SEQ ID NO: 388175 - DNA, 140 bp, Artificial Sequence
  Synthetic
aggccctggctgctgatatgcttaccaattcaaggggggagaactgcggctaccgcaggtgccgcgcgagcggcgtactgacaactagctgtggtaacaccctcacttgctacatcaagggaccttttgggacagcggtg

SEQ ID NO: 388176 - DNA, 140 bp, Artificial Sequence
  Synthetic
caccgctgtcccaaaaggtcccttgatgtagcaagtgagggtgttaccacagctagttgtcagtacgccgctcgcgcggcacctgcggtagccgcagttctccccccttgaattggtaagcatatcagcagccagggcct

SEQ ID NO: 388177 - DNA, 140 bp, Artificial Sequence
  Synthetic
atacgccatgctgggtctcctgcatccgtgcacggacaggtaggcgcggctttgttaatactgattaccctcttcacacttaccccggggtataagaccctcctcagtcggtgtctgtggcgtacttgggagtcggccat

SEQ ID NO: 388178 - DNA, 140 bp, Artificial Sequence
  Synthetic
atggccgactcccaagtacgccacagacaccgactgaggagggtcttataccccggggtaagtgtgaagagggtaatcagtattaacaaagccgcgcctacctgtccgtgcacggatgcaggagacccagcatggcgtat

SEQ ID NO: 388179 - DNA, 140 bp, Artificial Sequence
  Synthetic
aggccctggctgctgatatggcactacgcgccccgaccgtgcggtattgtacccgcggcggaggtgtgcggcccagtgtactgtttcaccccgagccctgttgtggtggggacgactgatgaccttttgggacagcggtg

SEQ ID NO: 388180 - DNA, 140 bp, Artificial Sequence
  Synthetic
caccgctgtcccaaaaggtcatcagtcgtccccaccacaacagggctcggggtgaaacagtacactgggccgcacacctccgccgcgggtacaataccgcacggtcggggcgcgtagtgccatatcagcagccagggcct

SEQ ID NO: 388181 - DNA, 140 bp, Artificial Sequence
  Synthetic
atacgccatgctgggtctccgtgagcatgacggggcgcgacaagacagaacaggccggggaaatccaagtcctgtccacggtcactcagtccttcctcggaacaaccatttcgggggtttcgtacttgggagtcggccat

SEQ ID NO: 388182 - DNA, 140 bp, Artificial Sequence
  Synthetic
atggccgactcccaagtacgaaacccccgaaatggttgttccgaggaaggactgagtgaccgtggacaggacttggatttccccggcctgttctgtcttgtcgcgccccgtcatgctcacggagacccagcatggcgtat

SEQ ID NO: 388183 - DNA, 140 bp, Artificial Sequence
  Synthetic
aggccctggctgctgatatgtgtggactgtttaccacggagctggcaacaagactctagccggctcacggggcccggtcacgcagatgtactcgagtgccgagggggacttggtagggtggaccttttgggacagcggtg

SEQ ID NO: 388184 - DNA, 140 bp, Artificial Sequence
  Synthetic
caccgctgtcccaaaaggtccaccctaccaagtccccctcggcactcgagtacatctgcgtgaccgggccccgtgagccggctagagtcttgttgccagctccgtggtaaacagtccacacatatcagcagccagggcct

SEQ ID NO: 388185 - DNA, 140 bp, Artificial Sequence
  Synthetic
atacgccatgctgggtctccgtgttcttctgtgctgcctggtacatcaagggcaggctggtccctggggcggcatatgctctttacggcgtatggccgctgctcttgctcctgctggcgtcgtacttgggagtcggccat

SEQ ID NO: 388186 - DNA, 140 bp, Artificial Sequence
  Synthetic
atggccgactcccaagtacgacgccagcaggagcaagagcagcggccatacgccgtaaagagcatatgccgccccagggaccagcctgcccttgatgtaccaggcagcacagaagaacacggagacccagcatggcgtat

SEQ ID NO: 388187 - DNA, 140 bp, Artificial Sequence
  Synthetic
aggccctggctgctgatatgccgaggcgcatttgcaagtgtggattccccccctcaacgttcgggggggccgcgacgccatcatcctcctcacgtgtgcggtccacccagagctaatcttgaccttttgggacagcggtg

SEQ ID NO: 388188 - DNA, 140 bp, Artificial Sequence
  Synthetic
caccgctgtcccaaaaggtcaagattagctctgggtggaccgcacacgtgaggaggatgatggcgtcgcggcccccccgaacgttgagggggggaatccacacttgcaaatgcgcctcggcatatcagcagccagggcct

SEQ ID NO: 388189 - DNA, 140 bp, Artificial Sequence
  Synthetic
aggccctggctgctgatatgacgtatggcaaattcctcgccgatgggggctgcgcaggcggcgcctatgacatcatcatatgcgacgaatgccacgctgtggattctaccaccattctcggaccttttgggacagcggtg

SEQ ID NO: 388190 - DNA, 140 bp, Artificial Sequence
  Synthetic
caccgctgtcccaaaaggtccgagaatggtggtagaatccacagcgtggcattcgtcgcatatgatgatgtcataggcgccgcctgcgcagcccccatcggcgaggaatttgccatacgtcatatcagcagccagggcct

SEQ ID NO: 388191 - DNA, 140 bp, Artificial Sequence
  Synthetic
atacgccatgctgggtctccgctagagccaaggcccctcccccgtcctgggacgtcatgtggaagtgtttgacccgacttaagcccacgctcgtgggtcccacacctctcctgtaccgttcgtacttgggagtcggccat

SEQ ID NO: 388192 - DNA, 140 bp, Artificial Sequence
  Synthetic
atggccgactcccaagtacgaacggtacaggagaggtgtgggacccacgagcgtgggcttaagtcgggtcaaacacttccacatgacgtcccaggacgggggaggggccttggctctagcggagacccagcatggcgtat

SEQ ID NO: 388193 - DNA, 140 bp, Artificial Sequence
  Synthetic
aggccctggctgctgatatgccgcagacattccaagtggcccatctacacgctcccactggcagcggtaagagcactagggtgccggctgcatatgcagcccaagggtacaaggtactcggaccttttgggacagcggtg

SEQ ID NO: 388194 - DNA, 140 bp, Artificial Sequence
  Synthetic
caccgctgtcccaaaaggtccgagtaccttgtacccttgggctgcatatgcagccggcaccctagtgctcttaccgctgccagtgggagcgtgtagatgggccacttggaatgtctgcggcatatcagcagccagggcct

SEQ ID NO: 388195 - DNA, 140 bp, Artificial Sequence
  Synthetic
atacgccatgctgggtctcctcctgaacccgtccgttgccgccaccttaggctttggggcgtatatgtctaaggcacatggtgttgaccccaacatcagaactggggtaaggaccatcaccgtacttgggagtcggccat

SEQ ID NO: 388196 - DNA, 140 bp, Artificial Sequence
  Synthetic
atggccgactcccaagtacggtgatggtccttaccccagttctgatgttggggtcaacaccatgtgccttagacatatacgccccaaagcctaaggtggcggcaacggacgggttcaggaggagacccagcatggcgtat

SEQ ID NO: 388197 - DNA, 140 bp, Artificial Sequence
  Synthetic
atacgccatgctgggtctcctgcggtccaatggatgaacaggctcattgcctttgcttccagaggaaaccacgtcgcccctacccactacgtgacggagtcggatgcgtcgcagcgtgtgcgtacttgggagtcggccat

SEQ ID NO: 388198 - DNA, 140 bp, Artificial Sequence
  Synthetic
atggccgactcccaagtacgcacacgctgcgacgcatccgactccgtcacgtagtgggtaggggcgacgtggtttcctctggaagcaaaggcaatgagcctgttcatccattggaccgcaggagacccagcatggcgtat

SEQ ID NO: 388199 - DNA, 140 bp, Artificial Sequence
  Synthetic
aggccctggctgctgatatggactccatggccttagcgcattttcactccacagttactctccaggtgaaatcaatagggtggccgcatgcctcaggaaacttggggtcccgcccttgcggaccttttgggacagcggtg

SEQ ID NO: 388200 - DNA, 140 bp, Artificial Sequence
  Synthetic
caccgctgtcccaaaaggtccgcaagggcgggaccccaagtttcctgaggcatgcggccaccctattgatttcacctggagagtaactgtggagtgaaaatgcgctaaggccatggagtccatatcagcagccagggcct

SEQ ID NO: 388201 - DNA, 140 bp, Artificial Sequence
  Synthetic
atacgccatgctgggtctccgggggcggacgccgccgactccggcagtcggtcgccccctgatgagttggctctttcggaaacaggttctacctcctccatgccccccctcgagggggagcgtacttgggagtcggccat

SEQ ID NO: 388202 - DNA, 140 bp, Artificial Sequence
  Synthetic
atggccgactcccaagtacgctccccctcgagggggggcatggaggaggtagaacctgtttccgaaagagccaactcatcagggggcgaccgactgccggagtcggcggcgtccgcccccggagacccagcatggcgtat

SEQ ID NO: 388203 - DNA, 140 bp, Artificial Sequence
  Synthetic
aggccctggctgctgatatgccaggggggggaggtggctcccggctcggactcggggtcctggtctacttgctccgaggagaatgtctccgtcgttttctgctccatttcatactcctgggaccttttgggacagcggtg

SEQ ID NO: 388204 - DNA, 140 bp, Artificial Sequence
  Synthetic
caccgctgtcccaaaaggtcccaggagtatgaaatggagcagaaaacgacggagacattctcctcggagcaagtagaccaggaccccgagtccgagccgggagccacctcccccccctggcatatcagcagccagggcct

SEQ ID NO: 388205 - DNA, 140 bp, Artificial Sequence
  Synthetic
atacgccatgctgggtctccctacatcaaagagcgcctcactgagggctaaaaaggtaacttttgataggatgcaagtgctcgacgcctattatgactcagtcttaaaggacatcaagctcgtacttgggagtcggccat

SEQ ID NO: 388206 - DNA, 140 bp, Artificial Sequence
  Synthetic
atggccgactcccaagtacgagcttgatgtcctttaagactgagtcataataggcgtcgagcacttgcatcctatcaaaagttacctttttagccctcagtgaggcgctctttgatgtagggagacccagcatggcgtat

SEQ ID NO: 388207 - DNA, 140 bp, Artificial Sequence
  Synthetic
atacgccatgctgggtctccactgagagactttacgtgggagggcccatgtttaacagcaagggccaggcctgcgggtacaggcgttgccgcgccagcggggtgctcaccactagcatggcgtacttgggagtcggccat

SEQ ID NO: 388208 - DNA, 140 bp, Artificial Sequence
  Synthetic
atggccgactcccaagtacgccatgctagtggtgagcaccccgctggcgcggcaacgcctgtacccgcaggcctggcccttgctgttaaacatgggccctcccacgtaaagtctctcagtggagacccagcatggcgtat

SEQ ID NO: 388209 - DNA, 140 bp, Artificial Sequence
  Synthetic
atacgccatgctgggtctccctgcgggtacaggcgttgccgcgccagcggggtgctcaccactagcatggggaacaccatcacatgctatgtgaaagccctagcggcctgtaaggctgcgcgtacttgggagtcggccat

SEQ ID NO: 388210 - DNA, 140 bp, Artificial Sequence
  Synthetic
atggccgactcccaagtacgcgcagccttacaggccgctagggctttcacatagcatgtgatggtgttccccatgctagtggtgagcaccccgctggcgcggcaacgcctgtacccgcagggagacccagcatggcgtat

SEQ ID NO: 388211 - DNA, 140 bp, Artificial Sequence
  Synthetic
atacgccatgctgggtctccgggatagttgcgcccacaatgctggtatgcggcgacgacttggttgtcatctcagaaagccaggggactgaggaggacgagcggaacctgagagccttcacgtacttgggagtcggccat

SEQ ID NO: 388212 - DNA, 140 bp, Artificial Sequence
  Synthetic
atggccgactcccaagtacgtgaaggctctcaggttccgctcgtcctcctcagtcccctggctttctgagatgacaaccaagtcgtcgccgcataccagcattgtgggcgcaactatcccggagacccagcatggcgtat

SEQ ID NO: 388213 - DNA, 140 bp, Artificial Sequence
  Synthetic
atacgccatgctgggtctccacagcgtgtcgcgtgcccgaccccgcttattactccttggcctactcctacttttcgtaggggtaggcctcttcctactccccgctcggtagagcggcaccgtacttgggagtcggccat

SEQ ID NO: 388214 - DNA, 140 bp, Artificial Sequence
  Synthetic
atggccgactcccaagtacggtgccgctctaccgagcggggagtaggaagaggcctacccctacgaaaagtaggagtaggccaaggagtaataagcggggtcgggcacgcgacacgctgtggagacccagcatggcgtat

SEQ ID NO: 388215 - DNA, 140 bp, Artificial Sequence
  Synthetic
aggccctggctgctgatatggtactgcctgatagggtgcttgcgagtgccccgggaggtctcgtagaccgtgcaccatgagcacaaatcctaaacctcaaagaaaaaccaaaagaaacacgaccttttgggacagcggtg

SEQ ID NO: 388216 - DNA, 140 bp, Artificial Sequence
  Synthetic
caccgctgtcccaaaaggtcgtgtttcttttggtttttctttgaggtttaggatttgtgctcatggtgcacggtctacgagacctcccggggcactcgcaagcaccctatcaggcagtaccatatcagcagccagggcct

SEQ ID NO: 388217 - DNA, 140 bp, Artificial Sequence
  Synthetic
aggccctggctgctgatatgtgtcctgcatcaccattccggtctctgctatcgaagtgaagaacaccagtgacggttatatggtgactaatgactgttccaatggcagcatcacctggcagaccttttgggacagcggtg

SEQ ID NO: 388218 - DNA, 140 bp, Artificial Sequence
  Synthetic
caccgctgtcccaaaaggtctgccaggtgatgctgccattggaacagtcattagtcaccatataaccgtcactggtgttcttcacttcgatagcagagaccggaatggtgatgcaggacacatatcagcagccagggcct

SEQ ID NO: 388219 - DNA, 140 bp, Artificial Sequence
  Synthetic
aggccctggctgctgatatgaccaacggcagttggcacatcaatcgcacggccttgaactgcaatgatagcctccacaccggctggatagcagggcttctctattacaacaaattcaactgaccttttgggacagcggtg

SEQ ID NO: 388220 - DNA, 140 bp, Artificial Sequence
  Synthetic
caccgctgtcccaaaaggtcagttgaatttgttgtaatagagaagccctgctatccagccggtgtggaggctatcattgcagttcaaggccgtgcgattgatgtgccaactgccgttggtcatatcagcagccagggcct

SEQ ID NO: 388221 - DNA, 140 bp, Artificial Sequence
  Synthetic
aggccctggctgctgatatgcacccgaccctgatattcgacatcaccaaactgctgctggccatcttcggacccctttggattcttcaagccagtttgcttaaagtaccctacttcgtgcgaccttttgggacagcggtg

SEQ ID NO: 388222 - DNA, 140 bp, Artificial Sequence
  Synthetic
caccgctgtcccaaaaggtcgcacgaagtagggtactttaagcaaactggcttgaagaatccaaaggggtccgaagatggccagcagcagtttggtgatgtcgaatatcagggtcgggtgcatatcagcagccagggcct

SEQ ID NO: 388223 - DNA, 140 bp, Artificial Sequence
  Synthetic
aggccctggctgctgatatgacaccgcatggcatgggacatgatgatgaactggtcgcccacggccaccatgatcctggcgtacgcgatgcgcgtccccgaggtcatcatagacatcattgaccttttgggacagcggtg

SEQ ID NO: 388224 - DNA, 140 bp, Artificial Sequence
  Synthetic
caccgctgtcccaaaaggtcaatgatgtctatgatgacctcggggacgcgcatcgcgtacgccaggatcatggtggccgtgggcgaccagttcatcatcatgtcccatgccatgcggtgtcatatcagcagccagggcct

SEQ ID NO: 388225 - DNA, 140 bp, Artificial Sequence
  Synthetic
atacgccatgctgggtctccacgcgaatacctactccgtcgggggttccactgcgcatctcacccagacctttgccggcctcttcaccctgggctctcagcagaatatccagctcatcaacgtacttgggagtcggccat

SEQ ID NO: 388226 - DNA, 140 bp, Artificial Sequence
  Synthetic
atggccgactcccaagtacgttgatgagctggatattctgctgagagcccagggtgaagaggccggcaaaggtctgggtgagatgcgcagtggaacccccgacggagtaggtattcgcgtggagacccagcatggcgtat

SEQ ID NO: 388227 - DNA, 140 bp, Artificial Sequence
  Synthetic
atacgccatgctgggtctcccaccaatggcagttggcacatcaaccgtactgccctgaattgcaatgaatccctgaacaccggctttctcgcgtccctgttctacacccacgcgttcaaccgtacttgggagtcggccat

SEQ ID NO: 388228 - DNA, 140 bp, Artificial Sequence
  Synthetic
atggccgactcccaagtacggttgaacgcgtgggtgtagaacagggacgcgagaaagccggtgttcagggattcattgcaattcagggcagtacggttgatgtgccaactgccattggtgggagacccagcatggcgtat

SEQ ID NO: 388229 - DNA, 140 bp, Artificial Sequence
  Synthetic
atacgccatgctgggtctccaagatatgagaccatattgctggcactacccaccaaaacagtgcggcatagtccccgcgaggtctgtatgtggcccggtgtactgtttcactcccagccccgtacttgggagtcggccat

SEQ ID NO: 388230 - DNA, 140 bp, Artificial Sequence
  Synthetic
atggccgactcccaagtacggggctgggagtgaaacagtacaccgggccacatacagacctcgcggggactatgccgcactgttttggtgggtagtgccagcaatatggtctcatatcttggagacccagcatggcgtat

SEQ ID NO: 388231 - DNA, 140 bp, Artificial Sequence
  Synthetic
aggccctggctgctgatatgacctgttatgccccacggactgttttaggaagcatcctgaggccacttacaccaaatgtggctctgggccttggctcacgccaagatgcatggtcgactagaccttttgggacagcggtg

SEQ ID NO: 388232 - DNA, 140 bp, Artificial Sequence
  Synthetic
caccgctgtcccaaaaggtctagtcgaccatgcatcttggcgtgagccaaggcccagagccacatttggtgtaagtggcctcaggatgcttcctaaaacagtccgtggggcataacaggtcatatcagcagccagggcct

SEQ ID NO: 388233 - DNA, 140 bp, Artificial Sequence
  Synthetic
aggccctggctgctgatatgaacttcactcgtggggatcgttgcaacttggaggacagagacagaagtcaactgtctcctttgttgcactccaccacggaatgggccattttgccttgtagaccttttgggacagcggtg

SEQ ID NO: 388234 - DNA, 140 bp, Artificial Sequence
  Synthetic
caccgctgtcccaaaaggtctacaaggcaaaatggcccattccgtggtggagtgcaacaaaggagacagttgacttctgtctctgtcctccaagttgcaacgatccccacgagtgaagttcatatcagcagccagggcct

SEQ ID NO: 388235 - DNA, 140 bp, Artificial Sequence
  Synthetic
aggccctggctgctgatatgctccggatcccacaagccgtcgtggacatggtggcgggggcccactggggagtcctggcgggccttgcctactattccatggtggggaactgggctaagggaccttttgggacagcggtg

SEQ ID NO: 388236 - DNA, 140 bp, Artificial Sequence
  Synthetic
caccgctgtcccaaaaggtcccttagcccagttccccaccatggaatagtaggcaaggcccgccaggactccccagtgggcccccgccaccatgtccacgacggcttgtgggatccggagcatatcagcagccagggcct

SEQ ID NO: 388237 - DNA, 140 bp, Artificial Sequence
  Synthetic
aggccctggctgctgatatgtcaaggggcgggcagtcccccttgctgcctattcccttaccggcctatggtccttctgcctactgctcctagcactgccccaacaggcttatgcctatgagaccttttgggacagcggtg

SEQ ID NO: 388238 - DNA, 140 bp, Artificial Sequence
  Synthetic
caccgctgtcccaaaaggtctcataggcataagcctgttggggcagtgctaggagcagtaggcagaaggaccataggccggtaagggaataggcagcaagggggactgcccgccccttgacatatcagcagccagggcct

SEQ ID NO: 388239 - DNA, 140 bp, Artificial Sequence
  Synthetic
atacgccatgctgggtctccacatcaacagaactgccttgaactgcaatgactccctccacactggattccttgccgcgctgttctacgtgcgcaggttcaactcgtccggatgcccagacgtacttgggagtcggccat

SEQ ID NO: 388240 - DNA, 140 bp, Artificial Sequence
  Synthetic
atggccgactcccaagtacgtctgggcatccggacgagttgaacctgcgcacgtagaacagcgcggcaaggaatccagtgtggagggagtcattgcagttcaaggcagttctgttgatgtggagacccagcatggcgtat

SEQ ID NO: 388241 - DNA, 140 bp, Artificial Sequence
  Synthetic
atacgccatgctgggtctcctcaggactggggtcagaactgtgacaaccggggactccatcacatactccacatatggtaaattcctcgctgatgggggctgcgcaggcggcgcctatgacgtacttgggagtcggccat

SEQ ID NO: 388242 - DNA, 140 bp, Artificial Sequence
  Synthetic
atggccgactcccaagtacgtcataggcgccgcctgcgcagcccccatcagcgaggaatttaccatatgtggagtatgtgatggagtccccggttgtcacagttctgaccccagtcctgaggagacccagcatggcgtat

SEQ ID NO: 388243 - DNA, 140 bp, Artificial Sequence
  Synthetic
aggccctggctgctgatatgacatatggtaaattcctcgctgatgggggctgcgcaggcggcgcctatgacatcatcatatgcgatgaatgccacgccgttggatctaccaccaatctcggaccttttgggacagcggtg

SEQ ID NO: 388244 - DNA, 140 bp, Artificial Sequence
  Synthetic
caccgctgtcccaaaaggtccgagattggtggtagatccaacggcgtggcattcatcgcatatgatgatgtcataggcgccgcctgcgcagcccccatcagcgaggaatttaccatatgtcatatcagcagccagggcct

SEQ ID NO: 388245 - DNA, 140 bp, Artificial Sequence
  Synthetic
atacgccatgctgggtctccatcaccaaaattttgctcgccatactcggtccgctcatggtgctccaagcaggtatagccagagtgccgtacttcgtacgcgctcacgggcttattcgtgcgtacttgggagtcggccat

SEQ ID NO: 388246 - DNA, 140 bp, Artificial Sequence
  Synthetic
atggccgactcccaagtacgcacgaataagcccgtgagcgcgtacgaagtacggcactctggctatacctgcttggagcaccatgagcggaccgagtatggcgagcaaaattttggtgatggagacccagcatggcgtat

SEQ ID NO: 388247 - DNA, 140 bp, Artificial Sequence
  Synthetic
aggccctggctgctgatatgagtggcccatctacacgctcccactggcagcggcaagagcactaaggtgccggctgcgtatgcagcccaagggtacaaggtgctcgtcctgaacccgtctgaccttttgggacagcggtg

SEQ ID NO: 388248 - DNA, 140 bp, Artificial Sequence
  Synthetic
caccgctgtcccaaaaggtcagacgggttcaggacgagcaccttgtacccttgggctgcatacgcagccggcaccttagtgctcttgccgctgccagtgggagcgtgtagatgggccactcatatcagcagccagggcct

SEQ ID NO: 388249 - DNA, 140 bp, Artificial Sequence
  Synthetic
aggccctggctgctgatatgcactcaaagaaaaagtgtgacgagctcgcggcggcccttcggggcatgggcttgaacgctgtggcatactacagagggttggacgtctccgtaataccaagaccttttgggacagcggtg

SEQ ID NO: 388250 - DNA, 140 bp, Artificial Sequence
  Synthetic
caccgctgtcccaaaaggtcttggtattacggagacgtccaaccctctgtagtatgccacagcgttcaagcccatgccccgaagggccgccgcgagctcgtcacactttttctttgagtgcatatcagcagccagggcct

SEQ ID NO: 388251 - DNA, 140 bp, Artificial Sequence
  Synthetic
atacgccatgctgggtctccctgacttccaagttgttcccaaagatgcctggcctcccctttatctcttgccaaaaggggtacaagggtgtgtgggccggcactggtatcatgaccacaccgtacttgggagtcggccat

SEQ ID NO: 388252 - DNA, 140 bp, Artificial Sequence
  Synthetic
atggccgactcccaagtacggtgtggtcatgataccagtgccggcccacacacccttgtaccccttttggcaagagataaaggggaggccaggcatctttgggaacaacttggaagtcagggagacccagcatggcgtat

SEQ ID NO: 388253 - DNA, 140 bp, Artificial Sequence
  Synthetic
atacgccatgctgggtctccagacgtggaaaaagcctgactacgaaccacctgtggtccatggctgtccgcttccacctccacagtcccctcctgtgcctccgcctcggaagaagcggaccgtacttgggagtcggccat

SEQ ID NO: 388254 - DNA, 140 bp, Artificial Sequence
  Synthetic
atggccgactcccaagtacggtccgcttcttccgaggcggaggcacaggaggggactgtggaggtggaagcggacagccatggaccacaggtggttcgtagtcaggctttttccacgtctggagacccagcatggcgtat

SEQ ID NO: 388255 - DNA, 140 bp, Artificial Sequence
  Synthetic
aggccctggctgctgatatgtgcaaatccataggtttgcccccacaccaaagccgttctttcgggatgaggtctcgttttatgttgggctcaattcgtttgtcgtagggtctcagctcccgaccttttgggacagcggtg

SEQ ID NO: 388256 - DNA, 140 bp, Artificial Sequence
  Synthetic
caccgctgtcccaaaaggtcgggagctgagaccctacgacaaacgaattgagcccaacataaaacgagacctcatcccgaaagaacggctttggtgtgggggcaaacctatggatttgcacatatcagcagccagggcct

SEQ ID NO: 388257 - DNA, 140 bp, Artificial Sequence
  Synthetic
atacgccatgctgggtctcctaggccatttcctggtttttttttttttttttttttttttttttttttttttttcccccccccccttttttttttttttttccccaaagggggggggccccgtacttgggagtcggccat

SEQ ID NO: 388258 - DNA, 140 bp, Artificial Sequence
  Synthetic
atggccgactcccaagtacggggccccccccctttggggaaaaaaaaaaaaaaaagggggggggggaaaaaaaaaaaaaaaaaaaaaaaaaaaaaaaaaaaaaaaccaggaaatggcctaggagacccagcatggcgtat

SEQ ID NO: 388259 - DNA, 140 bp, Artificial Sequence
  Synthetic
atacgccatgctgggtctcccgccagccttaccggcctgggcacggcctgattacaacccaccgcttgtggaatcgtggaagaggccagattaccaaccgcccactgttgcgggctgtgccgtacttgggagtcggccat

SEQ ID NO: 388260 - DNA, 140 bp, Artificial Sequence
  Synthetic
atggccgactcccaagtacggcacagcccgcaacagtgggcggttggtaatctggcctcttccacgattccacaagcggtgggttgtaatcaggccgtgcccaggccggtaaggctggcgggagacccagcatggcgtat

SEQ ID NO: 388261 - DNA, 140 bp, Artificial Sequence
  Synthetic
aggccctggctgctgatatggaatcgtggaagaggccagattaccaaccgcccactgttgcgggctgtgctctccccccccctaagaaaaccccgacgcctcccccaaggaggcgccggagaccttttgggacagcggtg

SEQ ID NO: 388262 - DNA, 140 bp, Artificial Sequence
  Synthetic
caccgctgtcccaaaaggtctccggcgcctccttgggggaggcgtcggggttttcttagggggggggagagcacagcccgcaacagtgggcggttggtaatctggcctcttccacgattccatatcagcagccagggcct

SEQ ID NO: 388263 - DNA, 140 bp, Artificial Sequence
  Synthetic
atacgccatgctgggtctcctctccccccccctaagaaaaccccgacgcctcccccaaggaggcgccggacagtgggtctggatgagagcaccataggagatgccctccagcagctggcccgtacttgggagtcggccat

SEQ ID NO: 388264 - DNA, 140 bp, Artificial Sequence
  Synthetic
atggccgactcccaagtacgggccagctgctggagggcatctcctatggtgctctcatccagacccactgtccggcgcctccttgggggaggcgtcggggttttcttagggggggggagaggagacccagcatggcgtat

SEQ ID NO: 388265 - DNA, 140 bp, Artificial Sequence
  Synthetic
aggccctggctgctgatatggggggcgctgccagggccctggcgcatggcgtccgggttctggaagacggcgtgaactatgcaacagggaatcttcccggttgctctttctctatcttccgaccttttgggacagcggtg

SEQ ID NO: 388266 - DNA, 140 bp, Artificial Sequence
  Synthetic
caccgctgtcccaaaaggtcggaagatagagaaagagcaaccgggaagattccctgttgcatagttcacgccgtcttccagaacccggacgccatgcgccagggccctggcagcgccccccatatcagcagccagggcct

SEQ ID NO: 388267 - DNA, 140 bp, Artificial Sequence
  Synthetic
aggccctggctgctgatatggggggcgacatttatcacagcgtgtcgcgtgcccgaccccgcttattactccttggcctactcctactttctgtaggggtaggcctctttctactccccggaccttttgggacagcggtg

SEQ ID NO: 388268 - DNA, 140 bp, Artificial Sequence
  Synthetic
caccgctgtcccaaaaggtccggggagtagaaagaggcctacccctacagaaagtaggagtaggccaaggagtaataagcggggtcgggcacgcgacacgctgtgataaatgtcgccccccatatcagcagccagggcct

SEQ ID NO: 388269 - DNA, 140 bp, Artificial Sequence
  Synthetic
aggccctggctgctgatatgggacgtgcaatacttgtacggggtggggtcaagcattgtgtcctgggccatcaagtgggaatatgtcatcctcttgtttctcctgcttgcagacgcgcgcgaccttttgggacagcggtg

SEQ ID NO: 388270 - DNA, 140 bp, Artificial Sequence
  Synthetic
caccgctgtcccaaaaggtcgcgcgcgtctgcaagcaggagaaacaagaggatgacatattcccacttgatggcccaggacacaatgcttgaccccaccccgtacaagtattgcacgtcccatatcagcagccagggcct

SEQ ID NO: 388271 - DNA, 140 bp, Artificial Sequence
  Synthetic
atacgccatgctgggtctccactagttacatggtgactaatgattgttccaatgacagcatcacctggcagcttaaggccgcagtcctccacgtccccgggtgcgtcccgtgcgagagagcgtacttgggagtcggccat

SEQ ID NO: 388272 - DNA, 140 bp, Artificial Sequence
  Synthetic
atggccgactcccaagtacgctctctcgcacgggacgcacccggggacgtggaggactgcggccttaagctgccaggtgatgctgtcattggaacaatcattagtcaccatgtaactagtggagacccagcatggcgtat

SEQ ID NO: 388273 - DNA, 140 bp, Artificial Sequence
  Synthetic
atacgccatgctgggtctcctcggataggatggggcaccttgcaatacgaggatgatgtcaccaatccagaagatatgagaccatattgctggcactacccaccaaaacagtgcggcatacgtacttgggagtcggccat

SEQ ID NO: 388274 - DNA, 140 bp, Artificial Sequence
  Synthetic
atggccgactcccaagtacgtatgccgcactgttttggtgggtagtgccagcaatatggtctcatatcttctggattggtgacatcatcctcgtattgcaaggtgccccatcctatccgaggagacccagcatggcgtat

SEQ ID NO: 388275 - DNA, 140 bp, Artificial Sequence
  Synthetic
aggccctggctgctgatatgtccctacaggctctggcattacccctgcacagttaactataccatcttcaagataaggatgtatgtggggggggttgagcacaggctcacggccgcgtgcgaccttttgggacagcggtg

SEQ ID NO: 388276 - DNA, 140 bp, Artificial Sequence
  Synthetic
caccgctgtcccaaaaggtcgcacgcggccgtgagcctgtgctcaaccccccccacatacatccttatcttgaagatggtatagttaactgtgcaggggtaatgccagagcctgtagggacatatcagcagccagggcct

SEQ ID NO: 388277 - DNA, 140 bp, Artificial Sequence
  Synthetic
aggccctggctgctgatatgagataaggatgtatgtggggggggttgagcacaggctcacggccgcgtgcaatttctctcgcggggatcgttgcaacttggaggacagggacagaagtcagaccttttgggacagcggtg

SEQ ID NO: 388278 - DNA, 140 bp, Artificial Sequence
  Synthetic
caccgctgtcccaaaaggtctgacttctgtccctgtcctccaagttgcaacgatccccgcgagagaaattgcacgcggccgtgagcctgtgctcaaccccccccacatacatccttatctcatatcagcagccagggcct

SEQ ID NO: 388279 - DNA, 140 bp, Artificial Sequence
  Synthetic
  misc_feature (85)..(85): n is a, c, g, or t
atacgccatgctgggtctcccttattcagacttgcccgccttgtcgaccggtctgctccacctccaccaaaacatcgtggacgtncaatacatgtatggcctgtcaccagccctcacaaacgtacttgggagtcggccat

SEQ ID NO: 388280 - DNA, 140 bp, Artificial Sequence
  Synthetic
  misc_feature (56)..(56): n is a, c, g, or t
atggccgactcccaagtacgtttgtgagggctggtgacaggccatacatgtattgnacgtccacgatgttttggtggaggtggagcagaccggtcgacaaggcgggcaagtctgaataagggagacccagcatggcgtat

SEQ ID NO: 388281 - DNA, 140 bp, Artificial Sequence
  Synthetic
aggccctggctgctgatatgtttctgctccgccatgtacgtgggggatctctgcggatctgtcttcctcgtctcccagctgttcaccttctcgcctcgccggcatgagacggtacaggacgaccttttgggacagcggtg

SEQ ID NO: 388282 - DNA, 140 bp, Artificial Sequence
  Synthetic
caccgctgtcccaaaaggtcgtcctgtaccgtctcatgccggcgaggcgagaaggtgaacagctgggagacgaggaagacagatccgcagagatcccccacgtacatggcggagcagaaacatatcagcagccagggcct

SEQ ID NO: 388283 - DNA, 140 bp, Artificial Sequence
  Synthetic
aggccctggctgctgatatggaagcagcgctagagaagctggtcatcttgcacgctgcgagcgcggctagctgcaacggcttcctatactttgtcatctttttcgtggctgcttggtacagaccttttgggacagcggtg

SEQ ID NO: 388284 - DNA, 140 bp, Artificial Sequence
  Synthetic
caccgctgtcccaaaaggtctgtaccaagcagccacgaaaaagatgacaaagtataggaagccgttgcagctagccgcgctcgcagcgtgcaagatgaccagcttctctagcgctgcttccatatcagcagccagggcct

SEQ ID NO: 388285 - DNA, 140 bp, Artificial Sequence
  Synthetic
aggccctggctgctgatatggaccaagacctcgtaggctggcccgctccccaaggtgcccgctcactgacaccctgcacttgcggctcctcggacctttacctggtcacgaggcacgccggaccttttgggacagcggtg

SEQ ID NO: 388286 - DNA, 140 bp, Artificial Sequence
  Synthetic
caccgctgtcccaaaaggtccggcgtgcctcgtgaccaggtaaaggtccgaggagccgcaagtgcagggtgtcagtgagcgggcaccttggggagcgggccagcctacgaggtcttggtccatatcagcagccagggcct

SEQ ID NO: 388287 - DNA, 140 bp, Artificial Sequence
  Synthetic
atacgccatgctgggtctcctctttacactcaccccggggtataagacccttctcagccggtgcctgtggtggttgtgctatctcctgaccctgggggaagccatggtccaggaatgggccgtacttgggagtcggccat

SEQ ID NO: 388288 - DNA, 140 bp, Artificial Sequence
  Synthetic
atggccgactcccaagtacggcccattcctggaccatggcttcccccagggtcaggagatagcacaaccaccacaggcaccggctgagaagggtcttataccccggggtgagtgtaaagaggagacccagcatggcgtat

SEQ ID NO: 388289 - DNA, 140 bp, Artificial Sequence
  Synthetic
aggccctggctgctgatatgggcactacgcgcctcggccgtgcggtatcgtacccgcggcgaaggtgtgtggtccagtgtattgcttcactccaagccctgtcgtggtggggacgaccgagaccttttgggacagcggtg

SEQ ID NO: 388290 - DNA, 140 bp, Artificial Sequence
  Synthetic
caccgctgtcccaaaaggtctcggtcgtccccaccacgacagggcttggagtgaagcaatacactggaccacacaccttcgccgcgggtacgataccgcacggccgaggcgcgtagtgcccatatcagcagccagggcct

SEQ ID NO: 388291 - DNA, 140 bp, Artificial Sequence
  Synthetic
aggccctggctgctgatatgcgtgcagcctccaggaccccccctcccgggagagccatagtggtctgcggaaccggtgagtacaccggaattgccaggatgaccgggtcctttcttggatgaccttttgggacagcggtg

SEQ ID NO: 388292 - DNA, 140 bp, Artificial Sequence
  Synthetic
caccgctgtcccaaaaggtcatccaagaaaggacccggtcatcctggcaattccggtgtactcaccggttccgcagaccactatggctctcccgggagggggggtcctggaggctgcacgcatatcagcagccagggcct

SEQ ID NO: 388293 - DNA, 140 bp, Artificial Sequence
  Synthetic
aggccctggctgctgatatgggtgtggtctgcgcagcaatactgcgccggcacgttggcccgggcgagggagcagtgcaatggatgaaccggctaatagccttcgcctcccgggggaaccgaccttttgggacagcggtg

SEQ ID NO: 388294 - DNA, 140 bp, Artificial Sequence
  Synthetic
caccgctgtcccaaaaggtcggttcccccgggaggcgaaggctattagccggttcatccattgcactgctccctcgcccgggccaacgtgccggcgcagtattgctgcgcagaccacacccatatcagcagccagggcct

SEQ ID NO: 388295 - DNA, 140 bp, Artificial Sequence
  Synthetic
aggccctggctgctgatatgtgacaacagcacaccaccggctgtgccccagacctatcaggtcgggtacttgcatgccccaactggcagtggaaagagtaccaaggtccctgtcgcgtacgaccttttgggacagcggtg

SEQ ID NO: 388296 - DNA, 140 bp, Artificial Sequence
  Synthetic
caccgctgtcccaaaaggtcgtacgcgacagggaccttggtactctttccactgccagttggggcatgcaagtacccgacctgataggtctggggcacagccggtggtgtgctgttgtcacatatcagcagccagggcct

SEQ ID NO: 388297 - DNA, 140 bp, Artificial Sequence
  Synthetic
aggccctggctgctgatatgtgcatgccccaactggcagtggaaagagtaccaaggtccctgtcgcgtacgccgctcaggggtacaaagtgttggtgcttaatccttcggtggctgccacgaccttttgggacagcggtg

SEQ ID NO: 388298 - DNA, 140 bp, Artificial Sequence
  Synthetic
caccgctgtcccaaaaggtcgtggcagccaccgaaggattaagcaccaacactttgtacccctgagcggcgtacgcgacagggaccttggtactctttccactgccagttggggcatgcacatatcagcagccagggcct

SEQ ID NO: 388299 - DNA, 140 bp, Artificial Sequence
  Synthetic
aggccctggctgctgatatgtgcatgcatgctggtgcggaaggtcgctgggggtcattatgtccaaatggctctcatgaagctagccgcactgacaggcacgtacgtttatgaccatcttgaccttttgggacagcggtg

SEQ ID NO: 388300 - DNA, 140 bp, Artificial Sequence
  Synthetic
caccgctgtcccaaaaggtcaagatggtcataaacgtacgtgcctgtcagtgcggctagcttcatgagagccatttggacataatgacccccagcgaccttccgcaccagcatgcatgcacatatcagcagccagggcct

SEQ ID NO: 388301 - DNA, 140 bp, Artificial Sequence
  Synthetic
aggccctggctgctgatatgctctcatgaagctagccgcactgacaggcacgtacgtttatgaccatcttactccactgcgggactgggcccacgcgggcctacgggaccttgcggtggcgaccttttgggacagcggtg

SEQ ID NO: 388302 - DNA, 140 bp, Artificial Sequence
  Synthetic
caccgctgtcccaaaaggtcgccaccgcaaggtcccgtaggcccgcgtgggcccagtcccgcagtggagtaagatggtcataaacgtacgtgcctgtcagtgcggctagcttcatgagagcatatcagcagccagggcct

SEQ ID NO: 388303 - DNA, 140 bp, Artificial Sequence
  Synthetic
aggccctggctgctgatatgtgaagtccaagatccaaggcttattgcagcaagcctctaaacaggcccaggacatacaacccgctgtgcaggcttcatggcccaaggtggagcaattctggaccttttgggacagcggtg

SEQ ID NO: 388304 - DNA, 140 bp, Artificial Sequence
  Synthetic
caccgctgtcccaaaaggtccagaattgctccaccttgggccatgaagcctgcacagcgggttgtatgtcctgggcctgtttagaggcttgctgcaataagccttggatcttggacttcacatatcagcagccagggcct

SEQ ID NO: 388305 - DNA, 140 bp, Artificial Sequence
  Synthetic
atacgccatgctgggtctccggccaaacacatgtggaacttccatagcggcattccatacctcgcaagactgtcacaactgccagggaacccggctgtggcttcaatgatggcattcaagcgtacttgggagtcggccat

SEQ ID NO: 388306 - DNA, 140 bp, Artificial Sequence
  Synthetic
atggccgactcccaagtacgcttgaatgccatcattgaagccacagccgggttccctggcagttgtgacagtcttgcgaggtatggaatgccgctatggaagttccacatgtgtttggccggagacccagcatggcgtat

SEQ ID NO: 388307 - DNA, 140 bp, Artificial Sequence
  Synthetic
atacgccatgctgggtctcctgcggtggtgtcttgggcgcttaagtgggagtatgttgtgctggccttcttgctgttggcagacgctagggtttgtgcatgtctctggatgatgctgctgcgtacttgggagtcggccat

SEQ ID NO: 388308 - DNA, 140 bp, Artificial Sequence
  Synthetic
atggccgactcccaagtacgcagcagcatcatccagagacatgcacaaaccctagcgtctgccaacagcaagaaggccagcacaacatactcccacttaagcgcccaagacaccaccgcaggagacccagcatggcgtat

SEQ ID NO: 388309 - DNA, 140 bp, Artificial Sequence
  Synthetic
aggccctggctgctgatatgccaggagaacggccctcgggcatgttcgattcctcggtcctgtgcgagtgctatgacgcgggctgcgcttggtatgagctcacgcccgccgagacctcaggaccttttgggacagcggtg

SEQ ID NO: 388310 - DNA, 140 bp, Artificial Sequence
  Synthetic
caccgctgtcccaaaaggtcctgaggtctcggcgggcgtgagctcataccaagcgcagcccgcgtcatagcactcgcacaggaccgaggaatcgaacatgcccgagggccgttctcctggcatatcagcagccagggcct

SEQ ID NO: 388311 - DNA, 140 bp, Artificial Sequence
  Synthetic
atacgccatgctgggtctccccaaaaggggtataggggtgtgtgggccggcactggcatcatgaccacacgatgtccttgcggcgccaacatctctggcaatgtccgcttgggctccatgcgtacttgggagtcggccat

SEQ ID NO: 388312 - DNA, 140 bp, Artificial Sequence
  Synthetic
atggccgactcccaagtacgcatggagcccaagcggacattgccagagatgttggcgccgcaaggacatcgtgtggtcatgatgccagtgccggcccacacacccctataccccttttggggagacccagcatggcgtat

SEQ ID NO: 388313 - DNA, 140 bp, Artificial Sequence
  Synthetic
aggccctggctgctgatatgtgcagatccacaggtttgcccccacgccaaagccgttttttcgggatgaggtctcgttttgcgttgggctcaattcatttgtcgtcgggtctcagcttccgaccttttgggacagcggtg

SEQ ID NO: 388314 - DNA, 140 bp, Artificial Sequence
  Synthetic
caccgctgtcccaaaaggtcggaagctgagacccgacgacaaatgaattgagcccaacgcaaaacgagacctcatcccgaaaaaacggctttggcgtgggggcaaacctgtggatctgcacatatcagcagccagggcct

SEQ ID NO: 388315 - DNA, 140 bp, Artificial Sequence
  Synthetic
atacgccatgctgggtctccttgggggcgacactccaccatgaatcactcccctgtgaggaactactgtcttcacgcagaaagcgtctagccatggcgttagtatgagtgtcgtgcagcccgtacttgggagtcggccat

SEQ ID NO: 388316 - DNA, 140 bp, Artificial Sequence
  Synthetic
atggccgactcccaagtacgggctgcacgacactcatactaacgccatggctagacgctttctgcgtgaagacagtagttcctcacaggggagtgattcatggtggagtgtcgcccccaaggagacccagcatggcgtat

SEQ ID NO: 388317 - DNA, 140 bp, Artificial Sequence
  Synthetic
atacgccatgctgggtctcctctccccccccccaagaaaaccccgacgcctcccccaaggagacgccggacggtgggtctgaacaaaagcactataggaaatttcctccaacagctggcccgtacttgggagtcggccat

SEQ ID NO: 388318 - DNA, 140 bp, Artificial Sequence
  Synthetic
atggccgactcccaagtacgggccagctgttggaggaaatttcctatagtgcttttgttcagacccaccgtccggcgtctccttgggggaggcgtcggggttttcttggggggggggagaggagacccagcatggcgtat

SEQ ID NO: 388319 - DNA, 140 bp, Artificial Sequence
  Synthetic
aggccctggctgctgatatgaggtcacattccaggtcggcctcaaccaatacctggttgggtcacagctcccgtgcgagcctgaaccggatgtaacagtagtcacttccatgcttaccgagaccttttgggacagcggtg

SEQ ID NO: 388320 - DNA, 140 bp, Artificial Sequence
  Synthetic
caccgctgtcccaaaaggtctcggtaagcatggaagtgactactgttacatccggttcaggctcgcacgggagctgtgacccaaccaggtattggttgaggccgacctggaatgtgacctcatatcagcagccagggcct

SEQ ID NO: 388321 - DNA, 140 bp, Artificial Sequence
  Synthetic
atacgccatgctgggtctccctctttcggagacaggttccatttcctccatgccccccctcgagggggagcctggggatccagacctagagcctgagcaggtagagcttcaacctccccccgtacttgggagtcggccat

SEQ ID NO: 388322 - DNA, 140 bp, Artificial Sequence
  Synthetic
atggccgactcccaagtacggggggaggttgaagctctacctgctcaggctctaggtctggatccccaggctccccctcgagggggggcatggaggaaatggaacctgtctccgaaagagggagacccagcatggcgtat

SEQ ID NO: 388323 - DNA, 140 bp, Artificial Sequence
  Synthetic
atacgccatgctgggtctccgccaggcagaacatccagctgatcaacaccaacggcagttggcacatcaatcggacggccttgaactgcaacgctagccttgacgccggctggatagcagcgtacttgggagtcggccat

SEQ ID NO: 388324 - DNA, 140 bp, Artificial Sequence
  Synthetic
atggccgactcccaagtacgctgctatccagccggcgtcaaggctagcgttgcagttcaaggccgtccgattgatgtgccaactgccgttggtgttgatcagctggatgttctgcctggcggagacccagcatggcgtat

SEQ ID NO: 388325 - DNA, 140 bp, Artificial Sequence
  Synthetic
aggccctggctgctgatatggaggtccgcagcttgtccgggagggccgttaaccacatcaagtccgtgtggaaggacctcctggaagactcacaaacaccaattcctacgaccatcatgggaccttttgggacagcggtg

SEQ ID NO: 388326 - DNA, 140 bp, Artificial Sequence
  Synthetic
caccgctgtcccaaaaggtcccatgatggtcgtaggaattggtgtttgtgagtcttccaggaggtccttccacacggacttgatgtggttaacggccctcccggacaagctgcggacctccatatcagcagccagggcct

SEQ ID NO: 388327 - DNA, 140 bp, Artificial Sequence
  Synthetic
aggccctggctgctgatatgggcatagcgtatttctccatggtggggaactgggcgaaggtcctggtagtgctgctgctatttgccggcgttgacgcggaaacccacgtcaccgggggaagaccttttgggacagcggtg

SEQ ID NO: 388328 - DNA, 140 bp, Artificial Sequence
  Synthetic
caccgctgtcccaaaaggtcttcccccggtgacgtgggtttccgcgtcaacgccggcaaatagcagcagcactaccaggaccttcgcccagttccccaccatggagaaatacgctatgcccatatcagcagccagggcct

SEQ ID NO: 388329 - DNA, 140 bp, Artificial Sequence
  Synthetic
aggccctggctgctgatatgaagcagaacatccaactgatcaacaccaacggcagttggcacatcaatagcacggccttgaactgcaatgaaagccttaacaccggctggttagcagggcgaccttttgggacagcggtg

SEQ ID NO: 388330 - DNA, 140 bp, Artificial Sequence
  Synthetic
caccgctgtcccaaaaggtcgccctgctaaccagccggtgttaaggctttcattgcagttcaaggccgtgctattgatgtgccaactgccgttggtgttgatcagttggatgttctgcttcatatcagcagccagggcct

SEQ ID NO: 388331 - DNA, 140 bp, Artificial Sequence
  Synthetic
aggccctggctgctgatatgcgggcctctaccatgtcaccaatgattgccctaactcgagtattgtgtacgagacgaccgataccatcctacactctccggggtgtgtcccttgcgttcggaccttttgggacagcggtg

SEQ ID NO: 388332 - DNA, 140 bp, Artificial Sequence
  Synthetic
caccgctgtcccaaaaggtccgaacgcaagggacacaccccggagagtgtaggatggtatcggtcgtctcgtacacaatactcgagttagggcaatcattggtgacatggtagaggcccgcatatcagcagccagggcct

SEQ ID NO: 388333 - DNA, 140 bp, Artificial Sequence
  Synthetic
atacgccatgctgggtctccaacagggaatctacctggttgctccttttctatcttcttgctggccctactgtcctgtatcaccattccagtctctgctgtccaagtgaagaacaccagccgtacttgggagtcggccat

SEQ ID NO: 388334 - DNA, 140 bp, Artificial Sequence
  Synthetic
atggccgactcccaagtacggctggtgttcttcacttggacagcagagactggaatggtgatacaggacagtagggccagcaagaagatagaaaaggagcaaccaggtagattccctgttggagacccagcatggcgtat

SEQ ID NO: 388335 - DNA, 140 bp, Artificial Sequence
  Synthetic
atacgccatgctgggtctccaacaccaacggcagttggcacatcaatcgcacggccttgaactgcaatgagagcctcgagactggctggttagcggggctcttttatcaccacaaattcacgtacttgggagtcggccat

SEQ ID NO: 388336 - DNA, 140 bp, Artificial Sequence
  Synthetic
atggccgactcccaagtacgtgaatttgtggtgataaaagagccccgctaaccagccagtctcgaggctctcattgcagttcaaggccgtgcgattgatgtgccaactgccgttggtgttggagacccagcatggcgtat

SEQ ID NO: 388337 - DNA, 140 bp, Artificial Sequence
  Synthetic
aggccctggctgctgatatgcgtgatgtccgctacgctctgctctgctctctacgtgggggacctctgcggcggggtaatgctggcagcccagatgttcattatctcgccggagcaccacgaccttttgggacagcggtg

SEQ ID NO: 388338 - DNA, 140 bp, Artificial Sequence
  Synthetic
caccgctgtcccaaaaggtcgtggtgctccggcgagataatgaacatctgggctgccagcattaccccgccgcagaggtcccccacgtagagagcagagcagagcgtagcggacatcacgcatatcagcagccagggcct

SEQ ID NO: 388339 - DNA, 140 bp, Artificial Sequence
  Synthetic
aggccctggctgctgatatgttcgaccaaggctggggccctatcagctacgccaacggaagcggtcccgaacaccggccctattgctggcactaccccccgaagccctgtggcatcgtgcgaccttttgggacagcggtg

SEQ ID NO: 388340 - DNA, 140 bp, Artificial Sequence
  Synthetic
caccgctgtcccaaaaggtcgcacgatgccacagggcttcggggggtagtgccagcaatagggccggtgttcgggaccgcttccgttggcgtagctgatagggccccagccttggtcgaacatatcagcagccagggcct

SEQ ID NO: 388341 - DNA, 140 bp, Artificial Sequence
  Synthetic
aggccctggctgctgatatgacaccggccctattgctggcactaccccccgaagccctgtggcatcgtgccagcacggaccgtatgtggcccagtgtattgcttcactcccagccctgtggaccttttgggacagcggtg

SEQ ID NO: 388342 - DNA, 140 bp, Artificial Sequence
  Synthetic
caccgctgtcccaaaaggtccacagggctgggagtgaagcaatacactgggccacatacggtccgtgctggcacgatgccacagggcttcggggggtagtgccagcaatagggccggtgtcatatcagcagccagggcct

SEQ ID NO: 388343 - DNA, 140 bp, Artificial Sequence
  Synthetic
atacgccatgctgggtctcctgatcctggcttacgtgatgcgcgtccccgaggtcatcatagacatcattagtggagctcattggggcgttatgttcggcctggcctacttctctatgcacgtacttgggagtcggccat

SEQ ID NO: 388344 - DNA, 140 bp, Artificial Sequence
  Synthetic
atggccgactcccaagtacgtgcatagagaagtaggccaggccgaacataacgccccaatgagctccactaatgatgtctatgatgacctcggggacgcgcatcacgtaagccaggatcaggagacccagcatggcgtat

SEQ ID NO: 388345 - DNA, 140 bp, Artificial Sequence
  Synthetic
atacgccatgctgggtctccttcgccggcctcctctcacccggctctaagcagaacatccagcttattaacaccaatggcagttggcacatcaaccgcaccgccctgaattgtaatgacacgtacttgggagtcggccat

SEQ ID NO: 388346 - DNA, 140 bp, Artificial Sequence
  Synthetic
atggccgactcccaagtacgtgtcattacaattcagggcggtgcggttgatgtgccaactgccattggtgttaataagctggatgttctgcttagagccgggtgagaggaggccggcgaaggagacccagcatggcgtat

SEQ ID NO: 388347 - DNA, 140 bp, Artificial Sequence
  Synthetic
atacgccatgctgggtctcctcgtcagggtgtcccgaacgcctgtcctcctgccgcagtattgaggccttccggataggatggggcactttgcaatacgaggataatgtcaccaatccagcgtacttgggagtcggccat

SEQ ID NO: 388348 - DNA, 140 bp, Artificial Sequence
  Synthetic
atggccgactcccaagtacgctggattggtgacattatcctcgtattgcaaagtgccccatcctatccggaaggcctcaatactgcggcaggaggacaggcgttcgggacaccctgacgaggagacccagcatggcgtat

SEQ ID NO: 388349 - DNA, 140 bp, Artificial Sequence
  Synthetic
aggccctggctgctgatatgatgcatacccccgggtgcgtgccctgcgttcgggagggtaatacctcccgctgctgggtagcgctcactcccacgcttgcggccaggaacgccagcgtccgaccttttgggacagcggtg

SEQ ID NO: 388350 - DNA, 140 bp, Artificial Sequence
  Synthetic
caccgctgtcccaaaaggtcggacgctggcgttcctggccgcaagcgtgggagtgagcgctacccagcagcgggaggtattaccctcccgaacgcagggcacgcacccgggggtatgcatcatatcagcagccagggcct

SEQ ID NO: 388351 - DNA, 140 bp, Artificial Sequence
  Synthetic
aggccctggctgctgatatggagtcctggcgggccttgcctactattccatggtggggaactgggccaaggtcttgattgtgatgctactctttgccggcgttgacgggaacacccgcgtgaccttttgggacagcggtg

SEQ ID NO: 388352 - DNA, 140 bp, Artificial Sequence
  Synthetic
caccgctgtcccaaaaggtcacgcgggtgttcccgtcaacgccggcaaagagtagcatcacaatcaagaccttggcccagttccccaccatggaatagtaggcaaggcccgccaggactccatatcagcagccagggcct

SEQ ID NO: 388353 - DNA, 140 bp, Artificial Sequence
  Synthetic
aggccctggctgctgatatggaggcagcactagagaagctggtcgtcttgcacgctgcgagcgcagctagctgcaatggcttcctatattttgtcatctttttcgtggctgcttggtacagaccttttgggacagcggtg

SEQ ID NO: 388354 - DNA, 140 bp, Artificial Sequence
  Synthetic
caccgctgtcccaaaaggtctgtaccaagcagccacgaaaaagatgacaaaatataggaagccattgcagctagctgcgctcgcagcgtgcaagacgaccagcttctctagtgctgcctccatatcagcagccagggcct

SEQ ID NO: 388355 - DNA, 140 bp, Artificial Sequence
  Synthetic
atacgccatgctgggtctcctcaaaggtcgggtggtccccttggccacctattccctcaccggcctatggcccttttgcctactgctcctcgcactgccccaacaggcttatgcctatgacgtacttgggagtcggccat

SEQ ID NO: 388356 - DNA, 140 bp, Artificial Sequence
  Synthetic
atggccgactcccaagtacgtcataggcataagcctgttggggcagtgcgaggagcagtaggcaaaagggccataggccggtgagggaataggtggccaaggggaccacccgacctttgaggagacccagcatggcgtat

SEQ ID NO: 388357 - DNA, 140 bp, Artificial Sequence
  Synthetic
aggccctggctgctgatatgcctcgccgcgctgttctacgtacacaagttcaacgcgtcgggatgcccggagcgcatggccagctgccgccccattgacacgttcaatcaggggtggggtgaccttttgggacagcggtg

SEQ ID NO: 388358 - DNA, 140 bp, Artificial Sequence
  Synthetic
caccgctgtcccaaaaggtcaccccacccctgattgaacgtgtcaatggggcggcagctggccatgcgctccgggcatcccgacgcgttgaacttgtgtacgtagaacagcgcggcgaggcatatcagcagccagggcct

SEQ ID NO: 388359 - DNA, 140 bp, Artificial Sequence
  Synthetic
aggccctggctgctgatatggtccagtgtattgcttcaccccaagccctgttgtggtggggacgaccgatcgttccggcgtccccacgtataactggggggagaatgagacggacgtgctgaccttttgggacagcggtg

SEQ ID NO: 388360 - DNA, 140 bp, Artificial Sequence
  Synthetic
caccgctgtcccaaaaggtcagcacgtccgtctcattctccccccagttatacgtggggacgccggaacgatcggtcgtccccaccacaacagggcttggggtgaagcaatacactggaccatatcagcagccagggcct

SEQ ID NO: 388361 - DNA, 140 bp, Artificial Sequence
  Synthetic
aggccctggctgctgatatgccatcaccgcttacgcccagcagacacgaggtctcttgggcgccatagtggtgagcatgacgggacgcgacaagacagagcaggccggggaaatccaagtgaccttttgggacagcggtg

SEQ ID NO: 388362 - DNA, 140 bp, Artificial Sequence
  Synthetic
caccgctgtcccaaaaggtcacttggatttccccggcctgctctgtcttgtcgcgtcccgtcatgctcaccactatggcgcccaagagacctcgtgtctgctgggcgtaagcggtgatggcatatcagcagccagggcct

SEQ ID NO: 388363 - DNA, 140 bp, Artificial Sequence
  Synthetic
aggccctggctgctgatatggtccactggcttgatccatctccatcagaacatcgtggacgtgcaatacctgtatggtgtagggtcggccgttgtctcccttgtaatcaaatgggagtacgaccttttgggacagcggtg

SEQ ID NO: 388364 - DNA, 140 bp, Artificial Sequence
  Synthetic
caccgctgtcccaaaaggtcgtactcccatttgattacaagggagacaacggccgaccctacaccatacaggtattgcacgtccacgatgttctgatggagatggatcaagccagtggaccatatcagcagccagggcct

SEQ ID NO: 388365 - DNA, 140 bp, Artificial Sequence
  Synthetic
aggccctggctgctgatatgcgttaccaccacgagcatacgccatggaccgggaaatggctgcatcgtgcggaggcgcggttttcataggtctggcactcttgaccttgtcaccacactagaccttttgggacagcggtg

SEQ ID NO: 388366 - DNA, 140 bp, Artificial Sequence
  Synthetic
caccgctgtcccaaaaggtctagtgtggtgacaaggtcaagagtgccagacctatgaaaaccgcgcctccgcacgatgcagccatttcccggtccatggcgtatgctcgtggtggtaacgcatatcagcagccagggcct

SEQ ID NO: 388367 - DNA, 140 bp, Artificial Sequence
  Synthetic
aggccctggctgctgatatgattcgtgcatgcatgttggtgcggaaagttgctgggggccattacgtccaaatggctttcatgaagctggccgcgctgacgggtacgtacgtttatgaccgaccttttgggacagcggtg

SEQ ID NO: 388368 - DNA, 140 bp, Artificial Sequence
  Synthetic
caccgctgtcccaaaaggtcggtcataaacgtacgtacccgtcagcgcggccagcttcatgaaagccatttggacgtaatggcccccagcaactttccgcaccaacatgcatgcacgaatcatatcagcagccagggcct

SEQ ID NO: 388369 - DNA, 140 bp, Artificial Sequence
  Synthetic
atacgccatgctgggtctccattacgctccaagaccctgcgacgttgagccggccaagaacatttgtggccctgtttactgctttacaccatctcctgtagtcgttggcactacggataacgtacttgggagtcggccat

SEQ ID NO: 388370 - DNA, 140 bp, Artificial Sequence
  Synthetic
atggccgactcccaagtacgttatccgtagtgccaacgactacaggagatggtgtaaagcagtaaacagggccacaaatgttcttggccggctcaacgtcgcagggtcttggagcgtaatggagacccagcatggcgtat

SEQ ID NO: 388371 - DNA, 140 bp, Artificial Sequence
  Synthetic
atacgccatgctgggtctcccgtagacttcagcctggaccccaccttcactataaccacacagactgtccctcaagacgctgtctcacgcagccagcgccgggggcgcacaggtagaggacgtacttgggagtcggccat

SEQ ID NO: 388372 - DNA, 140 bp, Artificial Sequence
  Synthetic
atggccgactcccaagtacgtcctctacctgtgcgcccccggcgctggctgcgtgagacagcgtcttgagggacagtctgtgtggttatagtgaaggtggggtccaggctgaagtctacgggagacccagcatggcgtat

SEQ ID NO: 388373 - DNA, 140 bp, Artificial Sequence
  Synthetic
aggccctggctgctgatatgacgcctggcttgcccgtgtgccaagaccatcttgagttttgggaggcagttttcaccggcctcacacacatagatgcccacttcctttcccaaacaaagcgaccttttgggacagcggtg

SEQ ID NO: 388374 - DNA, 140 bp, Artificial Sequence
  Synthetic
caccgctgtcccaaaaggtcgctttgtttgggaaaggaagtgggcatctatgtgtgtgaggccggtgaaaactgcctcccaaaactcaagatggtcttggcacacgggcaagccaggcgtcatatcagcagccagggcct

SEQ ID NO: 388375 - DNA, 140 bp, Artificial Sequence
  Synthetic
aggccctggctgctgatatgtttcaccggcctcacacacatagatgcccacttcctttcccaaacaaagcaatcgggggagaatttcgcatacttagtagcctatcaggctacagtgtgcgaccttttgggacagcggtg

SEQ ID NO: 388376 - DNA, 140 bp, Artificial Sequence
  Synthetic
caccgctgtcccaaaaggtcgcacactgtagcctgataggctactaagtatgcgaaattctcccccgattgctttgtttgggaaaggaagtgggcatctatgtgtgtgaggccggtgaaacatatcagcagccagggcct

SEQ ID NO: 388377 - DNA, 140 bp, Artificial Sequence
  Synthetic
aggccctggctgctgatatggtaccgcagacattccaagtggcccatctacacgctcccactggcagcggcaagagcaccaaggtgccggctgcatatgcagcccaggggtacaaggtacgaccttttgggacagcggtg

SEQ ID NO: 388378 - DNA, 140 bp, Artificial Sequence
  Synthetic
caccgctgtcccaaaaggtcgtaccttgtacccctgggctgcatatgcagccggcaccttggtgctcttgccgctgccagtgggagcgtgtagatgggccacttggaatgtctgcggtaccatatcagcagccagggcct

SEQ ID NO: 388379 - DNA, 140 bp, Artificial Sequence
  Synthetic
aggccctggctgctgatatgtcgactgtaatacatgtgtcacccagacagtcgacttcagcttggaccctaccttcaccattgagacgacgaccgtgccacaagacgcggtgtcgcgctcgaccttttgggacagcggtg

SEQ ID NO: 388380 - DNA, 140 bp, Artificial Sequence
  Synthetic
caccgctgtcccaaaaggtcgagcgcgacaccgcgtcttgtggcacggtcgtcgtctcaatggtgaaggtagggtccaagctgaagtcgactgtctgggtgacacatgtattacagtcgacatatcagcagccagggcct

SEQ ID NO: 388381 - DNA, 140 bp, Artificial Sequence
  Synthetic
aggccctggctgctgatatgcacgggccaacacccctgctgtataggctaggagccgtccaaaacgaggtcaccctcacacaccccataaccaaatacatcatggcatgcatgtcggctggaccttttgggacagcggtg

SEQ ID NO: 388382 - DNA, 140 bp, Artificial Sequence
  Synthetic
caccgctgtcccaaaaggtccagccgacatgcatgccatgatgtatttggttatggggtgtgtgagggtgacctcgttttggacggctcctagcctatacagcaggggtgttggcccgtgcatatcagcagccagggcct

SEQ ID NO: 388383 - DNA, 140 bp, Artificial Sequence
  Synthetic
aggccctggctgctgatatgcccccatctgaggcaagctcctcggcgagccagctatcggcgccatcgctgcgagccacctgcaccacccacggcaagacctatgatgtggacatggtgggaccttttgggacagcggtg

SEQ ID NO: 388384 - DNA, 140 bp, Artificial Sequence
  Synthetic
caccgctgtcccaaaaggtcccaccatgtccacatcataggtcttgccgtgggtggtgcaggtggctcgcagcgatggcgccgatagctggctcgccgaggagcttgcctcagatgggggcatatcagcagccagggcct

SEQ ID NO: 388385 - DNA, 140 bp, Artificial Sequence
  Synthetic
aggccctggctgctgatatggcgagccacctgcaccacccacggcaagacctatgatgtggacatggtggatgccaacctgttcatggggggcgatgtgacccggatagagtctgagtccgaccttttgggacagcggtg

SEQ ID NO: 388386 - DNA, 140 bp, Artificial Sequence
  Synthetic
caccgctgtcccaaaaggtcggactcagactctatccgggtcacatcgccccccatgaacaggttggcatccaccatgtccacatcataggtcttgccgtgggtggtgcaggtggctcgccatatcagcagccagggcct

SEQ ID NO: 388387 - DNA, 140 bp, Artificial Sequence
  Synthetic
aggccctggctgctgatatgacagtgctcacttccatgctcaccgacccctcccacattacagcagaggcggctaggcgtaggctggccagggggtctcccccctccttggccagctcttgaccttttgggacagcggtg

SEQ ID NO: 388388 - DNA, 140 bp, Artificial Sequence
  Synthetic
caccgctgtcccaaaaggtcaagagctggccaaggaggggggagaccccctggccagcctacgcctagccgcctctgctgtaatgtgggaggggtcggtgagcatggaagtgagcactgtcatatcagcagccagggcct

SEQ ID NO: 388389 - DNA, 140 bp, Artificial Sequence
  Synthetic
atacgccatgctgggtctccaacggcagttggcacatcaatagaacggccttgaactgcaatgaaagcctcgacaccggctggctagcagggctcttttatcgttataagttcaacgattcgtacttgggagtcggccat

SEQ ID NO: 388390 - DNA, 140 bp, Artificial Sequence
  Synthetic
atggccgactcccaagtacgaatcgttgaacttataacgataaaagagccctgctagccagccggtgtcgaggctttcattgcagttcaaggccgttctattgatgtgccaactgccgttggagacccagcatggcgtat

SEQ ID NO: 388391 - DNA, 140 bp, Artificial Sequence
  Synthetic
atacgccatgctgggtctccgcccaaaagctccagcttataaacaccaacggcagctggcacatcaacaggactgccctgaactgcaatgactccctcaacactgggttccttgccgcgccgtacttgggagtcggccat

SEQ ID NO: 388392 - DNA, 140 bp, Artificial Sequence
  Synthetic
atggccgactcccaagtacggcgcggcaaggaacccagtgttgagggagtcattgcagttcagggcagtcctgttgatgtgccagctgccgttggtgtttataagctggagcttttgggcggagacccagcatggcgtat

SEQ ID NO: 388393 - DNA, 140 bp, Artificial Sequence
  Synthetic
aggccctggctgctgatatggcaagcatccggaagccacatactctcggtgcggctccggtccctggattacacccaggtgcatggtcgactacccgtataggctttggcactatccttggaccttttgggacagcggtg

SEQ ID NO: 388394 - DNA, 140 bp, Artificial Sequence
  Synthetic
caccgctgtcccaaaaggtccaaggatagtgccaaagcctatacgggtagtcgaccatgcacctgggtgtaatccagggaccggagccgcaccgagagtatgtggcttccggatgcttgccatatcagcagccagggcct

SEQ ID NO: 388395 - DNA, 140 bp, Artificial Sequence
  Synthetic
atacgccatgctgggtctccctcaatgcagcatccctggccgggacgcacggtcttgtgtccttcctcgtgttcttctgctttgcgtggtatctgaagggtaggtgggtgcccggagcggcgtacttgggagtcggccat

SEQ ID NO: 388396 - DNA, 140 bp, Artificial Sequence
  Synthetic
atggccgactcccaagtacgccgctccgggcacccacctacccttcagataccacgcaaagcagaagaacacgaggaaggacacaagaccgtgcgtcccggccagggatgctgcattgagggagacccagcatggcgtat

SEQ ID NO: 388397 - DNA, 140 bp, Artificial Sequence
  Synthetic
aggccctggctgctgatatgtaacgggtcaccgcatggcgtgggatatgatgatgaactggtcccctacaacagcgctggtagtggctcagctgctccgggtcccgcaagccatcgtggagaccttttgggacagcggtg

SEQ ID NO: 388398 - DNA, 140 bp, Artificial Sequence
  Synthetic
caccgctgtcccaaaaggtctccacgatggcttgcgggacccggagcagctgagccactaccagcgctgttgtaggggaccagttcatcatcatatcccacgccatgcggtgacccgttacatatcagcagccagggcct

SEQ ID NO: 388399 - DNA, 140 bp, Artificial Sequence
  Synthetic
atacgccatgctgggtctccggttgctccttttctatcttcttgctggccttactgtcctgcatcaccgttccggtttcagccgtccaagtgaagaacatcagcgacagctatatggtgacgtacttgggagtcggccat

SEQ ID NO: 388400 - DNA, 140 bp, Artificial Sequence
  Synthetic
atggccgactcccaagtacgtcaccatatagctgtcgctgatgttcttcacttggacggctgaaaccggaacggtgatgcaggacagtaaggccagcaagaagatagaaaaggagcaaccggagacccagcatggcgtat

SEQ ID NO: 388401 - DNA, 140 bp, Artificial Sequence
  Synthetic
aggccctggctgctgatatggcgtcatgtttggcttggcctacttctctatgcaaggagcatgggcgaaagtcgttgtcatccttctgctgaccgctggggtggacgcgcatacccgcaggaccttttgggacagcggtg

SEQ ID NO: 388402 - DNA, 140 bp, Artificial Sequence
  Synthetic
caccgctgtcccaaaaggtcctgcgggtatgcgcgtccaccccagcggtcagcagaaggatgacaacgactttcgcccatgctccttgcatagagaagtaggccaagccaaacatgacgccatatcagcagccagggcct

SEQ ID NO: 388403 - DNA, 140 bp, Artificial Sequence
  Synthetic
aggccctggctgctgatatgggccctggctcacgccaaggtgcctggtcgactacccttacaggctctggcattacccctgcacaatcaactataccatcttcaagataaggatgtatgtgaccttttgggacagcggtg

SEQ ID NO: 388404 - DNA, 140 bp, Artificial Sequence
  Synthetic
caccgctgtcccaaaaggtcacatacatccttatcttgaagatggtatagttgattgtgcaggggtaatgccagagcctgtaagggtagtcgaccaggcaccttggcgtgagccagggcccatatcagcagccagggcct

SEQ ID NO: 388405 - DNA, 140 bp, Artificial Sequence
  Synthetic
aggccctggctgctgatatgcacatcaacagaactgccctgaactgcaatgactccctccagactgggttcattgccgcgctgttctacagacgcagtttcaactcgtccgggtgtctgggaccttttgggacagcggtg

SEQ ID NO: 388406 - DNA, 140 bp, Artificial Sequence
  Synthetic
caccgctgtcccaaaaggtcccagacacccggacgagttgaaactgcgtctgtagaacagcgcggcaatgaacccagtctggagggagtcattgcagttcagggcagttctgttgatgtgcatatcagcagccagggcct

SEQ ID NO: 388407 - DNA, 140 bp, Artificial Sequence
  Synthetic
atacgccatgctgggtctccgagtgggtagtactcttattcctgctcttggcggatgccagggtctgcgcttgcttgtggatgctcatcttgctgggccaggccgaagcagcactagagacgtacttgggagtcggccat

SEQ ID NO: 388408 - DNA, 140 bp, Artificial Sequence
  Synthetic
atggccgactcccaagtacgtctctagtgctgcttcggcctggcccagcaagatgagcatccacaagcaagcgcagaccctggcatccgccaagagcaggaataagagtactacccactcggagacccagcatggcgtat

SEQ ID NO: 388409 - DNA, 140 bp, Artificial Sequence
  Synthetic
atacgccatgctgggtctccccccttggccgcttattccctcactggcttgtggcccttttgcctgttgctcctagcactgccccaacaggcttatgcatatgatgcatccgtgcacggacgtacttgggagtcggccat

SEQ ID NO: 388410 - DNA, 140 bp, Artificial Sequence
  Synthetic
atggccgactcccaagtacgtccgtgcacggatgcatcatatgcataagcctgttggggcagtgctaggagcaacaggcaaaagggccacaagccagtgagggaataagcggccaaggggggagacccagcatggcgtat

SEQ ID NO: 388411 - DNA, 140 bp, Artificial Sequence
  Synthetic
aggccctggctgctgatatggccaacacccctgctatacagactgggcgctgttcagaatgaagtcaccctgacgcacccaatcaccaaatacatcatgacatgcatgtcggccgacctggaccttttgggacagcggtg

SEQ ID NO: 388412 - DNA, 140 bp, Artificial Sequence
  Synthetic
caccgctgtcccaaaaggtccaggtcggccgacatgcatgtcatgatgtatttggtgattgggtgcgtcagggtgacttcattctgaacagcgcccagtctgtatagcaggggtgttggccatatcagcagccagggcct

SEQ ID NO: 388413 - DNA, 140 bp, Artificial Sequence
  Synthetic
atacgccatgctgggtctcctttttttgtgctgcctggtacatcaaaggtaggctggtccctggggcggcgtacgctctttatggtgtatggccgctgctcctcctcctactggcgttaccgtacttgggagtcggccat

SEQ ID NO: 388414 - DNA, 140 bp, Artificial Sequence
  Synthetic
atggccgactcccaagtacggtaacgccagtaggaggaggagcagcggccatacaccataaagagcgtacgccgccccagggaccagcctacctttgatgtaccaggcagcacaaaaaaaggagacccagcatggcgtat

SEQ ID NO: 388415 - DNA, 140 bp, Artificial Sequence
  Synthetic
aggccctggctgctgatatgggcgatgttgtcgtcgtggcaactgatgctctcatgaccggctttaccggcgacttcgactcggtgatagactgcaacacgtgtgtcacccagacagtcggaccttttgggacagcggtg

SEQ ID NO: 388416 - DNA, 140 bp, Artificial Sequence
  Synthetic
caccgctgtcccaaaaggtccgactgtctgggtgacacacgtgttgcagtctatcaccgagtcgaagtcgccggtaaagccggtcatgagagcatcagttgccacgacgacaacatcgcccatatcagcagccagggcct

SEQ ID NO: 388417 - DNA, 140 bp, Artificial Sequence
  Synthetic
aggccctggctgctgatatgctcacacccgccgagaccacagttaggctacgagcatacatgaacaccccggggcttcccgtgtgccaagaccatcttgaattttgggagggcgtcttcagaccttttgggacagcggtg

SEQ ID NO: 388418 - DNA, 140 bp, Artificial Sequence
  Synthetic
caccgctgtcccaaaaggtctgaagacgccctcccaaaattcaagatggtcttggcacacgggaagccccggggtgttcatgtatgctcgtagcctaactgtggtctcggcgggtgtgagcatatcagcagccagggcct

SEQ ID NO: 388419 - DNA, 140 bp, Artificial Sequence
  Synthetic
atacgccatgctgggtctcccgccccctgggtcggtgacaaccccccatcccaatatagaggaggtagccctcgggcaggagggcgagatccccttctatgggagggcgattcccctgtccgtacttgggagtcggccat

SEQ ID NO: 388420 - DNA, 140 bp, Artificial Sequence
  Synthetic
atggccgactcccaagtacggacaggggaatcgccctcccatagaaggggatctcgccctcctgcccgagggctacctcctctatattgggatggggggttgtcaccgacccagggggcgggagacccagcatggcgtat

SEQ ID NO: 388421 - DNA, 140 bp, Artificial Sequence
  Synthetic
aggccctggctgctgatatgacgtagccagcgccgggggcgcacaggtagaggaagactgggcatttataggtatgtttccactggtgagcgagcctcaggaatgtttgacagtgtagtggaccttttgggacagcggtg

SEQ ID NO: 388422 - DNA, 140 bp, Artificial Sequence
  Synthetic
caccgctgtcccaaaaggtccactacactgtcaaacattcctgaggctcgctcaccagtggaaacatacctataaatgcccagtcttcctctacctgtgcgcccccggcgctggctacgtcatatcagcagccagggcct

SEQ ID NO: 388423 - DNA, 140 bp, Artificial Sequence
  Synthetic
atacgccatgctgggtctcccgcatacttagtagcctatcaggctacagtgtgcgccagagccaaagcccctcccccgtcctgggacgtcatgtggaagtgcttgactcgactcaagccccgtacttgggagtcggccat

SEQ ID NO: 388424 - DNA, 140 bp, Artificial Sequence
  Synthetic
atggccgactcccaagtacggggcttgagtcgagtcaagcacttccacatgacgtcccaggacgggggaggggctttggctctggcgcacactgtagcctgataggctactaagtatgcgggagacccagcatggcgtat

SEQ ID NO: 388425 - DNA, 140 bp, Artificial Sequence
  Synthetic
atacgccatgctgggtctccacactcgtgggccctacacctctcctgtaccgtttgggccctgttaccaacgaggtcactctcacacatcctgtgacgaaatacatcgccacatgcatgccgtacttgggagtcggccat

SEQ ID NO: 388426 - DNA, 140 bp, Artificial Sequence
  Synthetic
atggccgactcccaagtacggcatgcatgtggcgatgtatttcgtcacaggatgtgtgagagtgacctcgttggtaacagggcccaaacggtacaggagaggtgtagggcccacgagtgtggagacccagcatggcgtat

SEQ ID NO: 388427 - DNA, 140 bp, Artificial Sequence
  Synthetic
atacgccatgctgggtctccgcttcgctcagggatggggtcccatcacttatgctgagcctgtcgactcgggccagaggccttattgctggcactacgcgcctcgaccgtgcggtattgtcgtacttgggagtcggccat

SEQ ID NO: 388428 - DNA, 140 bp, Artificial Sequence
  Synthetic
atggccgactcccaagtacgacaataccgcacggtcgaggcgcgtagtgccagcaataaggcctctggcccgagtcgacaggctcagcataagtgatgggaccccatccctgagcgaagcggagacccagcatggcgtat

SEQ ID NO: 388429 - DNA, 140 bp, Artificial Sequence
  Synthetic
atacgccatgctgggtctcctcccaaagatgcccggcctcccctttatctcctgccaaaaggggtacaggggcgtgtgggccggcactggcatcatgaccacacgatgtccttgcggcgccgtacttgggagtcggccat

SEQ ID NO: 388430 - DNA, 140 bp, Artificial Sequence
  Synthetic
atggccgactcccaagtacggcgccgcaaggacatcgtgtggtcatgatgccagtgccggcccacacgcccctgtaccccttttggcaggagataaaggggaggccgggcatctttgggaggagacccagcatggcgtat

SEQ ID NO: 388431 - DNA, 140 bp, Artificial Sequence
  Synthetic
atacgccatgctgggtctccgagggccagtgcgtgccgaaacccgcgccaaacttcaagaccgccatctggagggtggcggcctcggagtacgcggaggtgacgcagcacgggtcatactcgtacttgggagtcggccat

SEQ ID NO: 388432 - DNA, 140 bp, Artificial Sequence
  Synthetic
atggccgactcccaagtacgagtatgacccgtgctgcgtcacctccgcgtactccgaggccgccaccctccagatggcggtcttgaagtttggcgcgggtttcggcacgcactggccctcggagacccagcatggcgtat

SEQ ID NO: 388433 - DNA, 140 bp, Artificial Sequence
  Synthetic
atacgccatgctgggtctccggctcaattcgtttgtcgtcgggtctcagcttccctgtgaccctgagcccgacgcagacgtattgacgtccatgctaacagatccgtcccatatcacggccgtacttgggagtcggccat

SEQ ID NO: 388434 - DNA, 140 bp, Artificial Sequence
  Synthetic
atggccgactcccaagtacggccgtgatatgggacggatctgttagcatggacgtcaatacgtctgcgtcgggctcagggtcacagggaagctgagacccgacgacaaacgaattgagccggagacccagcatggcgtat

SEQ ID NO: 388435 - DNA, 140 bp, Artificial Sequence
  Synthetic
atacgccatgctgggtctcccagattaccaaccgcctactgttgcgggctgtgctctcccccctcccaagaagactccgacgccccccccaaggagacgtcggacagtgggtctaaacgacgtacttgggagtcggccat

SEQ ID NO: 388436 - DNA, 140 bp, Artificial Sequence
  Synthetic
atggccgactcccaagtacgtcgtttagacccactgtccgacgtctccttggggggggcgtcggagtcttcttgggaggggggagagcacagcccgcaacagtaggcggttggtaatctgggagacccagcatggcgtat

SEQ ID NO: 388437 - DNA, 140 bp, Artificial Sequence
  Synthetic
aggccctggctgctgatatgtcctagcgggcatagcgtatttctccatggtgggaaactgggcgaaagtcctggtagtgctgttgctattcgccggcgtcgacgcagaaaccgtcatcaggaccttttgggacagcggtg

SEQ ID NO: 388438 - DNA, 140 bp, Artificial Sequence
  Synthetic
caccgctgtcccaaaaggtcctgatgacggtttctgcgtcgacgccggcgaatagcaacagcactaccaggactttcgcccagtttcccaccatggagaaatacgctatgcccgctaggacatatcagcagccagggcct

SEQ ID NO: 388439 - DNA, 140 bp, Artificial Sequence
  Synthetic
atacgccatgctgggtctccactctttcgatccgctccgagcagaggaggatgagagggaaatatccgttccggcggagatcctgctgaaatccaggagattccccccagcgctgcccatcgtacttgggagtcggccat

SEQ ID NO: 388440 - DNA, 140 bp, Artificial Sequence
  Synthetic
atggccgactcccaagtacgatgggcagcgctggggggaatctcctggatttcagcaggatctccgccggaacggatatttccctctcatcctcctctgctcggagcggatcgaaagagtggagacccagcatggcgtat

SEQ ID NO: 388441 - DNA, 140 bp, Artificial Sequence
  Synthetic
atacgccatgctgggtctccatcaataggacggccttgaactgcaatgaaaacattgaaaccggctggatagcggggcttttctattacaaccaatttaactcttcaggctgccccgagccgtacttgggagtcggccat

SEQ ID NO: 388442 - DNA, 140 bp, Artificial Sequence
  Synthetic
atggccgactcccaagtacggctcggggcagcctgaagagttaaattggttgtaatagaaaagccccgctatccagccggtttcaatgttttcattgcagttcaaggccgtcctattgatggagacccagcatggcgtat

SEQ ID NO: 388443 - DNA, 140 bp, Artificial Sequence
  Synthetic
aggccctggctgctgatatgcatcggaggggtgggcaacaacaccttgctctgccccactgattgcttccgcaaacatccggaagccacatactctcggtgcggctccggtccctggattgaccttttgggacagcggtg

SEQ ID NO: 388444 - DNA, 140 bp, Artificial Sequence
  Synthetic
caccgctgtcccaaaaggtcaatccagggaccggagccgcaccgagagtatgtggcttccggatgtttgcggaagcaatcagtggggcagagcaaggtgttgttgcccacccctccgatgcatatcagcagccagggcct

SEQ ID NO: 388445 - DNA, 140 bp, Artificial Sequence
  Synthetic
atacgccatgctgggtctccactgagagagacattagaactgaggagtccatataccgggcctgctccctgcccgaggaggcccacactgccatacactcgctaactgagagactctacgcgtacttgggagtcggccat

SEQ ID NO: 388446 - DNA, 140 bp, Artificial Sequence
  Synthetic
atggccgactcccaagtacgcgtagagtctctcagttagcgagtgtatggcagtgtgggcctcctcgggcagggagcaggcccggtatatggactcctcagttctaatgtctctctcagtggagacccagcatggcgtat

SEQ ID NO: 388447 - DNA, 140 bp, Artificial Sequence
  Synthetic
aggccctggctgctgatatgtgctatttgccggcgtcgacgcagagacccacgtcactggggggaatgtcgcccgcgccgcttctggacttgctggcctcctcagtccaggcgctaagcagaccttttgggacagcggtg

SEQ ID NO: 388448 - DNA, 140 bp, Artificial Sequence
  Synthetic
caccgctgtcccaaaaggtctgcttagcgcctggactgaggaggccagcaagtccagaagcggcgcgggcgacattccccccagtgacgtgggtctctgcgtcgacgccggcaaatagcacatatcagcagccagggcct

SEQ ID NO: 388449 - DNA, 140 bp, Artificial Sequence
  Synthetic
aggccctggctgctgatatgcctgcttgctgcaggggtaggcatctacctcctccccaaccgatgaaggttggggtaaacactccggcctcttaggccacttcctggtttttttttttttgaccttttgggacagcggtg

SEQ ID NO: 388450 - DNA, 140 bp, Artificial Sequence
  Synthetic
caccgctgtcccaaaaggtcaaaaaaaaaaaaaccaggaagtggcctaagaggccggagtgtttaccccaaccttcatcggttggggaggaggtagatgcctacccctgcagcaagcaggcatatcagcagccagggcct

SEQ ID NO: 388451 - DNA, 140 bp, Artificial Sequence
  Synthetic
aggccctggctgctgatatgtggggtaaacactccggcctcttaggccacttcctggtttttttttttttttttcccctttttttttttttttttttttttttttttttttttttcccccgaccttttgggacagcggtg

SEQ ID NO: 388452 - DNA, 140 bp, Artificial Sequence
  Synthetic
caccgctgtcccaaaaggtcgggggaaaaaaaaaaaaaaaaaaaaaaaaaaaaaaaaaaaaaggggaaaaaaaaaaaaaaaaaccaggaagtggcctaagaggccggagtgtttaccccacatatcagcagccagggcct

SEQ ID NO: 388453 - DNA, 140 bp, Artificial Sequence
  Synthetic
atacgccatgctgggtctccgcggtgaagaccaagctcaaactcactccattgccggaggcacgcctcctggatttatccagttggtttaccgtcggcgccggcgggggcgacatttatccgtacttgggagtcggccat

SEQ ID NO: 388454 - DNA, 140 bp, Artificial Sequence
  Synthetic
atggccgactcccaagtacggataaatgtcgcccccgccggcgccgacggtaaaccaactggataaatccaggaggcgtgcctccggcaatggagtgagtttgagcttggtcttcaccgcggagacccagcatggcgtat

SEQ ID NO: 388455 - DNA, 140 bp, Artificial Sequence
  Synthetic
  misc_feature (104)..(104): n is a, c, g, or t
atacgccatgctgggtctccggttgctccttttctatcttcttgctggccctgttgtcttgcatcactgttccggtctccgctgcccaagtgaagaacactagnagcggttacatggtgacgtacttgggagtcggccat

SEQ ID NO: 388456 - DNA, 140 bp, Artificial Sequence
  Synthetic
  misc_feature (37)..(37): n is a, c, g, or t
atggccgactcccaagtacgtcaccatgtaaccgctnctagtgttcttcacttgggcagcggagaccggaacagtgatgcaagacaacagggccagcaagaagatagaaaaggagcaaccggagacccagcatggcgtat

SEQ ID NO: 388457 - DNA, 140 bp, Artificial Sequence
  Synthetic
  misc_feature (96)..(96): n is a, c, g, or t
atacgccatgctgggtctccgtgttggataccggtctcaccaaacgtggctgtgcggcagcccggcgccctcacgcaaggcctgcggacgcacctngacatggttgtgatgtccgccacgcgtacttgggagtcggccat

SEQ ID NO: 388458 - DNA, 140 bp, Artificial Sequence
  Synthetic
  misc_feature (45)..(45): n is a, c, g, or t
atggccgactcccaagtacgcgtggcggacatcacaaccatgtcnaggtgcgtccgcaggccttgcgtgagggcgccgggctgccgcacagccacgtttggtgagaccggtatccaacacggagacccagcatggcgtat

SEQ ID NO: 388459 - DNA, 140 bp, Artificial Sequence
  Synthetic
aggccctggctgctgatatggtgtgtggcccggtatactgcttcactcccagccccgtggtggtgggaacgaccgacaggtcgggcgcgcctacctacaactggggtgaaaatgacacgggaccttttgggacagcggtg

SEQ ID NO: 388460 - DNA, 140 bp, Artificial Sequence
  Synthetic
caccgctgtcccaaaaggtcccgtgtcattttcaccccagttgtaggtaggcgcgcccgacctgtcggtcgttcccaccaccacggggctgggagtgaagcagtataccgggccacacaccatatcagcagccagggcct

SEQ ID NO: 388461 - DNA, 140 bp, Artificial Sequence
  Synthetic
atacgccatgctgggtctccgaacgactgttccaactctagcatagtgtatgagacagcggacatgatcatgcacacccctgggtgcgtgccctgcgttcaggagagcagcaccatctcccgtacttgggagtcggccat

SEQ ID NO: 388462 - DNA, 140 bp, Artificial Sequence
  Synthetic
atggccgactcccaagtacgggagatggtgctgctctcctgaacgcagggcacgcacccaggggtgtgcatgatcatgtccgctgtctcatacactatgctagagttggaacagtcgttcggagacccagcatggcgtat

SEQ ID NO: 388463 - DNA, 140 bp, Artificial Sequence
  Synthetic
  misc_feature (22)..(22): n is a, c, g, or t
  misc_feature (24)..(24): n is a, c, g, or t
  misc_feature (32)..(32): n is a, c, g, or t
atacgccatgctgggtctccgntntggcgccnagcagaacatccagctcattaacaccaatggcagttggcacatcaaccgcactgccctgaattgcaatgactctttgaacactggcttcgtacttgggagtcggccat

SEQ ID NO: 388464 - DNA, 140 bp, Artificial Sequence
  Synthetic
  misc_feature (109)..(109): n is a, c, g, or t
  misc_feature (117)..(117): n is a, c, g, or t
  misc_feature (119)..(119): n is a, c, g, or t
atggccgactcccaagtacgaagccagtgttcaaagagtcattgcaattcagggcagtgcggttgatgtgccaactgccattggtgttaatgagctggatgttctgctnggcgccanancggagacccagcatggcgtat

SEQ ID NO: 388465 - DNA, 140 bp, Artificial Sequence
  Synthetic
aggccctggctgctgatatgaggttttgattgtcatgctactctttaccggcgttgacggcgtcacccacacgacagggggagcgacagcccaaggtgctagggggttagtgtccttcttgaccttttgggacagcggtg

SEQ ID NO: 388466 - DNA, 140 bp, Artificial Sequence
  Synthetic
caccgctgtcccaaaaggtcaagaaggacactaaccccctagcaccttgggctgtcgctccccctgtcgtgtgggtgacgccgtcaacgccggtaaagagtagcatgacaatcaaaacctcatatcagcagccagggcct

SEQ ID NO: 388467 - DNA, 140 bp, Artificial Sequence
  Synthetic
atacgccatgctgggtctccaccgttgcgacttggaggacagagataggagtcagctgtctcctttgttgcactctaccacggaatgggccattttgccctgctcctactcggacctgcccgtacttgggagtcggccat

SEQ ID NO: 388468 - DNA, 140 bp, Artificial Sequence
  Synthetic
atggccgactcccaagtacgggcaggtccgagtaggagcagggcaaaatggcccattccgtggtagagtgcaacaaaggagacagctgactcctatctctgtcctccaagtcgcaacggtggagacccagcatggcgtat

SEQ ID NO: 388469 - DNA, 140 bp, Artificial Sequence
  Synthetic
atacgccatgctgggtctccccccttggctgcctattccctcaccggcctatggtctttctgcctattgctcctagtactgccccagcaggcttatgcctatgaggcatctgtgcacggacgtacttgggagtcggccat

SEQ ID NO: 388470 - DNA, 140 bp, Artificial Sequence
  Synthetic
atggccgactcccaagtacgtccgtgcacagatgcctcataggcataagcctgctggggcagtactaggagcaataggcagaaagaccataggccggtgagggaataggcagccaaggggggagacccagcatggcgtat

SEQ ID NO: 388471 - DNA, 140 bp, Artificial Sequence
  Synthetic
aggccctggctgctgatatgcgcggtggccgggatggcatcatctgggccgccactatattctgcccgggcgtggtgtttgacataaccaagtggcttttggcggcgcttgggtctggctgaccttttgggacagcggtg

SEQ ID NO: 388472 - DNA, 140 bp, Artificial Sequence
  Synthetic
caccgctgtcccaaaaggtcagccagacccaagcgccgccaaaagccacttggttatgtcaaacaccacgcccgggcagaatatagtggcggcccagatgatgccatcccggccaccgcgcatatcagcagccagggcct

SEQ ID NO: 388473 - DNA, 140 bp, Artificial Sequence
  Synthetic
atacgccatgctgggtctcccagtccttccttggaacatccatctcgggggtcttatggactgtctaccacggagctggcaataagactctagccggctcacggggcccagtcacccagacgtacttgggagtcggccat

SEQ ID NO: 388474 - DNA, 140 bp, Artificial Sequence
  Synthetic
atggccgactcccaagtacgtctgggtgactgggccccgtgagccggctagagtcttattgccagctccgtggtagacagtccataagacccccgagatggatgttccaaggaaggactgggagacccagcatggcgtat

SEQ ID NO: 388475 - DNA, 140 bp, Artificial Sequence
  Synthetic
aggccctggctgctgatatggctatgacgcgggttgtgcttggtacgagctcacacccgccgagacctcagtcaggttgcgggcttacctaaatacaccagggttgcccgtctgccaggagaccttttgggacagcggtg

SEQ ID NO: 388476 - DNA, 140 bp, Artificial Sequence
  Synthetic
caccgctgtcccaaaaggtctcctggcagacgggcaaccctggtgtatttaggtaagcccgcaacctgactgaggtctcggcgggtgtgagctcgtaccaagcacaacccgcgtcatagccatatcagcagccagggcct

SEQ ID NO: 388477 - DNA, 140 bp, Artificial Sequence
  Synthetic
aggccctggctgctgatatggccgctgttggcagcataggccttgggaaggtgcttgtggacattctggcgggctatggagcaggagtggcaggcgcactcgtggcctttaaggtcatgagaccttttgggacagcggtg

SEQ ID NO: 388478 - DNA, 140 bp, Artificial Sequence
  Synthetic
caccgctgtcccaaaaggtctcatgaccttaaaggccacgagtgcgcctgccactcctgctccatagcccgccagaatgtccacaagcaccttcccaaggcctatgctgccaacagcggccatatcagcagccagggcct

SEQ ID NO: 388479 - DNA, 140 bp, Artificial Sequence
  Synthetic
aggccctggctgctgatatgggcttaattcatttgtcgtcgggtctcagcttccttgtgaccctgaacccgacacagacgtattgatgtccatgctaacagatccatcccatattacggcgaccttttgggacagcggtg

SEQ ID NO: 388480 - DNA, 140 bp, Artificial Sequence
  Synthetic
caccgctgtcccaaaaggtcgccgtaatatgggatggatctgttagcatggacatcaatacgtctgtgtcgggttcagggtcacaaggaagctgagacccgacgacaaatgaattaagcccatatcagcagccagggcct

SEQ ID NO: 388481 - DNA, 140 bp, Artificial Sequence
  Synthetic
aggccctggctgctgatatgacctccacggtcccctcctatacctccgcctcggaagaagcggacggtggtcctcactgattcaaccgtgtccactgccttggccgagcttgccgccaaagaccttttgggacagcggtg

SEQ ID NO: 388482 - DNA, 140 bp, Artificial Sequence
  Synthetic
caccgctgtcccaaaaggtctttggcggcaagctcggccaaggcagtggacacggttgaatcagtgaggaccaccgtccgcttcttccgaggcggaggtataggaggggaccgtggaggtcatatcagcagccagggcct

SEQ ID NO: 388483 - DNA, 140 bp, Artificial Sequence
  Synthetic
aggccctggctgctgatatgacccacggcaagacctatgatgtggacatggtggatgccaacctgttcatggggggcgatgtgactcggatagagtctgagtccaaagtggtcgttctgggaccttttgggacagcggtg

SEQ ID NO: 388484 - DNA, 140 bp, Artificial Sequence
  Synthetic
caccgctgtcccaaaaggtcccagaacgaccactttggactcagactctatccgagtcacatcgccccccatgaacaggttggcatccaccatgtccacatcataggtcttgccgtgggtcatatcagcagccagggcct

SEQ ID NO: 388485 - DNA, 140 bp, Artificial Sequence
  Synthetic
aggccctggctgctgatatgctgggcacggcctgactacaaccctccgcttgtggaatcgtggaagaggcccgattaccaaccgcccactgttgcgggctgtgctctcccccctcctaaggaccttttgggacagcggtg

SEQ ID NO: 388486 - DNA, 140 bp, Artificial Sequence
  Synthetic
caccgctgtcccaaaaggtccttaggaggggggagagcacagcccgcaacagtgggcggttggtaatcgggcctcttccacgattccacaagcggagggttgtagtcaggccgtgcccagcatatcagcagccagggcct

SEQ ID NO: 388487 - DNA, 140 bp, Artificial Sequence
  Synthetic
atacgccatgctgggtctccagccccccccaagcggcgactcaggcctttccacgggggcggacgctgccgactccggcggccaggcgtcccccgatgagttggctctttcggagacaggcgtacttgggagtcggccat

SEQ ID NO: 388488 - DNA, 140 bp, Artificial Sequence
  Synthetic
atggccgactcccaagtacgcctgtctccgaaagagccaactcatcgggggacgcctggccgccggagtcggcagcgtccgcccccgtggaaaggcctgagtcgccgcttggggggggctggagacccagcatggcgtat

SEQ ID NO: 388489 - DNA, 140 bp, Artificial Sequence
  Synthetic
aggccctggctgctgatatgtggttttgcctactcctgcttgctgcaggggtaggcatctacctcctccccaaccggtgaaggttggggtaaacactccggcctcttaggccatttcctggaccttttgggacagcggtg

SEQ ID NO: 388490 - DNA, 140 bp, Artificial Sequence
  Synthetic
caccgctgtcccaaaaggtccaggaaatggcctaagaggccggagtgtttaccccaaccttcaccggttggggaggaggtagatgcctacccctgcagcaagcaggagtaggcaaaaccacatatcagcagccagggcct

SEQ ID NO: 388491 - DNA, 140 bp, Artificial Sequence
  Synthetic
aggccctggctgctgatatggccagtttgcttaaagtaccctacttcgtgcgcgtccaaggccttctccggatctgcgcgctggcgcggaagatggtcggaggccattacgtgcaaatgggaccttttgggacagcggtg

SEQ ID NO: 388492 - DNA, 140 bp, Artificial Sequence
  Synthetic
caccgctgtcccaaaaggtcccatttgcacgtaatggcctccgaccatcttccgcgccagcgcgcagatccggagaaggccttggacgcgcacgaagtagggtactttaagcaaactggccatatcagcagccagggcct

SEQ ID NO: 388493 - DNA, 140 bp, Artificial Sequence
  Synthetic
aggccctggctgctgatatgggagggtgaggtccagattgtgtcaactgctgcccaaaccttcctggcaacgtgcatcaatggggtatgctggactgtctaccacggggccggaacgagggaccttttgggacagcggtg

SEQ ID NO: 388494 - DNA, 140 bp, Artificial Sequence
  Synthetic
caccgctgtcccaaaaggtccctcgttccggccccgtggtagacagtccagcataccccattgatgcacgttgccaggaaggtttgggcagcagttgacacaatctggacctcaccctcccatatcagcagccagggcct

SEQ ID NO: 388495 - DNA, 140 bp, Artificial Sequence
  Synthetic
atacgccatgctgggtctccaaccgcttcaactcgtcaggatgtcctgaacgcctgtccgtttgccgcaatatcgaggccttccggataggatggggcaccttgcaatacgaggataatgcgtacttgggagtcggccat

SEQ ID NO: 388496 - DNA, 140 bp, Artificial Sequence
  Synthetic
atggccgactcccaagtacgcattatcctcgtattgcaaggtgccccatcctatccggaaggcctcgatattgcggcaaacggacaggcgttcaggacatcctgacgagttgaagcggttggagacccagcatggcgtat

SEQ ID NO: 388497 - DNA, 140 bp, Artificial Sequence
  Synthetic
atacgccatgctgggtctccccggcgtcgacgcgaacacctacgtcaccgggggagctgccggcctcaccacggccggatttgctggtttcttcatgggaagcacttcaagaggccccaacgtacttgggagtcggccat

SEQ ID NO: 388498 - DNA, 140 bp, Artificial Sequence
  Synthetic
atggccgactcccaagtacgttggggcctcttgaagtgcttcccatgaagaaaccagcaaatccggccgtggtgaggccggcagctcccccggtgacgtaggtgttcgcgtcgacgccggggagacccagcatggcgtat

SEQ ID NO: 388499 - DNA, 140 bp, Artificial Sequence
  Synthetic
aggccctggctgctgatatgtgccagtgtctgcagtggaagtcaggaacattagttctagctactacgccactaatgattgctcaaacaacagcatcacctggcagctcactgacgcagtgaccttttgggacagcggtg

SEQ ID NO: 388500 - DNA, 140 bp, Artificial Sequence
  Synthetic
caccgctgtcccaaaaggtcactgcgtcagtgagctgccaggtgatgctgttgtttgagcaatcattagtggcgtagtagctagaactaatgttcctgacttccactgcagacactggcacatatcagcagccagggcct

SEQ ID NO: 388501 - DNA, 140 bp, Artificial Sequence
  Synthetic
aggccctggctgctgatatgattgctggatacaagtaacacccaacgtggctgtgaaacaccgcggtgcgctcactcgtagcctgcgaacacacgtcgacatgatcgtaatggcagctacgaccttttgggacagcggtg

SEQ ID NO: 388502 - DNA, 140 bp, Artificial Sequence
  Synthetic
caccgctgtcccaaaaggtcgtagctgccattacgatcatgtcgacgtgtgttcgcaggctacgagtgagcgcaccgcggtgtttcacagccacgttgggtgttacttgtatccagcaatcatatcagcagccagggcct

SEQ ID NO: 388503 - DNA, 140 bp, Artificial Sequence
  Synthetic
atacgccatgctgggtctccgcacataaaccggactgccctcaattgcaatgacagcttacagacgggtttcctcgcttccttgttttacacccacaagttcaacagctctggctgcccccgtacttgggagtcggccat

SEQ ID NO: 388504 - DNA, 140 bp, Artificial Sequence
  Synthetic
atggccgactcccaagtacgggggcagccagagctgttgaacttgtgggtgtaaaacaaggaagcgaggaaacccgtctgtaagctgtcattgcaattgagggcagtccggtttatgtgcggagacccagcatggcgtat

SEQ ID NO: 388505 - DNA, 140 bp, Artificial Sequence
  Synthetic
atacgccatgctgggtctccgagcgcttgtcttcctgccgcgggctggacgattttcgcatcggctggggaaccttggaatacgaaaccaacgtcaccaacgatggggacatgaggccgtcgtacttgggagtcggccat

SEQ ID NO: 388506 - DNA, 140 bp, Artificial Sequence
  Synthetic
atggccgactcccaagtacgacggcctcatgtccccatcgttggtgacgttggtttcgtattccaaggttccccagccgatgcgaaaatcgtccagcccgcggcaggaagacaagcgctcggagacccagcatggcgtat

SEQ ID NO: 388507 - DNA, 140 bp, Artificial Sequence
  Synthetic
aggccctggctgctgatatgtgcacctggatgaacgggactgggttcactaagacatgcggtgcaccaccttgccgcattaggaaagactacaacagcactatcgatttattgtgccccagaccttttgggacagcggtg

SEQ ID NO: 388508 - DNA, 140 bp, Artificial Sequence
  Synthetic
caccgctgtcccaaaaggtctggggcacaataaatcgatagtgctgttgtagtctttcctaatgcggcaaggtggtgcaccgcatgtcttagtgaacccagtcccgttcatccaggtgcacatatcagcagccagggcct

SEQ ID NO: 388509 - DNA, 140 bp, Artificial Sequence
  Synthetic
aggccctggctgctgatatggcattatccgtgcactgtaaacttcaccatcttcaaggcgcggatgtatgtaggaggggtggagcatcgattctccgcagcatgcaacttcacgcgcggagaccttttgggacagcggtg

SEQ ID NO: 388510 - DNA, 140 bp, Artificial Sequence
  Synthetic
caccgctgtcccaaaaggtctccgcgcgtgaagttgcatgctgcggagaatcgatgctccacccctcctacatacatccgcgccttgaagatggtgaagtttacagtgcacggataatgccatatcagcagccagggcct

SEQ ID NO: 388511 - DNA, 140 bp, Artificial Sequence
  Synthetic
aggccctggctgctgatatgatatgccttctatggcgtatggccgctgtttctgctcctgctggcgttaccaccacgagcatacgccatggaccgggaggtggctgcatcgtgcggaggcgaccttttgggacagcggtg

SEQ ID NO: 388512 - DNA, 140 bp, Artificial Sequence
  Synthetic
caccgctgtcccaaaaggtcgcctccgcacgatgcagccacctcccggtccatggcgtatgctcgtggtggtaacgccagcaggagcagaaacagcggccatacgccatagaaggcatatcatatcagcagccagggcct

SEQ ID NO: 388513 - DNA, 140 bp, Artificial Sequence
  Synthetic
atacgccatgctgggtctccgatgccatcatcctcctcatgtgcgtggtccacccagagctgatttttgacatcaccaaaatgttgctcgccgtgctcggtccgctcatggtgctccaggcgtacttgggagtcggccat

SEQ ID NO: 388514 - DNA, 140 bp, Artificial Sequence
  Synthetic
atggccgactcccaagtacgcctggagcaccatgagcggaccgagcacggcgagcaacattttggtgatgtcaaaaatcagctctgggtggaccacgcacatgaggaggatgatggcatcggagacccagcatggcgtat

SEQ ID NO: 388515 - DNA, 140 bp, Artificial Sequence
  Synthetic
aggccctggctgctgatatgcatcaccaaaatgttgctcgccgtgctcggtccgctcatggtgctccaggctgccataattaaagtgccgtacttcgtgcgcgcacaagggctcattcgtgaccttttgggacagcggtg

SEQ ID NO: 388516 - DNA, 140 bp, Artificial Sequence
  Synthetic
caccgctgtcccaaaaggtcacgaatgagcccttgtgcgcgcacgaagtacggcactttaattatggcagcctggagcaccatgagcggaccgagcacggcgagcaacattttggtgatgcatatcagcagccagggcct

SEQ ID NO: 388517 - DNA, 140 bp, Artificial Sequence
  Synthetic
atacgccatgctgggtctccgtggtttttcatcttctttacagcggcctggtacttaaagggcagggtggtccccgtggccacgtactctgtcctcggcttatggtccttcctcctcctacgtacttgggagtcggccat

SEQ ID NO: 388518 - DNA, 140 bp, Artificial Sequence
  Synthetic
atggccgactcccaagtacgtaggaggaggaaggaccataagccgaggacagagtacgtggccacggggaccaccctgccctttaagtaccaggccgctgtaaagaagatgaaaaaccacggagacccagcatggcgtat

SEQ ID NO: 388519 - DNA, 140 bp, Artificial Sequence
  Synthetic
aggccctggctgctgatatggttgagcccgttgtcttctctgacatggagaccaagatcatcacctggggggcagacaccgcggcgtgtggggacatcatcttgggcctacccgtctccggaccttttgggacagcggtg

SEQ ID NO: 388520 - DNA, 140 bp, Artificial Sequence
  Synthetic
caccgctgtcccaaaaggtccggagacgggtaggcccaagatgatgtccccacacgccgcggtgtctgccccccaggtgatgatcttggtctccatgtcagagaagacaacgggctcaaccatatcagcagccagggcct

SEQ ID NO: 388521 - DNA, 140 bp, Artificial Sequence
  Synthetic
atacgccatgctgggtctccccgaggggggcgtgacgggatcatctgggtggctgtcattctacacccacgccttgtgtttgaggtcacgaaatggttgttagcaatcctggggcctgcccgtacttgggagtcggccat

SEQ ID NO: 388522 - DNA, 140 bp, Artificial Sequence
  Synthetic
atggccgactcccaagtacgggcaggccccaggattgctaacaaccatttcgtgacctcaaacacaaggcgtgggtgtagaatgacagccacccagatgatcccgtcacgcccccctcggggagacccagcatggcgtat

SEQ ID NO: 388523 - DNA, 140 bp, Artificial Sequence
  Synthetic
aggccctggctgctgatatgtgggcggcaacatcaccagggttgagtcagagaacaaagtggtgattctggactccttcgatccgcttgtggcggaggaggacgagcgggagatctccgtgaccttttgggacagcggtg

SEQ ID NO: 388524 - DNA, 140 bp, Artificial Sequence
  Synthetic
caccgctgtcccaaaaggtcacggagatctcccgctcgtcctcctccgccacaagcggatcgaaggagtccagaatcaccactttgttctctgactcaaccctggtgatgttgccgcccacatatcagcagccagggcct

SEQ ID NO: 388525 - DNA, 140 bp, Artificial Sequence
  Synthetic
aggccctggctgctgatatgctcctgtgcccccgcctcggaagaagcgtacggtagtcctcaacgcatcaaccgtatctgctgccttggccgagcttgccaccaaaacctttggcaactcgaccttttgggacagcggtg

SEQ ID NO: 388526 - DNA, 140 bp, Artificial Sequence
  Synthetic
caccgctgtcccaaaaggtcgagttgccaaaggttttggtggcaagctcggccaaggcagcagatacggttgatgcgttgaggactaccgtacgcttcttccgaggcgggggcacaggagcatatcagcagccagggcct

SEQ ID NO: 388527 - DNA, 140 bp, Artificial Sequence
  Synthetic
aggccctggctgctgatatgcaggagaacgcccctcgggcatgttcgattcctcggtcctgtgtgagtgctatgacgcgggttgtgcttggtacgagctcacacccgctgagacctcagtgaccttttgggacagcggtg

SEQ ID NO: 388528 - DNA, 140 bp, Artificial Sequence
  Synthetic
caccgctgtcccaaaaggtcactgaggtctcagcgggtgtgagctcgtaccaagcacaacccgcgtcatagcactcacacaggaccgaggaatcgaacatgcccgaggggcgttctcctgcatatcagcagccagggcct

SEQ ID NO: 388529 - DNA, 140 bp, Artificial Sequence
  Synthetic
aggccctggctgctgatatgtgcgacgagctcgcagcggccctccggggcatgggtgtcaatgccgttgcatactataggggtctcgacgtctccgttataccaactcaaggagacgtgggaccttttgggacagcggtg

SEQ ID NO: 388530 - DNA, 140 bp, Artificial Sequence
  Synthetic
caccgctgtcccaaaaggtcccacgtctccttgagttggtataacggagacgtcgagacccctatagtatgcaacggcattgacacccatgccccggagggccgctgcgagctcgtcgcacatatcagcagccagggcct

SEQ ID NO: 388531 - DNA, 140 bp, Artificial Sequence
  Synthetic
atacgccatgctgggtctccaaggcctcctacaacaggccacaaggcaagctcaagacatacagccagctatacagtcatcatggcccaagcttgaacaattttgggccaaacacatgtgcgtacttgggagtcggccat

SEQ ID NO: 388532 - DNA, 140 bp, Artificial Sequence
  Synthetic
atggccgactcccaagtacgcacatgtgtttggcccaaaattgttcaagcttgggccatgatgactgtatagctggctgtatgtcttgagcttgccttgtggcctgttgtaggaggccttggagacccagcatggcgtat

SEQ ID NO: 388533 - DNA, 140 bp, Artificial Sequence
  Synthetic
aggccctggctgctgatatggcaatcctgcgccgccacgtcggtcagggagagggagcggtccagtggatgaacagactgatcgccttcgcctccaggggaaaccacgttgcccctacccgaccttttgggacagcggtg

SEQ ID NO: 388534 - DNA, 140 bp, Artificial Sequence
  Synthetic
caccgctgtcccaaaaggtcgggtaggggcaacgtggtttcccctggaggcgaaggcgatcagtctgttcatccactggaccgctccctctccctgaccgacgtggcggcgcaggattgccatatcagcagccagggcct

SEQ ID NO: 388535 - DNA, 140 bp, Artificial Sequence
  Synthetic
atacgccatgctgggtctccctccccaagatgcccggcattccctttatctcttgccagaagggatacaagggtgtatgggctggtacgggtgtcatgactactcggtgcccatgtggagcgtacttgggagtcggccat

SEQ ID NO: 388536 - DNA, 140 bp, Artificial Sequence
  Synthetic
atggccgactcccaagtacgctccacatgggcaccgagtagtcatgacacccgtaccagcccatacacccttgtatcccttctggcaagagataaagggaatgccgggcatcttggggagggagacccagcatggcgtat

SEQ ID NO: 388537 - DNA, 140 bp, Artificial Sequence
  Synthetic
aggccctggctgctgatatgacatggtctatgccacaacatcccgcagcgcaagccagcggcagaagaaggtcacctttgacagactgcaagtcctggacgaccactaccgggacgtgctgaccttttgggacagcggtg

SEQ ID NO: 388538 - DNA, 140 bp, Artificial Sequence
  Synthetic
caccgctgtcccaaaaggtcagcacgtcccggtagtggtcgtccaggacttgcagtctgtcaaaggtgaccttcttctgccgctggcttgcgctgcgggatgttgtggcatagaccatgtcatatcagcagccagggcct

SEQ ID NO: 388539 - DNA, 140 bp, Artificial Sequence
  Synthetic
aggccctggctgctgatatgaaccagaatacgacttggagctcataacatcgtgctcctccaacgtgtcagtcgcccacgacggcgctggaaagagggtctactaccttacccgtgacccgaccttttgggacagcggtg

SEQ ID NO: 388540 - DNA, 140 bp, Artificial Sequence
  Synthetic
caccgctgtcccaaaaggtcgggtcacgggtaaggtagtagaccctctttccagcgccgtcgtgggcgactgacacgttggaggagcacgatgttatgagctccaagtcgtattctggttcatatcagcagccagggcct

SEQ ID NO: 388541 - DNA, 140 bp, Artificial Sequence
  Synthetic
atacgccatgctgggtctccactccgccaaatcgcgatacggatttggggcaaaagaggtgcgcagcttatccaggagggccgttaaccacatccggtccgtgtgggaggacctcctggacgtacttgggagtcggccat

SEQ ID NO: 388542 - DNA, 140 bp, Artificial Sequence
  Synthetic
atggccgactcccaagtacgtccaggaggtcctcccacacggaccggatgtggttaacggccctcctggataagctgcgcacctcttttgccccaaatccgtatcgcgatttggcggagtggagacccagcatggcgtat

SEQ ID NO: 388543 - DNA, 140 bp, Artificial Sequence
  Synthetic
aggccctggctgctgatatgccgtcgcccacaggacgttaagttcccgggtggcggtcagatcgttggtggagtttacttgttgccgcgcaggggccctagattgggtgtgcgcgcgacggaccttttgggacagcggtg

SEQ ID NO: 388544 - DNA, 140 bp, Artificial Sequence
  Synthetic
caccgctgtcccaaaaggtccgtcgcgcgcacacccaatctagggcccctgcgcggcaacaagtaaactccaccaacgatctgaccgccacccgggaacttaacgtcctgtgggcgacggcatatcagcagccagggcct

SEQ ID NO: 388545 - DNA, 140 bp, Artificial Sequence
  Synthetic
atacgccatgctgggtctccgttatgttggtgtgtggagacgacctggtcgtcatctcagagagccaaggtaacgaggaggacgagcgaaacctgagagctttcacggaggctatgaccacgtacttgggagtcggccat

SEQ ID NO: 388546 - DNA, 140 bp, Artificial Sequence
  Synthetic
atggccgactcccaagtacgtggtcatagcctccgtgaaagctctcaggtttcgctcgtcctcctcgttaccttggctctctgagatgacgaccaggtcgtctccacacaccaacataacggagacccagcatggcgtat

SEQ ID NO: 388547 - DNA, 140 bp, Artificial Sequence
  Synthetic
atacgccatgctgggtctccggtattccgcccctcccggtgaccttcccagaccggaatatgacttggagcttataacatcctgctcctcaaacgtatcggtagcgctggactctcggggcgtacttgggagtcggccat

SEQ ID NO: 388548 - DNA, 140 bp, Artificial Sequence
  Synthetic
atggccgactcccaagtacgccccgagagtccagcgctaccgatacgtttgaggagcaggatgttataagctccaagtcatattccggtctgggaaggtcaccgggaggggcggaataccggagacccagcatggcgtat

SEQ ID NO: 388549 - DNA, 140 bp, Artificial Sequence
  Synthetic
atacgccatgctgggtctccataattgaaaggctacatgggcttgaagccttttcactgcacacatactctccccacgaactctcacgggtggcagcaactctcagaaaacttggagcgccgtacttgggagtcggccat

SEQ ID NO: 388550 - DNA, 140 bp, Artificial Sequence
  Synthetic
atggccgactcccaagtacggcgctccaagttttctgagagttgctgccacccgtgagagttcgtggggagagtatgtgtgcagtgaaaaggcttcaagcccatgtagcctttcaattatggagacccagcatggcgtat

SEQ ID NO: 388551 - DNA, 140 bp, Artificial Sequence
  Synthetic
aggccctggctgctgatatgtccccacgaactctcacgggtggcagcaactctcagaaaacttggagcgcctccccttagagcgtggaagagtcgggcgcgtgccgtgagagcttcactcgaccttttgggacagcggtg

SEQ ID NO: 388552 - DNA, 140 bp, Artificial Sequence
  Synthetic
caccgctgtcccaaaaggtcgagtgaagctctcacggcacgcgcccgactcttccacgctctaaggggaggcgctccaagttttctgagagttgctgccacccgtgagagttcgtggggacatatcagcagccagggcct

SEQ ID NO: 388553 - DNA, 140 bp, Artificial Sequence
  Synthetic
aggccctggctgctgatatgtctgctccgctatgtacgtgggggatctctgcggatctgttttcctcgtctcccagctgttcaccttctcgcctcgccggcatgagacggtgcaggactggaccttttgggacagcggtg

SEQ ID NO: 388554 - DNA, 140 bp, Artificial Sequence
  Synthetic
caccgctgtcccaaaaggtccagtcctgcaccgtctcatgccggcgaggcgagaaggtgaacagctgggagacgaggaaaacagatccgcagagatcccccacgtacatagcggagcagacatatcagcagccagggcct

SEQ ID NO: 388555 - DNA, 140 bp, Artificial Sequence
  Synthetic
atacgccatgctgggtctcctggatttatccgggtggttcaccgtgggcgccggcgggggcgacatttatcacagcgtgtcgcatgcccgaccccgcctattactcctttgcctactcctcgtacttgggagtcggccat

SEQ ID NO: 388556 - DNA, 140 bp, Artificial Sequence
  Synthetic
atggccgactcccaagtacgaggagtaggcaaaggagtaataggcggggtcgggcatgcgacacgctgtgataaatgtcgcccccgccggcgcccacggtgaaccacccggataaatccaggagacccagcatggcgtat

SEQ ID NO: 388557 - DNA, 140 bp, Artificial Sequence
  Synthetic
aggccctggctgctgatatggggggagacatctcatcttctgtcactcaaagaagaagtgcgacgagctcgccgcaaagctggtcgcattgggcatcaatgccgtggcctactaccgcgggaccttttgggacagcggtg

SEQ ID NO: 388558 - DNA, 140 bp, Artificial Sequence
  Synthetic
caccgctgtcccaaaaggtcccgcggtagtaggccacggcattgatgcccaatgcgaccagctttgcggcgagctcgtcgcacttcttctttgagtgacagaagatgagatgtctccccccatatcagcagccagggcct

SEQ ID NO: 388559 - DNA, 140 bp, Artificial Sequence
  Synthetic
atacgccatgctgggtctccatccgggccgactcagaaaatccagcttgtaaacaccaacggcagctggcacatcaacaggactgccctgaactgcaacgactccctcaacaccgggttccgtacttgggagtcggccat

SEQ ID NO: 388560 - DNA, 140 bp, Artificial Sequence
  Synthetic
atggccgactcccaagtacggaacccggtgttgagggagtcgttgcagttcagggcagtcctgttgatgtgccagctgccgttggtgtttacaagctggattttctgagtcggcccggatggagacccagcatggcgtat

SEQ ID NO: 388561 - DNA, 140 bp, Artificial Sequence
  Synthetic
aggccctggctgctgatatgcttgccgcgctgttctacacacacaagttcaacgcgtccgggtgcccagagcgcatggccagctgccgccccattgacgagttcgctcaggggtggggtcgaccttttgggacagcggtg

SEQ ID NO: 388562 - DNA, 140 bp, Artificial Sequence
  Synthetic
caccgctgtcccaaaaggtcgaccccacccctgagcgaactcgtcaatggggcggcagctggccatgcgctctgggcacccggacgcgttgaacttgtgtgtgtagaacagcgcggcaagcatatcagcagccagggcct

SEQ ID NO: 388563 - DNA, 140 bp, Artificial Sequence
  Synthetic
atacgccatgctgggtctccgcgcatggccagctgccgccccattgacgagttcgctcaggggtggggtcccatcacttacgctgagccgcccagctcggaccagaggccttattgctggcgtacttgggagtcggccat

SEQ ID NO: 388564 - DNA, 140 bp, Artificial Sequence
  Synthetic
atggccgactcccaagtacgccagcaataaggcctctggtccgagctgggcggctcagcgtaagtgatgggaccccacccctgagcgaactcgtcaatggggcggcagctggccatgcgcggagacccagcatggcgtat

SEQ ID NO: 388565 - DNA, 140 bp, Artificial Sequence
  Synthetic
aggccctggctgctgatatgcagccttgtccaccggcctcatccacctccaccagaacatcgtggacgtgcagtacctgtacggggtggggtcaagcattgcatcctgggccatcaagtggaccttttgggacagcggtg

SEQ ID NO: 388566 - DNA, 140 bp, Artificial Sequence
  Synthetic
caccgctgtcccaaaaggtccacttgatggcccaggatgcaatgcttgaccccaccccgtacaggtactgcacgtccacgatgttctggtggaggtggatgaggccggtggacaaggctgcatatcagcagccagggcct

SEQ ID NO: 388567 - DNA, 140 bp, Artificial Sequence
  Synthetic
aggccctggctgctgatatgggaggacagggatagatcagagcttagcccgctgctgctgtctacaacagagtggcagatactgccctgttccttcaccaccctaccggctctgtccactgaccttttgggacagcggtg

SEQ ID NO: 388568 - DNA, 140 bp, Artificial Sequence
  Synthetic
caccgctgtcccaaaaggtcagtggacagagccggtagggtggtgaaggaacagggcagtatctgccactctgttgtagacagcagcagcgggctaagctctgatctatccctgtcctcccatatcagcagccagggcct

SEQ ID NO: 388569 - DNA, 140 bp, Artificial Sequence
  Synthetic
aggccctggctgctgatatggagttcgatgagatggaagagtgctctcagcacttaccgtacatcgagcaagggatgatgctcgccgagcagttcaagcagaaggccctcggcctcctgcgaccttttgggacagcggtg

SEQ ID NO: 388570 - DNA, 140 bp, Artificial Sequence
  Synthetic
caccgctgtcccaaaaggtcgcaggaggccgagggccttctgcttgaactgctcggcgagcatcatcccttgctcgatgtacggtaagtgctgagagcactcttccatctcatcgaactccatatcagcagccagggcct

SEQ ID NO: 388571 - DNA, 140 bp, Artificial Sequence
  Synthetic
aggccctggctgctgatatgctgactagagtagaagcgcaactgcacgtgtgggttccccccctcaacgtccgaggggggcgcgatgctgtcatcttgctcatgtgtgttatacacccgagaccttttgggacagcggtg

SEQ ID NO: 388572 - DNA, 140 bp, Artificial Sequence
  Synthetic
caccgctgtcccaaaaggtctcgggtgtataacacacatgagcaagatgacagcatcgcgcccccctcggacgttgagggggggaacccacacgtgcagttgcgcttctactctagtcagcatatcagcagccagggcct

SEQ ID NO: 388573 - DNA, 140 bp, Artificial Sequence
  Synthetic
aggccctggctgctgatatgggtgtggtatttggcttggcctatttctccatgcagggagcgtgggccaaggtcattgccatcctccttcttgttgcgggagtggatgcgaccacctattgaccttttgggacagcggtg

SEQ ID NO: 388574 - DNA, 140 bp, Artificial Sequence
  Synthetic
caccgctgtcccaaaaggtcaataggtggtcgcatccactcccgcaacaagaaggaggatggcaatgaccttggcccacgctccctgcatggagaaataggccaagccaaataccacacccatatcagcagccagggcct

SEQ ID NO: 388575 - DNA, 140 bp, Artificial Sequence
  Synthetic
atacgccatgctgggtctccgcacataaaccggaccgccctcaactgcaatgacagcttgcacacgggtttcatggccgccctgttttatgccaacaaattcaacagctctggctgcccccgtacttgggagtcggccat

SEQ ID NO: 388576 - DNA, 140 bp, Artificial Sequence
  Synthetic
atggccgactcccaagtacgggggcagccagagctgttgaatttgttggcataaaacagggcggccatgaaacccgtgtgcaagctgtcattgcagttgagggcggtccggtttatgtgcggagacccagcatggcgtat

SEQ ID NO: 388577 - DNA, 140 bp, Artificial Sequence
  Synthetic
atacgccatgctgggtctccgagcgtttgtcttcctgccgtgggctggatgattttcgtatcgggtggggaaccttggaatacgagaccaacgtcaccaatgttgaagacatgaggccgtcgtacttgggagtcggccat

SEQ ID NO: 388578 - DNA, 140 bp, Artificial Sequence
  Synthetic
atggccgactcccaagtacgacggcctcatgtcttcaacattggtgacgttggtctcgtattccaaggttccccacccgatacgaaaatcatccagcccacggcaggaagacaaacgctcggagacccagcatggcgtat

SEQ ID NO: 388579 - DNA, 140 bp, Artificial Sequence
  Synthetic
aggccctggctgctgatatgcagactgttttaggaagcacccagatgctacctatgttaagtgtggagcagggccctggttgacccccaggtgcctgatagactacccttacagactgtggaccttttgggacagcggtg

SEQ ID NO: 388580 - DNA, 140 bp, Artificial Sequence
  Synthetic
caccgctgtcccaaaaggtccacagtctgtaagggtagtctatcaggcacctgggggtcaaccagggccctgctccacacttaacataggtagcatctgggtgcttcctaaaacagtctgcatatcagcagccagggcct

SEQ ID NO: 388581 - DNA, 140 bp, Artificial Sequence
  Synthetic
aggccctggctgctgatatgtacccggtggggtcgcaattaccttgcgagcccgaaccggacgtggccgtgttgacgtccatgctcactgatccctcccatataacagcagaggcggccggaccttttgggacagcggtg

SEQ ID NO: 388582 - DNA, 140 bp, Artificial Sequence
  Synthetic
caccgctgtcccaaaaggtccggccgcctctgctgttatatgggagggatcagtgagcatggacgtcaacacggccacgtccggttcgggctcgcaaggtaattgcgaccccaccgggtacatatcagcagccagggcct

SEQ ID NO: 388583 - DNA, 140 bp, Artificial Sequence
  Synthetic
aggccctggctgctgatatggcactccaccactgagtgggcggtgttgccatgctccttctccgacctaccggcactatctactggcctgttgcaccttcaccaaaacatcgtggacgtggaccttttgggacagcggtg

SEQ ID NO: 388584 - DNA, 140 bp, Artificial Sequence
  Synthetic
caccgctgtcccaaaaggtccacgtccacgatgttttggtgaaggtgcaacaggccagtagatagtgccggtaggtcggagaaggagcatggcaacaccgcccactcagtggtggagtgccatatcagcagccagggcct

SEQ ID NO: 388585 - DNA, 140 bp, Artificial Sequence
  Synthetic
aggccctggctgctgatatgcatgcctttggatgctcatcatactgggccaagctgaggcggcgcttgagaagctcatcatcttgcactccgctagcgctgctagtgccaatgggccgctgaccttttgggacagcggtg

SEQ ID NO: 388586 - DNA, 140 bp, Artificial Sequence
  Synthetic
caccgctgtcccaaaaggtcagcggcccattggcactagcagcgctagcggagtgcaagatgatgagcttctcaagcgccgcctcagcttggcccagtatgatgagcatccaaaggcatgcatatcagcagccagggcct

SEQ ID NO: 388587 - DNA, 140 bp, Artificial Sequence
  Synthetic
aggccctggctgctgatatggtggttcttcatcttttttacggcggcctggtacttaaagggcagagtggtccccgcggccacatactctgttctcggcttgtggtcctttctccttctagaccttttgggacagcggtg

SEQ ID NO: 388588 - DNA, 140 bp, Artificial Sequence
  Synthetic
caccgctgtcccaaaaggtctagaaggagaaaggaccacaagccgagaacagagtatgtggccgcggggaccactctgccctttaagtaccaggccgccgtaaaaaagatgaagaaccaccatatcagcagccagggcct

SEQ ID NO: 388589 - DNA, 140 bp, Artificial Sequence
  Synthetic
aggccctggctgctgatatgttgctccgggggcgcctatgacatcataatatgtgatgagtgccactcaactgactcgactaccatcttgggcatcggcacagtcctggaccaagcggaggaccttttgggacagcggtg

SEQ ID NO: 388590 - DNA, 140 bp, Artificial Sequence
  Synthetic
caccgctgtcccaaaaggtcctccgcttggtccaggactgtgccgatgcccaagatggtagtcgagtcagttgagtggcactcatcacatattatgatgtcataggcgcccccggagcaacatatcagcagccagggcct

SEQ ID NO: 388591 - DNA, 140 bp, Artificial Sequence
  Synthetic
atacgccatgctgggtctccagtcaccgtgccacaccccaatattgaggaggtggccctgtccaatatcggagagatccccttttatggcaaagccatccccctcggaaccatcaaggggcgtacttgggagtcggccat

SEQ ID NO: 388592 - DNA, 140 bp, Artificial Sequence
  Synthetic
atggccgactcccaagtacgccccttgatggttccgagggggatggctttgccataaaaggggatctctccgatattggacagggccacctcctcaatattggggtgtggcacggtgactggagacccagcatggcgtat

SEQ ID NO: 388593 - DNA, 140 bp, Artificial Sequence
  Synthetic
atacgccatgctgggtctcccacaatctggtgtattccaccacctcacgcagtgcttgccaaaggcagaagaaagtcacatttgacagactgcaagtcctggacagccattaccaggacgcgtacttgggagtcggccat

SEQ ID NO: 388594 - DNA, 140 bp, Artificial Sequence
  Synthetic
atggccgactcccaagtacgcgtcctggtaatggctgtccaggacttgcagtctgtcaaatgtgactttcttctgcctttggcaagcactgcgtgaggtggtggaatacaccagattgtgggagacccagcatggcgtat

SEQ ID NO: 388595 - DNA, 140 bp, Artificial Sequence
  Synthetic
aggccctggctgctgatatgggatacaatacttagcaggcttgtccactctgcctgggaaccccgcaatagcatcactgatggcattcacagcctccatcaccagcccgctcaccacccagaccttttgggacagcggtg

SEQ ID NO: 388596 - DNA, 140 bp, Artificial Sequence
  Synthetic
caccgctgtcccaaaaggtctgggtggtgagcgggctggtgatggaggctgtgaatgccatcagtgatgctattgcggggttcccaggcagagtggacaagcctgctaagtattgtatcccatatcagcagccagggcct

SEQ ID NO: 388597 - DNA, 140 bp, Artificial Sequence
  Synthetic
aggccctggctgctgatatgcttgcctgactgtgcccgcttcagcctaccaagtgcgcaactccacggggctttaccatgtcaccaatgattgccctaactcgagtattgtgtacgaggcgaccttttgggacagcggtg

SEQ ID NO: 388598 - DNA, 140 bp, Artificial Sequence
  Synthetic
caccgctgtcccaaaaggtcgcctcgtacacaatactcgagttagggcaatcattggtgacatggtaaagccccgtggagttgcgcacttggtaggctgaagcgggcacagtcaggcaagcatatcagcagccagggcct

SEQ ID NO: 388599 - DNA, 140 bp, Artificial Sequence
  Synthetic
aggccctggctgctgatatggtgtgtcaagaccacctggagttctgggaagcggtcttcacaggtctcacacacatcgatgcccacttcctctcccagacgaagcaaggaggagataactgaccttttgggacagcggtg

SEQ ID NO: 388600 - DNA, 140 bp, Artificial Sequence
  Synthetic
caccgctgtcccaaaaggtcagttatctcctccttgcttcgtctgggagaggaagtgggcatcgatgtgtgtgagacctgtgaagaccgcttcccagaactccaggtggtcttgacacaccatatcagcagccagggcct

SEQ ID NO: 388601 - DNA, 140 bp, Artificial Sequence
  Synthetic
aggccctggctgctgatatgcaacggcagttggcacatcaataggacggccttgaactgcaatgatagccttcacaccggctggatagcagggcttctctattacaacaaattcaactctgaccttttgggacagcggtg

SEQ ID NO: 388602 - DNA, 140 bp, Artificial Sequence
  Synthetic
caccgctgtcccaaaaggtcagagttgaatttgttgtaatagagaagccctgctatccagccggtgtgaaggctatcattgcagttcaaggccgtcctattgatgtgccaactgccgttgcatatcagcagccagggcct

SEQ ID NO: 388603 - DNA, 140 bp, Artificial Sequence
  Synthetic
atacgccatgctgggtctccccactgcccaccagcaccaccatcctcttgaacatcatgggggggtggttggcctcccagattgccccccctgccggagccaccggcttcgttgtcagtgcgtacttgggagtcggccat

SEQ ID NO: 388604 - DNA, 140 bp, Artificial Sequence
  Synthetic
atggccgactcccaagtacgcactgacaacgaagccggtggctccggcagggggggcaatctgggaggccaaccacccccccatgatgttcaagaggatggtggtgctggtgggcagtggggagacccagcatggcgtat

SEQ ID NO: 388605 - DNA, 140 bp, Artificial Sequence
  Synthetic
aggccctggctgctgatatgaagagcgtgtgtggcccggtgtattgcttcactcccagccccgtggtggtgggaacgaccgacaggtcgggcgcgcctacctacaactggggtgaaaatggaccttttgggacagcggtg

SEQ ID NO: 388606 - DNA, 140 bp, Artificial Sequence
  Synthetic
caccgctgtcccaaaaggtccattttcaccccagttgtaggtaggcgcgcccgacctgtcggtcgttcccaccaccacggggctgggagtgaagcaatacaccgggccacacacgctcttcatatcagcagccagggcct

SEQ ID NO: 388607 - DNA, 140 bp, Artificial Sequence
  Synthetic
atacgccatgctgggtctccgcctagtgggggcagcagtcggaagtataggcctgggtaagatattggtggacgtcctagccgggtacggtgcaggcatttcaggggccctcgtggctttcgtacttgggagtcggccat

SEQ ID NO: 388608 - DNA, 140 bp, Artificial Sequence
  Synthetic
atggccgactcccaagtacgaaagccacgagggcccctgaaatgcctgcaccgtacccggctaggacgtccaccaatatcttacccaggcctatacttccgactgctgcccccactaggcggagacccagcatggcgtat

SEQ ID NO: 388609 - DNA, 140 bp, Artificial Sequence
  Synthetic
aggccctggctgctgatatgggtccctggatcacacccaggtgcctggtccactacccgtataggctttggcattacccttgtaccgtcaactacaccatatttaaagtcaggatgtacggaccttttgggacagcggtg

SEQ ID NO: 388610 - DNA, 140 bp, Artificial Sequence
  Synthetic
caccgctgtcccaaaaggtccgtacatcctgactttaaatatggtgtagttgacggtacaagggtaatgccaaagcctatacgggtagtggaccaggcacctgggtgtgatccagggacccatatcagcagccagggcct

SEQ ID NO: 388611 - DNA, 140 bp, Artificial Sequence
  Synthetic
aggccctggctgctgatatgcacaagccgtcatggacatggtggcgggggcccactggggagtcctggcgggccttgcctactattccatggtggggaactgggctaaggtcttgattgtgaccttttgggacagcggtg

SEQ ID NO: 388612 - DNA, 140 bp, Artificial Sequence
  Synthetic
caccgctgtcccaaaaggtcacaatcaagaccttagcccagttccccaccatggaatagtaggcaaggcccgccaggactccccagtgggcccccgccaccatgtccatgacggcttgtgcatatcagcagccagggcct

SEQ ID NO: 388613 - DNA, 140 bp, Artificial Sequence
  Synthetic
aggccctggctgctgatatgagtttaacagctcagggtgccccgaacgactcgcaagctgcaaggcccttgacacattcgaccaaggttggggctcacttggggtcgctaacatcagcgggaccttttgggacagcggtg

SEQ ID NO: 388614 - DNA, 140 bp, Artificial Sequence
  Synthetic
caccgctgtcccaaaaggtcccgctgatgttagcgaccccaagtgagccccaaccttggtcgaatgtgtcaagggccttgcagcttgcgagtcgttcggggcaccctgagctgttaaactcatatcagcagccagggcct

SEQ ID NO: 388615 - DNA, 140 bp, Artificial Sequence
  Synthetic
aggccctggctgctgatatgtagtgcgaggctcctctcagtagaggaagcctgcgcgttgaccccgccccactccgccaaatcacgatacggatttggggcaaaggaggtgcgcagcttagaccttttgggacagcggtg

SEQ ID NO: 388616 - DNA, 140 bp, Artificial Sequence
  Synthetic
caccgctgtcccaaaaggtctaagctgcgcacctcctttgccccaaatccgtatcgtgatttggcggagtggggcggggtcaacgcgcaggcttcctctactgagaggagcctcgcactacatatcagcagccagggcct

SEQ ID NO: 388617 - DNA, 140 bp, Artificial Sequence
  Synthetic
aggccctggctgctgatatgggagtcaccgaggatgccagtgcactgcgagctttcacggaggctatgaccagatactcggctcctccaggggacgaaccgcatcccgagtacgacctgggaccttttgggacagcggtg

SEQ ID NO: 388618 - DNA, 140 bp, Artificial Sequence
  Synthetic
caccgctgtcccaaaaggtcccaggtcgtactcgggatgcggttcgtcccctggaggagccgagtatctggtcatagcctccgtgaaagctcgcagtgcactggcatcctcggtgactcccatatcagcagccagggcct

SEQ ID NO: 388619 - DNA, 140 bp, Artificial Sequence
  Synthetic
aggccctggctgctgatatgtaccctgaccttggggtcagggtgtgcgaaaagatggccctttatgacattgcacaaaagcttcccaaggcaataatggggccgtcctatgggttccaatgaccttttgggacagcggtg

SEQ ID NO: 388620 - DNA, 140 bp, Artificial Sequence
  Synthetic
caccgctgtcccaaaaggtcattggaacccataggacggccccattattgccttgggaagcttttgtgcaatgtcataaagggccatcttttcgcacaccctgaccccaaggtcagggtacatatcagcagccagggcct

SEQ ID NO: 388621 - DNA, 140 bp, Artificial Sequence
  Synthetic
atacgccatgctgggtctccactctcctgcagaacgggtcgattttctcctcaaagcttggggaagtaagaaggacccaatggggttctcatatgacacccgctgcttcgactcaaccgtcgtacttgggagtcggccat

SEQ ID NO: 388622 - DNA, 140 bp, Artificial Sequence
  Synthetic
atggccgactcccaagtacgacggttgagtcgaagcagcgggtgtcatatgagaaccccattgggtccttcttacttccccaagctttgaggagaaaatcgacccgttctgcaggagagtggagacccagcatggcgtat

SEQ ID NO: 388623 - DNA, 140 bp, Artificial Sequence
  Synthetic
aggccctggctgctgatatggtaggagggcccatgacaaacagcaaagggcaatcctgcggttacaggcgttgccgcgcaagcggtgtcttcactaccagcatggggaacaccatgacatgaccttttgggacagcggtg

SEQ ID NO: 388624 - DNA, 140 bp, Artificial Sequence
  Synthetic
caccgctgtcccaaaaggtcatgtcatggtgttccccatgctggtagtgaagacaccgcttgcgcggcaacgcctgtaaccgcaggattgccctttgctgtttgtcatgggccctcctaccatatcagcagccagggcct

SEQ ID NO: 388625 - DNA, 140 bp, Artificial Sequence
  Synthetic
aggccctggctgctgatatggttttgattgtgatgctactctttgccggcgttgacggacgcacccacgtgtcaggggggacggcaggccaaaacacctacagcctgacctccatctttagaccttttgggacagcggtg

SEQ ID NO: 388626 - DNA, 140 bp, Artificial Sequence
  Synthetic
caccgctgtcccaaaaggtctaaagatggaggtcaggctgtaggtgttttggcctgccgtcccccctgacacgtgggtgcgtccgtcaacgccggcaaagagtagcatcacaatcaaaaccatatcagcagccagggcct

SEQ ID NO: 388627 - DNA, 140 bp, Artificial Sequence
  Synthetic
aggccctggctgctgatatgctttgccgcgctgttctacgcacacaagttcaactcgtccgggtgtccagagcgcatggccagctgccgccccattgacaagttcgatcaggggtggggtgaccttttgggacagcggtg

SEQ ID NO: 388628 - DNA, 140 bp, Artificial Sequence
  Synthetic
caccgctgtcccaaaaggtcaccccacccctgatcgaacttgtcaatggggcggcagctggccatgcgctctggacacccggacgagttgaacttgtgtgcgtagaacagcgcggcaaagcatatcagcagccagggcct

SEQ ID NO: 388629 - DNA, 140 bp, Artificial Sequence
  Synthetic
aggccctggctgctgatatgactcgtccgtcctctgtgagtgctatgacgcgggctgtgcttggtatgagctcacacccgccgagaccacagttaggctacgagcgtacatgaacaccccgaccttttgggacagcggtg

SEQ ID NO: 388630 - DNA, 140 bp, Artificial Sequence
  Synthetic
caccgctgtcccaaaaggtcggggtgttcatgtacgctcgtagcctaactgtggtctcggcgggtgtgagctcataccaagcacagcccgcgtcatagcactcacagaggacggacgagtcatatcagcagccagggcct

SEQ ID NO: 388631 - DNA, 140 bp, Artificial Sequence
  Synthetic
atacgccatgctgggtctcccgaaagatcggcgctccaccggcaagtcctggggaaagccaggatatccttggcccctgtacggaaacgagggttgcggctgggcaggttggctcctgtccgtacttgggagtcggccat

SEQ ID NO: 388632 - DNA, 140 bp, Artificial Sequence
  Synthetic
atggccgactcccaagtacggacaggagccaacctgcccagccgcaaccctcgtttccgtacaggggccaaggatatcctggctttccccaggacttgccggtggagcgccgatctttcgggagacccagcatggcgtat

SEQ ID NO: 388633 - DNA, 140 bp, Artificial Sequence
  Synthetic
atacgccatgctgggtctcctaatggcagctacggtctgctcggccttgtacgtgggagatgtgtgcggagccgtgatgatcgtgtcgcaggctctcatagtatcgccagaacgccacaacgtacttgggagtcggccat

SEQ ID NO: 388634 - DNA, 140 bp, Artificial Sequence
  Synthetic
atggccgactcccaagtacgttgtggcgttctggcgatactatgagagcctgcgacacgatcatcacggctccgcacacatctcccacgtacaaggccgagcagaccgtagctgccattaggagacccagcatggcgtat

SEQ ID NO: 388635 - DNA, 140 bp, Artificial Sequence
  Synthetic
aggccctggctgctgatatgctatgcggtccccggtcttcacggacaactcgtcccctccggccgtaccgcagacattccaagtggcccatctacacgctcccactggcagcggcaagaggaccttttgggacagcggtg

SEQ ID NO: 388636 - DNA, 140 bp, Artificial Sequence
  Synthetic
caccgctgtcccaaaaggtcctcttgccgctgccagtgggagcgtgtagatgggccacttggaatgtctgcggtacggccggaggggacgagttgtccgtgaagaccggggaccgcatagcatatcagcagccagggcct

SEQ ID NO: 388637 - DNA, 140 bp, Artificial Sequence
  Synthetic
aggccctggctgctgatatgagtcctattcttccatgccccccctggagggggagcctggggatccggatctcagcgacgggtcatggtcgacggtcagtagtgaggccggcacggaggagaccttttgggacagcggtg

SEQ ID NO: 388638 - DNA, 140 bp, Artificial Sequence
  Synthetic
caccgctgtcccaaaaggtctcctccgtgccggcctcactactgaccgtcgaccatgacccgtcgctgagatccggatccccaggctccccctccagggggggcatggaagaataggactcatatcagcagccagggcct

SEQ ID NO: 388639 - DNA, 140 bp, Artificial Sequence
  Synthetic
aggccctggctgctgatatgcaacttgcaccaccaaccatgactcccctgacgccgagctcatagaggctaacctcctgtggaggcaggagatgggcggtaacatcaccagggttgagtcgaccttttgggacagcggtg

SEQ ID NO: 388640 - DNA, 140 bp, Artificial Sequence
  Synthetic
caccgctgtcccaaaaggtcgactcaaccctggtgatgttaccgcccatctcctgcctccacaggaggttagcctctatgagctcggcgtcaggggagtcatggttggtggtgcaagttgcatatcagcagccagggcct

SEQ ID NO: 388641 - DNA, 140 bp, Artificial Sequence
  Synthetic
aggccctggctgctgatatgttattgtgccccacagactgttttaggaagcacccaggtgctacatatattaaatgtggagcagggccttggttgacccccaggtgcgtggtagattaccgaccttttgggacagcggtg

SEQ ID NO: 388642 - DNA, 140 bp, Artificial Sequence
  Synthetic
caccgctgtcccaaaaggtcggtaatctaccacgcacctgggggtcaaccaaggccctgctccacatttaatatatgtagcacctgggtgcttcctaaaacagtctgtggggcacaataacatatcagcagccagggcct

SEQ ID NO: 388643 - DNA, 140 bp, Artificial Sequence
  Synthetic
aggccctggctgctgatatgggccgatgccatcctgcactctccggggtgtgttctttgcgtccgcgagggtaacacctcgaaatgttgggtggcggtggcccccacagtggccaccagggaccttttgggacagcggtg

SEQ ID NO: 388644 - DNA, 140 bp, Artificial Sequence
  Synthetic
caccgctgtcccaaaaggtccctggtggccactgtgggggccaccgccacccaacatttcgaggtgttaccctcgcggacgcaaagaacacaccccggagagtgcaggatggcatcggcccatatcagcagccagggcct

SEQ ID NO: 388645 - DNA, 140 bp, Artificial Sequence
  Synthetic
aggccctggctgctgatatgggcatgtgggcccaggagagggggctgtgcagtggatgaaccggctgatagcgttcgcttcgcggggtaaccacgtctcccccacgcactatgtgcctgagaccttttgggacagcggtg

SEQ ID NO: 388646 - DNA, 140 bp, Artificial Sequence
  Synthetic
caccgctgtcccaaaaggtctcaggcacatagtgcgtgggggagacgtggttaccccgcgaagcgaacgctatcagccggttcatccactgcacagccccctctcctgggcccacatgcccatatcagcagccagggcct

SEQ ID NO: 388647 - DNA, 140 bp, Artificial Sequence
  Synthetic
aggccctggctgctgatatgcaacggcagttggcacatcaatcgcacggccttgaactgtaatgcgagccacgacactggctgggtagcgcggctcttctattaccacagattcaactctgaccttttgggacagcggtg

SEQ ID NO: 388648 - DNA, 140 bp, Artificial Sequence
  Synthetic
caccgctgtcccaaaaggtcagagttgaatctgtggtaatagaagagccgcgctacccagccagtgtcgtggctcgcattacagttcaaggccgtgcgattgatgtgccaactgccgttgcatatcagcagccagggcct

SEQ ID NO: 388649 - DNA, 140 bp, Artificial Sequence
  Synthetic
atacgccatgctgggtctccagtagtctcttcacacgaggcgccaggcagaacatccagctgatcaacaccaacggtagttggcacattaataggacggccttgaactgcaatgatagcccgtacttgggagtcggccat

SEQ ID NO: 388650 - DNA, 140 bp, Artificial Sequence
  Synthetic
atggccgactcccaagtacgggctatcattgcagttcaaggccgtcctattaatgtgccaactaccgttggtgttgatcagctggatgttctgcctggcgcctcgtgtgaagagactactggagacccagcatggcgtat

SEQ ID NO: 388651 - DNA, 140 bp, Artificial Sequence
  Synthetic
aggccctggctgctgatatggcccctactgctggcactaccccccaaaaccttgcggtattgtgcctgcaaagagcgtgtgtggcccggtgtattgtttcactcccagccccgtggtggtgaccttttgggacagcggtg

SEQ ID NO: 388652 - DNA, 140 bp, Artificial Sequence
  Synthetic
caccgctgtcccaaaaggtcaccaccacggggctgggagtgaaacaatacaccgggccacacacgctctttgcaggcacaataccgcaaggttttggggggtagtgccagcagtaggggccatatcagcagccagggcct

SEQ ID NO: 388653 - DNA, 140 bp, Artificial Sequence
  Synthetic
aggccctggctgctgatatgcttggtctaccgtgagcgaggaggctagtgaggacgtcgtctgctgctcgatgtcctacacatggacaggcgccctgatcacgccatgcgccgcggaggagaccttttgggacagcggtg

SEQ ID NO: 388654 - DNA, 140 bp, Artificial Sequence
  Synthetic
caccgctgtcccaaaaggtctcctccgcggcgcatggcgtgatcagggcgcctgtccatgtgtaggacatcgagcagcagacgacgtcctcactagcctcctcgctcacggtagaccaagcatatcagcagccagggcct

SEQ ID NO: 388655 - DNA, 140 bp, Artificial Sequence
  Synthetic
aggccctggctgctgatatgatgtcctacacatggacaggcgccctgatcacgccatgcgccgcggaggaaagcaagctgcccatcaatgcgttgagcaactctttgctgcgtcaccacagaccttttgggacagcggtg

SEQ ID NO: 388656 - DNA, 140 bp, Artificial Sequence
  Synthetic
caccgctgtcccaaaaggtctgtggtgacgcagcaaagagttgctcaacgcattgatgggcagcttgctttcctccgcggcgcatggcgtgatcagggcgcctgtccatgtgtaggacatcatatcagcagccagggcct

SEQ ID NO: 388657 - DNA, 140 bp, Artificial Sequence
  Synthetic
atacgccatgctgggtctcctcacgggtctcacacacattgatgcccacttcctctcccagacgaagcaaggaggagacaactttgcgtatctgacggcctatcaggccacagtatgcgccgtacttgggagtcggccat

SEQ ID NO: 388658 - DNA, 140 bp, Artificial Sequence
  Synthetic
atggccgactcccaagtacggcgcatactgtggcctgataggccgtcagatacgcaaagttgtctcctccttgcttcgtctgggagaggaagtgggcatcaatgtgtgtgagacccgtgaggagacccagcatggcgtat

SEQ ID NO: 388659 - DNA, 140 bp, Artificial Sequence
  Synthetic
aggccctggctgctgatatggtccttcctcgtgtttttctgctttgcatggtatctgaggggtaggtgggcgcccggggtggcctacgccttctacgggatgtggcctctcctcctgctcgaccttttgggacagcggtg

SEQ ID NO: 388660 - DNA, 140 bp, Artificial Sequence
  Synthetic
caccgctgtcccaaaaggtcgagcaggaggagaggccacatcccgtagaaggcgtaggccaccccgggcgcccacctacccctcagataccatgcaaagcagaaaaacacgaggaaggaccatatcagcagccagggcct

SEQ ID NO: 388661 - DNA, 140 bp, Artificial Sequence
  Synthetic
aggccctggctgctgatatgcgcccggggtggcctacgccttctacgggatgtggcctctcctcctgctcctgttggcgttgccccaacgggcatacgcgctggacacggagatggccgcgaccttttgggacagcggtg

SEQ ID NO: 388662 - DNA, 140 bp, Artificial Sequence
  Synthetic
caccgctgtcccaaaaggtcgcggccatctccgtgtccagcgcgtatgcccgttggggcaacgccaacaggagcaggaggagaggccacatcccgtagaaggcgtaggccaccccgggcgcatatcagcagccagggcct

SEQ ID NO: 388663 - DNA, 140 bp, Artificial Sequence
  Synthetic
atacgccatgctgggtctccgatcaccaagatcttgcttgccatgctcggtccgctcatggtgctccaggctagtataactaaaatgccgtacttcgtacgcgcacaagggctcattcgtcgtacttgggagtcggccat

SEQ ID NO: 388664 - DNA, 140 bp, Artificial Sequence
  Synthetic
atggccgactcccaagtacgacgaatgagcccttgtgcgcgtacgaagtacggcattttagttatactagcctggagcaccatgagcggaccgagcatggcaagcaagatcttggtgatcggagacccagcatggcgtat

SEQ ID NO: 388665 - DNA, 140 bp, Artificial Sequence
  Synthetic
aggccctggctgctgatatgcatattacaagcgctatatcagctggtgcttatggtggcttcagtactttctgaccagagtagaagcgcaactgcacgtgtgggtcccccccctcaacgtgaccttttgggacagcggtg

SEQ ID NO: 388666 - DNA, 140 bp, Artificial Sequence
  Synthetic
caccgctgtcccaaaaggtcacgttgaggggggggacccacacgtgcagttgcgcttctactctggtcagaaagtactgaagccaccataagcaccagctgatatagcgcttgtaatatgcatatcagcagccagggcct

SEQ ID NO: 388667 - DNA, 140 bp, Artificial Sequence
  Synthetic
aggccctggctgctgatatgggtcctggtagtgctgctgctatttgccggcgtcgacgcggaaacctacatcagcgggcaaggcgctgctcacgccacgcgtcaatttgtcgacatcttcgaccttttgggacagcggtg

SEQ ID NO: 388668 - DNA, 140 bp, Artificial Sequence
  Synthetic
caccgctgtcccaaaaggtcgaagatgtcgacaaattgacgcgtggcgtgagcagcgccttgcccgctgatgtaggtttccgcgtcgacgccggcaaatagcagcagcactaccaggacccatatcagcagccagggcct

SEQ ID NO: 388669 - DNA, 140 bp, Artificial Sequence
  Synthetic
aggccctggctgctgatatgtggattcttcaagccagtttgcttaaagtaccctacttcgtgcgcgtccaaggccttctccggatctgcgcgctagcgcggaagatggtcggaggccattgaccttttgggacagcggtg

SEQ ID NO: 388670 - DNA, 140 bp, Artificial Sequence
  Synthetic
caccgctgtcccaaaaggtcaatggcctccgaccatcttccgcgctagcgcgcagatccggagaaggccttggacgcgcacgaagtagggtactttaagcaaactggcttgaagaatccacatatcagcagccagggcct

SEQ ID NO: 388671 - DNA, 140 bp, Artificial Sequence
  Synthetic
atacgccatgctgggtctccggttagcagggcttttcaacctccgcaaattcaactcttcaggctgtcgcgagaggatggccagctgccaaccccttaccgcttttgcccagggctggggcgtacttgggagtcggccat

SEQ ID NO: 388672 - DNA, 140 bp, Artificial Sequence
  Synthetic
atggccgactcccaagtacgccccagccctgggcaaaagcggtaaggggttggcagctggccatcctctcgcgacagcctgaagagttgaatttgcggaggttgaaaagccctgctaaccggagacccagcatggcgtat

SEQ ID NO: 388673 - DNA, 140 bp, Artificial Sequence
  Synthetic
atacgccatgctgggtctcctcctattagctacgccatcggaagcggccccgaccagcgcccatactgctggcactacgccccaaaaccttgtggtatcgtacccgcaagaaacgtatgccgtacttgggagtcggccat

SEQ ID NO: 388674 - DNA, 140 bp, Artificial Sequence
  Synthetic
atggccgactcccaagtacggcatacgtttcttgcgggtacgataccacaaggttttggggcgtagtgccagcagtatgggcgctggtcggggccgcttccgatggcgtagctaataggaggagacccagcatggcgtat

SEQ ID NO: 388675 - DNA, 140 bp, Artificial Sequence
  Synthetic
atacgccatgctgggtctccccggcactacctccctgggcccgtccagaatacaaccctcctgtgatcgagacatggaagaggccggactatgaaccacccactgtcctaggctgtgccccgtacttgggagtcggccat

SEQ ID NO: 388676 - DNA, 140 bp, Artificial Sequence
  Synthetic
atggccgactcccaagtacggggcacagcctaggacagtgggtggttcatagtccggcctcttccatgtctcgatcacaggagggttgtattctggacgggcccagggaggtagtgccggggagacccagcatggcgtat

SEQ ID NO: 388677 - DNA, 140 bp, Artificial Sequence
  Synthetic
aggccctggctgctgatatgctccggatcccacaagccgtcgtggacatggtggcgggggcccactggggagtcctggcgggccttgcttactattccatggtggggaactgggctaagggaccttttgggacagcggtg

SEQ ID NO: 388678 - DNA, 140 bp, Artificial Sequence
  Synthetic
caccgctgtcccaaaaggtcccttagcccagttccccaccatggaatagtaagcaaggcccgccaggactccccagtgggcccccgccaccatgtccacgacggcttgtgggatccggagcatatcagcagccagggcct

SEQ ID NO: 388679 - DNA, 140 bp, Artificial Sequence
  Synthetic
aggccctggctgctgatatgagtcctggcgggccttgcttactattccatggtggggaactgggctaaggtcttgattgtgatgctactctttgccggcgttgacgggggaactctagcagaccttttgggacagcggtg

SEQ ID NO: 388680 - DNA, 140 bp, Artificial Sequence
  Synthetic
caccgctgtcccaaaaggtctgctagagttcccccgtcaacgccggcaaagagtagcatcacaatcaagaccttagcccagttccccaccatggaatagtaagcaaggcccgccaggactcatatcagcagccagggcct

SEQ ID NO: 388681 - DNA, 140 bp, Artificial Sequence
  Synthetic
atacgccatgctgggtctccaccctctgagcaattcgctcatgcggttccataacaaggtgtactccacaacctcgaggagtgcctctctgagggcaaagaaggtgacctttgacagggtcgtacttgggagtcggccat

SEQ ID NO: 388682 - DNA, 140 bp, Artificial Sequence
  Synthetic
atggccgactcccaagtacgaccctgtcaaaggtcaccttctttgccctcagagaggcactcctcgaggttgtggagtacaccttgttatggaaccgcatgagcgaattgctcagagggtggagacccagcatggcgtat

SEQ ID NO: 388683 - DNA, 140 bp, Artificial Sequence
  Synthetic
atacgccatgctgggtctccgcaggtgctggacacacactatgactcagtcttgcaggacgttaagcgggccgcctccaaggttagtgcgaggctcctctcagtagaggaagcttgcgcgcgtacttgggagtcggccat

SEQ ID NO: 388684 - DNA, 140 bp, Artificial Sequence
  Synthetic
atggccgactcccaagtacgcgcgcaagcttcctctactgagaggagcctcgcactaaccttggaggcggcccgcttaacgtcctgcaagactgagtcatagtgtgtgtccagcacctgcggagacccagcatggcgtat

SEQ ID NO: 388685 - DNA, 140 bp, Artificial Sequence
  Synthetic
aggccctggctgctgatatggtccagtgtattgtttcaccccaagcccggttgtggtggggacgaccgaccggtccggtgtccctacgtatagctggggggagaatgagacagacgtgctgaccttttgggacagcggtg

SEQ ID NO: 388686 - DNA, 140 bp, Artificial Sequence
  Synthetic
caccgctgtcccaaaaggtcagcacgtctgtctcattctccccccagctatacgtagggacaccggaccggtcggtcgtccccaccacaaccgggcttggggtgaaacaatacactggaccatatcagcagccagggcct

SEQ ID NO: 388687 - DNA, 140 bp, Artificial Sequence
  Synthetic
aggccctggctgctgatatgcatcaccaagatcttgctcgccatactcggtccgctcatggtactccaggctggcataaccaaaatgccgtactttgtgcgcgctcaggggctcattcgtgaccttttgggacagcggtg

SEQ ID NO: 388688 - DNA, 140 bp, Artificial Sequence
  Synthetic
caccgctgtcccaaaaggtcacgaatgagcccctgagcgcgcacaaagtacggcattttggttatgccagcctggagtaccatgagcggaccgagtatggcgagcaagatcttggtgatgcatatcagcagccagggcct

SEQ ID NO: 388689 - DNA, 140 bp, Artificial Sequence
  Synthetic
atacgccatgctgggtctcctgagagactctacgtaggagggcccatgacaaacagcaagggacaatcctgcggttacaggcgttgccgcgcgagcggcgttttcactaccagcatggggcgtacttgggagtcggccat

SEQ ID NO: 388690 - DNA, 140 bp, Artificial Sequence
  Synthetic
atggccgactcccaagtacgccccatgctggtagtgaaaacgccgctcgcgcggcaacgcctgtaaccgcaggattgtcccttgctgtttgtcatgggccctcctacgtagagtctctcaggagacccagcatggcgtat

SEQ ID NO: 388691 - DNA, 140 bp, Artificial Sequence
  Synthetic
aggccctggctgctgatatgtgctcgtgtgtggcgacgacttagtcgttatctgtgagagtgcgggggtccaggaggacgcggcgaacctgagagccttcacggaggctatgaccaggtagaccttttgggacagcggtg

SEQ ID NO: 388692 - DNA, 140 bp, Artificial Sequence
  Synthetic
caccgctgtcccaaaaggtctacctggtcatagcctccgtgaaggctctcaggttcgccgcgtcctcctggacccccgcactctcacagataacgactaagtcgtcgccacacacgagcacatatcagcagccagggcct

SEQ ID NO: 388693 - DNA, 140 bp, Artificial Sequence
  Synthetic
atacgccatgctgggtctccatcctcgcctacgctgctcgcattcctgagctagtcctcgaagttatcttcggtggccactggggtgtgatgtttggcctggcctatttttccatgcaggcgtacttgggagtcggccat

SEQ ID NO: 388694 - DNA, 140 bp, Artificial Sequence
  Synthetic
atggccgactcccaagtacgcctgcatggaaaaataggccaggccaaacatcacaccccagtggccaccgaagataacttcgaggactagctcaggaatgcgagcagcgtaggcgaggatggagacccagcatggcgtat

SEQ ID NO: 388695 - DNA, 140 bp, Artificial Sequence
  Synthetic
atacgccatgctgggtctcccactagcctctttagcattggtgccaagcagaacatccagttaatcaacaccaatggcagctggcacataaaccggaccgccctcaattgcaatgacagccgtacttgggagtcggccat

SEQ ID NO: 388696 - DNA, 140 bp, Artificial Sequence
  Synthetic
atggccgactcccaagtacggctgtcattgcaattgagggcggtccggtttatgtgccagctgccattggtgttgattaactggatgttctgcttggcaccaatgctaaagaggctagtgggagacccagcatggcgtat

SEQ ID NO: 388697 - DNA, 140 bp, Artificial Sequence
  Synthetic
atacgccatgctgggtctccttgtcgtgggcaccactgacaagcagggcgtacccacctatagctggggggaaaatgagaccgatgtcttcctgctaaatagcacaagacccccgcgaggcgtacttgggagtcggccat

SEQ ID NO: 388698 - DNA, 140 bp, Artificial Sequence
  Synthetic
atggccgactcccaagtacgcctcgcgggggtcttgtgctatttagcaggaagacatcggtctcattttccccccagctataggtgggtacgccctgcttgtcagtggtgcccacgacaaggagacccagcatggcgtat

SEQ ID NO: 388699 - DNA, 140 bp, Artificial Sequence
  Synthetic
aggccctggctgctgatatgctcccctgacgccgagctcatagaggctaacctcctgtggaggcaggagatgggcggcaacatcaccagggtcgagtcagagaacaaagtggtgattctggaccttttgggacagcggtg

SEQ ID NO: 388700 - DNA, 140 bp, Artificial Sequence
  Synthetic
caccgctgtcccaaaaggtccagaatcaccactttgttctctgactcgaccctggtgatgttgccgcccatctcctgcctccacaggaggttagcctctatgagctcggcgtcaggggagcatatcagcagccagggcct

SEQ ID NO: 388701 - DNA, 140 bp, Artificial Sequence
  Synthetic
atacgccatgctgggtctcctaagtgcgggtcagggccttggttgacccctaaatgcctggtagaatacccttatagactgtggcactatccgtgcaccgtaaattttaccatcttcaagcgtacttgggagtcggccat

SEQ ID NO: 388702 - DNA, 140 bp, Artificial Sequence
  Synthetic
atggccgactcccaagtacgcttgaagatggtaaaatttacggtgcacggatagtgccacagtctataagggtattctaccaggcatttaggggtcaaccaaggccctgacccgcacttaggagacccagcatggcgtat

SEQ ID NO: 388703 - DNA, 140 bp, Artificial Sequence
  Synthetic
atacgccatgctgggtctcccttcacgcgcggagaccgctgcagattggaagatagggataggggtcagcagagtccactgctgcattccaccactgagtgggcggtgttgccatgctcccgtacttgggagtcggccat

SEQ ID NO: 388704 - DNA, 140 bp, Artificial Sequence
  Synthetic
atggccgactcccaagtacgggagcatggcaacaccgcccactcagtggtggaatgcagcagtggactctgctgacccctatccctatcttccaatctgcagcggtctccgcgcgtgaagggagacccagcatggcgtat

SEQ ID NO: 388705 - DNA, 140 bp, Artificial Sequence
  Synthetic
aggccctggctgctgatatgagagtccactgctgcattccaccactgagtgggcggtgttgccatgctccttctccgacctaccggcactatccactggtctattgcacctccaccaaaagaccttttgggacagcggtg

SEQ ID NO: 388706 - DNA, 140 bp, Artificial Sequence
  Synthetic
caccgctgtcccaaaaggtcttttggtggaggtgcaatagaccagtggatagtgccggtaggtcggagaaggagcatggcaacaccgcccactcagtggtggaatgcagcagtggactctcatatcagcagccagggcct

SEQ ID NO: 388707 - DNA, 140 bp, Artificial Sequence
  Synthetic
atacgccatgctgggtctccgctgtcctatatgctggtcttggccgaggcccagattcagcaatgggttccccccctggaggcccgaggggggcgtgacgggatcatctggctggctgtccgtacttgggagtcggccat

SEQ ID NO: 388708 - DNA, 140 bp, Artificial Sequence
  Synthetic
atggccgactcccaagtacggacagccagccagatgatcccgtcacgcccccctcgggcctccagggggggaacccattgctgaatctgggcctcggccaagaccagcatataggacagcggagacccagcatggcgtat

SEQ ID NO: 388709 - DNA, 140 bp, Artificial Sequence
  Synthetic
atacgccatgctgggtctcccccccctggaggcccgaggggggcgtgacgggatcatctggctggctgtcattctgcacccacgccttgtgtttgagatcacgaagtggctgttagcaatcgtacttgggagtcggccat

SEQ ID NO: 388710 - DNA, 140 bp, Artificial Sequence
  Synthetic
atggccgactcccaagtacgattgctaacagccacttcgtgatctcaaacacaaggcgtgggtgcagaatgacagccagccagatgatcccgtcacgcccccctcgggcctccaggggggggagacccagcatggcgtat

SEQ ID NO: 388711 - DNA, 140 bp, Artificial Sequence
  Synthetic
atacgccatgctgggtctcccagtcaggggtataaagtacttgtactaaatccctctgtcgcggccacgcttggttttggggcctacatgtccaaagcccacgggatcaaccccaacatccgtacttgggagtcggccat

SEQ ID NO: 388712 - DNA, 140 bp, Artificial Sequence
  Synthetic
atggccgactcccaagtacggatgttggggttgatcccgtgggctttggacatgtaggccccaaaaccaagcgtggccgcgacagagggatttagtacaagtactttatacccctgactgggagacccagcatggcgtat

SEQ ID NO: 388713 - DNA, 140 bp, Artificial Sequence
  Synthetic
atacgccatgctgggtctccagaaccggagtacggactgtgaccaccggggactctatcacctactccacttatggcaagtttatcgcggacggaggctgctcagctggcgcctatgacgcgtacttgggagtcggccat

SEQ ID NO: 388714 - DNA, 140 bp, Artificial Sequence
  Synthetic
atggccgactcccaagtacgcgtcataggcgccagctgagcagcctccgtccgcgataaacttgccataagtggagtaggtgatagagtccccggtggtcacagtccgtactccggttctggagacccagcatggcgtat

SEQ ID NO: 388715 - DNA, 140 bp, Artificial Sequence
  Synthetic
aggccctggctgctgatatgagaatatccagctaatcaacaccaacggcagttggcacatcaatcgcacggccttgaactgtaatgcgagcctcgagactggctggatagcggggctcttgaccttttgggacagcggtg

SEQ ID NO: 388716 - DNA, 140 bp, Artificial Sequence
  Synthetic
caccgctgtcccaaaaggtcaagagccccgctatccagccagtctcgaggctcgcattacagttcaaggccgtgcgattgatgtgccaactgccgttggtgttgattagctggatattctcatatcagcagccagggcct

SEQ ID NO: 388717 - DNA, 140 bp, Artificial Sequence
  Synthetic
atacgccatgctgggtctccttcaaagaagaagtgcgatgagctcgcagcagcccttcggggcatgggtgtcaatgccgttgcctactacaggggtctcgacgtctccgttataccaactcgtacttgggagtcggccat

SEQ ID NO: 388718 - DNA, 140 bp, Artificial Sequence
  Synthetic
atggccgactcccaagtacgagttggtataacggagacgtcgagacccctgtagtaggcaacggcattgacacccatgccccgaagggctgctgcgagctcatcgcacttcttctttgaaggagacccagcatggcgtat

SEQ ID NO: 388719 - DNA, 140 bp, Artificial Sequence
  Synthetic
atacgccatgctgggtctccttggaccaggggcgagcggtgcgatctacatgatagggacaggattgaaatgagtccgctgcttttctcaactacgcagctcgccatactcccctgttcgcgtacttgggagtcggccat

SEQ ID NO: 388720 - DNA, 140 bp, Artificial Sequence
  Synthetic
atggccgactcccaagtacgcgaacaggggagtatggcgagctgcgtagttgagaaaagcagcggactcatttcaatcctgtccctatcatgtagatcgcaccgctcgcccctggtccaaggagacccagcatggcgtat

SEQ ID NO: 388721 - DNA, 140 bp, Artificial Sequence
  Synthetic
aggccctggctgctgatatgccccccaaaaccttgcggtatcgtgtccgcaaagaccgtgtgtggcccggtatattgctttacacccagccctgtggcggtggggacgaccgacaagtcggaccttttgggacagcggtg

SEQ ID NO: 388722 - DNA, 140 bp, Artificial Sequence
  Synthetic
caccgctgtcccaaaaggtccgacttgtcggtcgtccccaccgccacagggctgggtgtaaagcaatataccgggccacacacggtctttgcggacacgataccgcaaggttttggggggcatatcagcagccagggcct

SEQ ID NO: 388723 - DNA, 140 bp, Artificial Sequence
  Synthetic
atacgccatgctgggtctcctatattgctttacacccagccctgtggcggtggggacgaccgacaagtcgggcgtgcccacctataactggggtgcaaatgagacggacgtcttcgtcctcgtacttgggagtcggccat

SEQ ID NO: 388724 - DNA, 140 bp, Artificial Sequence
  Synthetic
atggccgactcccaagtacgaggacgaagacgtccgtctcatttgcaccccagttataggtgggcacgcccgacttgtcggtcgtccccaccgccacagggctgggtgtaaagcaatataggagacccagcatggcgtat

SEQ ID NO: 388725 - DNA, 140 bp, Artificial Sequence
  Synthetic
atacgccatgctgggtctccgcatcaacccacatcaccggggggcaagctgctcagaaaacggctgcgatcgccggcctcttcaatcgaggcgccaaccaggacatccatctgatcaactcgtacttgggagtcggccat

SEQ ID NO: 388726 - DNA, 140 bp, Artificial Sequence
  Synthetic
atggccgactcccaagtacgagttgatcagatggatgtcctggttggcgcctcgattgaagaggccggcgatcgcagccgttttctgagcagcttgccccccggtgatgtgggttgatgcggagacccagcatggcgtat

SEQ ID NO: 388727 - DNA, 140 bp, Artificial Sequence
  Synthetic
atacgccatgctgggtctcctcccttgccaggtaccagctccagaattcttctcttgggtggacggggtgcagatacaccgattcgcccccattccaggtcccttctttcgggatgaggtcgtacttgggagtcggccat

SEQ ID NO: 388728 - DNA, 140 bp, Artificial Sequence
  Synthetic
atggccgactcccaagtacgacctcatcccgaaagaagggacctggaatgggggcgaatcggtgtatctgcaccccgtccacccaagagaagaattctggagctggtacctggcaagggaggagacccagcatggcgtat

SEQ ID NO: 388729 - DNA, 140 bp, Artificial Sequence
  Synthetic
aggccctggctgctgatatgcagatacaccgattcgcccccattccaggtcccttctttcgggatgaggtgacgttcaccgtaggcctcaattcctttgtggtcggctctcagctcccttgaccttttgggacagcggtg

SEQ ID NO: 388730 - DNA, 140 bp, Artificial Sequence
  Synthetic
caccgctgtcccaaaaggtcaagggagctgagagccgaccacaaaggaattgaggcctacggtgaacgtcacctcatcccgaaagaagggacctggaatgggggcgaatcggtgtatctgcatatcagcagccagggcct

SEQ ID NO: 388731 - DNA, 140 bp, Artificial Sequence
  Synthetic
atacgccatgctgggtctcctcccacattaccgcggaggcggcagccaggcggttggccaggggatctcccccttcacaggccagctcttcagcgagccagctctccgccccgtccttgacgtacttgggagtcggccat

SEQ ID NO: 388732 - DNA, 140 bp, Artificial Sequence
  Synthetic
atggccgactcccaagtacgtcaaggacggggcggagagctggctcgctgaagagctggcctgtgaagggggagatcccctggccaaccgcctggctgccgcctccgcggtaatgtgggaggagacccagcatggcgtat

SEQ ID NO: 388733 - DNA, 140 bp, Artificial Sequence
  Synthetic
aggccctggctgctgatatgggcacatcaacaggactgccctgaactgcaatgactccctccagaccgggtttcttgccgcgctgttctacacacacagtttcaacgcgtccggatgcccgaccttttgggacagcggtg

SEQ ID NO: 388734 - DNA, 140 bp, Artificial Sequence
  Synthetic
caccgctgtcccaaaaggtcgggcatccggacgcgttgaaactgtgtgtgtagaacagcgcggcaagaaacccggtctggagggagtcattgcagttcagggcagtcctgttgatgtgcccatatcagcagccagggcct

SEQ ID NO: 388735 - DNA, 140 bp, Artificial Sequence
  Synthetic
atacgccatgctgggtctccgggggaccccgacctggagtttgaaccagcgagatccgcccccccttctgagggggagtgtgagatcattgattcggactctaagtcgtggtccacggtccgtacttgggagtcggccat

SEQ ID NO: 388736 - DNA, 140 bp, Artificial Sequence
  Synthetic
atggccgactcccaagtacggaccgtggaccacgacttagagtccgaatcaatgatctcacactccccctcagaagggggggcggatctcgctggttcaaactccaggtcggggtcccccggagacccagcatggcgtat

SEQ ID NO: 388737 - DNA, 140 bp, Artificial Sequence
  Synthetic
aggccctggctgctgatatgagggtgaggtccagattgtgtcaactgctgcccaaactttcctggcaacatgcatcaacggggtatgctggactgtctaccatggggccggaacgaggacgaccttttgggacagcggtg

SEQ ID NO: 388738 - DNA, 140 bp, Artificial Sequence
  Synthetic
caccgctgtcccaaaaggtcgtcctcgttccggccccatggtagacagtccagcataccccgttgatgcatgttgccaggaaagtttgggcagcagttgacacaatctggacctcaccctcatatcagcagccagggcct

SEQ ID NO: 388739 - DNA, 140 bp, Artificial Sequence
  Synthetic
aggccctggctgctgatatgcggaagcaccccgaggccacttacaccaaatgcggctcggggccctggttgacacctaggtgtatagttgactacccatacaggctttggcactacccctgaccttttgggacagcggtg

SEQ ID NO: 388740 - DNA, 140 bp, Artificial Sequence
  Synthetic
caccgctgtcccaaaaggtcaggggtagtgccaaagcctgtatgggtagtcaactatacacctaggtgtcaaccagggccccgagccgcatttggtgtaagtggcctcggggtgcttccgcatatcagcagccagggcct

SEQ ID NO: 388741 - DNA, 140 bp, Artificial Sequence
  Synthetic
aggccctggctgctgatatgttgactcaaccgtcacggagagggacataagaacagaagaatccatatatcaggcttgttctctgcctcaagaggccaaaactgtcatacactcgctcacgaccttttgggacagcggtg

SEQ ID NO: 388742 - DNA, 140 bp, Artificial Sequence
  Synthetic
caccgctgtcccaaaaggtcgtgagcgagtgtatgacagttttggcctcttgaggcagagaacaagcctgatatatggattcttctgttcttatgtccctctccgtgacggttgagtcaacatatcagcagccagggcct

SEQ ID NO: 388743 - DNA, 140 bp, Artificial Sequence
  Synthetic
atacgccatgctgggtctccggtctgtcttccttgtcggtcaactgttcactttctcccccaggcgccactggacaacgcaagactgcaactgttctatctaccccggccatataacgggcgtacttgggagtcggccat

SEQ ID NO: 388744 - DNA, 140 bp, Artificial Sequence
  Synthetic
atggccgactcccaagtacgcccgttatatggccggggtagatagaacagttgcagtcttgcgttgtccagtggcgcctgggggagaaagtgaacagttgaccgacaaggaagacagaccggagacccagcatggcgtat

SEQ ID NO: 388745 - DNA, 140 bp, Artificial Sequence
  Synthetic
aggccctggctgctgatatgttgttcctcgcccggctcatatggtggttacagtacttcatcaccagagccgaggcgtccttacaagtgtgggtcccccctctcaacgttcgggggggccgaccttttgggacagcggtg

SEQ ID NO: 388746 - DNA, 140 bp, Artificial Sequence
  Synthetic
caccgctgtcccaaaaggtcggcccccccgaacgttgagaggggggacccacacttgtaaggacgcctcggctctggtgatgaagtactgtaaccaccatatgagccgggcgaggaacaacatatcagcagccagggcct

SEQ ID NO: 388747 - DNA, 140 bp, Artificial Sequence
  Synthetic
atacgccatgctgggtctcccggaaacccacgtcaccgggggaagtgccgctcacggcgtgcggggactcgtcagcctctttgactggggccccagccagaacatccggctcatcaactccgtacttgggagtcggccat

SEQ ID NO: 388748 - DNA, 140 bp, Artificial Sequence
  Synthetic
atggccgactcccaagtacggagttgatgagccggatgttctggctggggccccagtcaaagaggctgacgagtccccgcacgccgtgagcggcacttcccccggtgacgtgggtttccgggagacccagcatggcgtat

SEQ ID NO: 388749 - DNA, 140 bp, Artificial Sequence
  Synthetic
aggccctggctgctgatatgcatttatcacagcgtgtcgcatgcccgaccccgcctattactcctttgcctactcctacttagcgtaggggtaggcatctttttactccccgctcggtaggaccttttgggacagcggtg

SEQ ID NO: 388750 - DNA, 140 bp, Artificial Sequence
  Synthetic
caccgctgtcccaaaaggtcctaccgagcggggagtaaaaagatgcctacccctacgctaagtaggagtaggcaaaggagtaataggcggggtcgggcatgcgacacgctgtgataaatgcatatcagcagccagggcct

SEQ ID NO: 388751 - DNA, 140 bp, Artificial Sequence
  Synthetic
aggccctggctgctgatatgctcctcaaggtgcccgctcattgacaccctgcacctgcggctcctcggacctttacctggtcacgaggcacgccgatgtcattcccgtgcgccggcgggggaccttttgggacagcggtg

SEQ ID NO: 388752 - DNA, 140 bp, Artificial Sequence
  Synthetic
caccgctgtcccaaaaggtcccccgccggcgcacgggaatgacatcggcgtgcctcgtgaccaggtaaaggtccgaggagccgcaggtgcagggtgtcaatgagcgggcaccttgaggagcatatcagcagccagggcct

SEQ ID NO: 388753 - DNA, 140 bp, Artificial Sequence
  Synthetic
atacgccatgctgggtctccacttagcgtaggagtaggcatctttttactccccgctcggtagagcggcaaaccctagctacactccatagctagtttccgtttttttttttttttttttcgtacttgggagtcggccat

SEQ ID NO: 388754 - DNA, 140 bp, Artificial Sequence
  Synthetic
atggccgactcccaagtacgaaaaaaaaaaaaaaaaaaacggaaactagctatggagtgtagctagggtttgccgctctaccgagcggggagtaaaaagatgcctactcctacgctaagtggagacccagcatggcgtat

SEQ ID NO: 388755 - DNA, 140 bp, Artificial Sequence
  Synthetic
aggccctggctgctgatatgggcggcgcttgagaagctcatcatcttgcactccgctagcgctgctagtgccaatgggccgctgtggtttttcatcttctttacagcggcctggtacttagaccttttgggacagcggtg

SEQ ID NO: 388756 - DNA, 140 bp, Artificial Sequence
  Synthetic
caccgctgtcccaaaaggtctaagtaccaggccgctgtaaagaagatgaaaaaccacagcggcccattggcactagcagcgctagcggagtgcaagatgatgagcttctcaagcgccgcccatatcagcagccagggcct

SEQ ID NO: 388757 - DNA, 140 bp, Artificial Sequence
  Synthetic
aggccctggctgctgatatgcgccacgtgcatgcaggctgacctcgagatcatgacaagcacatgggtcctggcagggggggtgctagccgccgtggcagcttactgcctggcgaccggcgaccttttgggacagcggtg

SEQ ID NO: 388758 - DNA, 140 bp, Artificial Sequence
  Synthetic
caccgctgtcccaaaaggtcgccggtcgccaggcagtaagctgccacggcggctagcaccccccctgccaggacccatgtgcttgtcatgatctcgaggtcagcctgcatgcacgtggcgcatatcagcagccagggcct

SEQ ID NO: 388759 - DNA, 140 bp, Artificial Sequence
  Synthetic
  misc_feature (62)..(62): n is a, c, g, or t
  misc_feature (99)..(99): n is a, c, g, or t
atacgccatgctgggtctcctgcccggagagggcgtctcctcctcctcggccctgccgacgntatgagggacatgggctggagacttctcgctcctatnaccgcgtattgccaacaaactcgtacttgggagtcggccat

SEQ ID NO: 388760 - DNA, 140 bp, Artificial Sequence
  Synthetic
  misc_feature (42)..(42): n is a, c, g, or t
  misc_feature (79)..(79): n is a, c, g, or t
atggccgactcccaagtacgagtttgttggcaatacgcggtnataggagcgagaagtctccagcccatgtccctcatancgtcggcagggccgaggaggaggagacgccctctccgggcaggagacccagcatggcgtat

SEQ ID NO: 388761 - DNA, 140 bp, Artificial Sequence
  Synthetic
aggccctggctgctgatatgtgctcacttccatgctcaccgacccctcccacattacagcagagacggccaagcgtaggctggctagggggtctcccccctccttggccagctcttcagcgaccttttgggacagcggtg

SEQ ID NO: 388762 - DNA, 140 bp, Artificial Sequence
  Synthetic
caccgctgtcccaaaaggtcgctgaagagctggccaaggaggggggagaccccctagccagcctacgcttggccgtctctgctgtaatgtgggaggggtcggtgagcatggaagtgagcacatatcagcagccagggcct

SEQ ID NO: 388763 - DNA, 140 bp, Artificial Sequence
  Synthetic
aggccctggctgctgatatgccctcggcctcctgcagaccgcatcccgccaggcagaggtcatcgcccctgctgtccagaccaactggcaaaaactcgaggccttctgggcgaagcatatgaccttttgggacagcggtg

SEQ ID NO: 388764 - DNA, 140 bp, Artificial Sequence
  Synthetic
caccgctgtcccaaaaggtcatatgcttcgcccagaaggcctcgagtttttgccagttggtctggacagcaggggcgatgacctctgcctggcgggatgcggtctgcaggaggccgagggcatatcagcagccagggcct

SEQ ID NO: 388765 - DNA, 140 bp, Artificial Sequence
  Synthetic
atacgccatgctgggtctccgctgtccagaccaactggcaaaaactcgaggccttctgggcgaagcatatgtggaacttcatcagtgggatacaatatctggcgggcctgtcaacgttgccgtacttgggagtcggccat

SEQ ID NO: 388766 - DNA, 140 bp, Artificial Sequence
  Synthetic
atggccgactcccaagtacggcaacgttgacaggcccgccagatattgtatcccactgatgaagttccacatatgcttcgcccagaaggcctcgagtttttgccagttggtctggacagcggagacccagcatggcgtat

SEQ ID NO: 388767 - DNA, 140 bp, Artificial Sequence
  Synthetic
aggccctggctgctgatatgtagctactacgccactaatgattgctcgaacaacagcatcacctggcagctcactaacgcagttctccaccttcctggatgcgtcccatgtgagaatgatgaccttttgggacagcggtg

SEQ ID NO: 388768 - DNA, 140 bp, Artificial Sequence
  Synthetic
caccgctgtcccaaaaggtcatcattctcacatgggacgcatccaggaaggtggagaactgcgttagtgagctgccaggtgatgctgttgttcgagcaatcattagtggcgtagtagctacatatcagcagccagggcct

SEQ ID NO: 388769 - DNA, 140 bp, Artificial Sequence
  Synthetic
aggccctggctgctgatatgaggtcacctttgacagactgcaagtcctggacgaccattaccgggacgtgctcaaggagatgaaggcgaaggcgtccacagttaaggctaaacttctatcgaccttttgggacagcggtg

SEQ ID NO: 388770 - DNA, 140 bp, Artificial Sequence
  Synthetic
caccgctgtcccaaaaggtcgatagaagtttagccttaactgtggacgccttcgccttcatctccttgagcacgtcccggtaatggtcgtccaggacttgcagtctgtcaaaggtgacctcatatcagcagccagggcct

SEQ ID NO: 388771 - DNA, 140 bp, Artificial Sequence
  Synthetic
atacgccatgctgggtctcctgctcacctctttgcccgtggtccccaacagaagctccatttagtcaatagcaatggcagctggcacataaaccggactgccctcaactgcaatgacagccgtacttgggagtcggccat

SEQ ID NO: 388772 - DNA, 140 bp, Artificial Sequence
  Synthetic
atggccgactcccaagtacggctgtcattgcagttgagggcagtccggtttatgtgccagctgccattgctattgactaaatggagcttctgttggggaccacgggcaaagaggtgagcaggagacccagcatggcgtat

SEQ ID NO: 388773 - DNA, 140 bp, Artificial Sequence
  Synthetic
atacgccatgctgggtctccccaatgggccgctgtggttcttcatcttctttacagcggcctggtacttaaagggcagggtggtccctgcggccacgtactctgtactcggcttgtggtccgtacttgggagtcggccat

SEQ ID NO: 388774 - DNA, 140 bp, Artificial Sequence
  Synthetic
atggccgactcccaagtacggaccacaagccgagtacagagtacgtggccgcagggaccaccctgccctttaagtaccaggccgctgtaaagaagatgaagaaccacagcggcccattggggagacccagcatggcgtat

SEQ ID NO: 388775 - DNA, 140 bp, Artificial Sequence
  Synthetic
aggccctggctgctgatatggcattatccttgtaccatcaactacaccatattcaaagtcaggatgtacgtgggaggggtcgagcacaggctggaagctgcctgcaactggacgcggggcgaccttttgggacagcggtg

SEQ ID NO: 388776 - DNA, 140 bp, Artificial Sequence
  Synthetic
caccgctgtcccaaaaggtcgccccgcgtccagttgcaggcagcttccagcctgtgctcgacccctcccacgtacatcctgactttgaatatggtgtagttgatggtacaaggataatgccatatcagcagccagggcct

SEQ ID NO: 388777 - DNA, 140 bp, Artificial Sequence
  Synthetic
aggccctggctgctgatatgcatcctgcatggcctcccggtttccgcgaggctaggcagggaagttttgctcggccctgccgatagctacacctcgaaggggtggaagctcctagcccccgaccttttgggacagcggtg

SEQ ID NO: 388778 - DNA, 140 bp, Artificial Sequence
  Synthetic
caccgctgtcccaaaaggtcgggggctaggagcttccaccccttcgaggtgtagctatcggcagggccgagcaaaacttccctgcctagcctcgcggaaaccgggaggccatgcaggatgcatatcagcagccagggcct

SEQ ID NO: 388779 - DNA, 140 bp, Artificial Sequence
  Synthetic
atacgccatgctgggtctccaccagtcactcagatgtacaccagcgcagagggggacctcgtgggatggcctagcccccccgggactaagtcattagacccctgtacctgcggggccgtgcgtacttgggagtcggccat

SEQ ID NO: 388780 - DNA, 140 bp, Artificial Sequence
  Synthetic
atggccgactcccaagtacgcacggccccgcaggtacaggggtctaatgacttagtcccgggggggctaggccatcccacgaggtccccctctgcgctggtgtacatctgagtgactggtggagacccagcatggcgtat

SEQ ID NO: 388781 - DNA, 140 bp, Artificial Sequence
  Synthetic
atacgccatgctgggtctcccacgtaaacaggaccgccctgaactgcaacgactccctccaaaccgggtgggttgccgcgctgttctacagccacaggttcaactcgtctggctgcccagcgtacttgggagtcggccat

SEQ ID NO: 388782 - DNA, 140 bp, Artificial Sequence
  Synthetic
atggccgactcccaagtacgctgggcagccagacgagttgaacctgtggctgtagaacagcgcggcaacccacccggtttggagggagtcgttgcagttcagggcggtcctgtttacgtgggagacccagcatggcgtat

SEQ ID NO: 388783 - DNA, 140 bp, Artificial Sequence
  Synthetic
aggccctggctgctgatatgggttgccgcgctgttctacagccacaggttcaactcgtctggctgcccagagcgcatggccagctgccgccccatcggcgaattcgctcaggggtggggtgaccttttgggacagcggtg

SEQ ID NO: 388784 - DNA, 140 bp, Artificial Sequence
  Synthetic
caccgctgtcccaaaaggtcaccccacccctgagcgaattcgccgatggggcggcagctggccatgcgctctgggcagccagacgagttgaacctgtggctgtagaacagcgcggcaacccatatcagcagccagggcct

SEQ ID NO: 388785 - DNA, 140 bp, Artificial Sequence
  Synthetic
atacgccatgctgggtctccttcagtgtcctcatagccagggatcacgcttgtaacaggccgctatgtattagcgaaatttatcggggcattgctatcttccatagcaacccactgtatgcgtacttgggagtcggccat

SEQ ID NO: 388786 - DNA, 140 bp, Artificial Sequence
  Synthetic
atggccgactcccaagtacgcatacagtgggttgctatggaagatagcaatgccccgataaatttcgctaatacatagcggcctgttacaagcgtgatccctggctatgaggacactgaaggagacccagcatggcgtat

SEQ ID NO: 388787 - DNA, 140 bp, Artificial Sequence
  Synthetic
atacgccatgctgggtctcctcatcatatgcgacgaatgccattcagtggacgccactaccatccttggcattggaacagtcctcgaccaggctgagaccgcaggtgtcaggctagtggtcgtacttgggagtcggccat

SEQ ID NO: 388788 - DNA, 140 bp, Artificial Sequence
  Synthetic
atggccgactcccaagtacgaccactagcctgacacctgcggtctcagcctggtcgaggactgttccaatgccaaggatggtagtggcgtccactgaatggcattcgtcgcatatgatgaggagacccagcatggcgtat

SEQ ID NO: 388789 - DNA, 140 bp, Artificial Sequence
  Synthetic
atacgccatgctgggtctccttcaagaaagaagtgcgacgagctcgcagcagcccttcggggcttaggtgtcaatgccgttgcctactataggggtctcgacgtttccgttataccaactcgtacttgggagtcggccat

SEQ ID NO: 388790 - DNA, 140 bp, Artificial Sequence
  Synthetic
atggccgactcccaagtacgagttggtataacggaaacgtcgagacccctatagtaggcaacggcattgacacctaagccccgaagggctgctgcgagctcgtcgcacttctttcttgaaggagacccagcatggcgtat

SEQ ID NO: 388791 - DNA, 140 bp, Artificial Sequence
  Synthetic
aggccctggctgctgatatgttgactttagcctagacccaacctttaccatcaccactcaaaccgtccctcaggacgctgtctcccgtagtcaacgtagagggagaactgggagggggcggaccttttgggacagcggtg

SEQ ID NO: 388792 - DNA, 140 bp, Artificial Sequence
  Synthetic
caccgctgtcccaaaaggtccgccccctcccagttctccctctacgttgactacgggagacagcgtcctgagggacggtttgagtggtgatggtaaaggttgggtctaggctaaagtcaacatatcagcagccagggcct

SEQ ID NO: 388793 - DNA, 140 bp, Artificial Sequence
  Synthetic
atacgccatgctgggtctccgagcttacgcctgctgagactacggtgagactccgggcatatttcaacacgcccggtttacccgtgtgtcaagaccacctggagttctgggaagcggtctcgtacttgggagtcggccat

SEQ ID NO: 388794 - DNA, 140 bp, Artificial Sequence
  Synthetic
atggccgactcccaagtacgagaccgcttcccagaactccaggtggtcttgacacacgggtaaaccgggcgtgttgaaatatgcccggagtctcaccgtagtctcagcaggcgtaagctcggagacccagcatggcgtat

SEQ ID NO: 388795 - DNA, 140 bp, Artificial Sequence
  Synthetic
atacgccatgctgggtctcctgcggcggagatcctgcggaaatccaggaagttccccccagcgttgcccatatgggcacgcccggattacaaccctccactgctagagtcctggaaggaccgtacttgggagtcggccat

SEQ ID NO: 388796 - DNA, 140 bp, Artificial Sequence
  Synthetic
atggccgactcccaagtacggtccttccaggactctagcagtggagggttgtaatccgggcgtgcccatatgggcaacgctggggggaacttcctggatttccgcaggatctccgccgcaggagacccagcatggcgtat

SEQ ID NO: 388797 - DNA, 140 bp, Artificial Sequence
  Synthetic
atacgccatgctgggtctccacaccgtagcgggactcacaagtctctttacagcaggccccagccagaaaatccagctgatcaactccaatggtagttggcacatcaatcgcacggccctcgtacttgggagtcggccat

SEQ ID NO: 388798 - DNA, 140 bp, Artificial Sequence
  Synthetic
atggccgactcccaagtacgagggccgtgcgattgatgtgccaactaccattggagttgatcagctggattttctggctggggcctgctgtaaagagacttgtgagtcccgctacggtgtggagacccagcatggcgtat

SEQ ID NO: 388799 - DNA, 140 bp, Artificial Sequence
  Synthetic
aggccctggctgctgatatgatccagctgatcaactccaatggtagttggcacatcaatcgcacggccctgaactgtaatgacagcctcaacaccggctggctagcggggctcttttactgaccttttgggacagcggtg

SEQ ID NO: 388800 - DNA, 140 bp, Artificial Sequence
  Synthetic
caccgctgtcccaaaaggtcagtaaaagagccccgctagccagccggtgttgaggctgtcattacagttcagggccgtgcgattgatgtgccaactaccattggagttgatcagctggatcatatcagcagccagggcct

SEQ ID NO: 388801 - DNA, 140 bp, Artificial Sequence
  Synthetic
atacgccatgctgggtctcctggggggatggttggcctcccagattgccccccctgccggggccactggcttcgttgtcagtggtctagtgggggcggccgtcgggagtataggcctaggcgtacttgggagtcggccat

SEQ ID NO: 388802 - DNA, 140 bp, Artificial Sequence
  Synthetic
atggccgactcccaagtacgcctaggcctatactcccgacggccgcccccactagaccactgacaacgaagccagtggccccggcagggggggcaatctgggaggccaaccatccccccaggagacccagcatggcgtat

SEQ ID NO: 388803 - DNA, 140 bp, Artificial Sequence
  Synthetic
aggccctggctgctgatatgaagcggccccgaccatcgcccctactgctggcactaccccccaaagccttgtggtattgtgcccgcgcagagcgtctgtggcccggtatattgcttcactgaccttttgggacagcggtg

SEQ ID NO: 388804 - DNA, 140 bp, Artificial Sequence
  Synthetic
caccgctgtcccaaaaggtcagtgaagcaatataccgggccacagacgctctgcgcgggcacaataccacaaggctttggggggtagtgccagcagtaggggcgatggtcggggccgcttcatatcagcagccagggcct

SEQ ID NO: 388805 - DNA, 140 bp, Artificial Sequence
  Synthetic
atacgccatgctgggtctccgttgtaaatctcctgcctgctattctgtctcctggtgctttggtagtgggagtcatctgtgcggcaatcttgcgccgccacgtcggccagggggagggggcgtacttgggagtcggccat

SEQ ID NO: 388806 - DNA, 140 bp, Artificial Sequence
  Synthetic
atggccgactcccaagtacgccccctccccctggccgacgtggcggcgcaagattgccgcacagatgactcccactaccaaagcaccaggagacagaatagcaggcaggagatttacaacggagacccagcatggcgtat

SEQ ID NO: 388807 - DNA, 140 bp, Artificial Sequence
  Synthetic
aggccctggctgctgatatggggggtcgcgaaggcagtggactttgtgcccgttgagtctatggaaaccaccatgcggtccccggtcttcacggacaactcatctcccccggccgtaccggaccttttgggacagcggtg

SEQ ID NO: 388808 - DNA, 140 bp, Artificial Sequence
  Synthetic
caccgctgtcccaaaaggtccggtacggccgggggagatgagttgtccgtgaagaccggggaccgcatggtggtttccatagactcaacgggcacaaagtccactgccttcgcgaccccccatatcagcagccagggcct

SEQ ID NO: 388809 - DNA, 140 bp, Artificial Sequence
  Synthetic
atacgccatgctgggtctccgcacatggtgtcgaccctaacatcagaactggggtaaggaccatcaccacgggcgcccccatcacgtactccacctacggcaagttccttgccgacggtgcgtacttgggagtcggccat

SEQ ID NO: 388810 - DNA, 140 bp, Artificial Sequence
  Synthetic
atggccgactcccaagtacgcaccgtcggcaaggaacttgccgtaggtggagtacgtgatgggggcgcccgtggtgatggtccttaccccagttctgatgttagggtcgacaccatgtgcggagacccagcatggcgtat

SEQ ID NO: 388811 - DNA, 140 bp, Artificial Sequence
  Synthetic
atacgccatgctgggtctccttccccccacacctcaagcgccagtgcccccacctcggaggcgccgcgccaaaatcctgactcaggacaatgtggagggggttctcagggagatggcggacgtacttgggagtcggccat

SEQ ID NO: 388812 - DNA, 140 bp, Artificial Sequence
  Synthetic
atggccgactcccaagtacgtccgccatctccctgagaaccccctccacattgtcctgagtcaggattttggcgcggcgcctccgaggtgggggcactggcgcttgaggtgtggggggaaggagacccagcatggcgtat

SEQ ID NO: 388813 - DNA, 140 bp, Artificial Sequence
  Synthetic
aggccctggctgctgatatgagttcgatgagatggaggagtgcgcctcacacctcccttacatcgaacagggaatgcagcttgccgagcagttcaagcagaaagcgctcgggttgctgcagaccttttgggacagcggtg

SEQ ID NO: 388814 - DNA, 140 bp, Artificial Sequence
  Synthetic
caccgctgtcccaaaaggtctgcagcaacccgagcgctttctgcttgaactgctcggcaagctgcattccctgttcgatgtaagggaggtgtgaggcgcactcctccatctcatcgaactcatatcagcagccagggcct

SEQ ID NO: 388815 - DNA, 140 bp, Artificial Sequence
  Synthetic
atacgccatgctgggtctccttggctgggcaacatcgtccaatacgcccctacaatctgggtccggatggtcataatgacccacttcttctccatactattggcccaggacactctgaaccgtacttgggagtcggccat

SEQ ID NO: 388816 - DNA, 140 bp, Artificial Sequence
  Synthetic
atggccgactcccaagtacggttcagagtgtcctgggccaatagtatggagaagaagtgggtcattatgaccatccggacccagattgtaggggcgtattggacgatgttgcccagccaaggagacccagcatggcgtat

SEQ ID NO: 388817 - DNA, 140 bp, Artificial Sequence
  Synthetic
aggccctggctgctgatatgtcataatgacccacttcttctccatactattggcccaggacactctgaaccaaaatctcaattttgagatgtacggggcagtatattcggtcaatccattgaccttttgggacagcggtg

SEQ ID NO: 388818 - DNA, 140 bp, Artificial Sequence
  Synthetic
caccgctgtcccaaaaggtcaatggattgaccgaatatactgccccgtacatctcaaaattgagattttggttcagagtgtcctgggccaatagtatggagaagaagtgggtcattatgacatatcagcagccagggcct

SEQ ID NO: 388819 - DNA, 140 bp, Artificial Sequence
  Synthetic
aggccctggctgctgatatgacacggacgttttcgtccttaacaacaccaggccaccgctgggcaattggttcggttgtacctggatgaactcaactggatataccaaagtgtgcggagcgaccttttgggacagcggtg

SEQ ID NO: 388820 - DNA, 140 bp, Artificial Sequence
  Synthetic
caccgctgtcccaaaaggtcgctccgcacactttggtatatccagttgagttcatccaggtacaaccgaaccaattgcccagcggtggcctggtgttgttaaggacgaaaacgtccgtgtcatatcagcagccagggcct

SEQ ID NO: 388821 - DNA, 140 bp, Artificial Sequence
  Synthetic
atacgccatgctgggtctcccccccgttttttttttttcccccctaaggggggccccccccctaaccaacagggagggtgtggggggggattatttttttggggggggtagctctttccacgtacttgggagtcggccat

SEQ ID NO: 388822 - DNA, 140 bp, Artificial Sequence
  Synthetic
atggccgactcccaagtacgtggaaagagctaccccccccaaaaaaataatccccccccacaccctccctgttggttagggggggggccccccttaggggggaaaaaaaaaaaacgggggggagacccagcatggcgtat

SEQ ID NO: 388823 - DNA, 140 bp, Artificial Sequence
  Synthetic
atacgccatgctgggtctccggattcaccagcctcttctcaccgggccccagccagcacatccagctgatcaactccaatggcagttggcacatcaatcgcacggctctgaactgtaatgcgtacttgggagtcggccat

SEQ ID NO: 388824 - DNA, 140 bp, Artificial Sequence
  Synthetic
atggccgactcccaagtacgcattacagttcagagccgtgcgattgatgtgccaactgccattggagttgatcagctggatgtgctggctggggcccggtgagaagaggctggtgaatccggagacccagcatggcgtat

SEQ ID NO: 388825 - DNA, 140 bp, Artificial Sequence
  Synthetic
aggccctggctgctgatatgcaactccaatggcagttggcacatcaatcgcacggctctgaactgtaatgacagcctcaacaccggttgggtagcagggctcctctactaccgcagattcgaccttttgggacagcggtg

SEQ ID NO: 388826 - DNA, 140 bp, Artificial Sequence
  Synthetic
caccgctgtcccaaaaggtcgaatctgcggtagtagaggagccctgctacccaaccggtgttgaggctgtcattacagttcagagccgtgcgattgatgtgccaactgccattggagttgcatatcagcagccagggcct

SEQ ID NO: 388827 - DNA, 140 bp, Artificial Sequence
  Synthetic
aggccctggctgctgatatggagtcctggcgggccttgcctactattccatggtggggaactgggctaaggtcgtggttgtgatgctactctttgccggcgttgacggatcaacccacttgaccttttgggacagcggtg

SEQ ID NO: 388828 - DNA, 140 bp, Artificial Sequence
  Synthetic
caccgctgtcccaaaaggtcaagtgggttgatccgtcaacgccggcaaagagtagcatcacaaccacgaccttagcccagttccccaccatggaatagtaggcaaggcccgccaggactccatatcagcagccagggcct

SEQ ID NO: 388829 - DNA, 140 bp, Artificial Sequence
  Synthetic
atacgccatgctgggtctcccacatcaacagaactgccctgaactgcaatgattccctccaaactgggtttattgccgcgttgttccacgcacacaaaatcaacgcgaccgggtgcccagcgtacttgggagtcggccat

SEQ ID NO: 388830 - DNA, 140 bp, Artificial Sequence
  Synthetic
atggccgactcccaagtacgctgggcacccggtcgcgttgattttgtgtgcgtggaacaacgcggcaataaacccagtttggagggaatcattgcagttcagggcagttctgttgatgtgggagacccagcatggcgtat

SEQ ID NO: 388831 - DNA, 140 bp, Artificial Sequence
  Synthetic
atacgccatgctgggtctccagcgcatggccagctgccgctccattgacaagttcgcccaggggtggggacccatcacttacaccgagcctcacgacttggaccagaggccctactgctgcgtacttgggagtcggccat

SEQ ID NO: 388832 - DNA, 140 bp, Artificial Sequence
  Synthetic
atggccgactcccaagtacgcagcagtagggcctctggtccaagtcgtgaggctcggtgtaagtgatgggtccccacccctgggcgaacttgtcaatggagcggcagctggccatgcgctggagacccagcatggcgtat

SEQ ID NO: 388833 - DNA, 140 bp, Artificial Sequence
  Synthetic
aggccctggctgctgatatgccagggccctggcgcatggcgtccgggttctggaagacggcgtgaactatgcaacagggaaccttcctggttgctctttctctatcttccttttggccctgaccttttgggacagcggtg

SEQ ID NO: 388834 - DNA, 140 bp, Artificial Sequence
  Synthetic
caccgctgtcccaaaaggtcagggccaaaaggaagatagagaaagagcaaccaggaaggttccctgttgcatagttcacgccgtcttccagaacccggacgccatgcgccagggccctggcatatcagcagccagggcct

SEQ ID NO: 388835 - DNA, 140 bp, Artificial Sequence
  Synthetic
aggccctggctgctgatatgcaccacgggcatacgccatggaccgggagatggctgcatcgtgcggaggcgcggtttttataggtttggtaatcctgaccttgtcaccatactacaaagagaccttttgggacagcggtg

SEQ ID NO: 388836 - DNA, 140 bp, Artificial Sequence
  Synthetic
caccgctgtcccaaaaggtctctttgtagtatggtgacaaggtcaggattaccaaacctataaaaaccgcgcctccgcacgatgcagccatctcccggtccatggcgtatgcccgtggtgcatatcagcagccagggcct

SEQ ID NO: 388837 - DNA, 140 bp, Artificial Sequence
  Synthetic
atacgccatgctgggtctcctcgtgcgttacagtgccagtgtctgcagtggaaatcaggaacatcagtactagttactatgccactaacgattgctcgaacaacagcatcacctggcagccgtacttgggagtcggccat

SEQ ID NO: 388838 - DNA, 140 bp, Artificial Sequence
  Synthetic
atggccgactcccaagtacggctgccaggtgatgctgttgttcgagcaatcgttagtggcatagtaactagtactgatgttcctgatttccactgcagacactggcactgtaacgcacgaggagacccagcatggcgtat

SEQ ID NO: 388839 - DNA, 140 bp, Artificial Sequence
  Synthetic
atacgccatgctgggtctccaacggcaccttgcgctgctggatacaagtaacacctaatgtggctgtgaaacaccgtggcgcactcactcacaatctgcgaacacatgtcgacgtgatcgcgtacttgggagtcggccat

SEQ ID NO: 388840 - DNA, 140 bp, Artificial Sequence
  Synthetic
atggccgactcccaagtacgcgatcacgtcgacatgtgttcgcagattgtgagtgagtgcgccacggtgtttcacagccacattaggtgttacttgtatccagcagcgcaaggtgccgttggagacccagcatggcgtat

SEQ ID NO: 388841 - DNA, 140 bp, Artificial Sequence
  Synthetic
atacgccatgctgggtctccgcgtgcatgttggtgcggagagttgctgggggccaatatgtccaaatggctctcatgaagctggccgcgctgacgggcacgtacgtttataaccaccttacgtacttgggagtcggccat

SEQ ID NO: 388842 - DNA, 140 bp, Artificial Sequence
  Synthetic
atggccgactcccaagtacgtaaggtggttataaacgtacgtgcccgtcagcgcggccagcttcatgagagccatttggacatattggcccccagcaactctccgcaccaacatgcacgcggagacccagcatggcgtat

SEQ ID NO: 388843 - DNA, 140 bp, Artificial Sequence
  Synthetic
atacgccatgctgggtctccgccgtgatgatcgtgtcgcaggctttcataatatcgccacaacaccacaacttcacccaggagtgcaactgttccatctaccaaggtcatatcaccggcccgtacttgggagtcggccat

SEQ ID NO: 388844 - DNA, 140 bp, Artificial Sequence
  Synthetic
atggccgactcccaagtacgggccggtgatatgaccttggtagatggaacagttgcactcctgggtgaagttgtggtgttgtggcgatattatgaaagcctgcgacacgatcatcacggcggagacccagcatggcgtat

SEQ ID NO: 388845 - DNA, 140 bp, Artificial Sequence
  Synthetic
aggccctggctgctgatatgagtctgacgacgggtcttactcgtccatgcctccgcttgaaggggagccgggtgatccagacctcacatcggactcgtggtccacagtcagcggatcggagaccttttgggacagcggtg

SEQ ID NO: 388846 - DNA, 140 bp, Artificial Sequence
  Synthetic
caccgctgtcccaaaaggtctccgatccgctgactgtggaccacgagtccgatgtgaggtctggatcacccggctccccttcaagcggaggcatggacgagtaagacccgtcgtcagactcatatcagcagccagggcct

SEQ ID NO: 388847 - DNA, 140 bp, Artificial Sequence
  Synthetic
aggccctggctgctgatatgttcgcccagggctggggccctatcagctatgccaacggaagcggccccgaacaccgcccctactgctggcactactccccaaaaccttgtggtatcgtgcgaccttttgggacagcggtg

SEQ ID NO: 388848 - DNA, 140 bp, Artificial Sequence
  Synthetic
caccgctgtcccaaaaggtcgcacgataccacaaggttttggggagtagtgccagcagtaggggcggtgttcggggccgcttccgttggcatagctgatagggccccagccctgggcgaacatatcagcagccagggcct

SEQ ID NO: 388849 - DNA, 140 bp, Artificial Sequence
  Synthetic
atacgccatgctgggtctcccaaatggcagctggcacataaaccggaccgccctcaactgcaatgacagcttgcatacgggcttcatcgcttccctgttttacgtccgcaatttcaacagcgtacttgggagtcggccat

SEQ ID NO: 388850 - DNA, 140 bp, Artificial Sequence
  Synthetic
atggccgactcccaagtacgctgttgaaattgcggacgtaaaacagggaagcgatgaagcccgtatgcaagctgtcattgcagttgagggcggtccggtttatgtgccagctgccatttgggagacccagcatggcgtat

SEQ ID NO: 388851 - DNA, 140 bp, Artificial Sequence
  Synthetic
atacgccatgctgggtctcctggtcaacagcaacggcagttggcacatcaacagcacggccttgaactgcaatgattcccttaccaccggctggctagcagggcttttctattacaacaacgtacttgggagtcggccat

SEQ ID NO: 388852 - DNA, 140 bp, Artificial Sequence
  Synthetic
atggccgactcccaagtacgttgttgtaatagaaaagccctgctagccagccggtggtaagggaatcattgcagttcaaggccgtgctgttgatgtgccaactgccgttgctgttgaccaggagacccagcatggcgtat

SEQ ID NO: 388853 - DNA, 140 bp, Artificial Sequence
  Synthetic
aggccctggctgctgatatgaatgattcccttaccaccggctggctagcagggcttttctattacaacaaattcaacttttcaggttgtcccgagaggttggccagctgccgacccctcagaccttttgggacagcggtg

SEQ ID NO: 388854 - DNA, 140 bp, Artificial Sequence
  Synthetic
caccgctgtcccaaaaggtctgaggggtcggcagctggccaacctctcgggacaacctgaaaagttgaatttgttgtaatagaaaagccctgctagccagccggtggtaagggaatcattcatatcagcagccagggcct

SEQ ID NO: 388855 - DNA, 140 bp, Artificial Sequence
  Synthetic
atacgccatgctgggtctcccttatagattgtggcattatccgtgcactgtgaacttcaccatcttcaaggtgcggatgtatataggaggggtggagcatcgattgaacgcagcgtgcaacgtacttgggagtcggccat

SEQ ID NO: 388856 - DNA, 140 bp, Artificial Sequence
  Synthetic
atggccgactcccaagtacgttgcacgctgcgttcaatcgatgctccacccctcctatatacatccgcaccttgaagatggtgaagttcacagtgcacggataatgccacaatctataagggagacccagcatggcgtat

SEQ ID NO: 388857 - DNA, 140 bp, Artificial Sequence
  Synthetic
atacgccatgctgggtctccttctctgacctaccggcactatctactggtctattgcacctccaccaaaacatcgtggacgtgcagtacctctatgggctttctccagctatcacaaggtcgtacttgggagtcggccat

SEQ ID NO: 388858 - DNA, 140 bp, Artificial Sequence
  Synthetic
atggccgactcccaagtacgaccttgtgatagctggagaaagcccatagaggtactgcacgtccacgatgttttggtggaggtgcaatagaccagtagatagtgccggtaggtcagagaaggagacccagcatggcgtat

SEQ ID NO: 388859 - DNA, 140 bp, Artificial Sequence
  Synthetic
atacgccatgctgggtctccttgctggcactatgcgcctcgaccgtgcggtattgtacccgcgtcgacggtgtgtggtccagtgtattgctttaccccaagccctgttgtagtggggacgcgtacttgggagtcggccat

SEQ ID NO: 388860 - DNA, 140 bp, Artificial Sequence
  Synthetic
atggccgactcccaagtacgcgtccccactacaacagggcttggggtaaagcaatacactggaccacacaccgtcgacgcgggtacaataccgcacggtcgaggcgcatagtgccagcaaggagacccagcatggcgtat

SEQ ID NO: 388861 - DNA, 140 bp, Artificial Sequence
  Synthetic
aggccctggctgctgatatgaagggcagggtggtccctgtggctacgtactctgttctcggcttgtggtcctttctcctcctggtcttggccttaccacagcaggcttatgccctggatggaccttttgggacagcggtg

SEQ ID NO: 388862 - DNA, 140 bp, Artificial Sequence
  Synthetic
caccgctgtcccaaaaggtccatccagggcataagcctgctgtggtaaggccaagaccaggaggagaaaggaccacaagccgagaacagagtacgtagccacagggaccaccctgcccttcatatcagcagccagggcct

SEQ ID NO: 388863 - DNA, 140 bp, Artificial Sequence
  Synthetic
aggccctggctgctgatatgcccggccttggtatttgacatcaccaagttgttgctggccgtcttcggacccctttggattcttcaaaccagtctgctcaaagtgccctacttcgtgcgcgaccttttgggacagcggtg

SEQ ID NO: 388864 - DNA, 140 bp, Artificial Sequence
  Synthetic
caccgctgtcccaaaaggtcgcgcacgaagtagggcactttgagcagactggtttgaagaatccaaaggggtccgaagacggccagcaacaacttggtgatgtcaaataccaaggccgggcatatcagcagccagggcct

SEQ ID NO: 388865 - DNA, 140 bp, Artificial Sequence
  Synthetic
atacgccatgctgggtctccattctacacccacgccttgtgtttgaggtcacgaaatggctgttggcagtcctggggcctgcctacctcctcaaagtttccctgttacgggtaccatactcgtacttgggagtcggccat

SEQ ID NO: 388866 - DNA, 140 bp, Artificial Sequence
  Synthetic
atggccgactcccaagtacgagtatggtacccgtaacagggaaactttgaggaggtaggcaggccccaggactgccaacagccatttcgtgacctcaaacacaaggcgtgggtgtagaatggagacccagcatggcgtat

SEQ ID NO: 388867 - DNA, 140 bp, Artificial Sequence
  Synthetic
atacgccatgctgggtctcctggcacttacatctatgaccacctttcccctttgtcaacttgggcagcccatggcctgcgagacctggcagtcgccgtggagcctgtggtattcagcccacgtacttgggagtcggccat

SEQ ID NO: 388868 - DNA, 140 bp, Artificial Sequence
  Synthetic
atggccgactcccaagtacgtgggctgaataccacaggctccacggcgactgccaggtctcgcaggccatgggctgcccaagttgacaaaggggaaaggtggtcatagatgtaagtgccaggagacccagcatggcgtat

SEQ ID NO: 388869 - DNA, 140 bp, Artificial Sequence
  Synthetic
aggccctggctgctgatatggcctacgagatctggccgtggctgtagagccagtcgtcttctcccaaatggagaccaagctcatcacgtggggggcggacaccgccgcgtgcggtgacatgaccttttgggacagcggtg

SEQ ID NO: 388870 - DNA, 140 bp, Artificial Sequence
  Synthetic
caccgctgtcccaaaaggtcatgtcaccgcacgcggcggtgtccgccccccacgtgatgagcttggtctccatttgggagaagacgactggctctacagccacggccagatctcgtaggccatatcagcagccagggcct

SEQ ID NO: 388871 - DNA, 140 bp, Artificial Sequence
  Synthetic
aggccctggctgctgatatgagttcgatgagatggaagagtgtgcatcacacctcccctacatcgaacagggaatgcagctcgccgagcaattcaagcagaaggcgctcgggttgctgcagaccttttgggacagcggtg

SEQ ID NO: 388872 - DNA, 140 bp, Artificial Sequence
  Synthetic
caccgctgtcccaaaaggtctgcagcaacccgagcgccttctgcttgaattgctcggcgagctgcattccctgttcgatgtaggggaggtgtgatgcacactcttccatctcatcgaactcatatcagcagccagggcct

SEQ ID NO: 388873 - DNA, 140 bp, Artificial Sequence
  Synthetic
atacgccatgctgggtctccaaggatcatccggcggacccgtgctctgccctaggggacatgccgtgggcctgttcagagcggccgtgtgcaccaggggtgtggccaaatccattgacttcgtacttgggagtcggccat

SEQ ID NO: 388874 - DNA, 140 bp, Artificial Sequence
  Synthetic
atggccgactcccaagtacgaagtcaatggatttggccacacccctggtgcacacggccgctctgaacaggcccacggcatgtcccctagggcagagcacgggtccgccggatgatccttggagacccagcatggcgtat

SEQ ID NO: 388875 - DNA, 140 bp, Artificial Sequence
  Synthetic
aggccctggctgctgatatgcatcgaggccaacctcctgtggcggcaggagatgggcgggaacatcacccgcgtggagtcagagaataaggtagtaattctggactctttcgacccgcttgaccttttgggacagcggtg

SEQ ID NO: 388876 - DNA, 140 bp, Artificial Sequence
  Synthetic
caccgctgtcccaaaaggtcaagcgggtcgaaagagtccagaattactaccttattctctgactccacgcgggtgatgttcccgcccatctcctgccgccacaggaggttggcctcgatgcatatcagcagccagggcct

SEQ ID NO: 388877 - DNA, 140 bp, Artificial Sequence
  Synthetic
atacgccatgctgggtctccgacaacacaacccctattccgacaacaatcatggccaaaaatgaggttttttctgttaacccccagaaaggcggccgaaagccagcgcgcctcatcgtatcgtacttgggagtcggccat

SEQ ID NO: 388878 - DNA, 140 bp, Artificial Sequence
  Synthetic
atggccgactcccaagtacgatacgatgaggcgcgctggctttcggccgcctttctgggggttaacagaaaaaacctcatttttggccatgattgttgtcggaataggggttgtgttgtcggagacccagcatggcgtat

SEQ ID NO: 388879 - DNA, 140 bp, Artificial Sequence
  Synthetic
aggccctggctgctgatatgcttagcccgctactgctgtctacaacggagtggcagatactgccctgttccttcaccaccttgccggctttgtccactggcttgattcatctccatcagagaccttttgggacagcggtg

SEQ ID NO: 388880 - DNA, 140 bp, Artificial Sequence
  Synthetic
caccgctgtcccaaaaggtctctgatggagatgaatcaagccagtggacaaagccggcaaggtggtgaaggaacagggcagtatctgccactccgttgtagacagcagtagcgggctaagcatatcagcagccagggcct

SEQ ID NO: 388881 - DNA, 140 bp, Artificial Sequence
  Synthetic
atacgccatgctgggtctccgaactcacgcctgctgagaccacagtgagacttcgggcctacttcaacacgcccggtctgcccgtgtgtcaagaccacctagaattttgggaggcggtctcgtacttgggagtcggccat

SEQ ID NO: 388882 - DNA, 140 bp, Artificial Sequence
  Synthetic
atggccgactcccaagtacgagaccgcctcccaaaattctaggtggtcttgacacacgggcagaccgggcgtgttgaagtaggcccgaagtctcactgtggtctcagcaggcgtgagttcggagacccagcatggcgtat

SEQ ID NO: 388883 - DNA, 140 bp, Artificial Sequence
  Synthetic
aggccctggctgctgatatgcggactacgttcctccggtggtacacgggtgcccattaccacctaccaagggccctccgataccccctccacggagaaagaggacggttgtcctaacagagaccttttgggacagcggtg

SEQ ID NO: 388884 - DNA, 140 bp, Artificial Sequence
  Synthetic
caccgctgtcccaaaaggtctctgttaggacaaccgtcctctttctccgtggagggggtatcggagggcccttggtaggtggtaatgggcacccgtgtaccaccggaggaacgtagtccgcatatcagcagccagggcct

SEQ ID NO: 388885 - DNA, 140 bp, Artificial Sequence
  Synthetic
aggccctggctgctgatatgaagaccgcaatttggagggtggcagcgtctgagtacgttgagatcacgcagcatggctctttctcgtatgtgacggggctaaccagtgacaaccttaagggaccttttgggacagcggtg

SEQ ID NO: 388886 - DNA, 140 bp, Artificial Sequence
  Synthetic
caccgctgtcccaaaaggtcccttaaggttgtcactggttagccccgtcacatacgagaaagagccatgctgcgtgatctcaacgtactcagacgctgccaccctccaaattgcggtcttcatatcagcagccagggcct

SEQ ID NO: 388887 - DNA, 140 bp, Artificial Sequence
  Synthetic
aggccctggctgctgatatgccaggcgccactggacgacgcaagactgcaattgttctatctatcccggccatataacgggtcaccgcatggcatgggatatgatgatgaactggtccccgaccttttgggacagcggtg

SEQ ID NO: 388888 - DNA, 140 bp, Artificial Sequence
  Synthetic
caccgctgtcccaaaaggtcggggaccagttcatcatcatatcccatgccatgcggtgacccgttatatggccgggatagatagaacaattgcagtcttgcgtcgtccagtggcgcctggcatatcagcagccagggcct

SEQ ID NO: 388889 - DNA, 140 bp, Artificial Sequence
  Synthetic
atacgccatgctgggtctccgcgagccttccgtaccatcagagtacttgatcaggaggaaaaagttcccatcggcactacctccctgggctcgcccagattacaaccctcctacgatcgacgtacttgggagtcggccat

SEQ ID NO: 388890 - DNA, 140 bp, Artificial Sequence
  Synthetic
atggccgactcccaagtacgtcgatcgtaggagggttgtaatctgggcgagcccagggaggtagtgccgatgggaactttttcctcctgatcaagtactctgatggtacggaaggctcgcggagacccagcatggcgtat

SEQ ID NO: 388891 - DNA, 140 bp, Artificial Sequence
  Synthetic
atacgccatgctgggtctccgatatggaagaggccaggctatgaaccacccactgtcctaggatgtgccctcccccccacacctcaagtgccagtgcccccccctcggaggcgccgcacccgtacttgggagtcggccat

SEQ ID NO: 388892 - DNA, 140 bp, Artificial Sequence
  Synthetic
atggccgactcccaagtacgggtgcggcgcctccgaggggggggcactggcacttgaggtgtgggggggagggcacatcctaggacagtgggtggttcatagcctggcctcttccatatcggagacccagcatggcgtat

SEQ ID NO: 388893 - DNA, 140 bp, Artificial Sequence
  Synthetic
aggccctggctgctgatatgggtcctggcgggcctcgcatattattccatggtggggaactgggctaaggttttgattgtgatgctactctttgccggcgttgatgcgacaacccacgtagaccttttgggacagcggtg

SEQ ID NO: 388894 - DNA, 140 bp, Artificial Sequence
  Synthetic
caccgctgtcccaaaaggtctacgtgggttgtcgcatcaacgccggcaaagagtagcatcacaatcaaaaccttagcccagttccccaccatggaataatatgcgaggcccgccaggacccatatcagcagccagggcct

SEQ ID NO: 388895 - DNA, 140 bp, Artificial Sequence
  Synthetic
atacgccatgctgggtctccacatcaacaggactgccttgaactgcaatgactccctccacactgggtttattacctcactgttttacagatacaagttcaactcgtccggatgcccagacgtacttgggagtcggccat

SEQ ID NO: 388896 - DNA, 140 bp, Artificial Sequence
  Synthetic
atggccgactcccaagtacgtctgggcatccggacgagttgaacttgtatctgtaaaacagtgaggtaataaacccagtgtggagggagtcattgcagttcaaggcagtcctgttgatgtggagacccagcatggcgtat

SEQ ID NO: 388897 - DNA, 140 bp, Artificial Sequence
  Synthetic
aggccctggctgctgatatgtcgcctcatcgtatacccggaccttggggtcagggtgtgcgagaagatggccctttatgacattgcacagaagcttcccaaggcagtaatggggccgtcagaccttttgggacagcggtg

SEQ ID NO: 388898 - DNA, 140 bp, Artificial Sequence
  Synthetic
caccgctgtcccaaaaggtctgacggccccattactgccttgggaagcttctgtgcaatgtcataaagggccatcttctcgcacaccctgaccccaaggtccgggtatacgatgaggcgacatatcagcagccagggcct

SEQ ID NO: 388899 - DNA, 140 bp, Artificial Sequence
  Synthetic
aggccctggctgctgatatgtcttcgggcccctttggattcttcaagccagtttgctaaaagtaccctactttgtgcgcgttcaaggccttctccggatctgcgcgctagcgcggaagatgaccttttgggacagcggtg

SEQ ID NO: 388900 - DNA, 140 bp, Artificial Sequence
  Synthetic
caccgctgtcccaaaaggtcatcttccgcgctagcgcgcagatccggagaaggccttgaacgcgcacaaagtagggtacttttagcaaactggcttgaagaatccaaaggggcccgaagacatatcagcagccagggcct

SEQ ID NO: 388901 - DNA, 140 bp, Artificial Sequence
  Synthetic
aggccctggctgctgatatgttcctcgctaggctcatatggtggttgcaatatcttatcaccagagccgaggcgcatttgcaagtgtggattccccctctcaacgttcgggggggccgcggaccttttgggacagcggtg

SEQ ID NO: 388902 - DNA, 140 bp, Artificial Sequence
  Synthetic
caccgctgtcccaaaaggtccgcggcccccccgaacgttgagagggggaatccacacttgcaaatgcgcctcggctctggtgataagatattgcaaccaccatatgagcctagcgaggaacatatcagcagccagggcct

SEQ ID NO: 388903 - DNA, 140 bp, Artificial Sequence
  Synthetic
atacgccatgctgggtctccggcgaaggtcctggtggtgctgctgctatttgccggcgtcgacgcagaaacccaagtcaccgggggaattgctagctacaccacatctggaattgctagccgtacttgggagtcggccat

SEQ ID NO: 388904 - DNA, 140 bp, Artificial Sequence
  Synthetic
atggccgactcccaagtacggctagcaattccagatgtggtgtagctagcaattcccccggtgacttgggtttctgcgtcgacgccggcaaatagcagcagcaccaccaggaccttcgccggagacccagcatggcgtat

SEQ ID NO: 388905 - DNA, 140 bp, Artificial Sequence
  Synthetic
atacgccatgctgggtctccccggctggatagcagggcttatctatcaccacaaattcaactcttcaggctgtcctgagaggctggccagctgccgaccccttacctatttcaaccagggcgtacttgggagtcggccat

SEQ ID NO: 388906 - DNA, 140 bp, Artificial Sequence
  Synthetic
atggccgactcccaagtacgccctggttgaaataggtaaggggtcggcagctggccagcctctcaggacagcctgaagagttgaatttgtggtgatagataagccctgctatccagccggggagacccagcatggcgtat

SEQ ID NO: 388907 - DNA, 140 bp, Artificial Sequence
  Synthetic
atacgccatgctgggtctccctggggccctatcaagcatgccaacggaagcggccccgaccaacgcccctattgctggcactatcccccaaaaccttgtggaattgtgcccgcaaagacccgtacttgggagtcggccat

SEQ ID NO: 388908 - DNA, 140 bp, Artificial Sequence
  Synthetic
atggccgactcccaagtacgggtctttgcgggcacaattccacaaggttttgggggatagtgccagcaataggggcgttggtcggggccgcttccgttggcatgcttgatagggccccagggagacccagcatggcgtat

SEQ ID NO: 388909 - DNA, 140 bp, Artificial Sequence
  Synthetic
aggccctggctgctgatatgaacgcccctactgctggcactaccccccaaagccttgcggtatcgtgcccgcaagaggcgtgtgtggcccggtgtattgcttcactcccagccccgtcgcgaccttttgggacagcggtg

SEQ ID NO: 388910 - DNA, 140 bp, Artificial Sequence
  Synthetic
caccgctgtcccaaaaggtcgcgacggggctgggagtgaagcaatacaccgggccacacacgcctcttgcgggcacgataccgcaaggctttggggggtagtgccagcagtaggggcgttcatatcagcagccagggcct

SEQ ID NO: 388911 - DNA, 140 bp, Artificial Sequence
  Synthetic
aggccctggctgctgatatgtaacacatgtgtcacccagacggtcgatttcagcttggaccctaccttcaccatcgagacgacgaccgtgccccaagacgcggtgtcgcgctcgcagcgggaccttttgggacagcggtg

SEQ ID NO: 388912 - DNA, 140 bp, Artificial Sequence
  Synthetic
caccgctgtcccaaaaggtcccgctgcgagcgcgacaccgcgtcttggggcacggtcgtcgtctcgatggtgaaggtagggtccaagctgaaatcgaccgtctgggtgacacatgtgttacatatcagcagccagggcct

SEQ ID NO: 388913 - DNA, 140 bp, Artificial Sequence
  Synthetic
atacgccatgctgggtctccatggagaagaaggtcattgtgtggggggctgagacagtggcatgtggggatatcctgcatggcctcccggtttccgcgaggctaggtagggaagttctgccgtacttgggagtcggccat

SEQ ID NO: 388914 - DNA, 140 bp, Artificial Sequence
  Synthetic
atggccgactcccaagtacggcagaacttccctacctagcctcgcggaaaccgggaggccatgcaggatatccccacatgccactgtctcagccccccacacaatgaccttcttctccatggagacccagcatggcgtat

SEQ ID NO: 388915 - DNA, 140 bp, Artificial Sequence
  Synthetic
atacgccatgctgggtctccactgggcacttacaggtatgtctcgtcaggtgaaaggccgtctgggatgttcgacagcgtagtgctctgcgagtgctatgatgccggggcagcctggtaccgtacttgggagtcggccat

SEQ ID NO: 388916 - DNA, 140 bp, Artificial Sequence
  Synthetic
atggccgactcccaagtacggtaccaggctgccccggcatcatagcactcgcagagcactacgctgtcgaacatcccagacggcctttcacctgacgagacatacctgtaagtgcccagtggagacccagcatggcgtat

SEQ ID NO: 388917 - DNA, 140 bp, Artificial Sequence
  Synthetic
atacgccatgctgggtctccttgcttcattgatggcttttacagctgctgtcaccagcccactaaccactagccaaaccctcctcttcaacatattgggggggtgggtggctgcccagctcgtacttgggagtcggccat

SEQ ID NO: 388918 - DNA, 140 bp, Artificial Sequence
  Synthetic
atggccgactcccaagtacgagctgggcagccacccacccccccaatatgttgaagaggagggtttggctagtggttagtgggctggtgacagcagctgtaaaagccatcaatgaagcaaggagacccagcatggcgtat

SEQ ID NO: 388919 - DNA, 140 bp, Artificial Sequence
  Synthetic
aggccctggctgctgatatgacaacaccttgcactgccccactgattgtttccgcaagcatccggaagccacatactctcggtgcggctccggtccctggatcacgcccaggtgcctggtgaccttttgggacagcggtg

SEQ ID NO: 388920 - DNA, 140 bp, Artificial Sequence
  Synthetic
caccgctgtcccaaaaggtcaccaggcacctgggcgtgatccagggaccggagccgcaccgagagtatgtggcttccggatgcttgcggaaacaatcagtggggcagtgcaaggtgttgtcatatcagcagccagggcct

SEQ ID NO: 388921 - DNA, 140 bp, Artificial Sequence
  Synthetic
aggccctggctgctgatatgaggagatgggcggcaacatcaccagggttgagtcagagaacaaagtggtgattctggactccttcgatccgcttgtggcggaggaggatgagcgggagatgaccttttgggacagcggtg

SEQ ID NO: 388922 - DNA, 140 bp, Artificial Sequence
  Synthetic
caccgctgtcccaaaaggtcatctcccgctcatcctcctccgccacaagcggatcgaaggagtccagaatcaccactttgttctctgactcaaccctggtgatgttgccgcccatctcctcatatcagcagccagggcct

SEQ ID NO: 388923 - DNA, 140 bp, Artificial Sequence
  Synthetic
aggccctggctgctgatatgcccgactacgaaccacctgtggtccatggctgtccgcttccacctccaaagtcccctcctgtgcctccgcctcggaagaagcggacggtggtcctcactggaccttttgggacagcggtg

SEQ ID NO: 388924 - DNA, 140 bp, Artificial Sequence
  Synthetic
caccgctgtcccaaaaggtccagtgaggaccaccgtccgcttcttccgaggcggaggcacaggaggggactttggaggtggaagcggacagccatggaccacaggtggttcgtagtcgggcatatcagcagccagggcct

SEQ ID NO: 388925 - DNA, 140 bp, Artificial Sequence
  Synthetic
aggccctggctgctgatatgaatggcaccttgcgctgctggatacaagtaacacctaatgtggctgtgaaacaccgcggtgcactcactcacaacctgcgaacacacgtcgacatgatcggaccttttgggacagcggtg

SEQ ID NO: 388926 - DNA, 140 bp, Artificial Sequence
  Synthetic
caccgctgtcccaaaaggtccgatcatgtcgacgtgtgttcgcaggttgtgagtgagtgcaccgcggtgtttcacagccacattaggtgttacttgtatccagcagcgcaaggtgccattcatatcagcagccagggcct

SEQ ID NO: 388927 - DNA, 140 bp, Artificial Sequence
  Synthetic
atacgccatgctgggtctcccttcacccaagagtgcaattgttccatctaccaaggccatatcaccggccaccgcatggcatgggacatgatgctaaactggtcaccaactcttaccatgcgtacttgggagtcggccat

SEQ ID NO: 388928 - DNA, 140 bp, Artificial Sequence
  Synthetic
atggccgactcccaagtacgcatggtaagagttggtgaccagtttagcatcatgtcccatgccatgcggtggccggtgatatggccttggtagatggaacaattgcactcttgggtgaagggagacccagcatggcgtat

SEQ ID NO: 388929 - DNA, 140 bp, Artificial Sequence
  Synthetic
atacgccatgctgggtctcccagtggcctctttgcccctggtcccaggcagagaatccatttaatcaacaccaatggcagctggcacatcaaccggaccgccctcaattgcaacgacagccgtacttgggagtcggccat

SEQ ID NO: 388930 - DNA, 140 bp, Artificial Sequence
  Synthetic
atggccgactcccaagtacggctgtcgttgcaattgagggcggtccggttgatgtgccagctgccattggtgttgattaaatggattctctgcctgggaccaggggcaaagaggccactgggagacccagcatggcgtat

SEQ ID NO: 388931 - DNA, 140 bp, Artificial Sequence
  Synthetic
atacgccatgctgggtctccgcatcgggtggggaaccttggaatacgagaccaatgtcaccaacgatgaggacatgaggccgtactgctggcattaccctccgaagccttgcggtatcgtcgtacttgggagtcggccat

SEQ ID NO: 388932 - DNA, 140 bp, Artificial Sequence
  Synthetic
atggccgactcccaagtacgacgataccgcaaggcttcggagggtaatgccagcagtacggcctcatgtcctcatcgttggtgacattggtctcgtattccaaggttccccacccgatgcggagacccagcatggcgtat

SEQ ID NO: 388933 - DNA, 140 bp, Artificial Sequence
  Synthetic
aggccctggctgctgatatggacatgaggccgtactgctggcattaccctccgaagccttgcggtatcgtctcggctaggacggtttgcgggccggtctactgttttactcctagccctggaccttttgggacagcggtg

SEQ ID NO: 388934 - DNA, 140 bp, Artificial Sequence
  Synthetic
caccgctgtcccaaaaggtccagggctaggagtaaaacagtagaccggcccgcaaaccgtcctagccgagacgataccgcaaggcttcggagggtaatgccagcagtacggcctcatgtccatatcagcagccagggcct

SEQ ID NO: 388935 - DNA, 140 bp, Artificial Sequence
  Synthetic
aggccctggctgctgatatgacatcaacaggactgccctgaactgcaatgactccctccacaccggatggcttgctgcgctgttctacaaaaacaacttcaacgcgtccggatgcccggagaccttttgggacagcggtg

SEQ ID NO: 388936 - DNA, 140 bp, Artificial Sequence
  Synthetic
caccgctgtcccaaaaggtctccgggcatccggacgcgttgaagttgtttttgtagaacagcgcagcaagccatccggtgtggagggagtcattgcagttcagggcagtcctgttgatgtcatatcagcagccagggcct

SEQ ID NO: 388937 - DNA, 140 bp, Artificial Sequence
  Synthetic
aggccctggctgctgatatgcttatagattgtggcattatccgtgcactgtgaattttaccatcttcaaggtgcggatgtatgtagggggggtggagcatcgattgtccgcagcatgtaagaccttttgggacagcggtg

SEQ ID NO: 388938 - DNA, 140 bp, Artificial Sequence
  Synthetic
caccgctgtcccaaaaggtcttacatgctgcggacaatcgatgctccaccccccctacatacatccgcaccttgaagatggtaaaattcacagtgcacggataatgccacaatctataagcatatcagcagccagggcct

SEQ ID NO: 388939 - DNA, 140 bp, Artificial Sequence
  Synthetic
atacgccatgctgggtctcctttcacgcgcggagaccgctgcaggttggaagatagggacaggggtcagcagagtccactgctgcattccaccactgagtgggcggtgttgccatgctcccgtacttgggagtcggccat

SEQ ID NO: 388940 - DNA, 140 bp, Artificial Sequence
  Synthetic
atggccgactcccaagtacgggagcatggcaacaccgcccactcagtggtggaatgcagcagtggactctgctgacccctgtccctatcttccaacctgcagcggtctccgcgcgtgaaaggagacccagcatggcgtat

SEQ ID NO: 388941 - DNA, 140 bp, Artificial Sequence
  Synthetic
atacgccatgctgggtctccgttgtcctacatgctggtcttagccgaagcccagattcagcaatgggttccccccctggaagcccgaggggggcgtgatgggatcatctggctggctgtccgtacttgggagtcggccat

SEQ ID NO: 388942 - DNA, 140 bp, Artificial Sequence
  Synthetic
atggccgactcccaagtacggacagccagccagatgatcccatcacgcccccctcgggcttccagggggggaacccattgctgaatctgggcttcggctaagaccagcatgtaggacaacggagacccagcatggcgtat

SEQ ID NO: 388943 - DNA, 140 bp, Artificial Sequence
  Synthetic
atacgccatgctgggtctccatgccatcatcctcctcacgtgtgcggtccacccagagctgatttttgacatcaccaaattgttgctcgccatacttggtccgctcatggtgctccaggccgtacttgggagtcggccat

SEQ ID NO: 388944 - DNA, 140 bp, Artificial Sequence
  Synthetic
atggccgactcccaagtacggcctggagcaccatgagcggaccaagtatggcgagcaacaatttggtgatgtcaaaaatcagctctgggtggaccgcacacgtgaggaggatgatggcatggagacccagcatggcgtat

SEQ ID NO: 388945 - DNA, 140 bp, Artificial Sequence
  Synthetic
aggccctggctgctgatatgttgttcagagcggccgtgtgctccaggggtgtggccaaatctattgacttcatccctgttgaatctctcgacatcgccagacggacgcccagtttctctggaccttttgggacagcggtg

SEQ ID NO: 388946 - DNA, 140 bp, Artificial Sequence
  Synthetic
caccgctgtcccaaaaggtccagagaaactgggcgtccgtctggcgatgtcgagagattcaacagggatgaagtcaatagatttggccacacccctggagcacacggccgctctgaacaacatatcagcagccagggcct

SEQ ID NO: 388947 - DNA, 140 bp, Artificial Sequence
  Synthetic
atacgccatgctgggtctccgggacttacaccaccgggggagctgtctcccacgttgcgcaaggggtatctaacctcttctcatcaggcgcccagcagaacatccagctaatcaacaccgcgtacttgggagtcggccat

SEQ ID NO: 388948 - DNA, 140 bp, Artificial Sequence
  Synthetic
atggccgactcccaagtacgcggtgttgattagctggatgttctgctgggcgcctgatgagaagaggttagataccccttgcgcaacgtgggagacagctcccccggtggtgtaagtcccggagacccagcatggcgtat

SEQ ID NO: 388949 - DNA, 140 bp, Artificial Sequence
  Synthetic
atacgccatgctgggtctcctatgcggtccccggtcttcacagacaactcatctccaccggctgtaccgcagactttccaagtggcccacttacacgctcctactggcagcggcaagagccgtacttgggagtcggccat

SEQ ID NO: 388950 - DNA, 140 bp, Artificial Sequence
  Synthetic
atggccgactcccaagtacggctcttgccgctgccagtaggagcgtgtaagtgggccacttggaaagtctgcggtacagccggtggagatgagttgtctgtgaagaccggggaccgcataggagacccagcatggcgtat

SEQ ID NO: 388951 - DNA, 140 bp, Artificial Sequence
  Synthetic
atacgccatgctgggtctcctagaggaggtggcccttggtcatgagggcgagatccctttttacggcaaggctattcccctagctttcatcaaggggggcagacacctgatcttttgccacgtacttgggagtcggccat

SEQ ID NO: 388952 - DNA, 140 bp, Artificial Sequence
  Synthetic
atggccgactcccaagtacgtggcaaaagatcaggtgtctgccccccttgatgaaagctaggggaatagccttgccgtaaaaagggatctcgccctcatgaccaagggccacctcctctaggagacccagcatggcgtat

SEQ ID NO: 388953 - DNA, 140 bp, Artificial Sequence
  Synthetic
aggccctggctgctgatatgtgtccaccacacagtggcaggtccttccgtgttccttcacgaccttgccagccttgtccaccggcctcatccacctccaccagaacatcgtggacgtgcagaccttttgggacagcggtg

SEQ ID NO: 388954 - DNA, 140 bp, Artificial Sequence
  Synthetic
caccgctgtcccaaaaggtctgcacgtccacgatgttctggtggaggtggatgaggccggtggacaaggctggcaaggtcgtgaaggaacacggaaggacctgccactgtgtggtggacacatatcagcagccagggcct

SEQ ID NO: 388955 - DNA, 140 bp, Artificial Sequence
  Synthetic
aggccctggctgctgatatgtccaccctaccgggaaatcccgcagtggcgtcaatgatggctttcagcgccgcattgactagcccactacccaccagcaccaccatcctcttgaacatcagaccttttgggacagcggtg

SEQ ID NO: 388956 - DNA, 140 bp, Artificial Sequence
  Synthetic
caccgctgtcccaaaaggtctgatgttcaagaggatggtggtgctggtgggtagtgggctagtcaatgcggcgctgaaagccatcattgacgccactgcgggatttcccggtagggtggacatatcagcagccagggcct

SEQ ID NO: 388957 - DNA, 140 bp, Artificial Sequence
  Synthetic
atacgccatgctgggtctcctgacagcttgcagacaggattcatcgccggcctgttctaccgccataaattcaatagctctgggtgtccggagaggctttctagctgcaaacgccttgatcgtacttgggagtcggccat

SEQ ID NO: 388958 - DNA, 140 bp, Artificial Sequence
  Synthetic
atggccgactcccaagtacgatcaaggcgtttgcagctagaaagcctctccggacacccagagctattgaatttatggcggtagaacaggccggcgatgaatcctgtctgcaagctgtcaggagacccagcatggcgtat

SEQ ID NO: 388959 - DNA, 140 bp, Artificial Sequence
  Synthetic
atacgccatgctgggtctccaacgttcactgtaggccttaattcctttgtggtcggctctcagctcccttgcgaccctgagccggacaccgaggtattggcctccatgttgacagacccgcgtacttgggagtcggccat

SEQ ID NO: 388960 - DNA, 140 bp, Artificial Sequence
  Synthetic
atggccgactcccaagtacgcgggtctgtcaacatggaggccaatacctcggtgtccggctcagggtcgcaagggagctgagagccgaccacaaaggaattaaggcctacagtgaacgttggagacccagcatggcgtat

SEQ ID NO: 388961 - DNA, 140 bp, Artificial Sequence
  Synthetic
aggccctggctgctgatatgcagcctaacgggccgcgacaaaaatgagcaggctgggcaagtccaggttctgtcctccgtcacacaatctttcttggggacatctatttcgggggtcctcgaccttttgggacagcggtg

SEQ ID NO: 388962 - DNA, 140 bp, Artificial Sequence
  Synthetic
caccgctgtcccaaaaggtcgaggacccccgaaatagatgtccccaagaaagattgtgtgacggaggacagaacctggacttgcccagcctgctcatttttgtcgcggcccgttaggctgcatatcagcagccagggcct

SEQ ID NO: 388963 - DNA, 140 bp, Artificial Sequence
  Synthetic
atacgccatgctgggtctccaataggacggccttgaactgcaatgacagccttaacaccggctgggtagcagggctcttctaccacaacaacttcgactcttcaggctgtcctgagaggtcgtacttgggagtcggccat

SEQ ID NO: 388964 - DNA, 140 bp, Artificial Sequence
  Synthetic
atggccgactcccaagtacgacctctcaggacagcctgaagagtcgaagttgttgtggtagaagagccctgctacccagccggtgttaaggctgtcattgcagttcaaggccgtcctattggagacccagcatggcgtat

SEQ ID NO: 388965 - DNA, 140 bp, Artificial Sequence
  Synthetic
atacgccatgctgggtctccggaggacgcggcgagcctgagagccttcacggaggctatgaccaggtactccgccccccccggggaccccccccaaccagaatacgacttggagctcatacgtacttgggagtcggccat

SEQ ID NO: 388966 - DNA, 140 bp, Artificial Sequence
  Synthetic
atggccgactcccaagtacgtatgagctccaagtcgtattctggttggggggggtccccggggggggcggagtacctggtcatagcctccgtgaaggctctcaggctcgccgcgtcctccggagacccagcatggcgtat

SEQ ID NO: 388967 - DNA, 140 bp, Artificial Sequence
  Synthetic
aggccctggctgctgatatgggaagcaccccgaggccacttacaccaaatgcggctcggggccttggttgacacctaggtgcatagttcactacccatacaggctttggcactacccctggaccttttgggacagcggtg

SEQ ID NO: 388968 - DNA, 140 bp, Artificial Sequence
  Synthetic
caccgctgtcccaaaaggtccaggggtagtgccaaagcctgtatgggtagtgaactatgcacctaggtgtcaaccaaggccccgagccgcatttggtgtaagtggcctcggggtgcttcccatatcagcagccagggcct

SEQ ID NO: 388969 - DNA, 140 bp, Artificial Sequence
  Synthetic
aggccctggctgctgatatgcattgggcccacgcgggcctacgagaccttgcggtcgcagtagagcccgtcgtcttctctgacatggaaaccaagatcatcacctggggggcagacaccggaccttttgggacagcggtg

SEQ ID NO: 388970 - DNA, 140 bp, Artificial Sequence
  Synthetic
caccgctgtcccaaaaggtccggtgtctgccccccaggtgatgatcttggtttccatgtcagagaagacgacgggctctactgcgaccgcaaggtctcgtaggcccgcgtgggcccaatgcatatcagcagccagggcct

SEQ ID NO: 388971 - DNA, 140 bp, Artificial Sequence
  Synthetic
aggccctggctgctgatatggtagaccaagacctcgtcggctggcatgcgcctcccggggcgcgttcccttacaccatgcacctgcggtagctcggacctctatctggtcacgagacatggaccttttgggacagcggtg

SEQ ID NO: 388972 - DNA, 140 bp, Artificial Sequence
  Synthetic
caccgctgtcccaaaaggtccatgtctcgtgaccagatagaggtccgagctaccgcaggtgcatggtgtaagggaacgcgccccgggaggcgcatgccagccgacgaggtcttggtctaccatatcagcagccagggcct

SEQ ID NO: 388973 - DNA, 140 bp, Artificial Sequence
  Synthetic
atacgccatgctgggtctcctgttcctcgccaagctcatatggtggttgcaatattttatcaccagagccgaggcgcacctgcaagtgtggatcccccctctcaatgttcgggggggccgcgtacttgggagtcggccat

SEQ ID NO: 388974 - DNA, 140 bp, Artificial Sequence
  Synthetic
atggccgactcccaagtacgcggcccccccgaacattgagaggggggatccacacttgcaggtgcgcctcggctctggtgataaaatattgcaaccaccatatgagcttggcgaggaacaggagacccagcatggcgtat

SEQ ID NO: 388975 - DNA, 140 bp, Artificial Sequence
  Synthetic
aggccctggctgctgatatgcaaactactgctggccgtcttcggacccctttggattctccaagccagtttgcttaaagtcccctacttcgtgcgcgttcaaggccttctccggatctgcgaccttttgggacagcggtg

SEQ ID NO: 388976 - DNA, 140 bp, Artificial Sequence
  Synthetic
caccgctgtcccaaaaggtcgcagatccggagaaggccttgaacgcgcacgaagtaggggactttaagcaaactggcttggagaatccaaaggggtccgaagacggccagcagtagtttgcatatcagcagccagggcct

SEQ ID NO: 388977 - DNA, 140 bp, Artificial Sequence
  Synthetic
aggccctggctgctgatatgatcgctggtgctcactggggagtcctggcgggcatagcgtatttctccatggtggggaactgggcgaaggtcctggtagtgctgctgctatttgccggcggaccttttgggacagcggtg

SEQ ID NO: 388978 - DNA, 140 bp, Artificial Sequence
  Synthetic
caccgctgtcccaaaaggtccgccggcaaatagcagcagcactaccaggaccttcgcccagttccccaccatggagaaatacgctatgcccgccaggactccccagtgagcaccagcgatcatatcagcagccagggcct

SEQ ID NO: 388979 - DNA, 140 bp, Artificial Sequence
  Synthetic
aggccctggctgctgatatgatagccttaacaccggctggttagcagggctcatctatcagtacaatttcaactcttcaggctgtcccgagaggttggccagttgccgaccccttgctgagaccttttgggacagcggtg

SEQ ID NO: 388980 - DNA, 140 bp, Artificial Sequence
  Synthetic
caccgctgtcccaaaaggtctcagcaaggggtcggcaactggccaacctctcgggacagcctgaagagttgaaattgtactgatagatgagccctgctaaccagccggtgttaaggctatcatatcagcagccagggcct

SEQ ID NO: 388981 - DNA, 140 bp, Artificial Sequence
  Synthetic
aggccctggctgctgatatgggtggtgggaacgaccgacaggtcgggcgcgcctacctacaactggggtgaaaatgatacggacgtcttcgtccttaacaacaccaggccaccgctgggcgaccttttgggacagcggtg

SEQ ID NO: 388982 - DNA, 140 bp, Artificial Sequence
  Synthetic
caccgctgtcccaaaaggtcgcccagcggtggcctggtgttgttaaggacgaagacgtccgtatcattttcaccccagttgtaggtaggcgcgcccgacctgtcggtcgttcccaccacccatatcagcagccagggcct

SEQ ID NO: 388983 - DNA, 140 bp, Artificial Sequence
  Synthetic
atacgccatgctgggtctcctgctagcatcttttcccccggcgccaagcagaacatcaatttaatcaagaccaatggcagctggcacataaaccggaccgccctcaactgcaatgacagccgtacttgggagtcggccat

SEQ ID NO: 388984 - DNA, 140 bp, Artificial Sequence
  Synthetic
atggccgactcccaagtacggctgtcattgcagttgagggcggtccggtttatgtgccagctgccattggtcttgattaaattgatgttctgcttggcgccgggggaaaagatgctagcaggagacccagcatggcgtat

SEQ ID NO: 388985 - DNA, 140 bp, Artificial Sequence
  Synthetic
atacgccatgctgggtctccttctccgacctaccggcactatccactggcctattgcacctccaccaaaacatcgtggacgtgcagtacctctatggactttctccggctgttacaagatcgtacttgggagtcggccat

SEQ ID NO: 388986 - DNA, 140 bp, Artificial Sequence
  Synthetic
atggccgactcccaagtacgatcttgtaacagccggagaaagtccatagaggtactgcacgtccacgatgttttggtggaggtgcaataggccagtggatagtgccggtaggtcggagaaggagacccagcatggcgtat

SEQ ID NO: 388987 - DNA, 140 bp, Artificial Sequence
  Synthetic
aggccctggctgctgatatgcgggatacaatacttagcaggcttgtccactctgcctgggaatcccgcaatagcatcactgatggcattcacagcctctatcaccagcccgctcaccaccgaccttttgggacagcggtg

SEQ ID NO: 388988 - DNA, 140 bp, Artificial Sequence
  Synthetic
caccgctgtcccaaaaggtcggtggtgagcgggctggtgatagaggctgtgaatgccatcagtgatgctattgcgggattcccaggcagagtggacaagcctgctaagtattgtatcccgcatatcagcagccagggcct

SEQ ID NO: 388989 - DNA, 140 bp, Artificial Sequence
  Synthetic
aggccctggctgctgatatgatccagatgtacaccaatgtggacaaagatcttgtgggctggcccgctcctcaaggctcccgctcattgacaccctgcacctgcggctcctcggacctttgaccttttgggacagcggtg

SEQ ID NO: 388990 - DNA, 140 bp, Artificial Sequence
  Synthetic
caccgctgtcccaaaaggtcaaaggtccgaggagccgcaggtgcagggtgtcaatgagcgggagccttgaggagcgggccagcccacaagatctttgtccacattggtgtacatctggatcatatcagcagccagggcct

SEQ ID NO: 388991 - DNA, 140 bp, Artificial Sequence
  Synthetic
atacgccatgctgggtctccaaggatcatccggtggacccgtgctctgccctaggggacacgccgtgggcttgttcagagcggccgtgtgtgccaggggtgtagccaaatctattgacttcgtacttgggagtcggccat

SEQ ID NO: 388992 - DNA, 140 bp, Artificial Sequence
  Synthetic
atggccgactcccaagtacgaagtcaatagatttggctacacccctggcacacacggccgctctgaacaagcccacggcgtgtcccctagggcagagcacgggtccaccggatgatccttggagacccagcatggcgtat

SEQ ID NO: 388993 - DNA, 140 bp, Artificial Sequence
  Synthetic
atacgccatgctgggtctccattcttcacggaggtggatggggtgcggttgcacaggtacgctccggcgtgcaaacccctcctacgggaggaggtcacattccaggtcgggctcaaccaacgtacttgggagtcggccat

SEQ ID NO: 388994 - DNA, 140 bp, Artificial Sequence
  Synthetic
atggccgactcccaagtacgttggttgagcccgacctggaatgtgacctcctcccgtaggaggggtttgcacgccggagcgtacctgtgcaaccgcaccccatccacctccgtgaagaatggagacccagcatggcgtat

SEQ ID NO: 388995 - DNA, 140 bp, Artificial Sequence
  Synthetic
aggccctggctgctgatatgcgtggcctactaccgcggtcttgacgtgtctgtcatcccgaccagcggcgatgttgtcgtcgtggcaactgatgctctcatgaccggctataccggcgacgaccttttgggacagcggtg

SEQ ID NO: 388996 - DNA, 140 bp, Artificial Sequence
  Synthetic
caccgctgtcccaaaaggtcgtcgccggtatagccggtcatgagagcatcagttgccacgacgacaacatcgccgctggtcgggatgacagacacgtcaagaccgcggtagtaggccacgcatatcagcagccagggcct

SEQ ID NO: 388997 - DNA, 140 bp, Artificial Sequence
  Synthetic
atacgccatgctgggtctccggtgctgtgaccaacgaggttaccctgacgcaccccgtgacgaaatatatcgccacgtgcatgcaagctgacctcgagatcatgacaagcacatgggtcccgtacttgggagtcggccat

SEQ ID NO: 388998 - DNA, 140 bp, Artificial Sequence
  Synthetic
atggccgactcccaagtacgggacccatgtgcttgtcatgatctcgaggtcagcttgcatgcacgtggcgatatatttcgtcacggggtgcgtcagggtaacctcgttggtcacagcaccggagacccagcatggcgtat

SEQ ID NO: 388999 - DNA, 140 bp, Artificial Sequence
  Synthetic
atacgccatgctgggtctcccgtacgcccagcagacaaggggcctcctagggtgtataatcaccagcctgactggccgggacaaaaaccaagtggagggtgaggtccagattgtgtcaaccgtacttgggagtcggccat

SEQ ID NO: 389000 - DNA, 140 bp, Artificial Sequence
  Synthetic
atggccgactcccaagtacggttgacacaatctggacctcaccctccacttggtttttgtcccggccagtcaggctggtgattatacaccctaggaggccccttgtctgctgggcgtacgggagacccagcatggcgtat

SEQ ID NO: 389001 - DNA, 140 bp, Artificial Sequence
  Synthetic
aggccctggctgctgatatgttaccatgtcaccaatgattgccccaactcgagtattgtgtacgagacggccgacaccattctacactctccggggtgtgtcccttgcgttcgcgagggtgaccttttgggacagcggtg

SEQ ID NO: 389002 - DNA, 140 bp, Artificial Sequence
  Synthetic
caccgctgtcccaaaaggtcaccctcgcgaacgcaagggacacaccccggagagtgtagaatggtgtcggccgtctcgtacacaatactcgagttggggcaatcattggtgacatggtaacatatcagcagccagggcct

SEQ ID NO: 389003 - DNA, 140 bp, Artificial Sequence
  Synthetic
aggccctggctgctgatatggctaaccttttcatgggaggcgatgtgacccggattgagtccgactctaaggtgattgttgtcctctccctggattccatgactgaggtagaggatgatcgaccttttgggacagcggtg

SEQ ID NO: 389004 - DNA, 140 bp, Artificial Sequence
  Synthetic
caccgctgtcccaaaaggtcgatcatcctctacctcagtcatggaatccagggagaggacaacaatcaccttagagtcggactcaatccgggtcacatcgcctcccatgaaaaggttagccatatcagcagccagggcct

SEQ ID NO: 389005 - DNA, 140 bp, Artificial Sequence
  Synthetic
aggccctggctgctgatatgggaggatgtcgtgtgctgctcaatgtcttattcctggacaggcgcactcgtcaccccatgcgccgcggaagaacagaaactgcccattaacgcgctgagcgaccttttgggacagcggtg

SEQ ID NO: 389006 - DNA, 140 bp, Artificial Sequence
  Synthetic
caccgctgtcccaaaaggtcgctcagcgcgttaatgggcagtttctgttcttccgcggcgcatggggtgacgagtgcgcctgtccaggaataagacattgagcagcacacgacatcctcccatatcagcagccagggcct

SEQ ID NO: 389007 - DNA, 140 bp, Artificial Sequence
  Synthetic
aggccctggctgctgatatgacattaacaggactgctctgaactgcaatgactctctcaagaccgggttccttgctgcgctgttctacgtgcgcagtttcaactcgtccgggtgcttagagaccttttgggacagcggtg

SEQ ID NO: 389008 - DNA, 140 bp, Artificial Sequence
  Synthetic
caccgctgtcccaaaaggtctctaagcacccggacgagttgaaactgcgcacgtagaacagcgcagcaaggaacccggtcttgagagagtcattgcagttcagagcagtcctgttaatgtcatatcagcagccagggcct

SEQ ID NO: 389009 - DNA, 140 bp, Artificial Sequence
  Synthetic
atacgccatgctgggtctcccttgctgcgctgttctacgtgcgcagtttcaactcgtccgggtgcttagagcgcatggccagctgccgccccatcgactcgttcgctcaggggtggggtccgtacttgggagtcggccat

SEQ ID NO: 389010 - DNA, 140 bp, Artificial Sequence
  Synthetic
atggccgactcccaagtacggaccccacccctgagcgaacgagtcgatggggcggcagctggccatgcgctctaagcacccggacgagttgaaactgcgcacgtagaacagcgcagcaagggagacccagcatggcgtat

SEQ ID NO: 389011 - DNA, 140 bp, Artificial Sequence
  Synthetic
atacgccatgctgggtctccagggctggggccctatcagttacaccaacgtaagcggccccgaacaacgcccctactgttggcactaccccccaaagccttgcggcatcgtgccagcacgcgtacttgggagtcggccat

SEQ ID NO: 389012 - DNA, 140 bp, Artificial Sequence
  Synthetic
atggccgactcccaagtacgcgtgctggcacgatgccgcaaggctttggggggtagtgccaacagtaggggcgttgttcggggccgcttacgttggtgtaactgatagggccccagccctggagacccagcatggcgtat

SEQ ID NO: 389013 - DNA, 140 bp, Artificial Sequence
  Synthetic
atacgccatgctgggtctccaaaaatgaggtgttctgtgttgatcccactaaaggcgggaaaaagccagctcgcctcatcgtataccccgacctcggggtcagggtgtgcgaaaagatggcgtacttgggagtcggccat

SEQ ID NO: 389014 - DNA, 140 bp, Artificial Sequence
  Synthetic
atggccgactcccaagtacgccatcttttcgcacaccctgaccccgaggtcggggtatacgatgaggcgagctggctttttcccgcctttagtgggatcaacacagaacacctcatttttggagacccagcatggcgtat

SEQ ID NO: 389015 - DNA, 140 bp, Artificial Sequence
  Synthetic
aggccctggctgctgatatgacccaggtgcatggttgactatccatacaggctttggcactacccctgcactgtcaacttcaccatcttcaaggtcaggatgtatgtggggggcgtggaggaccttttgggacagcggtg

SEQ ID NO: 389016 - DNA, 140 bp, Artificial Sequence
  Synthetic
caccgctgtcccaaaaggtcctccacgccccccacatacatcctgaccttgaagatggtgaagttgacagtgcaggggtagtgccaaagcctgtatggatagtcaaccatgcacctgggtcatatcagcagccagggcct

SEQ ID NO: 389017 - DNA, 140 bp, Artificial Sequence
  Synthetic
aggccctggctgctgatatgagtggcaggtgctgccctgttccttcaccaccctaccggctctgtccactggcttgatccatctccatcagaacatcgtggacgtgcaatacctgtacgggaccttttgggacagcggtg

SEQ ID NO: 389018 - DNA, 140 bp, Artificial Sequence
  Synthetic
caccgctgtcccaaaaggtcccgtacaggtattgcacgtccacgatgttctgatggagatggatcaagccagtggacagagccggtagggtggtgaaggaacagggcagcacctgccactcatatcagcagccagggcct

SEQ ID NO: 389019 - DNA, 140 bp, Artificial Sequence
  Synthetic
aggccctggctgctgatatgcagagagccaaggtaacgaggaggacgagcggaacctgagagctttcacggaggctatgaccaggtattccgcccctcccggtgaccttcccagaccggagaccttttgggacagcggtg

SEQ ID NO: 389020 - DNA, 140 bp, Artificial Sequence
  Synthetic
caccgctgtcccaaaaggtctccggtctgggaaggtcaccgggaggggcggaatacctggtcatagcctccgtgaaagctctcaggttccgctcgtcctcctcgttaccttggctctctgcatatcagcagccagggcct

SEQ ID NO: 389021 - DNA, 140 bp, Artificial Sequence
  Synthetic
aggccctggctgctgatatgccacgcactacgtgccggagagcgatgcagctgcccgcgtcactgccatactcagcagcctcactgtgacccagctcctgaggcgactgcaccagtggatgaccttttgggacagcggtg

SEQ ID NO: 389022 - DNA, 140 bp, Artificial Sequence
  Synthetic
caccgctgtcccaaaaggtcatccactggtgcagtcgcctcaggagctgggtcacagtgaggctgctgagtatggcagtgacgcgggcagctgcatcgctctccggcacgtagtgcgtggcatatcagcagccagggcct

SEQ ID NO: 389023 - DNA, 140 bp, Artificial Sequence
  Synthetic
aggccctggctgctgatatgaccacgagcttacgccatggaccgggagatggctgcatcgtgcggaggcgcggttttcataggtctggtactcttgaccttgtcaccgcactacaaagtggaccttttgggacagcggtg

SEQ ID NO: 389024 - DNA, 140 bp, Artificial Sequence
  Synthetic
caccgctgtcccaaaaggtccactttgtagtgcggtgacaaggtcaagagtaccagacctatgaaaaccgcgcctccgcacgatgcagccatctcccggtccatggcgtaagctcgtggtcatatcagcagccagggcct

SEQ ID NO: 389025 - DNA, 140 bp, Artificial Sequence
  Synthetic
aggccctggctgctgatatgttctggttttgcctactcctgcttgctgcaggggtaggtatctacctcctccccaaccgatgaaggttggggtaaacactccggccttttaggccatttcgaccttttgggacagcggtg

SEQ ID NO: 389026 - DNA, 140 bp, Artificial Sequence
  Synthetic
caccgctgtcccaaaaggtcgaaatggcctaaaaggccggagtgtttaccccaaccttcatcggttggggaggaggtagatacctacccctgcagcaagcaggagtaggcaaaaccagaacatatcagcagccagggcct

SEQ ID NO: 389027 - DNA, 140 bp, Artificial Sequence
  Synthetic
aggccctggctgctgatatgacacaccccataaccaaatacatcatggcatgcatgtcggctgacctggaggtcgtcacgagcacttgggtgctagtgggcggagtccttgcagctctgggaccttttgggacagcggtg

SEQ ID NO: 389028 - DNA, 140 bp, Artificial Sequence
  Synthetic
caccgctgtcccaaaaggtcccagagctgcaaggactccgcccactagcacccaagtgctcgtgacgacctccaggtcagccgacatgcatgccatgatgtatttggttatggggtgtgtcatatcagcagccagggcct

SEQ ID NO: 389029 - DNA, 140 bp, Artificial Sequence
  Synthetic
aggccctggctgctgatatggacatggaaaaggccgggctatgaaccacccactgtcctaggctgtgcccttccccccacacttcaagcgccagtgcccccacctcggaggcgccgcgccgaccttttgggacagcggtg

SEQ ID NO: 389030 - DNA, 140 bp, Artificial Sequence
  Synthetic
caccgctgtcccaaaaggtcggcgcggcgcctccgaggtgggggcactggcgcttgaagtgtggggggaagggcacagcctaggacagtgggtggttcatagcccggccttttccatgtccatatcagcagccagggcct

SEQ ID NO: 389031 - DNA, 140 bp, Artificial Sequence
  Synthetic
aggccctggctgctgatatggcgagatgccctccaccgaggacctggtcaacttactccctgccatcctctctcctggcgccctggtcgtcggggtcgtgtgcgcagcaatactgcgtcggaccttttgggacagcggtg

SEQ ID NO: 389032 - DNA, 140 bp, Artificial Sequence
  Synthetic
caccgctgtcccaaaaggtccgacgcagtattgctgcgcacacgaccccgacgaccagggcgccaggagagaggatggcagggagtaagttgaccaggtcctcggtggagggcatctcgccatatcagcagccagggcct

SEQ ID NO: 389033 - DNA, 140 bp, Artificial Sequence
  Synthetic
atacgccatgctgggtctccacatcgcggtgcactcactcacaacctgcgaacacacgtcgacatgatcgtaatggcagctacggtctgctcggccttgtacgtgggagatgtgtgcgggcgtacttgggagtcggccat

SEQ ID NO: 389034 - DNA, 140 bp, Artificial Sequence
  Synthetic
atggccgactcccaagtacgcccgcacacatctcccacgtacaaggccgagcagaccgtagctgccattacgatcatgtcgacgtgtgttcgcaggttgtgagtgagtgcaccgcgatgtggagacccagcatggcgtat

SEQ ID NO: 389035 - DNA, 140 bp, Artificial Sequence
  Synthetic
aggccctggctgctgatatgcttcacccaagagtgcaactgttccatctaccagggccatatcaccggccatcgcatggcatgggacatgatgctaaactggtcaccaactcttaccatggaccttttgggacagcggtg

SEQ ID NO: 389036 - DNA, 140 bp, Artificial Sequence
  Synthetic
caccgctgtcccaaaaggtccatggtaagagttggtgaccagtttagcatcatgtcccatgccatgcgatggccggtgatatggccctggtagatggaacagttgcactcttgggtgaagcatatcagcagccagggcct

SEQ ID NO: 389037 - DNA, 140 bp, Artificial Sequence
  Synthetic
atacgccatgctgggtctcctgctaacctctttacccctggtgccaagcagaacatccagttaatcaacaccaacggcagctggcacataaaccggaccgccctcaattgcaatgacagccgtacttgggagtcggccat

SEQ ID NO: 389038 - DNA, 140 bp, Artificial Sequence
  Synthetic
atggccgactcccaagtacggctgtcattgcaattgagggcggtccggtttatgtgccagctgccgttggtgttgattaactggatgttctgcttggcaccaggggtaaagaggttagcaggagacccagcatggcgtat

SEQ ID NO: 389039 - DNA, 140 bp, Artificial Sequence
  Synthetic
atacgccatgctgggtctcctttactcttaccccagcatacaagattctcctgagccgttcagtgtggtggctgtcctacatgctggtcttggccgaggcccagattcagcagtgggttccgtacttgggagtcggccat

SEQ ID NO: 389040 - DNA, 140 bp, Artificial Sequence
  Synthetic
atggccgactcccaagtacggaacccactgctgaatctgggcctcggccaagaccagcatgtaggacagccaccacactgaacggctcaggagaatcttgtatgctggggtaagagtaaaggagacccagcatggcgtat

SEQ ID NO: 389041 - DNA, 140 bp, Artificial Sequence
  Synthetic
atacgccatgctgggtctccttgtgagggcccacgctttgctacgagtgtgtaccctggtgagacgcattgcaggagctaagtacatccaggtgctgctgctcaccataggcaggtggaccgtacttgggagtcggccat

SEQ ID NO: 389042 - DNA, 140 bp, Artificial Sequence
  Synthetic
atggccgactcccaagtacggtccacctgcctatggtgagcagcagcacctggatgtacttagctcctgcaatgcgtctcaccagggtacacactcgtagcaaagcgtgggccctcacaaggagacccagcatggcgtat

SEQ ID NO: 389043 - DNA, 140 bp, Artificial Sequence
  Synthetic
aggccctggctgctgatatgatgcacacccccgggtgcgtgccctgcgttcgggaggacaactcctcccgctgctgggtagcgctcactcccacgcttgcggccaggaacgccagcgtccgaccttttgggacagcggtg

SEQ ID NO: 389044 - DNA, 140 bp, Artificial Sequence
  Synthetic
caccgctgtcccaaaaggtcggacgctggcgttcctggccgcaagcgtgggagtgagcgctacccagcagcgggaggagttgtcctcccgaacgcagggcacgcacccgggggtgtgcatcatatcagcagccagggcct

SEQ ID NO: 389045 - DNA, 140 bp, Artificial Sequence
  Synthetic
  misc_feature (39)..(39): n is a, c, g, or t
atacgccatgctgggtctccgccgcgaatttcttagccngtttcttagatcgaggcgccaggcaagaaatccggctgatcaacaccaacggcagttggcacatcaacagcacggccttgacgtacttgggagtcggccat

SEQ ID NO: 389046 - DNA, 140 bp, Artificial Sequence
  Synthetic
  misc_feature (102)..(102): n is a, c, g, or t
atggccgactcccaagtacgtcaaggccgtgctgttgatgtgccaactgccgttggtgttgatcagccggatttcttgcctggcgcctcgatctaagaaacnggctaagaaattcgcggcggagacccagcatggcgtat

SEQ ID NO: 389047 - DNA, 140 bp, Artificial Sequence
  Synthetic
aggccctggctgctgatatggaatcctggcgggtcttgcctactattccatggtggggaactgggctaaggtcttgatagtgatgctactctttgccggcgttgacgggaccacttacacgaccttttgggacagcggtg

SEQ ID NO: 389048 - DNA, 140 bp, Artificial Sequence
  Synthetic
caccgctgtcccaaaaggtcgtgtaagtggtcccgtcaacgccggcaaagagtagcatcactatcaagaccttagcccagttccccaccatggaatagtaggcaagacccgccaggattccatatcagcagccagggcct

SEQ ID NO: 389049 - DNA, 140 bp, Artificial Sequence
  Synthetic
atacgccatgctgggtctcccacatcaataggactgccctgaactgcaacgactccctcaacactgggttcattgccgcgctggtctacgcacacaagttcaactcgtccggatgcccggcgtacttgggagtcggccat

SEQ ID NO: 389050 - DNA, 140 bp, Artificial Sequence
  Synthetic
atggccgactcccaagtacgccgggcatccggacgagttgaacttgtgtgcgtagaccagcgcggcaatgaacccagtgttgagggagtcgttgcagttcagggcagtcctattgatgtgggagacccagcatggcgtat

SEQ ID NO: 389051 - DNA, 140 bp, Artificial Sequence
  Synthetic
aggccctggctgctgatatgacgccttctacgggatgtggcctctcctcctgctcctgttggcgttgccccaacgggcatacgcgctggacacggagatggccgcgtcgtgtggcggcgtgaccttttgggacagcggtg

SEQ ID NO: 389052 - DNA, 140 bp, Artificial Sequence
  Synthetic
caccgctgtcccaaaaggtcacgccgccacacgacgcggccatctccgtgtccagcgcgtatgcccgttggggcaacgccaacaggagcaggaggagaggccacatcccgtagaaggcgtcatatcagcagccagggcct

SEQ ID NO: 389053 - DNA, 140 bp, Artificial Sequence
  Synthetic
atacgccatgctgggtctcccccatcacttacgatgggccccgcagccaggaccagaggccctattgttggcattacgcgcctcaaccgtgcggcattgtacccgcgttggaggtgtgtgcgtacttgggagtcggccat

SEQ ID NO: 389054 - DNA, 140 bp, Artificial Sequence
  Synthetic
atggccgactcccaagtacgcacacacctccaacgcgggtacaatgccgcacggttgaggcgcgtaatgccaacaatagggcctctggtcctggctgcggggcccatcgtaagtgatgggggagacccagcatggcgtat

SEQ ID NO: 389055 - DNA, 140 bp, Artificial Sequence
  Synthetic
atacgccatgctgggtctccctgtaatgacagccttaacaccggctggctagcagggcttctctatgtcaacagattcaactcttcaggctgtcccgagaggttggccagctgccggccccgtacttgggagtcggccat

SEQ ID NO: 389056 - DNA, 140 bp, Artificial Sequence
  Synthetic
atggccgactcccaagtacggggccggcagctggccaacctctcgggacagcctgaagagttgaatctgttgacatagagaagccctgctagccagccggtgttaaggctgtcattacagggagacccagcatggcgtat

SEQ ID NO: 389057 - DNA, 140 bp, Artificial Sequence
  Synthetic
aggccctggctgctgatatgacagattcaactcttcaggctgtcccgagaggttggccagctgccggccccttaccgattttgaccaaggctggggccccatcagttatgccagcggaaagaccttttgggacagcggtg

SEQ ID NO: 389058 - DNA, 140 bp, Artificial Sequence
  Synthetic
caccgctgtcccaaaaggtctttccgctggcataactgatggggccccagccttggtcaaaatcggtaaggggccggcagctggccaacctctcgggacagcctgaagagttgaatctgtcatatcagcagccagggcct

SEQ ID NO: 389059 - DNA, 140 bp, Artificial Sequence
  Synthetic
  misc_feature (72)..(72): n is a, c, g, or t
  misc_feature (109)..(109): n is a, c, g, or t
aggccctggctgctgatatgcccccccctcaacgtccggggggggcgcgacgctgtcatcttactcatgtgngttgcacacccgactttggtatttgacatcaccaaantgttgctggccgaccttttgggacagcggtg

SEQ ID NO: 389060 - DNA, 140 bp, Artificial Sequence
  Synthetic
  misc_feature (32)..(32): n is a, c, g, or t
  misc_feature (69)..(69): n is a, c, g, or t
caccgctgtcccaaaaggtcggccagcaacantttggtgatgtcaaataccaaagtcgggtgtgcaacncacatgagtaagatgacagcgtcgcgccccccccggacgttgaggggggggcatatcagcagccagggcct

SEQ ID NO: 389061 - DNA, 140 bp, Artificial Sequence
  Synthetic
atacgccatgctgggtctccccaaacacatgtggaacttcatcagtggcatacagtacctggcgggactctccaccctaccgggaaatcccgcagtggcatcaatgatggctttcagcgccgtacttgggagtcggccat

SEQ ID NO: 389062 - DNA, 140 bp, Artificial Sequence
  Synthetic
atggccgactcccaagtacggcgctgaaagccatcattgatgccactgcgggatttcccggtagggtggagagtcccgccaggtactgtatgccactgatgaagttccacatgtgtttggggagacccagcatggcgtat

SEQ ID NO: 389063 - DNA, 140 bp, Artificial Sequence
  Synthetic
atacgccatgctgggtctccgcggttttcataggtctggcaatcttgaccttgtcaccgtattataaagtggtcctcgctaggatcatatggtggttgcaatatcttatcaccagagccgcgtacttgggagtcggccat

SEQ ID NO: 389064 - DNA, 140 bp, Artificial Sequence
  Synthetic
atggccgactcccaagtacgcggctctggtgataagatattgcaaccaccatatgatcctagcgaggaccactttataatacggtgacaaggtcaagattgccagacctatgaaaaccgcggagacccagcatggcgtat

SEQ ID NO: 389065 - DNA, 140 bp, Artificial Sequence
  Synthetic
aggccctggctgctgatatgagtcatctgtgcagcaatcttgcgccgccacgtcggccagggagagggggcagtccagtggatgaacaggctgatcgcctttgcctccagaggaaaccatgaccttttgggacagcggtg

SEQ ID NO: 389066 - DNA, 140 bp, Artificial Sequence
  Synthetic
caccgctgtcccaaaaggtcatggtttcctctggaggcaaaggcgatcagcctgttcatccactggactgccccctctccctggccgacgtggcggcgcaagattgctgcacagatgactcatatcagcagccagggcct

SEQ ID NO: 389067 - DNA, 140 bp, Artificial Sequence
  Synthetic
aggccctggctgctgatatgctccactgcgggactgggcccacgcgggcctacgagaccttgcggtggcagttgagcccgtcgtcttttctgacatggagaccaagatcatcacctgggggaccttttgggacagcggtg

SEQ ID NO: 389068 - DNA, 140 bp, Artificial Sequence
  Synthetic
caccgctgtcccaaaaggtcccccaggtgatgatcttggtctccatgtcagaaaagacgacgggctcaactgccaccgcaaggtctcgtaggcccgcgtgggcccagtcccgcagtggagcatatcagcagccagggcct

SEQ ID NO: 389069 - DNA, 140 bp, Artificial Sequence
  Synthetic
aggccctggctgctgatatggctaacctttccaggggaggcgatgtgacccggattgagtccgactctaaggtgatcgttctcgactctcttgattccatgactgaggtagacgatgatcgaccttttgggacagcggtg

SEQ ID NO: 389070 - DNA, 140 bp, Artificial Sequence
  Synthetic
caccgctgtcccaaaaggtcgatcatcgtctacctcagtcatggaatcaagagagtcgagaacgatcaccttagagtcggactcaatccgggtcacatcgcctcccctggaaaggttagccatatcagcagccagggcct

SEQ ID NO: 389071 - DNA, 140 bp, Artificial Sequence
  Synthetic
atacgccatgctgggtctccgggggaccctgacctggagtttgaaccagcgggatccgctcccccttccgagggggagtgtgaggtcattgattcggactctaagtcgtggtccacagtccgtacttgggagtcggccat

SEQ ID NO: 389072 - DNA, 140 bp, Artificial Sequence
  Synthetic
atggccgactcccaagtacggactgtggaccacgacttagagtccgaatcaatgacctcacactccccctcggaagggggagcggatcccgctggttcaaactccaggtcagggtcccccggagacccagcatggcgtat

SEQ ID NO: 389073 - DNA, 140 bp, Artificial Sequence
  Synthetic
atacgccatgctgggtctcctgcatcattaatggcttttacagcttccatcaccagcccgcttaccacccagagcactctcctgttcaacatcctgggggggtgggtagccgcccaactccgtacttgggagtcggccat

SEQ ID NO: 389074 - DNA, 140 bp, Artificial Sequence
  Synthetic
atggccgactcccaagtacggagttgggcggctacccacccccccaggatgttgaacaggagagtgctctgggtggtaagcgggctggtgatggaagctgtaaaagccattaatgatgcaggagacccagcatggcgtat

SEQ ID NO: 389075 - DNA, 140 bp, Artificial Sequence
  Synthetic
aggccctggctgctgatatgaatctcgtgtattctaccacctcacgcagtgcttgccaaaggcagaagaaagtcacatttgacagactgcaggttctggacaaccactaccaggacgtgcgaccttttgggacagcggtg

SEQ ID NO: 389076 - DNA, 140 bp, Artificial Sequence
  Synthetic
caccgctgtcccaaaaggtcgcacgtcctggtagtggttgtccagaacctgcagtctgtcaaatgtgactttcttctgcctttggcaagcactgcgtgaggtggtagaatacacgagattcatatcagcagccagggcct

SEQ ID NO: 389077 - DNA, 140 bp, Artificial Sequence
  Synthetic
aggccctggctgctgatatgccatagtggtctgcggaaccggtgagtacaccggaattgccaggacgaccgggtcctttcttggataaaacccgctcaatgcctggagatttgggcgtgcgaccttttgggacagcggtg

SEQ ID NO: 389078 - DNA, 140 bp, Artificial Sequence
  Synthetic
caccgctgtcccaaaaggtcgcacgcccaaatctccaggcattgagcgggttttatccaagaaaggacccggtcgtcctggcaattccggtgtactcaccggttccgcagaccactatggcatatcagcagccagggcct

SEQ ID NO: 389079 - DNA, 140 bp, Artificial Sequence
  Synthetic
aggccctggctgctgatatgttatggcaagtttctcgcggatggaggctgctcagctggcgcctatgacatcatcatatgcgacgaatgccattcagtggacgctactaccatccttggcgaccttttgggacagcggtg

SEQ ID NO: 389080 - DNA, 140 bp, Artificial Sequence
  Synthetic
caccgctgtcccaaaaggtcgccaaggatggtagtagcgtccactgaatggcattcgtcgcatatgatgatgtcataggcgccagctgagcagcctccatccgcgagaaacttgccataacatatcagcagccagggcct

SEQ ID NO: 389081 - DNA, 140 bp, Artificial Sequence
  Synthetic
atacgccatgctgggtctcctttagccacagccacgccccccggtacggtgacaactccccacagtaacatagaggaggtagccctcggtcatgagggcgagatccctttttatggcaagcgtacttgggagtcggccat

SEQ ID NO: 389082 - DNA, 140 bp, Artificial Sequence
  Synthetic
atggccgactcccaagtacgcttgccataaaaagggatctcgccctcatgaccgagggctacctcctctatgttactgtggggagttgtcaccgtaccggggggcgtggctgtggctaaaggagacccagcatggcgtat

SEQ ID NO: 389083 - DNA, 140 bp, Artificial Sequence
  Synthetic
aggccctggctgctgatatgcgcggggacccacgtcaccgggggaagcgtcgccagaaccacagcgtcactcgccggtctcttcagtccaggtcctcagcagaacatccagctgatcaatgaccttttgggacagcggtg

SEQ ID NO: 389084 - DNA, 140 bp, Artificial Sequence
  Synthetic
caccgctgtcccaaaaggtcattgatcagctggatgttctgctgaggacctggactgaagagaccggcgagtgacgctgtggttctggcgacgcttcccccggtgacgtgggtccccgcgcatatcagcagccagggcct

SEQ ID NO: 389085 - DNA, 140 bp, Artificial Sequence
  Synthetic
aggccctggctgctgatatgtgaacctagtcacggatacttcggactcctaagccatttcctgatttttttttttccctttttttttttttttttttttttttttcccccccccctttttgaccttttgggacagcggtg

SEQ ID NO: 389086 - DNA, 140 bp, Artificial Sequence
  Synthetic
caccgctgtcccaaaaggtcaaaaaggggggggggaaaaaaaaaaaaaaaaaaaaaaaaaaagggaaaaaaaaaaatcaggaaatggcttaggagtccgaagtatccgtgactaggttcacatatcagcagccagggcct

SEQ ID NO: 389087 - DNA, 140 bp, Artificial Sequence
  Synthetic
atacgccatgctgggtctccagaacatccagcttgtaaactccaacggcagttggcacatcaacaggactgccctgaactgcaatgactccctccagactgggtttattgccgcgctgatcgtacttgggagtcggccat

SEQ ID NO: 389088 - DNA, 140 bp, Artificial Sequence
  Synthetic
atggccgactcccaagtacgatcagcgcggcaataaacccagtctggagggagtcattgcagttcagggcagtcctgttgatgtgccaactgccgttggagtttacaagctggatgttctggagacccagcatggcgtat

SEQ ID NO: 389089 - DNA, 140 bp, Artificial Sequence
  Synthetic
aggccctggctgctgatatggcgcccccttgtgtcatcggaggggtgggcaacaacaccttgtattgccccactgattgtttccgcaaacatccggaagccacatactctcggtgcggctgaccttttgggacagcggtg

SEQ ID NO: 389090 - DNA, 140 bp, Artificial Sequence
  Synthetic
caccgctgtcccaaaaggtcagccgcaccgagagtatgtggcttccggatgtttgcggaaacaatcagtggggcaatacaaggtgttgttgcccacccctccgatgacacaagggggcgccatatcagcagccagggcct

SEQ ID NO: 389091 - DNA, 140 bp, Artificial Sequence
  Synthetic
atacgccatgctgggtctcctaagatactggtggacgttttggccgggtacggtgcaggcatttcaggggccctcgtagcttttaagatcatgagcggcgagaagccctcggtagaagatcgtacttgggagtcggccat

SEQ ID NO: 389092 - DNA, 140 bp, Artificial Sequence
  Synthetic
atggccgactcccaagtacgatcttctaccgagggcttctcgccgctcatgatcttaaaagctacgagggcccctgaaatgcctgcaccgtacccggccaaaacgtccaccagtatcttaggagacccagcatggcgtat

SEQ ID NO: 389093 - DNA, 140 bp, Artificial Sequence
  Synthetic
aggccctggctgctgatatgtgtccatgcggagcaaacatctcgggccatgtccgcttgggcaccatgaaaataacaggcccgaagacctgcttgaacctgtggcagggaaccttccccagaccttttgggacagcggtg

SEQ ID NO: 389094 - DNA, 140 bp, Artificial Sequence
  Synthetic
caccgctgtcccaaaaggtctggggaaggttccctgccacaggttcaagcaggtcttcgggcctgttattttcatggtgcccaagcggacatggcccgagatgtttgctccgcatggacacatatcagcagccagggcct

SEQ ID NO: 389095 - DNA, 140 bp, Artificial Sequence
  Synthetic
atacgccatgctgggtctccaggctacctgtaccacccataagatggcatatgattgtgacatggtggatgctaaccttttcatgggaggcgatgtgacccggattgagtccgactctaacgtacttgggagtcggccat

SEQ ID NO: 389096 - DNA, 140 bp, Artificial Sequence
  Synthetic
atggccgactcccaagtacgttagagtcggactcaatccgggtcacatcgcctcccatgaaaaggttagcatccaccatgtcacaatcatatgccatcttatgggtggtacaggtagcctggagacccagcatggcgtat

SEQ ID NO: 389097 - DNA, 140 bp, Artificial Sequence
  Synthetic
aggccctggctgctgatatggcactacgcaccccaaccgtgtggtattgtacccgcggcggaggtgtgtggtccagtgtattgcttcaccccaagccctgttgtggtggggacgaccgatgaccttttgggacagcggtg

SEQ ID NO: 389098 - DNA, 140 bp, Artificial Sequence
  Synthetic
caccgctgtcccaaaaggtcatcggtcgtccccaccacaacagggcttggggtgaagcaatacactggaccacacacctccgccgcgggtacaataccacacggttggggtgcgtagtgccatatcagcagccagggcct

SEQ ID NO: 389099 - DNA, 140 bp, Artificial Sequence
  Synthetic
aggccctggctgctgatatggttcctcgctaggctcatatggtggttacaatattttatcaccagagccgaggcgcacttgcaagtgtgggtcccccccctcaacgtccgggggggccgcgaccttttgggacagcggtg

SEQ ID NO: 389100 - DNA, 140 bp, Artificial Sequence
  Synthetic
caccgctgtcccaaaaggtcgcggcccccccggacgttgaggggggggacccacacttgcaagtgcgcctcggctctggtgataaaatattgtaaccaccatatgagcctagcgaggaaccatatcagcagccagggcct

SEQ ID NO: 389101 - DNA, 140 bp, Artificial Sequence
  Synthetic
atacgccatgctgggtctcctctgatcaagaggattctgttatctgctgctccatgtcatactcctggacgggggccctcataacaccatgtgggcccgaggaggagaagttgccaatcacgtacttgggagtcggccat

SEQ ID NO: 389102 - DNA, 140 bp, Artificial Sequence
  Synthetic
atggccgactcccaagtacgtgattggcaacttctcctcctcgggcccacatggtgttatgagggcccccgtccaggagtatgacatggagcagcagataacagaatcctcttgatcagaggagacccagcatggcgtat

SEQ ID NO: 389103 - DNA, 140 bp, Artificial Sequence
  Synthetic
aggccctggctgctgatatgctccactgcaggactgggcccacgcgggcctacgggaccttgcggtggcagttgagcccgttatcttctctgacatggagaccaagatcatcacctgggggaccttttgggacagcggtg

SEQ ID NO: 389104 - DNA, 140 bp, Artificial Sequence
  Synthetic
caccgctgtcccaaaaggtcccccaggtgatgatcttggtctccatgtcagagaagataacgggctcaactgccaccgcaaggtcccgtaggcccgcgtgggcccagtcctgcagtggagcatatcagcagccagggcct

SEQ ID NO: 389105 - DNA, 140 bp, Artificial Sequence
  Synthetic
aggccctggctgctgatatgacaaggtgctggtgctcaacccctccgttgctgcaacactgggctttggtgcttatatgtccaaggcccatgggattgatcctaacatcaggactggggtgaccttttgggacagcggtg

SEQ ID NO: 389106 - DNA, 140 bp, Artificial Sequence
  Synthetic
caccgctgtcccaaaaggtcaccccagtcctgatgttaggatcaatcccatgggccttggacatataagcaccaaagcccagtgttgcagcaacggaggggttgagcaccagcaccttgtcatatcagcagccagggcct

SEQ ID NO: 389107 - DNA, 140 bp, Artificial Sequence
  Synthetic
aggccctggctgctgatatgggagagatccccttctatggcaaggccatccccatcgaggccatcaagggggggaggcacctcattttctgccactccaagaagaaatgtgacgagctcggaccttttgggacagcggtg

SEQ ID NO: 389108 - DNA, 140 bp, Artificial Sequence
  Synthetic
caccgctgtcccaaaaggtccgagctcgtcacatttcttcttggagtggcagaaaatgaggtgcctcccccccttgatggcctcgatggggatggccttgccatagaaggggatctctcccatatcagcagccagggcct

SEQ ID NO: 389109 - DNA, 140 bp, Artificial Sequence
  Synthetic
aggccctggctgctgatatgggggaggcacctcattttctgccactccaagaagaaatgtgacgagctcgccgcaaagctgtcaggcctcggtctcaacgctgtagcgtattaccggggtgaccttttgggacagcggtg

SEQ ID NO: 389110 - DNA, 140 bp, Artificial Sequence
  Synthetic
caccgctgtcccaaaaggtcaccccggtaatacgctacagcgttgagaccgaggcctgacagctttgcggcgagctcgtcacatttcttcttggagtggcagaaaatgaggtgcctcccccatatcagcagccagggcct

SEQ ID NO: 389111 - DNA, 140 bp, Artificial Sequence
  Synthetic
aggccctggctgctgatatgagctctggcacacggtgttagggtcctggaagacgggataaattacgcaacagggaatctacctggttgctccttttctatcttcttacttgctcttctggaccttttgggacagcggtg

SEQ ID NO: 389112 - DNA, 140 bp, Artificial Sequence
  Synthetic
caccgctgtcccaaaaggtccagaagagcaagtaagaagatagaaaaggagcaaccaggtagattccctgttgcgtaatttatcccgtcttccaggaccctaacaccgtgtgccagagctcatatcagcagccagggcct

SEQ ID NO: 389113 - DNA, 140 bp, Artificial Sequence
  Synthetic
atacgccatgctgggtctcctcatgcgtcacagtgccagtgtctgcagtggaagtcaggaacatcagttctagctactatgccactaacgattgctcgaacaacagcatcacctggcagccgtacttgggagtcggccat

SEQ ID NO: 389114 - DNA, 140 bp, Artificial Sequence
  Synthetic
atggccgactcccaagtacggctgccaggtgatgctgttgttcgagcaatcgttagtggcatagtagctagaactgatgttcctgacttccactgcagacactggcactgtgacgcatgaggagacccagcatggcgtat

SEQ ID NO: 389115 - DNA, 140 bp, Artificial Sequence
  Synthetic
atacgccatgctgggtctcctcactaacgcagttctccaccttcctggatgcgtcccatgtgagaatgataatggcaccttgcgctgctggatacaagtaacacccaatgtggctgtgaacgtacttgggagtcggccat

SEQ ID NO: 389116 - DNA, 140 bp, Artificial Sequence
  Synthetic
atggccgactcccaagtacgttcacagccacattgggtgttacttgtatccagcagcgcaaggtgccattatcattctcacatgggacgcatccaggaaggtggagaactgcgttagtgaggagacccagcatggcgtat

SEQ ID NO: 389117 - DNA, 140 bp, Artificial Sequence
  Synthetic
atacgccatgctgggtctcccactggcatctttagccctggtcctcagcagaacatccacttaatcaataccaatggcagctggcacataaacaggactgctctcaattgcaatgacagccgtacttgggagtcggccat

SEQ ID NO: 389118 - DNA, 140 bp, Artificial Sequence
  Synthetic
atggccgactcccaagtacggctgtcattgcaattgagagcagtcctgtttatgtgccagctgccattggtattgattaagtggatgttctgctgaggaccagggctaaagatgccagtgggagacccagcatggcgtat

SEQ ID NO: 389119 - DNA, 140 bp, Artificial Sequence
  Synthetic
atacgccatgctgggtctcccttataggctgtggcattatccgtgcactgtaaatttcaccatcttcaaggtgcggatgtatgtagggggggtggagcatcgattgtccgcagcatgtaacgtacttgggagtcggccat

SEQ ID NO: 389120 - DNA, 140 bp, Artificial Sequence
  Synthetic
atggccgactcccaagtacgttacatgctgcggacaatcgatgctccaccccccctacatacatccgcaccttgaagatggtgaaatttacagtgcacggataatgccacagcctataagggagacccagcatggcgtat

SEQ ID NO: 389121 - DNA, 140 bp, Artificial Sequence
  Synthetic
aggccctggctgctgatatgggcggcgcttgagaagctcatcatcttgcactccgctagcgccgctagtgccaatgggccgctgtggttcttcatcttctttacagcggcctggtacttagaccttttgggacagcggtg

SEQ ID NO: 389122 - DNA, 140 bp, Artificial Sequence
  Synthetic
caccgctgtcccaaaaggtctaagtaccaggccgctgtaaagaagatgaagaaccacagcggcccattggcactagcggcgctagcggagtgcaagatgatgagcttctcaagcgccgcccatatcagcagccagggcct

SEQ ID NO: 389123 - DNA, 140 bp, Artificial Sequence
  Synthetic
aggccctggctgctgatatggcatgaccactgacaacataaagtgcccatgccaggttccggcccccgaattcttcacagaagtggatggggtgcggctgcacaggtacgctccggcgtggaccttttgggacagcggtg

SEQ ID NO: 389124 - DNA, 140 bp, Artificial Sequence
  Synthetic
caccgctgtcccaaaaggtccacgccggagcgtacctgtgcagccgcaccccatccacttctgtgaagaattcgggggccggaacctggcatgggcactttatgttgtcagtggtcatgccatatcagcagccagggcct

SEQ ID NO: 389125 - DNA, 140 bp, Artificial Sequence
  Synthetic
atacgccatgctgggtctccttgtgagggctcacgctctgctacgagtgtgcaccctggtgagacacctcgcaggagctaggtacatccagatgctgttgatcaccatgggcaggtggaccgtacttgggagtcggccat

SEQ ID NO: 389126 - DNA, 140 bp, Artificial Sequence
  Synthetic
atggccgactcccaagtacggtccacctgcccatggtgatcaacagcatctggatgtacctagctcctgcgaggtgtctcaccagggtgcacactcgtagcagagcgtgagccctcacaaggagacccagcatggcgtat

SEQ ID NO: 389127 - DNA, 140 bp, Artificial Sequence
  Synthetic
atacgccatgctgggtctcccagcctaacgggccgcgacaaaaatgagcaggctgggcaggtccaggttctgtcctctgtcacacaatctttcttggggacatctatttcgggggtcctccgtacttgggagtcggccat

SEQ ID NO: 389128 - DNA, 140 bp, Artificial Sequence
  Synthetic
atggccgactcccaagtacggaggacccccgaaatagatgtccccaagaaagattgtgtgacagaggacagaacctggacctgcccagcctgctcatttttgtcgcggcccgttaggctgggagacccagcatggcgtat

SEQ ID NO: 389129 - DNA, 140 bp, Artificial Sequence
  Synthetic
aggccctggctgctgatatgcggactacgtccctccggtggtgcacgggtgcccattgccacctaccaagggccctccaataccacctccacggaggaagaagacggttgtcctgacagagaccttttgggacagcggtg

SEQ ID NO: 389130 - DNA, 140 bp, Artificial Sequence
  Synthetic
caccgctgtcccaaaaggtctctgtcaggacaaccgtcttcttcctccgtggaggtggtattggagggcccttggtaggtggcaatgggcacccgtgcaccaccggagggacgtagtccgcatatcagcagccagggcct

SEQ ID NO: 389131 - DNA, 140 bp, Artificial Sequence
  Synthetic
atacgccatgctgggtctccgacctctacctggtcacccgaaacgctgatgtcattccggtccggaggaaagatgaccggcggggtgcactactctcgccaaggcctctctcaaccctcacgtacttgggagtcggccat

SEQ ID NO: 389132 - DNA, 140 bp, Artificial Sequence
  Synthetic
atggccgactcccaagtacgtgagggttgagagaggccttggcgagagtagtgcaccccgccggtcatctttcctccggaccggaatgacatcagcgtttcgggtgaccaggtagaggtcggagacccagcatggcgtat

SEQ ID NO: 389133 - DNA, 140 bp, Artificial Sequence
  Synthetic
aggccctggctgctgatatgagatgaccggcggggtgcactactctcgccaaggcctctctcaaccctcaaaggatcatccggcggacccgtgctctgccctaggggacacgccgtcggcgaccttttgggacagcggtg

SEQ ID NO: 389134 - DNA, 140 bp, Artificial Sequence
  Synthetic
caccgctgtcccaaaaggtcgccgacggcgtgtcccctagggcagagcacgggtccgccggatgatcctttgagggttgagagaggccttggcgagagtagtgcaccccgccggtcatctcatatcagcagccagggcct

SEQ ID NO: 389135 - DNA, 140 bp, Artificial Sequence
  Synthetic
aggccctggctgctgatatgcggccctgcccgtttgggcgcggccggactacaaccccccgctactggagacgtggaaaaagcctgactacgaaccacctgtggtccatggctgcccgctgaccttttgggacagcggtg

SEQ ID NO: 389136 - DNA, 140 bp, Artificial Sequence
  Synthetic
caccgctgtcccaaaaggtcagcgggcagccatggaccacaggtggttcgtagtcaggctttttccacgtctccagtagcggggggttgtagtccggccgcgcccaaacgggcagggccgcatatcagcagccagggcct

SEQ ID NO: 389137 - DNA, 140 bp, Artificial Sequence
  Synthetic
atacgccatgctgggtctccacaacagcacgccaccagctgtgccccagtcttaccaggtgggctacttgcacgcaccaacgggcagcgggaagagcaccaaggtccctgccgcatatgccgtacttgggagtcggccat

SEQ ID NO: 389138 - DNA, 140 bp, Artificial Sequence
  Synthetic
atggccgactcccaagtacggcatatgcggcagggaccttggtgctcttcccgctgcccgttggtgcgtgcaagtagcccacctggtaagactggggcacagctggtggcgtgctgttgtggagacccagcatggcgtat

SEQ ID NO: 389139 - DNA, 140 bp, Artificial Sequence
  Synthetic
aggccctggctgctgatatggtgggagacagcaagacacactccagtcaattcctggctaggcaacataatcatgtttgcccccacattgtgggcgaggatgatactgatgacccatttcgaccttttgggacagcggtg

SEQ ID NO: 389140 - DNA, 140 bp, Artificial Sequence
  Synthetic
caccgctgtcccaaaaggtcgaaatgggtcatcagtatcatcctcgcccacaatgtgggggcaaacatgattatgttgcctagccaggaattgactggagtgtgtcttgctgtctcccaccatatcagcagccagggcct

SEQ ID NO: 389141 - DNA, 140 bp, Artificial Sequence
  Synthetic
atacgccatgctgggtctccccctgacaaggaaatcttatatgaggcctttgatgagatggaagaatgcgcctccaaagccgccctcattgaggaagggcagcggatggcggagatgctccgtacttgggagtcggccat

SEQ ID NO: 389142 - DNA, 140 bp, Artificial Sequence
  Synthetic
atggccgactcccaagtacggagcatctccgccatccgctgcccttcctcaatgagggcggctttggaggcgcattcttccatctcatcaaaggcctcatataagatttccttgtcagggggagacccagcatggcgtat

SEQ ID NO: 389143 - DNA, 140 bp, Artificial Sequence
  Synthetic
aggccctggctgctgatatgggacatgatcgctggtgcccactggggagtcctagcgggcatagcgtatttctccatggtggggaactgggcgaaggtcctggtggtgctgttgctgtttgaccttttgggacagcggtg

SEQ ID NO: 389144 - DNA, 140 bp, Artificial Sequence
  Synthetic
caccgctgtcccaaaaggtcaaacagcaacagcaccaccaggaccttcgcccagttccccaccatggagaaatacgctatgcccgctaggactccccagtgggcaccagcgatcatgtcccatatcagcagccagggcct

SEQ ID NO: 389145 - DNA, 140 bp, Artificial Sequence
  Synthetic
atacgccatgctgggtctcccgcgtatagattcacctctttctttgcacccggtcccaagcagaatgttcagctgatctacaccaacggcagctggcacatcaatcgcacggccttgaatcgtacttgggagtcggccat

SEQ ID NO: 389146 - DNA, 140 bp, Artificial Sequence
  Synthetic
atggccgactcccaagtacgattcaaggccgtgcgattgatgtgccagctgccgttggtgtagatcagctgaacattctgcttgggaccgggtgcaaagaaagaggtgaatctatacgcgggagacccagcatggcgtat

SEQ ID NO: 389147 - DNA, 140 bp, Artificial Sequence
  Synthetic
atacgccatgctgggtctccggaccccccctcccgggagagccatagtgtctgcggaaccggtgagtacaccggaattgcaggacgaccgggtcctttcttggataaacccgctcaatgccgtacttgggagtcggccat

SEQ ID NO: 389148 - DNA, 140 bp, Artificial Sequence
  Synthetic
atggccgactcccaagtacggcattgagcgggtttatccaagaaaggacccggtcgtcctgcaattccggtgtactcaccggttccgcagacactatggctctcccgggagggggggtccggagacccagcatggcgtat

SEQ ID NO: 389149 - DNA, 140 bp, Artificial Sequence
  Synthetic
atacgccatgctgggtctccagtcatctgtgcggcaatcttgcgccgccacgtcggccagggagagggggcggtccagtggatgaacagactgatcgcctttgcctccagaggaaaccatcgtacttgggagtcggccat

SEQ ID NO: 389150 - DNA, 140 bp, Artificial Sequence
  Synthetic
atggccgactcccaagtacgatggtttcctctggaggcaaaggcgatcagtctgttcatccactggaccgccccctctccctggccgacgtggcggcgcaagattgccgcacagatgactggagacccagcatggcgtat

SEQ ID NO: 389151 - DNA, 140 bp, Artificial Sequence
  Synthetic
atacgccatgctgggtctccaaaagggatacaggggtgtatgggctggcacgggagtcatgactactcggtgtccatgcggagcaaacatctcgggccatgtccgcatgggtaccatgaacgtacttgggagtcggccat

SEQ ID NO: 389152 - DNA, 140 bp, Artificial Sequence
  Synthetic
atggccgactcccaagtacgttcatggtacccatgcggacatggcccgagatgtttgctccgcatggacaccgagtagtcatgactcccgtgccagcccatacacccctgtatcccttttggagacccagcatggcgtat

SEQ ID NO: 389153 - DNA, 140 bp, Artificial Sequence
  Synthetic
atacgccatgctgggtctcctcaattgttacacagaagggccttgcgtgccaaaaccccctcctaattataagaccgcaatttggagggtggcagcgtcggagtacgttgaggtcacgcacgtacttgggagtcggccat

SEQ ID NO: 389154 - DNA, 140 bp, Artificial Sequence
  Synthetic
atggccgactcccaagtacgtgcgtgacctcaacgtactccgacgctgccaccctccaaattgcggtcttataattaggagggggttttggcacgcaaggcccttctgtgtaacaattgaggagacccagcatggcgtat

SEQ ID NO: 389155 - DNA, 140 bp, Artificial Sequence
  Synthetic
aggccctggctgctgatatgatatgatgatgaactggtcacctacaacagccctagtggtatcgcagttactccggatcccacaagctgtcgtggacatggtggcgggggcccactgggggaccttttgggacagcggtg

SEQ ID NO: 389156 - DNA, 140 bp, Artificial Sequence
  Synthetic
caccgctgtcccaaaaggtcccccagtgggcccccgccaccatgtccacgacagcttgtgggatccggagtaactgcgataccactagggctgttgtaggtgaccagttcatcatcatatcatatcagcagccagggcct

SEQ ID NO: 389157 - DNA, 140 bp, Artificial Sequence
  Synthetic
atacgccatgctgggtctccttcaactcttcaggctgtcccgagaggttggccagctgccggctcattaccgactttgaccagggctggggccctatcaggtatgccaacggaagtggcccgtacttgggagtcggccat

SEQ ID NO: 389158 - DNA, 140 bp, Artificial Sequence
  Synthetic
atggccgactcccaagtacgggccacttccgttggcatacctgatagggccccagccctggtcaaagtcggtaatgagccggcagctggccaacctctcgggacagcctgaagagttgaaggagacccagcatggcgtat

SEQ ID NO: 389159 - DNA, 140 bp, Artificial Sequence
  Synthetic
aggccctggctgctgatatgcccctcacaggccagctcttcagcgagccagctttccgccccgtccttgaaggctacctgtaccacccataagatggcatatgattgtgacatggtggatgaccttttgggacagcggtg

SEQ ID NO: 389160 - DNA, 140 bp, Artificial Sequence
  Synthetic
caccgctgtcccaaaaggtcatccaccatgtcacaatcatatgccatcttatgggtggtacaggtagccttcaaggacggggcggaaagctggctcgctgaagagctggcctgtgaggggcatatcagcagccagggcct

SEQ ID NO: 389161 - DNA, 140 bp, Artificial Sequence
  Synthetic
atacgccatgctgggtctccgccccatcacttacgctgagcctggccacttggaccagaagccctactgctggcactacgcgcctcaaccgtgtggtcttgtgcccgcagcggaggtgtgcgtacttgggagtcggccat

SEQ ID NO: 389162 - DNA, 140 bp, Artificial Sequence
  Synthetic
atggccgactcccaagtacgcacacctccgctgcgggcacaagaccacacggttgaggcgcgtagtgccagcagtagggcttctggtccaagtggccaggctcagcgtaagtgatggggcggagacccagcatggcgtat

SEQ ID NO: 389163 - DNA, 140 bp, Artificial Sequence
  Synthetic
aggccctggctgctgatatgactcccagccccgtggtggtgggaacgaccgacaagtcgggcgcacctacctacaactggggtgaaaatgaaacggacgtcttcgtccttaacaacaccagaccttttgggacagcggtg

SEQ ID NO: 389164 - DNA, 140 bp, Artificial Sequence
  Synthetic
caccgctgtcccaaaaggtctggtgttgttaaggacgaagacgtccgtttcattttcaccccagttgtaggtaggtgcgcccgacttgtcggtcgttcccaccaccacggggctgggagtcatatcagcagccagggcct

SEQ ID NO: 389165 - DNA, 140 bp, Artificial Sequence
  Synthetic
aggccctggctgctgatatgctacaactggggtgaaaatgaaacggacgtcttcgtccttaacaacaccaggccaccgctgggcaattggttcggttgtacctggatgaactcaactggagaccttttgggacagcggtg

SEQ ID NO: 389166 - DNA, 140 bp, Artificial Sequence
  Synthetic
caccgctgtcccaaaaggtctccagttgagttcatccaggtacaaccgaaccaattgcccagcggtggcctggtgttgttaaggacgaagacgtccgtttcattttcaccccagttgtagcatatcagcagccagggcct

SEQ ID NO: 389167 - DNA, 140 bp, Artificial Sequence
  Synthetic
atacgccatgctgggtctccggggcggcatatgctgtttatggcgtatggccgctgcttctgcttctgatggcgttaccaccaagagcatacgccatggaccgggaggtggctgcatcgtcgtacttgggagtcggccat

SEQ ID NO: 389168 - DNA, 140 bp, Artificial Sequence
  Synthetic
atggccgactcccaagtacgacgatgcagccacctcccggtccatggcgtatgctcttggtggtaacgccatcagaagcagaagcagcggccatacgccataaacagcatatgccgccccggagacccagcatggcgtat

SEQ ID NO: 389169 - DNA, 140 bp, Artificial Sequence
  Synthetic
aggccctggctgctgatatggcgcgttcaaggccttctccggatctgcgcgctagcgcggaagatggccggaggccattacgtgcagatggtcatcatcaagttaggggcgcttactggcgaccttttgggacagcggtg

SEQ ID NO: 389170 - DNA, 140 bp, Artificial Sequence
  Synthetic
caccgctgtcccaaaaggtcgccagtaagcgcccctaacttgatgatgaccatctgcacgtaatggcctccggccatcttccgcgctagcgcgcagatccggagaaggccttgaacgcgccatatcagcagccagggcct

SEQ ID NO: 389171 - DNA, 140 bp, Artificial Sequence
  Synthetic
aggccctggctgctgatatgcggtggcagtcgagcccgtcatcttctctgatatggagaccaagatcatcacttggggggcggacaccgcggcgtgtggggacatcatctcgggtctaccgaccttttgggacagcggtg

SEQ ID NO: 389172 - DNA, 140 bp, Artificial Sequence
  Synthetic
caccgctgtcccaaaaggtcggtagacccgagatgatgtccccacacgccgcggtgtccgccccccaagtgatgatcttggtctccatatcagagaagatgacgggctcgactgccaccgcatatcagcagccagggcct

SEQ ID NO: 389173 - DNA, 140 bp, Artificial Sequence
  Synthetic
aggccctggctgctgatatggcaggagctaggtacatccagatgctgttgatcaccataggcaggtggaccggcacttacatctatgaccacctctcccctttatcaacttgggcagcccgaccttttgggacagcggtg

SEQ ID NO: 389174 - DNA, 140 bp, Artificial Sequence
  Synthetic
caccgctgtcccaaaaggtcgggctgcccaagttgataaaggggagaggtggtcatagatgtaagtgccggtccacctgcctatggtgatcaacagcatctggatgtacctagctcctgccatatcagcagccagggcct

SEQ ID NO: 389175 - DNA, 140 bp, Artificial Sequence
  Synthetic
atacgccatgctgggtctccaggatcatcttgtccgggaagccggccatcattcccgacagggaagtcctctaccaggagttcgatgagatggaagagtgcgcctcacacctcccttacacgtacttgggagtcggccat

SEQ ID NO: 389176 - DNA, 140 bp, Artificial Sequence
  Synthetic
atggccgactcccaagtacgtgtaagggaggtgtgaggcgcactcttccatctcatcgaactcctggtagaggacttccctgtcgggaatgatggccggcttcccggacaagatgatcctggagacccagcatggcgtat

SEQ ID NO: 389177 - DNA, 140 bp, Artificial Sequence
  Synthetic
aggccctggctgctgatatgcccaactcgctccccccagcgctgcttcggccttcgtaggcgccggcattgccggtgcggctgttggcagtataggtcttgggaaggtgcttgtggacatgaccttttgggacagcggtg

SEQ ID NO: 389178 - DNA, 140 bp, Artificial Sequence
  Synthetic
caccgctgtcccaaaaggtcatgtccacaagcaccttcccaagacctatactgccaacagccgcaccggcaatgccggcgcctacgaaggccgaagcagcgctggggggagcgagttgggcatatcagcagccagggcct

SEQ ID NO: 389179 - DNA, 140 bp, Artificial Sequence
  Synthetic
aggccctggctgctgatatgtcatgagcggcgagatgccctccaccgaggacctggtcaacttgctccctgccatcctctctcctggtgccctggtcgtcggggtcgtgtgtgcagcaatgaccttttgggacagcggtg

SEQ ID NO: 389180 - DNA, 140 bp, Artificial Sequence
  Synthetic
caccgctgtcccaaaaggtcattgctgcacacacgaccccgacgaccagggcaccaggagagaggatggcagggagcaagttgaccaggtcctcggtggagggcatctcgccgctcatgacatatcagcagccagggcct

SEQ ID NO: 389181 - DNA, 140 bp, Artificial Sequence
  Synthetic
aggccctggctgctgatatgacgtaggacctggagagggagcggtacagtggatgaacaggctcatcgcattcgcatctcggggcaatcacgtctcaccaacgcattatgttcccgagaggaccttttgggacagcggtg

SEQ ID NO: 389182 - DNA, 140 bp, Artificial Sequence
  Synthetic
caccgctgtcccaaaaggtcctctcgggaacataatgcgttggtgagacgtgattgccccgagatgcgaatgcgatgagcctgttcatccactgtaccgctccctctccaggtcctacgtcatatcagcagccagggcct

SEQ ID NO: 389183 - DNA, 140 bp, Artificial Sequence
  Synthetic
aggccctggctgctgatatggctccacgccgtgctccggctcgtggctaagggatgtttgggactggatatgcacggtgttgactgacttcaagacctggctccagtccaagctcctgccgaccttttgggacagcggtg

SEQ ID NO: 389184 - DNA, 140 bp, Artificial Sequence
  Synthetic
caccgctgtcccaaaaggtcggcaggagcttggactggagccaggtcttgaagtcagtcaacaccgtgcatatccagtcccaaacatcccttagccacgagccggagcacggcgtggagccatatcagcagccagggcct

SEQ ID NO: 389185 - DNA, 140 bp, Artificial Sequence
  Synthetic
aggccctggctgctgatatgcaggagatgggcgggaacatcacccgtgtggagtcggagaataaagtagtgattctggactcttttgaaccgcttcaagcggaggaagatgagagggaaggaccttttgggacagcggtg

SEQ ID NO: 389186 - DNA, 140 bp, Artificial Sequence
  Synthetic
caccgctgtcccaaaaggtccttccctctcatcttcctccgcttgaagcggttcaaaagagtccagaatcactactttattctccgactccacacgggtgatgttcccgcccatctcctgcatatcagcagccagggcct

SEQ ID NO: 389187 - DNA, 140 bp, Artificial Sequence
  Synthetic
aggccctggctgctgatatgagcggacggtggtcctcaccgaatcaactgtatctactgccttggccgagcttgccaccaaaagttttggcagctcctcaacttccggcatcacgggcgagaccttttgggacagcggtg

SEQ ID NO: 389188 - DNA, 140 bp, Artificial Sequence
  Synthetic
caccgctgtcccaaaaggtctcgcccgtgatgccggaagttgaggagctgccaaaacttttggtggcaagctcggccaaggcagtagatacagttgattcggtgaggaccaccgtccgctcatatcagcagccagggcct

SEQ ID NO: 389189 - DNA, 140 bp, Artificial Sequence
  Synthetic
atacgccatgctgggtctccgaaggacccggactacgttcctccggtggtgcacgggtgcccactgccacctgccaaggcgcctccagtaccacctccgcggaggaagaggacggttgttcgtacttgggagtcggccat

SEQ ID NO: 389190 - DNA, 140 bp, Artificial Sequence
  Synthetic
atggccgactcccaagtacgaacaaccgtcctcttcctccgcggaggtggtactggaggcgccttggcaggtggcagtgggcacccgtgcaccaccggaggaacgtagtccgggtccttcggagacccagcatggcgtat

SEQ ID NO: 389191 - DNA, 140 bp, Artificial Sequence
  Synthetic
atacgccatgctgggtctccgagcggataccggaggagacagcgtccagcagccctctgacgagactgccgcttcagaaacgggatcactgtcctccatgcctccccttgagggagagcccgtacttgggagtcggccat

SEQ ID NO: 389192 - DNA, 140 bp, Artificial Sequence
  Synthetic
atggccgactcccaagtacgggctctccctcaaggggaggcatggaggacagtgatcccgtttctgaagcggcagtctcgtcagagggctgctggacgctgtctcctccggtatccgctcggagacccagcatggcgtat

SEQ ID NO: 389193 - DNA, 140 bp, Artificial Sequence
  Synthetic
aggccctggctgctgatatggatatgatgatgaactggtcacccacaacagccctagtggtatcgcagttgctccggatcccacaagccgtcgtggacatggtggcgggggcccactggggaccttttgggacagcggtg

SEQ ID NO: 389194 - DNA, 140 bp, Artificial Sequence
  Synthetic
caccgctgtcccaaaaggtccccagtgggcccccgccaccatgtccacgacggcttgtgggatccggagcaactgcgataccactagggctgttgtgggtgaccagttcatcatcatatccatatcagcagccagggcct

SEQ ID NO: 389195 - DNA, 140 bp, Artificial Sequence
  Synthetic
aggccctggctgctgatatgggatcctggcgggcctcgcctactattccatggcggggaactgggctaaggtcttgattgtgatgctagtctttgccggcgtcgacgggaaaactcatacgaccttttgggacagcggtg

SEQ ID NO: 389196 - DNA, 140 bp, Artificial Sequence
  Synthetic
caccgctgtcccaaaaggtcgtatgagttttcccgtcgacgccggcaaagactagcatcacaatcaagaccttagcccagttccccgccatggaatagtaggcgaggcccgccaggatcccatatcagcagccagggcct

SEQ ID NO: 389197 - DNA, 140 bp, Artificial Sequence
  Synthetic
atacgccatgctgggtctccagcgtatgtccagctgccgccccatcagcgagtttgctcaggggtggggtcccatcacttacgccaagcgggacggcccggaccaaaggccctattgttgcgtacttgggagtcggccat

SEQ ID NO: 389198 - DNA, 140 bp, Artificial Sequence
  Synthetic
atggccgactcccaagtacgcaacaatagggcctttggtccgggccgtcccgcttggcgtaagtgatgggaccccacccctgagcaaactcgctgatggggcggcagctggacatacgctggagacccagcatggcgtat

SEQ ID NO: 389199 - DNA, 140 bp, Artificial Sequence
  Synthetic
aggccctggctgctgatatggccgtgatgctcgtgtcgcaggctctcatagtatcaccagaacgccacaacttcacccaagagtgcaattgttccatctaccaaggccagatcaccggccgaccttttgggacagcggtg

SEQ ID NO: 389200 - DNA, 140 bp, Artificial Sequence
  Synthetic
caccgctgtcccaaaaggtcggccggtgatctggccttggtagatggaacaattgcactcttgggtgaagttgtggcgttctggtgatactatgagagcctgcgacacgagcatcacggccatatcagcagccagggcct

SEQ ID NO: 389201 - DNA, 140 bp, Artificial Sequence
  Synthetic
aggccctggctgctgatatggcgcctccttgtgtcatcggaggggtgggcaacaacaccttgcattgccccactgattgtttccgcaagcatccggatgccacatactctcggtgtggctgaccttttgggacagcggtg

SEQ ID NO: 389202 - DNA, 140 bp, Artificial Sequence
  Synthetic
caccgctgtcccaaaaggtcagccacaccgagagtatgtggcatccggatgcttgcggaaacaatcagtggggcaatgcaaggtgttgttgcccacccctccgatgacacaaggaggcgccatatcagcagccagggcct

SEQ ID NO: 389203 - DNA, 140 bp, Artificial Sequence
  Synthetic
atacgccatgctgggtctcccgctgggctcttcacccgtggtccccagcagcagctccacttaatcaacaccaatggtagttggcacataaatcggaccgccctcaattgcaatgacagccgtacttgggagtcggccat

SEQ ID NO: 389204 - DNA, 140 bp, Artificial Sequence
  Synthetic
atggccgactcccaagtacggctgtcattgcaattgagggcggtccgatttatgtgccaactaccattggtgttgattaagtggagctgctgctggggaccacgggtgaagagcccagcgggagacccagcatggcgtat

SEQ ID NO: 389205 - DNA, 140 bp, Artificial Sequence
  Synthetic
aggccctggctgctgatatgtcaatgcggcgtccgtggccggagcgcatggcattctctccttccttgtgttcttctgtgctgcctggtacatcaagggcaggctggtccctggggcggcgaccttttgggacagcggtg

SEQ ID NO: 389206 - DNA, 140 bp, Artificial Sequence
  Synthetic
caccgctgtcccaaaaggtcgccgccccagggaccagcctgcccttgatgtaccaggcagcacagaagaacacaaggaaggagagaatgccatgcgctccggccacggacgccgcattgacatatcagcagccagggcct

SEQ ID NO: 389207 - DNA, 140 bp, Artificial Sequence
  Synthetic
aggccctggctgctgatatgggtgggcgggatggctcctgtccccccgcggctctcgaccatcttggggtcccaatgatccccggcggagatcgcgtaatttgggtaaagtcatcgatacgaccttttgggacagcggtg

SEQ ID NO: 389208 - DNA, 140 bp, Artificial Sequence
  Synthetic
caccgctgtcccaaaaggtcgtatcgatgactttacccaaattacgcgatctccgccggggatcattgggaccccaagatggtcgagagccgcggggggacaggagccatcccgcccacccatatcagcagccagggcct

SEQ ID NO: 389209 - DNA, 140 bp, Artificial Sequence
  Synthetic
atacgccatgctgggtctccaccgtattataagcgctatatcagctggtgcttatggtggcttcaatacctcctgaccagagtggaagcacagctgcacgtatgggtcccccccttcaaccgtacttgggagtcggccat

SEQ ID NO: 389210 - DNA, 140 bp, Artificial Sequence
  Synthetic
atggccgactcccaagtacggttgaagggggggacccatacgtgcagctgtgcttccactctggtcaggaggtattgaagccaccataagcaccagctgatatagcgcttataatacggtggagacccagcatggcgtat

SEQ ID NO: 389211 - DNA, 140 bp, Artificial Sequence
  Synthetic
aggccctggctgctgatatgacccctttggattcttcaagccagtttgcttaaagtaccctactttgtgcgcgttcaaggccttctccggatctgcgcactagcgcggaagatggccggagaccttttgggacagcggtg

SEQ ID NO: 389212 - DNA, 140 bp, Artificial Sequence
  Synthetic
caccgctgtcccaaaaggtctccggccatcttccgcgctagtgcgcagatccggagaaggccttgaacgcgcacaaagtagggtactttaagcaaactggcttgaagaatccaaaggggtcatatcagcagccagggcct

SEQ ID NO: 389213 - DNA, 140 bp, Artificial Sequence
  Synthetic
aggccctggctgctgatatggctgtcctacatgctggtcttggccgaggcccagatccagcagtgggttccccccctggaggctagggggggacgtgacgggatcatctgggcggctgtcgaccttttgggacagcggtg

SEQ ID NO: 389214 - DNA, 140 bp, Artificial Sequence
  Synthetic
caccgctgtcccaaaaggtcgacagccgcccagatgatcccgtcacgtccccccctagcctccagggggggaacccactgctggatctgggcctcggccaagaccagcatgtaggacagccatatcagcagccagggcct

SEQ ID NO: 389215 - DNA, 140 bp, Artificial Sequence
  Synthetic
aggccctggctgctgatatgaaccttgtgttactcaatgcggcgtctctggccgggacgcacggtgttgtgtccttcctcgtgtttttctgctttgcatggtatctgaggggtaggtggggaccttttgggacagcggtg

SEQ ID NO: 389216 - DNA, 140 bp, Artificial Sequence
  Synthetic
caccgctgtcccaaaaggtccccacctacccctcagataccatgcaaagcagaaaaacacgaggaaggacacaacaccgtgcgtcccggccagagacgccgcattgagtaacacaaggttcatatcagcagccagggcct

SEQ ID NO: 389217 - DNA, 140 bp, Artificial Sequence
  Synthetic
aggccctggctgctgatatgtatcttcatcttggcacttctctcgtgcctgactgtcccggcctcagctctgcattatcggaacgtctcgggcatctaccatgtcaccaacgactgcccggaccttttgggacagcggtg

SEQ ID NO: 389218 - DNA, 140 bp, Artificial Sequence
  Synthetic
caccgctgtcccaaaaggtccgggcagtcgttggtgacatggtagatgcccgagacgttccgataatgcagagctgaggccgggacagtcaggcacgagagaagtgccaagatgaagatacatatcagcagccagggcct

SEQ ID NO: 389219 - DNA, 140 bp, Artificial Sequence
  Synthetic
aggccctggctgctgatatgttggttttggggcctacatgtccaaagcccacgggatcaaccctaacatcagaaccggagtgcggactgtgaccaccggggaccctatcacctactccacgaccttttgggacagcggtg

SEQ ID NO: 389220 - DNA, 140 bp, Artificial Sequence
  Synthetic
caccgctgtcccaaaaggtcgtggagtaggtgatagggtccccggtggtcacagtccgcactccggttctgatgttagggttgatcccgtgggctttggacatgtaggccccaaaaccaacatatcagcagccagggcct

SEQ ID NO: 389221 - DNA, 140 bp, Artificial Sequence
  Synthetic
atacgccatgctgggtctccgttgctccttctctatcttcctcctcgctctcttctcctgcttgacttgccccgcgtccagtctggagtacaggaatgcgtctggcctatatttgcttaccgtacttgggagtcggccat

SEQ ID NO: 389222 - DNA, 140 bp, Artificial Sequence
  Synthetic
atggccgactcccaagtacggtaagcaaatataggccagacgcattcctgtactccagactggacgcggggcaagtcaagcaggagaagagagcgaggaggaagatagagaaggagcaacggagacccagcatggcgtat

SEQ ID NO: 389223 - DNA, 140 bp, Artificial Sequence
  Synthetic
atacgccatgctgggtctcctcgtgctggacaccgatttcaccgacggtggccgtcaagcaccctggtgtgaccaccgcgtcgatccgaaatcatgtgaatatgttggtggccccgccaacgtacttgggagtcggccat

SEQ ID NO: 389224 - DNA, 140 bp, Artificial Sequence
  Synthetic
atggccgactcccaagtacgttggcggggccaccaacatattcacatgatttcggatcgacgcggtggtcacaccagggtgcttgacggccaccgtcggtgaaatcggtgtccagcacgaggagacccagcatggcgtat

SEQ ID NO: 389225 - DNA, 140 bp, Artificial Sequence
  Synthetic
atacgccatgctgggtctcccttctctcctaggcaccacgtggacgacgcaagactgcaactgttcaatgtatcctggccatataacgggtcaccgcatggcatgggatatgatgagtaccgtacttgggagtcggccat

SEQ ID NO: 389226 - DNA, 140 bp, Artificial Sequence
  Synthetic
atggccgactcccaagtacggtactcatcatatcccatgccatgcggtgacccgttatatggccaggatacattgaacagttgcagtcttgcgtcgtccacgtggtgcctaggagagaagggagacccagcatggcgtat

SEQ ID NO: 389227 - DNA, 140 bp, Artificial Sequence
  Synthetic
aggccctggctgctgatatgagcccggttgtggtggggacgaccgaccgctccggcgtccctacgtatacctggggggagaatgagacggacgtgctgctcctcaacaacacgcggccgcgaccttttgggacagcggtg

SEQ ID NO: 389228 - DNA, 140 bp, Artificial Sequence
  Synthetic
caccgctgtcccaaaaggtcgcggccgcgtgttgttgaggagcagcacgtccgtctcattctccccccaggtatacgtagggacgccggagcggtcggtcgtccccaccacaaccgggctcatatcagcagccagggcct

SEQ ID NO: 389229 - DNA, 140 bp, Artificial Sequence
  Synthetic
atacgccatgctgggtctcccaagtacccacgtcaccgggggagctgtcgcccacaatgcggctggccttagtagtctcttcataccaggcgccaagcagaacgtccagctaattaacaccgtacttgggagtcggccat

SEQ ID NO: 389230 - DNA, 140 bp, Artificial Sequence
  Synthetic
atggccgactcccaagtacggtgttaattagctggacgttctgcttggcgcctggtatgaagagactactaaggccagccgcattgtgggcgacagctcccccggtgacgtgggtacttgggagacccagcatggcgtat

SEQ ID NO: 389231 - DNA, 140 bp, Artificial Sequence
  Synthetic
aggccctggctgctgatatggccttgaactgcaatgatagccttgacaccggctgggtagcagggcttttctattaccacaaattcaactcttcaggctgtcccgagaggttggccagctgaccttttgggacagcggtg

SEQ ID NO: 389232 - DNA, 140 bp, Artificial Sequence
  Synthetic
caccgctgtcccaaaaggtcagctggccaacctctcgggacagcctgaagagttgaatttgtggtaatagaaaagccctgctacccagccggtgtcaaggctatcattgcagttcaaggccatatcagcagccagggcct

SEQ ID NO: 389233 - DNA, 140 bp, Artificial Sequence
  Synthetic
aggccctggctgctgatatgagccgtccaaaatgaggtcaccctcacacaccccataaccaaatacatcatggcatgcatgtcggctgacctggaggtcgtcacgagcacctgggtgctagaccttttgggacagcggtg

SEQ ID NO: 389234 - DNA, 140 bp, Artificial Sequence
  Synthetic
caccgctgtcccaaaaggtctagcacccaggtgctcgtgacgacctccaggtcagccgacatgcatgccatgatgtatttggttatggggtgtgtgagggtgacctcattttggacggctcatatcagcagccagggcct

SEQ ID NO: 389235 - DNA, 140 bp, Artificial Sequence
  Synthetic
aggccctggctgctgatatgggaggttgctctgtccaccaccggagagatccctttctacggcaaggctatcccccttgaggcaatcaagggggggagacatctcatcttctgtcactcagaccttttgggacagcggtg

SEQ ID NO: 389236 - DNA, 140 bp, Artificial Sequence
  Synthetic
caccgctgtcccaaaaggtctgagtgacagaagatgagatgtctcccccccttgattgcctcaagggggatagccttgccgtagaaagggatctctccggtggtggacagagcaacctcccatatcagcagccagggcct

SEQ ID NO: 389237 - DNA, 140 bp, Artificial Sequence
  Synthetic
aggccctggctgctgatatggatgtggcctctcctcctgctcctgttggcgttgccccagcgggcatacgcgctggacacggaggtggccgcgtcgtgtggcggcgttgttcttgtcggggaccttttgggacagcggtg

SEQ ID NO: 389238 - DNA, 140 bp, Artificial Sequence
  Synthetic
caccgctgtcccaaaaggtccccgacaagaacaacgccgccacacgacgcggccacctccgtgtccagcgcgtatgcccgctggggcaacgccaacaggagcaggaggagaggccacatccatatcagcagccagggcct

SEQ ID NO: 389239 - DNA, 140 bp, Artificial Sequence
  Synthetic
aggccctggctgctgatatgcatcttccgggctgctgtatgcacccggggggtcgcgaaggcggtggactttatacccgttgagtccatggaaactactatgcggtccccggtcttcacggaccttttgggacagcggtg

SEQ ID NO: 389240 - DNA, 140 bp, Artificial Sequence
  Synthetic
caccgctgtcccaaaaggtccgtgaagaccggggaccgcatagtagtttccatggactcaacgggtataaagtccaccgccttcgcgaccccccgggtgcatacagcagcccggaagatgcatatcagcagccagggcct

SEQ ID NO: 389241 - DNA, 140 bp, Artificial Sequence
  Synthetic
aggccctggctgctgatatgacacgcccccactggcagcggcaagagcactaaggtgccggctgcgtatgcagcccaagggtacaaggtactcgtcctgaacccgtccgttgccgccaccgaccttttgggacagcggtg

SEQ ID NO: 389242 - DNA, 140 bp, Artificial Sequence
  Synthetic
caccgctgtcccaaaaggtcggtggcggcaacggacgggttcaggacgagtaccttgtacccttgggctgcatacgcagccggcaccttagtgctcttgccgctgccagtgggggcgtgtcatatcagcagccagggcct

SEQ ID NO: 389243 - DNA, 140 bp, Artificial Sequence
  Synthetic
aggccctggctgctgatatgtagctactacgccactaatgattgctcgaacaacagcatcacctggcagctctctaacgcagttctccaccttcctggatgcgtcccatgtgagaatgatgaccttttgggacagcggtg

SEQ ID NO: 389244 - DNA, 140 bp, Artificial Sequence
  Synthetic
caccgctgtcccaaaaggtcatcattctcacatgggacgcatccaggaaggtggagaactgcgttagagagctgccaggtgatgctgttgttcgagcaatcattagtggcgtagtagctacatatcagcagccagggcct

SEQ ID NO: 389245 - DNA, 140 bp, Artificial Sequence
  Synthetic
aggccctggctgctgatatgtataatcaccagcctaactggccgggacaaaaaccaagtggagggtgaggtccagattgtgtcaactgctgcccaaactttcctggcaacgtgcatcaatgaccttttgggacagcggtg

SEQ ID NO: 389246 - DNA, 140 bp, Artificial Sequence
  Synthetic
caccgctgtcccaaaaggtcattgatgcacgttgccaggaaagtttgggcagcagttgacacaatctggacctcaccctccacttggtttttgtcccggccagttaggctggtgattatacatatcagcagccagggcct

SEQ ID NO: 389247 - DNA, 140 bp, Artificial Sequence
  Synthetic
atacgccatgctgggtctccatcctcgcctacgctgctcgtgttcccgagatggtccttgaaattattttcggcggccattggggtgtggtgtttggcttggcctatttctccatgcaggcgtacttgggagtcggccat

SEQ ID NO: 389248 - DNA, 140 bp, Artificial Sequence
  Synthetic
atggccgactcccaagtacgcctgcatggagaaataggccaagccaaacaccacaccccaatggccgccgaaaataatttcaaggaccatctcgggaacacgagcagcgtaggcgaggatggagacccagcatggcgtat

SEQ ID NO: 389249 - DNA, 140 bp, Artificial Sequence
  Synthetic
atacgccatgctgggtctcccggcggccattggggtgtggtgtttggcttggcctatttctccatgcagggagcgtgggccaaagtcattgccatcctccttcttgtcgcgggagtggatcgtacttgggagtcggccat

SEQ ID NO: 389250 - DNA, 140 bp, Artificial Sequence
  Synthetic
atggccgactcccaagtacgatccactcccgcgacaagaaggaggatggcaatgactttggcccacgctccctgcatggagaaataggccaagccaaacaccacaccccaatggccgccgggagacccagcatggcgtat

SEQ ID NO: 389251 - DNA, 140 bp, Artificial Sequence
  Synthetic
aggccctggctgctgatatgttacatgtccaaggcccatgggatcgatcctaacatcaggaccggggtgaggacaattaccactggcagccccatcacgtactccacctacggcaagttcgaccttttgggacagcggtg

SEQ ID NO: 389252 - DNA, 140 bp, Artificial Sequence
  Synthetic
caccgctgtcccaaaaggtcgaacttgccgtaggtggagtacgtgatggggctgccagtggtaattgtcctcaccccggtcctgatgttaggatcgatcccatgggccttggacatgtaacatatcagcagccagggcct

SEQ ID NO: 389253 - DNA, 140 bp, Artificial Sequence
  Synthetic
atacgccatgctgggtctccagcttggttcggctgcacttggatgaacgggactgggttcactaagacatgcggagcaccaccttgccgcattaggagggactacaacagcactctcgatcgtacttgggagtcggccat

SEQ ID NO: 389254 - DNA, 140 bp, Artificial Sequence
  Synthetic
atggccgactcccaagtacgatcgagagtgctgttgtagtccctcctaatgcggcaaggtggtgctccgcatgtcttagtgaacccagtcccgttcatccaagtgcagccgaaccaagctggagacccagcatggcgtat

SEQ ID NO: 389255 - DNA, 140 bp, Artificial Sequence
  Synthetic
atacgccatgctgggtctccgcggagcaccaccttgccgcattaggagggactacaacagcactctcgatctattgtgccccacagactgttttaggaagcacccaggtgctacctatctcgtacttgggagtcggccat

SEQ ID NO: 389256 - DNA, 140 bp, Artificial Sequence
  Synthetic
atggccgactcccaagtacgagataggtagcacctgggtgcttcctaaaacagtctgtggggcacaatagatcgagagtgctgttgtagtccctcctaatgcggcaaggtggtgctccgcggagacccagcatggcgtat

SEQ ID NO: 389257 - DNA, 140 bp, Artificial Sequence
  Synthetic
aggccctggctgctgatatgcttctgtcactcaaagaagaagtgtgacgagctcgccgcaaagctggtcgcattgggcgtcaatgccgtggcctactaccgcggtcttgacgtgtctgtcgaccttttgggacagcggtg

SEQ ID NO: 389258 - DNA, 140 bp, Artificial Sequence
  Synthetic
caccgctgtcccaaaaggtcgacagacacgtcaagaccgcggtagtaggccacggcattgacgcccaatgcgaccagctttgcggcgagctcgtcacacttcttctttgagtgacagaagcatatcagcagccagggcct

SEQ ID NO: 389259 - DNA, 140 bp, Artificial Sequence
  Synthetic
aggccctggctgctgatatggagaacaaagtggtgattctggactccttcgatccgcttgtggcagaggaggatgagcgggagatctccgtgcccgcagagatcctgcggaagtcccggagaccttttgggacagcggtg

SEQ ID NO: 389260 - DNA, 140 bp, Artificial Sequence
  Synthetic
caccgctgtcccaaaaggtctccgggacttccgcaggatctctgcgggcacggagatctcccgctcatcctcctctgccacaagcggatcgaaggagtccagaatcaccactttgttctccatatcagcagccagggcct

SEQ ID NO: 389261 - DNA, 140 bp, Artificial Sequence
  Synthetic
atacgccatgctgggtctccccgctgaacaaggggaactagggctggtcatactagtaatcatatccatctttactcttactccagcatacaagattctcctgagccgttcagtgtggtgcgtacttgggagtcggccat

SEQ ID NO: 389262 - DNA, 140 bp, Artificial Sequence
  Synthetic
atggccgactcccaagtacgcaccacactgaacggctcaggagaatcttgtatgctggagtaagagtaaagatggatatgattactagtatgaccagccctagttccccttgttcagcggggagacccagcatggcgtat

SEQ ID NO: 389263 - DNA, 140 bp, Artificial Sequence
  Synthetic
aggccctggctgctgatatggatccggatctcagcgacgggtcatggtcgacggtcagtagtgaggctggcacggaggatgtcgtgtgctgctcaatgtcttactcctggacaggcgcacgaccttttgggacagcggtg

SEQ ID NO: 389264 - DNA, 140 bp, Artificial Sequence
  Synthetic
caccgctgtcccaaaaggtcgtgcgcctgtccaggagtaagacattgagcagcacacgacatcctccgtgccagcctcactactgaccgtcgaccatgacccgtcgctgagatccggatccatatcagcagccagggcct

SEQ ID NO: 389265 - DNA, 140 bp, Artificial Sequence
  Synthetic
atacgccatgctgggtctccttgtgagggcccacgctctgctacgagtgtgtaccctggtgaggcacctcgcaggagctaggtacgtccagatgctgttgcttaccatgggcaggtggaccgtacttgggagtcggccat

SEQ ID NO: 389266 - DNA, 140 bp, Artificial Sequence
  Synthetic
atggccgactcccaagtacggtccacctgcccatggtaagcaacagcatctggacgtacctagctcctgcgaggtgcctcaccagggtacacactcgtagcagagcgtgggccctcacaaggagacccagcatggcgtat

SEQ ID NO: 389267 - DNA, 140 bp, Artificial Sequence
  Synthetic
atacgccatgctgggtctccattactgcttacactcagcagactcgcggtctcttgggtgctatcgtggtcagtctaacgggccgcgacaaaaatgagcaggctgggcaggtccaggtcccgtacttgggagtcggccat

SEQ ID NO: 389268 - DNA, 140 bp, Artificial Sequence
  Synthetic
atggccgactcccaagtacgggacctggacctgcccagcctgctcatttttgtcgcggcccgttagactgaccacgatagcacccaagagaccgcgagtctgctgagtgtaagcagtaatggagacccagcatggcgtat

SEQ ID NO: 389269 - DNA, 140 bp, Artificial Sequence
  Synthetic
aggccctggctgctgatatgggccaacctcctgtggcggcaggagatgggcgggaacatcacccgcgtggagtcagagaacaaggtggtagtcctggactctttcgagccgcttcgagcggaccttttgggacagcggtg

SEQ ID NO: 389270 - DNA, 140 bp, Artificial Sequence
  Synthetic
caccgctgtcccaaaaggtccgctcgaagcggctcgaaagagtccaggactaccaccttgttctctgactccacgcgggtgatgttcccgcccatctcctgccgccacaggaggttggcccatatcagcagccagggcct

SEQ ID NO: 389271 - DNA, 140 bp, Artificial Sequence
  Synthetic
aggccctggctgctgatatgttgttcagagcggccgtgtgcgccaggggtgtggccaaatctattgacttcatccctgttgaatctctcaatatcgccacacggacgcccagcttctctggaccttttgggacagcggtg

SEQ ID NO: 389272 - DNA, 140 bp, Artificial Sequence
  Synthetic
caccgctgtcccaaaaggtccagagaagctgggcgtccgtgtggcgatattgagagattcaacagggatgaagtcaatagatttggccacacccctggcgcacacggccgctctgaacaacatatcagcagccagggcct

SEQ ID NO: 389273 - DNA, 140 bp, Artificial Sequence
  Synthetic
atacgccatgctgggtctccgagaaagaggacggttgtcctaacagagtccactgtctcttctgccttggcggagcttgctacgaagaccttcggcagctccgaaccgtcggccgctgaccgtacttgggagtcggccat

SEQ ID NO: 389274 - DNA, 140 bp, Artificial Sequence
  Synthetic
atggccgactcccaagtacggtcagcggccgacggttcggagctgccgaaggtcttcgtagcaagctccgccaaggcagaagagacagtggactctgttaggacaaccgtcctctttctcggagacccagcatggcgtat

SEQ ID NO: 389275 - DNA, 140 bp, Artificial Sequence
  Synthetic
aggccctggctgctgatatgtggaggacagggatagatcagagcttagcccgctgctgctgtctacaacggagtggcagatactgccctgttccttcaccaccctaccggccttgtccacgaccttttgggacagcggtg

SEQ ID NO: 389276 - DNA, 140 bp, Artificial Sequence
  Synthetic
caccgctgtcccaaaaggtcgtggacaaggccggtagggtggtgaaggaacagggcagtatctgccactccgttgtagacagcagcagcgggctaagctctgatctatccctgtcctccacatatcagcagccagggcct

SEQ ID NO: 389277 - DNA, 140 bp, Artificial Sequence
  Synthetic
atacgccatgctgggtctccttatggcaagtttgtcgcagatggaggctgtcaagctggcgcctatgacatcatcatatgcgacgaatgccactcggtggacgctactaccatccttggtcgtacttgggagtcggccat

SEQ ID NO: 389278 - DNA, 140 bp, Artificial Sequence
  Synthetic
atggccgactcccaagtacgaccaaggatggtagtagcgtccaccgagtggcattcgtcgcatatgatgatgtcataggcgccagcttgacagcctccatctgcgacaaacttgccataaggagacccagcatggcgtat

SEQ ID NO: 389279 - DNA, 140 bp, Artificial Sequence
  Synthetic
atacgccatgctgggtctcccctggatcactgaagattgcccagtcccatgttcggggtcttggctccaggacatttgggattgggtttgttccattctcacagactttaagaactggctcgtacttgggagtcggccat

SEQ ID NO: 389280 - DNA, 140 bp, Artificial Sequence
  Synthetic
atggccgactcccaagtacgagccagttcttaaagtctgtgagaatggaacaaacccaatcccaaatgtcctggagccaagaccccgaacatgggactgggcaatcttcagtgatccaggggagacccagcatggcgtat

SEQ ID NO: 389281 - DNA, 140 bp, Artificial Sequence
  Synthetic
aggccctggctgctgatatggctgcaggggtaggcatctacctcctccccaaccgatgaacggggagctaaacactccaggccaataggccatttcctgtttttttttttttttttttttgaccttttgggacagcggtg

SEQ ID NO: 389282 - DNA, 140 bp, Artificial Sequence
  Synthetic
caccgctgtcccaaaaggtcaaaaaaaaaaaaaaaaaaaaacaggaaatggcctattggcctggagtgtttagctccccgttcatcggttggggaggaggtagatgcctacccctgcagccatatcagcagccagggcct

SEQ ID NO: 389283 - DNA, 140 bp, Artificial Sequence
  Synthetic
atacgccatgctgggtctccggtgatcgttctcgactccctcgattccatgactgaggtagaggacgatcgtgagccttctgtaccatcagagtacttgatcaggaggagaaagttcccacgtacttgggagtcggccat

SEQ ID NO: 389284 - DNA, 140 bp, Artificial Sequence
  Synthetic
atggccgactcccaagtacgtgggaactttctcctcctgatcaagtactctgatggtacagaaggctcacgatcgtcctctacctcagtcatggaatcgagggagtcgagaacgatcaccggagacccagcatggcgtat

SEQ ID NO: 389285 - DNA, 140 bp, Artificial Sequence
  Synthetic
atacgccatgctgggtctccagagttctgactcaggacaatgtggagggggtcctcagggagatggcggacaaagtgctcagccctctccaagaccacaatgactccggtcactccactgcgtacttgggagtcggccat

SEQ ID NO: 389286 - DNA, 140 bp, Artificial Sequence
  Synthetic
atggccgactcccaagtacgcagtggagtgaccggagtcattgtggtcttggagagggctgagcactttgtccgccatctccctgaggaccccctccacattgtcctgagtcagaactctggagacccagcatggcgtat

SEQ ID NO: 389287 - DNA, 140 bp, Artificial Sequence
  Synthetic
aggccctggctgctgatatggtctgtctttcttgtcggccaactgttcaccttctctcccaggcgccactggacgacgcaagactgcaattgttctatctaccccggccatataacaggtgaccttttgggacagcggtg

SEQ ID NO: 389288 - DNA, 140 bp, Artificial Sequence
  Synthetic
caccgctgtcccaaaaggtcacctgttatatggccggggtagatagaacaattgcagtcttgcgtcgtccagtggcgcctgggagagaaggtgaacagttggccgacaagaaagacagaccatatcagcagccagggcct

SEQ ID NO: 389289 - DNA, 140 bp, Artificial Sequence
  Synthetic
atacgccatgctgggtctcccgcgagcacctacacctctggggggagtgccgccaggtccacgttcacgtttgttaagttccttgcaccaggcgccaagcaggaccttcagctgatcaaccgtacttgggagtcggccat

SEQ ID NO: 389290 - DNA, 140 bp, Artificial Sequence
  Synthetic
atggccgactcccaagtacggttgatcagctgaaggtcctgcttggcgcctggtgcaaggaacttaacaaacgtgaacgtggacctggcggcactccccccagaggtgtaggtgctcgcgggagacccagcatggcgtat

SEQ ID NO: 389291 - DNA, 140 bp, Artificial Sequence
  Synthetic
aggccctggctgctgatatgccacggggctggaacgaggaccatcgcatcacccaagggccctgttatccagatgtataccaatgtggacaaagaccttgtgggctggcccgctcctcaagaccttttgggacagcggtg

SEQ ID NO: 389292 - DNA, 140 bp, Artificial Sequence
  Synthetic
caccgctgtcccaaaaggtcttgaggagcgggccagcccacaaggtctttgtccacattggtatacatctggataacagggcccttgggtgatgcgatggtcctcgttccagccccgtggcatatcagcagccagggcct

SEQ ID NO: 389293 - DNA, 140 bp, Artificial Sequence
  Synthetic
aggccctggctgctgatatgactaaagtgccggctgcatatgcagcccaagggtacaaggtactcgtcctgaacccgtccgttgccgccaccttaggttttggggcgtatatgtctaagggaccttttgggacagcggtg

SEQ ID NO: 389294 - DNA, 140 bp, Artificial Sequence
  Synthetic
caccgctgtcccaaaaggtcccttagacatatacgccccaaaacctaaggtggcggcaacggacgggttcaggacgagtaccttgtacccttgggctgcatatgcagccggcactttagtcatatcagcagccagggcct

SEQ ID NO: 389295 - DNA, 140 bp, Artificial Sequence
  Synthetic
aggccctggctgctgatatggggggacttccactacgtgacgggtatgactactgacaatcttaaatgcccgtgccaggtcccatcgcccgaatttttcacagaattggacggggtgcgcgaccttttgggacagcggtg

SEQ ID NO: 389296 - DNA, 140 bp, Artificial Sequence
  Synthetic
caccgctgtcccaaaaggtcgcgcaccccgtccaattctgtgaaaaattcgggcgatgggacctggcacgggcatttaagattgtcagtagtcatacccgtcacgtagtggaagtccccccatatcagcagccagggcct

SEQ ID NO: 389297 - DNA, 140 bp, Artificial Sequence
  Synthetic
aggccctggctgctgatatgatgttgggggccctcttaccaattcaaggggggagaactgcggctatcgcaggtgccgcgcgagcggcgtactgacaactagctgtggtaacaccctcacgaccttttgggacagcggtg

SEQ ID NO: 389298 - DNA, 140 bp, Artificial Sequence
  Synthetic
caccgctgtcccaaaaggtcgtgagggtgttaccacagctagttgtcagtacgccgctcgcgcggcacctgcgatagccgcagttctccccccttgaattggtaagagggcccccaacatcatatcagcagccagggcct

SEQ ID NO: 389299 - DNA, 140 bp, Artificial Sequence
  Synthetic
aggccctggctgctgatatgattgtgtacgagacggccgataccatcctacactctccggggtgtgtcccttgcgttcgcgagggtaacgcctcgaaatgttgggtggcggtggcccccagaccttttgggacagcggtg

SEQ ID NO: 389300 - DNA, 140 bp, Artificial Sequence
  Synthetic
caccgctgtcccaaaaggtctgggggccaccgccacccaacatttcgaggcgttaccctcgcgaacgcaagggacacaccccggagagtgtaggatggtatcggccgtctcgtacacaatcatatcagcagccagggcct

SEQ ID NO: 389301 - DNA, 140 bp, Artificial Sequence
  Synthetic
atacgccatgctgggtctccggactatgtccctccggtggtgcatgggtgcccactaccgcctgccaaggcggccccagtaccacccccacggaggaagaggacggttgtcctgacagaacgtacttgggagtcggccat

SEQ ID NO: 389302 - DNA, 140 bp, Artificial Sequence
  Synthetic
atggccgactcccaagtacgttctgtcaggacaaccgtcctcttcctccgtgggggtggtactggggccgccttggcaggcggtagtgggcacccatgcaccaccggagggacatagtccggagacccagcatggcgtat

SEQ ID NO: 389303 - DNA, 140 bp, Artificial Sequence
  Synthetic
atacgccatgctgggtctccgccagggtctgtgcatgcctttggatgctcatcatactgggccaggccgaggcggcgcttgagaagctcatcatcttgcactccgctagtgccgctagtgcgtacttgggagtcggccat

SEQ ID NO: 389304 - DNA, 140 bp, Artificial Sequence
  Synthetic
atggccgactcccaagtacgcactagcggcactagcggagtgcaagatgatgagcttctcaagcgccgcctcggcctggcccagtatgatgagcatccaaaggcatgcacagaccctggcggagacccagcatggcgtat

SEQ ID NO: 389305 - DNA, 140 bp, Artificial Sequence
  Synthetic
atacgccatgctgggtctccccactgaacaaggggaactgggactggtcatgattgtaatcatatccatctttactcttaccccagcatacaagactcttttgagccggtcagtatggtgcgtacttgggagtcggccat

SEQ ID NO: 389306 - DNA, 140 bp, Artificial Sequence
  Synthetic
atggccgactcccaagtacgcaccatactgaccggctcaaaagagtcttgtatgctggggtaagagtaaagatggatatgattacaatcatgaccagtcccagttccccttgttcagtggggagacccagcatggcgtat

SEQ ID NO: 389307 - DNA, 140 bp, Artificial Sequence
  Synthetic
aggccctggctgctgatatggacttgtccggctggttcacggctggctacagcgggggagacatttatcacagcgtgtctcatgcccggccccgctggttctggttttgcctactcctgcgaccttttgggacagcggtg

SEQ ID NO: 389308 - DNA, 140 bp, Artificial Sequence
  Synthetic
caccgctgtcccaaaaggtcgcaggagtaggcaaaaccagaaccagcggggccgggcatgagacacgctgtgataaatgtctcccccgctgtagccagccgtgaaccagccggacaagtccatatcagcagccagggcct

SEQ ID NO: 389309 - DNA, 140 bp, Artificial Sequence
  Synthetic
atacgccatgctgggtctcccctggggcctgcctacctcctcagggaatccctgctacgggtgccatactttgtgagggctcacgccctactacgagtgtgcaccctggtgagacacctccgtacttgggagtcggccat

SEQ ID NO: 389310 - DNA, 140 bp, Artificial Sequence
  Synthetic
atggccgactcccaagtacggaggtgtctcaccagggtgcacactcgtagtagggcgtgagccctcacaaagtatggcacccgtagcagggattccctgaggaggtaggcaggccccaggggagacccagcatggcgtat

SEQ ID NO: 389311 - DNA, 140 bp, Artificial Sequence
  Synthetic
aggccctggctgctgatatggagtcctggcgggccttgcgtactattccatggtggggaactgggctaaggtcttgattgtgatgctactttttgccggcgtcgatgggagcacctatacgaccttttgggacagcggtg

SEQ ID NO: 389312 - DNA, 140 bp, Artificial Sequence
  Synthetic
caccgctgtcccaaaaggtcgtataggtgctcccatcgacgccggcaaaaagtagcatcacaatcaagaccttagcccagttccccaccatggaatagtacgcaaggcccgccaggactccatatcagcagccagggcct

SEQ ID NO: 389313 - DNA, 140 bp, Artificial Sequence
  Synthetic
atacgccatgctgggtctcccacatcaatagaactgctctgaactgcaatgaatccctcaccaccgggtttctcgccgcgctgttctacacaaataagttcaacgcgtccgggtgcccagcgtacttgggagtcggccat

SEQ ID NO: 389314 - DNA, 140 bp, Artificial Sequence
  Synthetic
atggccgactcccaagtacgctgggcacccggacgcgttgaacttatttgtgtagaacagcgcggcgagaaacccggtggtgagggattcattgcagttcagagcagttctattgatgtgggagacccagcatggcgtat

SEQ ID NO: 389315 - DNA, 140 bp, Artificial Sequence
  Synthetic
atacgccatgctgggtctccatcactgcttatactcagcagactcgtggccttctaggtgctatcgtggtcagcctgactggtcgcgacaagaatgagcaggcagggcaggtccaggttccgtacttgggagtcggccat

SEQ ID NO: 389316 - DNA, 140 bp, Artificial Sequence
  Synthetic
atggccgactcccaagtacggaacctggacctgccctgcctgctcattcttgtcgcgaccagtcaggctgaccacgatagcacctagaaggccacgagtctgctgagtataagcagtgatggagacccagcatggcgtat

SEQ ID NO: 389317 - DNA, 140 bp, Artificial Sequence
  Synthetic
aggccctggctgctgatatgggaggccattacgtgcaaatggccatcatcaagttaggggcgcttactggcacttatgtttacaaccatctcactccccttcgggactgggcgcacaacggaccttttgggacagcggtg

SEQ ID NO: 389318 - DNA, 140 bp, Artificial Sequence
  Synthetic
caccgctgtcccaaaaggtccgttgtgcgcccagtcccgaaggggagtgagatggttgtaaacataagtgccagtaagcgcccctaacttgatgatggccatttgcacgtaatggcctcccatatcagcagccagggcct

SEQ ID NO: 389319 - DNA, 140 bp, Artificial Sequence
  Synthetic
aggccctggctgctgatatgagatgaccggcggggtgcactactctcgccgaggcctctttcaaccctcaagggatcatccggtggacccgtgctttgctccagaggacatgccgtgggcgaccttttgggacagcggtg

SEQ ID NO: 389320 - DNA, 140 bp, Artificial Sequence
  Synthetic
caccgctgtcccaaaaggtcgcccacggcatgtcctctggagcaaagcacgggtccaccggatgatcccttgagggttgaaagaggcctcggcgagagtagtgcaccccgccggtcatctcatatcagcagccagggcct

SEQ ID NO: 389321 - DNA, 140 bp, Artificial Sequence
  Synthetic
atacgccatgctgggtctccagaaccggagtacggactgtgaccactggggaccccatcacttattccacttatggcaaattccttgcagacgaaggttgctcagctggcgcctatgacgcgtacttgggagtcggccat

SEQ ID NO: 389322 - DNA, 140 bp, Artificial Sequence
  Synthetic
atggccgactcccaagtacgcgtcataggcgccagctgagcaaccttcgtctgcaaggaatttgccataagtggaataagtgatggggtccccagtggtcacagtccgtactccggttctggagacccagcatggcgtat

SEQ ID NO: 389323 - DNA, 140 bp, Artificial Sequence
  Synthetic
aggccctggctgctgatatgttcagggccgcggtgtgcacccgtggagtggctaaggcggtggacttcatccctgtggagaacctagagacaaccatgaggtccccggtgttcacggacagaccttttgggacagcggtg

SEQ ID NO: 389324 - DNA, 140 bp, Artificial Sequence
  Synthetic
caccgctgtcccaaaaggtctgtccgtgaacaccggggacctcatggttgtctctaggttctccacagggatgaagtccaccgccttagccactccacgggtgcacaccgcggccctgaacatatcagcagccagggcct

SEQ ID NO: 389325 - DNA, 140 bp, Artificial Sequence
  Synthetic
atacgccatgctgggtctccccctgtggagaacctagagacaaccatgaggtccccggtgttcacggacaactcctctccaccagcagtgccccagagcttccaggtggcccacctgcatcgtacttgggagtcggccat

SEQ ID NO: 389326 - DNA, 140 bp, Artificial Sequence
  Synthetic
atggccgactcccaagtacgatgcaggtgggccacctggaagctctggggcactgctggtggagaggagttgtccgtgaacaccggggacctcatggttgtctctaggttctccacagggggagacccagcatggcgtat

SEQ ID NO: 389327 - DNA, 140 bp, Artificial Sequence
  Synthetic
atacgccatgctgggtctcctttggccacggccacgcctcctggtacagtgacaactccccatagtaacatagaggaggtggctcttggtcatgaaggcgagatccctttttacggcaagcgtacttgggagtcggccat

SEQ ID NO: 389328 - DNA, 140 bp, Artificial Sequence
  Synthetic
atggccgactcccaagtacgcttgccgtaaaaagggatctcgccttcatgaccaagagccacctcctctatgttactatggggagttgtcactgtaccaggaggcgtggccgtggccaaaggagacccagcatggcgtat

SEQ ID NO: 389329 - DNA, 140 bp, Artificial Sequence
  Synthetic
aggccctggctgctgatatgagggctggggccctatcagctacaccaacgtaagtggccccgaacaacggccctactgctggcactaccccccaaaaccttgtggcatcgtgccagcacagaccttttgggacagcggtg

SEQ ID NO: 389330 - DNA, 140 bp, Artificial Sequence
  Synthetic
caccgctgtcccaaaaggtctgtgctggcacgatgccacaaggttttggggggtagtgccagcagtagggccgttgttcggggccacttacgttggtgtagctgatagggccccagccctcatatcagcagccagggcct

SEQ ID NO: 389331 - DNA, 140 bp, Artificial Sequence
  Synthetic
atacgccatgctgggtctccgaacttacgcccgccgagactacagtgagactccgggcctatttcaacacgcccggcctgcccgtgtgtcaagaccacctggaattctgggaggctgtctcgtacttgggagtcggccat

SEQ ID NO: 389332 - DNA, 140 bp, Artificial Sequence
  Synthetic
atggccgactcccaagtacgagacagcctcccagaattccaggtggtcttgacacacgggcaggccgggcgtgttgaaataggcccggagtctcactgtagtctcggcgggcgtaagttcggagacccagcatggcgtat

SEQ ID NO: 389333 - DNA, 140 bp, Artificial Sequence
  Synthetic
atacgccatgctgggtctcctagggcaaaggctccccctccttcgtgggacgtgatgtggaagtgtctaactaggctcaaacctacactgactggtcctacccccctcctgtaccgcttgcgtacttgggagtcggccat

SEQ ID NO: 389334 - DNA, 140 bp, Artificial Sequence
  Synthetic
atggccgactcccaagtacgcaagcggtacaggaggggggtaggaccagtcagtgtaggtttgagcctagttagacacttccacatcacgtcccacgaaggagggggagcctttgccctaggagacccagcatggcgtat

SEQ ID NO: 389335 - DNA, 140 bp, Artificial Sequence
  Synthetic
atacgccatgctgggtctccaaagaccctagccggctcaaagggcccaattgtccagatgtacaccaatgtagaccaggacctcgttggttggcaagcgccccccggagcgcgctccctgcgtacttgggagtcggccat

SEQ ID NO: 389336 - DNA, 140 bp, Artificial Sequence
  Synthetic
atggccgactcccaagtacgcagggagcgcgctccggggggcgcttgccaaccaacgaggtcctggtctacattggtgtacatctggacaattgggccctttgagccggctagggtctttggagacccagcatggcgtat

SEQ ID NO: 389337 - DNA, 140 bp, Artificial Sequence
  Synthetic
aggccctggctgctgatatgtgaacccgtctgttgctgccaccttaggttttggggcgtatatgtctaaggcacatggtgtcgaccctaacattagaactggggtaaggaccatcaccacgaccttttgggacagcggtg

SEQ ID NO: 389338 - DNA, 140 bp, Artificial Sequence
  Synthetic
caccgctgtcccaaaaggtcgtggtgatggtccttaccccagttctaatgttagggtcgacaccatgtgccttagacatatacgccccaaaacctaaggtggcagcaacagacgggttcacatatcagcagccagggcct

SEQ ID NO: 389339 - DNA, 140 bp, Artificial Sequence
  Synthetic
atacgccatgctgggtctccctataggttggggtcggtgcaaaatgaggtcacattgacccacccagtaaccaaatacatcatggcctgcatgtcggcggatctagaagtggtgaccagccgtacttgggagtcggccat

SEQ ID NO: 389340 - DNA, 140 bp, Artificial Sequence
  Synthetic
atggccgactcccaagtacggctggtcaccacttctagatccgccgacatgcaggccatgatgtatttggttactgggtgggtcaatgtgacctcattttgcaccgaccccaacctatagggagacccagcatggcgtat

SEQ ID NO: 389341 - DNA, 140 bp, Artificial Sequence
  Synthetic
aggccctggctgctgatatgagacaaagaccttgtgggctggcccgctcctcaaggctcccgttcattgacgccctgcacctgcggctcctcggacctctacctggtcacgaggcacgctgaccttttgggacagcggtg

SEQ ID NO: 389342 - DNA, 140 bp, Artificial Sequence
  Synthetic
caccgctgtcccaaaaggtcagcgtgcctcgtgaccaggtagaggtccgaggagccgcaggtgcagggcgtcaatgaacgggagccttgaggagcgggccagcccacaaggtctttgtctcatatcagcagccagggcct

SEQ ID NO: 389343 - DNA, 140 bp, Artificial Sequence
  Synthetic
aggccctggctgctgatatggtgagccttctgtaccatctgagtacttgatcaggaggaaaaagttcccaccggcactacctccctggggccgtccagactacaaccctcctgttattgagaccttttgggacagcggtg

SEQ ID NO: 389344 - DNA, 140 bp, Artificial Sequence
  Synthetic
caccgctgtcccaaaaggtctcaataacaggagggttgtagtctggacggccccagggaggtagtgccggtgggaactttttcctcctgatcaagtactcagatggtacagaaggctcaccatatcagcagccagggcct

SEQ ID NO: 389345 - DNA, 140 bp, Artificial Sequence
  Synthetic
aggccctggctgctgatatgaagcggacggtggtcctcactgaatcaaccgtatctactgccttggccgagcttgccaccaaaagctttggcagctcctcaacttccggtattacgggcggaccttttgggacagcggtg

SEQ ID NO: 389346 - DNA, 140 bp, Artificial Sequence
  Synthetic
caccgctgtcccaaaaggtccgcccgtaataccggaagttgaggagctgccaaagcttttggtggcaagctcggccaaggcagtagatacggttgattcagtgaggaccaccgtccgcttcatatcagcagccagggcct

SEQ ID NO: 389347 - DNA, 140 bp, Artificial Sequence
  Synthetic
aggccctggctgctgatatggacaccgccgcgtgcggtgacatcatcaacggcttgcccgtctctgcccgcaggggccgagagatactgctcggaccagctgatggaatggtctccaagggaccttttgggacagcggtg

SEQ ID NO: 389348 - DNA, 140 bp, Artificial Sequence
  Synthetic
caccgctgtcccaaaaggtcccttggagaccattccatcagctggtccgagcagtatctctcggcccctgcgggcagagacgggcaagccgttgatgatgtcaccgcacgcggcggtgtccatatcagcagccagggcct

SEQ ID NO: 389349 - DNA, 140 bp, Artificial Sequence
  Synthetic
aggccctggctgctgatatgactctttcgacccgcttcgagcggaggaggatgagagggaggtgtccattccggcagagatcctgcggaaatccaagaggttccccccggcgatgcccatgaccttttgggacagcggtg

SEQ ID NO: 389350 - DNA, 140 bp, Artificial Sequence
  Synthetic
caccgctgtcccaaaaggtcatgggcatcgccggggggaacctcttggatttccgcaggatctctgccggaatggacacctccctctcatcctcctccgctcgaagcgggtcgaaagagtcatatcagcagccagggcct

SEQ ID NO: 389351 - DNA, 140 bp, Artificial Sequence
  Synthetic
aggccctggctgctgatatgcagccctccgatgacggtgacgcaggatccgacgttgagtcgtactcctccatgcccccccttgagggagagccgggggaccccgatctcagcgacgggtgaccttttgggacagcggtg

SEQ ID NO: 389352 - DNA, 140 bp, Artificial Sequence
  Synthetic
caccgctgtcccaaaaggtcacccgtcgctgagatcggggtcccccggctctccctcaagggggggcatggaggagtacgactcaacgtcggatcctgcgtcaccgtcatcggagggctgcatatcagcagccagggcct

SEQ ID NO: 389353 - DNA, 140 bp, Artificial Sequence
  Synthetic
aggccctggctgctgatatgtacgtgccggagagcgatgcagctgcccgcgtcactgccatactcagcagcctcactgtgacccagctcctgaggcgactacaccagtggataagctcgggaccttttgggacagcggtg

SEQ ID NO: 389354 - DNA, 140 bp, Artificial Sequence
  Synthetic
caccgctgtcccaaaaggtcccgagcttatccactggtgtagtcgcctcaggagctgggtcacagtgaggctgctgagtatggcagtgacgcgggcagctgcatcgctctccggcacgtacatatcagcagccagggcct

SEQ ID NO: 389355 - DNA, 140 bp, Artificial Sequence
  Synthetic
atacgccatgctgggtctccgcatcgggtggggaaccttggaatatgagactaatgtcaccaatgatgaagacatgcggccatactgctggcattaccctccgaagccttgcggtatcgtcgtacttgggagtcggccat

SEQ ID NO: 389356 - DNA, 140 bp, Artificial Sequence
  Synthetic
atggccgactcccaagtacgacgataccgcaaggcttcggagggtaatgccagcagtatggccgcatgtcttcatcattggtgacattagtctcatattccaaggttccccacccgatgcggagacccagcatggcgtat

SEQ ID NO: 389357 - DNA, 140 bp, Artificial Sequence
  Synthetic
atacgccatgctgggtctccatggcatgggatatgatgatgaactggtcccctacaacagcgctggtagtagctcagctgctcagggtcccgcaagccatcttggacatgatcgctggtgcgtacttgggagtcggccat

SEQ ID NO: 389358 - DNA, 140 bp, Artificial Sequence
  Synthetic
atggccgactcccaagtacgcaccagcgatcatgtccaagatggcttgcgggaccctgagcagctgagctactaccagcgctgttgtaggggaccagttcatcatcatatcccatgccatggagacccagcatggcgtat

SEQ ID NO: 389359 - DNA, 140 bp, Artificial Sequence
  Synthetic
aggccctggctgctgatatgtatccttgtactatcaactacaccctgttcaaagtcaggatgtacgtgggaggggtcgagcacaggctggaagttgcttgcaactggacgcggggcgagcgaccttttgggacagcggtg

SEQ ID NO: 389360 - DNA, 140 bp, Artificial Sequence
  Synthetic
caccgctgtcccaaaaggtcgctcgccccgcgtccagttgcaagcaacttccagcctgtgctcgacccctcccacgtacatcctgactttgaacagggtgtagttgatagtacaaggatacatatcagcagccagggcct

SEQ ID NO: 389361 - DNA, 140 bp, Artificial Sequence
  Synthetic
aggccctggctgctgatatgggagtcctggcgggccttgcctactattccatggtggggaactgggctaaggtgctgattgtgatgctgctctttgccggcgttgacggagagactcacggaccttttgggacagcggtg

SEQ ID NO: 389362 - DNA, 140 bp, Artificial Sequence
  Synthetic
caccgctgtcccaaaaggtccgtgagtctctccgtcaacgccggcaaagagcagcatcacaatcagcaccttagcccagttccccaccatggaatagtaggcaaggcccgccaggactcccatatcagcagccagggcct

SEQ ID NO: 389363 - DNA, 140 bp, Artificial Sequence
  Synthetic
atacgccatgctgggtctccgcacatcaataggactgccctcaactgcaatgactccctcaacaccgggttccttgccgcgctgttctacagacacgggttcaacgcgtccggatgcctacgtacttgggagtcggccat

SEQ ID NO: 389364 - DNA, 140 bp, Artificial Sequence
  Synthetic
atggccgactcccaagtacgtaggcatccggacgcgttgaacccgtgtctgtagaacagcgcggcaaggaacccggtgttgagggagtcattgcagttgagggcagtcctattgatgtgcggagacccagcatggcgtat

SEQ ID NO: 389365 - DNA, 140 bp, Artificial Sequence
  Synthetic
aggccctggctgctgatatgttgagggggagccgggggaccccgatctcagcgacgggtcttggtccactgtgagcgaggaggctggtgaggacgtcgtctgctgctcgatgtcctacacgaccttttgggacagcggtg

SEQ ID NO: 389366 - DNA, 140 bp, Artificial Sequence
  Synthetic
caccgctgtcccaaaaggtcgtgtaggacatcgagcagcagacgacgtcctcaccagcctcctcgctcacagtggaccaagacccgtcgctgagatcggggtcccccggctccccctcaacatatcagcagccagggcct

SEQ ID NO: 389367 - DNA, 140 bp, Artificial Sequence
  Synthetic
aggccctggctgctgatatgtcctgcttgctgcaggggtaggcatctacctcctccccaaccgatgaaggttggggtaaacactccggcctcttaggccattcctgttttttttttttttgaccttttgggacagcggtg

SEQ ID NO: 389368 - DNA, 140 bp, Artificial Sequence
  Synthetic
caccgctgtcccaaaaggtcaaaaaaaaaaaaaacaggaatggcctaagaggccggagtgtttaccccaaccttcatcggttggggaggaggtagatgcctacccctgcagcaagcaggacatatcagcagccagggcct

SEQ ID NO: 389369 - DNA, 140 bp, Artificial Sequence
  Synthetic
atacgccatgctgggtctcctccaatcacctacactgtgccccgcgaccaggaccagaggccctattgctggcactacgcgccaaagccgtgtggtattattcccgcgtcgcaggtgtgtcgtacttgggagtcggccat

SEQ ID NO: 389370 - DNA, 140 bp, Artificial Sequence
  Synthetic
atggccgactcccaagtacgacacacctgcgacgcgggaataataccacacggctttggcgcgtagtgccagcaatagggcctctggtcctggtcgcggggcacagtgtaggtgattggaggagacccagcatggcgtat

SEQ ID NO: 389371 - DNA, 140 bp, Artificial Sequence
  Synthetic
atacgccatgctgggtctcccctatgctctctatggcacatggccgctactcctgctcttgctggcgttacccccacgagcttacgccttagaccgggagatggccgcatcgtgtggaggcgtacttgggagtcggccat

SEQ ID NO: 389372 - DNA, 140 bp, Artificial Sequence
  Synthetic
atggccgactcccaagtacgcctccacacgatgcggccatctcccggtctaaggcgtaagctcgtgggggtaacgccagcaagagcaggagtagcggccatgtgccatagagagcataggggagacccagcatggcgtat

SEQ ID NO: 389373 - DNA, 140 bp, Artificial Sequence
  Synthetic
aggccctggctgctgatatgcagaacatccagctgatcaacaccaacggcagttggcacatcaatagcacggccttgaactgcaatgatagccttcacaccggctggatagcagggctctgaccttttgggacagcggtg

SEQ ID NO: 389374 - DNA, 140 bp, Artificial Sequence
  Synthetic
caccgctgtcccaaaaggtcagagccctgctatccagccggtgtgaaggctatcattgcagttcaaggccgtgctattgatgtgccaactgccgttggtgttgatcagctggatgttctgcatatcagcagccagggcct

SEQ ID NO: 389375 - DNA, 140 bp, Artificial Sequence
  Synthetic
aggccctggctgctgatatggaccatgtggtattgtgcccgcaaagagcgtgtgtggcccggtgtattgcttcactcccagccctgtggtggtgggaacgaccgacaggtcgggcgcgccgaccttttgggacagcggtg

SEQ ID NO: 389376 - DNA, 140 bp, Artificial Sequence
  Synthetic
caccgctgtcccaaaaggtcggcgcgcccgacctgtcggtcgttcccaccaccacagggctgggagtgaagcaatacaccgggccacacacgctctttgcgggcacaataccacatggtccatatcagcagccagggcct

SEQ ID NO: 389377 - DNA, 140 bp, Artificial Sequence
  Synthetic
aggccctggctgctgatatgttcactcccagccctgtggtggtgggaacgaccgacaggtcgggcgcgcctacctacaactggggtgaaaatgatacggacgtcttcgtcctcaacaacagaccttttgggacagcggtg

SEQ ID NO: 389378 - DNA, 140 bp, Artificial Sequence
  Synthetic
caccgctgtcccaaaaggtctgttgttgaggacgaagacgtccgtatcattttcaccccagttgtaggtaggcgcgcccgacctgtcggtcgttcccaccaccacagggctgggagtgaacatatcagcagccagggcct

SEQ ID NO: 389379 - DNA, 140 bp, Artificial Sequence
  Synthetic
atacgccatgctgggtctccgatatgtgctgcagtgttgcgccggcatgtaggccctggggaaggagcagtgcagtggatgaacagactcatagcgttcgcatctcgggggaaccatgtacgtacttgggagtcggccat

SEQ ID NO: 389380 - DNA, 140 bp, Artificial Sequence
  Synthetic
atggccgactcccaagtacgtacatggttcccccgagatgcgaacgctatgagtctgttcatccactgcactgctccttccccagggcctacatgccggcgcaacactgcagcacatatcggagacccagcatggcgtat

SEQ ID NO: 389381 - DNA, 140 bp, Artificial Sequence
  Synthetic
  misc_feature (41)..(41): n is a, c, g, or t
  misc_feature (105)..(105): n is a, c, g, or t
  misc_feature (112)..(112): n is a, c, g, or t
atacgccatgctgggtctccatcacctggcaactcaccaangcggtcctccaccttcctggatgcgtcccatgtgagaatgataatggcaccctgcgctgctggntacaagnaacacctacgtacttgggagtcggccat

SEQ ID NO: 389382 - DNA, 140 bp, Artificial Sequence
  Synthetic
  misc_feature (29)..(29): n is a, c, g, or t
  misc_feature (36)..(36): n is a, c, g, or t
  misc_feature (100)..(100): n is a, c, g, or t
atggccgactcccaagtacgtaggtgttncttgtanccagcagcgcagggtgccattatcattctcacatgggacgcatccaggaaggtggaggaccgcnttggtgagttgccaggtgatggagacccagcatggcgtat

SEQ ID NO: 389383 - DNA, 140 bp, Artificial Sequence
  Synthetic
  misc_feature (52)..(52): n is a, c, g, or t
atacgccatgctgggtctccacgtggctgtgaaataccgcggcgcactcacncacaacctgcgaacacacgtcgatatgatcgtaatggcagctacggtctgctcggccttgtatgtgggcgtacttgggagtcggccat

SEQ ID NO: 389384 - DNA, 140 bp, Artificial Sequence
  Synthetic
  misc_feature (89)..(89): n is a, c, g, or t
atggccgactcccaagtacgcccacatacaaggccgagcagaccgtagctgccattacgatcatatcgacgtgtgttcgcaggttgtgngtgagtgcgccgcggtatttcacagccacgtggagacccagcatggcgtat

SEQ ID NO: 389385 - DNA, 140 bp, Artificial Sequence
  Synthetic
aggccctggctgctgatatgatgatacggacgtcttcgtcctcaacaacaccaggccaccgttgggcaattggttcggttgtacctggatgaactcaactggattcaccaaagtgtgcgggaccttttgggacagcggtg

SEQ ID NO: 389386 - DNA, 140 bp, Artificial Sequence
  Synthetic
caccgctgtcccaaaaggtcccgcacactttggtgaatccagttgagttcatccaggtacaaccgaaccaattgcccaacggtggcctggtgttgttgaggacgaagacgtccgtatcatcatatcagcagccagggcct

SEQ ID NO: 389387 - DNA, 140 bp, Artificial Sequence
  Synthetic
atacgccatgctgggtctccatgtcattccggtgcgccggcggggcgacagcagggggagcctactctcccccaggcccgtctcctacttgaagggctcttcgggcggcccactgctctgcgtacttgggagtcggccat

SEQ ID NO: 389388 - DNA, 140 bp, Artificial Sequence
  Synthetic
atggccgactcccaagtacgcagagcagtgggccgcccgaagagcccttcaagtaggagacgggcctgggggagagtaggctccccctgctgtcgccccgccggcgcaccggaatgacatggagacccagcatggcgtat

SEQ ID NO: 389389 - DNA, 140 bp, Artificial Sequence
  Synthetic
atacgccatgctgggtctcccagcaccctcgatttactgtgccccacagactgttttagaaagcacccagacactacctatctcaagtgcggagcagggccttggttgactcccaaatgccgtacttgggagtcggccat

SEQ ID NO: 389390 - DNA, 140 bp, Artificial Sequence
  Synthetic
atggccgactcccaagtacggcatttgggagtcaaccaaggccctgctccgcacttgagataggtagtgtctgggtgctttctaaaacagtctgtggggcacagtaaatcgagggtgctgggagacccagcatggcgtat

SEQ ID NO: 389391 - DNA, 140 bp, Artificial Sequence
  Synthetic
aggccctggctgctgatatgtacacgattacccggtggggtcgcaattgccttgcgagcccgaaccggacgtggccgtgttgacgtccatgctcaccgatccctcccatataacagcagagaccttttgggacagcggtg

SEQ ID NO: 389392 - DNA, 140 bp, Artificial Sequence
  Synthetic
caccgctgtcccaaaaggtctctgctgttatatgggagggatcggtgagcatggacgtcaacacggccacgtccggttcgggctcgcaaggcaattgcgaccccaccgggtaatcgtgtacatatcagcagccagggcct

SEQ ID NO: 389393 - DNA, 140 bp, Artificial Sequence
  Synthetic
aggccctggctgctgatatggctatcacgaagtacatcgtgaagtgggagtgggtgatcctccttttcttgttgttggccgacgccagggtttgcgcgtgcctctggatgctcatcatacgaccttttgggacagcggtg

SEQ ID NO: 389394 - DNA, 140 bp, Artificial Sequence
  Synthetic
caccgctgtcccaaaaggtcgtatgatgagcatccagaggcacgcgcaaaccctggcgtcggccaacaacaagaaaaggaggatcacccactcccacttcacgatgtacttcgtgatagccatatcagcagccagggcct

SEQ ID NO: 389395 - DNA, 140 bp, Artificial Sequence
  Synthetic
  misc_feature (87)..(87): n is a, c, g, or t
  misc_feature (100)..(100): n is a, c, g, or t
atacgccatgctgggtctccggcctggtacctaaagggcagggtggtccccgtggccacgtactctgctctcggcttgtggtctttnctcctcctagtcntagccttgccacagcaggctcgtacttgggagtcggccat

SEQ ID NO: 389396 - DNA, 140 bp, Artificial Sequence
  Synthetic
  misc_feature (41)..(41): n is a, c, g, or t
  misc_feature (54)..(54): n is a, c, g, or t
atggccgactcccaagtacgagcctgctgtggcaaggctangactaggaggagnaaagaccacaagccgagagcagagtacgtggccacggggaccaccctgccctttaggtaccaggccggagacccagcatggcgtat

SEQ ID NO: 389397 - DNA, 140 bp, Artificial Sequence
  Synthetic
atacgccatgctgggtctcccgaagaccctagctggcccaaagggtcccatcacccaaatgtacaccaatgtagaccaagatcttgttggctggcaggcgccccctggagcgcgctccatcgtacttgggagtcggccat

SEQ ID NO: 389398 - DNA, 140 bp, Artificial Sequence
  Synthetic
atggccgactcccaagtacgatggagcgcgctccagggggcgcctgccagccaacaagatcttggtctacattggtgtacatttgggtgatgggaccctttgggccagctagggtcttcgggagacccagcatggcgtat

SEQ ID NO: 389399 - DNA, 140 bp, Artificial Sequence
  Synthetic
atacgccatgctgggtctccccttgtggggaagactttacaggacacgtaaggaatgggtccatgaggatagcaggatcaggcctctgcgctaacatgtggcatggcaccttccccatcacgtacttgggagtcggccat

SEQ ID NO: 389400 - DNA, 140 bp, Artificial Sequence
  Synthetic
atggccgactcccaagtacgtgatggggaaggtgccatgccacatgttagcgcagaggcctgatcctgctatcctcatggacccattccttacgtgtcctgtaaagtcttccccacaaggggagacccagcatggcgtat

SEQ ID NO: 389401 - DNA, 140 bp, Artificial Sequence
  Synthetic
atacgccatgctgggtctccgagggcgtctttacgggcctcacccatatagatgcccacttcctatcccagacaaagcagagtggggagaactttccttacctggtagcgtaccaagccacgtacttgggagtcggccat

SEQ ID NO: 389402 - DNA, 140 bp, Artificial Sequence
  Synthetic
atggccgactcccaagtacgtggcttggtacgctaccaggtaaggaaagttctccccactctgctttgtctgggataggaagtgggcatctatatgggtgaggcccgtaaagacgccctcggagacccagcatggcgtat

SEQ ID NO: 389403 - DNA, 140 bp, Artificial Sequence
  Synthetic
  misc_feature (89)..(89): n is a, c, g, or t
  misc_feature (117)..(117): n is a, c, g, or t
aggccctggctgctgatatgcaggtccaggttctgtcctctgtcacacagtctttcttggggacatgtatctcgggggtcctctggacngtatatcatggagctggcaataagaccntgggaccttttgggacagcggtg

SEQ ID NO: 389404 - DNA, 140 bp, Artificial Sequence
  Synthetic
  misc_feature (24)..(24): n is a, c, g, or t
  misc_feature (52)..(52): n is a, c, g, or t
caccgctgtcccaaaaggtcccanggtcttattgccagctccatgatatacngtccagaggacccccgagatacatgtccccaagaaagactgtgtgacagaggacagaacctggacctgcatatcagcagccagggcct

SEQ ID NO: 389405 - DNA, 140 bp, Artificial Sequence
  Synthetic
  misc_feature (72)..(72): n is a, c, g, or t
  misc_feature (85)..(85): n is a, c, g, or t
  misc_feature (99)..(99): n is a, c, g, or t
atacgccatgctgggtctccttgtggagccgtggacctctacctggtcactcgaaacgctgatgtcattccngtccgaaggaaanatgaccggcggggngcactactctcgccaaggccccgtacttgggagtcggccat

SEQ ID NO: 389406 - DNA, 140 bp, Artificial Sequence
  Synthetic
  misc_feature (42)..(42): n is a, c, g, or t
  misc_feature (56)..(56): n is a, c, g, or t
  misc_feature (69)..(69): n is a, c, g, or t
atggccgactcccaagtacggggccttggcgagagtagtgcnccccgccggtcatntttccttcggacnggaatgacatcagcgtttcgagtgaccaggtagaggtccacggctccacaaggagacccagcatggcgtat

SEQ ID NO: 389407 - DNA, 140 bp, Artificial Sequence
  Synthetic
  misc_feature (35)..(35): n is a, c, g, or t
  misc_feature (70)..(70): n is a, c, g, or t
  misc_feature (91)..(91): n is a, c, g, or t
atacgccatgctgggtctccaatccattgacttcntccctgttgaatctcttgacatcgccacacggtcncccagtttctctgacaacagnacgccaccagctgtgccccagacttaccacgtacttgggagtcggccat

SEQ ID NO: 389408 - DNA, 140 bp, Artificial Sequence
  Synthetic
  misc_feature (50)..(50): n is a, c, g, or t
  misc_feature (71)..(71): n is a, c, g, or t
  misc_feature (106)..(106): n is a, c, g, or t
atggccgactcccaagtacgtggtaagtctggggcacagctggtggcgtnctgttgtcagagaaactgggngaccgtgtggcgatgtcaagagattcaacagggangaagtcaatggattggagacccagcatggcgtat

SEQ ID NO: 389409 - DNA, 140 bp, Artificial Sequence
  Synthetic
  misc_feature (68)..(68): n is a, c, g, or t
  misc_feature (97)..(97): n is a, c, g, or t
  misc_feature (115)..(115): n is a, c, g, or t
atacgccatgctgggtctcctcacctactccacgtatggcaagtttctcgcagacggaggctgctcanctggagcctatgacgtcatcatatgcgangaatgccatgcggtggangccaccgtacttgggagtcggccat

SEQ ID NO: 389410 - DNA, 140 bp, Artificial Sequence
  Synthetic
  misc_feature (26)..(26): n is a, c, g, or t
  misc_feature (44)..(44): n is a, c, g, or t
  misc_feature (73)..(73): n is a, c, g, or t
atggccgactcccaagtacggtggcntccaccgcatggcattcntcgcatatgatgacgtcataggctccagntgagcagcctccgtctgcgagaaacttgccatacgtggagtaggtgaggagacccagcatggcgtat

SEQ ID NO: 389411 - DNA, 140 bp, Artificial Sequence
  Synthetic
aggccctggctgctgatatgagacctggctgaaagccaagctcatgccacaactgcctgggattccctttgtgtcctgccagcgcgggtataggggggtctggcgaggagacggcatcatgaccttttgggacagcggtg

SEQ ID NO: 389412 - DNA, 140 bp, Artificial Sequence
  Synthetic
caccgctgtcccaaaaggtcatgatgccgtctcctcgccagacccccctatacccgcgctggcaggacacaaagggaatcccaggcagttgtggcatgagcttggctttcagccaggtctcatatcagcagccagggcct

SEQ ID NO: 389413 - DNA, 140 bp, Artificial Sequence
  Synthetic
atacgccatgctgggtctccgtcactcagattgttgactttagcctagacccaacttttaccattaccactcaaaccgtccctcaggacgctgtctcccgtagtcaacgtagagggagaacgtacttgggagtcggccat

SEQ ID NO: 389414 - DNA, 140 bp, Artificial Sequence
  Synthetic
atggccgactcccaagtacgttctccctctacgttgactacgggagacagcgtcctgagggacggtttgagtggtaatggtaaaagttgggtctaggctaaagtcaacaatctgagtgacggagacccagcatggcgtat

SEQ ID NO: 389415 - DNA, 140 bp, Artificial Sequence
  Synthetic
  misc_feature (91)..(91): n is a, c, g, or t
aggccctggctgctgatatgccttctgggatgttcgacagcgtagtgctctgcgagtgctatgatgccggggcagcctggtatgagctcangcccgctgagaccacagtgagactccggggaccttttgggacagcggtg

SEQ ID NO: 389416 - DNA, 140 bp, Artificial Sequence
  Synthetic
  misc_feature (50)..(50): n is a, c, g, or t
caccgctgtcccaaaaggtccccggagtctcactgtggtctcagcgggcntgagctcataccaggctgccccggcatcatagcactcgcagagcactacgctgtcgaacatcccagaaggcatatcagcagccagggcct

SEQ ID NO: 389417 - DNA, 140 bp, Artificial Sequence
  Synthetic
aggccctggctgctgatatgccagacgaagcaaggaggagacaactttgcgtatctgacggcttaccaggccacagtatgtgctagggcgaaagcccctcctccctcatgggacgtgatggaccttttgggacagcggtg

SEQ ID NO: 389418 - DNA, 140 bp, Artificial Sequence
  Synthetic
caccgctgtcccaaaaggtccatcacgtcccatgagggaggaggggctttcgccctagcacatactgtggcctggtaagccgtcagatacgcaaagttgtctcctccttgcttcgtctggcatatcagcagccagggcct

SEQ ID NO: 389419 - DNA, 140 bp, Artificial Sequence
  Synthetic
aggccctggctgctgatatgatggaagaatgcgcctccaaagccgccctcattgaggaagggcagaggatggcagaaatgctgaagtctaagatacaaggcctcttacaacaggccacaagaccttttgggacagcggtg

SEQ ID NO: 389420 - DNA, 140 bp, Artificial Sequence
  Synthetic
caccgctgtcccaaaaggtcttgtggcctgttgtaagaggccttgtatcttagacttcagcatttctgccatcctctgcccttcctcaatgagggcggctttggaggcgcattcttccatcatatcagcagccagggcct

SEQ ID NO: 389421 - DNA, 140 bp, Artificial Sequence
  Synthetic
  misc_feature (114)..(114): n is a, c, g, or t
atacgccatgctgggtctcccggggccactggcttcgttgtcagtggtttggtgggggcggccgtcggaagtataggcctgggtaagatattggtggacgttttggccgggtanggtgcacgtacttgggagtcggccat

SEQ ID NO: 389422 - DNA, 140 bp, Artificial Sequence
  Synthetic
  misc_feature (27)..(27): n is a, c, g, or t
atggccgactcccaagtacgtgcaccntacccggccaaaacgtccaccaatatcttacccaggcctatacttccgacggccgcccccaccaaaccactgacaacgaagccagtggccccgggagacccagcatggcgtat

SEQ ID NO: 389423 - DNA, 140 bp, Artificial Sequence
  Synthetic
  misc_feature (60)..(60): n is a, c, g, or t
aggccctggctgctgatatggccccgtctctgaaggctacctgtaccacccataagatgncatatgattgtgacatggtggatgccaatctcttcatgggaggtgatgtgacccggatcggaccttttgggacagcggtg

SEQ ID NO: 389424 - DNA, 140 bp, Artificial Sequence
  Synthetic
  misc_feature (81)..(81): n is a, c, g, or t
caccgctgtcccaaaaggtccgatccgggtcacatcacctcccatgaagagattggcatccaccatgtcacaatcatatgncatcttatgggtggtacaggtagccttcagagacggggccatatcagcagccagggcct

SEQ ID NO: 389425 - DNA, 140 bp, Artificial Sequence
  Synthetic
atacgccatgctgggtctccgagaaagttcccaccggcactacctccatgggcccatccagactataaccctcccacgattgagacatggaaggagccgggctataaaccacccactgtccgtacttgggagtcggccat

SEQ ID NO: 389426 - DNA, 140 bp, Artificial Sequence
  Synthetic
atggccgactcccaagtacggacagtgggtggtttatagcccggctccttccatgtctcaatcgtgggagggttatagtctggatgggcccatggaggtagtgccggtgggaactttctcggagacccagcatggcgtat

SEQ ID NO: 389427 - DNA, 140 bp, Artificial Sequence
  Synthetic
aggccctggctgctgatatgctcccacgattgagacatggaaggagccgggctataaaccacccactgtcctaggctgtgcccttccccccacgcctcaggtgccggtgcccccacctcggaccttttgggacagcggtg

SEQ ID NO: 389428 - DNA, 140 bp, Artificial Sequence
  Synthetic
caccgctgtcccaaaaggtccgaggtgggggcaccggcacctgaggcgtggggggaagggcacagcctaggacagtgggtggtttatagcccggctccttccatgtctcaatcgtgggagcatatcagcagccagggcct

SEQ ID NO: 389429 - DNA, 140 bp, Artificial Sequence
  Synthetic
  misc_feature (67)..(67): n is a, c, g, or t
atacgccatgctgggtctccggtcactccactggagtggacaccgggggagacagcgtccagcagcnctctgacgagattgccgcttcggaagcgggatcactgtcctccatgcctcccccgtacttgggagtcggccat

SEQ ID NO: 389430 - DNA, 140 bp, Artificial Sequence
  Synthetic
  misc_feature (74)..(74): n is a, c, g, or t
atggccgactcccaagtacgggggaggcatggaggacagtgatcccgcttccgaagcggcaatctcgtcagagngctgctggacgctgtctcccccggtgtccactccagtggagtgaccggagacccagcatggcgtat

SEQ ID NO: 389431 - DNA, 140 bp, Artificial Sequence
  Synthetic
aggccctggctgctgatatgtgacgagattgccgcttcggaagcgggatcactgtcctccatgcctcccctcgagggagagccgggagaccctgacctggagtttgaaccagctggatccgaccttttgggacagcggtg

SEQ ID NO: 389432 - DNA, 140 bp, Artificial Sequence
  Synthetic
caccgctgtcccaaaaggtcggatccagctggttcaaactccaggtcagggtctcccggctctccctcgaggggaggcatggaggacagtgatcccgcttccgaagcggcaatctcgtcacatatcagcagccagggcct

SEQ ID NO: 389433 - DNA, 140 bp, Artificial Sequence
  Synthetic
aggccctggctgctgatatgcccaaccgatgaaggttggggtaaacactccggcctcttaggccatttcctgttttttttttttttttttttttttttttttttccccccccctttttttgaccttttgggacagcggtg

SEQ ID NO: 389434 - DNA, 140 bp, Artificial Sequence
  Synthetic
caccgctgtcccaaaaggtcaaaaaaagggggggggaaaaaaaaaaaaaaaaaaaaaaaaaaaaaaaacaggaaatggcctaagaggccggagtgtttaccccaaccttcatcggttgggcatatcagcagccagggcct

SEQ ID NO: 389435 - DNA, 140 bp, Artificial Sequence
  Synthetic
atacgccatgctgggtctccttttcgtaggtctggttcttttgaccttgtcaccacactataaggcgctcctcgctaggctcatatggtggttgcaatatctaaccaccagagccgaggccgtacttgggagtcggccat

SEQ ID NO: 389436 - DNA, 140 bp, Artificial Sequence
  Synthetic
atggccgactcccaagtacggcctcggctctggtggttagatattgcaaccaccatatgagcctagcgaggagcgccttatagtgtggtgacaaggtcaaaagaaccagacctacgaaaaggagacccagcatggcgtat

SEQ ID NO: 389437 - DNA, 140 bp, Artificial Sequence
  Synthetic
  misc_feature (33)..(33): n is a, c, g, or t
  misc_feature (51)..(51): n is a, c, g, or t
  misc_feature (57)..(57): n is a, c, g, or t
  misc_feature (105)..(105): n is a, c, g, or t
aggccctggctgctgatatgggacactctgaancaaaatctcaattttganatgtanggggcagtatattcggtcaatccattagacctaccagccataattganaggttacatgggctggaccttttgggacagcggtg

SEQ ID NO: 389438 - DNA, 140 bp, Artificial Sequence
  Synthetic
  misc_feature (36)..(36): n is a, c, g, or t
  misc_feature (84)..(84): n is a, c, g, or t
  misc_feature (90)..(90): n is a, c, g, or t
  misc_feature (108)..(108): n is a, c, g, or t
caccgctgtcccaaaaggtccagcccatgtaacctntcaattatggctggtaggtctaatggattgaccgaatatactgccccntacatntcaaaattgagattttgnttcagagtgtcccatatcagcagccagggcct

SEQ ID NO: 389439 - DNA, 140 bp, Artificial Sequence
  Synthetic
aggccctggctgctgatatgtcaggctgtcctgagaggttggccagctgccgaccccttaccgattttgaccagggctggggccctatcagttatgccaacggaagcggccccgaccaacgaccttttgggacagcggtg

SEQ ID NO: 389440 - DNA, 140 bp, Artificial Sequence
  Synthetic
caccgctgtcccaaaaggtcgttggtcggggccgcttccgttggcataactgatagggccccagccctggtcaaaatcggtaaggggtcggcagctggccaacctctcaggacagcctgacatatcagcagccagggcct

SEQ ID NO: 389441 - DNA, 140 bp, Artificial Sequence
  Synthetic
aggccctggctgctgatatgggcccctggattacacccaggtgcctggtcgactacccgtataggctttggcattatccttgtaccatcaactacaccatatttaaaatcaggatgtacggaccttttgggacagcggtg

SEQ ID NO: 389442 - DNA, 140 bp, Artificial Sequence
  Synthetic
caccgctgtcccaaaaggtccgtacatcctgattttaaatatggtgtagttgatggtacaaggataatgccaaagcctatacgggtagtcgaccaggcacctgggtgtaatccaggggcccatatcagcagccagggcct

SEQ ID NO: 389443 - DNA, 140 bp, Artificial Sequence
  Synthetic
atacgccatgctgggtctccacgtgtggttttgccgacctcatggggtacatccctgtcgttggcgccccggtcggaggcgtcgccagagctctggcacacggtgttagggtcctggaggcgtacttgggagtcggccat

SEQ ID NO: 389444 - DNA, 140 bp, Artificial Sequence
  Synthetic
atggccgactcccaagtacgcctccaggaccctaacaccgtgtgccagagctctggcgacgcctccgaccggggcgccaacgacagggatgtaccccatgaggtcggcaaaaccacacgtggagacccagcatggcgtat

SEQ ID NO: 389445 - DNA, 140 bp, Artificial Sequence
  Synthetic
atacgccatgctgggtctccatgtgtccgtcataccggccagcggggacgtcgttgtcgtggcaacggacgctctaatgacgggctttaccggtgacttcgactcagtaatcgactgcaacgtacttgggagtcggccat

SEQ ID NO: 389446 - DNA, 140 bp, Artificial Sequence
  Synthetic
atggccgactcccaagtacgttgcagtcgattactgagtcgaagtcaccggtaaagcccgtcattagagcgtccgttgccacgacaacgacgtccccgctggccggtatgacggacacatggagacccagcatggcgtat

SEQ ID NO: 389447 - DNA, 140 bp, Artificial Sequence
  Synthetic
atacgccatgctgggtctccatctatcagtgctgtgacctggagcccgaggcccgcaaagcgataaccgcccttacagagagactctatttgggtggccccatgtacaacagcaagggggcgtacttgggagtcggccat

SEQ ID NO: 389448 - DNA, 140 bp, Artificial Sequence
  Synthetic
atggccgactcccaagtacgcccccttgctgttgtacatggggccacccaaatagagtctctctgtaagggcggttatcgctttgcgggcctcgggctccaggtcacagcactgatagatggagacccagcatggcgtat

SEQ ID NO: 389449 - DNA, 140 bp, Artificial Sequence
  Synthetic
atacgccatgctgggtctcccccacctacagctggggggaaaatgagaccgatgtctttctgctaaatagcacaagacccccgcaaggagcttggttcggctgcacttggatgaacgggacgtacttgggagtcggccat

SEQ ID NO: 389450 - DNA, 140 bp, Artificial Sequence
  Synthetic
atggccgactcccaagtacgtcccgttcatccaagtgcagccgaaccaagctccttgcgggggtcttgtgctatttagcagaaagacatcggtctcattttccccccagctgtaggtgggggagacccagcatggcgtat

SEQ ID NO: 389451 - DNA, 140 bp, Artificial Sequence
  Synthetic
atacgccatgctgggtctccattttcagcagcatgcaactttacgcgcggagaccgctgcagattggaggatagagataggggtcagcagagtccactgctgcattccaccactgagtggcgtacttgggagtcggccat

SEQ ID NO: 389452 - DNA, 140 bp, Artificial Sequence
  Synthetic
atggccgactcccaagtacgccactcagtggtggaatgcagcagtggactctgctgacccctatctctatcctccaatctgcagcggtctccgcgcgtaaagttgcatgctgctgaaaatggagacccagcatggcgtat

SEQ ID NO: 389453 - DNA, 140 bp, Artificial Sequence
  Synthetic
  misc_feature (77)..(77): n is a, c, g, or t
atacgccatgctgggtctccctccggctatcacgaagtacatcgtgaagtgggagtgggtgatcctccttttcttgntgttggccgacgccagggtttgcgcgtgcctctggatgctcatcgtacttgggagtcggccat

SEQ ID NO: 389454 - DNA, 140 bp, Artificial Sequence
  Synthetic
  misc_feature (64)..(64): n is a, c, g, or t
atggccgactcccaagtacgatgagcatccagaggcacgcgcaaaccctggcgtcggccaacancaagaaaaggaggatcacccactcccacttcacgatgtacttcgtgatagccggagggagacccagcatggcgtat

SEQ ID NO: 389455 - DNA, 140 bp, Artificial Sequence
  Synthetic
aggccctggctgctgatatggcaattgctcaatctatcccggccacgtatcaggtcatcgcatggcttgggatatgatgatgaactggtcacctacaacagccctagtggtgtcgcagttgaccttttgggacagcggtg

SEQ ID NO: 389456 - DNA, 140 bp, Artificial Sequence
  Synthetic
caccgctgtcccaaaaggtcaactgcgacaccactagggctgttgtaggtgaccagttcatcatcatatcccaagccatgcgatgacctgatacgtggccgggatagattgagcaattgccatatcagcagccagggcct

SEQ ID NO: 389457 - DNA, 140 bp, Artificial Sequence
  Synthetic
aggccctggctgctgatatgcccaatcaccaagtacatcatgacatgcatgtcggctgacctggaggtcgtcacgagtacctgggtgctcgttggcggcgttctggctgctttggccgcggaccttttgggacagcggtg

SEQ ID NO: 389458 - DNA, 140 bp, Artificial Sequence
  Synthetic
caccgctgtcccaaaaggtccgcggccaaagcagccagaacgccgccaacgagcacccaggtactcgtgacgacctccaggtcagccgacatgcatgtcatgatgtacttggtgattgggcatatcagcagccagggcct

SEQ ID NO: 389459 - DNA, 140 bp, Artificial Sequence
  Synthetic
aggccctggctgctgatatgcttcctgcgccgaactatacgttcgcgctgtggagggtgtctgcggaggaatacgtggaaataaggcaggtgggggacttccactacgtgacgggcatgagaccttttgggacagcggtg

SEQ ID NO: 389460 - DNA, 140 bp, Artificial Sequence
  Synthetic
caccgctgtcccaaaaggtctcatgcccgtcacgtagtggaagtcccccacctgccttatttccacgtattcctccgcagacaccctccacagcgcgaacgtatagttcggcgcaggaagcatatcagcagccagggcct

SEQ ID NO: 389461 - DNA, 140 bp, Artificial Sequence
  Synthetic
aggccctggctgctgatatgattaccaggacgtgctcaaggaggttaaggcagcggcgtcaaaagtgaaggctaacttgctatccgtagaggaagcttgcagcctgacgcccccacactcgaccttttgggacagcggtg

SEQ ID NO: 389462 - DNA, 140 bp, Artificial Sequence
  Synthetic
caccgctgtcccaaaaggtcgagtgtgggggcgtcaggctgcaagcttcctctacggatagcaagttagccttcacttttgacgccgctgccttaacctccttgagcacgtcctggtaatcatatcagcagccagggcct

SEQ ID NO: 389463 - DNA, 140 bp, Artificial Sequence
  Synthetic
atacgccatgctgggtctccggccttgcctactattccatggtggggaactgggctaaggtttttattgtgatgctactctttgccggcgttgacgggcggaccatcacggtagggggagcgtacttgggagtcggccat

SEQ ID NO: 389464 - DNA, 140 bp, Artificial Sequence
  Synthetic
atggccgactcccaagtacgctccccctaccgtgatggtccgcccgtcaacgccggcaaagagtagcatcacaataaaaaccttagcccagttccccaccatggaatagtaggcaaggccggagacccagcatggcgtat

SEQ ID NO: 389465 - DNA, 140 bp, Artificial Sequence
  Synthetic
atacgccatgctgggtctcctatgtcggtggtcctatgtacaactcaaagggccaatgttgtggataccgtcgatgcagggccagcggggtccttccaaccagcctaggcaacaccatgacgtacttgggagtcggccat

SEQ ID NO: 389466 - DNA, 140 bp, Artificial Sequence
  Synthetic
atggccgactcccaagtacgtcatggtgttgcctaggctggttggaaggaccccgctggccctgcatcgacggtatccacaacattggccctttgagttgtacataggaccaccgacataggagacccagcatggcgtat

SEQ ID NO: 389467 - DNA, 140 bp, Artificial Sequence
  Synthetic
aggccctggctgctgatatggaagcaccccgaggccacttacaccaaatgcggttcggggccttggctgacacctaggtgcttggttgactacccatacaggctttggcactacccctgcgaccttttgggacagcggtg

SEQ ID NO: 389468 - DNA, 140 bp, Artificial Sequence
  Synthetic
caccgctgtcccaaaaggtcgcaggggtagtgccaaagcctgtatgggtagtcaaccaagcacctaggtgtcagccaaggccccgaaccgcatttggtgtaagtggcctcggggtgcttccatatcagcagccagggcct

SEQ ID NO: 389469 - DNA, 140 bp, Artificial Sequence
  Synthetic
atacgccatgctgggtctcccgggagagccatagtgtctgcggaaccggtgagtacaccggaattgccaggacgaccgggtcctttcttggataacccgctcaatgcctggagatttgggcgtacttgggagtcggccat

SEQ ID NO: 389470 - DNA, 140 bp, Artificial Sequence
  Synthetic
atggccgactcccaagtacgcccaaatctccaggcattgagcgggttatccaagaaaggacccggtcgtcctggcaattccggtgtactcaccggttccgcagacactatggctctcccgggagacccagcatggcgtat

SEQ ID NO: 389471 - DNA, 140 bp, Artificial Sequence
  Synthetic
atacgccatgctgggtctccgacgccatcatcctcctgacgtgcatggtccacccagggctaatctttgacatcaccaaatacctgcttgccgtactcggtccgctcatggtactccaggcgtacttgggagtcggccat

SEQ ID NO: 389472 - DNA, 140 bp, Artificial Sequence
  Synthetic
atggccgactcccaagtacgcctggagtaccatgagcggaccgagtacggcaagcaggtatttggtgatgtcaaagattagccctgggtggaccatgcacgtcaggaggatgatggcgtcggagacccagcatggcgtat

SEQ ID NO: 389473 - DNA, 140 bp, Artificial Sequence
  Synthetic
aggccctggctgctgatatggcacatggcatcaatcccaacattaggactggagtcaggaccgtgatgaccggggaggccatcacgtactccacatatggcaaatttctcgccgatgggggaccttttgggacagcggtg

SEQ ID NO: 389474 - DNA, 140 bp, Artificial Sequence
  Synthetic
caccgctgtcccaaaaggtcccccatcggcgagaaatttgccatatgtggagtacgtgatggcctccccggtcatcacggtcctgactccagtcctaatgttgggattgatgccatgtgccatatcagcagccagggcct

SEQ ID NO: 389475 - DNA, 140 bp, Artificial Sequence
  Synthetic
atacgccatgctgggtctccgtggatgctacctccattctcggcatcggaacggtccttgatcaagcagagacagccggggtcagactaactgtgctggctacggccacaccccccgggtcgtacttgggagtcggccat

SEQ ID NO: 389476 - DNA, 140 bp, Artificial Sequence
  Synthetic
atggccgactcccaagtacgacccggggggtgtggccgtagccagcacagttagtctgaccccggctgtctctgcttgatcaaggaccgttccgatgccgagaatggaggtagcatccacggagacccagcatggcgtat

SEQ ID NO: 389477 - DNA, 140 bp, Artificial Sequence
  Synthetic
aggccctggctgctgatatgcggcggcccttcggggcatgggcttgaatgccgtggcatactatagagggttggacgtctccataataccagctcagggagatgtggtggtcgtcgccacgaccttttgggacagcggtg

SEQ ID NO: 389478 - DNA, 140 bp, Artificial Sequence
  Synthetic
caccgctgtcccaaaaggtcgtggcgacgaccaccacatctccctgagctggtattatggagacgtccaaccctctatagtatgccacggcattcaagcccatgccccgaagggccgccgcatatcagcagccagggcct

SEQ ID NO: 389479 - DNA, 140 bp, Artificial Sequence
  Synthetic
  misc_feature (81)..(81): n is a, c, g, or t
  misc_feature (94)..(94): n is a, c, g, or t
atacgccatgctgggtctcccctctttagtgctggtcccagtcagaaaatcagtttgatcaacaccaatggcagctggcanataaaccggaccnccctcaactgcaatgacagcttgcagcgtacttgggagtcggccat

SEQ ID NO: 389480 - DNA, 140 bp, Artificial Sequence
  Synthetic
  misc_feature (47)..(47): n is a, c, g, or t
  misc_feature (60)..(60): n is a, c, g, or t
atggccgactcccaagtacgctgcaagctgtcattgcagttgagggnggtccggtttatntgccagctgccattggtgttgatcaaactgattttctgactgggaccagcactaaagaggggagacccagcatggcgtat

SEQ ID NO: 389481 - DNA, 140 bp, Artificial Sequence
  Synthetic
aggccctggctgctgatatgcagacagtcgatttcagcttggaccctaccttcaccattgagacgacgaccgtgccccaagacgcggtgtcgcgctcgcagcggcgaggcaggactggtagaccttttgggacagcggtg

SEQ ID NO: 389482 - DNA, 140 bp, Artificial Sequence
  Synthetic
caccgctgtcccaaaaggtctaccagtcctgcctcgccgctgcgagcgcgacaccgcgtcttggggcacggtcgtcgtctcaatggtgaaggtagggtccaagctgaaatcgactgtctgcatatcagcagccagggcct

SEQ ID NO: 389483 - DNA, 140 bp, Artificial Sequence
  Synthetic
aggccctggctgctgatatgccggggtgagaacaattaccactggcagccccatcacgtactccacctacggcaagttccttgccgacggcgggtgctcagggggtgcttatgacataatgaccttttgggacagcggtg

SEQ ID NO: 389484 - DNA, 140 bp, Artificial Sequence
  Synthetic
caccgctgtcccaaaaggtcattatgtcataagcaccccctgagcacccgccgtcggcaaggaacttgccgtaggtggagtacgtgatggggctgccagtggtaattgttctcaccccggcatatcagcagccagggcct

SEQ ID NO: 389485 - DNA, 140 bp, Artificial Sequence
  Synthetic
aggccctggctgctgatatgcggtagggggcgtcgccagagctctggcacatggtgttagagtcctggaagacgggataaattacgcaacagggaacttacctggttgctctttctctatgaccttttgggacagcggtg

SEQ ID NO: 389486 - DNA, 140 bp, Artificial Sequence
  Synthetic
caccgctgtcccaaaaggtcatagagaaagagcaaccaggtaagttccctgttgcgtaatttatcccgtcttccaggactctaacaccatgtgccagagctctggcgacgccccctaccgcatatcagcagccagggcct

SEQ ID NO: 389487 - DNA, 140 bp, Artificial Sequence
  Synthetic
atacgccatgctgggtctccccatgctccggatcctggctccgcgacgtgtgggactgggtttgcaccatcttgacagacttcaaaaattggctgacctctaaattgttccccaagctgccgtacttgggagtcggccat

SEQ ID NO: 389488 - DNA, 140 bp, Artificial Sequence
  Synthetic
atggccgactcccaagtacggcagcttggggaacaatttagaggtcagccaatttttgaagtctgtcaagatggtgcaaacccagtcccacacgtcgcggagccaggatccggagcatggggagacccagcatggcgtat

SEQ ID NO: 389489 - DNA, 140 bp, Artificial Sequence
  Synthetic
aggccctggctgctgatatgacacctggcaggggacctttcctatcaattgctacacggagggccagtgcgcgccgaaaccccccacgaactacaagaccgccatctggagggtggcggcgaccttttgggacagcggtg

SEQ ID NO: 389490 - DNA, 140 bp, Artificial Sequence
  Synthetic
caccgctgtcccaaaaggtcgccgccaccctccagatggcggtcttgtagttcgtggggggtttcggcgcgcactggccctccgtgtagcaattgataggaaaggtcccctgccaggtgtcatatcagcagccagggcct

SEQ ID NO: 389491 - DNA, 140 bp, Artificial Sequence
  Synthetic
aggccctggctgctgatatgtttttctcctgggtggacggtgtgcagatccataggtttgcacccacaccaaagccgtttttccgggatgaggtctcgttctgcgttgggcttaattcctgaccttttgggacagcggtg

SEQ ID NO: 389492 - DNA, 140 bp, Artificial Sequence
  Synthetic
caccgctgtcccaaaaggtcaggaattaagcccaacgcagaacgagacctcatcccggaaaaacggctttggtgtgggtgcaaacctatggatctgcacaccgtccacccaggagaaaaacatatcagcagccagggcct

SEQ ID NO: 389493 - DNA, 140 bp, Artificial Sequence
  Synthetic
atacgccatgctgggtctccacccggacaccacctatcttaagtgcggaacagggccttggttgacccccaattgcctggtagattacccctacagattgtggcattatccgtgcaccgtcgtacttgggagtcggccat

SEQ ID NO: 389494 - DNA, 140 bp, Artificial Sequence
  Synthetic
atggccgactcccaagtacgacggtgcacggataatgccacaatctgtaggggtaatctaccaggcaattgggggtcaaccaaggccctgttccgcacttaagataggtggtgtccgggtggagacccagcatggcgtat

SEQ ID NO: 389495 - DNA, 140 bp, Artificial Sequence
  Synthetic
atacgccatgctgggtctccgcggcgcttggcacggggatcacctccatctgaggcgagctcctcagtgagccagctatcagcaccgtcgctgcgggccacctgcaccacccacagcaaccgtacttgggagtcggccat

SEQ ID NO: 389496 - DNA, 140 bp, Artificial Sequence
  Synthetic
atggccgactcccaagtacggttgctgtgggtggtgcaggtggcccgcagcgacggtgctgatagctggctcactgaggagctcgcctcagatggaggtgatccccgtgccaagcgccgcggagacccagcatggcgtat

SEQ ID NO: 389497 - DNA, 140 bp, Artificial Sequence
  Synthetic
atacgccatgctgggtctccggctcagacagagcctgagtccagggtgcccgttctggactttctcgagccaatggccgaggaagagagcgaccttgagccctcaataccatcggagtgccgtacttgggagtcggccat

SEQ ID NO: 389498 - DNA, 140 bp, Artificial Sequence
  Synthetic
atggccgactcccaagtacggcactccgatggtattgagggctcaaggtcgctctcttcctcggccattggctcgagaaagtccagaacgggcaccctggactcaggctctgtctgagccggagacccagcatggcgtat

SEQ ID NO: 389499 - DNA, 140 bp, Artificial Sequence
  Synthetic
aggccctggctgctgatatgcgcccaccgttgctggttgtgctctccccccccccaagaaggccccgacgcctcccccaaggagacgccggacagtgggtctgagcgagagcaccatatcgaccttttgggacagcggtg

SEQ ID NO: 389500 - DNA, 140 bp, Artificial Sequence
  Synthetic
caccgctgtcccaaaaggtcgatatggtgctctcgctcagacccactgtccggcgtctccttgggggaggcgtcggggccttcttggggggggggagagcacaaccagcaacggtgggcgcatatcagcagccagggcct

SEQ ID NO: 389501 - DNA, 140 bp, Artificial Sequence
  Synthetic
aggccctggctgctgatatgtccgctagtgccgctagtgccaatgggccgctgtggttcttcatcttctttacagcggcttggtactttaagggcagggtggtccccgtggccacgtactgaccttttgggacagcggtg

SEQ ID NO: 389502 - DNA, 140 bp, Artificial Sequence
  Synthetic
caccgctgtcccaaaaggtcagtacgtggccacggggaccaccctgcccttaaagtaccaagccgctgtaaagaagatgaagaaccacagcggcccattggcactagcggcactagcggacatatcagcagccagggcct

SEQ ID NO: 389503 - DNA, 140 bp, Artificial Sequence
  Synthetic
atacgccatgctgggtctccccgacgtcccctggtgagccggccccctcagagacaggttccgcctcctctatgccccccctcgagggggagcctggagatccggacctggagtctgatccgtacttgggagtcggccat

SEQ ID NO: 389504 - DNA, 140 bp, Artificial Sequence
  Synthetic
atggccgactcccaagtacggatcagactccaggtccggatctccaggctccccctcgagggggggcatagaggaggcggaacctgtctctgagggggccggctcaccaggggacgtcggggagacccagcatggcgtat

SEQ ID NO: 389505 - DNA, 140 bp, Artificial Sequence
  Synthetic
atacgccatgctgggtctccgttagtaatcatatccatctttactctcaccccagcatataaaattctcctgagccgttcattgtggtggctgtcctacctgctagtcttggctgaggcccgtacttgggagtcggccat

SEQ ID NO: 389506 - DNA, 140 bp, Artificial Sequence
  Synthetic
atggccgactcccaagtacgggcctcagccaagactagcaggtaggacagccaccacaatgaacggctcaggagaattttatatgctggggtgagagtaaagatggatatgattactaacggagacccagcatggcgtat

SEQ ID NO: 389507 - DNA, 140 bp, Artificial Sequence
  Synthetic
aggccctggctgctgatatgtgagccgttcattgtggtggctgtcctacctgctagtcttggctgaggccttgattcagcaatgggttccccccctggaggtacggggggggcgtgacgggaccttttgggacagcggtg

SEQ ID NO: 389508 - DNA, 140 bp, Artificial Sequence
  Synthetic
caccgctgtcccaaaaggtcccgtcacgccccccccgtacctccagggggggaacccattgctgaatcaaggcctcagccaagactagcaggtaggacagccaccacaatgaacggctcacatatcagcagccagggcct

SEQ ID NO: 389509 - DNA, 140 bp, Artificial Sequence
  Synthetic
atacgccatgctgggtctccctgggccgttaaaaccaagctcaaactcactccattggccggcgcggctactctcgacttgtcggggtggtttacgtcaggctacagcgggggggacattcgtacttgggagtcggccat

SEQ ID NO: 389510 - DNA, 140 bp, Artificial Sequence
  Synthetic
atggccgactcccaagtacgaatgtcccccccgctgtagcctgacgtaaaccaccccgacaagtcgagagtagccgcgccggccaatggagtgagtttgagcttggttttaacggcccagggagacccagcatggcgtat

SEQ ID NO: 389511 - DNA, 140 bp, Artificial Sequence
  Synthetic
aggccctggctgctgatatgtcaccataggcaggtggaccggcacttacatttatgaccacctctcccctttgtcaacttgggcagcccagggtttacgggacttggcagtcgccgtggagaccttttgggacagcggtg

SEQ ID NO: 389512 - DNA, 140 bp, Artificial Sequence
  Synthetic
caccgctgtcccaaaaggtctccacggcgactgccaagtcccgtaaaccctgggctgcccaagttgacaaaggggagaggtggtcataaatgtaagtgccggtccacctgcctatggtgacatatcagcagccagggcct

SEQ ID NO: 389513 - DNA, 140 bp, Artificial Sequence
  Synthetic
aggccctggctgctgatatgtccccagatgctgacctcatcgaggccaacctcctgtggcggcaggagatgggcgggaacatcacccgcgtggagtcagagaacaaggtagtaattctgggaccttttgggacagcggtg

SEQ ID NO: 389514 - DNA, 140 bp, Artificial Sequence
  Synthetic
caccgctgtcccaaaaggtcccagaattactaccttgttctctgactccacgcgggtgatgttcccgcccatctcctgccgccacaggaggttggcctcgatgaggtcagcatctggggacatatcagcagccagggcct

SEQ ID NO: 389515 - DNA, 140 bp, Artificial Sequence
  Synthetic
atacgccatgctgggtctccctaggtagggaagttctgctcggccccgccgatggctacgcctcaaaggggtggaagctcccggctcccatcacggcttacgcccaacagacgcgaggctcgtacttgggagtcggccat

SEQ ID NO: 389516 - DNA, 140 bp, Artificial Sequence
  Synthetic
atggccgactcccaagtacgagcctcgcgtctgttgggcgtaagccgtgatgggagccgggagcttccacccctttgaggcgtagccatcggcggggccgagcagaacttccctacctagggagacccagcatggcgtat

SEQ ID NO: 389517 - DNA, 140 bp, Artificial Sequence
  Synthetic
aggccctggctgctgatatggtttttcgtatgatacccgatgcttcgactcaaccgtcactgagagagacatcaggaccgaggagtccatataccaggcctgctccctgcccgaggaggcgaccttttgggacagcggtg

SEQ ID NO: 389518 - DNA, 140 bp, Artificial Sequence
  Synthetic
caccgctgtcccaaaaggtcgcctcctcgggcagggagcaggcctggtatatggactcctcggtcctgatgtctctctcagtgacggttgagtcgaagcatcgggtatcatacgaaaaaccatatcagcagccagggcct

SEQ ID NO: 389519 - DNA, 140 bp, Artificial Sequence
  Synthetic
aggccctggctgctgatatggctcgtcggcgcccccctagggggcgttgccagggccctggcgcatggcgtccgggttctggaggacggcgtgaactatgcaacagggaatttgcccggtgaccttttgggacagcggtg

SEQ ID NO: 389520 - DNA, 140 bp, Artificial Sequence
  Synthetic
caccgctgtcccaaaaggtcaccgggcaaattccctgttgcatagttcacgccgtcctccagaacccggacgccatgcgccagggccctggcaacgccccctaggggggcgccgacgagccatatcagcagccagggcct

SEQ ID NO: 389521 - DNA, 140 bp, Artificial Sequence
  Synthetic
aggccctggctgctgatatgtccgggttctggaggacggcgtgaactatgcaacagggaatttgcccggttgctctttctctatcttcctcttggctctgctgtcctgcttgaccatcccgaccttttgggacagcggtg

SEQ ID NO: 389522 - DNA, 140 bp, Artificial Sequence
  Synthetic
caccgctgtcccaaaaggtcgggatggtcaagcaggacagcagagccaagaggaagatagagaaagagcaaccgggcaaattccctgttgcatagttcacgccgtcctccagaacccggacatatcagcagccagggcct

SEQ ID NO: 389523 - DNA, 140 bp, Artificial Sequence
  Synthetic
aggccctggctgctgatatggagtcctagcgggccttgcgtactattccatggtagggaactgggctaaggttttgattgtgatgctactctttgccggcgttgacggaaccaccgtggtgaccttttgggacagcggtg

SEQ ID NO: 389524 - DNA, 140 bp, Artificial Sequence
  Synthetic
caccgctgtcccaaaaggtcaccacggtggttccgtcaacgccggcaaagagtagcatcacaatcaaaaccttagcccagttccctaccatggaatagtacgcaaggcccgctaggactccatatcagcagccagggcct

SEQ ID NO: 389525 - DNA, 140 bp, Artificial Sequence
  Synthetic
atacgccatgctgggtctcccacattaacaggaccgccctgaactgcaatgactccctcaacaccgggtttattgccgcgctgttctacgtacgccatttcaacgcgtccggatgcccaccgtacttgggagtcggccat

SEQ ID NO: 389526 - DNA, 140 bp, Artificial Sequence
  Synthetic
atggccgactcccaagtacggtgggcatccggacgcgttgaaatggcgtacgtagaacagcgcggcaataaacccggtgttgagggagtcattgcagttcagggcggtcctgttaatgtgggagacccagcatggcgtat

SEQ ID NO: 389527 - DNA, 140 bp, Artificial Sequence
  Synthetic
atacgccatgctgggtctcctgttcgagctcttgaggacggaatcaatttcgcaacagggaatttacctggttgctctttctctatcttcctcttggctttgctctcatgcttgcttacacgtacttgggagtcggccat

SEQ ID NO: 389528 - DNA, 140 bp, Artificial Sequence
  Synthetic
atggccgactcccaagtacgtgtaagcaagcatgagagcaaagccaagaggaagatagagaaagagcaaccaggtaaattccctgttgcgaaattgattccgtcctcaagagctcgaacaggagacccagcatggcgtat

SEQ ID NO: 389529 - DNA, 140 bp, Artificial Sequence
  Synthetic
aggccctggctgctgatatgctaggtgcatggttgactacccatacaggctttggcattacccctgcactgtcaactttaccatcttcaaggttaggatgtatgtggggggtgtggagcagaccttttgggacagcggtg

SEQ ID NO: 389530 - DNA, 140 bp, Artificial Sequence
  Synthetic
caccgctgtcccaaaaggtctgctccacaccccccacatacatcctaaccttgaagatggtaaagttgacagtgcaggggtaatgccaaagcctgtatgggtagtcaaccatgcacctagcatatcagcagccagggcct

SEQ ID NO: 389531 - DNA, 140 bp, Artificial Sequence
  Synthetic
aggccctggctgctgatatggtcaactttaccatcttcaaggttaggatgtatgtggggggtgtggagcacaggctcaaggctgcatgcaactggactcgaggagagcgttgcgatctgggaccttttgggacagcggtg

SEQ ID NO: 389532 - DNA, 140 bp, Artificial Sequence
  Synthetic
caccgctgtcccaaaaggtcccagatcgcaacgctctcctcgagtccagttgcatgcagccttgagcctgtgctccacaccccccacatacatcctaaccttgaagatggtaaagttgaccatatcagcagccagggcct

SEQ ID NO: 389533 - DNA, 140 bp, Artificial Sequence
  Synthetic
atacgccatgctgggtctccacgcggcgtccgtagccggagcgcacggcgttctccctttccttgtgttcttctgcgctgcctggtacatcaagggcaggctggtccccggggtggcatacgtacttgggagtcggccat

SEQ ID NO: 389534 - DNA, 140 bp, Artificial Sequence
  Synthetic
atggccgactcccaagtacgtatgccaccccggggaccagcctgcccttgatgtaccaggcagcgcagaagaacacaaggaaagggagaacgccgtgcgctccggctacggacgccgcgtggagacccagcatggcgtat

SEQ ID NO: 389535 - DNA, 140 bp, Artificial Sequence
  Synthetic
atacgccatgctgggtctcccacgggcgtacgccatggaccgggaggtagctgcatcgtgcggaggcgcggttctcataggtctcgcacttttgactctgtcaccatgctataaagcgctcgtacttgggagtcggccat

SEQ ID NO: 389536 - DNA, 140 bp, Artificial Sequence
  Synthetic
atggccgactcccaagtacgagcgctttatagcatggtgacagagtcaaaagtgcgagacctatgagaaccgcgcctccgcacgatgcagctacctcccggtccatggcgtacgcccgtgggagacccagcatggcgtat

SEQ ID NO: 389537 - DNA, 140 bp, Artificial Sequence
  Synthetic
atacgccatgctgggtctccggcagacaccgcggcgtgcggggacatcatccttggtctgcccgtctccgcccgaagggggagggagatattcctgggaccggccgatagtcttgaaggccgtacttgggagtcggccat

SEQ ID NO: 389538 - DNA, 140 bp, Artificial Sequence
  Synthetic
atggccgactcccaagtacggccttcaagactatcggccggtcccaggaatatctccctcccccttcgggcggagacgggcagaccaaggatgatgtccccgcacgccgcggtgtctgccggagacccagcatggcgtat

SEQ ID NO: 389539 - DNA, 140 bp, Artificial Sequence
  Synthetic
atacgccatgctgggtctccgggtggcgactccttgcgcctatcacggcctatgcccagcaaacgcgaggcttacttggctgcatcattacgagcctcacaggccgggataagaaccaggcgtacttgggagtcggccat

SEQ ID NO: 389540 - DNA, 140 bp, Artificial Sequence
  Synthetic
atggccgactcccaagtacgcctggttcttatcccggcctgtgaggctcgtaatgatgcagccaagtaagcctcgcgtttgctgggcataggccgtgataggcgcaaggagtcgccacccggagacccagcatggcgtat

SEQ ID NO: 389541 - DNA, 140 bp, Artificial Sequence
  Synthetic
aggccctggctgctgatatgaggcgccaagcagaacatccagctgatcaacaccaacggcagttggcacatcaacagcacggccttgaactgcaacgatagcctcaacaccggctgggtagaccttttgggacagcggtg

SEQ ID NO: 389542 - DNA, 140 bp, Artificial Sequence
  Synthetic
caccgctgtcccaaaaggtctacccagccggtgttgaggctatcgttgcagttcaaggccgtgctgttgatgtgccaactgccgttggtgttgatcagctggatgttctgcttggcgcctcatatcagcagccagggcct

SEQ ID NO: 389543 - DNA, 140 bp, Artificial Sequence
  Synthetic
atacgccatgctgggtctccgcttgcgagtcttttcacactgggcgcccaacagaacatccagctaatcaacaccagcggcagttggcatatcaataggacagccctgaactgcaatgatcgtacttgggagtcggccat

SEQ ID NO: 389544 - DNA, 140 bp, Artificial Sequence
  Synthetic
atggccgactcccaagtacgatcattgcagttcagggctgtcctattgatatgccaactgccgctggtgttgattagctggatgttctgttgggcgcccagtgtgaaaagactcgcaagcggagacccagcatggcgtat

SEQ ID NO: 389545 - DNA, 140 bp, Artificial Sequence
  Synthetic
atacgccatgctgggtctccttgcccagggctggggtcctatcagttacaccaatggaagtggccccgaccatcgcccttactgctggcactaccccccaaaaccttgtggtattgtgcccgtacttgggagtcggccat

SEQ ID NO: 389546 - DNA, 140 bp, Artificial Sequence
  Synthetic
atggccgactcccaagtacgggcacaataccacaaggttttggggggtagtgccagcagtaagggcgatggtcggggccacttccattggtgtaactgataggaccccagccctgggcaaggagacccagcatggcgtat

SEQ ID NO: 389547 - DNA, 140 bp, Artificial Sequence
  Synthetic
aggccctggctgctgatatggacgttaagttcccgggcggtggccagatcgttggcggagtatacttgctgccgcgcaggggcccgagattgggtgtgcgcgcggcgaggaaaacttccggaccttttgggacagcggtg

SEQ ID NO: 389548 - DNA, 140 bp, Artificial Sequence
  Synthetic
caccgctgtcccaaaaggtccggaagttttcctcgccgcgcgcacacccaatctcgggcccctgcgcggcagcaagtatactccgccaacgatctggccaccgcccgggaacttaacgtccatatcagcagccagggcct

SEQ ID NO: 389549 - DNA, 140 bp, Artificial Sequence
  Synthetic
atacgccatgctgggtctccgaatgagggcctcggctgggcaggatggctcctgtccccccgcggttctcgcccttcatggggccccagtgacccccggcataaatcgcgcaacttgggccgtacttgggagtcggccat

SEQ ID NO: 389550 - DNA, 140 bp, Artificial Sequence
  Synthetic
atggccgactcccaagtacggcccaagttgcgcgatttatgccgggggtcactggggccccatgaagggcgagaaccgcggggggacaggagccatcctgcccagccgaggccctcattcggagacccagcatggcgtat

SEQ ID NO: 389551 - DNA, 140 bp, Artificial Sequence
  Synthetic
atacgccatgctgggtctccgggtgagggttctggaggacgggataaattatgcaacggggaatttgcccggttgctccttttctatctttcttttagccctcttgtcttgtatctctgtcgtacttgggagtcggccat

SEQ ID NO: 389552 - DNA, 140 bp, Artificial Sequence
  Synthetic
atggccgactcccaagtacgacagagatacaagacaagagggctaaaagaaagatagaaaaggagcaaccgggcaaattccccgttgcataatttatcccgtcctccagaaccctcacccggagacccagcatggcgtat

SEQ ID NO: 389553 - DNA, 140 bp, Artificial Sequence
  Synthetic
atacgccatgctgggtctccctccatactcctggatgtgtcccctgtgagaagaccggaaacaagagccgatgttgggtgccagtcactcccaatatagctataaatcaacccggcgctccgtacttgggagtcggccat

SEQ ID NO: 389554 - DNA, 140 bp, Artificial Sequence
  Synthetic
atggccgactcccaagtacggagcgccgggttgatttatagctatattgggagtgactggcacccaacatcggctcttgtttccggtcttctcacaggggacacatccaggagtatggagggagacccagcatggcgtat

SEQ ID NO: 389555 - DNA, 140 bp, Artificial Sequence
  Synthetic
atacgccatgctgggtctcccgctcaggtcgtcgtcgtatcgccacagcaccaccactttgtccaggaatgcaactgttccatatacccgggcaagatcacggggcaccgcatggcctggcgtacttgggagtcggccat

SEQ ID NO: 389556 - DNA, 140 bp, Artificial Sequence
  Synthetic
atggccgactcccaagtacgccaggccatgcggtgccccgtgatcttgcccgggtatatggaacagttgcattcctggacaaagtggtggtgctgtggcgatacgacgacgacctgagcgggagacccagcatggcgtat

SEQ ID NO: 389557 - DNA, 140 bp, Artificial Sequence
  Synthetic
aggccctggctgctgatatgccgactttggtattcgacatcaccaaactactgctggccgtcttcggtcccctttggattcttcaagccagtttgcttaaagtaccctactttgtgcgcggaccttttgggacagcggtg

SEQ ID NO: 389558 - DNA, 140 bp, Artificial Sequence
  Synthetic
caccgctgtcccaaaaggtccgcgcacaaagtagggtactttaagcaaactggcttgaagaatccaaaggggaccgaagacggccagcagtagtttggtgatgtcgaataccaaagtcggcatatcagcagccagggcct

SEQ ID NO: 389559 - DNA, 140 bp, Artificial Sequence
  Synthetic
aggccctggctgctgatatggacaccgccgcgtgcggtgacatcatcaacggcttgcccgtctccgcccgtaggggccgggagatactgctcggaccagccgacggaatggtctccaagggaccttttgggacagcggtg

SEQ ID NO: 389560 - DNA, 140 bp, Artificial Sequence
  Synthetic
caccgctgtcccaaaaggtcccttggagaccattccgtcggctggtccgagcagtatctcccggcccctacgggcggagacgggcaagccgttgatgatgtcaccgcacgcggcggtgtccatatcagcagccagggcct

SEQ ID NO: 389561 - DNA, 140 bp, Artificial Sequence
  Synthetic
atacgccatgctgggtctccgcgtgatgtttggcctggcttacttctccatgcagggggcgtgggcaaaggtcgtcgtcatcctcttgttgaccgctggggtggaggcatccacctacaccgtacttgggagtcggccat

SEQ ID NO: 389562 - DNA, 140 bp, Artificial Sequence
  Synthetic
atggccgactcccaagtacggtgtaggtggatgcctccaccccagcggtcaacaagaggatgacgacgacctttgcccacgccccctgcatggagaagtaagccaggccaaacatcacgcggagacccagcatggcgtat

SEQ ID NO: 389563 - DNA, 140 bp, Artificial Sequence
  Synthetic
atacgccatgctgggtctcccacatcaatcgcacagctctgaactgcaacgacagtctggaaaccggcttcctcgcggccctgttctataccagctcctttaacagctcaggatgccccgcgtacttgggagtcggccat

SEQ ID NO: 389564 - DNA, 140 bp, Artificial Sequence
  Synthetic
atggccgactcccaagtacgcggggcatcctgagctgttaaaggagctggtatagaacagggccgcgaggaagccggtttccagactgtcgttgcagttcagagctgtgcgattgatgtgggagacccagcatggcgtat

SEQ ID NO: 389565 - DNA, 140 bp, Artificial Sequence
  Synthetic
atacgccatgctgggtctccctgctggcattatcctcctagaccttgtggcatagttcctgcacggactgtgtgtggcccggtgtactgcttcactcccagcccagtcgtggtgggcacccgtacttgggagtcggccat

SEQ ID NO: 389566 - DNA, 140 bp, Artificial Sequence
  Synthetic
atggccgactcccaagtacgggtgcccaccacgactgggctgggagtgaagcagtacaccgggccacacacagtccgtgcaggaactatgccacaaggtctaggaggataatgccagcagggagacccagcatggcgtat

SEQ ID NO: 389567 - DNA, 140 bp, Artificial Sequence
  Synthetic
atacgccatgctgggtctccgcacgtggatgaacggcaccgggttcaccaagacctgcggcgcgccaccttgccgcatcaggaaagatttcaacgccagtgaggacctgttgtgccccaccgtacttgggagtcggccat

SEQ ID NO: 389568 - DNA, 140 bp, Artificial Sequence
  Synthetic
atggccgactcccaagtacggtggggcacaacaggtcctcactggcgttgaaatctttcctgatgcggcaaggtggcgcgccgcaggtcttggtgaacccggtgccgttcatccacgtgcggagacccagcatggcgtat

SEQ ID NO: 389569 - DNA, 140 bp, Artificial Sequence
  Synthetic
atacgccatgctgggtctcccattatccgtgcacagtcaactataccatctacaaagtacggatgttcgtagggggtattgaacacagacttcaagcagcctgcaacttcactcgtggggcgtacttgggagtcggccat

SEQ ID NO: 389570 - DNA, 140 bp, Artificial Sequence
  Synthetic
atggccgactcccaagtacgccccacgagtgaagttgcaggctgcttgaagtctgtgttcaataccccctacgaacatccgtactttgtagatggtatagttgactgtgcacggataatgggagacccagcatggcgtat

SEQ ID NO: 389571 - DNA, 140 bp, Artificial Sequence
  Synthetic
aggccctggctgctgatatgccctccccggcgccaaactattccagggcgctgtggcgggtggctgctgaggagtacgtggaggttacgcgggtgggggatttccactacgtgacgggcagaccttttgggacagcggtg

SEQ ID NO: 389572 - DNA, 140 bp, Artificial Sequence
  Synthetic
caccgctgtcccaaaaggtctgcccgtcacgtagtggaaatcccccacccgcgtaacctccacgtactcctcagcagccacccgccacagcgccctggaatagtttggcgccggggagggcatatcagcagccagggcct

SEQ ID NO: 389573 - DNA, 140 bp, Artificial Sequence
  Synthetic
atacgccatgctgggtctccagctttgtcaactggcctgctgcatctccaccaaaacatcgtggacgtgcagtatttatacggcctatcaccagccatcacgaagtacgtcgtcaagtggcgtacttgggagtcggccat

SEQ ID NO: 389574 - DNA, 140 bp, Artificial Sequence
  Synthetic
atggccgactcccaagtacgccacttgacgacgtacttcgtgatggctggtgataggccgtataaatactgcacgtccacgatgttttggtggagatgcagcaggccagttgacaaagctggagacccagcatggcgtat

SEQ ID NO: 389575 - DNA, 140 bp, Artificial Sequence
  Synthetic
atacgccatgctgggtctccagttggtcattttacatgcagccagtgctgctagctctaatggtcttctgtatttcatcctcttctttgtagccgcttggtgtattaaaggtcgtgcggtcgtacttgggagtcggccat

SEQ ID NO: 389576 - DNA, 140 bp, Artificial Sequence
  Synthetic
atggccgactcccaagtacgaccgcacgacctttaatacaccaagcggctacaaagaagaggatgaaatacagaagaccattagagctagcagcactggctgcatgtaaaatgaccaactggagacccagcatggcgtat

SEQ ID NO: 389577 - DNA, 140 bp, Artificial Sequence
  Synthetic
aggccctggctgctgatatgagctgtctgcgccttccttgaaggcaacatgcactacccggcatgactccccagacgctgacctcgtcgaggccaatctcctgtggcggcaggagatggggaccttttgggacagcggtg

SEQ ID NO: 389578 - DNA, 140 bp, Artificial Sequence
  Synthetic
caccgctgtcccaaaaggtccccatctcctgccgccacaggagattggcctcgacgaggtcagcgtctggggagtcatgccgggtagtgcatgttgccttcaaggaaggcgcagacagctcatatcagcagccagggcct

SEQ ID NO: 389579 - DNA, 140 bp, Artificial Sequence
  Synthetic
atacgccatgctgggtctcccagatcggcatggcgttactgatcgccataaccgccttcacgatcacaccggcatacaaaatccttctcagccgatgtttgtggtggacgtgctacatgccgtacttgggagtcggccat

SEQ ID NO: 389580 - DNA, 140 bp, Artificial Sequence
  Synthetic
atggccgactcccaagtacggcatgtagcacgtccaccacaaacatcggctgagaaggattttgtatgccggtgtgatcgtgaaggcggttatggcgatcagtaacgccatgccgatctgggagacccagcatggcgtat

SEQ ID NO: 389581 - DNA, 140 bp, Artificial Sequence
  Synthetic
atacgccatgctgggtctcctgtggtgtttgacataaccaagtggttgttggcgatcctcggacccggctacctcttcagagctgctgtgatgcgcacgccatacttcgttagggcaaatcgtacttgggagtcggccat

SEQ ID NO: 389582 - DNA, 140 bp, Artificial Sequence
  Synthetic
atggccgactcccaagtacgatttgccctaacgaagtatggcgtgcgcatcacagcagctctgaagaggtagccgggtccgaggatcgccaacaaccacttggttatgtcaaacaccacaggagacccagcatggcgtat

SEQ ID NO: 389583 - DNA, 140 bp, Artificial Sequence
  Synthetic
atacgccatgctgggtctccatgaccatctatcccccatgtcagactgggcagccgacggcctgcgcgacctagcggtggctgtcgagcctatcgtcttcagcccaatggagaggaaagtcgtacttgggagtcggccat

SEQ ID NO: 389584 - DNA, 140 bp, Artificial Sequence
  Synthetic
atggccgactcccaagtacgactttcctctccattgggctgaagacgataggctcgacagccaccgctaggtcgcgcaggccgtcggctgcccagtctgacatgggggatagatggtcatggagacccagcatggcgtat

SEQ ID NO: 389585 - DNA, 140 bp, Artificial Sequence
  Synthetic
atacgccatgctgggtctccggatacacctctaaagggtggagacttctcgcccctatcaccgcatacgcccagcaaacccgagggttgctgagcgccatagtggtgagcatgacggggccgtacttgggagtcggccat

SEQ ID NO: 389586 - DNA, 140 bp, Artificial Sequence
  Synthetic
atggccgactcccaagtacggccccgtcatgctcaccactatggcgctcagcaaccctcgggtttgctgggcgtatgcggtgataggggcgagaagtctccaccctttagaggtgtatccggagacccagcatggcgtat

SEQ ID NO: 389587 - DNA, 140 bp, Artificial Sequence
  Synthetic
atacgccatgctgggtctcccggtgccggaaacaaaacgctggctggttcccgtggcccggtcacgcagatgtactccagcgccgagggagacctcgtgggatggcctagtccccctggtcgtacttgggagtcggccat

SEQ ID NO: 389588 - DNA, 140 bp, Artificial Sequence
  Synthetic
atggccgactcccaagtacgaccagggggactaggccatcccacgaggtctccctcggcgctggagtacatctgcgtgaccgggccacgggaaccagccagcgttttgtttccggcaccgggagacccagcatggcgtat

SEQ ID NO: 389589 - DNA, 140 bp, Artificial Sequence
  Synthetic
atacgccatgctgggtctccgagcgctgctctccccgaggcccctgtcctccctcaaggggtcgtcgggagggcctgtcctctgccctaggggccacgccgtcggaatcttccgggcggccgtacttgggagtcggccat

SEQ ID NO: 389590 - DNA, 140 bp, Artificial Sequence
  Synthetic
atggccgactcccaagtacggccgcccggaagattccgacggcgtggcccctagggcagaggacaggccctcccgacgaccccttgagggaggacaggggcctcggggagagcagcgctcggagacccagcatggcgtat

SEQ ID NO: 389591 - DNA, 140 bp, Artificial Sequence
  Synthetic
atacgccatgctgggtctccccagctgtgccccagacctaccaggtgggatatctccatgctcccaccggtagcgggaagagtaccaaagtccccgcagcgtatgctgctcaggggtacacgtacttgggagtcggccat

SEQ ID NO: 389592 - DNA, 140 bp, Artificial Sequence
  Synthetic
atggccgactcccaagtacgtgtacccctgagcagcatacgctgcggggactttggtactcttcccgctaccggtgggagcatggagatatcccacctggtaggtctggggcacagctggggagacccagcatggcgtat

SEQ ID NO: 389593 - DNA, 140 bp, Artificial Sequence
  Synthetic
atacgccatgctgggtctcccacggtgacaactggggatgccatcacctactccacgtacggcaaattcctcgcggatggaggctgctccggcggcgcctatgatgtcataatatgcgaccgtacttgggagtcggccat

SEQ ID NO: 389594 - DNA, 140 bp, Artificial Sequence
  Synthetic
atggccgactcccaagtacggtcgcatattatgacatcataggcgccgccggagcagcctccatccgcgaggaatttgccgtacgtggagtaggtgatggcatccccagttgtcaccgtgggagacccagcatggcgtat

SEQ ID NO: 389595 - DNA, 140 bp, Artificial Sequence
  Synthetic
atacgccatgctgggtctccccccaccagggtctgtgacaactccacatcccaacatagaggaggtggccctcggacatgagggcgaaatccccttctatgggaaggccattcccctctccgtacttgggagtcggccat

SEQ ID NO: 389596 - DNA, 140 bp, Artificial Sequence
  Synthetic
atggccgactcccaagtacggagaggggaatggccttcccatagaaggggatttcgccctcatgtccgagggccacctcctctatgttgggatgtggagttgtcacagaccctggtggggggagacccagcatggcgtat

SEQ ID NO: 389597 - DNA, 140 bp, Artificial Sequence
  Synthetic
atacgccatgctgggtctcctactacagagggcttgacgtctcaataataccaacacaaggagacgtggtggttgtcgccaccgatgccctcatgacaggatatactggggacttcgactcgtacttgggagtcggccat

SEQ ID NO: 389598 - DNA, 140 bp, Artificial Sequence
  Synthetic
atggccgactcccaagtacgagtcgaagtccccagtatatcctgtcatgagggcatcggtggcgacaaccaccacgtctccttgtgttggtattattgagacgtcaagccctctgtagtaggagacccagcatggcgtat

SEQ ID NO: 389599 - DNA, 140 bp, Artificial Sequence
  Synthetic
atacgccatgctgggtctccccgcagccagcgccggggcaggaccgggagagggaggttgggcatatataggtatgtctcttccggtgagagggcgtcggggatgtttgacaccgtggtgcgtacttgggagtcggccat

SEQ ID NO: 389600 - DNA, 140 bp, Artificial Sequence
  Synthetic
atggccgactcccaagtacgcaccacggtgtcaaacatccccgacgccctctcaccggaagagacatacctatatatgcccaacctccctctcccggtcctgccccggcgctggctgcggggagacccagcatggcgtat

SEQ ID NO: 389601 - DNA, 140 bp, Artificial Sequence
  Synthetic
aggccctggctgctgatatgcgtccatgctcactgatccctcccacataacagcagaggcggccgggagaaggttggcgaggggatcacccccctctctggccagctcctcggctagccagaccttttgggacagcggtg

SEQ ID NO: 389602 - DNA, 140 bp, Artificial Sequence
  Synthetic
caccgctgtcccaaaaggtctggctagccgaggagctggccagagaggggggtgatcccctcgccaaccttctcccggccgcctctgctgttatgtgggagggatcagtgagcatggacgcatatcagcagccagggcct

SEQ ID NO: 389603 - DNA, 140 bp, Artificial Sequence
  Synthetic
atacgccatgctgggtctcccgaacgactgctccaactcaagcatcgtgtatgaggcagcggacgtgatcatgcacacccccgggtgcgtgccctgcgttcgggagggcaactcctcccgcgtacttgggagtcggccat

SEQ ID NO: 389604 - DNA, 140 bp, Artificial Sequence
  Synthetic
atggccgactcccaagtacgcgggaggagttgccctcccgaacgcagggcacgcacccgggggtgtgcatgatcacgtccgctgcctcatacacgatgcttgagttggagcagtcgttcgggagacccagcatggcgtat

SEQ ID NO: 389605 - DNA, 140 bp, Artificial Sequence
  Synthetic
aggccctggctgctgatatgctgacgccgagctcatagaggccaacctcctatggaggcaggagatgggcggtaacatcaccagggttgagtcagagaacaaagtggtgattctggactcgaccttttgggacagcggtg

SEQ ID NO: 389606 - DNA, 140 bp, Artificial Sequence
  Synthetic
caccgctgtcccaaaaggtcgagtccagaatcaccactttgttctctgactcaaccctggtgatgttaccgcccatctcctgcctccataggaggttggcctctatgagctcggcgtcagcatatcagcagccagggcct

SEQ ID NO: 389607 - DNA, 140 bp, Artificial Sequence
  Synthetic
aggccctggctgctgatatgccaccacggcaatacgacgccacgtcgatttgctcgttggggcggctgctttctgctccgctatgtacgtgggggatctctgcggatctgttctcctcgtgaccttttgggacagcggtg

SEQ ID NO: 389608 - DNA, 140 bp, Artificial Sequence
  Synthetic
caccgctgtcccaaaaggtcacgaggagaacagatccgcagagatcccccacgtacatagcggagcagaaagcagccgccccaacgagcaaatcgacgtggcgtcgtattgccgtggtggcatatcagcagccagggcct

SEQ ID NO: 389609 - DNA, 140 bp, Artificial Sequence
  Synthetic
atacgccatgctgggtctccacacttgtgggccctacacccctgttatatcgcctaggctcggtcactaatgaggtcaccctcacccaccccgtaaccaagtacatcgccacgtgcatgccgtacttgggagtcggccat

SEQ ID NO: 389610 - DNA, 140 bp, Artificial Sequence
  Synthetic
atggccgactcccaagtacggcatgcacgtggcgatgtacttggttacggggtgggtgagggtgacctcattagtgaccgagcctaggcgatataacaggggtgtagggcccacaagtgtggagacccagcatggcgtat

SEQ ID NO: 389611 - DNA, 140 bp, Artificial Sequence
  Synthetic
atacgccatgctgggtctcccggccgcatccatgtcaaccagaagacgatcatcgctcctgataaggaggtcctttatgaggcatttgatgagatggaggaatgtgcctctaggaccgcccgtacttgggagtcggccat

SEQ ID NO: 389612 - DNA, 140 bp, Artificial Sequence
  Synthetic
atggccgactcccaagtacgggcggtcctagaggcacattcctccatctcatcaaatgcctcataaaggacctccttatcaggagcgatgatcgtcttctggttgacatggatgcggccgggagacccagcatggcgtat

SEQ ID NO: 389613 - DNA, 140 bp, Artificial Sequence
  Synthetic
aggccctggctgctgatatgcacatcaacaggactgccctgaactgcaatgactccctcaaaaccgggttccttgccgcgctgttctacacacacaagttcaacgcgtccggatgcccaggaccttttgggacagcggtg

SEQ ID NO: 389614 - DNA, 140 bp, Artificial Sequence
  Synthetic
caccgctgtcccaaaaggtcctgggcatccggacgcgttgaacttgtgtgtgtagaacagcgcggcaaggaacccggttttgagggagtcattgcagttcagggcagtcctgttgatgtgcatatcagcagccagggcct

SEQ ID NO: 389615 - DNA, 140 bp, Artificial Sequence
  Synthetic
atacgccatgctgggtctcctgcaagcaacatggcccaagctagagcaattctgggccaagcacatgtggaacttcatcagtggcatccagtaccttgcggggctgtccacgttaccgggcgtacttgggagtcggccat

SEQ ID NO: 389616 - DNA, 140 bp, Artificial Sequence
  Synthetic
atggccgactcccaagtacgcccggtaacgtggacagccccgcaaggtactggatgccactgatgaagttccacatgtgcttggcccagaattgctctagcttgggccatgttgcttgcaggagacccagcatggcgtat

SEQ ID NO: 389617 - DNA, 140 bp, Artificial Sequence
  Synthetic
aggccctggctgctgatatgcggttcggcgcccctacgtatagctggggggaaaatgagacggacgtgctgcttctcaacaacacgcggccgccgcgaggcaactggttcggctgcacatgaccttttgggacagcggtg

SEQ ID NO: 389618 - DNA, 140 bp, Artificial Sequence
  Synthetic
caccgctgtcccaaaaggtcatgtgcagccgaaccagttgcctcgcggcggccgcgtgttgttgagaagcagcacgtccgtctcattttccccccagctatacgtaggggcgccgaaccgcatatcagcagccagggcct

SEQ ID NO: 389619 - DNA, 140 bp, Artificial Sequence
  Synthetic
aggccctggctgctgatatgcagcttccgcttatgaagtgcgcaacgtgtccggagtgtaccatgtcacgaacgactgctccaacgcaagcattgtgtatgaggcagcggacatgatcatgaccttttgggacagcggtg

SEQ ID NO: 389620 - DNA, 140 bp, Artificial Sequence
  Synthetic
caccgctgtcccaaaaggtcatgatcatgtccgctgcctcatacacaatgcttgcgttggagcagtcgttcgtgacatggtacactccggacacgttgcgcacttcataagcggaagctgcatatcagcagccagggcct

SEQ ID NO: 389621 - DNA, 140 bp, Artificial Sequence
  Synthetic
atacgccatgctgggtctccccattctgcgccgccacgtgggacaaggggaaggcgcggtccaatggatgaacaggcttatcgcctttgcgtccagaggtaaccatgtcgccccgacacacgtacttgggagtcggccat

SEQ ID NO: 389622 - DNA, 140 bp, Artificial Sequence
  Synthetic
atggccgactcccaagtacgtgtgtcggggcgacatggttacctctggacgcaaaggcgataagcctgttcatccattggaccgcgccttccccttgtcccacgtggcggcgcagaatggggagacccagcatggcgtat

SEQ ID NO: 389623 - DNA, 140 bp, Artificial Sequence
  Synthetic
atacgccatgctgggtctccgattgccctgtcccctgctccggctcatggcttcgagacgtgtgggactgggtctgctcaatcctaatagacttcaagaactggctatctgctaaattatcgtacttgggagtcggccat

SEQ ID NO: 389624 - DNA, 140 bp, Artificial Sequence
  Synthetic
atggccgactcccaagtacgataatttagcagatagccagttcttgaagtctattaggattgagcagacccagtcccacacgtctcgaagccatgagccggagcaggggacagggcaatcggagacccagcatggcgtat

SEQ ID NO: 389625 - DNA, 140 bp, Artificial Sequence
  Synthetic
atacgccatgctgggtctcccaacatcaccggcaacgtccgcttgggcaccatgagaatatcaggacctaagacctgcttgaatacctggcaggggacattccccatcaactgttacacgcgtacttgggagtcggccat

SEQ ID NO: 389626 - DNA, 140 bp, Artificial Sequence
  Synthetic
atggccgactcccaagtacgcgtgtaacagttgatggggaatgtcccctgccaggtattcaagcaggtcttaggtcctgatattctcatggtgcccaagcggacgttgccggtgatgttgggagacccagcatggcgtat

SEQ ID NO: 389627 - DNA, 140 bp, Artificial Sequence
  Synthetic
aggccctggctgctgatatgcatcaacaggactgccctgaactgcaacgactccctccaaactgggttccttgctgcgctgttctacgtgaaccggttcaactcgtcaggatgcccggaggaccttttgggacagcggtg

SEQ ID NO: 389628 - DNA, 140 bp, Artificial Sequence
  Synthetic
caccgctgtcccaaaaggtcctccgggcatcctgacgagttgaaccggttcacgtagaacagcgcagcaaggaacccagtttggagggagtcgttgcagttcagggcagtcctgttgatgcatatcagcagccagggcct

SEQ ID NO: 389629 - DNA, 140 bp, Artificial Sequence
  Synthetic
atacgccatgctgggtctccgaggggcaatcctacctacacctggggggccaatgagaccgacgtcttcatgatgtcgagcatgcgacccccagcgggagggtggtatgggtgcacatggcgtacttgggagtcggccat

SEQ ID NO: 389630 - DNA, 140 bp, Artificial Sequence
  Synthetic
atggccgactcccaagtacgccatgtgcacccataccaccctcccgctgggggtcgcatgctcgacatcatgaagacgtcggtctcattggccccccaggtgtaggtaggattgcccctcggagacccagcatggcgtat

SEQ ID NO: 389631 - DNA, 140 bp, Artificial Sequence
  Synthetic
atacgccatgctgggtctcccgtatgtgacagggttgacagcagacaacctaaaggttccttgccagctgccatgtccggagtttttctcctgggtggacggggttcagatccatcgattcgtacttgggagtcggccat

SEQ ID NO: 389632 - DNA, 140 bp, Artificial Sequence
  Synthetic
atggccgactcccaagtacgaatcgatggatctgaaccccgtccacccaggagaaaaactccggacatggcagctggcaaggaacctttaggttgtctgctgtcaaccctgtcacatacgggagacccagcatggcgtat

SEQ ID NO: 389633 - DNA, 140 bp, Artificial Sequence
  Synthetic
aggccctggctgctgatatggatgccatcatcctcctcacgtgtgcggcctacccagagctaatctttgacatcaccaaactcttgctcgccatactcggcccgctcatggtgctccagggaccttttgggacagcggtg

SEQ ID NO: 389634 - DNA, 140 bp, Artificial Sequence
  Synthetic
caccgctgtcccaaaaggtccctggagcaccatgagcgggccgagtatggcgagcaagagtttggtgatgtcaaagattagctctgggtaggccgcacacgtgaggaggatgatggcatccatatcagcagccagggcct

SEQ ID NO: 389635 - DNA, 140 bp, Artificial Sequence
  Synthetic
atacgccatgctgggtctccctggtgtactatgggaggcaatatgactcgcatagagtctgagtctaaggtgctcatggtcgactccttcgaccccgtggtcgataaggaggacgaacgccgtacttgggagtcggccat

SEQ ID NO: 389636 - DNA, 140 bp, Artificial Sequence
  Synthetic
atggccgactcccaagtacggcgttcgtcctccttatcgaccacggggtcgaaggagtcgaccatgagcaccttagactcagactctatgcgagtcatattgcctcccatagtacaccagggagacccagcatggcgtat

SEQ ID NO: 389637 - DNA, 140 bp, Artificial Sequence
  Synthetic
atacgccatgctgggtctcccctggaaaagaccagactatcaaccaccagtggtcgccggatgtgctctccctcctcctggaaccaccccagtgccgcctcctaggaggcggcgagctgtcgtacttgggagtcggccat

SEQ ID NO: 389638 - DNA, 140 bp, Artificial Sequence
  Synthetic
atggccgactcccaagtacgacagctcgccgcctcctaggaggcggcactggggtggttccaggaggagggagagcacatccggcgaccactggtggttgatagtctggtcttttccaggggagacccagcatggcgtat

SEQ ID NO: 389639 - DNA, 140 bp, Artificial Sequence
  Synthetic
aggccctggctgctgatatgatagggtcagtggttgtctcctttgcaatcaaatgggagtatatcgtgttgctcttccttctcctggcagacgcacgcgtctgtgcctgcctgtggatgagaccttttgggacagcggtg

SEQ ID NO: 389640 - DNA, 140 bp, Artificial Sequence
  Synthetic
caccgctgtcccaaaaggtctcatccacaggcaggcacagacgcgtgcgtctgccaggagaaggaagagcaacacgatatactcccatttgattgcaaaggagacaaccactgaccctatcatatcagcagccagggcct

SEQ ID NO: 389641 - DNA, 140 bp, Artificial Sequence
  Synthetic
atacgccatgctgggtctccgggggtaccaccggcgagaccagcaaatcaccaccagacgaacctgatgattcggaggcgggatccgtgtcttccatgcccccccttgagggggagcctgcgtacttgggagtcggccat

SEQ ID NO: 389642 - DNA, 140 bp, Artificial Sequence
  Synthetic
atggccgactcccaagtacgcaggctccccctcaagggggggcatggaagacacggatcccgcctccgaatcatcaggttcgtctggtggtgatttgctggtctcgccggtggtacccccggagacccagcatggcgtat

SEQ ID NO: 389643 - DNA, 140 bp, Artificial Sequence
  Synthetic
aggccctggctgctgatatgacaccatgcacctgcggcagctcggacctttacttggtcacgaggcatgctgatgtcatcccggtgcgccggcggggcgacagcagggggagcctgctttgaccttttgggacagcggtg

SEQ ID NO: 389644 - DNA, 140 bp, Artificial Sequence
  Synthetic
caccgctgtcccaaaaggtcaaagcaggctccccctgctgtcgccccgccggcgcaccgggatgacatcagcatgcctcgtgaccaagtaaaggtccgagctgccgcaggtgcatggtgtcatatcagcagccagggcct

SEQ ID NO: 389645 - DNA, 140 bp, Artificial Sequence
  Synthetic
atacgccatgctgggtctcccgatgtggacgactctgtggtgtgttgctccatgtcatactcctggaccggggcgttgataactccctgtagtccagaagaggaaaagttaccaataaaccgtacttgggagtcggccat

SEQ ID NO: 389646 - DNA, 140 bp, Artificial Sequence
  Synthetic
atggccgactcccaagtacggtttattggtaacttttcctcttctggactacagggagttatcaacgccccggtccaggagtatgacatggagcaacacaccacagagtcgtccacatcgggagacccagcatggcgtat

SEQ ID NO: 389647 - DNA, 140 bp, Artificial Sequence
  Synthetic
atacgccatgctgggtctccaactactagactctcattatgaatcagtcttgaaggacgtcaagcaggcagccaccaaggtcagtgctaagctcctctccatcgaggaggcatgtgcattcgtacttgggagtcggccat

SEQ ID NO: 389648 - DNA, 140 bp, Artificial Sequence
  Synthetic
atggccgactcccaagtacgaatgcacatgcctcctcgatggagaggagcttagcactgaccttggtggctgcctgcttgacgtccttcaagactgattcataatgagagtctagtagttggagacccagcatggcgtat

SEQ ID NO: 389649 - DNA, 140 bp, Artificial Sequence
  Synthetic
atacgccatgctgggtctccgacctcctggaagaccactgttcaccaattgatacaaccatcatggccaaaaacgaggtgttctgcgttgaccccaccaaaggtggaaagaaaccggctccgtacttgggagtcggccat

SEQ ID NO: 389650 - DNA, 140 bp, Artificial Sequence
  Synthetic
atggccgactcccaagtacggagccggtttctttccacctttggtggggtcaacgcagaacacctcgtttttggccatgatggttgtatcaattggtgaacagtggtcttccaggaggtcggagacccagcatggcgtat

SEQ ID NO: 389651 - DNA, 140 bp, Artificial Sequence
  Synthetic
atacgccatgctgggtctcccggattccagtactctccagcccagcgggtcgatttcctcctacaagcgtggaaggaaaagaagacccctatggggttttcctatgacacccgctgttttcgtacttgggagtcggccat

SEQ ID NO: 389652 - DNA, 140 bp, Artificial Sequence
  Synthetic
atggccgactcccaagtacgaaaacagcgggtgtcataggaaaaccccataggggtcttcttttccttccacgcttgtaggaggaaatcgacccgctgggctggagagtactggaatccgggagacccagcatggcgtat

SEQ ID NO: 389653 - DNA, 140 bp, Artificial Sequence
  Synthetic
aggccctggctgctgatatgggagagattcccttttatggcaaagccatccccatcgagaccatcaagggggggaggcatctcattttctgccattccaagaagaaatgtgacgagctcggaccttttgggacagcggtg

SEQ ID NO: 389654 - DNA, 140 bp, Artificial Sequence
  Synthetic
caccgctgtcccaaaaggtccgagctcgtcacatttcttcttggaatggcagaaaatgagatgcctcccccccttgatggtctcgatggggatggctttgccataaaagggaatctctcccatatcagcagccagggcct

SEQ ID NO: 389655 - DNA, 140 bp, Artificial Sequence
  Synthetic
aggccctggctgctgatatgggggtggcgactccttgcgcctatcacggcctactcccaacagacgcggggcctacttggctgcatcatcactagcctcacaggccgggacaagaaccaggaccttttgggacagcggtg

SEQ ID NO: 389656 - DNA, 140 bp, Artificial Sequence
  Synthetic
caccgctgtcccaaaaggtcctggttcttgtcccggcctgtgaggctagtgatgatgcagccaagtaggccccgcgtctgttgggagtaggccgtgataggcgcaaggagtcgccacccccatatcagcagccagggcct

SEQ ID NO: 389657 - DNA, 140 bp, Artificial Sequence
  Synthetic
atacgccatgctgggtctccagagactatacgtagggggccccatgacaaacagcaaagggcaatcctgcggatacaggcgttgtcgcgcgagcggagtgctcaccaccagcatgggcaacgtacttgggagtcggccat

SEQ ID NO: 389658 - DNA, 140 bp, Artificial Sequence
  Synthetic
atggccgactcccaagtacgttgcccatgctggtggtgagcactccgctcgcgcgacaacgcctgtatccgcaggattgccctttgctgtttgtcatggggccccctacgtatagtctctggagacccagcatggcgtat

SEQ ID NO: 389659 - DNA, 140 bp, Artificial Sequence
  Synthetic
atacgccatgctgggtctccgagagtcagggggtcgaggaggacgagcggaacctgagagtcttcacggaggctatgaccaggtactccgcccctcccggcgatcctcccaaagcagaatcgtacttgggagtcggccat

SEQ ID NO: 389660 - DNA, 140 bp, Artificial Sequence
  Synthetic
atggccgactcccaagtacgattctgctttgggaggatcgccgggaggggcggagtacctggtcatagcctccgtgaagactctcaggttccgctcgtcctcctcgaccccctgactctcggagacccagcatggcgtat

SEQ ID NO: 389661 - DNA, 140 bp, Artificial Sequence
  Synthetic
atacgccatgctgggtctccactcgccagggctgcctgggagacagcaagacactcccctgtcaattcatggctgggaaacatcatccagtacgccccgacagtttgggtgcgcatggtccgtacttgggagtcggccat

SEQ ID NO: 389662 - DNA, 140 bp, Artificial Sequence
  Synthetic
atggccgactcccaagtacggaccatgcgcacccaaactgtcggggcgtactggatgatgtttcccagccatgaattgacaggggagtgtcttgctgtctcccaggcagccctggcgagtggagacccagcatggcgtat

SEQ ID NO: 389663 - DNA, 140 bp, Artificial Sequence
  Synthetic
atacgccatgctgggtctccttggcacatcaacaggacggccttgaactgcaatgaaagcctccacaccggctggttaacagggcttttctcttaccgtcatgtcaactcttcaggctgtcgtacttgggagtcggccat

SEQ ID NO: 389664 - DNA, 140 bp, Artificial Sequence
  Synthetic
atggccgactcccaagtacgacagcctgaagagttgacatgacggtaagagaaaagccctgttaaccagccggtgtggaggctttcattgcagttcaaggccgtcctgttgatgtgccaaggagacccagcatggcgtat

SEQ ID NO: 389665 - DNA, 140 bp, Artificial Sequence
  Synthetic
aggccctggctgctgatatggtatttctccatggtggggaactgggcgaaggtcctggtagtgctgctgctatttgccggcgtcgacgcggaaacccacgtcaccgggggaagtgccgctgaccttttgggacagcggtg

SEQ ID NO: 389666 - DNA, 140 bp, Artificial Sequence
  Synthetic
caccgctgtcccaaaaggtcagcggcacttcccccggtgacgtgggtttccgcgtcgacgccggcaaatagcagcagcactaccaggaccttcgcccagttccccaccatggagaaataccatatcagcagccagggcct

SEQ ID NO: 389667 - DNA, 140 bp, Artificial Sequence
  Synthetic
atacgccatgctgggtctccacctcccggccataattgagagactacatgggcttgaagccttttcactgcactcatactctccccacgaactcactcgggtggctgccgctctcagaaacgtacttgggagtcggccat

SEQ ID NO: 389668 - DNA, 140 bp, Artificial Sequence
  Synthetic
atggccgactcccaagtacgtttctgagagcggcagccacccgagtgagttcgtggggagagtatgagtgcagtgaaaaggcttcaagcccatgtagtctctcaattatggccgggaggtggagacccagcatggcgtat

SEQ ID NO: 389669 - DNA, 140 bp, Artificial Sequence
  Synthetic
aggccctggctgctgatatgtgtggtccggtgtattgcttcactcccagccccgtggtagtgggaacgaccgacgcgttgggcgtccctacctacaactggggtgaaaatgaaacggacggaccttttgggacagcggtg

SEQ ID NO: 389670 - DNA, 140 bp, Artificial Sequence
  Synthetic
caccgctgtcccaaaaggtccgtccgtttcattttcaccccagttgtaggtagggacgcccaacgcgtcggtcgttcccactaccacggggctgggagtgaagcaatacaccggaccacacatatcagcagccagggcct

SEQ ID NO: 389671 - DNA, 140 bp, Artificial Sequence
  Synthetic
atacgccatgctgggtctccctcttcaactgggctgtgaggacgaagctcaaactcactccattgccggcggcacgcctcctggacttgtccagctggttcaccgtcagcgctggcggggcgtacttgggagtcggccat

SEQ ID NO: 389672 - DNA, 140 bp, Artificial Sequence
  Synthetic
atggccgactcccaagtacgccccgccagcgctgacggtgaaccagctggacaagtccaggaggcgtgccgccggcaatggagtgagtttgagcttcgtcctcacagcccagttgaagagggagacccagcatggcgtat

SEQ ID NO: 389673 - DNA, 140 bp, Artificial Sequence
  Synthetic
aggccctggctgctgatatgtccgcaagcatccggaagccacatactctcggtgcggctccggtccctggattacacccaggtgcctggtccactacccgtataggctttggcattatccgaccttttgggacagcggtg

SEQ ID NO: 389674 - DNA, 140 bp, Artificial Sequence
  Synthetic
caccgctgtcccaaaaggtcggataatgccaaagcctatacgggtagtggaccaggcacctgggtgtaatccagggaccggagccgcaccgagagtatgtggcttccggatgcttgcggacatatcagcagccagggcct

SEQ ID NO: 389675 - DNA, 140 bp, Artificial Sequence
  Synthetic
aggccctggctgctgatatgggggaacggccttcgggtatgttcgattcctcggtcctgtgcgagtgctatgacgcgggttgcgcttggtatgagctcacacccgccgagacctcagtcagaccttttgggacagcggtg

SEQ ID NO: 389676 - DNA, 140 bp, Artificial Sequence
  Synthetic
caccgctgtcccaaaaggtctgactgaggtctcggcgggtgtgagctcataccaagcgcaacccgcgtcatagcactcgcacaggaccgaggaatcgaacatacccgaaggccgttcccccatatcagcagccagggcct

SEQ ID NO: 389677 - DNA, 140 bp, Artificial Sequence
  Synthetic
aggccctggctgctgatatgggatgatgttactcatatcccaagcggaggcggctttggagaacctcgtagtactcaatgcagcatccttggccgggacgcacggtcttgtgtccttcctgaccttttgggacagcggtg

SEQ ID NO: 389678 - DNA, 140 bp, Artificial Sequence
  Synthetic
caccgctgtcccaaaaggtcaggaaggacacaagaccgtgcgtcccggccaaggatgctgcattgagtactacgaggttctccaaagccgcctccgcttgggatatgagtaacatcatcccatatcagcagccagggcct

SEQ ID NO: 389679 - DNA, 140 bp, Artificial Sequence
  Synthetic
atacgccatgctgggtctccagcccatcccaaaagatcggcgcaccactggcaagtcctggggacgtccaggatacccttggcccctgtatgggaatgagggcctcggttgggcagggtgcgtacttgggagtcggccat

SEQ ID NO: 389680 - DNA, 140 bp, Artificial Sequence
  Synthetic
atggccgactcccaagtacgcaccctgcccaaccgaggccctcattcccatacaggggccaagggtatcctggacgtccccaggacttgccagtggtgcgccgatcttttgggatgggctggagacccagcatggcgtat

SEQ ID NO: 389681 - DNA, 140 bp, Artificial Sequence
  Synthetic
atacgccatgctgggtctcctttgccgacctcatggggtacattcccgtcgtcggcgccccagtgggcggcgttgccagagctcttgcgcacggcgtgagagtcctggaggacgggataacgtacttgggagtcggccat

SEQ ID NO: 389682 - DNA, 140 bp, Artificial Sequence
  Synthetic
atggccgactcccaagtacgttatcccgtcctccaggactctcacgccgtgcgcaagagctctggcaacgccgcccactggggcgccgacgacgggaatgtaccccatgaggtcggcaaaggagacccagcatggcgtat

SEQ ID NO: 389683 - DNA, 140 bp, Artificial Sequence
  Synthetic
aggccctggctgctgatatgcgttgccagagctcttgcgcacggcgtgagagtcctggaggacgggataaattatgcgacggggaaccttcccggttgctctttctctatcttcttgttagaccttttgggacagcggtg

SEQ ID NO: 389684 - DNA, 140 bp, Artificial Sequence
  Synthetic
caccgctgtcccaaaaggtctaacaagaagatagagaaagagcaaccgggaaggttccccgtcgcataatttatcccgtcctccaggactctcacgccgtgcgcaagagctctggcaacgcatatcagcagccagggcct

SEQ ID NO: 389685 - DNA, 140 bp, Artificial Sequence
  Synthetic
atacgccatgctgggtctcccaccagtcacatatatatggtgaccaatgactgttcaaacagcagtatcacctggcagcttcaggacgcagtgcttcaccttcctggatgcgtcccctgtcgtacttgggagtcggccat

SEQ ID NO: 389686 - DNA, 140 bp, Artificial Sequence
  Synthetic
atggccgactcccaagtacgacaggggacgcatccaggaaggtgaagcactgcgtcctgaagctgccaggtgatactgctgtttgaacagtcattggtcaccatatatatgtgactggtgggagacccagcatggcgtat

SEQ ID NO: 389687 - DNA, 140 bp, Artificial Sequence
  Synthetic
atacgccatgctgggtctccacatcatcgtggcgtccgcaacggtttgctctgccctctacataggggatttgtgtggctcgatcatgatagctgctcaagttgtcatcgcctcgccgaacgtacttgggagtcggccat

SEQ ID NO: 389688 - DNA, 140 bp, Artificial Sequence
  Synthetic
atggccgactcccaagtacgttcggcgaggcgatgacaacttgagcagctatcatgatcgagccacacaaatcccctatgtagagggcagagcaaaccgttgcggacgccacgatgatgtggagacccagcatggcgtat

SEQ ID NO: 389689 - DNA, 140 bp, Artificial Sequence
  Synthetic
aggccctggctgctgatatgttgtgtggctcgatcatgatagctgctcaagttgtcatcgcctcgccgaaacaccacaatttcgtccaggactgcaactgttccatctacccgggccatggaccttttgggacagcggtg

SEQ ID NO: 389690 - DNA, 140 bp, Artificial Sequence
  Synthetic
caccgctgtcccaaaaggtccatggcccgggtagatggaacagttgcagtcctggacgaaattgtggtgtttcggcgaggcgatgacaacttgagcagctatcatgatcgagccacacaacatatcagcagccagggcct

SEQ ID NO: 389691 - DNA, 140 bp, Artificial Sequence
  Synthetic
atacgccatgctgggtctccgatcatcgccggtggccactggggggtggtgttcggcctagcctatttctccatgcaaggagcgtgggcaaaggtcgtcgtcatcctcctgctgtcagctcgtacttgggagtcggccat

SEQ ID NO: 389692 - DNA, 140 bp, Artificial Sequence
  Synthetic
atggccgactcccaagtacgagctgacagcaggaggatgacgacgacctttgcccacgctccttgcatggagaaataggctaggccgaacaccaccccccagtggccaccggcgatgatcggagacccagcatggcgtat

SEQ ID NO: 389693 - DNA, 140 bp, Artificial Sequence
  Synthetic
atacgccatgctgggtctcctcatcaacaccaatggcagctggcacataaaccgtactgccctcaactgcaatgactccctgcagaccggcttcatcgcatccttgttctacgccaacagcgtacttgggagtcggccat

SEQ ID NO: 389694 - DNA, 140 bp, Artificial Sequence
  Synthetic
atggccgactcccaagtacgctgttggcgtagaacaaggatgcgatgaagccggtctgcagggagtcattgcagttgagggcagtacggtttatgtgccagctgccattggtgttgatgaggagacccagcatggcgtat

SEQ ID NO: 389695 - DNA, 140 bp, Artificial Sequence
  Synthetic
atacgccatgctgggtctccaacgaggaagacatgaggccctactgttggcattacccacctaagccgtgtggtgtggttcctgccaagtctgtgtgtggcccagtctactgtttcaccccgtacttgggagtcggccat

SEQ ID NO: 389696 - DNA, 140 bp, Artificial Sequence
  Synthetic
atggccgactcccaagtacggggtgaaacagtagactgggccacacacagacttggcaggaaccacaccacacggcttaggtgggtaatgccaacagtagggcctcatgtcttcctcgttggagacccagcatggcgtat

SEQ ID NO: 389697 - DNA, 140 bp, Artificial Sequence
  Synthetic
atacgccatgctgggtctcctcccaagggagcctggtttggatgcacatggatgaatggcaccggatttaccaaaacgtgcggtgcgccaccgtgccgcatcaggcgggatttcaatgcccgtacttgggagtcggccat

SEQ ID NO: 389698 - DNA, 140 bp, Artificial Sequence
  Synthetic
atggccgactcccaagtacgggcattgaaatcccgcctgatgcggcacggtggcgcaccgcacgttttggtaaatccggtgccattcatccatgtgcatccaaaccaggctcccttgggaggagacccagcatggcgtat

SEQ ID NO: 389699 - DNA, 140 bp, Artificial Sequence
  Synthetic
atacgccatgctgggtctcctcgactacccctacaggctgtggcattacccatgcaccttcaactataccatctttaagataaggatgtttgtggggggaattgaacacaggctccaagccgtacttgggagtcggccat

SEQ ID NO: 389700 - DNA, 140 bp, Artificial Sequence
  Synthetic
atggccgactcccaagtacggcttggagcctgtgttcaattccccccacaaacatccttatcttaaagatggtatagttgaaggtgcatgggtaatgccacagcctgtaggggtagtcgaggagacccagcatggcgtat

SEQ ID NO: 389701 - DNA, 140 bp, Artificial Sequence
  Synthetic
atacgccatgctgggtctccccctgttcctttacagacctaccagccctctccacaggactcatccacctccaccagaacatcgtcgacgtccagtacctgtatggcctgacacctgccacgtacttgggagtcggccat

SEQ ID NO: 389702 - DNA, 140 bp, Artificial Sequence
  Synthetic
atggccgactcccaagtacgtggcaggtgtcaggccatacaggtactggacgtcgacgatgttctggtggaggtggatgagtcctgtggagagggctggtaggtctgtaaaggaacagggggagacccagcatggcgtat

SEQ ID NO: 389703 - DNA, 140 bp, Artificial Sequence
  Synthetic
aggccctggctgctgatatgtgcccctcggggcacgctgtgggcatcttccgggctgctgtgtgcacccggggggttgcgaaggcggtggactttatacccgttgagtccatggaaaccagaccttttgggacagcggtg

SEQ ID NO: 389704 - DNA, 140 bp, Artificial Sequence
  Synthetic
caccgctgtcccaaaaggtctggtttccatggactcaacgggtataaagtccaccgccttcgcaaccccccgggtgcacacagcagcccggaagatgcccacagcgtgccccgaggggcacatatcagcagccagggcct

SEQ ID NO: 389705 - DNA, 140 bp, Artificial Sequence
  Synthetic
atacgccatgctgggtctcctcaggctgaagcggcactggaaaagctggttgtcctgcacgctgccagcgcagctagttcccatggcttactatacttcatcctcttctttgtagcagctcgtacttgggagtcggccat

SEQ ID NO: 389706 - DNA, 140 bp, Artificial Sequence
  Synthetic
atggccgactcccaagtacgagctgctacaaagaagaggatgaagtatagtaagccatgggaactagctgcgctggcagcgtgcaggacaaccagcttttccagtgccgcttcagcctgaggagacccagcatggcgtat

SEQ ID NO: 389707 - DNA, 140 bp, Artificial Sequence
  Synthetic
atacgccatgctgggtctcccccttgacgcagctgaacagggccagctcggtctcgcgctgctggtgatcataactgctttcacactcaccccggcatataagatccttctcacccggtgcgtacttgggagtcggccat

SEQ ID NO: 389708 - DNA, 140 bp, Artificial Sequence
  Synthetic
atggccgactcccaagtacgcaccgggtgagaaggatcttatatgccggggtgagtgtgaaagcagttatgatcaccagcagcgcgagaccgagctggccctgttcagctgcgtcaagggggagacccagcatggcgtat

SEQ ID NO: 389709 - DNA, 140 bp, Artificial Sequence
  Synthetic
atacgccatgctgggtctccgccgcaaccatgttctgcccgggtgtagtgtttgacataacaaagtggctcctggcgatcctggggcctggctacctcttgagggaggtcttgacaggtgcgtacttgggagtcggccat

SEQ ID NO: 389710 - DNA, 140 bp, Artificial Sequence
  Synthetic
atggccgactcccaagtacgcacctgtcaagacctccctcaagaggtagccaggccccaggatcgccaggagccactttgttatgtcaaacactacacccgggcagaacatggttgcggcggagacccagcatggcgtat

SEQ ID NO: 389711 - DNA, 140 bp, Artificial Sequence
  Synthetic
atacgccatgctgggtctcctaggtggctcggcatatacatctacgaccacctcacccccatgtcggactgggctgctagaggacttcgggacctagcggtcgctgtagagcccattgtccgtacttgggagtcggccat

SEQ ID NO: 389712 - DNA, 140 bp, Artificial Sequence
  Synthetic
atggccgactcccaagtacggacaatgggctctacagcgaccgctaggtcccgaagtcctctagcagcccagtccgacatgggggtgaggtggtcgtagatgtatatgccgagccacctaggagacccagcatggcgtat

SEQ ID NO: 389713 - DNA, 140 bp, Artificial Sequence
  Synthetic
atacgccatgctgggtctccaggagatgaaggcgaaggcgtccacagttaaggctaaacttctatccgtagaggaagcctgcaagctgacgcccccacattcggccagatccaagtttggcgtacttgggagtcggccat

SEQ ID NO: 389714 - DNA, 140 bp, Artificial Sequence
  Synthetic
atggccgactcccaagtacgccaaacttggatctggccgaatgtgggggcgtcagcttgcaggcttcctctacggatagaagtttagccttaactgtggacgccttcgccttcatctcctggagacccagcatggcgtat

SEQ ID NO: 389715 - DNA, 140 bp, Artificial Sequence
  Synthetic
atacgccatgctgggtctccaagtcttgctaggtcccgctgacggctacacctccaaagggtggagactcctcgctcccattaccgcttacgcccagcagacacgtggcctgctgggcgccgtacttgggagtcggccat

SEQ ID NO: 389716 - DNA, 140 bp, Artificial Sequence
  Synthetic
atggccgactcccaagtacggcgcccagcaggccacgtgtctgctgggcgtaagcggtaatgggagcgaggagtctccaccctttggaggtgtagccgtcagcgggacctagcaagacttggagacccagcatggcgtat

SEQ ID NO: 389717 - DNA, 140 bp, Artificial Sequence
  Synthetic
atacgccatgctgggtctccggggttctctggaccgtgttccacggcgccggcaacaagacgttggctggatctcgcggtccagtcacgcagatgtataccagcgcagaaggagacctcgcgtacttgggagtcggccat

SEQ ID NO: 389718 - DNA, 140 bp, Artificial Sequence
  Synthetic
atggccgactcccaagtacgcgaggtctccttctgcgctggtatacatctgcgtgactggaccgcgagatccagccaacgtcttgttgccggcgccgtggaacacggtccagagaaccccggagacccagcatggcgtat

SEQ ID NO: 389719 - DNA, 140 bp, Artificial Sequence
  Synthetic
atacgccatgctgggtctcctcggagacagggagaccgacgagcggcactgctatccccgcggcccctctcaacattgaaggggtcctcaggaggacctgtcctctgttccagggctcatcgtacttgggagtcggccat

SEQ ID NO: 389720 - DNA, 140 bp, Artificial Sequence
  Synthetic
atggccgactcccaagtacgatgagccctggaacagaggacaggtcctcctgaggaccccttcaatgttgagaggggccgcggggatagcagtgccgctcgtcggtctccctgtctccgaggagacccagcatggcgtat

SEQ ID NO: 389721 - DNA, 140 bp, Artificial Sequence
  Synthetic
atacgccatgctgggtctccgcttcactgacaatggcacgcccccagcagtgcctcagacctaccaggtagggtacctgcatgctcctaccggaagcgggaagagtaccaaggttcctgccgtacttgggagtcggccat

SEQ ID NO: 389722 - DNA, 140 bp, Artificial Sequence
  Synthetic
atggccgactcccaagtacggcaggaaccttggtactcttcccgcttccggtaggagcatgcaggtaccctacctggtaggtctgaggcactgctgggggcgtgccattgtcagtgaagcggagacccagcatggcgtat

SEQ ID NO: 389723 - DNA, 140 bp, Artificial Sequence
  Synthetic
atacgccatgctgggtctcccccaacgtcagaaccggaatccgaactgtgacgaccggagagtctatcacctactccacatatggcaaattcctcgcagatggaggctgcgcaggcggagcgtacttgggagtcggccat

SEQ ID NO: 389724 - DNA, 140 bp, Artificial Sequence
  Synthetic
atggccgactcccaagtacgctccgcctgcgcagcctccatctgcgaggaatttgccatatgtggagtaggtgatagactctccggtcgtcacagttcggattccggttctgacgttgggggagacccagcatggcgtat

SEQ ID NO: 389725 - DNA, 140 bp, Artificial Sequence
  Synthetic
atacgccatgctgggtctccgttgacggttctggcgacggcaacgccgcctgggtccgttacaacgcctcaccccaacattgaggaggtagccctaggccacgagggcgagatccccttccgtacttgggagtcggccat

SEQ ID NO: 389726 - DNA, 140 bp, Artificial Sequence
  Synthetic
atggccgactcccaagtacggaaggggatctcgccctcgtggcctagggctacctcctcaatgttggggtgaggcgttgtaacggacccaggcggcgttgccgtcgccagaaccgtcaacggagacccagcatggcgtat

SEQ ID NO: 389727 - DNA, 140 bp, Artificial Sequence
  Synthetic
aggccctggctgctgatatgcatgcaagcccttgctgcgggatgaagtatcgtttagagtgggactccacgggtacccggtaggatcgcaattaccttgcgagcccgaaccggacgtatcgaccttttgggacagcggtg

SEQ ID NO: 389728 - DNA, 140 bp, Artificial Sequence
  Synthetic
caccgctgtcccaaaaggtcgatacgtccggttcgggctcgcaaggtaattgcgatcctaccgggtacccgtggagtcccactctaaacgatacttcatcccgcagcaagggcttgcatgcatatcagcagccagggcct

SEQ ID NO: 389729 - DNA, 140 bp, Artificial Sequence
  Synthetic
aggccctggctgctgatatggccagccaactatccgcaccatctctcaaggcaacttgcgctaccaaccatgactcccctgacgccgagctcatacaggccaacctcctgtggtggcagggaccttttgggacagcggtg

SEQ ID NO: 389730 - DNA, 140 bp, Artificial Sequence
  Synthetic
caccgctgtcccaaaaggtccctgccaccacaggaggttggcctgtatgagctcggcgtcaggggagtcatggttggtagcgcaagttgccttgagagatggtgcggatagttggctggccatatcagcagccagggcct

SEQ ID NO: 389731 - DNA, 140 bp, Artificial Sequence
  Synthetic
atacgccatgctgggtctccttttaacacaccagggttgcccgtgtgccaagaccatctggaattctgggaggcggtttttactggcctcacccacattgatgcccatttcctctctcaacgtacttgggagtcggccat

SEQ ID NO: 389732 - DNA, 140 bp, Artificial Sequence
  Synthetic
atggccgactcccaagtacgttgagagaggaaatgggcatcaatgtgggtgaggccagtaaaaaccgcctcccagaattccagatggtcttggcacacgggcaaccctggtgtgttaaaaggagacccagcatggcgtat

SEQ ID NO: 389733 - DNA, 140 bp, Artificial Sequence
  Synthetic
atacgccatgctgggtctccagtgtcttatccggcttaagcctacactaacaggcccaacacctttgctatatcgcttgggcgcggtcagcaatgaagtcaccctcacccaccccgtgaccgtacttgggagtcggccat

SEQ ID NO: 389734 - DNA, 140 bp, Artificial Sequence
  Synthetic
atggccgactcccaagtacggtcacggggtgggtgagggtgacttcattgctgaccgcgcccaagcgatatagcaaaggtgttgggcctgttagtgtaggcttaagccggataagacactggagacccagcatggcgtat

SEQ ID NO: 389735 - DNA, 140 bp, Artificial Sequence
  Synthetic
atacgccatgctgggtctccgcaactggctgtgtctccaccattggccggatacacatcaaccaacgtgcaatcattgcccctgacaaagaggtcctttacgaggcttttgacgagatggcgtacttgggagtcggccat

SEQ ID NO: 389736 - DNA, 140 bp, Artificial Sequence
  Synthetic
atggccgactcccaagtacgccatctcgtcaaaagcctcgtaaaggacctctttgtcaggggcaatgattgcacgttggttgatgtgtatccggccaatggtggagacacagccagttgcggagacccagcatggcgtat

SEQ ID NO: 389737 - DNA, 140 bp, Artificial Sequence
  Synthetic
aggccctggctgctgatatgcaagcattgtgtatgaggcagcggacatgatcatgcacacccccgggtgcgtgccctgcgtccgggagaacaactcctcccgctgctgggtagcgctcacgaccttttgggacagcggtg

SEQ ID NO: 389738 - DNA, 140 bp, Artificial Sequence
  Synthetic
caccgctgtcccaaaaggtcgtgagcgctacccagcagcgggaggagttgttctcccggacgcagggcacgcacccgggggtgtgcatgatcatgtccgctgcctcatacacaatgcttgcatatcagcagccagggcct

SEQ ID NO: 389739 - DNA, 140 bp, Artificial Sequence
  Synthetic
atacgccatgctgggtctccggctcagaatgtgcagcctgccgtccaggctacttggcccaagctggagcagttctgggccaagcacatgtggaacttcatcagcggtatccaatatcttcgtacttgggagtcggccat

SEQ ID NO: 389740 - DNA, 140 bp, Artificial Sequence
  Synthetic
atggccgactcccaagtacgaagatattggataccgctgatgaagttccacatgtgcttggcccagaactgctccagcttgggccaagtagcctggacggcaggctgcacattctgagccggagacccagcatggcgtat

SEQ ID NO: 389741 - DNA, 140 bp, Artificial Sequence
  Synthetic
atacgccatgctgggtctcctcaacatcatgggaggttggctagcctcacagatctctcctccagcaagtgccactggcttcgttgtcagtggcctggtgggggctgctgtaggtagtatcgtacttgggagtcggccat

SEQ ID NO: 389742 - DNA, 140 bp, Artificial Sequence
  Synthetic
atggccgactcccaagtacgatactacctacagcagcccccaccaggccactgacaacgaagccagtggcacttgctggaggagagatctgtgaggctagccaacctcccatgatgttgaggagacccagcatggcgtat

SEQ ID NO: 389743 - DNA, 140 bp, Artificial Sequence
  Synthetic
atacgccatgctgggtctccaggtctaggcaagatactggtggacgtcctggccgggtacggtgcaggtatctcgggagccctcgtcgcctttaagatcatgtctggcgagaagccctctcgtacttgggagtcggccat

SEQ ID NO: 389744 - DNA, 140 bp, Artificial Sequence
  Synthetic
atggccgactcccaagtacgagagggcttctcgccagacatgatcttaaaggcgacgagggctcccgagatacctgcaccgtacccggccaggacgtccaccagtatcttgcctagacctggagacccagcatggcgtat

SEQ ID NO: 389745 - DNA, 140 bp, Artificial Sequence
  Synthetic
aggccctggctgctgatatgctggcataactagagtgccgtactttgtgcgcgctcaagggctcattcgtgcatgcatgttggtgcggaaagtcgctgggggtcattatgtccaaatggcgaccttttgggacagcggtg

SEQ ID NO: 389746 - DNA, 140 bp, Artificial Sequence
  Synthetic
caccgctgtcccaaaaggtcgccatttggacataatgacccccagcgactttccgcaccaacatgcatgcacgaatgagcccttgagcgcgcacaaagtacggcactctagttatgccagcatatcagcagccagggcct

SEQ ID NO: 389747 - DNA, 140 bp, Artificial Sequence
  Synthetic
aggccctggctgctgatatggggaaggcgcggtccaatggatgaataggctcattgcctttgcgtccagaggtaaccatgtcgccccgacacattacgtgacggagtcagacgcgtccaagaccttttgggacagcggtg

SEQ ID NO: 389748 - DNA, 140 bp, Artificial Sequence
  Synthetic
caccgctgtcccaaaaggtcttggacgcgtctgactccgtcacgtaatgtgtcggggcgacatggttacctctggacgcaaaggcaatgagcctattcatccattggaccgcgccttccccatatcagcagccagggcct

SEQ ID NO: 389749 - DNA, 140 bp, Artificial Sequence
  Synthetic
aggccctggctgctgatatgaaatccagctcataaacaccaacggcagctggcacatcaacaggactgccctgaactgcaatgactccctccacactgggttccttgctgcgctgttctagaccttttgggacagcggtg

SEQ ID NO: 389750 - DNA, 140 bp, Artificial Sequence
  Synthetic
caccgctgtcccaaaaggtctagaacagcgcagcaaggaacccagtgtggagggagtcattgcagttcagggcagtcctgttgatgtgccagctgccgttggtgtttatgagctggatttcatatcagcagccagggcct

SEQ ID NO: 389751 - DNA, 140 bp, Artificial Sequence
  Synthetic
aggccctggctgctgatatgctgaactgcaatgactccctccacactgggttccttgctgcgctgttctacacacacaagttcaacgcgtcaggatgcccagagcgcatggccagctgccgaccttttgggacagcggtg

SEQ ID NO: 389752 - DNA, 140 bp, Artificial Sequence
  Synthetic
caccgctgtcccaaaaggtcggcagctggccatgcgctctgggcatcctgacgcgttgaacttgtgtgtgtagaacagcgcagcaaggaacccagtgtggagggagtcattgcagttcagcatatcagcagccagggcct

SEQ ID NO: 389753 - DNA, 140 bp, Artificial Sequence
  Synthetic
atacgccatgctgggtctcctggctctgggacgtgtgggattggatctgctccatcctaacggacttcaaaaattggttgtcctccaagctgttcccgaaaatgcctggccttccctttgcgtacttgggagtcggccat

SEQ ID NO: 389754 - DNA, 140 bp, Artificial Sequence
  Synthetic
atggccgactcccaagtacgcaaagggaaggccaggcattttcgggaacagcttggaggacaaccaatttttgaagtccgttaggatggagcagatccaatcccacacgtcccagagccaggagacccagcatggcgtat

SEQ ID NO: 389755 - DNA, 140 bp, Artificial Sequence
  Synthetic
atacgccatgctgggtctccgcgacctgcgtcaacggcgtgtgttggactgtctaccatggcgccggctcaaagaccctagccggcccaaagggcccaatcacccaaatgtacaccaatgcgtacttgggagtcggccat

SEQ ID NO: 389756 - DNA, 140 bp, Artificial Sequence
  Synthetic
atggccgactcccaagtacgcattggtgtacatttgggtgattgggccctttgggccggctagggtctttgagccggcgccatggtagacagtccaacacacgccgttgacgcaggtcgcggagacccagcatggcgtat

SEQ ID NO: 389757 - DNA, 140 bp, Artificial Sequence
  Synthetic
atacgccatgctgggtctccacttgaaggtcccctgccaaataccatctcctgaattcttctcctgggtggacggtgtgcaaatccacagatttgctcctaccccaaaaccgttcatcagcgtacttgggagtcggccat

SEQ ID NO: 389758 - DNA, 140 bp, Artificial Sequence
  Synthetic
atggccgactcccaagtacgctgatgaacggttttggggtaggagcaaatctgtggatttgcacaccgtccacccaggagaagaattcaggagatggtatttggcaggggaccttcaagtggagacccagcatggcgtat

SEQ ID NO: 389759 - DNA, 140 bp, Artificial Sequence
  Synthetic
atacgccatgctgggtctcccatctcatatcacggctgaggcggcagcagggcgattggcgcggggttcgcccccatcggaggccagctcttccgcaagtcagctatcagcgccttcgctcgtacttgggagtcggccat

SEQ ID NO: 389760 - DNA, 140 bp, Artificial Sequence
  Synthetic
atggccgactcccaagtacgagcgaaggcgctgatagctgacttgcggaagagctggcctccgatgggggcgaaccccgcgccaatcgccctgctgccgcctcagccgtgatatgagatgggagacccagcatggcgtat

SEQ ID NO: 389761 - DNA, 140 bp, Artificial Sequence
  Synthetic
atacgccatgctgggtctcccaaggtgatcatgttggactccctcgactcaatgaccgagggggaggacgagcgcgagccttccgttccatcagagtacttgctccccacaagggaaaaacgtacttgggagtcggccat

SEQ ID NO: 389762 - DNA, 140 bp, Artificial Sequence
  Synthetic
atggccgactcccaagtacgtttttcccttgtggggagcaagtactctgatggaacggaaggctcgcgctcgtcctccccctcggtcattgagtcgagggagtccaacatgatcaccttgggagacccagcatggcgtat

SEQ ID NO: 389763 - DNA, 140 bp, Artificial Sequence
  Synthetic
aggccctggctgctgatatgcggcagttggcacatcaacaggacggccttgaactgcaatgctagccttgacaccggctgggtagcagggcttttctattaccacaaattcaattcttcagaccttttgggacagcggtg

SEQ ID NO: 389764 - DNA, 140 bp, Artificial Sequence
  Synthetic
caccgctgtcccaaaaggtctgaagaattgaatttgtggtaatagaaaagccctgctacccagccggtgtcaaggctagcattgcagttcaaggccgtcctgttgatgtgccaactgccgcatatcagcagccagggcct

SEQ ID NO: 389765 - DNA, 140 bp, Artificial Sequence
  Synthetic
atacgccatgctgggtctccgtgcactcccccccccaggacaaaccccggtgcccccccccaggaggcgacgcaccgtggcactagaccagagcaccgtgggggaagctcttagagagctcgtacttgggagtcggccat

SEQ ID NO: 389766 - DNA, 140 bp, Artificial Sequence
  Synthetic
atggccgactcccaagtacgagctctctaagagcttcccccacggtgctctggtctagtgccacggtgcgtcgcctcctgggggggggcaccggggtttgtcctgggggggggagtgcacggagacccagcatggcgtat

SEQ ID NO: 389767 - DNA, 140 bp, Artificial Sequence
  Synthetic
aggccctggctgctgatatggagcatacgccatggaccgagagatggctgcatcgtgcggaggcgcggttttcgtaggcctggcactcttgaccttgtcaccacactacaaagtgttcctgaccttttgggacagcggtg

SEQ ID NO: 389768 - DNA, 140 bp, Artificial Sequence
  Synthetic
caccgctgtcccaaaaggtcaggaacactttgtagtgtggtgacaaggtcaagagtgccaggcctacgaaaaccgcgcctccgcacgatgcagccatctctcggtccatggcgtatgctccatatcagcagccagggcct

SEQ ID NO: 389769 - DNA, 140 bp, Artificial Sequence
  Synthetic
aggccctggctgctgatatgcgctaggctcatatggtggttacaatattttatcaccagagccgaggcgcatttgcaagtgtggatcccccctctcaacgttcgggggggccgcgatgccgaccttttgggacagcggtg

SEQ ID NO: 389770 - DNA, 140 bp, Artificial Sequence
  Synthetic
caccgctgtcccaaaaggtcggcatcgcggcccccccgaacgttgagaggggggatccacacttgcaaatgcgcctcggctctggtgataaaatattgtaaccaccatatgagcctagcgcatatcagcagccagggcct

SEQ ID NO: 389771 - DNA, 140 bp, Artificial Sequence
  Synthetic
atacgccatgctgggtctcctcagctgattcggaaacgggttccatgagctccatgccccccctcgagggggaacctggagacccagacttggagccaggaccggtcgagcaggagccttcgtacttgggagtcggccat

SEQ ID NO: 389772 - DNA, 140 bp, Artificial Sequence
  Synthetic
atggccgactcccaagtacgaaggctcctgctcgaccggtcctggctccaagtctgggtctccaggttccccctcgagggggggcatggagctcatggaacccgtttccgaatcagctgaggagacccagcatggcgtat

SEQ ID NO: 389773 - DNA, 140 bp, Artificial Sequence
  Synthetic
atacgccatgctgggtctccctggactggggccttgataaccccttgcagcccggaggaaggaaagttgcctatcaatccactcagcaactccttgttgcggtaccacaacaaggtataccgtacttgggagtcggccat

SEQ ID NO: 389774 - DNA, 140 bp, Artificial Sequence
  Synthetic
atggccgactcccaagtacggtataccttgttgtggtaccgcaacaaggagttgctgagtggattgataggcaactttccttcctccgggctgcaaggggttatcaaggccccagtccagggagacccagcatggcgtat

SEQ ID NO: 389775 - DNA, 140 bp, Artificial Sequence
  Synthetic
aggccctggctgctgatatggaagctggccgcactgacaggtacgtacgtttatgaccatcttactccactgcgggactgggcccatgcgggcctacgagaccttgcggtggcagttgaggaccttttgggacagcggtg

SEQ ID NO: 389776 - DNA, 140 bp, Artificial Sequence
  Synthetic
caccgctgtcccaaaaggtcctcaactgccaccgcaaggtctcgtaggcccgcatgggcccagtcccgcagtggagtaagatggtcataaacgtacgtacctgtcagtgcggccagcttccatatcagcagccagggcct

SEQ ID NO: 389777 - DNA, 140 bp, Artificial Sequence
  Synthetic
atacgccatgctgggtctccagcttgctgcctctaaggttagtgccaggcttctctcactagaagaggcatgcgcattgaccccgccccattctgcacgatccaagtacggatttggggccgtacttgggagtcggccat

SEQ ID NO: 389778 - DNA, 140 bp, Artificial Sequence
  Synthetic
atggccgactcccaagtacggccccaaatccgtacttggatcgtgcagaatggggcggggtcaatgcgcatgcctcttctagtgagagaagcctggcactaaccttagaggcagcaagctggagacccagcatggcgtat

SEQ ID NO: 389779 - DNA, 140 bp, Artificial Sequence
  Synthetic
atacgccatgctgggtctccatggccaaaaatgaggtgttctgtgtcgaccccgccaagggcgggaagaaggcagctcgcctcatcgtataccctgatctcggcgtcagggtctgcgaaacgtacttgggagtcggccat

SEQ ID NO: 389780 - DNA, 140 bp, Artificial Sequence
  Synthetic
atggccgactcccaagtacgtttcgcagaccctgacgccgagatcagggtatacgatgaggcgagctgccttcttcccgcccttggcggggtcgacacagaacacctcatttttggccatggagacccagcatggcgtat

SEQ ID NO: 389781 - DNA, 140 bp, Artificial Sequence
  Synthetic
atacgccatgctgggtctccgcgagcatggaaggaaaaacgggaccccatggggttctcatatgacactcgctgctttgactcaacggtcactgaaagagacatcagagttgaggagtcccgtacttgggagtcggccat

SEQ ID NO: 389782 - DNA, 140 bp, Artificial Sequence
  Synthetic
atggccgactcccaagtacgggactcctcaactctgatgtctctttcagtgaccgttgagtcaaagcagcgagtgtcatatgagaaccccatggggtcccgtttttccttccatgctcgcggagacccagcatggcgtat

SEQ ID NO: 389783 - DNA, 140 bp, Artificial Sequence
  Synthetic
atacgccatgctgggtctccaatcctgcggatacaggcgctgccgcgccagcggggtgctcaccactagcatgggaaacactctcacatgctacgtgaaagcccaagcggcctgtaaggccgtacttgggagtcggccat

SEQ ID NO: 389784 - DNA, 140 bp, Artificial Sequence
  Synthetic
atggccgactcccaagtacggccttacaggccgcttgggctttcacgtagcatgtgagagtgtttcccatgctagtggtgagcaccccgctggcgcggcagcgcctgtatccgcaggattggagacccagcatggcgtat

SEQ ID NO: 389785 - DNA, 140 bp, Artificial Sequence
  Synthetic
aggccctggctgctgatatgctggcgggcatagcgtatttctccatggtggggaactgggcgaaggtcctagtggtgctgctgctatttgccagcgtcgacgcggaaactcacgtcaccggaccttttgggacagcggtg

SEQ ID NO: 389786 - DNA, 140 bp, Artificial Sequence
  Synthetic
caccgctgtcccaaaaggtccggtgacgtgagtttccgcgtcgacgctggcaaatagcagcagcaccactaggaccttcgcccagttccccaccatggagaaatacgctatgcccgccagcatatcagcagccagggcct

SEQ ID NO: 389787 - DNA, 140 bp, Artificial Sequence
  Synthetic
atacgccatgctgggtctccttcacggaggctatgaccaggaattccgcccctcccggcgaccccccaaaacctgaatatgacttggagctgataacatcatgctcttccaatgtatctgcgtacttgggagtcggccat

SEQ ID NO: 389788 - DNA, 140 bp, Artificial Sequence
  Synthetic
atggccgactcccaagtacgcagatacattggaagagcatgatgttatcagctccaagtcatattcaggttttggggggtcgccgggaggggcggaattcctggtcatagcctccgtgaaggagacccagcatggcgtat

SEQ ID NO: 389789 - DNA, 140 bp, Artificial Sequence
  Synthetic
atacgccatgctgggtctccacttgctaatatcttctctcaaggcgccagccagaaaatccagctgatcaacaccaacggcagttggcacattaataggacggccttaaactgcaatgaacgtacttgggagtcggccat

SEQ ID NO: 389790 - DNA, 140 bp, Artificial Sequence
  Synthetic
atggccgactcccaagtacgttcattgcagtttaaggccgtcctattaatgtgccaactgccgttggtgttgatcagctggattttctggctggcgccttgagagaagatattagcaagtggagacccagcatggcgtat

SEQ ID NO: 389791 - DNA, 140 bp, Artificial Sequence
  Synthetic
atacgccatgctgggtctcccaatagcacggccttgaactgcaacgacagccttcacaccggctggttagcagggcttttctatcgctacaagttcaactcttcaggctgtcccgagaggcgtacttgggagtcggccat

SEQ ID NO: 389792 - DNA, 140 bp, Artificial Sequence
  Synthetic
atggccgactcccaagtacgcctctcgggacagcctgaagagttgaacttgtagcgatagaaaagccctgctaaccagccggtgtgaaggctgtcgttgcagttcaaggccgtgctattgggagacccagcatggcgtat

SEQ ID NO: 389793 - DNA, 140 bp, Artificial Sequence
  Synthetic
atacgccatgctgggtctcccaattcatggctgggaaacatcatccagtacgctccaacactgtgggtccgcatggtcctgatgacccattttttctccgtcctcatggcccaggacacccgtacttgggagtcggccat

SEQ ID NO: 389794 - DNA, 140 bp, Artificial Sequence
  Synthetic
atggccgactcccaagtacgggtgtcctgggccatgaggacggagaaaaaatgggtcatcaggaccatgcggacccacagtgttggagcgtactggatgatgtttcccagccatgaattgggagacccagcatggcgtat

SEQ ID NO: 389795 - DNA, 140 bp, Artificial Sequence
  Synthetic
aggccctggctgctgatatgcaacggccctactgctggcactaccctccaaaaccctgcggtatcgtgcccgcagggggtgtgtgtggcccagtatattgtttcactcccagtcctgtgggaccttttgggacagcggtg

SEQ ID NO: 389796 - DNA, 140 bp, Artificial Sequence
  Synthetic
caccgctgtcccaaaaggtcccacaggactgggagtgaaacaatatactgggccacacacaccccctgcgggcacgataccgcagggttttggagggtagtgccagcagtagggccgttgcatatcagcagccagggcct

SEQ ID NO: 389797 - DNA, 140 bp, Artificial Sequence
  Synthetic
atacgccatgctgggtctcctctctctgcacacatactctccccacgaactcacgcgggtggcatctgctctcagaaagcttggagcgccccctcttagagcgtggaagagtcgggctcgcgtacttgggagtcggccat

SEQ ID NO: 389798 - DNA, 140 bp, Artificial Sequence
  Synthetic
atggccgactcccaagtacgcgagcccgactcttccacgctctaagagggggcgctccaagctttctgagagcagatgccacccgcgtgagttcgtggggagagtatgtgtgcagagagaggagacccagcatggcgtat

SEQ ID NO: 389799 - DNA, 140 bp, Artificial Sequence
  Synthetic
aggccctggctgctgatatgagctgtcgggcctcggactcaacgctgtagcgtattaccggggtcttgacgtgtccgtcataccatctagcggagacgtcgttgtcgtggcaacagacgcgaccttttgggacagcggtg

SEQ ID NO: 389800 - DNA, 140 bp, Artificial Sequence
  Synthetic
caccgctgtcccaaaaggtcgcgtctgttgccacgacaacgacgtctccgctagatggtatgacggacacgtcaagaccccggtaatacgctacagcgttgagtccgaggcccgacagctcatatcagcagccagggcct

SEQ ID NO: 389801 - DNA, 140 bp, Artificial Sequence
  Synthetic
atacgccatgctgggtctccaattcaactggattcaccaaagtgtgcggggcgcctccttgtgttatcaaaggagtgggcaacaagaccttgtactgtcccacagattgtttccgcaaaccgtacttgggagtcggccat

SEQ ID NO: 389802 - DNA, 140 bp, Artificial Sequence
  Synthetic
atggccgactcccaagtacggtttgcggaaacaatctgtgggacagtacaaggtcttgttgcccactcctttgataacacaaggaggcgccccgcacactttggtgaatccagttgaattggagacccagcatggcgtat

SEQ ID NO: 389803 - DNA, 140 bp, Artificial Sequence
  Synthetic
aggccctggctgctgatatggagcgcccccttgtgccatcggaggggcgggcaacaacaacaccctgcactgtcccactgattgtttccgcaaacatccggaagccacatactctcgatggaccttttgggacagcggtg

SEQ ID NO: 389804 - DNA, 140 bp, Artificial Sequence
  Synthetic
caccgctgtcccaaaaggtccatcgagagtatgtggcttccggatgtttgcggaaacaatcagtgggacagtgcagggtgttgttgttgcccgcccctccgatggcacaagggggcgctccatatcagcagccagggcct

SEQ ID NO: 389805 - DNA, 140 bp, Artificial Sequence
  Synthetic
atacgccatgctgggtctccttgcctgcggcgcgccttctggatctttccagctggttctccgtcagtgcaggcgggggcgacatatatcacagcgtgtcgcgagcccaccccgcatcttcgtacttgggagtcggccat

SEQ ID NO: 389806 - DNA, 140 bp, Artificial Sequence
  Synthetic
atggccgactcccaagtacgaagatgcggggtgggctcgcgacacgctgtgatatatgtcgcccccgcctgcactgacggagaaccagctggaaagatccagaaggcgcgccgcaggcaaggagacccagcatggcgtat

SEQ ID NO: 389807 - DNA, 140 bp, Artificial Sequence
  Synthetic
atacgccatgctgggtctcccctatggactgctgcagttgtggccgctcctgctcctcatattggcgttgcctcaacgggccttcgcctttgatcgtgagcaggcagcttccatgggagccgtacttgggagtcggccat

SEQ ID NO: 389808 - DNA, 140 bp, Artificial Sequence
  Synthetic
atggccgactcccaagtacggctcccatggaagctgcctgctcacgatcaaaggcgaaggcccgttgaggcaacgccaatatgaggagcaggagcggccacaactgcagcagtccataggggagacccagcatggcgtat

SEQ ID NO: 389809 - DNA, 140 bp, Artificial Sequence
  Synthetic
atacgccatgctgggtctccaaaaccaaaagaaacaccaaccgccgcccacaggacgttaagtttccgggcggcggccagatcgttggcggagtatacttgttgccgcgcaggggccccacgtacttgggagtcggccat

SEQ ID NO: 389810 - DNA, 140 bp, Artificial Sequence
  Synthetic
atggccgactcccaagtacgtggggcccctgcgcggcaacaagtatactccgccaacgatctggccgccgcccggaaacttaacgtcctgtgggcggcggttggtgtttcttttggttttggagacccagcatggcgtat

SEQ ID NO: 389811 - DNA, 140 bp, Artificial Sequence
  Synthetic
aggccctggctgctgatatgcaactgcacgtgtgggttccccccctcaacgtccggggggggcgtgacgccgtcatactactcacgtgtgttgtacacccgaccttgatattcgacatcagaccttttgggacagcggtg

SEQ ID NO: 389812 - DNA, 140 bp, Artificial Sequence
  Synthetic
caccgctgtcccaaaaggtctgatgtcgaatatcaaggtcgggtgtacaacacacgtgagtagtatgacggcgtcacgccccccccggacgttgagggggggaacccacacgtgcagttgcatatcagcagccagggcct

SEQ ID NO: 389813 - DNA, 140 bp, Artificial Sequence
  Synthetic
atacgccatgctgggtctccagcagcattacctggcagcttcagaatgctgtgctgcacgttcctggatgcatcccctgtgagcgaggggacgacaacaggtcccggtgttggataccagcgtacttgggagtcggccat

SEQ ID NO: 389814 - DNA, 140 bp, Artificial Sequence
  Synthetic
atggccgactcccaagtacgctggtatccaacaccgggacctgttgtcgtcccctcgctcacaggggatgcatccaggaacgtgcagcacagcattctgaagctgccaggtaatgctgctggagacccagcatggcgtat

SEQ ID NO: 389815 - DNA, 140 bp, Artificial Sequence
  Synthetic
atacgccatgctgggtctccctacataggggatttatgtggcgcaataatgatagctgctcaagttgtcgttgtctcgccacaacaccatcactttgttcaggactgcaactgttccatccgtacttgggagtcggccat

SEQ ID NO: 389816 - DNA, 140 bp, Artificial Sequence
  Synthetic
atggccgactcccaagtacggatggaacagttgcagtcctgaacaaagtgatggtgttgtggcgagacaacgacaacttgagcagctatcattattgcgccacataaatcccctatgtagggagacccagcatggcgtat

SEQ ID NO: 389817 - DNA, 140 bp, Artificial Sequence
  Synthetic
aggccctggctgctgatatgttgtctcgccacaacaccatcactttgttcaggactgcaactgttccatctacccgggccacatatctggacaccgtatggcatgggacatgatgatgaagaccttttgggacagcggtg

SEQ ID NO: 389818 - DNA, 140 bp, Artificial Sequence
  Synthetic
caccgctgtcccaaaaggtcttcatcatcatgtcccatgccatacggtgtccagatatgtggcccgggtagatggaacagttgcagtcctgaacaaagtgatggtgttgtggcgagacaacatatcagcagccagggcct

SEQ ID NO: 389819 - DNA, 140 bp, Artificial Sequence
  Synthetic
aggccctggctgctgatatgcttgcctatttctccatgcaaggagcgtgggcaaaggtcgtcgtcatcctcctcctgtcagccggggtggacgcggccactcggaccgtcgggagcctaggaccttttgggacagcggtg

SEQ ID NO: 389820 - DNA, 140 bp, Artificial Sequence
  Synthetic
caccgctgtcccaaaaggtcctaggctcccgacggtccgagtggccgcgtccaccccggctgacaggaggaggatgacgacgacctttgcccacgctccttgcatggagaaataggcaagcatatcagcagccagggcct

SEQ ID NO: 389821 - DNA, 140 bp, Artificial Sequence
  Synthetic
aggccctggctgctgatatgcacactccggggtgtgtcccttgcgttcacgagggtaacgcctcgaggtgttgggtggcggtgacccccacggtggccaccagggacggcaaactccccagaccttttgggacagcggtg

SEQ ID NO: 389822 - DNA, 140 bp, Artificial Sequence
  Synthetic
caccgctgtcccaaaaggtctggggagtttgccgtccctggtggccaccgtgggggtcaccgccacccaacacctcgaggcgttaccctcgtgaacgcaagggacacaccccggagtgtgcatatcagcagccagggcct

SEQ ID NO: 389823 - DNA, 140 bp, Artificial Sequence
  Synthetic
atacgccatgctgggtctccagccctcaactgtaatgactccctgaacaccgggtttcttgcatctttgttttacacccacaagtttaatgcatcgggctgccccgcgcgcctggcttcccgtacttgggagtcggccat

SEQ ID NO: 389824 - DNA, 140 bp, Artificial Sequence
  Synthetic
atggccgactcccaagtacgggaagccaggcgcgcggggcagcccgatgcattaaacttgtgggtgtaaaacaaagatgcaagaaacccggtgttcagggagtcattacagttgagggctggagacccagcatggcgtat

SEQ ID NO: 389825 - DNA, 140 bp, Artificial Sequence
  Synthetic
aggccctggctgctgatatgcaaaaacggttccatgaggatcgttgggcctagggcctgcagcaacacgtggcatggaacattccccatcaacgcatacaccacgggcccttgcacgcccgaccttttgggacagcggtg

SEQ ID NO: 389826 - DNA, 140 bp, Artificial Sequence
  Synthetic
caccgctgtcccaaaaggtcgggcgtgcaagggcccgtggtgtatgcgttgatggggaatgttccatgccacgtgttgctgcaggccctaggcccaacgatcctcatggaaccgtttttgcatatcagcagccagggcct

SEQ ID NO: 389827 - DNA, 140 bp, Artificial Sequence
  Synthetic
atacgccatgctgggtctcccgcctaagccatgcggtctggtctctgccctgtccgtgtgtggcccagtctactgtttcaccccctccccggtggtagtgggcacgaccgacaaattcggcgtacttgggagtcggccat

SEQ ID NO: 389828 - DNA, 140 bp, Artificial Sequence
  Synthetic
atggccgactcccaagtacgccgaatttgtcggtcgtgcccactaccaccggggagggggtgaaacagtagactgggccacacacggacagggcagagaccagaccgcatggcttaggcgggagacccagcatggcgtat

SEQ ID NO: 389829 - DNA, 140 bp, Artificial Sequence
  Synthetic
aggccctggctgctgatatggtacgtggaggttacgcgggtgggggatttccactacgtgacgggcatgaccactgacaacgtgaagtgcccatgccaggttccggcccccgaattcttcgaccttttgggacagcggtg

SEQ ID NO: 389830 - DNA, 140 bp, Artificial Sequence
  Synthetic
caccgctgtcccaaaaggtcgaagaattcgggggccggaacctggcatgggcacttcacgttgtcagtggtcatgcccgtcacgtagtggaaatcccccacccgcgtaacctccacgtaccatatcagcagccagggcct

SEQ ID NO: 389831 - DNA, 140 bp, Artificial Sequence
  Synthetic
atacgccatgctgggtctccgctaccggattcaccaaaacatgtggcgcaccaccgtgccgcattcggcaggaccccggagcaaagaatagtagcgacctgctatgccccacagattgctcgtacttgggagtcggccat

SEQ ID NO: 389832 - DNA, 140 bp, Artificial Sequence
  Synthetic
atggccgactcccaagtacgagcaatctgtggggcatagcaggtcgctactattctttgctccggggtcctgccgaatgcggcacggtggtgcgccacatgttttggtgaatccggtagcggagacccagcatggcgtat

SEQ ID NO: 389833 - DNA, 140 bp, Artificial Sequence
  Synthetic
aggccctggctgctgatatgttgggtcacagctcccatgtgagcccgagccggacgtggcagtgctcacttccatgctcaccgacccctcccacattacagcagagacggctaagcgtaggaccttttgggacagcggtg

SEQ ID NO: 389834 - DNA, 140 bp, Artificial Sequence
  Synthetic
caccgctgtcccaaaaggtcctacgcttagccgtctctgctgtaatgtgggaggggtcggtgagcatggaagtgagcactgccacgtccggctcgggctcacatgggagctgtgacccaacatatcagcagccagggcct

SEQ ID NO: 389835 - DNA, 140 bp, Artificial Sequence
  Synthetic
atacgccatgctgggtctccgtgcactgtcaactattccatctttaagataaggatgtttgtagggggaattgaacacaggctccaagcggcgtgcaacttcactcgcggagaccgctgccgtacttgggagtcggccat

SEQ ID NO: 389836 - DNA, 140 bp, Artificial Sequence
  Synthetic
atggccgactcccaagtacggcagcggtctccgcgagtgaagttgcacgccgcttggagcctgtgttcaattccccctacaaacatccttatcttaaagatggaatagttgacagtgcacggagacccagcatggcgtat

SEQ ID NO: 389837 - DNA, 140 bp, Artificial Sequence
  Synthetic
atacgccatgctgggtctccccacgggacttatccacctccaccagaacatcgttgacgttcagtacttgtacggcctgacaccggccatcacaaaatacatcgtcaagtgggagtgggtcgtacttgggagtcggccat

SEQ ID NO: 389838 - DNA, 140 bp, Artificial Sequence
  Synthetic
atggccgactcccaagtacgacccactcccacttgacgatgtattttgtgatggccggtgtcaggccgtacaagtactgaacgtcaacgatgttctggtggaggtggataagtcccgtggggagacccagcatggcgtat

SEQ ID NO: 389839 - DNA, 140 bp, Artificial Sequence
  Synthetic
atacgccatgctgggtctccgttctgcacgctgccagtgcagccagttccaacggcttactatgcttcattctcttcttcgtagcggcctggtacatcaagggtcgggcagtcccgctggcgtacttgggagtcggccat

SEQ ID NO: 389840 - DNA, 140 bp, Artificial Sequence
  Synthetic
atggccgactcccaagtacgccagcgggactgcccgacccttgatgtaccaggccgctacgaagaagagaatgaagcatagtaagccgttggaactggctgcactggcagcgtgcagaacggagacccagcatggcgtat

SEQ ID NO: 389841 - DNA, 140 bp, Artificial Sequence
  Synthetic
atacgccatgctgggtctccccttgtgctgctggtgattatatctatcttcacactcaccccggcatataagatgcttctcggtcggtgcctgtggtggctatgctacatgttggttctgcgtacttgggagtcggccat

SEQ ID NO: 389842 - DNA, 140 bp, Artificial Sequence
  Synthetic
atggccgactcccaagtacgcagaaccaacatgtagcatagccaccacaggcaccgaccgagaagcatcttatatgccggggtgagtgtgaagatagatataatcaccagcagcacaaggggagacccagcatggcgtat

SEQ ID NO: 389843 - DNA, 140 bp, Artificial Sequence
  Synthetic
atacgccatgctgggtctccttgacataaccaagtggctcctggcgatcctcgggcctggttacctcttgaggggggttctgactagagtaccgtacttcgtcagagcgcatgccttattcgtacttgggagtcggccat

SEQ ID NO: 389844 - DNA, 140 bp, Artificial Sequence
  Synthetic
atggccgactcccaagtacgaataaggcatgcgctctgacgaagtacggtactctagtcagaacccccctcaagaggtaaccaggcccgaggatcgccaggagccacttggttatgtcaaggagacccagcatggcgtat

SEQ ID NO: 389845 - DNA, 140 bp, Artificial Sequence
  Synthetic
atacgccatgctgggtctccctcacccctatgtcagactgggctgctagcgggcttcgggacctagcggtcgctgtggagcccgtcattttcagcccgatggagaagagagtcatcacttcgtacttgggagtcggccat

SEQ ID NO: 389846 - DNA, 140 bp, Artificial Sequence
  Synthetic
atggccgactcccaagtacgaagtgatgactctcttctccatcgggctgaaaatgacgggctccacagcgaccgctaggtcccgaagcccgctagcagcccagtctgacataggggtgagggagacccagcatggcgtat

SEQ ID NO: 389847 - DNA, 140 bp, Artificial Sequence
  Synthetic
atacgccatgctgggtctccctccaaagggtggaagcttctcgctcccatcacggcctatcaccaacagactcgcggcctacttgggacaattgtcaccagtctcacaggtcgcgacaaacgtacttgggagtcggccat

SEQ ID NO: 389848 - DNA, 140 bp, Artificial Sequence
  Synthetic
atggccgactcccaagtacgtttgtcgcgacctgtgagactggtgacaattgtcccaagtaggccgcgagtctgttggtgataggccgtgatgggagcgagaagcttccaccctttggagggagacccagcatggcgtat

SEQ ID NO: 389849 - DNA, 140 bp, Artificial Sequence
  Synthetic
atacgccatgctgggtctccgctccaagaccttagccggccccaaaggccctgtttgccaaatgtacaccaatgtggaccaggacatggtgggatggccagcacctccaggtgctagatccgtacttgggagtcggccat

SEQ ID NO: 389850 - DNA, 140 bp, Artificial Sequence
  Synthetic
atggccgactcccaagtacggatctagcacctggaggtgctggccatcccaccatgtcctggtccacattggtgtacatttggcaaacagggcctttggggccggctaaggtcttggagcggagacccagcatggcgtat

SEQ ID NO: 389851 - DNA, 140 bp, Artificial Sequence
  Synthetic
atacgccatgctgggtctccactaactccctgcacctgtggctccagtgatgtctatctagtcaccaggaatgcggacgtgatccccgcaaggcgcaggggggacacccgcgctggactccgtacttgggagtcggccat

SEQ ID NO: 389852 - DNA, 140 bp, Artificial Sequence
  Synthetic
atggccgactcccaagtacggagtccagcgcgggtgtcccccctgcgccttgcggggatcacgtccgcattcctggtgactagatagacatcactggagccacaggtgcagggagttagtggagacccagcatggcgtat

SEQ ID NO: 389853 - DNA, 140 bp, Artificial Sequence
  Synthetic
aggccctggctgctgatatgcacatcaacaggaccgccttgaactgcaatgactccctccacactgggttccttgccgcgctgttctatgtacataagttcaactcgtctggatgcccaggaccttttgggacagcggtg

SEQ ID NO: 389854 - DNA, 140 bp, Artificial Sequence
  Synthetic
caccgctgtcccaaaaggtcctgggcatccagacgagttgaacttatgtacatagaacagcgcggcaaggaacccagtgtggagggagtcattgcagttcaaggcggtcctgttgatgtgcatatcagcagccagggcct

SEQ ID NO: 389855 - DNA, 140 bp, Artificial Sequence
  Synthetic
atacgccatgctgggtctcccaagaggagttgctaaggcgatagacttcgtgcccgtcgagaacatggagactaccatgcggtctccggtcttcaccgacaattcctctccacccgcagtcgtacttgggagtcggccat

SEQ ID NO: 389856 - DNA, 140 bp, Artificial Sequence
  Synthetic
atggccgactcccaagtacgactgcgggtggagaggaattgtcggtgaagaccggagaccgcatggtagtctccatgttctcgacgggcacgaagtctatcgccttagcaactcctcttgggagacccagcatggcgtat

SEQ ID NO: 389857 - DNA, 140 bp, Artificial Sequence
  Synthetic
atacgccatgctgggtctccagagcacaaaggtaccggcagcgtacgctagccagggttacaaggtgctggtgctcaatccatctgtagcagccaccctagcttttggctcttacatgagcgtacttgggagtcggccat

SEQ ID NO: 389858 - DNA, 140 bp, Artificial Sequence
  Synthetic
atggccgactcccaagtacgctcatgtaagagccaaaagctagggtggctgctacagatggattgagcaccagcaccttgtaaccctggctagcgtacgctgccggtacctttgtgctctggagacccagcatggcgtat

SEQ ID NO: 389859 - DNA, 140 bp, Artificial Sequence
  Synthetic
atacgccatgctgggtctcccaacgggaggtcccatcacctactccacctatggcaaattcttggctgatggaggttgttccggcggggcgtatgacatcatcatatgtgacgaatgccacgtacttgggagtcggccat

SEQ ID NO: 389860 - DNA, 140 bp, Artificial Sequence
  Synthetic
atggccgactcccaagtacgtggcattcgtcacatatgatgatgtcatacgccccgccggaacaacctccatcagccaagaatttgccataggtggagtaggtgatgggacctcccgttgggagacccagcatggcgtat

SEQ ID NO: 389861 - DNA, 140 bp, Artificial Sequence
  Synthetic
atacgccatgctgggtctccggatcagtcacggtgccgcatccaaacatctcggaggtcgccttacccaccacgggggaggtccccttctatgggaggggaatccccctagagtacatcacgtacttgggagtcggccat

SEQ ID NO: 389862 - DNA, 140 bp, Artificial Sequence
  Synthetic
atggccgactcccaagtacgtgatgtactctagggggattcccctcccatagaaggggacctcccccgtggtgggtaaggcgacctccgagatgtttggatgcggcaccgtgactgatccggagacccagcatggcgtat

SEQ ID NO: 389863 - DNA, 140 bp, Artificial Sequence
  Synthetic
atacgccatgctgggtctccgggtgtggatgtgtcagtgatccctacatcgggggatgttgtcgtctgcgccactgacgccctcatgaccggctatacgggtgatttcgactccgttatacgtacttgggagtcggccat

SEQ ID NO: 389864 - DNA, 140 bp, Artificial Sequence
  Synthetic
atggccgactcccaagtacgtataacggagtcgaaatcacccgtatagccggtcatgagggcgtcagtggcgcagacgacaacatcccccgatgtagggatcactgacacatccacacccggagacccagcatggcgtat

SEQ ID NO: 389865 - DNA, 140 bp, Artificial Sequence
  Synthetic
aggccctggctgctgatatgccactgacgccctcatgaccggctatacgggtgatttcgactccgttatagactgcaatgttgcggtcacacaggtagttgatttcagcctagaccccacgaccttttgggacagcggtg

SEQ ID NO: 389866 - DNA, 140 bp, Artificial Sequence
  Synthetic
caccgctgtcccaaaaggtcgtggggtctaggctgaaatcaactacctgtgtgaccgcaacattgcagtctataacggagtcgaaatcacccgtatagccggtcatgagggcgtcagtggcatatcagcagccagggcct

SEQ ID NO: 389867 - DNA, 140 bp, Artificial Sequence
  Synthetic
atacgccatgctgggtctcctcgcagggtgaacgaccgtcaggcacatttgacaccgtcgtcctttgcgaagcctacgatgttggctgtgcgtggtatgagctaacaccctcagaaaccacgtacttgggagtcggccat

SEQ ID NO: 389868 - DNA, 140 bp, Artificial Sequence
  Synthetic
atggccgactcccaagtacgtggtttctgagggtgttagctcataccacgcacagccaacatcgtaggcttcgcaaaggacgacggtgtcaaatgtgcctgacggtcgttcaccctgcgaggagacccagcatggcgtat

SEQ ID NO: 389869 - DNA, 140 bp, Artificial Sequence
  Synthetic
aggccctggctgctgatatgagcctacgatgttggctgtgcgtggtatgagctaacaccctcagaaaccaccgttaggctacgcgcgtaccttaacacgcctgggctgcccgtgtgccaagaccttttgggacagcggtg

SEQ ID NO: 389870 - DNA, 140 bp, Artificial Sequence
  Synthetic
caccgctgtcccaaaaggtcttggcacacgggcagcccaggcgtgttaaggtacgcgcgtagcctaacggtggtttctgagggtgttagctcataccacgcacagccaacatcgtaggctcatatcagcagccagggcct

SEQ ID NO: 389871 - DNA, 140 bp, Artificial Sequence
  Synthetic
atacgccatgctgggtctcctagtagcttatcaggccacggtgtgtgcgcgcgccaaagccccccccccgtcatgggacaacatgtggaaatgtcttctgcggctaaagcctatgcttgtcgtacttgggagtcggccat

SEQ ID NO: 389872 - DNA, 140 bp, Artificial Sequence
  Synthetic
atggccgactcccaagtacgacaagcataggctttagccgcagaagacatttccacatgttgtcccatgacggggggggggctttggcgcgcgcacacaccgtggcctgataagctactaggagacccagcatggcgtat

SEQ ID NO: 389873 - DNA, 140 bp, Artificial Sequence
  Synthetic
atacgccatgctgggtctccctaccactcatccaattactaaatacatcatgacttgcatgtcagccgacctcgaggtgatcactagcgcctgggtgctcacggggggaattcttgctgccgtacttgggagtcggccat

SEQ ID NO: 389874 - DNA, 140 bp, Artificial Sequence
  Synthetic
atggccgactcccaagtacggcagcaagaattccccccgtgagcacccaggcgctagtgatcacctcgaggtcggctgacatgcaagtcatgatgtatttagtaattggatgagtggtagggagacccagcatggcgtat

SEQ ID NO: 389875 - DNA, 140 bp, Artificial Sequence
  Synthetic
atacgccatgctgggtctcccagcagttcgatgagatggaggagtgctcacaccggatcccctacttagtcgagggccaacaaattgccgagcaattcaagcaaaaggtcttaggcctctcgtacttgggagtcggccat

SEQ ID NO: 389876 - DNA, 140 bp, Artificial Sequence
  Synthetic
atggccgactcccaagtacgagaggcctaagaccttttgcttgaattgctcggcaatttgttggccctcgactaagtaggggatccggtgtgagcactcctccatctcatcgaactgctgggagacccagcatggcgtat

SEQ ID NO: 389877 - DNA, 140 bp, Artificial Sequence
  Synthetic
atacgccatgctgggtctcctagcgggatacaatatttggctggcctgtcaacactgcctggcaacccggctgtggcctccttaatgtccttctccgcagctctgacaagccctttaagccgtacttgggagtcggccat

SEQ ID NO: 389878 - DNA, 140 bp, Artificial Sequence
  Synthetic
atggccgactcccaagtacggcttaaagggcttgtcagagctgcggagaaggacattaaggaggccacagccgggttgccaggcagtgttgacaggccagccaaatattgtatcccgctaggagacccagcatggcgtat

SEQ ID NO: 389879 - DNA, 140 bp, Artificial Sequence
  Synthetic
atacgccatgctgggtctccgcgctgccgtaggcagtatcggactaggccgcgtcatcgtcgacatcttggcgggctatggggcaggagtatccggtgctcttgttgcttttaagatcatcgtacttgggagtcggccat

SEQ ID NO: 389880 - DNA, 140 bp, Artificial Sequence
  Synthetic
atggccgactcccaagtacgatgatcttaaaagcaacaagagcaccggatactcctgccccatagcccgccaagatgtcgacgatgacgcggcctagtccgatactgcctacggcagcgcggagacccagcatggcgtat

SEQ ID NO: 389881 - DNA, 140 bp, Artificial Sequence
  Synthetic
atacgccatgctgggtctcccgtcgccacgtcggtccctctgaaggggcgacccagtggatgaacaggcttatagcatttgcctcaagaggcaatcacgtatcaccaacacactacgtaccgtacttgggagtcggccat

SEQ ID NO: 389882 - DNA, 140 bp, Artificial Sequence
  Synthetic
atggccgactcccaagtacggtacgtagtgtgttggtgatacgtgattgcctcttgaggcaaatgctataagcctgttcatccactgggtcgccccttcagagggaccgacgtggcgacgggagacccagcatggcgtat

SEQ ID NO: 389883 - DNA, 140 bp, Artificial Sequence
  Synthetic
atacgccatgctgggtctccgcacatcaacagaactgccttgaattgcaatgactcccttcaaactgggttccttgctgcgttgttctacacacatagtttcaacgcgtccggatgcccacgtacttgggagtcggccat

SEQ ID NO: 389884 - DNA, 140 bp, Artificial Sequence
  Synthetic
atggccgactcccaagtacgtgggcatccggacgcgttgaaactatgtgtgtagaacaacgcagcaaggaacccagtttgaagggagtcattgcaattcaaggcagttctgttgatgtgcggagacccagcatggcgtat

SEQ ID NO: 389885 - DNA, 140 bp, Artificial Sequence
  Synthetic
aggccctggctgctgatatgccgtgctgtcagacttcaagacctggcttaaggccaagcttgtgccgtccctgccgggcatcccctttctctcctgtcaacgggggttcaggggggtatggaccttttgggacagcggtg

SEQ ID NO: 389886 - DNA, 140 bp, Artificial Sequence
  Synthetic
caccgctgtcccaaaaggtccatacccccctgaacccccgttgacaggagagaaaggggatgcccggcagggacggcacaagcttggccttaagccaggtcttgaagtctgacagcacggcatatcagcagccagggcct

SEQ ID NO: 389887 - DNA, 140 bp, Artificial Sequence
  Synthetic
atacgccatgctgggtctccagcaatgtctggcatggcaggtttccaatcaatgccaccaccacgggacccagcgtacccatcccagatccaaactacaaaagagcattgtggagggtctcgtacttgggagtcggccat

SEQ ID NO: 389888 - DNA, 140 bp, Artificial Sequence
  Synthetic
atggccgactcccaagtacgagaccctccacaatgctcttttgtagtttggatctgggatgggtacgctgggtcccgtggtggtggcattgattggaaacctgccatgccagacattgctggagacccagcatggcgtat

SEQ ID NO: 389889 - DNA, 140 bp, Artificial Sequence
  Synthetic
atacgccatgctgggtctccggagtttttcaccgaagtggacgggatcaggctgcacagatacgcgcctacgtgtcggccacttctccgcgatgagctgacattctcagtagggctcaatcgtacttgggagtcggccat

SEQ ID NO: 389890 - DNA, 140 bp, Artificial Sequence
  Synthetic
atggccgactcccaagtacgattgagccctactgagaatgtcagctcatcgcggagaagtggccgacacgtaggcgcgtatctgtgcagcctgatcccgtccacttcggtgaaaaactccggagacccagcatggcgtat

SEQ ID NO: 389891 - DNA, 140 bp, Artificial Sequence
  Synthetic
aggccctggctgctgatatgccgcaaagctgtcgagcctcggaatcaatgctgtagcatattaccggggtctcgacgtgtccgtcataccgaccagcggagacgtcgttgtcgtggcaacgaccttttgggacagcggtg

SEQ ID NO: 389892 - DNA, 140 bp, Artificial Sequence
  Synthetic
caccgctgtcccaaaaggtcgttgccacgacaacgacgtctccgctggtcggtatgacggacacgtcgagaccccggtaatatgctacagcattgattccgaggctcgacagctttgcggcatatcagcagccagggcct

SEQ ID NO: 389893 - DNA, 140 bp, Artificial Sequence
  Synthetic
atacgccatgctgggtctccagatgggaggtaacatcactcgagttgagtccgagaacaaggttgtagtactcgactcctttgaccctcttgtcgccgagccggatgacagggagatatccgtacttgggagtcggccat

SEQ ID NO: 389894 - DNA, 140 bp, Artificial Sequence
  Synthetic
atggccgactcccaagtacggatatctccctgtcatccggctcggcgacaagagggtcaaaggagtcgagtactacaaccttgttctcggactcaactcgagtgatgttacctcccatctggagacccagcatggcgtat

SEQ ID NO: 389895 - DNA, 140 bp, Artificial Sequence
  Synthetic
atacgccatgctgggtctccgagaccatagtggtctgcggaaccggtgagtacaccggaaatgccaagacgaccgggtcctttcttggatcaccccgctcaatgcctggagatttgggcgcgtacttgggagtcggccat

SEQ ID NO: 389896 - DNA, 140 bp, Artificial Sequence
  Synthetic
atggccgactcccaagtacgcgcccaaatctccaggcattgagcggggtgatccaagaaaggacccggtcgtcttggcatttccggtgtactcaccggttccgcagaccactatggtctcggagacccagcatggcgtat

SEQ ID NO: 389897 - DNA, 140 bp, Artificial Sequence
  Synthetic
atacgccatgctgggtctccaaggctccagactacagtccaccaacagtctcgggctgtgctctccctccgaagggtataccacccgtgccaccacctaggaggaagaaagttgtacagccgtacttgggagtcggccat

SEQ ID NO: 389898 - DNA, 140 bp, Artificial Sequence
  Synthetic
atggccgactcccaagtacggctgtacaactttcttcctcctaggtggtggcacgggtggtatacccttcggagggagagcacagcccgagactgttggtggactgtagtctggagccttggagacccagcatggcgtat

SEQ ID NO: 389899 - DNA, 140 bp, Artificial Sequence
  Synthetic
atacgccatgctgggtctcccgttcccacctccattgaggcacagtcctccgacggtgtggagacggcgtcagacgccggttcatacagctctatgccaccgttggagggggaacccgggcgtacttgggagtcggccat

SEQ ID NO: 389900 - DNA, 140 bp, Artificial Sequence
  Synthetic
atggccgactcccaagtacgcccgggttccccctccaacggtggcatagagctgtatgaaccggcgtctgacgccgtctccacaccgtcggaggactgtgcctcaatggaggtgggaacgggagacccagcatggcgtat

SEQ ID NO: 389901 - DNA, 140 bp, Artificial Sequence
  Synthetic
atacgccatgctgggtctccacatcaccaaaatcttgctcgccatatttggtccgctcatggtgctccaggctggcctaactagagtgccgtacttcgtgcgcgctcaagggctcatccgcgtacttgggagtcggccat

SEQ ID NO: 389902 - DNA, 140 bp, Artificial Sequence
  Synthetic
atggccgactcccaagtacgcggatgagcccttgagcgcgcacgaagtacggcactctagttaggccagcctggagcaccatgagcggaccaaatatggcgagcaagattttggtgatgtggagacccagcatggcgtat

SEQ ID NO: 389903 - DNA, 140 bp, Artificial Sequence
  Synthetic
aggccctggctgctgatatgtccctcattcgccaccataacctggtatactccacaacatcacggagtgcctctctccgccaaaagaaagtgaccttcgatcgggtccaggtgctggaccgaccttttgggacagcggtg

SEQ ID NO: 389904 - DNA, 140 bp, Artificial Sequence
  Synthetic
caccgctgtcccaaaaggtcggtccagcacctggacccgatcgaaggtcactttcttttggcggagagaggcactccgtgatgttgtggagtataccaggttatggtggcgaatgagggacatatcagcagccagggcct

SEQ ID NO: 389905 - DNA, 140 bp, Artificial Sequence
  Synthetic
atacgccatgctgggtctccttcggctcgctctaagttcggatatggagcaaaagaagttcgcagccattctagtaaagccgttaaccacatcaactccgtgtgggaggacttgctagagcgtacttgggagtcggccat

SEQ ID NO: 389906 - DNA, 140 bp, Artificial Sequence
  Synthetic
atggccgactcccaagtacgctctagcaagtcctcccacacggagttgatgtggttaacggctttactagaatggctgcgaacttcttttgctccatatccgaacttagagcgagccgaaggagacccagcatggcgtat

SEQ ID NO: 389907 - DNA, 140 bp, Artificial Sequence
  Synthetic
atacgccatgctgggtctccaccctgatcttggggtaagggtgtgcgagaagagggctctgtacgatcttgcccagaaactgcccgaggcaataatgggatccgcttacggtttccagtacgtacttgggagtcggccat

SEQ ID NO: 389908 - DNA, 140 bp, Artificial Sequence
  Synthetic
atggccgactcccaagtacgtactggaaaccgtaagcggatcccattattgcctcgggcagtttctgggcaagatcgtacagagccctcttctcgcacacccttaccccaagatcagggtggagacccagcatggcgtat

SEQ ID NO: 389909 - DNA, 140 bp, Artificial Sequence
  Synthetic
atacgccatgctgggtctccacggaacgtgacatccgcactgaacaagacatctatctgtgctgccaattagatccggtagcacggaaagtcatcacatctctcacagaacggctgtactcgtacttgggagtcggccat

SEQ ID NO: 389910 - DNA, 140 bp, Artificial Sequence
  Synthetic
atggccgactcccaagtacgagtacagccgttctgtgagagatgtgatgactttccgtgctaccggatctaattggcagcacagatagatgtcttgttcagtgcggatgtcacgttccgtggagacccagcatggcgtat

SEQ ID NO: 389911 - DNA, 140 bp, Artificial Sequence
  Synthetic
atacgccatgctgggtctccgaaacccgggtctccgggggagctgccgcccacgccacgcttggatttaccagcctcttctcaagtggtcccaagcaaaacatccagttggtcaataccacgtacttgggagtcggccat

SEQ ID NO: 389912 - DNA, 140 bp, Artificial Sequence
  Synthetic
atggccgactcccaagtacgtggtattgaccaactggatgttttgcttgggaccacttgagaagaggctggtaaatccaagcgtggcgtgggcggcagctcccccggagacccgggtttcggagacccagcatggcgtat

SEQ ID NO: 389913 - DNA, 140 bp, Artificial Sequence
  Synthetic
atacgccatgctgggtctccctacctgaaggcccaggcggcttgtagggcagcgaagctcaaaaactttgacatgttggtctgtggggacgatttagtcgttgtcgctgagagcgaagggcgtacttgggagtcggccat

SEQ ID NO: 389914 - DNA, 140 bp, Artificial Sequence
  Synthetic
atggccgactcccaagtacgcccttcgctctcagcgacaacgactaaatcgtccccacagaccaacatgtcaaagtttttgagcttcgctgccctacaagccgcctgggccttcaggtagggagacccagcatggcgtat

SEQ ID NO: 389915 - DNA, 140 bp, Artificial Sequence
  Synthetic
atacgccatgctgggtctcctgataacatcatgctcatcgaatgtctccgtggcccacgatggttctggacagagatactactacctcacccgagacccagccataccattgacacgtgccgtacttgggagtcggccat

SEQ ID NO: 389916 - DNA, 140 bp, Artificial Sequence
  Synthetic
atggccgactcccaagtacggcacgtgtcaatggtatggctgggtctcgggtgaggtagtagtatctctgtccagaaccatcgtgggccacggagacattcgatgagcatgatgttatcaggagacccagcatggcgtat

SEQ ID NO: 389917 - DNA, 140 bp, Artificial Sequence
  Synthetic
atacgccatgctgggtctcctgcctgggaaacagcgcgccatactccagtgaactcatggttgggcaacatcatcatgttcgcgcccacaatttgggtgcgcatggtgttgatgacacatcgtacttgggagtcggccat

SEQ ID NO: 389918 - DNA, 140 bp, Artificial Sequence
  Synthetic
atggccgactcccaagtacgatgtgtcatcaacaccatgcgcacccaaattgtgggcgcgaacatgatgatgttgcccaaccatgagttcactggagtatggcgcgctgtttcccaggcaggagacccagcatggcgtat

SEQ ID NO: 389919 - DNA, 140 bp, Artificial Sequence
  Synthetic
atacgccatgctgggtctccttatccagcggttacatggtatggccgccttttcactccatggttactctccaggcgaactcaacagggtggcagcctgcctcaggaagcttggggcacccgtacttgggagtcggccat

SEQ ID NO: 389920 - DNA, 140 bp, Artificial Sequence
  Synthetic
atggccgactcccaagtacgggtgccccaagcttcctgaggcaggctgccaccctgttgagttcgcctggagagtaaccatggagtgaaaaggcggccataccatgtaaccgctggataaggagacccagcatggcgtat

SEQ ID NO: 389921 - DNA, 140 bp, Artificial Sequence
  Synthetic
atacgccatgctgggtctccgctgtgaagacaaagctcaaactcactccactccgcgatgcagctaacctggacctgtctgggtggtttgtcgtgggcggacgcgggggggacatatttccgtacttgggagtcggccat

SEQ ID NO: 389922 - DNA, 140 bp, Artificial Sequence
  Synthetic
atggccgactcccaagtacggaaatatgtcccccccgcgtccgcccacgacaaaccacccagacaggtccaggttagctgcatcgcggagtggagtgagtttgagctttgtcttcacagcggagacccagcatggcgtat

SEQ ID NO: 389923 - DNA, 140 bp, Artificial Sequence
  Synthetic
aggccctggctgctgatatggggcgggaacatcacccgcgtggagtcagagaacaaggtagtaatcttggactctttcgagccgcttcgagcggaagaggatgagagggaaatatccgtggaccttttgggacagcggtg

SEQ ID NO: 389924 - DNA, 140 bp, Artificial Sequence
  Synthetic
caccgctgtcccaaaaggtccacggatatttccctctcatcctcttccgctcgaagcggctcgaaagagtccaagattactaccttgttctctgactccacgcgggtgatgttcccgccccatatcagcagccagggcct

SEQ ID NO: 389925 - DNA, 140 bp, Artificial Sequence
  Synthetic
aggccctggctgctgatatgaactcttcaggctgtcccgagaggatggccagctgccgaccccttaccgattttgaccagggctggggccctatcagtcatgccaacggaagcggccccggaccttttgggacagcggtg

SEQ ID NO: 389926 - DNA, 140 bp, Artificial Sequence
  Synthetic
caccgctgtcccaaaaggtccggggccgcttccgttggcatgactgatagggccccagccctggtcaaaatcggtaaggggtcggcagctggccatcctctcgggacagcctgaagagttcatatcagcagccagggcct

SEQ ID NO: 389927 - DNA, 140 bp, Artificial Sequence
  Synthetic
aggccctggctgctgatatggccgcgtcgtgtggcggcgttgttcttgtcgggttaatggcgctgactctgtcaccatattacaagcgctatatcagctggtgcttgtggtggcttcagtgaccttttgggacagcggtg

SEQ ID NO: 389928 - DNA, 140 bp, Artificial Sequence
  Synthetic
caccgctgtcccaaaaggtcactgaagccaccacaagcaccagctgatatagcgcttgtaatatggtgacagagtcagcgccattaacccgacaagaacaacgccgccacacgacgcggccatatcagcagccagggcct

SEQ ID NO: 389929 - DNA, 140 bp, Artificial Sequence
  Synthetic
aggccctggctgctgatatgctatgacgcgggctgtgcttggtacgagctcacgcccgccgagacctcagttaggctgcgggcttacctaaatacaccagggttgcccgtttgccaggacgaccttttgggacagcggtg

SEQ ID NO: 389930 - DNA, 140 bp, Artificial Sequence
  Synthetic
caccgctgtcccaaaaggtcgtcctggcaaacgggcaaccctggtgtatttaggtaagcccgcagcctaactgaggtctcggcgggcgtgagctcgtaccaagcacagcccgcgtcatagcatatcagcagccagggcct

SEQ ID NO: 389931 - DNA, 140 bp, Artificial Sequence
  Synthetic
aggccctggctgctgatatgttaggctgcgggcttacctaaatacaccagggttgcccgtttgccaggaccatttggagttctgggagagcgtcttcacaggcctcacccacatagatgcgaccttttgggacagcggtg

SEQ ID NO: 389932 - DNA, 140 bp, Artificial Sequence
  Synthetic
caccgctgtcccaaaaggtcgcatctatgtgggtgaggcctgtgaagacgctctcccagaactccaaatggtcctggcaaacgggcaaccctggtgtatttaggtaagcccgcagcctaacatatcagcagccagggcct

SEQ ID NO: 389933 - DNA, 140 bp, Artificial Sequence
  Synthetic
atacgccatgctgggtctccggtgctggataccagtcacacctaacgtcgccgtgagggagcgcggggcgcttaccaaaggtctgcggacgcatatcgatttgatcgtggtgtccgccaccgtacttgggagtcggccat

SEQ ID NO: 389934 - DNA, 140 bp, Artificial Sequence
  Synthetic
atggccgactcccaagtacggtggcggacaccacgatcaaatcgatatgcgtccgcagacctttggtaagcgccccgcgctccctcacggcgacgttaggtgtgactggtatccagcaccggagacccagcatggcgtat

SEQ ID NO: 389935 - DNA, 140 bp, Artificial Sequence
  Synthetic
atacgccatgctgggtctcccggcccaggcaaccatcatttcgccgcaacaccacacttttgttcaggactgcaattgttccatttacccgggccacgtcacaggacaccgtatggcatgcgtacttgggagtcggccat

SEQ ID NO: 389936 - DNA, 140 bp, Artificial Sequence
  Synthetic
atggccgactcccaagtacgcatgccatacggtgtcctgtgacgtggcccgggtaaatggaacaattgcagtcctgaacaaaagtgtggtgttgcggcgaaatgatggttgcctgggccgggagacccagcatggcgtat

SEQ ID NO: 389937 - DNA, 140 bp, Artificial Sequence
  Synthetic
aggccctggctgctgatatgcggctgttggcagcataggccttgggaaggtgcttgtggacatcttggcgggttatggagcaggggtggcaggcgcacttgtggcctttaaggtcatgaggaccttttgggacagcggtg

SEQ ID NO: 389938 - DNA, 140 bp, Artificial Sequence
  Synthetic
caccgctgtcccaaaaggtcctcatgaccttaaaggccacaagtgcgcctgccacccctgctccataacccgccaagatgtccacaagcaccttcccaaggcctatgctgccaacagccgcatatcagcagccagggcct

SEQ ID NO: 389939 - DNA, 140 bp, Artificial Sequence
  Synthetic
aggccctggctgctgatatgggcgtaatgttcggcctagcctacttctccatgcagggggcgtgggccaaggtcgtcgtcatccttctattgactgcaggagtggacgcccagacgcacagaccttttgggacagcggtg

SEQ ID NO: 389940 - DNA, 140 bp, Artificial Sequence
  Synthetic
caccgctgtcccaaaaggtctgtgcgtctgggcgtccactcctgcagtcaatagaaggatgacgacgaccttggcccacgccccctgcatggagaagtaggctaggccgaacattacgcccatatcagcagccagggcct

SEQ ID NO: 389941 - DNA, 140 bp, Artificial Sequence
  Synthetic
aggccctggctgctgatatgcggcatgtgggcccaggggagggggctgtgcagtggatgaaccggctgatagcgttcgcttcgcggggtaaccacgtctcccccacgcactatgtgcctggaccttttgggacagcggtg

SEQ ID NO: 389942 - DNA, 140 bp, Artificial Sequence
  Synthetic
caccgctgtcccaaaaggtccaggcacatagtgcgtgggggagacgtggttaccccgcgaagcgaacgctatcagccggttcatccactgcacagccccctcccctgggcccacatgccgcatatcagcagccagggcct

SEQ ID NO: 389943 - DNA, 140 bp, Artificial Sequence
  Synthetic
atacgccatgctgggtctccgcatattaaccgcacggccttgaattgcaatgattcattgaaaacagggttcattgcggcattgttctactcccataaatttaactcctcgggttgtcctcgtacttgggagtcggccat

SEQ ID NO: 389944 - DNA, 140 bp, Artificial Sequence
  Synthetic
atggccgactcccaagtacgaggacaacccgaggagttaaatttatgggagtagaacaatgccgcaatgaaccctgttttcaatgaatcattgcaattcaaggccgtgcggttaatatgcggagacccagcatggcgtat

SEQ ID NO: 389945 - DNA, 140 bp, Artificial Sequence
  Synthetic
atacgccatgctgggtctccattgctggcattatccacccagaccatgtggcattgttcctgctcaaaccgtatgtggcccagtgtattgtttcacccccagtccagtcgtggtaggcaccgtacttgggagtcggccat

SEQ ID NO: 389946 - DNA, 140 bp, Artificial Sequence
  Synthetic
atggccgactcccaagtacggtgcctaccacgactggactgggggtgaaacaatacactgggccacatacggtttgagcaggaacaatgccacatggtctgggtggataatgccagcaatggagacccagcatggcgtat

SEQ ID NO: 389947 - DNA, 140 bp, Artificial Sequence
  Synthetic
aggccctggctgctgatatggacatgtcaagaacggttccatgaggatcgttgggcctaaaacctgtagcaacacgtggcatggaacattccccatcaacgcgtacaccacgggcccctggaccttttgggacagcggtg

SEQ ID NO: 389948 - DNA, 140 bp, Artificial Sequence
  Synthetic
caccgctgtcccaaaaggtccaggggcccgtggtgtacgcgttgatggggaatgttccatgccacgtgttgctacaggttttaggcccaacgatcctcatggaaccgttcttgacatgtccatatcagcagccagggcct

SEQ ID NO: 389949 - DNA, 140 bp, Artificial Sequence
  Synthetic
aggccctggctgctgatatgctgaggagtacgtggaggtcacgcgggtgggggatttccactacgtgacgggcatgaccactgacaacgtaaaatgcccatgccaggttccggcccccgagaccttttgggacagcggtg

SEQ ID NO: 389950 - DNA, 140 bp, Artificial Sequence
  Synthetic
caccgctgtcccaaaaggtctcgggggccggaacctggcatgggcattttacgttgtcagtggtcatgcccgtcacgtagtggaaatcccccacccgcgtgacctccacgtactcctcagcatatcagcagccagggcct

SEQ ID NO: 389951 - DNA, 140 bp, Artificial Sequence
  Synthetic
atacgccatgctgggtctccgcattacccgtgtaccatcaacttcaccatccacaaaatacggatgttcataggcggggttgaacacaggctcgaagcagcgtgcaattttacccgtgggcgtacttgggagtcggccat

SEQ ID NO: 389952 - DNA, 140 bp, Artificial Sequence
  Synthetic
atggccgactcccaagtacgcccacgggtaaaattgcacgctgcttcgagcctgtgttcaaccccgcctatgaacatccgtattttgtggatggtgaagttgatggtacacgggtaatgcggagacccagcatggcgtat

SEQ ID NO: 389953 - DNA, 140 bp, Artificial Sequence
  Synthetic
atacgccatgctgggtctcccggctctatctaccggtctcttacacctccaccaaaacatcgtggacgtgcagtacttgtatggcctatcgccggccattaccaagtatattgtcaaatgcgtacttgggagtcggccat

SEQ ID NO: 389954 - DNA, 140 bp, Artificial Sequence
  Synthetic
atggccgactcccaagtacgcatttgacaatatacttggtaatggccggcgataggccatacaagtactgcacgtccacgatgttttggtggaggtgtaagagaccggtagatagagccgggagacccagcatggcgtat

SEQ ID NO: 389955 - DNA, 140 bp, Artificial Sequence
  Synthetic
atacgccatgctgggtctccagcggcggagatcctgcggaaaaccaggaagttccccccagcgatgcctatatgggcacgcccggattacaacccaccactcctagagtcttggaagaaccgtacttgggagtcggccat

SEQ ID NO: 389956 - DNA, 140 bp, Artificial Sequence
  Synthetic
atggccgactcccaagtacggttcttccaagactctaggagtggtgggttgtaatccgggcgtgcccatataggcatcgctggggggaacttcctggttttccgcaggatctccgccgctggagacccagcatggcgtat

SEQ ID NO: 389957 - DNA, 140 bp, Artificial Sequence
  Synthetic
atacgccatgctgggtctccaagctagtcatcctgcatgcggccagtgccgcaagctctcatggcatgctttgtttcatcatcttcttcatagctgcttggtacatcaagggtcgagtcacgtacttgggagtcggccat

SEQ ID NO: 389958 - DNA, 140 bp, Artificial Sequence
  Synthetic
atggccgactcccaagtacgtgactcgacccttgatgtaccaagcagctatgaagaagatgatgaaacaaagcatgccatgagagcttgcggcactggccgcatgcaggatgactagcttggagacccagcatggcgtat

SEQ ID NO: 389959 - DNA, 140 bp, Artificial Sequence
  Synthetic
aggccctggctgctgatatgccagattacgtccctccggtggtgcacgggtgtccattgccacctaccaaggcccctccaataccacctccacggagaaagaggacggttgtcctgacaggaccttttgggacagcggtg

SEQ ID NO: 389960 - DNA, 140 bp, Artificial Sequence
  Synthetic
caccgctgtcccaaaaggtcctgtcaggacaaccgtcctctttctccgtggaggtggtattggaggggccttggtaggtggcaatggacacccgtgcaccaccggagggacgtaatctggcatatcagcagccagggcct

SEQ ID NO: 389961 - DNA, 140 bp, Artificial Sequence
  Synthetic
atacgccatgctgggtctccgcaaataggcctggtccttctagtggtcatatcagtctttacacttagcccggcatataagatccttctctgccgcagcttatggtggttgtcctatttgcgtacttgggagtcggccat

SEQ ID NO: 389962 - DNA, 140 bp, Artificial Sequence
  Synthetic
atggccgactcccaagtacgcaaataggacaaccaccataagctgcggcagagaaggatcttatatgccgggctaagtgtaaagactgatatgaccactagaaggaccaggcctatttgcggagacccagcatggcgtat

SEQ ID NO: 389963 - DNA, 140 bp, Artificial Sequence
  Synthetic
atacgccatgctgggtctccgtgtattgtttgacataaccaattggctcctggcaatcttaggacctggttacctccttaggagtgtcctcacaagcacgccatacttcgtcagagcgcacgtacttgggagtcggccat

SEQ ID NO: 389964 - DNA, 140 bp, Artificial Sequence
  Synthetic
atggccgactcccaagtacgtgcgctctgacgaagtatggcgtgcttgtgaggacactcctaaggaggtaaccaggtcctaagattgccaggagccaattggttatgtcaaacaatacacggagacccagcatggcgtat

SEQ ID NO: 389965 - DNA, 140 bp, Artificial Sequence
  Synthetic
atacgccatgctgggtctccccatcacttacgctgggccgcgcgactcggatcagaggccttattgctggcattacgcgcctcgaccgtgcggtgtcgtgcccgcgtcgcaggtgtgtggcgtacttgggagtcggccat

SEQ ID NO: 389966 - DNA, 140 bp, Artificial Sequence
  Synthetic
atggccgactcccaagtacgccacacacctgcgacgcgggcacgacaccgcacggtcgaggcgcgtaatgccagcaataaggcctctgatccgagtcgcgcggcccagcgtaagtgatggggagacccagcatggcgtat

SEQ ID NO: 389967 - DNA, 140 bp, Artificial Sequence
  Synthetic
atacgccatgctgggtctcctatgatcacctctccccaatgtcaggttgggctgctagtgggctacgcgacctcgcggttgctgtagaacccattgttttcagcccaatggagaaaaaagcgtacttgggagtcggccat

SEQ ID NO: 389968 - DNA, 140 bp, Artificial Sequence
  Synthetic
atggccgactcccaagtacgcttttttctccattgggctgaaaacaatgggttctacagcaaccgcgaggtcgcgtagcccactagcagcccaacctgacattggggagaggtgatcataggagacccagcatggcgtat

SEQ ID NO: 389969 - DNA, 140 bp, Artificial Sequence
  Synthetic
atacgccatgctgggtctcccgagtacacttccaaggggtggaaacttcttgcgcccatcaccgcttatgcccagcagacgcgtggtttgctgggtactatagtggtaagtatgacagggcgtacttgggagtcggccat

SEQ ID NO: 389970 - DNA, 140 bp, Artificial Sequence
  Synthetic
atggccgactcccaagtacgccctgtcatacttaccactatagtacccagcaaaccacgcgtctgctgggcataagcggtgatgggcgcaagaagtttccaccccttggaagtgtactcgggagacccagcatggcgtat

SEQ ID NO: 389971 - DNA, 140 bp, Artificial Sequence
  Synthetic
atacgccatgctgggtctccacggcgctgggaacaaaacgctagctggctcacgagggcctgttacgcagatgtattccagcgccgagggggaccttgtggggtggcccagccctcctggcgtacttgggagtcggccat

SEQ ID NO: 389972 - DNA, 140 bp, Artificial Sequence
  Synthetic
atggccgactcccaagtacgccaggagggctgggccaccccacaaggtccccctcggcgctggaatacatctgcgtaacaggccctcgtgagccagctagcgttttgttcccagcgccgtggagacccagcatggcgtat

SEQ ID NO: 389973 - DNA, 140 bp, Artificial Sequence
  Synthetic
aggccctggctgctgatatgggaggacagggatagatcagaacttagcccgctgctgctgtctacaacagagtggcagatattaccctgttccttcaccaccctacccgctctgtccactgaccttttgggacagcggtg

SEQ ID NO: 389974 - DNA, 140 bp, Artificial Sequence
  Synthetic
caccgctgtcccaaaaggtcagtggacagagcgggtagggtggtgaaggaacagggtaatatctgccactctgttgtagacagcagcagcgggctaagttctgatctatccctgtcctcccatatcagcagccagggcct

SEQ ID NO: 389975 - DNA, 140 bp, Artificial Sequence
  Synthetic
atacgccatgctgggtctccggggcattgctctccccaaggcctctttcaagtttgaaggggtcctcgggggggccagtgctttgccctagaggtcatgctgtggggattttccgagcagcgtacttgggagtcggccat

SEQ ID NO: 389976 - DNA, 140 bp, Artificial Sequence
  Synthetic
atggccgactcccaagtacgctgctcggaaaatccccacagcatgacctctagggcaaagcactggcccccccgaggaccccttcaaacttgaaagaggccttggggagagcaatgccccggagacccagcatggcgtat

SEQ ID NO: 389977 - DNA, 140 bp, Artificial Sequence
  Synthetic
aggccctggctgctgatatgtgctcttccttctcctggcggacgcgcgcgtctgcgcctgcttgtggatgatgctgctgatagctcaggctgaggccgccttagagaacctggtggtcctgaccttttgggacagcggtg

SEQ ID NO: 389978 - DNA, 140 bp, Artificial Sequence
  Synthetic
caccgctgtcccaaaaggtcaggaccaccaggttctctaaggcggcctcagcctgagctatcagcagcatcatccacaagcaggcgcagacgcgcgcgtccgccaggagaaggaagagcacatatcagcagccagggcct

SEQ ID NO: 389979 - DNA, 140 bp, Artificial Sequence
  Synthetic
atacgccatgctgggtctccccctgctgtgcctcagacctaccaggtgggatatttacatgcccctaccggtagtgggaagagcactaaggtgcccgcctcttacgctgctcaggggtaccgtacttgggagtcggccat

SEQ ID NO: 389980 - DNA, 140 bp, Artificial Sequence
  Synthetic
atggccgactcccaagtacggtacccctgagcagcgtaagaggcgggcaccttagtgctcttcccactaccggtaggggcatgtaaatatcccacctggtaggtctgaggcacagcagggggagacccagcatggcgtat

SEQ ID NO: 389981 - DNA, 140 bp, Artificial Sequence
  Synthetic
atacgccatgctgggtctccgaaccgtgacgaccggagagtccatcacatattctacctatggcaaattcctcgccgacggaggctgctcaggcggagcctatgacgtcataatatgcgacgtacttgggagtcggccat

SEQ ID NO: 389982 - DNA, 140 bp, Artificial Sequence
  Synthetic
atggccgactcccaagtacgtcgcatattatgacgtcataggctccgcctgagcagcctccgtcggcgaggaatttgccataggtagaatatgtgatggactctccggtcgtcacggttcggagacccagcatggcgtat

SEQ ID NO: 389983 - DNA, 140 bp, Artificial Sequence
  Synthetic
atacgccatgctgggtctccacgcctcctgggtctgtaacgactccccaccccaacatagaggaagtagctctcggccacgagggtgaaatccctttttatggaaaagcaatccccctatcgtacttgggagtcggccat

SEQ ID NO: 389984 - DNA, 140 bp, Artificial Sequence
  Synthetic
atggccgactcccaagtacgatagggggattgcttttccataaaaagggatttcaccctcgtggccgagagctacttcctctatgttggggtggggagtcgttacagacccaggaggcgtggagacccagcatggcgtat

SEQ ID NO: 389985 - DNA, 140 bp, Artificial Sequence
  Synthetic
atacgccatgctgggtctccttactacagagggctcgacgtctccgtgataccaacccagggggacgtggtggtggtagctaccgatgcccttatgacggggttcactggggatttcgaccgtacttgggagtcggccat

SEQ ID NO: 389986 - DNA, 140 bp, Artificial Sequence
  Synthetic
atggccgactcccaagtacggtcgaaatccccagtgaaccccgtcataagggcatcggtagctaccaccaccacgtccccctgggttggtatcacggagacgtcgagccctctgtagtaaggagacccagcatggcgtat

SEQ ID NO: 389987 - DNA, 140 bp, Artificial Sequence
  Synthetic
atacgccatgctgggtctcccacgcagccagcgtagagggcgaacgggtaggggtaggttgggcatatataggtatgtctcctctggagagcgagcttccgggatgttcgattccgtagtcgtacttgggagtcggccat

SEQ ID NO: 389988 - DNA, 140 bp, Artificial Sequence
  Synthetic
atggccgactcccaagtacgactacggaatcgaacatcccggaagctcgctctccagaggagacatacctatatatgcccaacctacccctacccgttcgccctctacgctggctgcgtgggagacccagcatggcgtat

SEQ ID NO: 389989 - DNA, 140 bp, Artificial Sequence
  Synthetic
atacgccatgctgggtctccttggtggctccatcttagccctagtcacggctagctgtgaaaggtccgtgagccgcatgactgcagagagtgctgatactggcctctctgcagatcatgtcgtacttgggagtcggccat

SEQ ID NO: 389990 - DNA, 140 bp, Artificial Sequence
  Synthetic
atggccgactcccaagtacgacatgatctgcagagaggccagtatcagcactctctgcagtcatgcggctcacggacctttcacagctagccgtgactagggctaagatggagccaccaaggagacccagcatggcgtat

SEQ ID NO: 389991 - DNA, 140 bp, Artificial Sequence
  Synthetic
atacgccatgctgggtctccgtgtgtcaggaccatttagagttctgggaggcagtttttaccggcctcacacacatagatgctcacttcctctcccagacgaaacaagcgggggagaactcgtacttgggagtcggccat

SEQ ID NO: 389992 - DNA, 140 bp, Artificial Sequence
  Synthetic
atggccgactcccaagtacgagttctcccccgcttgtttcgtctgggagaggaagtgagcatctatgtgtgtgaggccggtaaaaactgcctcccagaactctaaatggtcctgacacacggagacccagcatggcgtat

SEQ ID NO: 389993 - DNA, 140 bp, Artificial Sequence
  Synthetic
atacgccatgctgggtctcctacgctcaccggcccaacacctctgctctatcgcttaggccctgtcaccaatgagaccactctcacacaccccgtaaccaaatacatcgccacgtgcatgcgtacttgggagtcggccat

SEQ ID NO: 389994 - DNA, 140 bp, Artificial Sequence
  Synthetic
atggccgactcccaagtacgcatgcacgtggcgatgtatttggttacggggtgtgtgagagtggtctcattggtgacagggcctaagcgatagagcagaggtgttgggccggtgagcgtaggagacccagcatggcgtat

SEQ ID NO: 389995 - DNA, 140 bp, Artificial Sequence
  Synthetic
aggccctggctgctgatatgtcactgagagcgatatccgtacggaggaggcaatctaccaatgttgtgacctggacccccaagcccgcgtggccatcaagtccctcactgagaggctttagaccttttgggacagcggtg

SEQ ID NO: 389996 - DNA, 140 bp, Artificial Sequence
  Synthetic
caccgctgtcccaaaaggtctaaagcctctcagtgagggacttgatggccacgcgggcttgggggtccaggtcacaacattggtagattgcctcctccgtacggatatcgctctcagtgacatatcagcagccagggcct

SEQ ID NO: 389997 - DNA, 140 bp, Artificial Sequence
  Synthetic
atacgccatgctgggtctccgttcaggctacttggcccaaactggaacaattctgggccaagcacatgtggaatttcattagtggtatccagtatttggcaggactttccacgctacctgcgtacttgggagtcggccat

SEQ ID NO: 389998 - DNA, 140 bp, Artificial Sequence
  Synthetic
atggccgactcccaagtacgcaggtagcgtggaaagtcctgccaaatactggataccactaatgaaattccacatgtgcttggcccagaattgttccagtttgggccaagtagcctgaacggagacccagcatggcgtat

SEQ ID NO: 389999 - DNA, 140 bp, Artificial Sequence
  Synthetic
atacgccatgctgggtctccagcttcccagatcgctcccgccgcgggggccaccggctttgtcgttagcggcttagtaggggctgccgtgggcagtataggtctgggtaaaatattggtgcgtacttgggagtcggccat

SEQ ID NO: 390000 - DNA, 140 bp, Artificial Sequence
  Synthetic
atggccgactcccaagtacgcaccaatattttacccagacctatactgcccacggcagcccctactaagccgctaacgacaaagccggtggcccccgcggcgggagcgatctgggaagctggagacccagcatggcgtat

SEQ ID NO: 390001 - DNA, 140 bp, Artificial Sequence
  Synthetic
atacgccatgctgggtctcctccccgggattctatcaccgggtgcgttagtagtcggcgtcatctgcgcggccatcttacgccgccacgtgggacaaggggaaggcgcggtccagtggatcgtacttgggagtcggccat

SEQ ID NO: 390002 - DNA, 140 bp, Artificial Sequence
  Synthetic
atggccgactcccaagtacgatccactggaccgcgccttccccttgtcccacgtggcggcgtaagatggccgcgcagatgacgccgactactaacgcacccggtgatagaatcccggggaggagacccagcatggcgtat

SEQ ID NO: 390003 - DNA, 140 bp, Artificial Sequence
  Synthetic
atacgccatgctgggtctcctcgctcaccatcactagcctactcagaaggctccatacctggattaccgaagactgccctgttccatgcgccggctcttggcttcgcgacatatgggactcgtacttgggagtcggccat

SEQ ID NO: 390004 - DNA, 140 bp, Artificial Sequence
  Synthetic
atggccgactcccaagtacgagtcccatatgtcgcgaagccaagagccggcgcatggaacagggcagtcttcggtaatccaggtatggagccttctgagtaggctagtgatggtgagcgaggagacccagcatggcgtat

SEQ ID NO: 390005 - DNA, 140 bp, Artificial Sequence
  Synthetic
aggccctggctgctgatatgctggcacatcaacaggaccgccctgaactgcaatgactcccttcagactggattccttgccgcgctgttctatacacacaagttcaactcgtccggatgcgaccttttgggacagcggtg

SEQ ID NO: 390006 - DNA, 140 bp, Artificial Sequence
  Synthetic
caccgctgtcccaaaaggtcgcatccggacgagttgaacttgtgtgtatagaacagcgcggcaaggaatccagtctgaagggagtcattgcagttcagggcggtcctgttgatgtgccagcatatcagcagccagggcct

SEQ ID NO: 390007 - DNA, 140 bp, Artificial Sequence
  Synthetic
atacgccatgctgggtctcctcacagcgtgtctcatgcccggccccgctggttctggttttgcctactcctgctcgctgcaggggtaggcatctacctcctccccaaccgatgaaggttgcgtacttgggagtcggccat

SEQ ID NO: 390008 - DNA, 140 bp, Artificial Sequence
  Synthetic
atggccgactcccaagtacgcaaccttcatcggttggggaggaggtagatgcctacccctgcagcgagcaggagtaggcaaaaccagaaccagcggggccgggcatgagacacgctgtgaggagacccagcatggcgtat

SEQ ID NO: 390009 - DNA, 140 bp, Artificial Sequence
  Synthetic
atacgccatgctgggtctccaggggcttggactggcactggcatcatgacaacacggtgcccatgcggagctgtcgtttcgggcaatgtccgtcacggttccatgaggataaccggacctcgtacttgggagtcggccat

SEQ ID NO: 390010 - DNA, 140 bp, Artificial Sequence
  Synthetic
atggccgactcccaagtacgaggtccggttatcctcatggaaccgtgacggacattgcccgaaacgacagctccgcatgggcaccgtgttgtcatgatgccagtgccagtccaagcccctggagacccagcatggcgtat

SEQ ID NO: 390011 - DNA, 140 bp, Artificial Sequence
  Synthetic
atacgccatgctgggtctccggaaggtggcagcagcggaatatgcggaggtgacacgacatggttcctatgcttatgttacaggtttgacaaatgacaatctcaaagtcccttgccagttcgtacttgggagtcggccat

SEQ ID NO: 390012 - DNA, 140 bp, Artificial Sequence
  Synthetic
atggccgactcccaagtacgaactggcaagggactttgagattgtcatttgtcaaacctgtaacataagcataggaaccatgtcgtgtcacctccgcatattccgctgctgccaccttccggagacccagcatggcgtat

SEQ ID NO: 390013 - DNA, 140 bp, Artificial Sequence
  Synthetic
atacgccatgctgggtctccggcctcaactcttttgtggtggggtctcagctgccttgtgaacctgagccggacacggaagtgttggcatcaatgctgacggacccatcccacattacggcgtacttgggagtcggccat

SEQ ID NO: 390014 - DNA, 140 bp, Artificial Sequence
  Synthetic
atggccgactcccaagtacgccgtaatgtgggatgggtccgtcagcattgatgccaacacttccgtgtccggctcaggttcacaaggcagctgagaccccaccacaaaagagttgaggccggagacccagcatggcgtat

SEQ ID NO: 390015 - DNA, 140 bp, Artificial Sequence
  Synthetic
aggccctggctgctgatatgctgcactgtcaactttaccatcttcaagatcaggatgtacgtggggggcgtggagcacaggctcagtgctgcatgcaattggactcgaggcgagcgttgtgaccttttgggacagcggtg

SEQ ID NO: 390016 - DNA, 140 bp, Artificial Sequence
  Synthetic
caccgctgtcccaaaaggtcacaacgctcgcctcgagtccaattgcatgcagcactgagcctgtgctccacgccccccacgtacatcctgatcttgaagatggtaaagttgacagtgcagcatatcagcagccagggcct

SEQ ID NO: 390017 - DNA, 140 bp, Artificial Sequence
  Synthetic
atacgccatgctgggtctcccgcccatgctaagaactatgcggttgagatggtggatgcaaacttcttcatggggagtgatgtgacacggatagaatccgagacgaaggtgcttatcctacgtacttgggagtcggccat

SEQ ID NO: 390018 - DNA, 140 bp, Artificial Sequence
  Synthetic
atggccgactcccaagtacgtaggataagcaccttcgtctcggattctatccgtgtcacatcactccccatgaagaagtttgcatccaccatctcaaccgcatagttcttagcatgggcgggagacccagcatggcgtat

SEQ ID NO: 390019 - DNA, 140 bp, Artificial Sequence
  Synthetic
atacgccatgctgggtctcctctgggcgaggccagactacaatccaccagtcgtagagacctggaagagaccagattatgacccaccaacagtatccgggtgtgctcttcccccccgtgtcgtacttgggagtcggccat

SEQ ID NO: 390020 - DNA, 140 bp, Artificial Sequence
  Synthetic
atggccgactcccaagtacgacacgggggggaagagcacacccggatactgttggtgggtcataatctggtctcttccaggtctctacgactggtggattgtagtctggcctcgcccagaggagacccagcatggcgtat

SEQ ID NO: 390021 - DNA, 140 bp, Artificial Sequence
  Synthetic
aggccctggctgctgatatggtcctcaatgcggcgtccgtcgccggagcgcatggcatcctccccttccttatgttcttttgtgccgcttggtacattaagggcaggctggtccctgggggaccttttgggacagcggtg

SEQ ID NO: 390022 - DNA, 140 bp, Artificial Sequence
  Synthetic
caccgctgtcccaaaaggtcccccagggaccagcctgcccttaatgtaccaagcggcacaaaagaacataaggaaggggaggatgccatgcgctccggcgacggacgccgcattgaggaccatatcagcagccagggcct

SEQ ID NO: 390023 - DNA, 140 bp, Artificial Sequence
  Synthetic
aggccctggctgctgatatgtcccctggtgccctggtcgtcggggtcgtgtgcgcagcaatactgcgtcggcatgtgggcccaggggagggggctgtgcagtggatgaaccggctgataggaccttttgggacagcggtg

SEQ ID NO: 390024 - DNA, 140 bp, Artificial Sequence
  Synthetic
caccgctgtcccaaaaggtcctatcagccggttcatccactgcacagccccctcccctgggcccacatgccgacgcagtattgctgcgcacacgaccccgacgaccagggcaccaggggacatatcagcagccagggcct

SEQ ID NO: 390025 - DNA, 140 bp, Artificial Sequence
  Synthetic
atacgccatgctgggtctcccaacttccccctagctgtgattcaggtcgctccacagggatggacactaccgatgctactgaccaaccagccttaaaggaatctactgactcggaagcagcgtacttgggagtcggccat

SEQ ID NO: 390026 - DNA, 140 bp, Artificial Sequence
  Synthetic
atggccgactcccaagtacgctgcttccgagtcagtagattcctttaaggctggttggtcagtagcatcggtagtgtccatccctgtggagcgacctgaatcacagctagggggaagttgggagacccagcatggcgtat

SEQ ID NO: 390027 - DNA, 140 bp, Artificial Sequence
  Synthetic
aggccctggctgctgatatgaggcgcggtttttataggtctggcactcttgaccttgtcaccatactataaagtgttcctcgctaggctcatatggtggttacaatatttcatcaccagagaccttttgggacagcggtg

SEQ ID NO: 390028 - DNA, 140 bp, Artificial Sequence
  Synthetic
caccgctgtcccaaaaggtctctggtgatgaaatattgtaaccaccatatgagcctagcgaggaacactttatagtatggtgacaaggtcaagagtgccagacctataaaaaccgcgcctcatatcagcagccagggcct

SEQ ID NO: 390029 - DNA, 140 bp, Artificial Sequence
  Synthetic
atacgccatgctgggtctccagctcctgatctagactccggctcctggtccacatgttccgaggaggggggttctgaagtttgttgctccatgtcctactcctggaccggggcgctgatacgtacttgggagtcggccat

SEQ ID NO: 390030 - DNA, 140 bp, Artificial Sequence
  Synthetic
atggccgactcccaagtacgtatcagcgccccggtccaggagtaggacatggagcaacaaacttcagaacccccctcctcggaacatgtggaccaggagccggagtctagatcaggagctggagacccagcatggcgtat

SEQ ID NO: 390031 - DNA, 140 bp, Artificial Sequence
  Synthetic
aggccctggctgctgatatgttgacatcaccaaacttctgctcgccatgctcggtccgctcatggtgctccaggccggcataactagagtgccgtacttcgtacgcgctcaagggctcatgaccttttgggacagcggtg

SEQ ID NO: 390032 - DNA, 140 bp, Artificial Sequence
  Synthetic
caccgctgtcccaaaaggtcatgagcccttgagcgcgtacgaagtacggcactctagttatgccggcctggagcaccatgagcggaccgagcatggcgagcagaagtttggtgatgtcaacatatcagcagccagggcct

SEQ ID NO: 390033 - DNA, 140 bp, Artificial Sequence
  Synthetic
atacgccatgctgggtctccggcgcccggcagaacatccagttgatcaacgccaacggtagctggcacatcaatcgtacggccctaaactgcaacgagagccttaacaccggctggttagcgtacttgggagtcggccat

SEQ ID NO: 390034 - DNA, 140 bp, Artificial Sequence
  Synthetic
atggccgactcccaagtacgctaaccagccggtgttaaggctctcgttgcagtttagggccgtacgattgatgtgccagctaccgttggcgttgatcaactggatgttctgccgggcgccggagacccagcatggcgtat

SEQ ID NO: 390035 - DNA, 140 bp, Artificial Sequence
  Synthetic
atacgccatgctgggtctcctcgtgcatgcatgttagtgcggaaagccgccgggggtcattatatccaaatggccttcgtgaagctggccgcactgacaggtacgtacgtttatgaccatcgtacttgggagtcggccat

SEQ ID NO: 390036 - DNA, 140 bp, Artificial Sequence
  Synthetic
atggccgactcccaagtacgatggtcataaacgtacgtacctgtcagtgcggccagcttcacgaaggccatttggatataatgacccccggcggctttccgcactaacatgcatgcacgaggagacccagcatggcgtat

SEQ ID NO: 390037 - DNA, 140 bp, Artificial Sequence
  Synthetic
atacgccatgctgggtctcccttcacaacgggctaaaaaggtgacctttgacagggtgcaactacttgactctcattatgaccaagtcttaaaggacattaagctggctgcttccaaagtcgtacttgggagtcggccat

SEQ ID NO: 390038 - DNA, 140 bp, Artificial Sequence
  Synthetic
atggccgactcccaagtacgactttggaagcagccagcttaatgtcctttaagacttggtcataatgagagtcaagtagttgcaccctgtcaaaggtcacctttttagcccgttgtgaagggagacccagcatggcgtat

SEQ ID NO: 390039 - DNA, 140 bp, Artificial Sequence
  Synthetic
aggccctggctgctgatatgtctcattatgaccaagtcttaaaggacattaagctggctgcttccaaagtcagtgctaacctactctctatagaggaggcatgtgcgctgacccccccccgaccttttgggacagcggtg

SEQ ID NO: 390040 - DNA, 140 bp, Artificial Sequence
  Synthetic
caccgctgtcccaaaaggtcgggggggggtcagcgcacatgcctcctctatagagagtaggttagcactgactttggaagcagccagcttaatgtcctttaagacttggtcataatgagacatatcagcagccagggcct

SEQ ID NO: 390041 - DNA, 140 bp, Artificial Sequence
  Synthetic
aggccctggctgctgatatgagaccaacaaacaccaattcctacaaccatcatggccaaaaatgaggtgttctgcatcgacccgacgaaaggcgggaagaaggctgctcgcctcatcgtagaccttttgggacagcggtg

SEQ ID NO: 390042 - DNA, 140 bp, Artificial Sequence
  Synthetic
caccgctgtcccaaaaggtctacgatgaggcgagcagccttcttcccgcctttcgtcgggtcgatgcagaacacctcatttttggccatgatggttgtaggaattggtgtttgttggtctcatatcagcagccagggcct

SEQ ID NO: 390043 - DNA, 140 bp, Artificial Sequence
  Synthetic
atacgccatgctgggtctccactctcccgcacagcgtgttgatttcctgctgcgagcttggaaagaaaagaaagaccctatgggtttttcgtatgatacccgctgtttcgactcaacagtcgtacttgggagtcggccat

SEQ ID NO: 390044 - DNA, 140 bp, Artificial Sequence
  Synthetic
atggccgactcccaagtacgactgttgagtcgaaacagcgggtatcatacgaaaaacccatagggtctttcttttctttccaagctcgcagcaggaaatcaacacgctgtgcgggagagtggagacccagcatggcgtat

SEQ ID NO: 390045 - DNA, 140 bp, Artificial Sequence
  Synthetic
aggccctggctgctgatatgcatgacaccatgcacctgcggcagctcggatctgtacttggtcacgagacatgctgatgtcatcccggtgcgccggcggagcgacggtagggggagcctagaccttttgggacagcggtg

SEQ ID NO: 390046 - DNA, 140 bp, Artificial Sequence
  Synthetic
caccgctgtcccaaaaggtctaggctccccctaccgtcgctccgccggcgcaccgggatgacatcagcatgtctcgtgaccaagtacagatccgagctgccgcaggtgcatggtgtcatgcatatcagcagccagggcct

SEQ ID NO: 390047 - DNA, 140 bp, Artificial Sequence
  Synthetic
atacgccatgctgggtctccgtgggcgggcccatgatgaacagcaagggccagtcttgcggttataggcgttgtcgcgcaagcggagtgctcaccactagcatggggaacactatcacgtcgtacttgggagtcggccat

SEQ ID NO: 390048 - DNA, 140 bp, Artificial Sequence
  Synthetic
atggccgactcccaagtacgacgtgatagtgttccccatgctagtggtgagcactccgcttgcgcgacaacgcctataaccgcaagactggcccttgctgttcatcatgggcccgcccacggagacccagcatggcgtat

SEQ ID NO: 390049 - DNA, 140 bp, Artificial Sequence
  Synthetic
atacgccatgctgggtctccctggaaggacccggactacgtccctccggtggtacacgggtgtccattgccacctgccaaaacccccccgataccacctccacggaggaaaaggacggttcgtacttgggagtcggccat

SEQ ID NO: 390050 - DNA, 140 bp, Artificial Sequence
  Synthetic
atggccgactcccaagtacgaaccgtccttttcctccgtggaggtggtatcgggggggttttggcaggtggcaatggacacccgtgtaccaccggagggacgtagtccgggtccttccagggagacccagcatggcgtat

SEQ ID NO: 390051 - DNA, 140 bp, Artificial Sequence
  Synthetic
atacgccatgctgggtctccagctgaggaggatgagcgaaatctgagagtcttcacggaggctatgaccagatattctgctccccccggcgacccccctaaaccagaatatgacttggagcgtacttgggagtcggccat

SEQ ID NO: 390052 - DNA, 140 bp, Artificial Sequence
  Synthetic
atggccgactcccaagtacgctccaagtcatattctggtttaggggggtcgccggggggagcagaatatctggtcatagcctccgtgaagactctcagatttcgctcatcctcctcagctggagacccagcatggcgtat

SEQ ID NO: 390053 - DNA, 140 bp, Artificial Sequence
  Synthetic
atacgccatgctgggtctccctgcctgggagacagctagacactcccctgtcaattcatggctgggaaacatcattcaatacgcccccaccatatgggtgcgcatggtcctcatgacacacgtacttgggagtcggccat

SEQ ID NO: 390054 - DNA, 140 bp, Artificial Sequence
  Synthetic
atggccgactcccaagtacgtgtgtcatgaggaccatgcgcacccatatggtgggggcgtattgaatgatgtttcccagccatgaattgacaggggagtgtctagctgtctcccaggcagggagacccagcatggcgtat

SEQ ID NO: 390055 - DNA, 140 bp, Artificial Sequence
  Synthetic
atacgccatgctgggtctccataattgagagactacatgggcttgaagctttctcactgcacggttactctcccaccgaactcactcgggtggcagcagctctcagaaaacttggagcgccgtacttgggagtcggccat

SEQ ID NO: 390056 - DNA, 140 bp, Artificial Sequence
  Synthetic
atggccgactcccaagtacggcgctccaagttttctgagagctgctgccacccgagtgagttcggtgggagagtaaccgtgcagtgagaaagcttcaagcccatgtagtctctcaattatggagacccagcatggcgtat

SEQ ID NO: 390057 - DNA, 140 bp, Artificial Sequence
  Synthetic
atacgccatgctgggtctccctcccctcagagcgtggaagagccgggcacgtgcggtgagggcatcactcatctcccagggagggagagcggccacttgtggcttctatctcttcaactgcgtacttgggagtcggccat

SEQ ID NO: 390058 - DNA, 140 bp, Artificial Sequence
  Synthetic
atggccgactcccaagtacgcagttgaagagatagaagccacaagtggccgctctccctccctgggagatgagtgatgccctcaccgcacgtgcccggctcttccacgctctgaggggagggagacccagcatggcgtat

SEQ ID NO: 390059 - DNA, 140 bp, Artificial Sequence
  Synthetic
aggccctggctgctgatatgatccagatgtatactaatgtagacaaagacctcgtgggctggcccgctccgcaaggtacccgctcattgacgccctgcacctgcggctcctcggacctttgaccttttgggacagcggtg

SEQ ID NO: 390060 - DNA, 140 bp, Artificial Sequence
  Synthetic
caccgctgtcccaaaaggtcaaaggtccgaggagccgcaggtgcagggcgtcaatgagcgggtaccttgcggagcgggccagcccacgaggtctttgtctacattagtatacatctggatcatatcagcagccagggcct

SEQ ID NO: 390061 - DNA, 140 bp, Artificial Sequence
  Synthetic
atacgccatgctgggtctccacccccggcgacggtcacgcaatttgggtaaagtcatcgatacccttacgtgcggatttgccgatctcatggggtacatcccgctcgtcggcgctcccgtcgtacttgggagtcggccat

SEQ ID NO: 390062 - DNA, 140 bp, Artificial Sequence
  Synthetic
atggccgactcccaagtacgacgggagcgccgacgagcgggatgtaccccatgagatcggcaaatccgcacgtaagggtatcgatgactttacccaaattgcgtgaccgtcgccgggggtggagacccagcatggcgtat

SEQ ID NO: 390063 - DNA, 140 bp, Artificial Sequence
  Synthetic
atacgccatgctgggtctccaggaggcgtcgcaagagccctcgcgcatggcgtgagggcccttgaagacgggataaatttcgcaacagggaatttgcccggttgctccttttctatcttccgtacttgggagtcggccat

SEQ ID NO: 390064 - DNA, 140 bp, Artificial Sequence
  Synthetic
atggccgactcccaagtacggaagatagaaaaggagcaaccgggcaaattccctgttgcgaaatttatcccgtcttcaagggccctcacgccatgcgcgagggctcttgcgacgcctcctggagacccagcatggcgtat

SEQ ID NO: 390065 - DNA, 140 bp, Artificial Sequence
  Synthetic
atacgccatgctgggtctcccttctcgctctattctcttgtttaattcatccagctgctagtctagagtggcggaatgtgtctggcctctacatccttaccaacgactgtcccaacagcacgtacttgggagtcggccat

SEQ ID NO: 390066 - DNA, 140 bp, Artificial Sequence
  Synthetic
atggccgactcccaagtacgtgctgttgggacagtcgttggtaaggatgtagaggccagacacattccgccactctagactagcagctggatgaattaaacaagagaatagagcgagaagggagacccagcatggcgtat

SEQ ID NO: 390067 - DNA, 140 bp, Artificial Sequence
  Synthetic
atacgccatgctgggtctcctacagtggcagtcaggtacgtcggagcaaccaccgcttcgatacgcagtcatgtggacctattagtgggcgcagccacgatgtgctctgcgctctacgtgcgtacttgggagtcggccat

SEQ ID NO: 390068 - DNA, 140 bp, Artificial Sequence
  Synthetic
atggccgactcccaagtacgcacgtagagcgcagagcacatcgtggctgcgcccactaataggtccacatgactgcgtatcgaagcggtggttgctccgacgtacctgactgccactgtaggagacccagcatggcgtat

SEQ ID NO: 390069 - DNA, 140 bp, Artificial Sequence
  Synthetic
aggccctggctgctgatatgattactccatgcagggcaactgggccaaggtcattatcatcatggttatgttttcaggggtcgatgccaccacacacgttaccggtggcactgcaggtctgaccttttgggacagcggtg

SEQ ID NO: 390070 - DNA, 140 bp, Artificial Sequence
  Synthetic
caccgctgtcccaaaaggtcagacctgcagtgccaccggtaacgtgtgtggtggcatcgacccctgaaaacataaccatgatgataatgaccttggcccagttgccctgcatggagtaatcatatcagcagccagggcct

SEQ ID NO: 390071 - DNA, 140 bp, Artificial Sequence
  Synthetic
atacgccatgctgggtctccaactgcaatgattccctaaacaccgggttcatagctgggttgtttcgtttccacaaattcaactctaccggatgtcctgaaatgctcagcagctgtaagccgtacttgggagtcggccat

SEQ ID NO: 390072 - DNA, 140 bp, Artificial Sequence
  Synthetic
atggccgactcccaagtacggcttacagctgctgagcatttcaggacatccggtagagttgaatttgtggaaacgaaacaacccagctatgaacccggtgtttagggaatcattgcagttggagacccagcatggcgtat

SEQ ID NO: 390073 - DNA, 140 bp, Artificial Sequence
  Synthetic
atacgccatgctgggtctccttgcgaggttgtcccggcattgagcgtctgcggtcctgtgtattgtttcacaccatcgccagtggtcgtaggcactactgatgctaagggcgtcccaactcgtacttgggagtcggccat

SEQ ID NO: 390074 - DNA, 140 bp, Artificial Sequence
  Synthetic
atggccgactcccaagtacgagttgggacgcccttagcatcagtagtgcctacgaccactggcgatggtgtgaaacaatacacaggaccgcagacgctcaatgccgggacaacctcgcaaggagacccagcatggcgtat

SEQ ID NO: 390075 - DNA, 140 bp, Artificial Sequence
  Synthetic
atacgccatgctgggtctccgcctcccggaggtcggtggtttgggtgcacatggatgaactccacggggtttgtccaaacatgcggggctcccccttgcaacatttatgggggtggggggcgtacttgggagtcggccat

SEQ ID NO: 390076 - DNA, 140 bp, Artificial Sequence
  Synthetic
atggccgactcccaagtacgccccccacccccataaatgttgcaagggggagccccgcatgtttggacaaaccccgtggagttcatccatgtgcacccaaaccaccgacctccgggaggcggagacccagcatggcgtat

SEQ ID NO: 390077 - DNA, 140 bp, Artificial Sequence
  Synthetic
aggccctggctgctgatatgcatgcaagcccctcctacgggaggaggtcgtgttccaggtcgggctcaaccaatatctagttgggtcacaactcccatgcgagcccgaaccggatgtggcgaccttttgggacagcggtg

SEQ ID NO: 390078 - DNA, 140 bp, Artificial Sequence
  Synthetic
caccgctgtcccaaaaggtcgccacatccggttcgggctcgcatgggagttgtgacccaactagatattggttgagcccgacctggaacacgacctcctcccgtaggaggggcttgcatgcatatcagcagccagggcct

SEQ ID NO: 390079 - DNA, 140 bp, Artificial Sequence
  Synthetic
aggccctggctgctgatatgtgactccccggacgctgacctcattgaggccaacctcctgtggcggcaggagatgggcgggaacatcacccgcgtggagtcagaaaataaggtaataattgaccttttgggacagcggtg

SEQ ID NO: 390080 - DNA, 140 bp, Artificial Sequence
  Synthetic
caccgctgtcccaaaaggtcaattattaccttattttctgactccacgcgggtgatgttcccgcccatctcctgccgccacaggaggttggcctcaatgaggtcagcgtccggggagtcacatatcagcagccagggcct

SEQ ID NO: 390081 - DNA, 140 bp, Artificial Sequence
  Synthetic
atacgccatgctgggtctccgttttcctcctcctagcagacgcacgcgtgtgcgttgccctttggctgatgctgatgatatcgcaagcagaagcagccttggagaaccttgtcacgctgacgtacttgggagtcggccat

SEQ ID NO: 390082 - DNA, 140 bp, Artificial Sequence
  Synthetic
atggccgactcccaagtacgtcagcgtgacaaggttctccaaggctgcttctgcttgcgatatcatcagcatcagccaaagggcaacgcacacgcgtgcgtctgctaggaggaggaaaacggagacccagcatggcgtat

SEQ ID NO: 390083 - DNA, 140 bp, Artificial Sequence
  Synthetic
atacgccatgctgggtctccccccatcacttacgctgagcctagaagctcggatcagaggccctactgctggcattacgcgccccgaccgtgtggcgttgtccccgcggcgcaggtgtgtcgtacttgggagtcggccat

SEQ ID NO: 390084 - DNA, 140 bp, Artificial Sequence
  Synthetic
atggccgactcccaagtacgacacacctgcgccgcggggacaacgccacacggtcggggcgcgtaatgccagcagtagggcctctgatccgagcttctaggctcagcgtaagtgatggggggagacccagcatggcgtat

SEQ ID NO: 390085 - DNA, 140 bp, Artificial Sequence
  Synthetic
aggccctggctgctgatatgggtgtcatcctgctaacgagcctgctttatccatctttaatttttgacatcactaaactgctgatagcagtattgggcccattatacttaatacaggctagaccttttgggacagcggtg

SEQ ID NO: 390086 - DNA, 140 bp, Artificial Sequence
  Synthetic
caccgctgtcccaaaaggtctagcctgtattaagtataatgggcccaatactgctatcagcagtttagtgatgtcaaaaattaaagatggataaagcaggctcgttagcaggatgacacccatatcagcagccagggcct

SEQ ID NO: 390087 - DNA, 140 bp, Artificial Sequence
  Synthetic
atacgccatgctgggtctccgaacctgtaatatttagtcccatggaaatcaaggtcatcacttggggcgcggacacagcggcttgcggagatattctttgcgggctgcccgtctctgcgccgtacttgggagtcggccat

SEQ ID NO: 390088 - DNA, 140 bp, Artificial Sequence
  Synthetic
atggccgactcccaagtacggcgcagagacgggcagcccgcaaagaatatctccgcaagccgctgtgtccgcgccccaagtgatgaccttgatttccatgggactaaatattacaggttcggagacccagcatggcgtat

SEQ ID NO: 390089 - DNA, 140 bp, Artificial Sequence
  Synthetic
aggccctggctgctgatatgatcaggacctcgttgggtggccagcccctccaggggctaagtcccttgaaccgtgctcttgcgggtccgcagatttatacttggttacccgcgatgctgagaccttttgggacagcggtg

SEQ ID NO: 390090 - DNA, 140 bp, Artificial Sequence
  Synthetic
caccgctgtcccaaaaggtctcagcatcgcgggtaaccaagtataaatctgcggacccgcaagagcacggttcaagggacttagcccctggaggggctggccacccaacgaggtcctgatcatatcagcagccagggcct

SEQ ID NO: 390091 - DNA, 140 bp, Artificial Sequence
  Synthetic
aggccctggctgctgatatgcgatgccatcatcctccttacgtgtgcagtccatccagagctaatctttgacatcaccaaactcttgctcgccatactcggtccgctcatggtgctccaggaccttttgggacagcggtg

SEQ ID NO: 390092 - DNA, 140 bp, Artificial Sequence
  Synthetic
caccgctgtcccaaaaggtcctggagcaccatgagcggaccgagtatggcgagcaagagtttggtgatgtcaaagattagctctggatggactgcacacgtaaggaggatgatggcatcgcatatcagcagccagggcct

SEQ ID NO: 390093 - DNA, 140 bp, Artificial Sequence
  Synthetic
aggccctggctgctgatatggacgctactagcatattgggcataggcacggtcttggatcaggctgagacggctggggtgaggctgacggttctagcgacagcaaccccacctggcagcagaccttttgggacagcggtg

SEQ ID NO: 390094 - DNA, 140 bp, Artificial Sequence
  Synthetic
caccgctgtcccaaaaggtctgctgccaggtggggttgctgtcgctagaaccgtcagcctcaccccagccgtctcagcctgatccaagaccgtgcctatgcccaatatgctagtagcgtccatatcagcagccagggcct

SEQ ID NO: 390095 - DNA, 140 bp, Artificial Sequence
  Synthetic
aggccctggctgctgatatggaggcaccttatcttctgccattccaagaaaaaatgtgatgaggtggcatccaaactcagaggtatggggctcaatgctgtagcatactataggggtcttgaccttttgggacagcggtg

SEQ ID NO: 390096 - DNA, 140 bp, Artificial Sequence
  Synthetic
caccgctgtcccaaaaggtcaagacccctatagtatgctacagcattgagccccatacctctgagtttggatgccacctcatcacattttttcttggaatggcagaagataaggtgcctccatatcagcagccagggcct

SEQ ID NO: 390097 - DNA, 140 bp, Artificial Sequence
  Synthetic
aggccctggctgctgatatgcccgaccccgctggttcatgtggtgcctactcctactttccgtaggggtaggcatctacctgctccccaaccggtgaacggggagctaaacactccaggcgaccttttgggacagcggtg

SEQ ID NO: 390098 - DNA, 140 bp, Artificial Sequence
  Synthetic
caccgctgtcccaaaaggtcgcctggagtgtttagctccccgttcaccggttggggagcaggtagatgcctacccctacggaaagtaggagtaggcaccacatgaaccagcggggtcgggcatatcagcagccagggcct

SEQ ID NO: 390099 - DNA, 140 bp, Artificial Sequence
  Synthetic
atacgccatgctgggtctcccatcaagtccctcactgagaggctttatgttgggggccctcttaccaattcaaggggggagaactgcggctatcgcaggtgccgcgcgagcggcgtactgcgtacttgggagtcggccat

SEQ ID NO: 390100 - DNA, 140 bp, Artificial Sequence
  Synthetic
atggccgactcccaagtacgcagtacgccgctcgcgcggcacctgcgatagccgcagttctccccccttgaattggtaagagggcccccaacataaagcctctcagtgagggacttgatgggagacccagcatggcgtat

SEQ ID NO: 390101 - DNA, 140 bp, Artificial Sequence
  Synthetic
aggccctggctgctgatatgctaccaagccactgtgtgcgcccgcgcgcaggctccacccccaagttgggacgagacgtggaagtgtcttgtgcggcttaagccaacactacatggacccgaccttttgggacagcggtg

SEQ ID NO: 390102 - DNA, 140 bp, Artificial Sequence
  Synthetic
caccgctgtcccaaaaggtcgggtccatgtagtgttggcttaagccgcacaagacacttccacgtctcgtcccaacttgggggtggagcctgcgcgcgggcgcacacagtggcttggtagcatatcagcagccagggcct

SEQ ID NO: 390103 - DNA, 140 bp, Artificial Sequence
  Synthetic
atacgccatgctgggtctcctaaccaccagtacctgggtgttgctcgggggggttctcgcggccgtagcagcctactgcttgtcagtcggttgcgtagtgatcgtgggtcatattgagctcgtacttgggagtcggccat

SEQ ID NO: 390104 - DNA, 140 bp, Artificial Sequence
  Synthetic
atggccgactcccaagtacgagctcaatatgacccacgatcactacgcaaccgactgacaagcagtaggctgctacggccgcgagaacccccccgagcaacacccaggtactggtggttaggagacccagcatggcgtat

SEQ ID NO: 390105 - DNA, 140 bp, Artificial Sequence
  Synthetic
aggccctggctgctgatatggggtagcgctcactcccacgctcgcggccaggaacgccagcatccccaccacgacaatacggcgccacgtcgatttgctcgttgggacggctactttctggaccttttgggacagcggtg

SEQ ID NO: 390106 - DNA, 140 bp, Artificial Sequence
  Synthetic
caccgctgtcccaaaaggtccagaaagtagccgtcccaacgagcaaatcgacgtggcgccgtattgtcgtggtggggatgctggcgttcctggccgcgagcgtgggagtgagcgctaccccatatcagcagccagggcct

SEQ ID NO: 390107 - DNA, 140 bp, Artificial Sequence
  Synthetic
atacgccatgctgggtctccatccagtacttagcaggcctctccactttgcctggcaaccctgctgtggcgtctcttatggcgttcaccgcttcagtcaccagtcccctgacgaccaacccgtacttgggagtcggccat

SEQ ID NO: 390108 - DNA, 140 bp, Artificial Sequence
  Synthetic
atggccgactcccaagtacgggttggtcgtcaggggactggtgactgaagcggtgaacgccataagagacgccacagcagggttgccaggcaaagtggagaggcctgctaagtactggatggagacccagcatggcgtat

SEQ ID NO: 390109 - DNA, 140 bp, Artificial Sequence
  Synthetic
atacgccatgctgggtctccgccatttctggtttttttttttttttttttttttttttttttttttttttttttcccctttttaggggccccccccgggcccccccccccccccccggggcgtacttgggagtcggccat

SEQ ID NO: 390110 - DNA, 140 bp, Artificial Sequence
  Synthetic
atggccgactcccaagtacgccccgggggggggggggggggcccggggggggcccctaaaaaggggaaaaaaaaaaaaaaaaaaaaaaaaaaaaaaaaaaaaaaaaaaaccagaaatggcggagacccagcatggcgtat

SEQ ID NO: 390111 - DNA, 140 bp, Artificial Sequence
  Synthetic
aggccctggctgctgatatgccgggttcattgccgcgctgttctacgcacgcaagttcaattcgtccgggtgtccggagcgcttggccagctgccgccccatcaccgattttgatcaggggaccttttgggacagcggtg

SEQ ID NO: 390112 - DNA, 140 bp, Artificial Sequence
  Synthetic
caccgctgtcccaaaaggtcccctgatcaaaatcggtgatggggcggcagctggccaagcgctccggacacccggacgaattgaacttgcgtgcgtagaacagcgcggcaatgaacccggcatatcagcagccagggcct

SEQ ID NO: 390113 - DNA, 140 bp, Artificial Sequence
  Synthetic
atacgccatgctgggtctccgtccgacttcaagacatggctctctgctaagatcataccagcgctccctgggctgcccttcatttcctgtcaaaagggatacaagggcgtgtggcgggggcgtacttgggagtcggccat

SEQ ID NO: 390114 - DNA, 140 bp, Artificial Sequence
  Synthetic
atggccgactcccaagtacgcccccgccacacgcccttgtatcccttttgacaggaaatgaagggcagcccagggagcgctggtatgatcttagcagagagccatgtcttgaagtcggacggagacccagcatggcgtat

SEQ ID NO: 390115 - DNA, 140 bp, Artificial Sequence
  Synthetic
aggccctggctgctgatatgtgtgaagaatgggtccatgcggcttgcagggccgcgcacatgcgctaacatgtggtacggtactttccccatcaatgagtacaccaccgggcccagcacagaccttttgggacagcggtg

SEQ ID NO: 390116 - DNA, 140 bp, Artificial Sequence
  Synthetic
caccgctgtcccaaaaggtctgtgctgggcccggtggtgtactcattgatggggaaagtaccgtaccacatgttagcgcatgtgcgcggccctgcaagccgcatggacccattcttcacacatatcagcagccagggcct

SEQ ID NO: 390117 - DNA, 140 bp, Artificial Sequence
  Synthetic
atacgccatgctgggtctccccacagaagacgagctcaagtgtccgtgtcaagtgccggctactgagttctttactgaagtggatggggtgagacttcaccgtttcgcccctccatgtaacgtacttgggagtcggccat

SEQ ID NO: 390118 - DNA, 140 bp, Artificial Sequence
  Synthetic
atggccgactcccaagtacgttacatggaggggcgaaacggtgaagtctcaccccatccacttcagtaaagaactcagtagccggcacttgacacggacacttgagctcgtcttctgtggggagacccagcatggcgtat

SEQ ID NO: 390119 - DNA, 140 bp, Artificial Sequence
  Synthetic
atacgccatgctgggtctcccgataggatctcagctcccctgtgagcctgaaccagatgtttctgtgctgacctcgatgttgagagacccctcccatatcaccgccgaaacggcagcgcgcgtacttgggagtcggccat

SEQ ID NO: 390120 - DNA, 140 bp, Artificial Sequence
  Synthetic
atggccgactcccaagtacgcgcgctgccgtttcggcggtgatatgggaggggtctctcaacatcgaggtcagcacagaaacatctggttcaggctcacaggggagctgagatcctatcgggagacccagcatggcgtat

SEQ ID NO: 390121 - DNA, 140 bp, Artificial Sequence
  Synthetic
atacgccatgctgggtctccacctcgatgttgagagacccctcccatatcaccgccgaaacggcagcgcgccgccttgcgcgcgggtcccctccatcagaggcaagctcatccgccagcccgtacttgggagtcggccat

SEQ ID NO: 390122 - DNA, 140 bp, Artificial Sequence
  Synthetic
atggccgactcccaagtacgggctggcggatgagcttgcctctgatggaggggacccgcgcgcaaggcggcgcgctgccgtttcggcggtgatatgggaggggtctctcaacatcgaggtggagacccagcatggcgtat

SEQ ID NO: 390123 - DNA, 140 bp, Artificial Sequence
  Synthetic
atacgccatgctgggtctccccttgtgttcttctgcgctgcctggtacatcaagggcaggctggtccccggggcggcgtatgctctttacggagtgtggccgctgttcctgctcctgctgcgtacttgggagtcggccat

SEQ ID NO: 390124 - DNA, 140 bp, Artificial Sequence
  Synthetic
atggccgactcccaagtacgcagcaggagcaggaacagcggccacactccgtaaagagcatacgccgccccggggaccagcctgcccttgatgtaccaggcagcgcagaagaacacaaggggagacccagcatggcgtat

SEQ ID NO: 390125 - DNA, 140 bp, Artificial Sequence
  Synthetic
atacgccatgctgggtctcctaatgtgtccacagtgctagctgcgctagcggagaaaacattctcctcctctaaaccgcaggaagaggatagctcatcctcaggggtcgacacgcagtcccgtacttgggagtcggccat

SEQ ID NO: 390126 - DNA, 140 bp, Artificial Sequence
  Synthetic
atggccgactcccaagtacgggactgcgtgtcgacccctgaggatgagctatcctcttcctgcggtttagaggaggagaatgttttctccgctagcgcagctagcactgtggacacattaggagacccagcatggcgtat

SEQ ID NO: 390127 - DNA, 140 bp, Artificial Sequence
  Synthetic
aggccctggctgctgatatgacaaagcattcctcgccaagctcatatggtggttacaatattttatcaccagagctgaggcgcagctgcaagtgtggatcccccctctcaacgcccgggggaccttttgggacagcggtg

SEQ ID NO: 390128 - DNA, 140 bp, Artificial Sequence
  Synthetic
caccgctgtcccaaaaggtcccccgggcgttgagaggggggatccacacttgcagctgcgcctcagctctggtgataaaatattgtaaccaccatatgagcttggcgaggaatgctttgtcatatcagcagccagggcct

SEQ ID NO: 390129 - DNA, 140 bp, Artificial Sequence
  Synthetic
atacgccatgctgggtctcctcttcacatcgggccccaagcagaacatccacctggtcaactctaatggtagttggcacattaataggacggccctgaactgtaacgccagcctcgacaccgtacttgggagtcggccat

SEQ ID NO: 390130 - DNA, 140 bp, Artificial Sequence
  Synthetic
atggccgactcccaagtacggtgtcgaggctggcgttacagttcagggccgtcctattaatgtgccaactaccattagagttgaccaggtggatgttctgcttggggcccgatgtgaagaggagacccagcatggcgtat

SEQ ID NO: 390131 - DNA, 140 bp, Artificial Sequence
  Synthetic
atacgccatgctgggtctcctgagacatcataacctagtctattcaacgtcgtctagaagcgcttctcagcgccagaagaaggttaccttcgacaggttgcaggtgctcgacgaccattacgtacttgggagtcggccat

SEQ ID NO: 390132 - DNA, 140 bp, Artificial Sequence
  Synthetic
atggccgactcccaagtacgtaatggtcgtcgagcacctgcaacctgtcgaaggtaaccttcttctggcgctgagaagcgcttctagacgacgttgaatagactaggttatgatgtctcaggagacccagcatggcgtat

SEQ ID NO: 390133 - DNA, 140 bp, Artificial Sequence
  Synthetic
atacgccatgctgggtctccggccattgaccagatccgctccgtctgggaggacttgctggaagacaccacaactccaattccaaccaccatcatggcgaagagcgaggtgttttgtgtgcgtacttgggagtcggccat

SEQ ID NO: 390134 - DNA, 140 bp, Artificial Sequence
  Synthetic
atggccgactcccaagtacgcacacaaaacacctcgctcttcgccatgatggtggttggaattggagttgtggtgtcttccagcaagtcctcccagacggagcggatctggtcaatggccggagacccagcatggcgtat

SEQ ID NO: 390135 - DNA, 140 bp, Artificial Sequence
  Synthetic
atacgccatgctgggtctccgaccccgctaaagggggccgcaagcccgctcgcctcattgtgtaccctgacctgggggtgcgtgtctgtgagaaacgcgccctgtatgacgtgatacagacgtacttgggagtcggccat

SEQ ID NO: 390136 - DNA, 140 bp, Artificial Sequence
  Synthetic
atggccgactcccaagtacgtctgtatcacgtcatacagggcgcgtttctcacagacacgcacccccaggtcagggtacacaatgaggcgagcgggcttgcggccccctttagcggggtcggagacccagcatggcgtat

SEQ ID NO: 390137 - DNA, 140 bp, Artificial Sequence
  Synthetic
aggccctggctgctgatatgtgcttggtacgagctcacgcccgccgagacctcagttagattgcgggcttacctaaatacaccagggttgcccgtctgccaggaccatctggagttttgggaccttttgggacagcggtg

SEQ ID NO: 390138 - DNA, 140 bp, Artificial Sequence
  Synthetic
caccgctgtcccaaaaggtcccaaaactccagatggtcctggcagacgggcaaccctggtgtatttaggtaagcccgcaatctaactgaggtctcggcgggcgtgagctcgtaccaagcacatatcagcagccagggcct

SEQ ID NO: 390139 - DNA, 140 bp, Artificial Sequence
  Synthetic
aggccctggctgctgatatggtctccaagggatggaggttgctggcgcccatcacggcgtacgcccagcagacaaggggcctcttggggtgcataattaccagcctgaccggccgggacagaccttttgggacagcggtg

SEQ ID NO: 390140 - DNA, 140 bp, Artificial Sequence
  Synthetic
caccgctgtcccaaaaggtctgtcccggccggtcaggctggtaattatgcaccccaagaggccccttgtctgctgggcgtacgccgtgatgggcgccagcaacctccatcccttggagaccatatcagcagccagggcct

SEQ ID NO: 390141 - DNA, 140 bp, Artificial Sequence
  Synthetic
aggccctggctgctgatatggtacgctcctaccatctgggtgcgcatggtaatgatgacacactttttctccatactccaagcccaggagatacttgaccgaccccttgattttgaaatggaccttttgggacagcggtg

SEQ ID NO: 390142 - DNA, 140 bp, Artificial Sequence
  Synthetic
caccgctgtcccaaaaggtccatttcaaaatcaaggggtcggtcaagtatctcctgggcttggagtatggagaaaaagtgtgtcatcattaccatgcgcacccagatggtaggagcgtaccatatcagcagccagggcct

SEQ ID NO: 390143 - DNA, 140 bp, Artificial Sequence
  Synthetic
atacgccatgctgggtctccatgagcacacttcctaaacctcaaagaaaaaccaaaagaaacaccatccgtcgcccacaggacgtcaagttcccgggtggcggacagatcgttggtggagcgtacttgggagtcggccat

SEQ ID NO: 390144 - DNA, 140 bp, Artificial Sequence
  Synthetic
atggccgactcccaagtacgctccaccaacgatctgtccgccacccgggaacttgacgtcctgtgggcgacggatggtgtttcttttggtttttctttgaggtttaggaagtgtgctcatggagacccagcatggcgtat

SEQ ID NO: 390145 - DNA, 140 bp, Artificial Sequence
  Synthetic
atacgccatgctgggtctcctatacgtgttgccgcgcaggggcccacgattgggtgtgtgcgcgacgcgtaaaacttctgaacggtcacagcctcgcggacggcgacagcctatccccaacgtacttgggagtcggccat

SEQ ID NO: 390146 - DNA, 140 bp, Artificial Sequence
  Synthetic
atggccgactcccaagtacgttggggataggctgtcgccgtccgcgaggctgtgaccgttcagaagttttacgcgtcgcgcacacacccaatcgtgggcccctgcgcggcaacacgtataggagacccagcatggcgtat

SEQ ID NO: 390147 - DNA, 140 bp, Artificial Sequence
  Synthetic
aggccctggctgctgatatgagctcgccacgaaactggtcgcgttgggcatcaacgccgtggcttattaccgcggccttgacgtgtccgtcatcccgaccagcggcgacgttgtcgtcgtgaccttttgggacagcggtg

SEQ ID NO: 390148 - DNA, 140 bp, Artificial Sequence
  Synthetic
caccgctgtcccaaaaggtcacgacgacaacgtcgccgctggtcgggatgacggacacgtcaaggccgcggtaataagccacggcgttgatgcccaacgcgaccagtttcgtggcgagctcatatcagcagccagggcct

SEQ ID NO: 390149 - DNA, 140 bp, Artificial Sequence
  Synthetic
aggccctggctgctgatatggcccattggggcattttggcgggcctagcctattactccatgcagggcaactgggccaaggtcgctatcatcatggttatgttttcaggagtcgatgccagaccttttgggacagcggtg

SEQ ID NO: 390150 - DNA, 140 bp, Artificial Sequence
  Synthetic
caccgctgtcccaaaaggtctggcatcgactcctgaaaacataaccatgatgatagcgaccttggcccagttgccctgcatggagtaataggctaggcccgccaaaatgccccaatgggccatatcagcagccagggcct

SEQ ID NO: 390151 - DNA, 140 bp, Artificial Sequence
  Synthetic
atacgccatgctgggtctcctggctcgtggcacattaacaggactgccctgaactgcaatgattccataaacacagggtttatagccgggttgatttattatcataagttcaactctactcgtacttgggagtcggccat

SEQ ID NO: 390152 - DNA, 140 bp, Artificial Sequence
  Synthetic
atggccgactcccaagtacgagtagagttgaacttatgataataaatcaacccggctataaaccctgtgtttatggaatcattgcagttcagggcagtcctgttaatgtgccacgagccaggagacccagcatggcgtat

SEQ ID NO: 390153 - DNA, 140 bp, Artificial Sequence
  Synthetic
atacgccatgctgggtctccaaccgtactgctggcactacccacctaggccttgtgatactatccgggcatcaagtgtctgcggtccggtgtactgcttcacaccatcgccagtggttgtcgtacttgggagtcggccat

SEQ ID NO: 390154 - DNA, 140 bp, Artificial Sequence
  Synthetic
atggccgactcccaagtacgacaaccactggcgatggtgtgaagcagtacaccggaccgcagacacttgatgcccggatagtatcacaaggcctaggtgggtagtgccagcagtacggttggagacccagcatggcgtat

SEQ ID NO: 390155 - DNA, 140 bp, Artificial Sequence
  Synthetic
atacgccatgctgggtctccttcgggtgcacgtggatgaactccacagggtttaccaagacgtgcggagctcccccttgtaacatctatgggggtggggggaatctcaacaatgagtcagcgtacttgggagtcggccat

SEQ ID NO: 390156 - DNA, 140 bp, Artificial Sequence
  Synthetic
atggccgactcccaagtacgctgactcattgttgagattccccccacccccatagatgttacaagggggagctccgcacgtcttggtaaaccctgtggagttcatccacgtgcacccgaaggagacccagcatggcgtat

SEQ ID NO: 390157 - DNA, 140 bp, Artificial Sequence
  Synthetic
atacgccatgctgggtctccagccggtgtggcgcggggccttggttaacacctcgatgcttggtcgactatccgtaccggctttggcattacccttgtacagtcaattttacattgttcccgtacttgggagtcggccat

SEQ ID NO: 390158 - DNA, 140 bp, Artificial Sequence
  Synthetic
atggccgactcccaagtacgggaacaatgtaaaattgactgtacaagggtaatgccaaagccggtacggatagtcgaccaagcatcgaggtgttaaccaaggccccgcgccacaccggctggagacccagcatggcgtat

SEQ ID NO: 390159 - DNA, 140 bp, Artificial Sequence
  Synthetic
aggccctggctgctgatatgggcacatcaacaggactgccctgaactgcaatgactccctcaacacggggttccttgccgcgctgttttacacacacaagttcaactcgtccggatgcccgaccttttgggacagcggtg

SEQ ID NO: 390160 - DNA, 140 bp, Artificial Sequence
  Synthetic
caccgctgtcccaaaaggtcgggcatccggacgagttgaacttgtgtgtgtaaaacagcgcggcaaggaaccccgtgttgagggagtcattgcagttcagggcagtcctgttgatgtgcccatatcagcagccagggcct

SEQ ID NO: 390161 - DNA, 140 bp, Artificial Sequence
  Synthetic
atacgccatgctgggtctcctgcggggcaaacttgtcccgctggtgacctacagcctgacgggtctttggtccctagcattgctcgtcctcttgctcccccaacgggcgtatgcttggtccgtacttgggagtcggccat

SEQ ID NO: 390162 - DNA, 140 bp, Artificial Sequence
  Synthetic
atggccgactcccaagtacggaccaagcatacgcccgttgggggagcaagaggacgagcaatgctagggaccaaagacccgtcaggctgtaggtcaccagcgggacaagtttgccccgcaggagacccagcatggcgtat

SEQ ID NO: 390163 - DNA, 140 bp, Artificial Sequence
  Synthetic
atacgccatgctgggtctcctcggctagccagttatctgcggtttccttgaaggcagcatgcaccacccgtcatgaccccccagacgtcgatctcattgaggccaacctcctgtggcggccgtacttgggagtcggccat

SEQ ID NO: 390164 - DNA, 140 bp, Artificial Sequence
  Synthetic
atggccgactcccaagtacggccgccacaggaggttggcctcaatgagatcgacgtctggggggtcatgacgggtggtgcatgctgccttcaaggaaaccgcagataactggctagccgaggagacccagcatggcgtat

SEQ ID NO: 390165 - DNA, 140 bp, Artificial Sequence
  Synthetic
atacgccatgctgggtctccccctcccttacttgctcgcgggagtagggacggtgtcatcctgctaacaagcctgctttatccatctttaatttttgacatcactaagctgctgatagcacgtacttgggagtcggccat

SEQ ID NO: 390166 - DNA, 140 bp, Artificial Sequence
  Synthetic
atggccgactcccaagtacgtgctatcagcagcttagtgatgtcaaaaattaaagatggataaagcaggcttgttagcaggatgacaccgtccctactcccgcgagcaagtaagggagggggagacccagcatggcgtat

SEQ ID NO: 390167 - DNA, 140 bp, Artificial Sequence
  Synthetic
aggccctggctgctgatatgatccgttccggcggagatcctgcgaaaatccaggaagttcccccgagcgatacccatatgggcacgcccggattacaaccctccgctgctggagtcctgggaccttttgggacagcggtg

SEQ ID NO: 390168 - DNA, 140 bp, Artificial Sequence
  Synthetic
caccgctgtcccaaaaggtcccaggactccagcagcggagggttgtaatccgggcgtgcccatatgggtatcgctcgggggaacttcctggattttcgcaggatctccgccggaacggatcatatcagcagccagggcct

SEQ ID NO: 390169 - DNA, 140 bp, Artificial Sequence
  Synthetic
atacgccatgctgggtctcctgatggggggaaaatacttccagatggccatactgagcgttggcagatggtttaacacctacctatacgatcacctagcgccaatgcaacattgggccgccgtacttgggagtcggccat

SEQ ID NO: 390170 - DNA, 140 bp, Artificial Sequence
  Synthetic
atggccgactcccaagtacggcggcccaatgttgcattggcgctaggtgatcgtataggtaggtgttaaaccatctgccaacgctcagtatggccatctggaagtattttccccccatcaggagacccagcatggcgtat

SEQ ID NO: 390171 - DNA, 140 bp, Artificial Sequence
  Synthetic
atacgccatgctgggtctcccgttaaggcccccccaataccacccccccggaggaaaaggacggttgttctgacagaatccaccgtttcttctgccttggcggagctcgccacaaagacccgtacttgggagtcggccat

SEQ ID NO: 390172 - DNA, 140 bp, Artificial Sequence
  Synthetic
atggccgactcccaagtacgggtctttgtggcgagctccgccaaggcagaagaaacggtggattctgtcagaacaaccgtccttttcctccgggggggtggtattgggggggccttaacgggagacccagcatggcgtat

SEQ ID NO: 390173 - DNA, 140 bp, Artificial Sequence
  Synthetic
aggccctggctgctgatatggatattctttgcgggctgcccgtctctgcgcgattaggccgtgaggtgctgttgggacctgctgatgactatcgggagatgggttggcgcctgttggcccgaccttttgggacagcggtg

SEQ ID NO: 390174 - DNA, 140 bp, Artificial Sequence
  Synthetic
caccgctgtcccaaaaggtcgggccaacaggcgccaacccatctcccgatagtcatcagcaggtcccaacagcacctcacggcctaatcgcgcagagacgggcagcccgcaaagaatatccatatcagcagccagggcct

SEQ ID NO: 390175 - DNA, 140 bp, Artificial Sequence
  Synthetic
aggccctggctgctgatatgggcggtcagatcgttggtggagtttacttgttgccgcgcaggggccccaggttgggtgtgcgcgcgacgaggaagacttccgagcggtcgcaacctcgaggaccttttgggacagcggtg

SEQ ID NO: 390176 - DNA, 140 bp, Artificial Sequence
  Synthetic
caccgctgtcccaaaaggtcctcgaggttgcgaccgctcggaagtcttcctcgtcgcgcgcacacccaacctggggcccctgcgcggcaacaagtaaactccaccaacgatctgaccgcccatatcagcagccagggcct

SEQ ID NO: 390177 - DNA, 140 bp, Artificial Sequence
  Synthetic
aggccctggctgctgatatgtgttcttctgtgctgcctggtacatcaagggcaggctggtccccggagcggcatatgctctctacggcgtatggccgctgctcctgctcctactggcgttgaccttttgggacagcggtg

SEQ ID NO: 390178 - DNA, 140 bp, Artificial Sequence
  Synthetic
caccgctgtcccaaaaggtcaacgccagtaggagcaggagcagcggccatacgccgtagagagcatatgccgctccggggaccagcctgcccttgatgtaccaggcagcacagaagaacacatatcagcagccagggcct

SEQ ID NO: 390179 - DNA, 140 bp, Artificial Sequence
  Synthetic
atacgccatgctgggtctcctgtgattatctgtgatgagtgtcatgcccaagacgctactagcatattgggtataggcacggtcttagatcaggctgagacggctggggtgaggctgacgcgtacttgggagtcggccat

SEQ ID NO: 390180 - DNA, 140 bp, Artificial Sequence
  Synthetic
atggccgactcccaagtacgcgtcagcctcaccccagccgtctcagcctgatctaagaccgtgcctatacccaatatgctagtagcgtcttgggcatgacactcatcacagataatcacaggagacccagcatggcgtat

SEQ ID NO: 390181 - DNA, 140 bp, Artificial Sequence
  Synthetic
aggccctggctgctgatatgtgactaattcaaaagggcagaactgcggttatcgccggtgccgcgcgagcggcgtgctgacgactagctgcggtaacaccctcacatgttacttgaaggcgaccttttgggacagcggtg

SEQ ID NO: 390182 - DNA, 140 bp, Artificial Sequence
  Synthetic
caccgctgtcccaaaaggtcgccttcaagtaacatgtgagggtgttaccgcagctagtcgtcagcacgccgctcgcgcggcaccggcgataaccgcagttctgcccttttgaattagtcacatatcagcagccagggcct

SEQ ID NO: 390183 - DNA, 140 bp, Artificial Sequence
  Synthetic
aggccctggctgctgatatgtacctcacccgtgatcccaccacccccctcgcacgggctgcgtgggaaacagctagacacactccagttaactcctggctaggcaacattatcatgtatggaccttttgggacagcggtg

SEQ ID NO: 390184 - DNA, 140 bp, Artificial Sequence
  Synthetic
caccgctgtcccaaaaggtccatacatgataatgttgcctagccaggagttaactggagtgtgtctagctgtttcccacgcagcccgtgcgaggggggtggtgggatcacgggtgaggtacatatcagcagccagggcct

SEQ ID NO: 390185 - DNA, 140 bp, Artificial Sequence
  Synthetic
aggccctggctgctgatatgctcccccaggcccgtctcctacttgaagggctcttcgggtggcccactgctctgcccctcggggcacgctgtgggcatcttccgggccgccgtgtgcaccgaccttttgggacagcggtg

SEQ ID NO: 390186 - DNA, 140 bp, Artificial Sequence
  Synthetic
caccgctgtcccaaaaggtcggtgcacacggcggcccggaagatgcccacagcgtgccccgaggggcagagcagtgggccacccgaagagcccttcaagtaggagacgggcctgggggagcatatcagcagccagggcct

SEQ ID NO: 390187 - DNA, 140 bp, Artificial Sequence
  Synthetic
atacgccatgctgggtctccgttcgactcggttgttctctgtgagtgctatgacgcgggctgctcgtggtacgatctgcagcccgctgagaccacagtcagactgagagcttacttgtcccgtacttgggagtcggccat

SEQ ID NO: 390188 - DNA, 140 bp, Artificial Sequence
  Synthetic
atggccgactcccaagtacgggacaagtaagctctcagtctgactgtggtctcagcgggctgcagatcgtaccacgagcagcccgcgtcatagcactcacagagaacaaccgagtcgaacggagacccagcatggcgtat

SEQ ID NO: 390189 - DNA, 140 bp, Artificial Sequence
  Synthetic
aggccctggctgctgatatgacatcaacaggactgccttgaactgcaacgactccctccagaccgggttccttgccgcgctgttctacacccacaggttcaactcgtccggatgcccagagaccttttgggacagcggtg

SEQ ID NO: 390190 - DNA, 140 bp, Artificial Sequence
  Synthetic
caccgctgtcccaaaaggtctctgggcatccggacgagttgaacctgtgggtgtagaacagcgcggcaaggaacccggtctggagggagtcgttgcagttcaaggcagtcctgttgatgtcatatcagcagccagggcct

SEQ ID NO: 390191 - DNA, 140 bp, Artificial Sequence
  Synthetic
aggccctggctgctgatatggcttcagtcaccagtcccctgacgaccaaccaaactatgtttttcaacatactcggggggtgggttgctacccatttagcagggccccagagctcttccggaccttttgggacagcggtg

SEQ ID NO: 390192 - DNA, 140 bp, Artificial Sequence
  Synthetic
caccgctgtcccaaaaggtccggaagagctctggggccctgctaaatgggtagcaacccaccccccgagtatgttgaaaaacatagtttggttggtcgtcaggggactggtgactgaagccatatcagcagccagggcct

SEQ ID NO: 390193 - DNA, 140 bp, Artificial Sequence
  Synthetic
atacgccatgctgggtctcctcgtgcccggccccgctggttttggttttgcctactcctgctcgctgcgggggtaggcatctacctcctccccaaccggtaaggttggggtaaacactcccgtacttgggagtcggccat

SEQ ID NO: 390194 - DNA, 140 bp, Artificial Sequence
  Synthetic
atggccgactcccaagtacgggagtgtttaccccaaccttaccggttggggaggaggtagatgcctacccccgcagcgagcaggagtaggcaaaaccaaaaccagcggggccgggcacgaggagacccagcatggcgtat

SEQ ID NO: 390195 - DNA, 140 bp, Artificial Sequence
  Synthetic
aggccctggctgctgatatgggtgtgatatgcgctgccatactacgtcggcacgtaggacctggggagggggcggtgcagtggatgaacaggctcatcgcattcgcatcccggggtaaccgaccttttgggacagcggtg

SEQ ID NO: 390196 - DNA, 140 bp, Artificial Sequence
  Synthetic
caccgctgtcccaaaaggtcggttaccccgggatgcgaatgcgatgagcctgttcatccactgcaccgccccctccccaggtcctacgtgccgacgtagtatggcagcgcatatcacacccatatcagcagccagggcct

SEQ ID NO: 390197 - DNA, 140 bp, Artificial Sequence
  Synthetic
aggccctggctgctgatatgtgctccgctatgtacgtgggggacctctgcggatctgttttcctcgtctcccagctgttcaccttctcgcctcgccggcacgagacagtacaggactgcagaccttttgggacagcggtg

SEQ ID NO: 390198 - DNA, 140 bp, Artificial Sequence
  Synthetic
caccgctgtcccaaaaggtctgcagtcctgtactgtctcgtgccggcgaggcgagaaggtgaacagctgggagacgaggaaaacagatccgcagaggtcccccacgtacatagcggagcacatatcagcagccagggcct

SEQ ID NO: 390199 - DNA, 140 bp, Artificial Sequence
  Synthetic
aggccctggctgctgatatggtaccatctgggaatgggtttgcatggtgttgtccgacttcaagacatggctctccgctaagattatgccagcgctccccgggttgcccttcatttcctggaccttttgggacagcggtg

SEQ ID NO: 390200 - DNA, 140 bp, Artificial Sequence
  Synthetic
caccgctgtcccaaaaggtccaggaaatgaagggcaacccggggagcgctggcataatcttagcggagagccatgtcttgaagtcggacaacaccatgcaaacccattcccagatggtaccatatcagcagccagggcct

SEQ ID NO: 390201 - DNA, 140 bp, Artificial Sequence
  Synthetic
aggccctggctgctgatatgactgttcaatctatcccggccacgtatcaggtcatcgcatggcttgggatatgatgatgaactggtcacctacaacagccttagtggtgtcgcagttactgaccttttgggacagcggtg

SEQ ID NO: 390202 - DNA, 140 bp, Artificial Sequence
  Synthetic
caccgctgtcccaaaaggtcagtaactgcgacaccactaaggctgttgtaggtgaccagttcatcatcatatcccaagccatgcgatgacctgatacgtggccgggatagattgaacagtcatatcagcagccagggcct

SEQ ID NO: 390203 - DNA, 140 bp, Artificial Sequence
  Synthetic
aggccctggctgctgatatgcatcaatgagtacaccactggacccagcacaccttgcccatcacccaactacactcgcgcactatggcgcgtggctgccaacagctacgttgaggtgcgcgaccttttgggacagcggtg

SEQ ID NO: 390204 - DNA, 140 bp, Artificial Sequence
  Synthetic
caccgctgtcccaaaaggtcgcgcacctcaacgtagctgttggcagccacgcgccatagtgcgcgagtgtagttgggtgatgggcaaggtgtgctgggtccagtggtgtactcattgatgcatatcagcagccagggcct

SEQ ID NO: 390205 - DNA, 140 bp, Artificial Sequence
  Synthetic
aggccctggctgctgatatggggtaggcatctacctctaccccaaccgatgaaggttggggtaaacactccggcctcttaggccattcctgttttttttttttccctgggttttttttttgaccttttgggacagcggtg

SEQ ID NO: 390206 - DNA, 140 bp, Artificial Sequence
  Synthetic
caccgctgtcccaaaaggtcaaaaaaaaaacccagggaaaaaaaaaaaacaggaatggcctaagaggccggagtgtttaccccaaccttcatcggttggggtagaggtagatgcctaccccatatcagcagccagggcct

SEQ ID NO: 390207 - DNA, 140 bp, Artificial Sequence
  Synthetic
aggccctggctgctgatatgtggcacatcaacaggactgccctgaactgcaatgactccctcaacactgggtttcttgccgcgctgttctacacacacaagttcaactcgtccggatgccgaccttttgggacagcggtg

SEQ ID NO: 390208 - DNA, 140 bp, Artificial Sequence
  Synthetic
caccgctgtcccaaaaggtcggcatccggacgagttgaacttgtgtgtgtagaacagcgcggcaagaaacccagtgttgagggagtcattgcagttcagggcagtcctgttgatgtgccacatatcagcagccagggcct

SEQ ID NO: 390209 - DNA, 140 bp, Artificial Sequence
  Synthetic
atacgccatgctgggtctccggtcccatcacctacactgagcaccgcaactcggaccagaggccttactgctggcactacgcaccccaaccatgtggtattgtacccgcggcacaggtgtcgtacttgggagtcggccat

SEQ ID NO: 390210 - DNA, 140 bp, Artificial Sequence
  Synthetic
atggccgactcccaagtacgacacctgtgccgcgggtacaataccacatggttggggtgcgtagtgccagcagtaaggcctctggtccgagttgcggtgctcagtgtaggtgatgggaccggagacccagcatggcgtat

SEQ ID NO: 390211 - DNA, 140 bp, Artificial Sequence
  Synthetic
aggccctggctgctgatatggagtctgaaacaaaggttgtgattcttgattcatttgaacccctgagagccgaaactgatgacgccgagctctcggtggctgcagagtgtttcaagaaacgaccttttgggacagcggtg

SEQ ID NO: 390212 - DNA, 140 bp, Artificial Sequence
  Synthetic
caccgctgtcccaaaaggtcgtttcttgaaacactctgcagccaccgagagctcggcgtcatcagtttcggctctcaggggttcaaatgaatcaagaatcacaacctttgtttcagactccatatcagcagccagggcct

SEQ ID NO: 390213 - DNA, 140 bp, Artificial Sequence
  Synthetic
atacgccatgctgggtctccccatggatgcgccttaccaccaaagggcgctccaccggtgcccccccctcggaggaaaagaacagttcagctggatggctctaatgtgtccgcggcgctacgtacttgggagtcggccat

SEQ ID NO: 390214 - DNA, 140 bp, Artificial Sequence
  Synthetic
atggccgactcccaagtacgtagcgccgcggacacattagagccatccagctgaactgttcttttcctccgaggggggggcaccggtggagcgccctttggtggtaaggcgcatccatggggagacccagcatggcgtat

SEQ ID NO: 390215 - DNA, 140 bp, Artificial Sequence
  Synthetic
atacgccatgctgggtctccgctgcgctagcggaaaagtcatttccgtcctcgaaactgcaggaagagaacagctcatcctcaggggtcgacacacagcccagcaccacttccaatgtgtcgtacttgggagtcggccat

SEQ ID NO: 390216 - DNA, 140 bp, Artificial Sequence
  Synthetic
atggccgactcccaagtacgacacattggaagtggtgctgggctgtgtgtcgacccctgaggatgagctgttctcttcctgcagtttcgaggacggaaatgacttttccgctagcgcagcggagacccagcatggcgtat

SEQ ID NO: 390217 - DNA, 140 bp, Artificial Sequence
  Synthetic
aggccctggctgctgatatggcgctgccagggccctggcgcatggcgtccgagttctggaagacggcgtgaactatgcaacagggaaccttcctggttgctctttctctatcttcctcctgaccttttgggacagcggtg

SEQ ID NO: 390218 - DNA, 140 bp, Artificial Sequence
  Synthetic
caccgctgtcccaaaaggtcaggaggaagatagagaaagagcaaccaggaaggttccctgttgcatagttcacgccgtcttccagaactcggacgccatgcgccagggccctggcagcgccatatcagcagccagggcct

SEQ ID NO: 390219 - DNA, 140 bp, Artificial Sequence
  Synthetic
atacgccatgctgggtctccctgatcaacaccaacggcagttggcacatcaataggacggctttgaactgcaacgaaagtcttaacaccggctgggtagcagggctcttctactatcacacgtacttgggagtcggccat

SEQ ID NO: 390220 - DNA, 140 bp, Artificial Sequence
  Synthetic
atggccgactcccaagtacgtgtgatagtagaagagccctgctacccagccggtgttaagactttcgttgcagttcaaagccgtcctattgatgtgccaactgccgttggtgttgatcagggagacccagcatggcgtat

SEQ ID NO: 390221 - DNA, 140 bp, Artificial Sequence
  Synthetic
aggccctggctgctgatatgggggcccagtgtggttatcgccgttgccgtgctagcggagttctgcctaccagcttcggcaacacaatcacttgttacatcaaggccacagcggctgcgagaccttttgggacagcggtg

SEQ ID NO: 390222 - DNA, 140 bp, Artificial Sequence
  Synthetic
caccgctgtcccaaaaggtctcgcagccgctgtggccttgatgtaacaagtgattgtgttgccgaagctggtaggcagaactccgctagcacggcaacggcgataaccacactgggcccccatatcagcagccagggcct

SEQ ID NO: 390223 - DNA, 140 bp, Artificial Sequence
  Synthetic
atacgccatgctgggtctccgcgttcacactccatagttactctccagtagagctcaatagggtcgcggggacactcaggaaacttgggtgcccccccctacgggcttggagacatcgggcgtacttgggagtcggccat

SEQ ID NO: 390224 - DNA, 140 bp, Artificial Sequence
  Synthetic
atggccgactcccaagtacgcccgatgtctccaagcccgtaggggggggcacccaagtttcctgagtgtccccgcgaccctattgagctctactggagagtaactatggagtgtgaacgcggagacccagcatggcgtat

SEQ ID NO: 390225 - DNA, 140 bp, Artificial Sequence
  Synthetic
atacgccatgctgggtctccgtgtcggcgggaacgacatttatcacagcgtgtcacgtgcccgaacccgccatttgctgctttgcctactcctactaacggtaggggtaggcatctttctcgtacttgggagtcggccat

SEQ ID NO: 390226 - DNA, 140 bp, Artificial Sequence
  Synthetic
atggccgactcccaagtacgagaaagatgcctacccctaccgttagtaggagtaggcaaagcagcaaatggcgggttcgggcacgtgacacgctgtgataaatgtcgttcccgccgacacggagacccagcatggcgtat

SEQ ID NO: 390227 - DNA, 140 bp, Artificial Sequence
  Synthetic
aggccctggctgctgatatgaatgagggctgcgggtgggcagggtggctcctgtccccgcgcggctcccgtccatcttggggcccaaatgacccccggcggaggtcccgcaatttgggtagaccttttgggacagcggtg

SEQ ID NO: 390228 - DNA, 140 bp, Artificial Sequence
  Synthetic
caccgctgtcccaaaaggtctacccaaattgcgggacctccgccgggggtcatttgggccccaagatggacgggagccgcgcggggacaggagccaccctgcccacccgcagccctcattcatatcagcagccagggcct

SEQ ID NO: 390229 - DNA, 140 bp, Artificial Sequence
  Synthetic
atacgccatgctgggtctccgactgtctaccacggagccgggccgaggaccctcgcgtcacccaagggccctgttatccagatgtataccaatgtagacaaagaccttgtgggctggtcccgtacttgggagtcggccat

SEQ ID NO: 390230 - DNA, 140 bp, Artificial Sequence
  Synthetic
atggccgactcccaagtacgggaccagcccacaaggtctttgtctacattggtatacatctggataacagggcccttgggtgacgcgagggtcctcggcccggctccgtggtagacagtcggagacccagcatggcgtat

SEQ ID NO: 390231 - DNA, 140 bp, Artificial Sequence
  Synthetic
aggccctggctgctgatatgcatcttggcgggcctagcctattactccatgcagggcaattgggccaaagttgctatcatcatggttatgttttcaggggtcgatgccgtaacatataccgaccttttgggacagcggtg

SEQ ID NO: 390232 - DNA, 140 bp, Artificial Sequence
  Synthetic
caccgctgtcccaaaaggtcggtatatgttacggcatcgacccctgaaaacataaccatgatgatagcaactttggcccaattgccctgcatggagtaataggctaggcccgccaagatgcatatcagcagccagggcct

SEQ ID NO: 390233 - DNA, 140 bp, Artificial Sequence
  Synthetic
aggccctggctgctgatatgacatcaacagcactgccctgaactgtaatgagtccataaacaccgggttcatagctgggttgttttattatcataggttcaactccactggatgccctcagaccttttgggacagcggtg

SEQ ID NO: 390234 - DNA, 140 bp, Artificial Sequence
  Synthetic
caccgctgtcccaaaaggtctgagggcatccagtggagttgaacctatgataataaaacaacccagctatgaacccggtgtttatggactcattacagttcagggcagtgctgttgatgtcatatcagcagccagggcct

SEQ ID NO: 390235 - DNA, 140 bp, Artificial Sequence
  Synthetic
atacgccatgctgggtctcccacatcaacaggactgccttgaactgtaacgactccctccagactgggttcattgcctcgctgttctacgcacacaagttcaactcgtccggatgcccagcgtacttgggagtcggccat

SEQ ID NO: 390236 - DNA, 140 bp, Artificial Sequence
  Synthetic
atggccgactcccaagtacgctgggcatccggacgagttgaacttgtgtgcgtagaacagcgaggcaatgaacccagtctggagggagtcgttacagttcaaggcagtcctgttgatgtgggagacccagcatggcgtat

SEQ ID NO: 390237 - DNA, 140 bp, Artificial Sequence
  Synthetic
aggccctggctgctgatatgttcctgctggagtccctgcggcctcccggtggtcggtggtttgggtgcacgtggatgaactccacggggtttgtcaagacgtgcggggcttccccttgtggaccttttgggacagcggtg

SEQ ID NO: 390238 - DNA, 140 bp, Artificial Sequence
  Synthetic
caccgctgtcccaaaaggtccacaaggggaagccccgcacgtcttgacaaaccccgtggagttcatccacgtgcacccaaaccaccgaccaccgggaggccgcagggactccagcaggaacatatcagcagccagggcct

SEQ ID NO: 390239 - DNA, 140 bp, Artificial Sequence
  Synthetic
aggccctggctgctgatatgtgcggggccctggttgacaccccgctgcatggtcgactatccataccggctttggcattacccatgtacagtcaatttcacattgttcaaggtgaggatggaccttttgggacagcggtg

SEQ ID NO: 390240 - DNA, 140 bp, Artificial Sequence
  Synthetic
caccgctgtcccaaaaggtccatcctcaccttgaacaatgtgaaattgactgtacatgggtaatgccaaagccggtatggatagtcgaccatgcagcggggtgtcaaccagggccccgcacatatcagcagccagggcct

SEQ ID NO: 390241 - DNA, 140 bp, Artificial Sequence
  Synthetic
aggccctggctgctgatatggggggtctcccccctccttggccagttcttcagccagccagttgtctgcgccttctttgaaggcgacatgcactacccgtcatgactccccagacgctgagaccttttgggacagcggtg

SEQ ID NO: 390242 - DNA, 140 bp, Artificial Sequence
  Synthetic
caccgctgtcccaaaaggtctcagcgtctggggagtcatgacgggtagtgcatgtcgccttcaaagaaggcgcagacaactggctggctgaagaactggccaaggaggggggagaccccccatatcagcagccagggcct

SEQ ID NO: 390243 - DNA, 140 bp, Artificial Sequence
  Synthetic
aggccctggctgctgatatgcaccacgagcatacgccatggaccgggagatggctgcatcatgcggaggcgcggttttcgtgggtctggcgctcctgaccttgtcaccgcactacaaagtgaccttttgggacagcggtg

SEQ ID NO: 390244 - DNA, 140 bp, Artificial Sequence
  Synthetic
caccgctgtcccaaaaggtcactttgtagtgcggtgacaaggtcaggagcgccagacccacgaaaaccgcgcctccgcatgatgcagccatctcccggtccatggcgtatgctcgtggtgcatatcagcagccagggcct

SEQ ID NO: 390245 - DNA, 140 bp, Artificial Sequence
  Synthetic
atacgccatgctgggtctcccgcaagtactggttcgcctttgcatgctcgtgcgctccgtgatgggggggaaatacttccagatgatcatactgagcattggcagatggttcaacacctacgtacttgggagtcggccat

SEQ ID NO: 390246 - DNA, 140 bp, Artificial Sequence
  Synthetic
atggccgactcccaagtacgtaggtgttgaaccatctgccaatgctcagtatgatcatctggaagtatttcccccccatcacggagcgcacgagcatgcaaaggcgaaccagtacttgcgggagacccagcatggcgtat

SEQ ID NO: 390247 - DNA, 140 bp, Artificial Sequence
  Synthetic
atacgccatgctgggtctccctggaggtcctgttatgtgcccttcggggcatgttgcagggatctttagggctgctgtgtgcaccagaggtgtagcaaaagccctacagttcataccagtcgtacttgggagtcggccat

SEQ ID NO: 390248 - DNA, 140 bp, Artificial Sequence
  Synthetic
atggccgactcccaagtacgactggtatgaactgtagggcttttgctacacctctggtgcacacagcagccctaaagatccctgcaacatgccccgaagggcacataacaggacctccagggagacccagcatggcgtat

SEQ ID NO: 390249 - DNA, 140 bp, Artificial Sequence
  Synthetic
atacgccatgctgggtctccgctctttcatgtcgcgtgcctatgggatcgaccccaacatccgcactgggaaccgcaccgttacaactggtgccaaactgacctattccacctacggtaacgtacttgggagtcggccat

SEQ ID NO: 390250 - DNA, 140 bp, Artificial Sequence
  Synthetic
atggccgactcccaagtacgttaccgtaggtggaataggtcagtttggcaccagttgtaacggtgcggttcccagtgcggatgttggggtcgatcccataggcacgcgacatgaaagagcggagacccagcatggcgtat

SEQ ID NO: 390251 - DNA, 140 bp, Artificial Sequence
  Synthetic
aggccctggctgctgatatgggttgtccgcttccacctccacagtctcctcccgtgcctccgccccggaagaagcggacggtggtcctcaccgaatcaaaactatctatcgccttggccggaccttttgggacagcggtg

SEQ ID NO: 390252 - DNA, 140 bp, Artificial Sequence
  Synthetic
caccgctgtcccaaaaggtccggccaaggcgatagatagttttgattcggtgaggaccaccgtccgcttcttccggggcggaggcacgggaggagactgtggaggtggaagcggacaacccatatcagcagccagggcct

SEQ ID NO: 390253 - DNA, 140 bp, Artificial Sequence
  Synthetic
atacgccatgctgggtctccggctgccacctgtggcaggtacctcttcaactgggcagtaagaaccaagctcaaactcactccaatctcagctgcgtcccagttggacttgtctggctggcgtacttgggagtcggccat

SEQ ID NO: 390254 - DNA, 140 bp, Artificial Sequence
  Synthetic
atggccgactcccaagtacgccagccagacaagtccaactgggacgcagctgagattggagtgagtttgagcttggttcttactgcccagttgaagaggtacctgccacaggtggcagccggagacccagcatggcgtat

SEQ ID NO: 390255 - DNA, 140 bp, Artificial Sequence
  Synthetic
atacgccatgctgggtctcccatgtcagctgatctggaagtaaccaccagcacctgggtgttgcttggaggggtccttgcggccctagcggcctactgcttgtcagtcggctgcgttgtgcgtacttgggagtcggccat

SEQ ID NO: 390256 - DNA, 140 bp, Artificial Sequence
  Synthetic
atggccgactcccaagtacgcacaacgcagccgactgacaagcagtaggccgctagggccgcaaggacccctccaagcaacacccaggtgctggtggttacttccagatcagctgacatgggagacccagcatggcgtat

SEQ ID NO: 390257 - DNA, 140 bp, Artificial Sequence
  Synthetic
aggccctggctgctgatatggtgggggatctctgcggatctgttttcctcgtctcccagttattcaccttttcgccccgccgacataagacggtgcaggaatgcaattgttccatatatcgaccttttgggacagcggtg

SEQ ID NO: 390258 - DNA, 140 bp, Artificial Sequence
  Synthetic
caccgctgtcccaaaaggtcgatatatggaacaattgcattcctgcaccgtcttatgtcggcggggcgaaaaggtgaataactgggagacgaggaaaacagatccgcagagatcccccaccatatcagcagccagggcct

SEQ ID NO: 390259 - DNA, 140 bp, Artificial Sequence
  Synthetic
aggccctggctgctgatatggcttgacatcctggcaggatatggagctggtgtctcaggcgccttggtggcttttaagatcatgggaggagaactccccaccgctgaggacatggtcaacgaccttttgggacagcggtg

SEQ ID NO: 390260 - DNA, 140 bp, Artificial Sequence
  Synthetic
caccgctgtcccaaaaggtcgttgaccatgtcctcagcggtggggagttctcctcccatgatcttaaaagccaccaaggcgcctgagacaccagctccatatcctgccaggatgtcaagccatatcagcagccagggcct

SEQ ID NO: 390261 - DNA, 140 bp, Artificial Sequence
  Synthetic
aggccctggctgctgatatgtgtcgtggacatggtggcgggggctcactggggagtcctagcgggccttgcctactattccatgatagggaactgggctaaggttttgattgtgttgctagaccttttgggacagcggtg

SEQ ID NO: 390262 - DNA, 140 bp, Artificial Sequence
  Synthetic
caccgctgtcccaaaaggtctagcaacacaatcaaaaccttagcccagttccctatcatggaatagtaggcaaggcccgctaggactccccagtgagcccccgccaccatgtccacgacacatatcagcagccagggcct

SEQ ID NO: 390263 - DNA, 140 bp, Artificial Sequence
  Synthetic
aggccctggctgctgatatgggatgaacaggctcatcgcattcgcatcccggggcaaccacgtttcaccaacgcactatgttcccgagagcgatgctgcagcgagggtcaccgcattgctgaccttttgggacagcggtg

SEQ ID NO: 390264 - DNA, 140 bp, Artificial Sequence
  Synthetic
caccgctgtcccaaaaggtcagcaatgcggtgaccctcgctgcagcatcgctctcgggaacatagtgcgttggtgaaacgtggttgccccgggatgcgaatgcgatgagcctgttcatcccatatcagcagccagggcct

SEQ ID NO: 390265 - DNA, 140 bp, Artificial Sequence
  Synthetic
atacgccatgctgggtctccacgcactatgttcccgagagcgatgctgcagcgagggtcaccgcattgctgagttctctaactgtcacaagcctgctccggcggttacaccagtggatcacgtacttgggagtcggccat

SEQ ID NO: 390266 - DNA, 140 bp, Artificial Sequence
  Synthetic
atggccgactcccaagtacgtgatccactggtgtaaccgccggagcaggcttgtgacagttagagaactcagcaatgcggtgaccctcgctgcagcatcgctctcgggaacatagtgcgtggagacccagcatggcgtat

SEQ ID NO: 390267 - DNA, 140 bp, Artificial Sequence
  Synthetic
atacgccatgctgggtctccagaatatccagcttgtaaacaggaacggcagctggcatatcaacaggactgccctgaactgtaatgaatccctccagactgggtgggttgccgcgctgttcgtacttgggagtcggccat

SEQ ID NO: 390268 - DNA, 140 bp, Artificial Sequence
  Synthetic
atggccgactcccaagtacgaacagcgcggcaacccacccagtctggagggattcattacagttcagggcagtcctgttgatatgccagctgccgttcctgtttacaagctggatattctggagacccagcatggcgtat

SEQ ID NO: 390269 - DNA, 140 bp, Artificial Sequence
  Synthetic
aggccctggctgctgatatggattatgccagcgctccccgggctgcccttcatttcctgtcaaaagggatacaagggcgtgtggcggggggacggcgtgatgtcgacacgctgtccttgcgaccttttgggacagcggtg

SEQ ID NO: 390270 - DNA, 140 bp, Artificial Sequence
  Synthetic
caccgctgtcccaaaaggtcgcaaggacagcgtgtcgacatcacgccgtccccccgccacacgcccttgtatcccttttgacaggaaatgaagggcagcccggggagcgctggcataatccatatcagcagccagggcct

SEQ ID NO: 390271 - DNA, 140 bp, Artificial Sequence
  Synthetic
atacgccatgctgggtctccaggccaacccgcttggaccagaggccctactgttggcactacgctccgcaaccgtgtggtatcgtacccgcggcggaggtgtgtggtccggtgtattgctcgtacttgggagtcggccat

SEQ ID NO: 390272 - DNA, 140 bp, Artificial Sequence
  Synthetic
atggccgactcccaagtacgagcaatacaccggaccacacacctccgccgcgggtacgataccacacggttgcggagcgtagtgccaacagtagggcctctggtccaagcgggttggcctggagacccagcatggcgtat

SEQ ID NO: 390273 - DNA, 140 bp, Artificial Sequence
  Synthetic
atacgccatgctgggtctccggggcaacaataaccggtcatgtgaagaatgggtccatgcggcttgcagggccgcgtacatgtgctaacatgtggcacggtactttccccatcaatgagtcgtacttgggagtcggccat

SEQ ID NO: 390274 - DNA, 140 bp, Artificial Sequence
  Synthetic
atggccgactcccaagtacgactcattgatggggaaagtaccgtgccacatgttagcacatgtacgcggccctgcaagccgcatggacccattcttcacatgaccggttattgttgccccggagacccagcatggcgtat

SEQ ID NO: 390275 - DNA, 140 bp, Artificial Sequence
  Synthetic
aggccctggctgctgatatgtggtacatcaagggcaggctagtccctggggcggcatacgctttctacggcgtatggccgttgttcctgctcctgctggcgttgccaccacgggcatacggaccttttgggacagcggtg

SEQ ID NO: 390276 - DNA, 140 bp, Artificial Sequence
  Synthetic
caccgctgtcccaaaaggtccgtatgcccgtggtggcaacgccagcaggagcaggaacaacggccatacgccgtagaaagcgtatgccgccccagggactagcctgcccttgatgtaccacatatcagcagccagggcct

SEQ ID NO: 390277 - DNA, 140 bp, Artificial Sequence
  Synthetic
atacgccatgctgggtctccctggggtcgacacacagtccagcactacttccaaggtgcccccctccccgggaggggagtccgactcagagtcatgctcatccatgcctcctctcgagggcgtacttgggagtcggccat

SEQ ID NO: 390278 - DNA, 140 bp, Artificial Sequence
  Synthetic
atggccgactcccaagtacgccctcgagaggaggcatggatgagcatgactctgagtcggactcccctcccggggaggggggcaccttggaagtagtgctggactgtgtgtcgaccccagggagacccagcatggcgtat

SEQ ID NO: 390279 - DNA, 140 bp, Artificial Sequence
  Synthetic
atacgccatgctgggtctccagaaccgggcgatccggacttgagttgcgactcttggtccaccgttagtgacagcgaggagcagagcgtggtctgctgctctatgtcgtactcttggacccgtacttgggagtcggccat

SEQ ID NO: 390280 - DNA, 140 bp, Artificial Sequence
  Synthetic
atggccgactcccaagtacgggtccaagagtacgacatagagcagcagaccacgctctgctcctcgctgtcactaacggtggaccaagagtcgcaactcaagtccggatcgcccggttctggagacccagcatggcgtat

SEQ ID NO: 390281 - DNA, 140 bp, Artificial Sequence
  Synthetic
aggccctggctgctgatatgcgtgcggcttcgccgacctcatggggtacataccgcttgtcggcgcccctcttggaggcgctgccagggccctggcgcatggcgtccgggttctggaagagaccttttgggacagcggtg

SEQ ID NO: 390282 - DNA, 140 bp, Artificial Sequence
  Synthetic
caccgctgtcccaaaaggtctcttccagaacccggacgccatgcgccagggccctggcagcgcctccaagaggggcgccgacaagcggtatgtaccccatgaggtcggcgaagccgcacgcatatcagcagccagggcct

SEQ ID NO: 390283 - DNA, 140 bp, Artificial Sequence
  Synthetic
aggccctggctgctgatatggccttaacaccggctggatagcagggcttctctactaccacaaattcaactcttcaggctgtgccgagaggttggccagctgccgaccccttaccgatttgaccttttgggacagcggtg

SEQ ID NO: 390284 - DNA, 140 bp, Artificial Sequence
  Synthetic
caccgctgtcccaaaaggtcaaatcggtaaggggtcggcagctggccaacctctcggcacagcctgaagagttgaatttgtggtagtagagaagccctgctatccagccggtgttaaggccatatcagcagccagggcct

SEQ ID NO: 390285 - DNA, 140 bp, Artificial Sequence
  Synthetic
atacgccatgctgggtctccagcgtctagggtaaaggctcgcatgctcaccatcgaggaagcgtgcgcgctcgtccctcctcactctgcccggtcgaaattcgggtatagtgcgaaggaccgtacttgggagtcggccat

SEQ ID NO: 390286 - DNA, 140 bp, Artificial Sequence
  Synthetic
atggccgactcccaagtacggtccttcgcactatacccgaatttcgaccgggcagagtgaggagggacgagcgcgcacgcttcctcgatggtgagcatgcgagcctttaccctagacgctggagacccagcatggcgtat

SEQ ID NO: 390287 - DNA, 140 bp, Artificial Sequence
  Synthetic
aggccctggctgctgatatgcatcatcactagcctcacaggccgggacaagaaccaggtcgagggggaggttcaagtggtttccaccgcaacgcaatctttcctggcgacctgcgtcaacgaccttttgggacagcggtg

SEQ ID NO: 390288 - DNA, 140 bp, Artificial Sequence
  Synthetic
caccgctgtcccaaaaggtcgttgacgcaggtcgccaggaaagattgcgttgcggtggaaaccacttgaacctccccctcgacctggttcttgtcccggcctgtgaggctagtgatgatgcatatcagcagccagggcct

SEQ ID NO: 390289 - DNA, 140 bp, Artificial Sequence
  Synthetic
atacgccatgctgggtctcctttttttttttttttttttcccccccccttttttttttttttttttgggcgccgggggccccccccccccccccccttttgggggggggggggtttttggcgtacttgggagtcggccat

SEQ ID NO: 390290 - DNA, 140 bp, Artificial Sequence
  Synthetic
atggccgactcccaagtacgccaaaaacccccccccccccaaaaggggggggggggggggggcccccggcgcccaaaaaaaaaaaaaaaaaagggggggggaaaaaaaaaaaaaaaaaaaggagacccagcatggcgtat

SEQ ID NO: 390291 - DNA, 140 bp, Artificial Sequence
  Synthetic
aggccctggctgctgatatgtggtgaccgtcgttgccgtgccagtggagttttgcctaccagctttggcaatacaatcacttgttacatcaaagccacagcggctgcgaacggcgcaggcgaccttttgggacagcggtg

SEQ ID NO: 390292 - DNA, 140 bp, Artificial Sequence
  Synthetic
caccgctgtcccaaaaggtcgcctgcgccgttcgcagccgctgtggctttgatgtaacaagtgattgtattgccaaagctggtaggcaaaactccactggcacggcaacgacggtcaccacatatcagcagccagggcct

SEQ ID NO: 390293 - DNA, 140 bp, Artificial Sequence
  Synthetic
atacgccatgctgggtctcccatccaactcgtcaactccaatggcagctggcacgtcaatagtacggccttgaactgtaacaccagcctcgacaccggctggttggcgggcctcttctaccgtacttgggagtcggccat

SEQ ID NO: 390294 - DNA, 140 bp, Artificial Sequence
  Synthetic
atggccgactcccaagtacggtagaagaggcccgccaaccagccggtgtcgaggctggtgttacagttcaaggccgtactattgacgtgccagctgccattggagttgacgagttggatgggagacccagcatggcgtat

SEQ ID NO: 390295 - DNA, 140 bp, Artificial Sequence
  Synthetic
atacgccatgctgggtctccccctagcccgtgcggcttgggaaacagctcgtcacactccagttaactcctggttaggtaacatcatcatgtacgcgcctaccatctgggtgcgcatggtcgtacttgggagtcggccat

SEQ ID NO: 390296 - DNA, 140 bp, Artificial Sequence
  Synthetic
atggccgactcccaagtacgaccatgcgcacccagatggtaggcgcgtacatgatgatgttacctaaccaggagttaactggagtgtgacgagctgtttcccaagccgcacgggctagggggagacccagcatggcgtat

SEQ ID NO: 390297 - DNA, 140 bp, Artificial Sequence
  Synthetic
aggccctggctgctgatatgacaactggggtgagaatgatacggacgtcttcgtccttaacaacaccaggccaccgctgggcaattggttcggttgcacctggatgaactcaactggatagaccttttgggacagcggtg

SEQ ID NO: 390298 - DNA, 140 bp, Artificial Sequence
  Synthetic
caccgctgtcccaaaaggtctatccagttgagttcatccaggtgcaaccgaaccaattgcccagcggtggcctggtgttgttaaggacgaagacgtccgtatcattctcaccccagttgtcatatcagcagccagggcct

SEQ ID NO: 390299 - DNA, 140 bp, Artificial Sequence
  Synthetic
aggccctggctgctgatatgatcttggggatcggcacagtcctggaccaagcggagacggctggagcgcggctcgtcgtgctcgccaccgccacacctccaggatcggtcaccgtgccacgaccttttgggacagcggtg

SEQ ID NO: 390300 - DNA, 140 bp, Artificial Sequence
  Synthetic
caccgctgtcccaaaaggtcgtggcacggtgaccgatcctggaggtgtggcggtggcgagcacgacgagccgcgctccagccgtctccgcttggtccaggactgtgccgatccccaagatcatatcagcagccagggcct

SEQ ID NO: 390301 - DNA, 140 bp, Artificial Sequence
  Synthetic
atacgccatgctgggtctccgctcgtcgtgctcgccaccgccacacctccaggatcggtcaccgtgccacaccccaatatccaggaggtgggcctgtctaccactggagaaatccccttccgtacttgggagtcggccat

SEQ ID NO: 390302 - DNA, 140 bp, Artificial Sequence
  Synthetic
atggccgactcccaagtacggaaggggatttctccagtggtagacaggcccacctcctggatattggggtgtggcacggtgaccgatcctggaggtgtggcggtggcgagcacgacgagcggagacccagcatggcgtat

SEQ ID NO: 390303 - DNA, 140 bp, Artificial Sequence
  Synthetic
atacgccatgctgggtctcctactcccggtgtggctctggtccctggcttacacccaggtgcatggtccactacccttatagactttggcattatccttgtaccatcaattacaccatatcgtacttgggagtcggccat

SEQ ID NO: 390304 - DNA, 140 bp, Artificial Sequence
  Synthetic
atggccgactcccaagtacgatatggtgtaattgatggtacaaggataatgccaaagtctataagggtagtggaccatgcacctgggtgtaagccagggaccagagccacaccgggagtaggagacccagcatggcgtat

SEQ ID NO: 390305 - DNA, 140 bp, Artificial Sequence
  Synthetic
aggccctggctgctgatatgaacatggtctacgcaacaacatcccgcagcgcaagccagcggcagaagaaggtcacctttgacagactgcaagtcctggacgatcactaccaggacgtgcgaccttttgggacagcggtg

SEQ ID NO: 390306 - DNA, 140 bp, Artificial Sequence
  Synthetic
caccgctgtcccaaaaggtcgcacgtcctggtagtgatcgtccaggacttgcagtctgtcaaaggtgaccttcttctgccgctggcttgcgctgcgggatgttgttgcgtagaccatgttcatatcagcagccagggcct

SEQ ID NO: 390307 - DNA, 140 bp, Artificial Sequence
  Synthetic
aggccctggctgctgatatggtgcccgaacccgctatttgctgctttgcctactcctactaacggtaggggtaggcatctttctcctgccagctcggtgagctggtaagataacactccagaccttttgggacagcggtg

SEQ ID NO: 390308 - DNA, 140 bp, Artificial Sequence
  Synthetic
caccgctgtcccaaaaggtctggagtgttatcttaccagctcaccgagctggcaggagaaagatgcctacccctaccgttagtaggagtaggcaaagcagcaaatagcgggttcgggcaccatatcagcagccagggcct

SEQ ID NO: 390309 - DNA, 140 bp, Artificial Sequence
  Synthetic
aggccctggctgctgatatgagatctggccgtggctgtagagccagtcgtcttctccccaatggagaccaagctcatcacgtggggggcagacaccgccgcgtgcggtgacatcatcaacgaccttttgggacagcggtg

SEQ ID NO: 390310 - DNA, 140 bp, Artificial Sequence
  Synthetic
caccgctgtcccaaaaggtcgttgatgatgtcaccgcacgcggcggtgtctgccccccacgtgatgagcttggtctccattggggagaagacgactggctctacagccacggccagatctcatatcagcagccagggcct

SEQ ID NO: 390311 - DNA, 140 bp, Artificial Sequence
  Synthetic
aggccctggctgctgatatgggttccccccctcaacgtccgaggggggcgcgacgctgtcatcttactcatgtgtgttgtacacccgaccttggtattcgacatcaccaagctgctgctggaccttttgggacagcggtg

SEQ ID NO: 390312 - DNA, 140 bp, Artificial Sequence
  Synthetic
caccgctgtcccaaaaggtccagcagcagcttggtgatgtcgaataccaaggtcgggtgtacaacacacatgagtaagatgacagcgtcgcgcccccctcggacgttgagggggggaacccatatcagcagccagggcct

SEQ ID NO: 390313 - DNA, 140 bp, Artificial Sequence
  Synthetic
atacgccatgctgggtctccaaatggccggaggccattacgcgcaaatggtcatcatcaagataggggcacttactggcacctatgtttataaccatctcactccccttaagaactgggccgtacttgggagtcggccat

SEQ ID NO: 390314 - DNA, 140 bp, Artificial Sequence
  Synthetic
atggccgactcccaagtacggcccagttcttaaggggagtgagatggttataaacataggtgccagtaagtgcccctatcttgatgatgaccatttgcgcgtaatggcctccggccatttggagacccagcatggcgtat

SEQ ID NO: 390315 - DNA, 140 bp, Artificial Sequence
  Synthetic
aggccctggctgctgatatgccttctgggcgaagcacatgtggaatttcatcagcgggatacagtacttagcaggcttatccactctgcctgggaaccccgcaatagcatcactgatggcgaccttttgggacagcggtg

SEQ ID NO: 390316 - DNA, 140 bp, Artificial Sequence
  Synthetic
caccgctgtcccaaaaggtcgccatcagtgatgctattgcggggttcccaggcagagtggataagcctgctaagtactgtatcccgctgatgaaattccacatgtgcttcgcccagaaggcatatcagcagccagggcct

SEQ ID NO: 390317 - DNA, 140 bp, Artificial Sequence
  Synthetic
atacgccatgctgggtctccggacaagccttcacgttcagacctcgtcgccatcggacggtccagacctgtaactgctcgctgtacccaggccatctttcaggacagcgaatggcttgggcgtacttgggagtcggccat

SEQ ID NO: 390318 - DNA, 140 bp, Artificial Sequence
  Synthetic
atggccgactcccaagtacgcccaagccattcgctgtcctgaaagatggcctgggtacagcgagcagttacaggtctggaccgtccgatggcgacgaggtctgaacgtgaaggcttgtccggagacccagcatggcgtat

SEQ ID NO: 390319 - DNA, 140 bp, Artificial Sequence
  Synthetic
aggccctggctgctgatatgacaccaatggcagctggcacatcaacaggactgccttgaactgcaacgactccctcaatactgggttccttgccgcgctgttctacacacgcaatttcaagaccttttgggacagcggtg

SEQ ID NO: 390320 - DNA, 140 bp, Artificial Sequence
  Synthetic
caccgctgtcccaaaaggtcttgaaattgcgtgtgtagaacagcgcggcaaggaacccagtattgagggagtcgttgcagttcaaggcagtcctgttgatgtgccagctgccattggtgtcatatcagcagccagggcct

SEQ ID NO: 390321 - DNA, 140 bp, Artificial Sequence
  Synthetic
aggccctggctgctgatatgtccctcaatactgggttccttgccgcgctgttctacacacgcaatttcaactcgtccggatgcccggaacgcatggccagctgccgccccatcgatgagtgaccttttgggacagcggtg

SEQ ID NO: 390322 - DNA, 140 bp, Artificial Sequence
  Synthetic
caccgctgtcccaaaaggtcactcatcgatggggcggcagctggccatgcgttccgggcatccggacgagttgaaattgcgtgtgtagaacagcgcggcaaggaacccagtattgagggacatatcagcagccagggcct

SEQ ID NO: 390323 - DNA, 140 bp, Artificial Sequence
  Synthetic
aggccctggctgctgatatgcatcattgcgggcctagcctattactccatgcagggcaactgggccaaggtcgctatcatcatggttatgttttcaggggttgatgccagcacacacgtcgaccttttgggacagcggtg

SEQ ID NO: 390324 - DNA, 140 bp, Artificial Sequence
  Synthetic
caccgctgtcccaaaaggtcgacgtgtgtgctggcatcaacccctgaaaacataaccatgatgatagcgaccttggcccagttgccctgcatggagtaataggctaggcccgcaatgatgcatatcagcagccagggcct

SEQ ID NO: 390325 - DNA, 140 bp, Artificial Sequence
  Synthetic
atacgccatgctgggtctccgggcgtcaatgccgtggcttactaccgcggtcttgatgtgtccgtcatcccgaccagcggcgatgttgtcgtcgtggcaactgatgctctcatgaccggccgtacttgggagtcggccat

SEQ ID NO: 390326 - DNA, 140 bp, Artificial Sequence
  Synthetic
atggccgactcccaagtacggccggtcatgagagcatcagttgccacgacgacaacatcgccgctggtcgggatgacggacacatcaagaccgcggtagtaagccacggcattgacgcccggagacccagcatggcgtat

SEQ ID NO: 390327 - DNA, 140 bp, Artificial Sequence
  Synthetic
atacgccatgctgggtctccttcccgcccgtagacggggcgacactcgcgcctccttgctcagcccgagacccatcagttacctcaagggttcctcgggtggcccgatcatgtgcccttccgtacttgggagtcggccat

SEQ ID NO: 390328 - DNA, 140 bp, Artificial Sequence
  Synthetic
atggccgactcccaagtacggaagggcacatgatcgggccacccgaggaacccttgaggtaactgatgggtctcgggctgagcaaggaggcgcgagtgtcgccccgtctacgggcgggaaggagacccagcatggcgtat

SEQ ID NO: 390329 - DNA, 140 bp, Artificial Sequence
  Synthetic
aggccctggctgctgatatgtgcttcattcaacaactgagcttgctatactgccttgctctttcacgcccatgcctgcattgtcaacaggtctaatacacctccaccaaaacatcgtggagaccttttgggacagcggtg

SEQ ID NO: 390330 - DNA, 140 bp, Artificial Sequence
  Synthetic
caccgctgtcccaaaaggtctccacgatgttttggtggaggtgtattagacctgttgacaatgcaggcatgggcgtgaaagagcaaggcagtatagcaagctcagttgttgaatgaagcacatatcagcagccagggcct

SEQ ID NO: 390331 - DNA, 140 bp, Artificial Sequence
  Synthetic
atacgccatgctgggtctcctgcgttgctctttggctgatcctgacgatatcacaagcagaagcggccttggagaaccttgtcacgctgaacgccgtcgctgctgccgggacacacggcacgtacttgggagtcggccat

SEQ ID NO: 390332 - DNA, 140 bp, Artificial Sequence
  Synthetic
atggccgactcccaagtacgtgccgtgtgtcccggcagcagcgacggcgttcagcgtgacaaggttctccaaggccgcttctgcttgtgatatcgtcaggatcagccaaagagcaacgcaggagacccagcatggcgtat

SEQ ID NO: 390333 - DNA, 140 bp, Artificial Sequence
  Synthetic
aggccctggctgctgatatgccgcggacagcggcacggcgaccgcccctcctgaccaggcctccaacgacggcgacgcaggatctgacgttgagtcgtactcctccatgcccccccttgagaccttttgggacagcggtg

SEQ ID NO: 390334 - DNA, 140 bp, Artificial Sequence
  Synthetic
caccgctgtcccaaaaggtctcaagggggggcatggaggagtacgactcaacgtcagatcctgcgtcgccgtcgttggaggcctggtcaggaggggcggtcgccgtgccgctgtccgcggcatatcagcagccagggcct

SEQ ID NO: 390335 - DNA, 140 bp, Artificial Sequence
  Synthetic
aggccctggctgctgatatggggagagccgggggaccccgatctcagcgacgggtcttggtctaccgtgagcgaagaggctggtgaggacgtcgtctgctgctcgatgtcctacacatgggaccttttgggacagcggtg

SEQ ID NO: 390336 - DNA, 140 bp, Artificial Sequence
  Synthetic
caccgctgtcccaaaaggtcccatgtgtaggacatcgagcagcagacgacgtcctcaccagcctcttcgctcacggtagaccaagacccgtcgctgagatcggggtcccccggctctccccatatcagcagccagggcct

SEQ ID NO: 390337 - DNA, 140 bp, Artificial Sequence
  Synthetic
aggccctggctgctgatatgcgtttatgaccaccttactccactgcaggactgggcccacgcgggcctacgagaccttgcggtggcagttgagcccgtcgtcttctctgacatggagaccgaccttttgggacagcggtg

SEQ ID NO: 390338 - DNA, 140 bp, Artificial Sequence
  Synthetic
caccgctgtcccaaaaggtcggtctccatgtcagagaagacgacgggctcaactgccaccgcaaggtctcgtaggcccgcgtgggcccagtcctgcagtggagtaaggtggtcataaacgcatatcagcagccagggcct

SEQ ID NO: 390339 - DNA, 140 bp, Artificial Sequence
  Synthetic
aggccctggctgctgatatgctgcaagtcctggacgatcactaccgggacgtgctcaaggagatgaaggcgaaggcgtccacagttaaggccaaacttctatccgtagaagaagcctgcagaccttttgggacagcggtg

SEQ ID NO: 390340 - DNA, 140 bp, Artificial Sequence
  Synthetic
caccgctgtcccaaaaggtctgcaggcttcttctacggatagaagtttggccttaactgtggacgccttcgccttcatctccttgagcacgtcccggtagtgatcgtccaggacttgcagcatatcagcagccagggcct

SEQ ID NO: 390341 - DNA, 140 bp, Artificial Sequence
  Synthetic
atacgccatgctgggtctcccgcatgtactggtccgcctttgcatgcttgtgcgctccgtgatggggggaaaatacttccagatgatcatactgagcctggcagatggttcaaacacctacgtacttgggagtcggccat

SEQ ID NO: 390342 - DNA, 140 bp, Artificial Sequence
  Synthetic
atggccgactcccaagtacgtaggtgtttgaaccatctgccaggctcagtatgatcatctggaagtattttccccccatcacggagcgcacaagcatgcaaaggcggaccagtacatgcgggagacccagcatggcgtat

SEQ ID NO: 390343 - DNA, 140 bp, Artificial Sequence
  Synthetic
aggccctggctgctgatatgccaaatgtacaccaatgtagaccaggacctcgtcggctggcaggcgccccccggggcgcgttccctgacaccgtgcacctgcggcagctcggacctttacgaccttttgggacagcggtg

SEQ ID NO: 390344 - DNA, 140 bp, Artificial Sequence
  Synthetic
caccgctgtcccaaaaggtcgtaaaggtccgagctgccgcaggtgcacggtgtcagggaacgcgccccggggggcgcctgccagccgacgaggtcctggtctacattggtgtacatttggcatatcagcagccagggcct

SEQ ID NO: 390345 - DNA, 140 bp, Artificial Sequence
  Synthetic
atacgccatgctgggtctcctcacctgtgttcactgacaacagtacgccccctgcagtccctcatgagttccaagtggggcacctccatgcacccaccggaagcgggaagagcacaaaggcgtacttgggagtcggccat

SEQ ID NO: 390346 - DNA, 140 bp, Artificial Sequence
  Synthetic
atggccgactcccaagtacgcctttgtgctcttcccgcttccggtgggtgcatggaggtgccccacttggaactcatgagggactgcagggggcgtactgttgtcagtgaacacaggtgaggagacccagcatggcgtat

SEQ ID NO: 390347 - DNA, 140 bp, Artificial Sequence
  Synthetic
aggccctggctgctgatatgcatacggattccagtactctcctggacagcgggtcgagttcctggtgaatgcctggaaatcaaagaaatgccctatgggcttcgcatatgacacccgctggaccttttgggacagcggtg

SEQ ID NO: 390348 - DNA, 140 bp, Artificial Sequence
  Synthetic
caccgctgtcccaaaaggtccagcgggtgtcatatgcgaagcccatagggcatttctttgatttccaggcattcaccaggaactcgacccgctgtccaggagagtactggaatccgtatgcatatcagcagccagggcct

SEQ ID NO: 390349 - DNA, 140 bp, Artificial Sequence
  Synthetic
atacgccatgctgggtctcctggcagggataagaacgtggtggccggtgaagtgcaggtgctttctacggctacccagaccttcctaggtacaacagtagggggggttatgtggactgttcgtacttgggagtcggccat

SEQ ID NO: 390350 - DNA, 140 bp, Artificial Sequence
  Synthetic
atggccgactcccaagtacgaacagtccacataaccccccctactgttgtacctaggaaggtctgggtagccgtagaaagcacctgcacttcaccggccaccacgttcttatccctgccaggagacccagcatggcgtat

SEQ ID NO: 390351 - DNA, 140 bp, Artificial Sequence
  Synthetic
aggccctggctgctgatatgaccggcagcggtaagagcacaaaggtcccggccgcttatgtagcacaaggatataatgttctcgtgttgaatccatcggtggcggccacactaggcttcggaccttttgggacagcggtg

SEQ ID NO: 390352 - DNA, 140 bp, Artificial Sequence
  Synthetic
caccgctgtcccaaaaggtccgaagcctagtgtggccgccaccgatggattcaacacgagaacattatatccttgtgctacataagcggccgggacctttgtgctcttaccgctgccggtcatatcagcagccagggcct

SEQ ID NO: 390353 - DNA, 140 bp, Artificial Sequence
  Synthetic
aggccctggctgctgatatgtcgttctctgtgagtgctatgacgcaggctgctcgtggtacgacctgcagcccgctgagaccacagtcagactgagagcttacctgtccacgccggggttgaccttttgggacagcggtg

SEQ ID NO: 390354 - DNA, 140 bp, Artificial Sequence
  Synthetic
caccgctgtcccaaaaggtcaaccccggcgtggacaggtaagctctcagtctgactgtggtctcagcgggctgcaggtcgtaccacgagcagcctgcgtcatagcactcacagagaacgacatatcagcagccagggcct

SEQ ID NO: 390355 - DNA, 140 bp, Artificial Sequence
  Synthetic
atacgccatgctgggtctccgcccatatatcgagcaagctcaggtaatagcccaccagttcaaggaaaaagtccttggattgctgcagcgagccacccaacaacaagctgtcattgagcccgtacttgggagtcggccat

SEQ ID NO: 390356 - DNA, 140 bp, Artificial Sequence
  Synthetic
atggccgactcccaagtacgggctcaatgacagcttgttgttgggtggctcgctgcagcaatccaaggactttttccttgaactggtgggctattacctgagcttgctcgatatatgggcggagacccagcatggcgtat

SEQ ID NO: 390357 - DNA, 140 bp, Artificial Sequence
  Synthetic
aggccctggctgctgatatgggatgaaccggctgatagcgttcgcctcacggggtaaccacgtctcccccacgcactatgtgcctgagagcgacgctgcagcgcgtgtcactcagatcctgaccttttgggacagcggtg

SEQ ID NO: 390358 - DNA, 140 bp, Artificial Sequence
  Synthetic
caccgctgtcccaaaaggtcaggatctgagtgacacgcgctgcagcgtcgctctcaggcacatagtgcgtgggggagacgtggttaccccgtgaggcgaacgctatcagccggttcatcccatatcagcagccagggcct

SEQ ID NO: 390359 - DNA, 140 bp, Artificial Sequence
  Synthetic
aggccctggctgctgatatggcgggggcccactggggagtcctagcgggtcttgcctactactccatggtggggaactgggctaaggtcttgattgtgatgctactttttgccggcgttggaccttttgggacagcggtg

SEQ ID NO: 390360 - DNA, 140 bp, Artificial Sequence
  Synthetic
caccgctgtcccaaaaggtccaacgccggcaaaaagtagcatcacaatcaagaccttagcccagttccccaccatggagtagtaggcaagacccgctaggactccccagtgggcccccgccatatcagcagccagggcct

SEQ ID NO: 390361 - DNA, 140 bp, Artificial Sequence
  Synthetic
aggccctggctgctgatatgacaagggagtctggcggggggacggcatcatgcataccacctgcccatgtggagcacaaatcaccggacatgtcaaaaacggttccatgaggatcgttgggaccttttgggacagcggtg

SEQ ID NO: 390362 - DNA, 140 bp, Artificial Sequence
  Synthetic
caccgctgtcccaaaaggtcccaacgatcctcatggaaccgtttttgacatgtccggtgatttgtgctccacatgggcaggtggtatgcatgatgccgtccccccgccagactcccttgtcatatcagcagccagggcct

SEQ ID NO: 390363 - DNA, 140 bp, Artificial Sequence
  Synthetic
atacgccatgctgggtctccgactgggtttgctcggtggtgtccgacttcaaaacatggctctccgctaagattatgccagcgctccctgggctgcccttcatttcctgtcagaagggatcgtacttgggagtcggccat

SEQ ID NO: 390364 - DNA, 140 bp, Artificial Sequence
  Synthetic
atggccgactcccaagtacgatcccttctgacaggaaatgaagggcagcccagggagcgctggcataatcttagcggagagccatgttttgaagtcggacaccaccgagcaaacccagtcggagacccagcatggcgtat

SEQ ID NO: 390365 - DNA, 140 bp, Artificial Sequence
  Synthetic
aggccctggctgctgatatgtggttcggctgtacatggatgaatagcactgggttcaccaagacgtgtgggggccccccgtgtaacatcgggggggtcggcaacaacaccctgacctgccgaccttttgggacagcggtg

SEQ ID NO: 390366 - DNA, 140 bp, Artificial Sequence
  Synthetic
caccgctgtcccaaaaggtcggcaggtcagggtgttgttgccgacccccccgatgttacacggggggcccccacacgtcttggtgaacccagtgctattcatccatgtacagccgaaccacatatcagcagccagggcct

SEQ ID NO: 390367 - DNA, 140 bp, Artificial Sequence
  Synthetic
aggccctggctgctgatatgtcggggccctggttgacacctaggtgcatagttgactatccatacaggctttggcactacccctgcactgtcaactttaccatctttaaggttaggatgtgaccttttgggacagcggtg

SEQ ID NO: 390368 - DNA, 140 bp, Artificial Sequence
  Synthetic
caccgctgtcccaaaaggtcacatcctaaccttaaagatggtaaagttgacagtgcaggggtagtgccaaagcctgtatggatagtcaactatgcacctaggtgtcaaccagggccccgacatatcagcagccagggcct

SEQ ID NO: 390369 - DNA, 140 bp, Artificial Sequence
  Synthetic
atacgccatgctgggtctccagagggaagtatccgttccggcggaaatcttgcggaaatccaagagcttccccccggcgttgcccatatgggcacggccagactacaaccctccactgatcgtacttgggagtcggccat

SEQ ID NO: 390370 - DNA, 140 bp, Artificial Sequence
  Synthetic
atggccgactcccaagtacgatcagtggagggttgtagtctggccgtgcccatatgggcaacgccggggggaagctcttggatttccgcaagatttccgccggaacggatacttccctctggagacccagcatggcgtat

SEQ ID NO: 390371 - DNA, 140 bp, Artificial Sequence
  Synthetic
atacgccatgctgggtctccgccagacgcataggcctcatccagacgctgagctagtagacgccaacttgttatggcggcaagaaatgggcagcaacattacacgggtagagtctgaaaccgtacttgggagtcggccat

SEQ ID NO: 390372 - DNA, 140 bp, Artificial Sequence
  Synthetic
atggccgactcccaagtacggtttcagactctacccgtgtaatgttgctgcccatttcttgccgccataacaagttggcgtctactagctcagcgtctggatgaggcctatgcgtctggcggagacccagcatggcgtat

SEQ ID NO: 390373 - DNA, 140 bp, Artificial Sequence
  Synthetic
aggccctggctgctgatatgacgttgtctgctgctcgatgtcctacacatggacaggcgccctgatcacaccatgcgctgcggaggagagcaagctgcccattaatgcgttgagcaactcgaccttttgggacagcggtg

SEQ ID NO: 390374 - DNA, 140 bp, Artificial Sequence
  Synthetic
caccgctgtcccaaaaggtcgagttgctcaacgcattaatgggcagcttgctctcctccgcagcgcatggtgtgatcagggcgcctgtccatgtgtaggacatcgagcagcagacaacgtcatatcagcagccagggcct

SEQ ID NO: 390375 - DNA, 140 bp, Artificial Sequence
  Synthetic
atacgccatgctgggtctcccaacggcagttggcacatcaataggacggccctgaactgcaacgacagcctccacaccggctggatagcagggcttctttatcgcaacaatttcaactctcgtacttgggagtcggccat

SEQ ID NO: 390376 - DNA, 140 bp, Artificial Sequence
  Synthetic
atggccgactcccaagtacgagagttgaaattgttgcgataaagaagccctgctatccagccggtgtggaggctgtcgttgcagttcagggccgtcctattgatgtgccaactgccgttgggagacccagcatggcgtat

SEQ ID NO: 390377 - DNA, 140 bp, Artificial Sequence
  Synthetic
atacgccatgctgggtctccacaattcagctggatggttccaatgtgtccgcggcgctagctgcgctagcggaaaaatcattcccgtcctcgaaaccgcaggaagagaatagctcatcctcgtacttgggagtcggccat

SEQ ID NO: 390378 - DNA, 140 bp, Artificial Sequence
  Synthetic
atggccgactcccaagtacgaggatgagctattctcttcctgcggtttcgaggacgggaatgatttttccgctagcgcagctagcgccgcggacacattggaaccatccagctgaattgtggagacccagcatggcgtat

SEQ ID NO: 390379 - DNA, 140 bp, Artificial Sequence
  Synthetic
aggccctggctgctgatatgctcctggacagcgggtcgagttcctggtgaatgcctggaaatcaaagaagaaccctatgggctttgcatatgacacccgctgttttgactcaacagtcacgaccttttgggacagcggtg

SEQ ID NO: 390380 - DNA, 140 bp, Artificial Sequence
  Synthetic
caccgctgtcccaaaaggtcgtgactgttgagtcaaaacagcgggtgtcatatgcaaagcccatagggttcttctttgatttccaggcattcaccaggaactcgacccgctgtccaggagcatatcagcagccagggcct

SEQ ID NO: 390381 - DNA, 140 bp, Artificial Sequence
  Synthetic
aggccctggctgctgatatgaaggcgacatgcactacccatcatgactccccggacgctgacctcatcgaggccaacctcctgtggcggcaggagatgggcgggaacatcacccgcgtgggaccttttgggacagcggtg

SEQ ID NO: 390382 - DNA, 140 bp, Artificial Sequence
  Synthetic
caccgctgtcccaaaaggtcccacgcgggtgatgttcccgcccatctcctgccgccacaggaggttggcctcgatgaggtcagcgtccggggagtcatgatgggtagtgcatgtcgccttcatatcagcagccagggcct

SEQ ID NO: 390383 - DNA, 140 bp, Artificial Sequence
  Synthetic
aggccctggctgctgatatgttttgcccagggctggggccctatcgggtacgccaacggaagcggccccgaccagcgcccctactgctggcactacccaccaagaccttgtggtattgtggaccttttgggacagcggtg

SEQ ID NO: 390384 - DNA, 140 bp, Artificial Sequence
  Synthetic
caccgctgtcccaaaaggtccacaataccacaaggtcttggtgggtagtgccagcagtaggggcgctggtcggggccgcttccgttggcgtacccgatagggccccagccctgggcaaaacatatcagcagccagggcct

SEQ ID NO: 390385 - DNA, 140 bp, Artificial Sequence
  Synthetic
atacgccatgctgggtctccacacaatcacttgttacatcaaggccacagcggctgcgagggccgcaggcctccggaacccggactttcttgtctgcggagatgatctggtcgtggtggccgtacttgggagtcggccat

SEQ ID NO: 390386 - DNA, 140 bp, Artificial Sequence
  Synthetic
atggccgactcccaagtacggccaccacgaccagatcatctccgcagacaagaaagtccgggttccggaggcctgcggccctcgcagccgctgtggccttgatgtaacaagtgattgtgtggagacccagcatggcgtat

SEQ ID NO: 390387 - DNA, 140 bp, Artificial Sequence
  Synthetic
atacgccatgctgggtctccaggctatgaccaggtattctgctccacccggagatgctccacagcccacctacgaccttgagctcattacatcttgctcctccaacgtctccgtggcacgcgtacttgggagtcggccat

SEQ ID NO: 390388 - DNA, 140 bp, Artificial Sequence
  Synthetic
atggccgactcccaagtacgcgtgccacggagacgttggaggagcaagatgtaatgagctcaaggtcgtaggtgggctgtggagcatctccgggtggagcagaatacctggtcatagcctggagacccagcatggcgtat

SEQ ID NO: 390389 - DNA, 140 bp, Artificial Sequence
  Synthetic
aggccctggctgctgatatgtgatgagtgccactcaactgactcgacctccatcttgggcatcggcacagtcctggaccaagcggagacggctggagcgcgcctcgtcgtgctcgccaccgaccttttgggacagcggtg

SEQ ID NO: 390390 - DNA, 140 bp, Artificial Sequence
  Synthetic
caccgctgtcccaaaaggtcggtggcgagcacgacgaggcgcgctccagccgtctccgcttggtccaggactgtgccgatgcccaagatggaggtcgagtcagttgagtggcactcatcacatatcagcagccagggcct

SEQ ID NO: 390391 - DNA, 140 bp, Artificial Sequence
  Synthetic
atacgccatgctgggtctccaatgatgacgcattttttctccatactccaatcccaggagatacttgatcgaccccttgactttgaaatgtacggggccacttactctgtcactccgctgcgtacttgggagtcggccat

SEQ ID NO: 390392 - DNA, 140 bp, Artificial Sequence
  Synthetic
atggccgactcccaagtacgcagcggagtgacagagtaagtggccccgtacatttcaaagtcaaggggtcgatcaagtatctcctgggattggagtatggagaaaaaatgcgtcatcattggagacccagcatggcgtat

SEQ ID NO: 390393 - DNA, 140 bp, Artificial Sequence
  Synthetic
aggccctggctgctgatatgatgtcggctgacctggaggtcgtcacgagcacctgggtgctagtgggcggagtcctcgcagccctggccgcgtattgcctgacaacgggcagcgtggtcagaccttttgggacagcggtg

SEQ ID NO: 390394 - DNA, 140 bp, Artificial Sequence
  Synthetic
caccgctgtcccaaaaggtctgaccacgctgcccgttgtcaggcaatacgcggccagggctgcgaggactccgcccactagcacccaggtgctcgtgacgacctccaggtcagccgacatcatatcagcagccagggcct

SEQ ID NO: 390395 - DNA, 140 bp, Artificial Sequence
  Synthetic
atacgccatgctgggtctccgtcttgattgtgatgctactctttgccggcgttgacggggggaaaacttacacgacagggggggcggacagccgctccaccttcgcgtttacttccctttcgtacttgggagtcggccat

SEQ ID NO: 390396 - DNA, 140 bp, Artificial Sequence
  Synthetic
atggccgactcccaagtacgaaagggaagtaaacgcgaaggtggagcggctgtccgccccccctgtcgtgtaagttttccccccgtcaacgccggcaaagagtagcatcacaatcaagacggagacccagcatggcgtat

SEQ ID NO: 390397 - DNA, 140 bp, Artificial Sequence
  Synthetic
aggccctggctgctgatatggtggtggagtccagatggcgagcccttgaggccttctgggcgaagcacatgtggaacttcatcagcgggatacagtacctagcaggcttgtccaccttgcgaccttttgggacagcggtg

SEQ ID NO: 390398 - DNA, 140 bp, Artificial Sequence
  Synthetic
caccgctgtcccaaaaggtcgcaaggtggacaagcctgctaggtactgtatcccgctgatgaagttccacatgtgcttcgcccagaaggcctcaagggctcgccatctggactccaccaccatatcagcagccagggcct

SEQ ID NO: 390399 - DNA, 140 bp, Artificial Sequence
  Synthetic
aggccctggctgctgatatggtggacatcctggcgggttatggggcaggggtagctggcgcactcgtggcctttaagatcatgagcggcgagatgccctccaccgaggacctggtcaaccgaccttttgggacagcggtg

SEQ ID NO: 390400 - DNA, 140 bp, Artificial Sequence
  Synthetic
caccgctgtcccaaaaggtcggttgaccaggtcctcggtggagggcatctcgccgctcatgatcttaaaggccacgagtgcgccagctacccctgccccataacccgccaggatgtccaccatatcagcagccagggcct

SEQ ID NO: 390401 - DNA, 140 bp, Artificial Sequence
  Synthetic
aggccctggctgctgatatgtaactgctcgctgtacccaggccatctttcaggacatcgaatggcttgggatatgatgatgaattggtcccccgctgtgggtatggtggtggcgcatgtcgaccttttgggacagcggtg

SEQ ID NO: 390402 - DNA, 140 bp, Artificial Sequence
  Synthetic
caccgctgtcccaaaaggtcgacatgcgccaccaccatacccacagcgggggaccaattcatcatcatatcccaagccattcgatgtcctgaaagatggcctgggtacagcgagcagttacatatcagcagccagggcct

SEQ ID NO: 390403 - DNA, 140 bp, Artificial Sequence
  Synthetic
aggccctggctgctgatatgcatcttggcgggcctggcctattactccatgcagggcaactgggccaaggtcgcaatcatcatggttatgttctcaggggtcgatgcccacacatataccgaccttttgggacagcggtg

SEQ ID NO: 390404 - DNA, 140 bp, Artificial Sequence
  Synthetic
caccgctgtcccaaaaggtcggtatatgtgtgggcatcgacccctgagaacataaccatgatgattgcgaccttggcccagttgccctgcatggagtaataggccaggcccgccaagatgcatatcagcagccagggcct

SEQ ID NO: 390405 - DNA, 140 bp, Artificial Sequence
  Synthetic
aggccctggctgctgatatgggcatatgctatctatggcgtatggccgttgctcctgctcctgctggcgctaccaccacgagcttacgccatggaccgggagatggctgcatcgtgcggagaccttttgggacagcggtg

SEQ ID NO: 390406 - DNA, 140 bp, Artificial Sequence
  Synthetic
caccgctgtcccaaaaggtctccgcacgatgcagccatctcccggtccatggcgtaagctcgtggtggtagcgccagcaggagcaggagcaacggccatacgccatagatagcatatgcccatatcagcagccagggcct

SEQ ID NO: 390407 - DNA, 140 bp, Artificial Sequence
  Synthetic
aggccctggctgctgatatgtaccaccacgagcttacgccatggaccgggagatggctgcatcgtgcggaggcgcggttttcgtaggcctggtactcttgaccttgtcaccacactataagaccttttgggacagcggtg

SEQ ID NO: 390408 - DNA, 140 bp, Artificial Sequence
  Synthetic
caccgctgtcccaaaaggtcttatagtgtggtgacaaggtcaagagtaccaggcctacgaaaaccgcgcctccgcacgatgcagccatctcccggtccatggcgtaagctcgtggtggtacatatcagcagccagggcct

SEQ ID NO: 390409 - DNA, 140 bp, Artificial Sequence
  Synthetic
atacgccatgctgggtctccctgaagcgtacttgcaagtgtgggtcccccctctcaacgttcgggggggtcgcgatgccatcatcctcctcgcatgcgcggtccatccagagctggtcttcgtacttgggagtcggccat

SEQ ID NO: 390410 - DNA, 140 bp, Artificial Sequence
  Synthetic
atggccgactcccaagtacgaagaccagctctggatggaccgcgcatgcgaggaggatgatggcatcgcgacccccccgaacgttgagaggggggacccacacttgcaagtacgcttcagggagacccagcatggcgtat

SEQ ID NO: 390411 - DNA, 140 bp, Artificial Sequence
  Synthetic
aggccctggctgctgatatgtgtggcggcaggagatgggcgggaacatcacccgcgtggagtcagagaataaggtggtgatcctggactctttcgaaccgctccgagcggaggaggatgagaccttttgggacagcggtg

SEQ ID NO: 390412 - DNA, 140 bp, Artificial Sequence
  Synthetic
caccgctgtcccaaaaggtctcatcctcctccgctcggagcggttcgaaagagtccaggatcaccaccttattctctgactccacgcgggtgatgttcccgcccatctcctgccgccacacatatcagcagccagggcct

SEQ ID NO: 390413 - DNA, 140 bp, Artificial Sequence
  Synthetic
atacgccatgctgggtctccgggggagcgctgcgatatcgaggatcgtgaccgcagtgagcaacatccgctgctgcattcaacaactgagcttgctatactgccttgctctttcacgccccgtacttgggagtcggccat

SEQ ID NO: 390414 - DNA, 140 bp, Artificial Sequence
  Synthetic
atggccgactcccaagtacggggcgtgaaagagcaaggcagtatagcaagctcagttgttgaatgcagcagcggatgttgctcactgcggtcacgatcctcgatatcgcagcgctcccccggagacccagcatggcgtat

SEQ ID NO: 390415 - DNA, 140 bp, Artificial Sequence
  Synthetic
atacgccatgctgggtctccacggggcatgcttggttgcatcatcactagtctcacaggtcgggataagaaccaggtcgaaggagaggttcaagtggtctccaccgcaacacaaactttccgtacttgggagtcggccat

SEQ ID NO: 390416 - DNA, 140 bp, Artificial Sequence
  Synthetic
atggccgactcccaagtacggaaagtttgtgttgcggtggagaccacttgaacctctccttcgacctggttcttatcccgacctgtgagactagtgatgatgcaaccaagcatgccccgtggagacccagcatggcgtat

SEQ ID NO: 390417 - DNA, 140 bp, Artificial Sequence
  Synthetic
aggccctggctgctgatatggctaaacttctatccgtagaagaggcctgcaagctgacgcccccacactcagccagatccaaatttggctacggggcgaaggacgtccggagcctatccagaccttttgggacagcggtg

SEQ ID NO: 390418 - DNA, 140 bp, Artificial Sequence
  Synthetic
caccgctgtcccaaaaggtctggataggctccggacgtccttcgccccgtagccaaatttggatctggctgagtgtgggggcgtcagcttgcaggcctcttctacggatagaagtttagccatatcagcagccagggcct

SEQ ID NO: 390419 - DNA, 140 bp, Artificial Sequence
  Synthetic
aggccctggctgctgatatgccggggggttgcgaaggcggtggacttcatacccgttgagtctatggaaactactatgcggtccccggtcttcacggacaactcatctcccccggccgtagaccttttgggacagcggtg

SEQ ID NO: 390420 - DNA, 140 bp, Artificial Sequence
  Synthetic
caccgctgtcccaaaaggtctacggccgggggagatgagttgtccgtgaagaccggggaccgcatagtagtttccatagactcaacgggtatgaagtccaccgccttcgcaaccccccggcatatcagcagccagggcct

SEQ ID NO: 390421 - DNA, 140 bp, Artificial Sequence
  Synthetic
atacgccatgctgggtctccccaaatgtacacaaatgtagatcaggacctcgttgggtggccagcccctccaggggccaagtctcttgaaccgtgcgcctgcgggtcttcagacttataccgtacttgggagtcggccat

SEQ ID NO: 390422 - DNA, 140 bp, Artificial Sequence
  Synthetic
atggccgactcccaagtacggtataagtctgaagacccgcaggcgcacggttcaagagacttggcccctggaggggctggccacccaacgaggtcctgatctacatttgtgtacatttggggagacccagcatggcgtat

SEQ ID NO: 390423 - DNA, 140 bp, Artificial Sequence
  Synthetic
aggccctggctgctgatatggggggggaggcacctcattttctgccattccaagaagaagtgtgacgagctcgccgcaaagctgtcgggcctcggactcaatgctgtagcgtattaccgggaccttttgggacagcggtg

SEQ ID NO: 390424 - DNA, 140 bp, Artificial Sequence
  Synthetic
caccgctgtcccaaaaggtcccggtaatacgctacagcattgagtccgaggcccgacagctttgcggcgagctcgtcacacttcttcttggaatggcagaaaatgaggtgcctccccccccatatcagcagccagggcct

SEQ ID NO: 390425 - DNA, 140 bp, Artificial Sequence
  Synthetic
atacgccatgctgggtctcctggccctgggctctgaaggtgagatccctttctacggtaaggctataccgatagccctgctcaagggggggaggcaccttatcttttgccattccaagaacgtacttgggagtcggccat

SEQ ID NO: 390426 - DNA, 140 bp, Artificial Sequence
  Synthetic
atggccgactcccaagtacgttcttggaatggcaaaagataaggtgcctcccccccttgagcagggctatcggtatagccttaccgtagaaagggatctcaccttcagagcccagggccaggagacccagcatggcgtat

SEQ ID NO: 390427 - DNA, 140 bp, Artificial Sequence
  Synthetic
aggccctggctgctgatatgcgggttatggagcaggggtggcaggcgcactcgtggcctttaaggtcatgagcggcgagatgccctccaccgaggacctggtcaacttgctccctgccatgaccttttgggacagcggtg

SEQ ID NO: 390428 - DNA, 140 bp, Artificial Sequence
  Synthetic
caccgctgtcccaaaaggtcatggcagggagcaagttgaccaggtcctcggtggagggcatctcgccgctcatgaccttaaaggccacgagtgcgcctgccacccctgctccataacccgcatatcagcagccagggcct

SEQ ID NO: 390429 - DNA, 140 bp, Artificial Sequence
  Synthetic
aggccctggctgctgatatggctgcaggggtaggcatctacctcctccccaaccgatgaacctagtcacggctagctgtgaggtcatagctgtttcctgagttttttttttttttttcctgaccttttgggacagcggtg

SEQ ID NO: 390430 - DNA, 140 bp, Artificial Sequence
  Synthetic
caccgctgtcccaaaaggtcaggaaaaaaaaaaaaaaaactcaggaaacagctatgacctcacagctagccgtgactaggttcatcggttggggaggaggtagatgcctacccctgcagccatatcagcagccagggcct

SEQ ID NO: 390431 - DNA, 140 bp, Artificial Sequence
  Synthetic
aggccctggctgctgatatgcgggcatgaccactgacaacgtaaaatgcccgtgccaggttccggcccccgaattcttcacggaagtggatggggtgcggctgcacaggtacgctccggcgaccttttgggacagcggtg

SEQ ID NO: 390432 - DNA, 140 bp, Artificial Sequence
  Synthetic
caccgctgtcccaaaaggtcgccggagcgtacctgtgcagccgcaccccatccacttccgtgaagaattcgggggccggaacctggcacgggcattttacgttgtcagtggtcatgcccgcatatcagcagccagggcct

SEQ ID NO: 390433 - DNA, 140 bp, Artificial Sequence
  Synthetic
aggccctggctgctgatatggaattcttcacggaagtggatggggtgcggctgcacaggtacgctccggcgtgcaaacctctcctacgggaggaggtcacattccaggtcgggctcaaccgaccttttgggacagcggtg

SEQ ID NO: 390434 - DNA, 140 bp, Artificial Sequence
  Synthetic
caccgctgtcccaaaaggtcggttgagcccgacctggaatgtgacctcctcccgtaggagaggtttgcacgccggagcgtacctgtgcagccgcaccccatccacttccgtgaagaattccatatcagcagccagggcct

SEQ ID NO: 390435 - DNA, 140 bp, Artificial Sequence
  Synthetic
aggccctggctgctgatatgatccagcttataaataccaacggcagctggcacatcaacaggactgccctgaactgcaatgactccctccagactgggttcctcgcctcgctgttctacagaccttttgggacagcggtg

SEQ ID NO: 390436 - DNA, 140 bp, Artificial Sequence
  Synthetic
caccgctgtcccaaaaggtctgtagaacagcgaggcgaggaacccagtctggagggagtcattgcagttcagggcagtcctgttgatgtgccagctgccgttggtatttataagctggatcatatcagcagccagggcct

SEQ ID NO: 390437 - DNA, 140 bp, Artificial Sequence
  Synthetic
atacgccatgctgggtctcccacatcggttcaacgcgtccggatgtccagagcgcttggccagatgtcgccccattagtgagttcgaccagggttggggccccatcacctacggtgagtccgtacttgggagtcggccat

SEQ ID NO: 390438 - DNA, 140 bp, Artificial Sequence
  Synthetic
atggccgactcccaagtacggactcaccgtaggtgatggggccccaaccctggtcgaactcactaatggggcgacatctggccaagcgctctggacatccggacgcgttgaaccgatgtgggagacccagcatggcgtat

SEQ ID NO: 390439 - DNA, 140 bp, Artificial Sequence
  Synthetic
aggccctggctgctgatatgctgcttactgcaggggtaggcatctacctctaccccaaccgatgaaggttggggtaaacactccggcctcctaggccatttcctgtttttttttttttttgaccttttgggacagcggtg

SEQ ID NO: 390440 - DNA, 140 bp, Artificial Sequence
  Synthetic
caccgctgtcccaaaaggtcaaaaaaaaaaaaaaacaggaaatggcctaggaggccggagtgtttaccccaaccttcatcggttggggtagaggtagatgcctacccctgcagtaagcagcatatcagcagccagggcct

SEQ ID NO: 390441 - DNA, 140 bp, Artificial Sequence
  Synthetic
aggccctggctgctgatatggagcttagcccgctgctgctgtctacgacggagtggcaggtactgccctgttccttcaccaccctaccggctttgtccaccggtttgatccatctccatcgaccttttgggacagcggtg

SEQ ID NO: 390442 - DNA, 140 bp, Artificial Sequence
  Synthetic
caccgctgtcccaaaaggtcgatggagatggatcaaaccggtggacaaagccggtagggtggtgaaggaacagggcagtacctgccactccgtcgtagacagcagcagcgggctaagctccatatcagcagccagggcct

SEQ ID NO: 390443 - DNA, 140 bp, Artificial Sequence
  Synthetic
aggccctggctgctgatatgccgaggccgccttagagaacctggtggtcatcaacgcggcgtctgtggccggggcgcatggcattctctccttcctagtgtttttctgtgctgcctggtagaccttttgggacagcggtg

SEQ ID NO: 390444 - DNA, 140 bp, Artificial Sequence
  Synthetic
caccgctgtcccaaaaggtctaccaggcagcacagaaaaacactaggaaggagagaatgccatgcgccccggccacagacgccgcgttgatgaccaccaggttctctaaggcggcctcggcatatcagcagccagggcct

SEQ ID NO: 390445 - DNA, 140 bp, Artificial Sequence
  Synthetic
atacgccatgctgggtctcccctccagcccttcctatctgggctagaccggactacaatcctccactgttggaccgctggaaagcaccggattatgtaccaccaactgtccatggatgtgcgtacttgggagtcggccat

SEQ ID NO: 390446 - DNA, 140 bp, Artificial Sequence
  Synthetic
atggccgactcccaagtacgcacatccatggacagttggtggtacataatccggtgctttccagcggtccaacagtggaggattgtagtccggtctagcccagataggaagggctggaggggagacccagcatggcgtat

SEQ ID NO: 390447 - DNA, 140 bp, Artificial Sequence
  Synthetic
aggccctggctgctgatatgggaccgctggaaagcaccggattatgtaccaccaactgtccatggatgtgccttaccaccacggggcgctccaccggtgcctccccctcggaggaaaagggaccttttgggacagcggtg

SEQ ID NO: 390448 - DNA, 140 bp, Artificial Sequence
  Synthetic
caccgctgtcccaaaaggtcccttttcctccgagggggaggcaccggtggagcgccccgtggtggtaaggcacatccatggacagttggtggtacataatccggtgctttccagcggtcccatatcagcagccagggcct

SEQ ID NO: 390449 - DNA, 140 bp, Artificial Sequence
  Synthetic
aggccctggctgctgatatgtgatatggagaccaagatcatcacctggggagcggacactgcggcgtgtggggacatcctctcgggtctacccgtctccgcccgaagggggagggagatagaccttttgggacagcggtg

SEQ ID NO: 390450 - DNA, 140 bp, Artificial Sequence
  Synthetic
caccgctgtcccaaaaggtctatctccctcccccttcgggcggagacgggtagacccgagaggatgtccccacacgccgcagtgtccgctccccaggtgatgatcttggtctccatatcacatatcagcagccagggcct

SEQ ID NO: 390451 - DNA, 140 bp, Artificial Sequence
  Synthetic
aggccctggctgctgatatgtggccgcgtcgtgtggcggcgttgttcttgtcgggttgatggcgctgactctgtcaccatattacaagcgctatatcagctggtgcttgtggtggcttcagaccttttgggacagcggtg

SEQ ID NO: 390452 - DNA, 140 bp, Artificial Sequence
  Synthetic
caccgctgtcccaaaaggtctgaagccaccacaagcaccagctgatatagcgcttgtaatatggtgacagagtcagcgccatcaacccgacaagaacaacgccgccacacgacgcggccacatatcagcagccagggcct

SEQ ID NO: 390453 - DNA, 140 bp, Artificial Sequence
  Synthetic
aggccctggctgctgatatggcaggcaggagataacttcccctacctagtggcgtaccaggctactgtgtgcgccagggctcaggctccacctccatcgtgggatacaatgtggaagtgtgaccttttgggacagcggtg

SEQ ID NO: 390454 - DNA, 140 bp, Artificial Sequence
  Synthetic
caccgctgtcccaaaaggtcacacttccacattgtatcccacgatggaggtggagcctgagccctggcgcacacagtagcctggtacgccactaggtaggggaagttatctcctgcctgccatatcagcagccagggcct

SEQ ID NO: 390455 - DNA, 140 bp, Artificial Sequence
  Synthetic
aggccctggctgctgatatgagtcctggcgggccttggctactattccatggtggggaactgggctaaggttttgattgtgatgctactttttgccggcgttgatgggcatacccgcacggaccttttgggacagcggtg

SEQ ID NO: 390456 - DNA, 140 bp, Artificial Sequence
  Synthetic
caccgctgtcccaaaaggtccgtgcgggtatgcccatcaacgccggcaaaaagtagcatcacaatcaaaaccttagcccagttccccaccatggaatagtagccaaggcccgccaggactcatatcagcagccagggcct

SEQ ID NO: 390457 - DNA, 140 bp, Artificial Sequence
  Synthetic
atacgccatgctgggtctccacatcaacaggaccgccctgaattgcaatgactccctccagaccgggtttattgctgcactgttctatgcacacaggttcaactcatctggatgctcagacgtacttgggagtcggccat

SEQ ID NO: 390458 - DNA, 140 bp, Artificial Sequence
  Synthetic
atggccgactcccaagtacgtctgagcatccagatgagttgaacctgtgtgcatagaacagtgcagcaataaacccggtctggagggagtcattgcaattcagggcggtcctgttgatgtggagacccagcatggcgtat

SEQ ID NO: 390459 - DNA, 140 bp, Artificial Sequence
  Synthetic
atacgccatgctgggtctccccatcacctacgctgaacatcacggccgtgaccagaggccttactgctggcactacgcgcccaagccgtgcggtatagtacccgcgtcaacggtgtgtggcgtacttgggagtcggccat

SEQ ID NO: 390460 - DNA, 140 bp, Artificial Sequence
  Synthetic
atggccgactcccaagtacgccacacaccgttgacgcgggtactataccgcacggcttgggcgcgtagtgccagcagtaaggcctctggtcacggccgtgatgttcagcgtaggtgatggggagacccagcatggcgtat

SEQ ID NO: 390461 - DNA, 140 bp, Artificial Sequence
  Synthetic
atacgccatgctgggtctcctacgctttctatggtgtatggccgttatttctgctcttgctggcgttaccaccacgggcatacgccatggaccgggagatggctgcatcgtgcgggggcgcgtacttgggagtcggccat

SEQ ID NO: 390462 - DNA, 140 bp, Artificial Sequence
  Synthetic
atggccgactcccaagtacgcgcccccgcacgatgcagccatctcccggtccatggcgtatgcccgtggtggtaacgccagcaagagcagaaataacggccatacaccatagaaagcgtaggagacccagcatggcgtat

SEQ ID NO: 390463 - DNA, 140 bp, Artificial Sequence
  Synthetic
atacgccatgctgggtctcccagaacctgcagctggtcaacaccaatggctcgtggcacatcaacagcactgccctgaactgtgatgattccataaacaccgggttcatagctgggttgtcgtacttgggagtcggccat

SEQ ID NO: 390464 - DNA, 140 bp, Artificial Sequence
  Synthetic
atggccgactcccaagtacgacaacccagctatgaacccggtgtttatggaatcatcacagttcagggcagtgctgttgatgtgccacgagccattggtgttgaccagctgcaggttctgggagacccagcatggcgtat

SEQ ID NO: 390465 - DNA, 140 bp, Artificial Sequence
  Synthetic
atacgccatgctgggtctcctttactatcataagttcaactctactggatgtcctcaaaggctcagcgactgcaagcccatcactttcttcaagcaggggtggggccccttgacagatgccgtacttgggagtcggccat

SEQ ID NO: 390466 - DNA, 140 bp, Artificial Sequence
  Synthetic
atggccgactcccaagtacggcatctgtcaaggggccccacccctgcttgaagaaagtgatgggcttgcagtcgctgagcctttgaggacatccagtagagttgaacttatgatagtaaaggagacccagcatggcgtat

SEQ ID NO: 390467 - DNA, 140 bp, Artificial Sequence
  Synthetic
atacgccatgctgggtctcccggcttgaccagggtgccatacttcgtgcgcgcccaagggctcattcgtgcatgcatgttggtgcggaaagtcgctgggggccattatgctcaaatggctcgtacttgggagtcggccat

SEQ ID NO: 390468 - DNA, 140 bp, Artificial Sequence
  Synthetic
atggccgactcccaagtacgagccatttgagcataatggcccccagcgactttccgcaccaacatgcatgcacgaatgagcccttgggcgcgcacgaagtatggcaccctggtcaagccgggagacccagcatggcgtat

SEQ ID NO: 390469 - DNA, 140 bp, Artificial Sequence
  Synthetic
aggccctggctgctgatatgccctgcggcctcccagtggtcggtggtttgggtgcgcgtggatgaactccacggggttcctcaagacgtgcggagctcccccttgtaacatctatggggggaccttttgggacagcggtg

SEQ ID NO: 390470 - DNA, 140 bp, Artificial Sequence
  Synthetic
caccgctgtcccaaaaggtccccccatagatgttacaagggggagctccgcacgtcttgaggaaccccgtggagttcatccacgcgcacccaaaccaccgaccactgggaggccgcagggcatatcagcagccagggcct

SEQ ID NO: 390471 - DNA, 140 bp, Artificial Sequence
  Synthetic
aggccctggctgctgatatgtggcggagctagccacaaagacctttggtagctccgaatcgtcggccgtcgacagcggcacggcgaccgcccctcctgaccagccctccgacggcgacgagaccttttgggacagcggtg

SEQ ID NO: 390472 - DNA, 140 bp, Artificial Sequence
  Synthetic
caccgctgtcccaaaaggtctcgtcgccgtcggagggctggtcaggaggggcggtcgccgtgccgctgtcgacggccgacgattcggagctaccaaaggtctttgtggctagctccgccacatatcagcagccagggcct

SEQ ID NO: 390473 - DNA, 140 bp, Artificial Sequence
  Synthetic
atacgccatgctgggtctccccgcctttgcatgctcgtgcgctctgtgacgggggggaaatacttccagatgatcatactgaatattggcagatggttcaacacctacctatatgaccaccgtacttgggagtcggccat

SEQ ID NO: 390474 - DNA, 140 bp, Artificial Sequence
  Synthetic
atggccgactcccaagtacggtggtcatataggtaggtgttgaaccatctgccaatattcagtatgatcatctggaagtatttcccccccgtcacagagcgcacgagcatgcaaaggcggggagacccagcatggcgtat

SEQ ID NO: 390475 - DNA, 140 bp, Artificial Sequence
  Synthetic
aggccctggctgctgatatgaatgtggatcaggacctcgttggatggccagcccctccaggggccaagtctcttgaaccgtgcgcctgcgggtctgcggacttatacttggtcacccgaggaccttttgggacagcggtg

SEQ ID NO: 390476 - DNA, 140 bp, Artificial Sequence
  Synthetic
caccgctgtcccaaaaggtcctcgggtgaccaagtataagtccgcagacccgcaggcgcacggttcaagagacttggcccctggaggggctggccatccaacgaggtcctgatccacattcatatcagcagccagggcct

SEQ ID NO: 390477 - DNA, 140 bp, Artificial Sequence
  Synthetic
atacgccatgctgggtctccacacaggctaggtctccatccttctctgacaattcaactcctcctgctgttccacagagctatcaagtagggtaccttcatgccccgaccggcagcggtacgtacttgggagtcggccat

SEQ ID NO: 390478 - DNA, 140 bp, Artificial Sequence
  Synthetic
atggccgactcccaagtacgtaccgctgccggtcggggcatgaaggtaccctacttgatagctctgtggaacagcaggaggagttgaattgtcagagaaggatggagacctagcctgtgtggagacccagcatggcgtat

SEQ ID NO: 390479 - DNA, 140 bp, Artificial Sequence
  Synthetic
  misc_feature (43)..(43): n is a, c, g, or t
aggccctggctgctgatatgagggggggagacaccttatcttntgccattccaagaaaaaatgtgatgagatagcatccaaactcagaggcatggggctcaacgctgtagcgtactataggaccttttgggacagcggtg

SEQ ID NO: 390480 - DNA, 140 bp, Artificial Sequence
  Synthetic
  misc_feature (98)..(98): n is a, c, g, or t
caccgctgtcccaaaaggtcctatagtacgctacagcgttgagccccatgcctctgagtttggatgctatctcatcacattttttcttggaatggcanaagataaggtgtctccccccctcatatcagcagccagggcct

SEQ ID NO: 390481 - DNA, 140 bp, Artificial Sequence
  Synthetic
atacgccatgctgggtctcctgcccacttcctgtcacagaccaagcagcagggacttaacttctcgtacctagctgcctaccaagccactgtgtgcgcccgcgcgcaggctcctcccccacgtacttgggagtcggccat

SEQ ID NO: 390482 - DNA, 140 bp, Artificial Sequence
  Synthetic
atggccgactcccaagtacgtgggggaggagcctgcgcgcgggcgcacacagtggcttggtaggcagctaggtacgagaagttaagtccctgctgcttggtctgtgacaggaagtgggcaggagacccagcatggcgtat

SEQ ID NO: 390483 - DNA, 140 bp, Artificial Sequence
  Synthetic
aggccctggctgctgatatgtagctgcctaccaagccactgtgtgcgcccgcgcgcaggctcctcccccaagttgggacgagacgtggaagtgtcttatacggcttaagccaacactgcagaccttttgggacagcggtg

SEQ ID NO: 390484 - DNA, 140 bp, Artificial Sequence
  Synthetic
caccgctgtcccaaaaggtctgcagtgttggcttaagccgtataagacacttccacgtctcgtcccaacttgggggaggagcctgcgcgcgggcgcacacagtggcttggtaggcagctacatatcagcagccagggcct

SEQ ID NO: 390485 - DNA, 140 bp, Artificial Sequence
  Synthetic
aggccctggctgctgatatgtgggtagcagggcttctctattacaacaagttcaactcttcaggctgtcccgagaggttggccagctgccgaccccttgccgactttgaccagggctggggaccttttgggacagcggtg

SEQ ID NO: 390486 - DNA, 140 bp, Artificial Sequence
  Synthetic
caccgctgtcccaaaaggtccccagccctggtcaaagtcggcaaggggtcggcagctggccaacctctcgggacagcctgaagagttgaacttgttgtaatagagaagccctgctacccacatatcagcagccagggcct

SEQ ID NO: 390487 - DNA, 140 bp, Artificial Sequence
  Synthetic
atacgccatgctgggtctcccccgtcacagcaatacgacgtcatgtcgatttgctcgttgggacggctgctttctgttccgctatgtacgtgggagatctttgcggatctgtcttccccgcgtacttgggagtcggccat

SEQ ID NO: 390488 - DNA, 140 bp, Artificial Sequence
  Synthetic
atggccgactcccaagtacgcggggaagacagatccgcaaagatctcccacgtacatagcggaacagaaagcagccgtcccaacgagcaaatcgacatgacgtcgtattgctgtgacgggggagacccagcatggcgtat

SEQ ID NO: 390489 - DNA, 140 bp, Artificial Sequence
  Synthetic
aggccctggctgctgatatgggatatgatgatgaactggtcacctacggcagccctagtggtatcgcagttactccggatcccacaagccatcgtggatatggtggcgggggcccactgggaccttttgggacagcggtg

SEQ ID NO: 390490 - DNA, 140 bp, Artificial Sequence
  Synthetic
caccgctgtcccaaaaggtcccagtgggcccccgccaccatatccacgatggcttgtgggatccggagtaactgcgataccactagggctgccgtaggtgaccagttcatcatcatatcccatatcagcagccagggcct

SEQ ID NO: 390491 - DNA, 140 bp, Artificial Sequence
  Synthetic
atacgccatgctgggtctccgagcgcatggccagctgccgccccattgacaagttcgatcaagggtggggtcccatcacttatgctgagcctgacagctcggaccagaggccctactgctcgtacttgggagtcggccat

SEQ ID NO: 390492 - DNA, 140 bp, Artificial Sequence
  Synthetic
atggccgactcccaagtacgagcagtagggcctctggtccgagctgtcaggctcagcataagtgatgggaccccacccttgatcgaacttgtcaatggggcggcagctggccatgcgctcggagacccagcatggcgtat

SEQ ID NO: 390493 - DNA, 140 bp, Artificial Sequence
  Synthetic
aggccctggctgctgatatgtgctcctcaacaacacgcggccgccgctgggcaactggttcggctgtacatggatgaacagcactgggttcaccaagacgtgcgggggccccccgtgtaagaccttttgggacagcggtg

SEQ ID NO: 390494 - DNA, 140 bp, Artificial Sequence
  Synthetic
caccgctgtcccaaaaggtcttacacggggggcccccgcacgtcttggtgaacccagtgctgttcatccatgtacagccgaaccagttgcccagcggcggccgcgtgttgttgaggagcacatatcagcagccagggcct

SEQ ID NO: 390495 - DNA, 140 bp, Artificial Sequence
  Synthetic
atacgccatgctgggtctcccatatgctctttatggcgtatggccgctgctcttgctcctgctggcattaccaccacgagcatatgccatggaccgagaaatggccgcatcgtgcggaggcgtacttgggagtcggccat

SEQ ID NO: 390496 - DNA, 140 bp, Artificial Sequence
  Synthetic
atggccgactcccaagtacgcctccgcacgatgcggccatttctcggtccatggcatatgctcgtggtggtaatgccagcaggagcaagagcagcggccatacgccataaagagcatatgggagacccagcatggcgtat

SEQ ID NO: 390497 - DNA, 140 bp, Artificial Sequence
  Synthetic
atacgccatgctgggtctcctgaggagtcaatttaccaatgttgtgacttggcccccgaagccagacaggccataaggtcgctcacagagcggctttatatcgggggtcccctgactaatcgtacttgggagtcggccat

SEQ ID NO: 390498 - DNA, 140 bp, Artificial Sequence
  Synthetic
atggccgactcccaagtacgattagtcaggggacccccgatataaagccgctctgtgagcgaccttatggcctgtctggcttcgggggccaagtcacaacattggtaaattgactcctcaggagacccagcatggcgtat

SEQ ID NO: 390499 - DNA, 140 bp, Artificial Sequence
  Synthetic
atacgccatgctgggtctccgctcgcataaccagggtgccgtactttgtacgggctcaagggctcatccgtgcatgcatgttggtgcggaaagccgctgggggtcattacatccaaatggcgtacttgggagtcggccat

SEQ ID NO: 390500 - DNA, 140 bp, Artificial Sequence
  Synthetic
atggccgactcccaagtacgccatttggatgtaatgacccccagcggctttccgcaccaacatgcatgcacggatgagcccttgagcccgtacaaagtacggcaccctggttatgcgagcggagacccagcatggcgtat

SEQ ID NO: 390501 - DNA, 140 bp, Artificial Sequence
  Synthetic
aggccctggctgctgatatgtgcatgcatgttggtgcggaaagccgctgggggtcattacatccaaatggctctcatgaagctggccgcactgtcaggtacgtacgtttatgaccatcttgaccttttgggacagcggtg

SEQ ID NO: 390502 - DNA, 140 bp, Artificial Sequence
  Synthetic
caccgctgtcccaaaaggtcaagatggtcataaacgtacgtacctgacagtgcggccagcttcatgagagccatttggatgtaatgacccccagcggctttccgcaccaacatgcatgcacatatcagcagccagggcct

SEQ ID NO: 390503 - DNA, 140 bp, Artificial Sequence
  Synthetic
aggccctggctgctgatatggagaccgcgggggcgagactggttgtgctcgccaccgctacccctccgggctccgtcactgtgccccatcctaacatcgaggaggttgctctgtccaccagaccttttgggacagcggtg

SEQ ID NO: 390504 - DNA, 140 bp, Artificial Sequence
  Synthetic
caccgctgtcccaaaaggtctggtggacagagcaacctcctcgatgttaggatggggcacagtgacggagcccggaggggtagcggtggcgagcacaaccagtctcgcccccgcggtctccatatcagcagccagggcct

SEQ ID NO: 390505 - DNA, 140 bp, Artificial Sequence
  Synthetic
aggccctggctgctgatatgggaggtcgtcacgagcacctgggtgctcgttggtggcgtcctggctgctctggccgcgtattgcctgtcaacaggctgcgtggtcatagtgggcaggattgaccttttgggacagcggtg

SEQ ID NO: 390506 - DNA, 140 bp, Artificial Sequence
  Synthetic
caccgctgtcccaaaaggtcaatcctgcccactatgaccacgcagcctgttgacaggcaatacgcggccagagcagccaggacgccaccaacgagcacccaggtgctcgtgacgacctcccatatcagcagccagggcct

SEQ ID NO: 390507 - DNA, 140 bp, Artificial Sequence
  Synthetic
aggccctggctgctgatatggcaagttccttgccgacggcgggtgctcagggggtgcttatgacataataatttgtgacgagtgccactccacggatgccacatccatcttgggcatcgggaccttttgggacagcggtg

SEQ ID NO: 390508 - DNA, 140 bp, Artificial Sequence
  Synthetic
caccgctgtcccaaaaggtcccgatgcccaagatggatgtggcatccgtggagtggcactcgtcacaaattattatgtcataagcaccccctgagcacccgccgtcggcaaggaacttgccatatcagcagccagggcct

SEQ ID NO: 390509 - DNA, 140 bp, Artificial Sequence
  Synthetic
atacgccatgctgggtctccagcgcatggctagctgccgccccattgacgcgttcgctcaggggtggggtcccatcacttacgctgagcccagctacttggaccagaggccttattgctgcgtacttgggagtcggccat

SEQ ID NO: 390510 - DNA, 140 bp, Artificial Sequence
  Synthetic
atggccgactcccaagtacgcagcaataaggcctctggtccaagtagctgggctcagcgtaagtgatgggaccccacccctgagcgaacgcgtcaatggggcggcagctagccatgcgctggagacccagcatggcgtat

SEQ ID NO: 390511 - DNA, 140 bp, Artificial Sequence
  Synthetic
aggccctggctgctgatatgtagccttcgcctcccgggggaaccatgtttcccccacgcactacgtgccggagagcgatgcagctgcccgcgtcactgccatactcagcagcctcactgtgaccttttgggacagcggtg

SEQ ID NO: 390512 - DNA, 140 bp, Artificial Sequence
  Synthetic
caccgctgtcccaaaaggtcacagtgaggctgctgagtatggcagtgacgcgggcagctgcatcgctctccggcacgtagtgcgtgggggaaacatggttcccccgggaggcgaaggctacatatcagcagccagggcct

SEQ ID NO: 390513 - DNA, 140 bp, Artificial Sequence
  Synthetic
atacgccatgctgggtctcctcgacataatagccggggcccattggggcatcttggcgggcctagcctattactccatgcagggcaactgggccaaggtcgctatcatcatggttatgttcgtacttgggagtcggccat

SEQ ID NO: 390514 - DNA, 140 bp, Artificial Sequence
  Synthetic
atggccgactcccaagtacgaacataaccatgatgatagcgaccttggcccagttgccctgcatggagtaataggctaggcccgccaagatgccccaatgggccccggctattatgtcgaggagacccagcatggcgtat

SEQ ID NO: 390515 - DNA, 140 bp, Artificial Sequence
  Synthetic
aggccctggctgctgatatgataagttcaactctactggatgtcctcaaaggctcagcgactgcaagcccatcactttcttcaagcaggggtggggccccttgacagatgctaacatcacgaccttttgggacagcggtg

SEQ ID NO: 390516 - DNA, 140 bp, Artificial Sequence
  Synthetic
caccgctgtcccaaaaggtcgtgatgttagcatctgtcaaggggccccacccctgcttgaagaaagtgatgggcttgcagtcgctgagcctttgaggacatccagtagagttgaacttatcatatcagcagccagggcct

SEQ ID NO: 390517 - DNA, 140 bp, Artificial Sequence
  Synthetic
aggccctggctgctgatatgccatcgccagtggtcgtaggcactactgatgccaagggcgtgccaacctacacctggggcgcgaatgagacagatgtgttcctgctggagtccctgcggcgaccttttgggacagcggtg

SEQ ID NO: 390518 - DNA, 140 bp, Artificial Sequence
  Synthetic
caccgctgtcccaaaaggtcgccgcagggactccagcaggaacacatctgtctcattcgcgccccaggtgtaggttggcacgcccttggcatcagtagtgcctacgaccactggcgatggcatatcagcagccagggcct

SEQ ID NO: 390519 - DNA, 140 bp, Artificial Sequence
  Synthetic
atacgccatgctgggtctcccacctggggcgcgaatgagacagatgtgttcctgctggagtccctgcggcctcccagtggtcggtggtttgggtgcgcgtggatgaactccacggggttccgtacttgggagtcggccat

SEQ ID NO: 390520 - DNA, 140 bp, Artificial Sequence
  Synthetic
atggccgactcccaagtacggaaccccgtggagttcatccacgcgcacccaaaccaccgaccactgggaggccgcagggactccagcaggaacacatctgtctcattcgcgccccaggtgggagacccagcatggcgtat

SEQ ID NO: 390521 - DNA, 140 bp, Artificial Sequence
  Synthetic
aggccctggctgctgatatggcaccccgaggccacctacaccaaatgtgggtcggggccttggttgacacctaggtgcatggttgactacccatacaggctttggcattacccctgcactgaccttttgggacagcggtg

SEQ ID NO: 390522 - DNA, 140 bp, Artificial Sequence
  Synthetic
caccgctgtcccaaaaggtcagtgcaggggtaatgccaaagcctgtatgggtagtcaaccatgcacctaggtgtcaaccaaggccccgacccacatttggtgtaggtggcctcggggtgccatatcagcagccagggcct

SEQ ID NO: 390523 - DNA, 140 bp, Artificial Sequence
  Synthetic
aggccctggctgctgatatggcccggccccgctggttctggttctgcctactcctgcttgctgcaggggtaggcatctacctcctccccaaccgatgaaggttggggtaaacactccggcgaccttttgggacagcggtg

SEQ ID NO: 390524 - DNA, 140 bp, Artificial Sequence
  Synthetic
caccgctgtcccaaaaggtcgccggagtgtttaccccaaccttcatcggttggggaggaggtagatgcctacccctgcagcaagcaggagtaggcagaaccagaaccagcggggccgggccatatcagcagccagggcct

SEQ ID NO: 390525 - DNA, 140 bp, Artificial Sequence
  Synthetic
aggccctggctgctgatatgagcatcactgatggcattcacagcctctatcaccagcccgctcaccacccaaagcaccctcctgttcaacatcctggggggatgggtggccgcccaactcgaccttttgggacagcggtg

SEQ ID NO: 390526 - DNA, 140 bp, Artificial Sequence
  Synthetic
caccgctgtcccaaaaggtcgagttgggcggccacccatccccccaggatgttgaacaggagggtgctttgggtggtgagcgggctggtgatagaggctgtgaatgccatcagtgatgctcatatcagcagccagggcct

SEQ ID NO: 390527 - DNA, 140 bp, Artificial Sequence
  Synthetic
atacgccatgctgggtctccccctcatgactggattcaccggagacttcgattctgtcatagattgcaacgtagctgttgaacagtacgttgacttcagcctggaccccaccttttccatcgtacttgggagtcggccat

SEQ ID NO: 390528 - DNA, 140 bp, Artificial Sequence
  Synthetic
atggccgactcccaagtacgatggaaaaggtggggtccaggctgaagtcaacgtactgttcaacagctacgttgcaatctatgacagaatcgaagtctccggtgaatccagtcatgagggggagacccagcatggcgtat

SEQ ID NO: 390529 - DNA, 140 bp, Artificial Sequence
  Synthetic
aggccctggctgctgatatgtggcacagctgctccggatcccacaagccatcttggacatgatcgctggtgctcactggggagtcctggcgggcatagcgtatttctccatggtggggaagaccttttgggacagcggtg

SEQ ID NO: 390530 - DNA, 140 bp, Artificial Sequence
  Synthetic
caccgctgtcccaaaaggtcttccccaccatggagaaatacgctatgcccgccaggactccccagtgagcaccagcgatcatgtccaagatggcttgtgggatccggagcagctgtgccacatatcagcagccagggcct

SEQ ID NO: 390531 - DNA, 140 bp, Artificial Sequence
  Synthetic
aggccctggctgctgatatgggctgtcctgagagattggccagctgccgaccccttgccgactttgaccagggctggggccctatcagtcatgccaacggaagcggccccgaccaacgccgaccttttgggacagcggtg

SEQ ID NO: 390532 - DNA, 140 bp, Artificial Sequence
  Synthetic
caccgctgtcccaaaaggtcggcgttggtcggggccgcttccgttggcatgactgatagggccccagccctggtcaaagtcggcaaggggtcggcagctggccaatctctcaggacagcccatatcagcagccagggcct

SEQ ID NO: 390533 - DNA, 140 bp, Artificial Sequence
  Synthetic
aggccctggctgctgatatgtcctgcttactgcaggggtaggcatctacctcctccccaaccgataaaggttggggtaaacactccggcctcttaggcctttttcgtgattttttttttcgaccttttgggacagcggtg

SEQ ID NO: 390534 - DNA, 140 bp, Artificial Sequence
  Synthetic
caccgctgtcccaaaaggtcgaaaaaaaaaatcacgaaaaaggcctaagaggccggagtgtttaccccaacctttatcggttggggaggaggtagatgcctacccctgcagtaagcaggacatatcagcagccagggcct

SEQ ID NO: 390535 - DNA, 140 bp, Artificial Sequence
  Synthetic
atacgccatgctgggtctcccctactattccatggtggggaactgggctaaggttttaattgtgatgcttctctttgccggcgttgacgcaaccacccacgtgacgggggggacaacaagcgtacttgggagtcggccat

SEQ ID NO: 390536 - DNA, 140 bp, Artificial Sequence
  Synthetic
atggccgactcccaagtacgcttgttgtcccccccgtcacgtgggtggttgcgtcaacgccggcaaagagaagcatcacaattaaaaccttagcccagttccccaccatggaatagtaggggagacccagcatggcgtat

SEQ ID NO: 390537 - DNA, 140 bp, Artificial Sequence
  Synthetic
atacgccatgctgggtctccctgaactgtaatgactcccttaacactgggttcattgcctcgctgttctacataaacaggttcaactcgtccggatgcccagaacgcatggccagctgcccgtacttgggagtcggccat

SEQ ID NO: 390538 - DNA, 140 bp, Artificial Sequence
  Synthetic
atggccgactcccaagtacgggcagctggccatgcgttctgggcatccggacgagttgaacctgtttatgtagaacagcgaggcaatgaacccagtgttaagggagtcattacagttcagggagacccagcatggcgtat

SEQ ID NO: 390539 - DNA, 140 bp, Artificial Sequence
  Synthetic
  misc_feature (99)..(99): n is a, c, g, or t
atacgccatgctgggtctcccgggtgctctcgtcgtcggtgtgatatgcgctgctatactacgtcgacacgtaggacctggggagggagcggtacagtngatgaacaggctcatcgcattcgtacttgggagtcggccat

SEQ ID NO: 390540 - DNA, 140 bp, Artificial Sequence
  Synthetic
  misc_feature (42)..(42): n is a, c, g, or t
atggccgactcccaagtacgaatgcgatgagcctgttcatcnactgtaccgctccctccccaggtcctacgtgtcgacgtagtatagcagcgcatatcacaccgacgacgagagcacccgggagacccagcatggcgtat

SEQ ID NO: 390541 - DNA, 140 bp, Artificial Sequence
  Synthetic
atacgccatgctgggtctccgctccatcgacaagttcgatcaggggtggggtcccatcacttatgccacgtctcgcagcttggaccagaggccctactgctggcactacgcgcctcaacccgtacttgggagtcggccat

SEQ ID NO: 390542 - DNA, 140 bp, Artificial Sequence
  Synthetic
atggccgactcccaagtacgggttgaggcgcgtagtgccagcagtagggcctctggtccaagctgcgagacgtggcataagtgatgggaccccacccctgatcgaacttgtcgatggagcggagacccagcatggcgtat

SEQ ID NO: 390543 - DNA, 140 bp, Artificial Sequence
  Synthetic
aggccctggctgctgatatgaagtgcgcaactccacggggctctaccatgtcaccaatgattgccccaactcgagtattgtgtacgaggcggccgatgccatcctgcacactccggggtggaccttttgggacagcggtg

SEQ ID NO: 390544 - DNA, 140 bp, Artificial Sequence
  Synthetic
caccgctgtcccaaaaggtccaccccggagtgtgcaggatggcatcggccgcctcgtacacaatactcgagttggggcaatcattggtgacatggtagagccccgtggagttgcgcacttcatatcagcagccagggcct

SEQ ID NO: 390545 - DNA, 140 bp, Artificial Sequence
  Synthetic
aggccctggctgctgatatgcccatgcacaacagcaagggagacctttgtgggtatcggagatgccgcgcaagcggcgtctacacgaccagcttcggaaacacactgacatgctatctcagaccttttgggacagcggtg

SEQ ID NO: 390546 - DNA, 140 bp, Artificial Sequence
  Synthetic
caccgctgtcccaaaaggtctgagatagcatgtcagtgtgtttccgaagctggtcgtgtagacgccgcttgcgcggcatctccgatacccacaaaggtctcccttgctgttgtgcatgggcatatcagcagccagggcct

SEQ ID NO: 390547 - DNA, 140 bp, Artificial Sequence
  Synthetic
aggccctggctgctgatatgtcagaacatcgtggacgtgcaatacctgtacggtatagggtcagcggttgtctcctttgcaatcaaatgggagtatatcgtgttgctcttcctcctcctggaccttttgggacagcggtg

SEQ ID NO: 390548 - DNA, 140 bp, Artificial Sequence
  Synthetic
caccgctgtcccaaaaggtccaggaggaggaagagcaacacgatatactcccatttgattgcaaaggagacaaccgctgaccctataccgtacaggtattgcacgtccacgatgttctgacatatcagcagccagggcct

SEQ ID NO: 390549 - DNA, 140 bp, Artificial Sequence
  Synthetic
aggccctggctgctgatatgggattcaccaaagtgtgcggagcgcccccttgtgccatcggaggggtgggcaacaacaccttgctctgccccactgactgcttccgcaaacatccggaaggaccttttgggacagcggtg

SEQ ID NO: 390550 - DNA, 140 bp, Artificial Sequence
  Synthetic
caccgctgtcccaaaaggtccttccggatgtttgcggaagcagtcagtggggcagagcaaggtgttgttgcccacccctccgatggcacaagggggcgctccgcacactttggtgaatcccatatcagcagccagggcct

SEQ ID NO: 390551 - DNA, 140 bp, Artificial Sequence
  Synthetic
aggccctggctgctgatatgggatcccccccctcaacgttcgggggggccgcgacgccatcatcctcctcacgtgtgcggctcacccagagctgatctttgacatcaccaaactcttgctgaccttttgggacagcggtg

SEQ ID NO: 390552 - DNA, 140 bp, Artificial Sequence
  Synthetic
caccgctgtcccaaaaggtcagcaagagtttggtgatgtcaaagatcagctctgggtgagccgcacacgtgaggaggatgatggcgtcgcggcccccccgaacgttgaggggggggatcccatatcagcagccagggcct

SEQ ID NO: 390553 - DNA, 140 bp, Artificial Sequence
  Synthetic
aggccctggctgctgatatggtgggcatcttccgggccgccgtgtgcacccggggggttgcaaaggcggtggactttgtacccgttgagtccatggagaccactatgcggtccccggtctgaccttttgggacagcggtg

SEQ ID NO: 390554 - DNA, 140 bp, Artificial Sequence
  Synthetic
caccgctgtcccaaaaggtcagaccggggaccgcatagtggtctccatggactcaacgggtacaaagtccaccgcctttgcaaccccccgggtgcacacggcggcccggaagatgcccaccatatcagcagccagggcct

SEQ ID NO: 390555 - DNA, 140 bp, Artificial Sequence
  Synthetic
aggccctggctgctgatatgttggcgttgccccagcgggcatacgcactggacggggaggtggccgcgtcgtgtggcggcgttgttctcgtcgggttaatggcgctgactctgtcaccatgaccttttgggacagcggtg

SEQ ID NO: 390556 - DNA, 140 bp, Artificial Sequence
  Synthetic
caccgctgtcccaaaaggtcatggtgacagagtcagcgccattaacccgacgagaacaacgccgccacacgacgcggccacctccccgtccagtgcgtatgcccgctggggcaacgccaacatatcagcagccagggcct

SEQ ID NO: 390557 - DNA, 140 bp, Artificial Sequence
  Synthetic
atacgccatgctgggtctccggccaggaaagtgatctcctccctcacggagcggctttactgcgggggccctatgtttaacagcaagggggcccagtgtggttatcgccgttgccgtgcccgtacttgggagtcggccat

SEQ ID NO: 390558 - DNA, 140 bp, Artificial Sequence
  Synthetic
atggccgactcccaagtacgggcacggcaacggcgataaccacactgggcccccttgctgttaaacatagggcccccgcagtaaagccgctccgtgagggaggagatcactttcctggccggagacccagcatggcgtat

SEQ ID NO: 390559 - DNA, 140 bp, Artificial Sequence
  Synthetic
atacgccatgctgggtctccatacgcagcacaagggtacaaggtactcgtcttgaacccatctgttgctgccaccctaggttttggggcgtatatgtctaaggcacatggcatcgaccctcgtacttgggagtcggccat

SEQ ID NO: 390560 - DNA, 140 bp, Artificial Sequence
  Synthetic
atggccgactcccaagtacgagggtcgatgccatgtgccttagacatatacgccccaaaacctagggtggcagcaacagatgggttcaagacgagtaccttgtacccttgtgctgcgtatggagacccagcatggcgtat

SEQ ID NO: 390561 - DNA, 140 bp, Artificial Sequence
  Synthetic
aggccctggctgctgatatgtggtacgagctcacgcccgccgagacctcagttaggttgcgggcttacctaaacacaccagggttgcccgtctgccaggaccatctggagttctgggagagaccttttgggacagcggtg

SEQ ID NO: 390562 - DNA, 140 bp, Artificial Sequence
  Synthetic
caccgctgtcccaaaaggtctctcccagaactccagatggtcctggcagacgggcaaccctggtgtgtttaggtaagcccgcaacctaactgaggtctcggcgggcgtgagctcgtaccacatatcagcagccagggcct

SEQ ID NO: 390563 - DNA, 140 bp, Artificial Sequence
  Synthetic
atacgccatgctgggtctccacgcatggccagctgccgccccattgacaagttcgatcaggggtggggtcccatcacttacgctgagcctggcaattcggaccagaggccctattgctggcgtacttgggagtcggccat

SEQ ID NO: 390564 - DNA, 140 bp, Artificial Sequence
  Synthetic
atggccgactcccaagtacgccagcaatagggcctctggtccgaattgccaggctcagcgtaagtgatgggaccccacccctgatcgaacttgtcaatggggcggcagctggccatgcgtggagacccagcatggcgtat

SEQ ID NO: 390565 - DNA, 140 bp, Artificial Sequence
  Synthetic
atacgccatgctgggtctccgctcgtggcacatcaacagtactgctctgaactgtaatgagtccataaacaccgggttcatagctgggttgttttattaccataagttcaactctactggcgtacttgggagtcggccat

SEQ ID NO: 390566 - DNA, 140 bp, Artificial Sequence
  Synthetic
atggccgactcccaagtacgccagtagagttgaacttatggtaataaaacaacccagctatgaacccggtgtttatggactcattacagttcagagcagtactgttgatgtgccacgagcggagacccagcatggcgtat

SEQ ID NO: 390567 - DNA, 140 bp, Artificial Sequence
  Synthetic
aggccctggctgctgatatgtggcataaccagggtgccgtactttgtgcgcgcccaagggctcattcgtgcatgcatgttggtgcggaaagtcgctgggggtcattatgtccaaatggctgaccttttgggacagcggtg

SEQ ID NO: 390568 - DNA, 140 bp, Artificial Sequence
  Synthetic
caccgctgtcccaaaaggtcagccatttggacataatgacccccagcgactttccgcaccaacatgcatgcacgaatgagcccttgggcgcgcacaaagtacggcaccctggttatgccacatatcagcagccagggcct

SEQ ID NO: 390569 - DNA, 140 bp, Artificial Sequence
  Synthetic
atacgccatgctgggtctccccgtactgctggcactacgcacctagaccttgtgacgttgtcccggcattgaatgtctgcggccctgtgtactgcttcacaccatcgccagtggttgtggcgtacttgggagtcggccat

SEQ ID NO: 390570 - DNA, 140 bp, Artificial Sequence
  Synthetic
atggccgactcccaagtacgccacaaccactggcgatggtgtgaagcagtacacagggccgcagacattcaatgccgggacaacgtcacaaggtctaggtgcgtagtgccagcagtacggggagacccagcatggcgtat

SEQ ID NO: 390571 - DNA, 140 bp, Artificial Sequence
  Synthetic
atacgccatgctgggtctcctcagatgtgttcctgctggagtccctgaggcctcccagtggtcggtggtttgggtgtgcgtggatgaattccacggggtttctcaagacgtgtggagctccgtacttgggagtcggccat

SEQ ID NO: 390572 - DNA, 140 bp, Artificial Sequence
  Synthetic
atggccgactcccaagtacggagctccacacgtcttgagaaaccccgtggaattcatccacgcacacccaaaccaccgaccactgggaggcctcagggactccagcaggaacacatctgaggagacccagcatggcgtat

SEQ ID NO: 390573 - DNA, 140 bp, Artificial Sequence
  Synthetic
atacgccatgctgggtctccccggtgtggtgcagggccctggttgacacctcgttgcatggtcgactatccataccggctttggcattacccatgcacagtcaatttcacattgttcaagcgtacttgggagtcggccat

SEQ ID NO: 390574 - DNA, 140 bp, Artificial Sequence
  Synthetic
atggccgactcccaagtacgcttgaacaatgtgaaattgactgtgcatgggtaatgccaaagccggtatggatagtcgaccatgcaacgaggtgtcaaccagggccctgcaccacaccggggagacccagcatggcgtat

SEQ ID NO: 390575 - DNA, 140 bp, Artificial Sequence
  Synthetic
aggccctggctgctgatatgatcgaggccaacctcctgtggcggcaggagatgggcgggaacatcacccgcgtggagtcagagaacaaggtagtgattctggactctttcgatccgcttcgaccttttgggacagcggtg

SEQ ID NO: 390576 - DNA, 140 bp, Artificial Sequence
  Synthetic
caccgctgtcccaaaaggtcgaagcggatcgaaagagtccagaatcactaccttgttctctgactccacgcgggtgatgttcccgcccatctcctgccgccacaggaggttggcctcgatcatatcagcagccagggcct

SEQ ID NO: 390577 - DNA, 140 bp, Artificial Sequence
  Synthetic
aggccctggctgctgatatgcatgcggtccccggtcttcacggacaactcatccccaccggctgtaccgcagacatttcaagtggcccatctacacgcccctaccggcagcggcaagagcgaccttttgggacagcggtg

SEQ ID NO: 390578 - DNA, 140 bp, Artificial Sequence
  Synthetic
caccgctgtcccaaaaggtcgctcttgccgctgccggtaggggcgtgtagatgggccacttgaaatgtctgcggtacagccggtggggatgagttgtccgtgaagaccggggaccgcatgcatatcagcagccagggcct

SEQ ID NO: 390579 - DNA, 140 bp, Artificial Sequence
  Synthetic
atacgccatgctgggtctcccccccttacttgcgcgtgggagcagggacggtgtcatcttgctaacaagtctgctatacccatccttaatttttgacatcactaagctgctgatagcagtcgtacttgggagtcggccat

SEQ ID NO: 390580 - DNA, 140 bp, Artificial Sequence
  Synthetic
atggccgactcccaagtacgactgctatcagcagcttagtgatgtcaaaaattaaggatgggtatagcagacttgttagcaagatgacaccgtccctgctcccacgcgcaagtaagggggggagacccagcatggcgtat

SEQ ID NO: 390581 - DNA, 140 bp, Artificial Sequence
  Synthetic
aggccctggctgctgatatggagagatccccttctatggtaaagccatccccatcgagaccatcaagggggggaggcatcttattttctgccattccaagaagaaatgtgacgagctcgcgaccttttgggacagcggtg

SEQ ID NO: 390582 - DNA, 140 bp, Artificial Sequence
  Synthetic
caccgctgtcccaaaaggtcgcgagctcgtcacatttcttcttggaatggcagaaaataagatgcctcccccccttgatggtctcgatggggatggctttaccatagaaggggatctctccatatcagcagccagggcct

SEQ ID NO: 390583 - DNA, 140 bp, Artificial Sequence
  Synthetic
aggccctggctgctgatatggcaggggtaggcatctacctcctccccaaccgatgaaggttggggtaaacactccggcctcttaggccatttcctgttttttttttttttttttttttttgaccttttgggacagcggtg

SEQ ID NO: 390584 - DNA, 140 bp, Artificial Sequence
  Synthetic
caccgctgtcccaaaaggtcaaaaaaaaaaaaaaaaaaaaaaaacaggaaatggcctaagaggccggagtgtttaccccaaccttcatcggttggggaggaggtagatgcctacccctgccatatcagcagccagggcct

SEQ ID NO: 390585 - DNA, 140 bp, Artificial Sequence
  Synthetic
aggccctggctgctgatatgcggagacttcgattctgtcatagattgcaacgtggctgttgaacagtacgttgacttcagcttggaccccaccttttccattgagacccgcactgctcccgaccttttgggacagcggtg

SEQ ID NO: 390586 - DNA, 140 bp, Artificial Sequence
  Synthetic
caccgctgtcccaaaaggtcgggagcagtgcgggtctcaatggaaaaggtggggtccaagctgaagtcaacgtactgttcaacagccacgttgcaatctatgacagaatcgaagtctccgcatatcagcagccagggcct

SEQ ID NO: 390587 - DNA, 140 bp, Artificial Sequence
  Synthetic
atacgccatgctgggtctcctggtctcttttcattaggcgccaggcaggacatccagctgatcaacaccaacggcagttggcacatcaatcgcacggctttgaactgcaatagtagccttcgtacttgggagtcggccat

SEQ ID NO: 390588 - DNA, 140 bp, Artificial Sequence
  Synthetic
atggccgactcccaagtacgaaggctactattgcagttcaaagccgtgcgattgatgtgccaactgccgttggtgttgatcagctggatgtcctgcctggcgcctaatgaaaagagaccaggagacccagcatggcgtat

SEQ ID NO: 390589 - DNA, 140 bp, Artificial Sequence
  Synthetic
aggccctggctgctgatatgccctactgctggcactaccccccaaaaccttgcggtattgtgcccgcaaaggacgtgtgtggcccggtgtattgcttcactcccagccccgtggtggtgggaccttttgggacagcggtg

SEQ ID NO: 390590 - DNA, 140 bp, Artificial Sequence
  Synthetic
caccgctgtcccaaaaggtcccaccaccacggggctgggagtgaagcaatacaccgggccacacacgtcctttgcgggcacaataccgcaaggttttggggggtagtgccagcagtagggcatatcagcagccagggcct

SEQ ID NO: 390591 - DNA, 140 bp, Artificial Sequence
  Synthetic
aggccctggctgctgatatgggcatctacctcctccccaaccgatgaaggttggggtaaacactccggcctcttaggccatttcctggttttttttttttttttttttttttttttttttgaccttttgggacagcggtg

SEQ ID NO: 390592 - DNA, 140 bp, Artificial Sequence
  Synthetic
caccgctgtcccaaaaggtcaaaaaaaaaaaaaaaaaaaaaaaaaaaaaaaaccaggaaatggcctaagaggccggagtgtttaccccaaccttcatcggttggggaggaggtagatgcccatatcagcagccagggcct

SEQ ID NO: 390593 - DNA, 140 bp, Artificial Sequence
  Synthetic
atacgccatgctgggtctccttcgtggtaagcggcttggctggcgctgccatagggggtataggtctgggcagggtcttgcttgacatcctggcaggatacggagctggtgtctcaggcgcgtacttgggagtcggccat

SEQ ID NO: 390594 - DNA, 140 bp, Artificial Sequence
  Synthetic
atggccgactcccaagtacgcgcctgagacaccagctccgtatcctgccaggatgtcaagcaagaccctgcccagacctataccccctatggcagcgccagccaagccgcttaccacgaaggagacccagcatggcgtat

SEQ ID NO: 390595 - DNA, 140 bp, Artificial Sequence
  Synthetic
aggccctggctgctgatatggaccagagtagaagcgcaactgcacgtgtgggttccccccctcaacgtccgaggggggcgcgacgccatcatcttactcatgtgtgttgtgcacccgaccgaccttttgggacagcggtg

SEQ ID NO: 390596 - DNA, 140 bp, Artificial Sequence
  Synthetic
caccgctgtcccaaaaggtcggtcgggtgcacaacacacatgagtaagatgatggcgtcgcgcccccctcggacgttgagggggggaacccacacgtgcagttgcgcttctactctggtccatatcagcagccagggcct

SEQ ID NO: 390597 - DNA, 140 bp, Artificial Sequence
  Synthetic
aggccctggctgctgatatggccctgaactgcaatgactccctccagactgggtttattgccgcgctgatctacagacacaaggtcaacttgtccgggtgcccagagcgcttggccagctgaccttttgggacagcggtg

SEQ ID NO: 390598 - DNA, 140 bp, Artificial Sequence
  Synthetic
caccgctgtcccaaaaggtcagctggccaagcgctctgggcacccggacaagttgaccttgtgtctgtagatcagcgcggcaataaacccagtctggagggagtcattgcagttcagggccatatcagcagccagggcct

SEQ ID NO: 390599 - DNA, 140 bp, Artificial Sequence
  Synthetic
aggccctggctgctgatatggctatggggcgaaggacgtccggaacctatccagcaaggccgtcaaccacatcaactccgtgtggaaggacttgctggaagacactgaaacaccaattgagaccttttgggacagcggtg

SEQ ID NO: 390600 - DNA, 140 bp, Artificial Sequence
  Synthetic
caccgctgtcccaaaaggtctcaattggtgtttcagtgtcttccagcaagtccttccacacggagttgatgtggttgacggccttgctggataggttccggacgtccttcgccccatagccatatcagcagccagggcct

SEQ ID NO: 390601 - DNA, 140 bp, Artificial Sequence
  Synthetic
atacgccatgctgggtctccgtccgtgccaagtgccggctgctgagttctttactgaagtggatggggtgagactccaccgttacgcccctccatgtaagcccctgttgagagatgatatcgtacttgggagtcggccat

SEQ ID NO: 390602 - DNA, 140 bp, Artificial Sequence
  Synthetic
atggccgactcccaagtacgatatcatctctcaacaggggcttacatggaggggcgtaacggtggagtctcaccccatccacttcagtaaagaactcagcagccggcacttggcacggacggagacccagcatggcgtat

SEQ ID NO: 390603 - DNA, 140 bp, Artificial Sequence
  Synthetic
aggccctggctgctgatatggtgggcccaggagagggggctgtgcagtggatgaaccggctgatagcgttcgcttcacggggtaaccacgtctcccccacgcactatgtgcctgagagcggaccttttgggacagcggtg

SEQ ID NO: 390604 - DNA, 140 bp, Artificial Sequence
  Synthetic
caccgctgtcccaaaaggtccgctctcaggcacatagtgcgtgggggagacgtggttaccccgtgaagcgaacgctatcagccggttcatccactgcacagccccctctcctgggcccaccatatcagcagccagggcct

SEQ ID NO: 390605 - DNA, 140 bp, Artificial Sequence
  Synthetic
aggccctggctgctgatatggccaacttgttatggcggcaagagatgggcagcaacattacacgggtggagtctgaaacaaaggttgtgattcttgattcattcgaacctctgagagcccgaccttttgggacagcggtg

SEQ ID NO: 390606 - DNA, 140 bp, Artificial Sequence
  Synthetic
caccgctgtcccaaaaggtcgggctctcagaggttcgaatgaatcaagaatcacaacctttgtttcagactccacccgtgtaatgttgctgcccatctcttgccgccataacaagttggccatatcagcagccagggcct

SEQ ID NO: 390607 - DNA, 140 bp, Artificial Sequence
  Synthetic
atacgccatgctgggtctcctgcgctggcgaaaaaatcattcccgtccgtgaacccgcaggatgagaatagctcatcctctggggtcgacacacagtccagcaccacttccaaggtaccccgtacttgggagtcggccat

SEQ ID NO: 390608 - DNA, 140 bp, Artificial Sequence
  Synthetic
atggccgactcccaagtacggggtaccttggaagtggtgctggactgtgtgtcgaccccagaggatgagctattctcatcctgcgggttcacggacgggaatgattttttcgccagcgcaggagacccagcatggcgtat

SEQ ID NO: 390609 - DNA, 140 bp, Artificial Sequence
  Synthetic
aggccctggctgctgatatggatgccatcatcctcctcgcgtgtgcagtccacccagagctaatttttgacatcaccaaactcctgctcgccatactcggcccgctcatggtgctccagggaccttttgggacagcggtg

SEQ ID NO: 390610 - DNA, 140 bp, Artificial Sequence
  Synthetic
caccgctgtcccaaaaggtccctggagcaccatgagcgggccgagtatggcgagcaggagtttggtgatgtcaaaaattagctctgggtggactgcacacgcgaggaggatgatggcatccatatcagcagccagggcct

SEQ ID NO: 390611 - DNA, 140 bp, Artificial Sequence
  Synthetic
aggccctggctgctgatatgccttgaactgcaatgaaagccttaccaccggctggctagcagggcttttctataccaacaaattcaattcttcaggctgttccgagagattggcgagctggaccttttgggacagcggtg

SEQ ID NO: 390612 - DNA, 140 bp, Artificial Sequence
  Synthetic
caccgctgtcccaaaaggtccagctcgccaatctctcggaacagcctgaagaattgaatttgttggtatagaaaagccctgctagccagccggtggtaaggctttcattgcagttcaaggcatatcagcagccagggcct

SEQ ID NO: 390613 - DNA, 140 bp, Artificial Sequence
  Synthetic
aggccctggctgctgatatggggcctattcggctgcatcatcaccagcctcacaggccgggacaagaaccaggtcgagggggaggtccaagtggtctccaccgcaacacaatctttcctggaccttttgggacagcggtg

SEQ ID NO: 390614 - DNA, 140 bp, Artificial Sequence
  Synthetic
caccgctgtcccaaaaggtccaggaaagattgtgttgcggtggagaccacttggacctccccctcgacctggttcttgtcccggcctgtgaggctggtgatgatgcagccgaataggccccatatcagcagccagggcct

SEQ ID NO: 390615 - DNA, 140 bp, Artificial Sequence
  Synthetic
aggccctggctgctgatatgcccgactctggtatttgacatcaccaaactactgctggccgtcttcggacccctttggattcttcaagccagtttgcttaaagtaccctacttcgtgcgcgaccttttgggacagcggtg

SEQ ID NO: 390616 - DNA, 140 bp, Artificial Sequence
  Synthetic
caccgctgtcccaaaaggtcgcgcacgaagtagggtactttaagcaaactggcttgaagaatccaaaggggtccgaagacggccagcagtagtttggtgatgtcaaataccagagtcgggcatatcagcagccagggcct

SEQ ID NO: 390617 - DNA, 140 bp, Artificial Sequence
  Synthetic
atacgccatgctgggtctccctgaagatgtggacctcaaagaaaacccccttggggttctcgtatgacacccgctgctttgactcaactgtcactgaacaggacttcagggtggaagaggcgtacttgggagtcggccat

SEQ ID NO: 390618 - DNA, 140 bp, Artificial Sequence
  Synthetic
atggccgactcccaagtacgcctcttccaccctgaagtcctgttcagtgacagttgagtcaaagcagcgggtgtcatacgagaaccccaagggggttttctttgaggtccacatcttcagggagacccagcatggcgtat

SEQ ID NO: 390619 - DNA, 140 bp, Artificial Sequence
  Synthetic
atacgccatgctgggtctcctctttatgccgggggcgaaacagaacatccagctcataaacaccaacggcagctggcatatcaacaggaccgccctgaactgcaatgactcccttcgcaccgtacttgggagtcggccat

SEQ ID NO: 390620 - DNA, 140 bp, Artificial Sequence
  Synthetic
atggccgactcccaagtacggtgcgaagggagtcattgcagttcagggcggtcctgttgatatgccagctgccgttggtgtttatgagctggatgttctgtttcgcccccggcataaagaggagacccagcatggcgtat

SEQ ID NO: 390621 - DNA, 140 bp, Artificial Sequence
  Synthetic
aggccctggctgctgatatgagctggcatatcaacaggaccgccctgaactgcaatgactcccttcgcactgggttcctctccgcgctgttttacacgcacaagttcaactcgtctgggtgaccttttgggacagcggtg

SEQ ID NO: 390622 - DNA, 140 bp, Artificial Sequence
  Synthetic
caccgctgtcccaaaaggtcacccagacgagttgaacttgtgcgtgtaaaacagcgcggagaggaacccagtgcgaagggagtcattgcagttcagggcggtcctgttgatatgccagctcatatcagcagccagggcct

SEQ ID NO: 390623 - DNA, 140 bp, Artificial Sequence
  Synthetic
aggccctggctgctgatatgcactcaggaaacttgggtgcccccccctacgagcttggagacatcgggcacgagcagtgcgcgccaagcttatcgcccagggagggaaggccaaaatatggaccttttgggacagcggtg

SEQ ID NO: 390624 - DNA, 140 bp, Artificial Sequence
  Synthetic
caccgctgtcccaaaaggtccatattttggccttccctccctgggcgataagcttggcgcgcactgctcgtgcccgatgtctccaagctcgtaggggggggcacccaagtttcctgagtgcatatcagcagccagggcct

SEQ ID NO: 390625 - DNA, 140 bp, Artificial Sequence
  Synthetic
aggccctggctgctgatatgacaacagagtggcaggtgctgccctgttccttcaccaccctaccggctctgtccactgggttgatccatctccatcagaacatcgtggacatacaataccgaccttttgggacagcggtg

SEQ ID NO: 390626 - DNA, 140 bp, Artificial Sequence
  Synthetic
caccgctgtcccaaaaggtcggtattgtatgtccacgatgttctgatggagatggatcaacccagtggacagagccggtagggtggtgaaggaacagggcagcacctgccactctgttgtcatatcagcagccagggcct

SEQ ID NO: 390627 - DNA, 140 bp, Artificial Sequence
  Synthetic
atacgccatgctgggtctccccgcgtaggggcccacaattgggtgtgcgcgaagtacgtaagacttccgagcgatcacaacctcgcggacggcgtcagcctacccccaaggcacgcccgccgtacttgggagtcggccat

SEQ ID NO: 390628 - DNA, 140 bp, Artificial Sequence
  Synthetic
atggccgactcccaagtacggcgggcgtgccttgggggtaggctgacgccgtccgcgaggttgtgatcgctcggaagtcttacgtacttcgcgcacacccaattgtgggcccctacgcggggagacccagcatggcgtat

SEQ ID NO: 390629 - DNA, 140 bp, Artificial Sequence
  Synthetic
atacgccatgctgggtctccccccagctggggccaaaatgacccccggcgtagatcccgcaacttgggtaaggtcatcgataccctaacgtgcggatttgccgacctcatggggtacattcgtacttgggagtcggccat

SEQ ID NO: 390630 - DNA, 140 bp, Artificial Sequence
  Synthetic
atggccgactcccaagtacgaatgtaccccatgaggtcggcaaatccgcacgttagggtatcgatgaccttacccaagttgcgggatctacgccgggggtcattttggccccagctggggggagacccagcatggcgtat

SEQ ID NO: 390631 - DNA, 140 bp, Artificial Sequence
  Synthetic
atacgccatgctgggtctcctaaagtgttcctcgctaggttcatatggtggttgcaatatttcatcactagagccgaggcgcatttgcaagtgtgggtcccccccctcaacgtccgggggcgtacttgggagtcggccat

SEQ ID NO: 390632 - DNA, 140 bp, Artificial Sequence
  Synthetic
atggccgactcccaagtacgcccccggacgttgaggggggggacccacacttgcaaatgcgcctcggctctagtgatgaaatattgcaaccaccatatgaacctagcgaggaacactttaggagacccagcatggcgtat

SEQ ID NO: 390633 - DNA, 140 bp, Artificial Sequence
  Synthetic
atacgccatgctgggtctcctccaggctggcctaattaaagtgccgtactttgtgcgtgctcaggggctcatccgtgtatgcatgttggtgcggaaagccattgggggccattacgtccacgtacttgggagtcggccat

SEQ ID NO: 390634 - DNA, 140 bp, Artificial Sequence
  Synthetic
atggccgactcccaagtacgtggacgtaatggcccccaatggctttccgcaccaacatgcatacacggatgagcccctgagcacgcacaaagtacggcactttaattaggccagcctggaggagacccagcatggcgtat

SEQ ID NO: 390635 - DNA, 140 bp, Artificial Sequence
  Synthetic
atacgccatgctgggtctccgtgcaactgctcaatatacccaggtcatgtctcaggacatcgtatggcttgggatatgatgatgaactggtcccccgcaatcgggctagtgatatcacaccgtacttgggagtcggccat

SEQ ID NO: 390636 - DNA, 140 bp, Artificial Sequence
  Synthetic
atggccgactcccaagtacggtgtgatatcactagcccgattgcgggggaccagttcatcatcatatcccaagccatacgatgtcctgagacatgacctgggtatattgagcagttgcacggagacccagcatggcgtat

SEQ ID NO: 390637 - DNA, 140 bp, Artificial Sequence
  Synthetic
atacgccatgctgggtctccaggtcgtcatcgtgctaatcatgttttcaggagtggacgcgacaacacacaccactggtggcagcgcggcccaagccactgccgggtttacaagttttttcgtacttgggagtcggccat

SEQ ID NO: 390638 - DNA, 140 bp, Artificial Sequence
  Synthetic
atggccgactcccaagtacgaaaaaacttgtaaacccggcagtggcttgggccgcgctgccaccagtggtgtgtgttgtcgcgtccactcctgaaaacatgattagcacgatgacgacctggagacccagcatggcgtat

SEQ ID NO: 390639 - DNA, 140 bp, Artificial Sequence
  Synthetic
atacgccatgctgggtctcctttatagcgggcctcttctactatcacaaattcaactcctcggggtgccctgagcgaatgtccagctgtaagcccatcacatatttcaatcaggggtgggcgtacttgggagtcggccat

SEQ ID NO: 390640 - DNA, 140 bp, Artificial Sequence
  Synthetic
atggccgactcccaagtacgcccacccctgattgaaatatgtgatgggcttacagctggacattcgctcagggcaccccgaggagttgaatttgtgatagtagaagaggcccgctataaaggagacccagcatggcgtat

SEQ ID NO: 390641 - DNA, 140 bp, Artificial Sequence
  Synthetic
aggccctggctgctgatatgggagatggcatcatgcaaaccacctgcccatgtggagcacagatcaccggacatgtcaaaaacggttccatgaggatcgttgggcccaaaacctgtagcagaccttttgggacagcggtg

SEQ ID NO: 390642 - DNA, 140 bp, Artificial Sequence
  Synthetic
caccgctgtcccaaaaggtctgctacaggttttgggcccaacgatcctcatggaaccgtttttgacatgtccggtgatctgtgctccacatgggcaggtggtttgcatgatgccatctcccatatcagcagccagggcct

SEQ ID NO: 390643 - DNA, 140 bp, Artificial Sequence
  Synthetic
atacgccatgctgggtctccctgtgggcccgtctactgctttacaccctcaccggtggtggtgggcaccactgatattaaaggcctgccaacttataggtttggtgtgaacgagtcagatcgtacttgggagtcggccat

SEQ ID NO: 390644 - DNA, 140 bp, Artificial Sequence
  Synthetic
atggccgactcccaagtacgatctgactcgttcacaccaaacctataagttggcaggcctttaatatcagtggtgcccaccaccaccggtgagggtgtaaagcagtagacgggcccacagggagacccagcatggcgtat

SEQ ID NO: 390645 - DNA, 140 bp, Artificial Sequence
  Synthetic
atacgccatgctgggtctccgcaacatctatggggggatgaaggacattgaagcaaatcaaacccaccttaaatgccctaccgattgtttcaggaagcaccatgatgccacgtttacccgcgtacttgggagtcggccat

SEQ ID NO: 390646 - DNA, 140 bp, Artificial Sequence
  Synthetic
atggccgactcccaagtacgcgggtaaacgtggcatcatggtgcttcctgaaacaatcggtagggcatttaaggtgggtttgatttgcttcaatgtccttcatccccccatagatgttgcggagacccagcatggcgtat

SEQ ID NO: 390647 - DNA, 140 bp, Artificial Sequence
  Synthetic
atacgccatgctgggtctccagaatgttcgtaggaggacatgaacatcgattctcagccgcctgcaactggacgaggggagagcgctgtgatcttgaagatcgtgaccgcagtgagcaaccgtacttgggagtcggccat

SEQ ID NO: 390648 - DNA, 140 bp, Artificial Sequence
  Synthetic
atggccgactcccaagtacggttgctcactgcggtcacgatcttcaagatcacagcgctctcccctcgtccagttgcaggcggctgagaatcgatgttcatgtcctcctacgaacattctggagacccagcatggcgtat

SEQ ID NO: 390649 - DNA, 140 bp, Artificial Sequence
  Synthetic
atacgccatgctgggtctcccgtggacgtgcaatacctctatggtgttggttctgccgtagtgggctgggctctcaagtgggagttcgtcgtcctcgtcttcctccttctggcggacgcacgtacttgggagtcggccat

SEQ ID NO: 390650 - DNA, 140 bp, Artificial Sequence
  Synthetic
atggccgactcccaagtacgtgcgtccgccagaaggaggaagacgaggacgacgaactcccacttgagagcccagcccactacggcagaaccaacaccatagaggtattgcacgtccacgggagacccagcatggcgtat

SEQ ID NO: 390651 - DNA, 140 bp, Artificial Sequence
  Synthetic
atacgccatgctgggtctccagggttacgtctggtacctggttgcattctgcgccgcatggcacatccgggggaagctcgttccgctgataacctatggtttgacaggcctgtggcccctcgtacttgggagtcggccat

SEQ ID NO: 390652 - DNA, 140 bp, Artificial Sequence
  Synthetic
atggccgactcccaagtacgaggggccacaggcctgtcaaaccataggttatcagcggaacgagcttcccccggatgtgccatgcggcgcagaatgcaaccaggtaccagacgtaaccctggagacccagcatggcgtat

SEQ ID NO: 390653 - DNA, 140 bp, Artificial Sequence
  Synthetic
atacgccatgctgggtctccaccttatcaccatggtataagcactggattggccgtcttatctggtggaaccagtatgccatatgcaggggtgaggccgccttgcaagtatgggtccccccgtacttgggagtcggccat

SEQ ID NO: 390654 - DNA, 140 bp, Artificial Sequence
  Synthetic
atggccgactcccaagtacggggggacccatacttgcaaggcggcctcacccctgcatatggcatactggttccaccagataagacggccaatccagtgcttataccatggtgataaggtggagacccagcatggcgtat

SEQ ID NO: 390655 - DNA, 140 bp, Artificial Sequence
  Synthetic
atacgccatgctgggtctcctgggccactgtatttaatacaagccgcactcaccagcaccccctactttgtccgcgcccacgtgttgattcgtatctgcatgttggtgcgctctgcaatgcgtacttgggagtcggccat

SEQ ID NO: 390656 - DNA, 140 bp, Artificial Sequence
  Synthetic
atggccgactcccaagtacgcattgcagagcgcaccaacatgcagatacgaatcaacacgtgggcgcggacaaagtagggggtgctggtgagtgcggcttgtattaaatacagtggcccaggagacccagcatggcgtat

SEQ ID NO: 390657 - DNA, 140 bp, Artificial Sequence
  Synthetic
atacgccatgctgggtctccgtctcaaaggactggcggtggccacggagcccgtcatctttagtcctatggagattaaggttatcacctggggtgcagacacagcagcctgcggagacatcgtacttgggagtcggccat

SEQ ID NO: 390658 - DNA, 140 bp, Artificial Sequence
  Synthetic
atggccgactcccaagtacgatgtctccgcaggctgctgtgtctgcaccccaggtgataaccttaatctccataggactaaagatgacgggctccgtggccaccgccagtcctttgagacggagacccagcatggcgtat

SEQ ID NO: 390659 - DNA, 140 bp, Artificial Sequence
  Synthetic
atacgccatgctgggtctcctcagcatacgcccagcaaactcggggactatttggaactattgtcaccagcctgacaggtagggataagaacgtggtgactggtgaggtgcaggtgctgtcgtacttgggagtcggccat

SEQ ID NO: 390660 - DNA, 140 bp, Artificial Sequence
  Synthetic
atggccgactcccaagtacgacagcacctgcacctcaccagtcaccacgttcttatccctacctgtcaggctggtgacaatagttccaaatagtccccgagtttgctgggcgtatgctgaggagacccagcatggcgtat

SEQ ID NO: 390661 - DNA, 140 bp, Artificial Sequence
  Synthetic
atacgccatgctgggtctcccgcgcttcaaatgtacaccaatgtggaccaggacctggtaggttggccagcgcctgcggggaccaagtcccttgacccctgcacgtgcggttcttccgaccgtacttgggagtcggccat

SEQ ID NO: 390662 - DNA, 140 bp, Artificial Sequence
  Synthetic
atggccgactcccaagtacggtcggaagaaccgcacgtgcaggggtcaagggacttggtccccgcaggcgctggccaacctaccaggtcctggtccacattggtgtacatttgaagcgcgggagacccagcatggcgtat

SEQ ID NO: 390663 - DNA, 140 bp, Artificial Sequence
  Synthetic
atacgccatgctgggtctccgttcttctgggggtcctgtcatgtgcccttcggggcacgtggtggggatcttcagggcggcagtgtgcaccagaggtgtcgcaaaagccctgcagttcatcgtacttgggagtcggccat

SEQ ID NO: 390664 - DNA, 140 bp, Artificial Sequence
  Synthetic
atggccgactcccaagtacgatgaactgcagggcttttgcgacacctctggtgcacactgccgccctgaagatccccaccacgtgccccgaagggcacatgacaggacccccagaagaacggagacccagcatggcgtat

SEQ ID NO: 390665 - DNA, 140 bp, Artificial Sequence
  Synthetic
atacgccatgctgggtctcccgatgccatcctgcacactccggggtgtgtcccttgcgttcgcgagggtaacgcctcgaggtgttgggtggcggtgacccccacggtggccaccagggaccgtacttgggagtcggccat

SEQ ID NO: 390666 - DNA, 140 bp, Artificial Sequence
  Synthetic
atggccgactcccaagtacggtccctggtggccaccgtgggggtcaccgccacccaacacctcgaggcgttaccctcgcgaacgcaagggacacaccccggagtgtgcaggatggcatcgggagacccagcatggcgtat

SEQ ID NO: 390667 - DNA, 140 bp, Artificial Sequence
  Synthetic
atacgccatgctgggtctccgcccccactggaagcggcaaaagcaccaaagtccccgccgcttatgttgcacagggatattctgtcctagtgctaaatccatcggtagcggctaccctggcgtacttgggagtcggccat

SEQ ID NO: 390668 - DNA, 140 bp, Artificial Sequence
  Synthetic
atggccgactcccaagtacgccagggtagccgctaccgatggatttagcactaggacagaatatccctgtgcaacataagcggcggggactttggtgcttttgccgcttccagtgggggcggagacccagcatggcgtat

SEQ ID NO: 390669 - DNA, 140 bp, Artificial Sequence
  Synthetic
atacgccatgctgggtctcccggcaagttcctcgccgatgggggttgttctggaggcgcctatgacgtgatcatctgcgatgaatgtcacgcgcaagacgctacctccatactgggtatacgtacttgggagtcggccat

SEQ ID NO: 390670 - DNA, 140 bp, Artificial Sequence
  Synthetic
atggccgactcccaagtacgtatacccagtatggaggtagcgtcttgcgcgtgacattcatcgcagatgatcacgtcataggcgcctccagaacaacccccatcggcgaggaacttgccgggagacccagcatggcgtat

SEQ ID NO: 390671 - DNA, 140 bp, Artificial Sequence
  Synthetic
aggccctggctgctgatatgtatggtggcttcagtatttcctgaccagagtagaagcgcaactgcacgtgtgggttccccccctcaacgtccgaggggggcgtgatgctgtcatcctactgaccttttgggacagcggtg

SEQ ID NO: 390672 - DNA, 140 bp, Artificial Sequence
  Synthetic
caccgctgtcccaaaaggtcagtaggatgacagcatcacgcccccctcggacgttgagggggggaacccacacgtgcagttgcgcttctactctggtcaggaaatactgaagccaccatacatatcagcagccagggcct

SEQ ID NO: 390673 - DNA, 140 bp, Artificial Sequence
  Synthetic
atacgccatgctgggtctccaggaggtgggcctcaccagtgacggagaaatccccttttatggcaaagccctcccactggcaatgatcaagggaggaagacaccttgtattctgccattccgtacttgggagtcggccat

SEQ ID NO: 390674 - DNA, 140 bp, Artificial Sequence
  Synthetic
atggccgactcccaagtacggaatggcagaatacaaggtgtcttcctcccttgatcattgccagtgggagggctttgccataaaaggggatttctccgtcactggtgaggcccacctcctggagacccagcatggcgtat

SEQ ID NO: 390675 - DNA, 140 bp, Artificial Sequence
  Synthetic
atacgccatgctgggtctccacaccggctggatagcagggcttttctattacaacaaattcaactcttcaggctgtcccgagaggttggccagttgccgacccctcaccgactttgcccacgtacttgggagtcggccat

SEQ ID NO: 390676 - DNA, 140 bp, Artificial Sequence
  Synthetic
atggccgactcccaagtacgtgggcaaagtcggtgaggggtcggcaactggccaacctctcgggacagcctgaagagttgaatttgttgtaatagaaaagccctgctatccagccggtgtggagacccagcatggcgtat

SEQ ID NO: 390677 - DNA, 140 bp, Artificial Sequence
  Synthetic
atacgccatgctgggtctccggagacgtggtagtatgtgctactgatgccctcatgaccggatatacaggggattttgacaccgttatagactgtaacgtggctgtggagcagtacgtcgcgtacttgggagtcggccat

SEQ ID NO: 390678 - DNA, 140 bp, Artificial Sequence
  Synthetic
atggccgactcccaagtacgcgacgtactgctccacagccacgttacagtctataacggtgtcaaaatcccctgtatatccggtcatgagggcatcagtagcacatactaccacgtctccggagacccagcatggcgtat

SEQ ID NO: 390679 - DNA, 140 bp, Artificial Sequence
  Synthetic
atacgccatgctgggtctccgggaatataccggtttgtcactccaggggagcggccgtccggcatgtttgactcggtggtgctatgtgagtgctatgacgcaggttgttcctggtatgaccgtacttgggagtcggccat

SEQ ID NO: 390680 - DNA, 140 bp, Artificial Sequence
  Synthetic
atggccgactcccaagtacggtcataccaggaacaacctgcgtcatagcactcacatagcaccaccgagtcaaacatgccggacggccgctcccctggagtgacaaaccggtatattcccggagacccagcatggcgtat

SEQ ID NO: 390681 - DNA, 140 bp, Artificial Sequence
  Synthetic
atacgccatgctgggtctccccggactgactcatatagatgcccacttcttgtcacaggcaaaacagcagggcctaaactttgcatacttggtggcatatcaagccactgtctgcgctcgcgtacttgggagtcggccat

SEQ ID NO: 390682 - DNA, 140 bp, Artificial Sequence
  Synthetic
atggccgactcccaagtacgcgagcgcagacagtggcttgatatgccaccaagtatgcaaagtttaggccctgctgttttgcctgtgacaagaagtgggcatctatatgagtcagtccggggagacccagcatggcgtat

SEQ ID NO: 390683 - DNA, 140 bp, Artificial Sequence
  Synthetic
aggccctggctgctgatatggccatcatcctcctcacgtgcgtgatccacccagagctaatcttcaccatcaccaaaatcttgctcgccatactcggtccgctcatggtgctccaggctggaccttttgggacagcggtg

SEQ ID NO: 390684 - DNA, 140 bp, Artificial Sequence
  Synthetic
caccgctgtcccaaaaggtccagcctggagcaccatgagcggaccgagtatggcgagcaagattttggtgatggtgaagattagctctgggtggatcacgcacgtgaggaggatgatggccatatcagcagccagggcct

SEQ ID NO: 390685 - DNA, 140 bp, Artificial Sequence
  Synthetic
atacgccatgctgggtctccgcaattcaaaatgacatctgcatgacacaccctattaccaagtacatcatggcttgcatgtcagctgacttggaagtcaccacgagcgcctgggtgctggcgtacttgggagtcggccat

SEQ ID NO: 390686 - DNA, 140 bp, Artificial Sequence
  Synthetic
atggccgactcccaagtacgccagcacccaggcgctcgtggtgacttccaagtcagctgacatgcaagccatgatgtacttggtaatagggtgtgtcatgcagatgtcattttgaattgcggagacccagcatggcgtat

SEQ ID NO: 390687 - DNA, 140 bp, Artificial Sequence
  Synthetic
atacgccatgctgggtctcctgacagacaagtactgtaccaacaatatgatgagatggaagaatgttcccagtctgctccttacatcgagcaagcacaggctatcgctcagcaattcaagcgtacttgggagtcggccat

SEQ ID NO: 390688 - DNA, 140 bp, Artificial Sequence
  Synthetic
atggccgactcccaagtacgcttgaattgctgagcgatagcctgtgcttgctcgatgtaaggagcagactgggaacattcttccatctcatcatattgttggtacagtacttgtctgtcaggagacccagcatggcgtat

SEQ ID NO: 390689 - DNA, 140 bp, Artificial Sequence
  Synthetic
atacgccatgctgggtctccagcacatgtggaactttgtgagcgggatccagtacctggccggtctctccacactgccaggcaaccctgccgtggcttcccttatggccttcaccgcctccgtacttgggagtcggccat

SEQ ID NO: 390690 - DNA, 140 bp, Artificial Sequence
  Synthetic
atggccgactcccaagtacggaggcggtgaaggccataagggaagccacggcagggttgcctggcagtgtggagagaccggccaggtactggatcccgctcacaaagttccacatgtgctggagacccagcatggcgtat

SEQ ID NO: 390691 - DNA, 140 bp, Artificial Sequence
  Synthetic
atacgccatgctgggtctccgtggtaagcggcttggctggcgccgctgtgggaggcataggcattggcagggtgttgcttgacgtgcttgccgggtatggggctggggtctccggcgccccgtacttgggagtcggccat

SEQ ID NO: 390692 - DNA, 140 bp, Artificial Sequence
  Synthetic
atggccgactcccaagtacggggcgccggagaccccagccccatacccggcaagcacgtcaagcaacaccctgccaatgcctatgcctcccacagcggcgccagccaagccgcttaccacggagacccagcatggcgtat

SEQ ID NO: 390693 - DNA, 140 bp, Artificial Sequence
  Synthetic
atacgccatgctgggtctccaaaatccagcttgtgaacaccaacggcagctggcacatcaacaggactgcactgaactgcaatgactcccttcaaactggattccttgccgcgctgttctcgtacttgggagtcggccat

SEQ ID NO: 390694 - DNA, 140 bp, Artificial Sequence
  Synthetic
atggccgactcccaagtacgagaacagcgcggcaaggaatccagtttgaagggagtcattgcagttcagtgcagtcctgttgatgtgccagctgccgttggtgttcacaagctggattttggagacccagcatggcgtat

SEQ ID NO: 390695 - DNA, 140 bp, Artificial Sequence
  Synthetic
atacgccatgctgggtctcccgccccattgacgagttcgctcaggggtggggtcccatcagttacgctgagcctagcagctcggaccagaggccctactgttggcactacgctcctcagccgtacttgggagtcggccat

SEQ ID NO: 390696 - DNA, 140 bp, Artificial Sequence
  Synthetic
atggccgactcccaagtacggctgaggagcgtagtgccaacagtagggcctctggtccgagctgctaggctcagcgtaactgatgggaccccacccctgagcgaactcgtcaatggggcgggagacccagcatggcgtat

SEQ ID NO: 390697 - DNA, 140 bp, Artificial Sequence
  Synthetic
atacgccatgctgggtctccggatcaacgaggactatcctagtccctgcaacggtgactggttacatgacatctgggactgggtctgtatcgtacttagtgactttaagacctggctttccgtacttgggagtcggccat

SEQ ID NO: 390698 - DNA, 140 bp, Artificial Sequence
  Synthetic
atggccgactcccaagtacggaaagccaggtcttaaagtcactaagtacgatacagacccagtcccagatgtcatgtaaccagtcaccgttgcagggactaggatagtcctcgttgatccggagacccagcatggcgtat

SEQ ID NO: 390699 - DNA, 140 bp, Artificial Sequence
  Synthetic
aggccctggctgctgatatgcttacaccaaatgtggctcggggccttggttgacacctaggtgcatggttgactacccatacaggctttggcactacccctgcactgtcaactttaccatgaccttttgggacagcggtg

SEQ ID NO: 390700 - DNA, 140 bp, Artificial Sequence
  Synthetic
caccgctgtcccaaaaggtcatggtaaagttgacagtgcaggggtagtgccaaagcctgtatgggtagtcaaccatgcacctaggtgtcaaccaaggccccgagccacatttggtgtaagcatatcagcagccagggcct

SEQ ID NO: 390701 - DNA, 140 bp, Artificial Sequence
  Synthetic
atacgccatgctgggtctccgggggatactcattacgtggtgggggccacgaacgacggcctaaaaatcccatgccaggtgccagcgccagagttcttcaccgagttagacggagtgaggcgtacttgggagtcggccat

SEQ ID NO: 390702 - DNA, 140 bp, Artificial Sequence
  Synthetic
atggccgactcccaagtacgcctcactccgtctaactcggtgaagaactctggcgctggcacctggcatgggatttttaggccgtcgttcgtggcccccaccacgtaatgagtatcccccggagacccagcatggcgtat

SEQ ID NO: 390703 - DNA, 140 bp, Artificial Sequence
  Synthetic
aggccctggctgctgatatgctgctggcactaccccccaaaaccttgtggtattgtgcccgcaaagaacgtgtgtggcccggtatactgtttcactcccagccccgtggtggtgggaacggaccttttgggacagcggtg

SEQ ID NO: 390704 - DNA, 140 bp, Artificial Sequence
  Synthetic
caccgctgtcccaaaaggtccgttcccaccaccacggggctgggagtgaaacagtataccgggccacacacgttctttgcgggcacaataccacaaggttttggggggtagtgccagcagcatatcagcagccagggcct

SEQ ID NO: 390705 - DNA, 140 bp, Artificial Sequence
  Synthetic
atacgccatgctgggtctccaacccgagccggacgtcgcagtgttaacctcgatgttgcgagatcctgctcacatcaccgccgccacagcggcccggcgccttgcgcgcggttcacctcccgtacttgggagtcggccat

SEQ ID NO: 390706 - DNA, 140 bp, Artificial Sequence
  Synthetic
atggccgactcccaagtacgggaggtgaaccgcgcgcaaggcgccgggccgctgtggcggcggtgatgtgagcaggatctcgcaacatcgaggttaacactgcgacgtccggctcgggttggagacccagcatggcgtat

SEQ ID NO: 390707 - DNA, 140 bp, Artificial Sequence
  Synthetic
atacgccatgctgggtctccaaccttctatggaggcaagagatgggtagcaatatcactcgggtagagtccgagacgaaggtggtgatccttgactctttcgagcccctgagggccgaagcgtacttgggagtcggccat

SEQ ID NO: 390708 - DNA, 140 bp, Artificial Sequence
  Synthetic
atggccgactcccaagtacgcttcggccctcaggggctcgaaagagtcaaggatcaccaccttcgtctcggactctacccgagtgatattgctacccatctcttgcctccatagaaggttggagacccagcatggcgtat

SEQ ID NO: 390709 - DNA, 140 bp, Artificial Sequence
  Synthetic
atacgccatgctgggtctcctttgctcccttcatggaaggacccaacctacgagccgcccgcagttcacgggtgtgccttgccaccaactcgtcccgcaccagtgcctcccccccgcagacgtacttgggagtcggccat

SEQ ID NO: 390710 - DNA, 140 bp, Artificial Sequence
  Synthetic
atggccgactcccaagtacgtctgcgggggggaggcactggtgcgggacgagttggtggcaaggcacacccgtgaactgcgggcggctcgtaggttgggtccttccatgaagggagcaaaggagacccagcatggcgtat

SEQ ID NO: 390711 - DNA, 140 bp, Artificial Sequence
  Synthetic
atacgccatgctgggtctcccctcctcaggagtaggtacagaatccaccgctgagtccggtgactcgcccgaaactggcgaagaatcggacgtggagtcatattcgtccatgccgcccctcgtacttgggagtcggccat

SEQ ID NO: 390712 - DNA, 140 bp, Artificial Sequence
  Synthetic
atggccgactcccaagtacgaggggcggcatggacgaatatgactccacgtccgattcttcgccagtttcgggcgagtcaccggactcagcggtggattctgtacctactcctgaggaggggagacccagcatggcgtat

SEQ ID NO: 390713 - DNA, 140 bp, Artificial Sequence
  Synthetic
atacgccatgctgggtctcctggactggcgccataataacaccatgcagcgccgaggaggaaaaactacctatcagtccactcagcaactcgttgctgagacaccacaatcttgtctactcgtacttgggagtcggccat

SEQ ID NO: 390714 - DNA, 140 bp, Artificial Sequence
  Synthetic
atggccgactcccaagtacgagtagacaagattgtggtgtctcagcaacgagttgctgagtggactgataggtagtttttcctcctcggcgctgcatggtgttattatggcgccagtccaggagacccagcatggcgtat

SEQ ID NO: 390715 - DNA, 140 bp, Artificial Sequence
  Synthetic
atacgccatgctgggtctccggagcgagcatctggggtgaagggtcgcctgctctctttcgaggaagcatgctctcttgtccccccccactccggccggtcgaagtacgggtatagtgcacgtacttgggagtcggccat

SEQ ID NO: 390716 - DNA, 140 bp, Artificial Sequence
  Synthetic
atggccgactcccaagtacgtgcactatacccgtacttcgaccggccggagtggggggggacaagagagcatgcttcctcgaaagagagcaggcgacccttcaccccagatgctcgctccggagacccagcatggcgtat

SEQ ID NO: 390717 - DNA, 140 bp, Artificial Sequence
  Synthetic
atacgccatgctgggtctcctggcgaagaacgaggtgtttagcgtgaaccccgcgaaggggggccgcaaacctgcccgtctcatcgtctatcctgatctgggggtgcgggtctgtgagaacgtacttgggagtcggccat

SEQ ID NO: 390718 - DNA, 140 bp, Artificial Sequence
  Synthetic
atggccgactcccaagtacgttctcacagacccgcacccccagatcaggatagacgatgagacgggcaggtttgcggccccccttcgcggggttcacgctaaacacctcgttcttcgccaggagacccagcatggcgtat

SEQ ID NO: 390719 - DNA, 140 bp, Artificial Sequence
  Synthetic
atacgccatgctgggtctccaagatgtggacgtcgaagaagacccccttagggttttcatacgacactcgttgctttgactctactgtcaccgaacatgacatcaggacggaggaggggacgtacttgggagtcggccat

SEQ ID NO: 390720 - DNA, 140 bp, Artificial Sequence
  Synthetic
atggccgactcccaagtacgtcccctcctccgtcctgatgtcatgttcggtgacagtagagtcaaagcaacgagtgtcgtatgaaaaccctaagggggtcttcttcgacgtccacatcttggagacccagcatggcgtat

SEQ ID NO: 390721 - DNA, 140 bp, Artificial Sequence
  Synthetic
aggccctggctgctgatatggacgggggagacggcggccaaccaagctcggggtattgcgaacctcttctcacttggggcatctcagaagatccagcttgtgaacaccaacggcagctgggaccttttgggacagcggtg

SEQ ID NO: 390722 - DNA, 140 bp, Artificial Sequence
  Synthetic
caccgctgtcccaaaaggtcccagctgccgttggtgttcacaagctggatcttctgagatgccccaagtgagaagaggttcgcaataccccgagcttggttggccgccgtctcccccgtccatatcagcagccagggcct

SEQ ID NO: 390723 - DNA, 140 bp, Artificial Sequence
  Synthetic
atacgccatgctgggtctccccaatgcggttatcgccgctgccgcgctagcggcgtcttgcctaccagctttggcaacacaataacctgttacatcaaggccaccgcagccagcagagctcgtacttgggagtcggccat

SEQ ID NO: 390724 - DNA, 140 bp, Artificial Sequence
  Synthetic
atggccgactcccaagtacgagctctgctggctgcggtggccttgatgtaacaggttattgtgttgccaaagctggtaggcaagacgccgctagcgcggcagcggcgataaccgcattggggagacccagcatggcgtat

SEQ ID NO: 390725 - DNA, 140 bp, Artificial Sequence
  Synthetic
aggccctggctgctgatatggcactacgcacctcgaccgtgtggtattgtacccgcgtcgcaggtgtgtggtccagtgtattgcttcaccccaagccctgttgtggtggggacgaccgatgaccttttgggacagcggtg

SEQ ID NO: 390726 - DNA, 140 bp, Artificial Sequence
  Synthetic
caccgctgtcccaaaaggtcatcggtcgtccccaccacaacagggcttggggtgaagcaatacactggaccacacacctgcgacgcgggtacaataccacacggtcgaggtgcgtagtgccatatcagcagccagggcct

SEQ ID NO: 390727 - DNA, 140 bp, Artificial Sequence
  Synthetic
atacgccatgctgggtctcctcacggaggccatgaccagatattctgctccccctggagacgccccacagcccacctacgacttggagctgatttcatcttgctcctcaaacgtctccgtcgtacttgggagtcggccat

SEQ ID NO: 390728 - DNA, 140 bp, Artificial Sequence
  Synthetic
atggccgactcccaagtacgacggagacgtttgaggagcaagatgaaatcagctccaagtcgtaggtgggctgtggggcgtctccagggggagcagaatatctggtcatggcctccgtgaggagacccagcatggcgtat

SEQ ID NO: 390729 - DNA, 140 bp, Artificial Sequence
  Synthetic
atacgccatgctgggtctccaactcctggttgggaaatatcatcatgttcgcccctaccatttgggtccgcatggtgttgataacccacttcttttccatactgcaagcccaggagcagccgtacttgggagtcggccat

SEQ ID NO: 390730 - DNA, 140 bp, Artificial Sequence
  Synthetic
atggccgactcccaagtacggctgctcctgggcttgcagtatggaaaagaagtgggttatcaacaccatgcggacccaaatggtaggggcgaacatgatgatatttcccaaccaggagttggagacccagcatggcgtat

SEQ ID NO: 390731 - DNA, 140 bp, Artificial Sequence
  Synthetic
atacgccatgctgggtctccctcgcttcacggttactctccaactgagctcaacagagtggcgggggctctcagaaagcttgggatcccccccctacgagcgtggagacatcgggcacgacgtacttgggagtcggccat

SEQ ID NO: 390732 - DNA, 140 bp, Artificial Sequence
  Synthetic
atggccgactcccaagtacgtcgtgcccgatgtctccacgctcgtaggggggggatcccaagctttctgagagcccccgccactctgttgagctcagttggagagtaaccgtgaagcgagggagacccagcatggcgtat

SEQ ID NO: 390733 - DNA, 140 bp, Artificial Sequence
  Synthetic
aggccctggctgctgatatgtcagaaagcttgggatcccccccctacgagcgtggagacatcgggcacgagcagtacgcgccaaactcattgcccaaggaggaaaggccagaatatgcgggaccttttgggacagcggtg

SEQ ID NO: 390734 - DNA, 140 bp, Artificial Sequence
  Synthetic
caccgctgtcccaaaaggtcccgcatattctggcctttcctccttgggcaatgagtttggcgcgtactgctcgtgcccgatgtctccacgctcgtaggggggggatcccaagctttctgacatatcagcagccagggcct

SEQ ID NO: 390735 - DNA, 140 bp, Artificial Sequence
  Synthetic
aggccctggctgctgatatgggggcaggatgggcatctacaggtttgtgactccaggagagcggccctcgggcatgttcgattcctcggtcctatgtgagtgctatgacgcgggctgtgcgaccttttgggacagcggtg

SEQ ID NO: 390736 - DNA, 140 bp, Artificial Sequence
  Synthetic
caccgctgtcccaaaaggtcgcacagcccgcgtcatagcactcacataggaccgaggaatcgaacatgcccgagggccgctctcctggagtcacaaacctgtagatgcccatcctgcccccatatcagcagccagggcct

SEQ ID NO: 390737 - DNA, 140 bp, Artificial Sequence
  Synthetic
aggccctggctgctgatatgccacatccgctccgtgtggaaggacttgctggaagacactgagacaccaattgacaccaccatcatggcaaagaatgaggttttctgcgtccaaccagaggaccttttgggacagcggtg

SEQ ID NO: 390738 - DNA, 140 bp, Artificial Sequence
  Synthetic
caccgctgtcccaaaaggtcctctggttggacgcagaaaacctcattctttgccatgatggtggtgtcaattggtgtctcagtgtcttccagcaagtccttccacacggagcggatgtggcatatcagcagccagggcct

SEQ ID NO: 390739 - DNA, 140 bp, Artificial Sequence
  Synthetic
aggccctggctgctgatatgtcaacaccaacggcagttggcacatcaatagaacggccttgaactgcaatgatagccttaacaccggctggatagcagggctcttctatcaccacagattgaccttttgggacagcggtg

SEQ ID NO: 390740 - DNA, 140 bp, Artificial Sequence
  Synthetic
caccgctgtcccaaaaggtcaatctgtggtgatagaagagccctgctatccagccggtgttaaggctatcattgcagttcaaggccgttctattgatgtgccaactgccgttggtgttgacatatcagcagccagggcct

SEQ ID NO: 390741 - DNA, 140 bp, Artificial Sequence
  Synthetic
aggccctggctgctgatatggcggtctttataggtctggcactcttgaccttgtcaccacactataaagttttcctcgcccggctcatatggtggtcacaatacttcattaccagagccggaccttttgggacagcggtg

SEQ ID NO: 390742 - DNA, 140 bp, Artificial Sequence
  Synthetic
caccgctgtcccaaaaggtccggctctggtaatgaagtattgtgaccaccatatgagccgggcgaggaaaactttatagtgtggtgacaaggtcaagagtgccagacctataaagaccgccatatcagcagccagggcct

SEQ ID NO: 390743 - DNA, 140 bp, Artificial Sequence
  Synthetic
atacgccatgctgggtctcctcctaaaccacaaagaataaccaaaagaaacatcaaccgccggccacaggacgttaagttcccaggcggcggtcagatcgttggtggagtttacgtactacgtacttgggagtcggccat

SEQ ID NO: 390744 - DNA, 140 bp, Artificial Sequence
  Synthetic
atggccgactcccaagtacgtagtacgtaaactccaccaacgatctgaccgccgcctgggaacttaacgtcctgtggccggcggttgatgtttcttttggttattctttgtggtttaggaggagacccagcatggcgtat

SEQ ID NO: 390745 - DNA, 140 bp, Artificial Sequence
  Synthetic
aggccctggctgctgatatgcggaggctgctgctcccgtggtggagtccaagtggcgcgcccttgaggccttctgggcgaagcacatgtggaacttcatcagcgggatacagtacttagcgaccttttgggacagcggtg

SEQ ID NO: 390746 - DNA, 140 bp, Artificial Sequence
  Synthetic
caccgctgtcccaaaaggtcgctaagtactgtatcccgctgatgaagttccacatgtgcttcgcccagaaggcctcaagggcgcgccacttggactccaccacgggagcagcagcctccgcatatcagcagccagggcct

SEQ ID NO: 390747 - DNA, 140 bp, Artificial Sequence
  Synthetic
aggccctggctgctgatatgccctgcccatttgggcgcggccggactacaaccccccgctattggagacgtggaaaaagcctgactacgaaccacctgtggtccatggctgtccgcttccgaccttttgggacagcggtg

SEQ ID NO: 390748 - DNA, 140 bp, Artificial Sequence
  Synthetic
caccgctgtcccaaaaggtcggaagcggacagccatggaccacaggtggttcgtagtcaggctttttccacgtctccaatagcggggggttgtagtccggccgcgcccaaatgggcagggcatatcagcagccagggcct

SEQ ID NO: 390749 - DNA, 140 bp, Artificial Sequence
  Synthetic
aggccctggctgctgatatgttcggccttcgtgggcgccggcatcgctggcgctgctgttggcagcataggccttgggaaggtgcttgtggacatcctggcgggttatggagcaggggtggaccttttgggacagcggtg

SEQ ID NO: 390750 - DNA, 140 bp, Artificial Sequence
  Synthetic
caccgctgtcccaaaaggtccacccctgctccataacccgccaggatgtccacaagcaccttcccaaggcctatgctgccaacagcagcgccagcgatgccggcgcccacgaaggccgaacatatcagcagccagggcct

SEQ ID NO: 390751 - DNA, 140 bp, Artificial Sequence
  Synthetic
atacgccatgctgggtctcctccacttgcctggctgtatcccctgcgtgcgcttaaacaatgcatcaaaatgctggacccctgtaagccctaccgtcgccgtgagtcgccctggcgccgccgtacttgggagtcggccat

SEQ ID NO: 390752 - DNA, 140 bp, Artificial Sequence
  Synthetic
atggccgactcccaagtacggcggcgccagggcgactcacggcgacggtagggcttacaggggtccagcattttgatgcattgtttaagcgcacgcaggggatacagccaggcaagtggaggagacccagcatggcgtat

SEQ ID NO: 390753 - DNA, 140 bp, Artificial Sequence
  Synthetic
atacgccatgctgggtctccgggcaggggttctcatggagacatcgccagcattggactgtccaggattgcaactgttcgatctaccctggacatttgacaggccatcgtatggcttgggcgtacttgggagtcggccat

SEQ ID NO: 390754 - DNA, 140 bp, Artificial Sequence
  Synthetic
atggccgactcccaagtacgcccaagccatacgatggcctgtcaaatgtccagggtagatcgaacagttgcaatcctggacagtccaatgctggcgatgtctccatgagaacccctgcccggagacccagcatggcgtat

SEQ ID NO: 390755 - DNA, 140 bp, Artificial Sequence
  Synthetic
atacgccatgctgggtctcccgtgatggccggtgtggcttactactccatgcaagggaattgggccaaggtgtttctcgtgttatgtctattctccggagtggacgctagcacgacgatacgtacttgggagtcggccat

SEQ ID NO: 390756 - DNA, 140 bp, Artificial Sequence
  Synthetic
atggccgactcccaagtacgtatcgtcgtgctagcgtccactccggagaatagacataacacgagaaacaccttggcccaattcccttgcatggagtagtaagccacaccggccatcacgggagacccagcatggcgtat

SEQ ID NO: 390757 - DNA, 140 bp, Artificial Sequence
  Synthetic
atacgccatgctgggtctccacataaaccgcacggccctgaattgcaatgattccctaaacaccgggtttattgcgggtttgctctactaccacaagttcaattcatcagggtgtgtcgacgtacttgggagtcggccat

SEQ ID NO: 390758 - DNA, 140 bp, Artificial Sequence
  Synthetic
atggccgactcccaagtacgtcgacacaccctgatgaattgaacttgtggtagtagagcaaacccgcaataaacccggtgtttagggaatcattgcaattcagggccgtgcggtttatgtggagacccagcatggcgtat

SEQ ID NO: 390759 - DNA, 140 bp, Artificial Sequence
  Synthetic
atacgccatgctgggtctcctggcattatgcacctagaccttgcgacactgtccccgctcaaagtgtttgtggccctgtctactgtttcaccccttcgcccgttgtggtgggagcgactgcgtacttgggagtcggccat

SEQ ID NO: 390760 - DNA, 140 bp, Artificial Sequence
  Synthetic
atggccgactcccaagtacgcagtcgctcccaccacaacgggcgaaggggtgaaacagtagacagggccacaaacactttgagcggggacagtgtcgcaaggtctaggtgcataatgccaggagacccagcatggcgtat

SEQ ID NO: 390761 - DNA, 140 bp, Artificial Sequence
  Synthetic
atacgccatgctgggtctccgtggatgaacggctcggggtatgtcaagacatgtggtgcccccccctgtcacatctacggagggcgggaaggcaagtccaacaacagtctcgtctgtccccgtacttgggagtcggccat

SEQ ID NO: 390762 - DNA, 140 bp, Artificial Sequence
  Synthetic
atggccgactcccaagtacggggacagacgagactgttgttggacttgccttcccgccctccgtagatgtgacaggggggggcaccacatgtcttgacataccccgagccgttcatccacggagacccagcatggcgtat

SEQ ID NO: 390763 - DNA, 140 bp, Artificial Sequence
  Synthetic
atacgccatgctgggtctccggcactatccctgtaccgtgaattacaccatcttcaaggtcaggatgttcgttggcggattggaacatcgttttaacgccgcctgcaactggactagaggcgtacttgggagtcggccat

SEQ ID NO: 390764 - DNA, 140 bp, Artificial Sequence
  Synthetic
atggccgactcccaagtacgcctctagtccagttgcaggcggcgttaaaacgatgttccaatccgccaacgaacatcctgaccttgaagatggtgtaattcacggtacagggatagtgccggagacccagcatggcgtat

SEQ ID NO: 390765 - DNA, 140 bp, Artificial Sequence
  Synthetic
aggccctggctgctgatatgcccttgcaagcccttgttgcgggaggaggtatcattcagagtaggactccacgagtacccggtggggtcgcaactaccttgcgagcccgaaccggacgtggaccttttgggacagcggtg

SEQ ID NO: 390766 - DNA, 140 bp, Artificial Sequence
  Synthetic
caccgctgtcccaaaaggtccacgtccggttcgggctcgcaaggtagttgcgaccccaccgggtactcgtggagtcctactctgaatgatacctcctcccgcaacaagggcttgcaagggcatatcagcagccagggcct

SEQ ID NO: 390767 - DNA, 140 bp, Artificial Sequence
  Synthetic
atacgccatgctgggtctcccccgccctatcaacaggtctcatacatctccaccaaaatatcgtggatgttcaatacctgtacggaattagttcaggtctggtgggctgggcaatcaagtcgtacttgggagtcggccat

SEQ ID NO: 390768 - DNA, 140 bp, Artificial Sequence
  Synthetic
atggccgactcccaagtacgacttgattgcccagcccaccagacctgaactaattccgtacaggtattgaacatccacgatattttggtggagatgtatgagacctgttgatagggcgggggagacccagcatggcgtat

SEQ ID NO: 390769 - DNA, 140 bp, Artificial Sequence
  Synthetic
atacgccatgctgggtctccgaatttgattgtcctgaacgccatctccgctgcgggcacacatgggatctggtggtcccttgttgccttttgcgttgcttggcacgttcggggcaggatacgtacttgggagtcggccat

SEQ ID NO: 390770 - DNA, 140 bp, Artificial Sequence
  Synthetic
atggccgactcccaagtacgtatcctgccccgaacgtgccaagcaacgcaaaaggcaacaagggaccaccagatcccatgtgtgcccgcagcggagatggcgttcaggacaatcaaattcggagacccagcatggcgtat

SEQ ID NO: 390771 - DNA, 140 bp, Artificial Sequence
  Synthetic
atacgccatgctgggtctccccaccttgggtgccggagtgctgagcttgtttgcccttttcaccttgtccccctggtataagcattggatagcccgccttatctggtggaaccagtacaccgtacttgggagtcggccat

SEQ ID NO: 390772 - DNA, 140 bp, Artificial Sequence
  Synthetic
atggccgactcccaagtacggtgtactggttccaccagataaggcgggctatccaatgcttataccagggggacaaggtgaaaagggcaaacaagctcagcactccggcacccaaggtggggagacccagcatggcgtat

SEQ ID NO: 390773 - DNA, 140 bp, Artificial Sequence
  Synthetic
aggccctggctgctgatatgttaagttcccgggcggcggccagatcgttggtggagtttacttgttgccgcgcaggggccctagattgggtgtgcgcgcgacgaggaagacttccgagcggaccttttgggacagcggtg

SEQ ID NO: 390774 - DNA, 140 bp, Artificial Sequence
  Synthetic
caccgctgtcccaaaaggtccgctcggaagtcttcctcgtcgcgcgcacacccaatctagggcccctgcgcggcaacaagtaaactccaccaacgatctggccgccgcccgggaacttaacatatcagcagccagggcct

SEQ ID NO: 390775 - DNA, 140 bp, Artificial Sequence
  Synthetic
atacgccatgctgggtctccgctctagtctttgacatcactaagctcttgttagcaatactagggcctctttacatcctacaagccagccttgttcgcgtcccctactttgtgcgggccccgtacttgggagtcggccat

SEQ ID NO: 390776 - DNA, 140 bp, Artificial Sequence
  Synthetic
atggccgactcccaagtacggggcccgcacaaagtaggggacgcgaacaaggctggcttgtaggatgtaaagaggccctagtattgctaacaagagcttagtgatgtcaaagactagagcggagacccagcatggcgtat

SEQ ID NO: 390777 - DNA, 140 bp, Artificial Sequence
  Synthetic
atacgccatgctgggtctccatatgaccatctttcacccatgactgattgggcggctgagggcttgaaagacctagccgtggccgtcgagcccgtcatcttcagtcctatggaggttaagcgtacttgggagtcggccat

SEQ ID NO: 390778 - DNA, 140 bp, Artificial Sequence
  Synthetic
atggccgactcccaagtacgcttaacctccataggactgaagatgacgggctcgacggccacggctaggtctttcaagccctcagccgcccaatcagtcatgggtgaaagatggtcatatggagacccagcatggcgtat

SEQ ID NO: 390779 - DNA, 140 bp, Artificial Sequence
  Synthetic
atacgccatgctgggtctccatgattaccgctccatggggtggaggttgctggcgccgataacagctcacgcgcagcaaaccagaggcctattcggcacgattgtcaccagtctcactggcgtacttgggagtcggccat

SEQ ID NO: 390780 - DNA, 140 bp, Artificial Sequence
  Synthetic
atggccgactcccaagtacgccagtgagactggtgacaatcgtgccgaataggcctctggtttgctgcgcgtgagctgttatcggcgccagcaacctccaccccatggagcggtaatcatggagacccagcatggcgtat

SEQ ID NO: 390781 - DNA, 140 bp, Artificial Sequence
  Synthetic
atacgccatgctgggtctcccacggagctggttctaggacattagctggtaataagagaccagctctgcaaatgtacaccaacgtagaccaggacttggtcggctggccctctccacccgcgtacttgggagtcggccat

SEQ ID NO: 390782 - DNA, 140 bp, Artificial Sequence
  Synthetic
atggccgactcccaagtacgcgggtggagagggccagccgaccaagtcctggtctacgttggtgtacatttgcagagctggtctcttattaccagctaatgtcctagaaccagctccgtgggagacccagcatggcgtat

SEQ ID NO: 390783 - DNA, 140 bp, Artificial Sequence
  Synthetic
atacgccatgctgggtctccggctagcttgctcagtcctagacccctagcatgcttgaaaggctcttcgggcggtcccatcatgtgcccctctggtcatgtcgccggcatcttcagagcacgtacttgggagtcggccat

SEQ ID NO: 390784 - DNA, 140 bp, Artificial Sequence
  Synthetic
atggccgactcccaagtacgtgctctgaagatgccggcgacatgaccagaggggcacatgatgggaccgcccgaagagcctttcaagcatgctaggggtctaggactgagcaagctagccggagacccagcatggcgtat

SEQ ID NO: 390785 - DNA, 140 bp, Artificial Sequence
  Synthetic
atacgccatgctgggtctcccaccagcagtgccgcaaactttccaagtgggttatctccatgcgcccaccggcagcggtgagagtacaaaagtgcccgccagctatgtggctcaagggtacgtacttgggagtcggccat

SEQ ID NO: 390786 - DNA, 140 bp, Artificial Sequence
  Synthetic
atggccgactcccaagtacgtacccttgagccacatagctggcgggcacttttgtactctcaccgctgccggtgggcgcatggagataacccacttggaaagtttgcggcactgctggtgggagacccagcatggcgtat

SEQ ID NO: 390787 - DNA, 140 bp, Artificial Sequence
  Synthetic
atacgccatgctgggtctcccgcaccataaccaccggcgcaaagctcacatactcaacatatgggaagtttctagccgatggggggtgttcgggcggtgcttatgatgtcatcatttgtgcgtacttgggagtcggccat

SEQ ID NO: 390788 - DNA, 140 bp, Artificial Sequence
  Synthetic
atggccgactcccaagtacgcacaaatgatgacatcataagcaccgcccgaacaccccccatcggctagaaacttcccatatgttgagtatgtgagctttgcgccggtggttatggtgcgggagacccagcatggcgtat

SEQ ID NO: 390789 - DNA, 140 bp, Artificial Sequence
  Synthetic
atacgccatgctgggtctccaaccccgcctggtagtatcactgtcccacactctaacatcgaggaggtggctcttaccggggaaggggaaatccccttttacggcagggctatacccttacgtacttgggagtcggccat

SEQ ID NO: 390790 - DNA, 140 bp, Artificial Sequence
  Synthetic
atggccgactcccaagtacgtaagggtatagccctgccgtaaaaggggatttccccttccccggtaagagccacctcctcgatgttagagtgtgggacagtgatactaccaggcggggttggagacccagcatggcgtat

SEQ ID NO: 390791 - DNA, 140 bp, Artificial Sequence
  Synthetic
atacgccatgctgggtctcccattttacaggggtcttgatgtgtccgtgataccaacacaaggagatgtcgtggtgtgtgccactgacgctctcataactgggtacacgggggacttcgacgtacttgggagtcggccat

SEQ ID NO: 390792 - DNA, 140 bp, Artificial Sequence
  Synthetic
atggccgactcccaagtacgtcgaagtcccccgtgtacccagttatgagagcgtcagtggcacacaccacgacatctccttgtgttggtatcacggacacatcaagacccctgtaaaatgggagacccagcatggcgtat

SEQ ID NO: 390793 - DNA, 140 bp, Artificial Sequence
  Synthetic
aggccctggctgctgatatgcggactacgtccctccagtggtacacgggtgcccattgccgcctaccaaggcccctccaataccacctccacggaggaagaggacggttgtcctgacagagaccttttgggacagcggtg

SEQ ID NO: 390794 - DNA, 140 bp, Artificial Sequence
  Synthetic
caccgctgtcccaaaaggtctctgtcaggacaaccgtcctcttcctccgtggaggtggtattggaggggccttggtaggcggcaatgggcacccgtgtaccactggagggacgtagtccgcatatcagcagccagggcct

SEQ ID NO: 390795 - DNA, 140 bp, Artificial Sequence
  Synthetic
atacgccatgctgggtctcctccagaagtcagagaaggggccgcaccggtcgaggcaaaagtggcacttatcgctacgtctcgcccggtgaacggccgtcaggaatgtttgactccgtggcgtacttgggagtcggccat

SEQ ID NO: 390796 - DNA, 140 bp, Artificial Sequence
  Synthetic
atggccgactcccaagtacgccacggagtcaaacattcctgacggccgttcaccgggcgagacgtagcgataagtgccacttttgcctcgaccggtgcggccccttctctgacttctggaggagacccagcatggcgtat

SEQ ID NO: 390797 - DNA, 140 bp, Artificial Sequence
  Synthetic
aggccctggctgctgatatgcatgccccccctcgagggggagccgggggaccccgatctcagcgacgggtcttggtctaccgtgagcgaggaggctagtgaggatgtcgtctgctgctcagaccttttgggacagcggtg

SEQ ID NO: 390798 - DNA, 140 bp, Artificial Sequence
  Synthetic
caccgctgtcccaaaaggtctgagcagcagacgacatcctcactagcctcctcgctcacggtagaccaagacccgtcgctgagatcggggtcccccggctccccctcgagggggggcatgcatatcagcagccagggcct

SEQ ID NO: 390799 - DNA, 140 bp, Artificial Sequence
  Synthetic
atacgccatgctgggtctcccgtctgccaagaccatctggagttctgggaaggtgtatttactggattgacccacatagatgcccacttcctatctcaaacaaaacaacagggcctgaatcgtacttgggagtcggccat

SEQ ID NO: 390800 - DNA, 140 bp, Artificial Sequence
  Synthetic
atggccgactcccaagtacgattcaggccctgttgttttgtttgagataggaagtgggcatctatgtgggtcaatccagtaaatacaccttcccagaactccagatggtcttggcagacgggagacccagcatggcgtat

SEQ ID NO: 390801 - DNA, 140 bp, Artificial Sequence
  Synthetic
atacgccatgctgggtctcccaactctgcacgggcccacacccctcctttacaggctgggagctgtgcaaaatgagatctgcacgactcacccggttacaaaatacattgcaacttgtatcgtacttgggagtcggccat

SEQ ID NO: 390802 - DNA, 140 bp, Artificial Sequence
  Synthetic
atggccgactcccaagtacgatacaagttgcaatgtattttgtaaccgggtgagtcgtgcagatctcattttgcacagctcccagcctgtaaaggaggggtgtgggcccgtgcagagttgggagacccagcatggcgtat

SEQ ID NO: 390803 - DNA, 140 bp, Artificial Sequence
  Synthetic
atacgccatgctgggtctccgtaggtcacctggtactaggggggaagcctgctcttgtcccagacaaagaagtgctataccagcagtatgatgagatggaagaatgttctcgagcggctccgtacttgggagtcggccat

SEQ ID NO: 390804 - DNA, 140 bp, Artificial Sequence
  Synthetic
atggccgactcccaagtacggagccgctcgagaacattcttccatctcatcatactgctggtatagcacttctttgtctgggacaagagcaggcttcccccctagtaccaggtgacctacggagacccagcatggcgtat

SEQ ID NO: 390805 - DNA, 140 bp, Artificial Sequence
  Synthetic
atacgccatgctgggtctcccagaaaatccaacttataaacaccaacggcagctggcacatcaacaggactgccctgaactgcaatgactcccttcagactgggttcatcgccgcgctgtcgtacttgggagtcggccat

SEQ ID NO: 390806 - DNA, 140 bp, Artificial Sequence
  Synthetic
atggccgactcccaagtacgacagcgcggcgatgaacccagtctgaagggagtcattgcagttcagggcagtcctgttgatgtgccagctgccgttggtgtttataagttggattttctgggagacccagcatggcgtat

SEQ ID NO: 390807 - DNA, 140 bp, Artificial Sequence
  Synthetic
atacgccatgctgggtctccagctacaccgtattggcaaaagttggagaccttttggagcaaacacatgtggaactttgtcagcgggattcaatacttggccggattgtccaccttaccccgtacttgggagtcggccat

SEQ ID NO: 390808 - DNA, 140 bp, Artificial Sequence
  Synthetic
atggccgactcccaagtacggggtaaggtggacaatccggccaagtattgaatcccgctgacaaagttccacatgtgtttgctccaaaaggtctccaacttttgccaatacggtgtagctggagacccagcatggcgtat

SEQ ID NO: 390809 - DNA, 140 bp, Artificial Sequence
  Synthetic
atacgccatgctgggtctcctggccagtaatttggcacccccccctgcctccaccgcatttgtggtgagcggcttggccggtgccgctgtaggaagcatcggcctgggcaaggtcttactcgtacttgggagtcggccat

SEQ ID NO: 390810 - DNA, 140 bp, Artificial Sequence
  Synthetic
atggccgactcccaagtacgagtaagaccttgcccaggccgatgcttcctacagcggcaccggccaagccgctcaccacaaatgcggtggaggcaggggggggtgccaaattactggccaggagacccagcatggcgtat

SEQ ID NO: 390811 - DNA, 140 bp, Artificial Sequence
  Synthetic
atacgccatgctgggtctccttgcctgccatcttatcccccggtgctctagtggttggcgtgatctgcgcagctattctgcgccggcacgttggacccggggagggtgcagtacaatggacgtacttgggagtcggccat

SEQ ID NO: 390812 - DNA, 140 bp, Artificial Sequence
  Synthetic
atggccgactcccaagtacgtccattgtactgcaccctccccgggtccaacgtgccggcgcagaatagctgcgcagatcacgccaaccactagagcaccgggggataagatggcaggcaaggagacccagcatggcgtat

SEQ ID NO: 390813 - DNA, 140 bp, Artificial Sequence
  Synthetic
aggccctggctgctgatatgcatcttcaaggttaggatgtatgtggggggcgtggaacacaggctcaacgccgcatgcaactggactcgaggagagcgttgtgacttggaggacagggatgaccttttgggacagcggtg

SEQ ID NO: 390814 - DNA, 140 bp, Artificial Sequence
  Synthetic
caccgctgtcccaaaaggtcatccctgtcctccaagtcacaacgctctcctcgagtccagttgcatgcggcgttgagcctgtgttccacgccccccacatacatcctaaccttgaagatgcatatcagcagccagggcct

SEQ ID NO: 390815 - DNA, 140 bp, Artificial Sequence
  Synthetic
atacgccatgctgggtctccctctttgaccgttacacagctcctccgccggctccaccagtggatcaacgaagactatcccactccttgcgatgggaattggctttatgacatttggaatcgtacttgggagtcggccat

SEQ ID NO: 390816 - DNA, 140 bp, Artificial Sequence
  Synthetic
atggccgactcccaagtacgattccaaatgtcataaagccaattcccatcgcaaggagtgggatagtcttcgttgatccactggtggagccggcggaggagctgtgtaacggtcaaagagggagacccagcatggcgtat

SEQ ID NO: 390817 - DNA, 140 bp, Artificial Sequence
  Synthetic
aggccctggctgctgatatgtccatcagaacatcgtggacgtgcaatacctgtacggtgtagggtcggcggttgtctcccttgtaatcaaatgggagtacgtcgtgttgctcttcctcctgaccttttgggacagcggtg

SEQ ID NO: 390818 - DNA, 140 bp, Artificial Sequence
  Synthetic
caccgctgtcccaaaaggtcaggaggaagagcaacacgacgtactcccatttgattacaagggagacaaccgccgaccctacaccgtacaggtattgcacgtccacgatgttctgatggacatatcagcagccagggcct

SEQ ID NO: 390819 - DNA, 140 bp, Artificial Sequence
  Synthetic
atacgccatgctgggtctccggggtacttggcgaggcgatggagtcgtgtctacgcgctgcccttgcggagccctcctctctggtcacgtgaagaacgggactatgagacttgtaggtcccgtacttgggagtcggccat

SEQ ID NO: 390820 - DNA, 140 bp, Artificial Sequence
  Synthetic
atggccgactcccaagtacgggacctacaagtctcatagtcccgttcttcacgtgaccagagaggagggctccgcaagggcagcgcgtagacacgactccatcgcctcgccaagtaccccggagacccagcatggcgtat

SEQ ID NO: 390821 - DNA, 140 bp, Artificial Sequence
  Synthetic
aggccctggctgctgatatggcttccaggtggcccacctgcatgctcccaccggcagcggcaagagcaccaaggtcccggccgcgtacgcggctcagggctacaaggtgctggtactcaagaccttttgggacagcggtg

SEQ ID NO: 390822 - DNA, 140 bp, Artificial Sequence
  Synthetic
caccgctgtcccaaaaggtcttgagtaccagcaccttgtagccctgagccgcgtacgcggccgggaccttggtgctcttgccgctgccggtgggagcatgcaggtgggccacctggaagccatatcagcagccagggcct

SEQ ID NO: 390823 - DNA, 140 bp, Artificial Sequence
  Synthetic
atacgccatgctgggtctcctggcgggtagcttctgacagctacgtcgaggtacgcaaagtgggggacttccactatgtcacagggacgaccgatgacgggttgaaatgcccgtgtcaggcgtacttgggagtcggccat

SEQ ID NO: 390824 - DNA, 140 bp, Artificial Sequence
  Synthetic
atggccgactcccaagtacgcctgacacgggcatttcaacccgtcatcggtcgtccctgtgacatagtggaagtcccccactttgcgtacctcgacgtagctgtcagaagctacccgccaggagacccagcatggcgtat

SEQ ID NO: 390825 - DNA, 140 bp, Artificial Sequence
  Synthetic
atacgccatgctgggtctcctcatatggtggttgcagtatttcatcaccagagccgaggcgcatttacgagtgtggatcccccctctcgacgttcgggggggtcgcgatgccgtcatcttcgtacttgggagtcggccat

SEQ ID NO: 390826 - DNA, 140 bp, Artificial Sequence
  Synthetic
atggccgactcccaagtacgaagatgacggcatcgcgacccccccgaacgtcgagaggggggatccacactcgtaaatgcgcctcggctctggtgatgaaatactgcaaccaccatatgaggagacccagcatggcgtat

SEQ ID NO: 390827 - DNA, 140 bp, Artificial Sequence
  Synthetic
atacgccatgctgggtctccggggttgaactcctacgtaataggatcgcagctcccctgtgagcctgagccggacgtcgcggtggtgacctcaatgctgcaagatccatcgcacataactcgtacttgggagtcggccat

SEQ ID NO: 390828 - DNA, 140 bp, Artificial Sequence
  Synthetic
atggccgactcccaagtacgagttatgtgcgatggatcttgcagcattgaggtcaccaccgcgacgtccggctcaggctcacaggggagctgcgatcctattacgtaggagttcaaccccggagacccagcatggcgtat

SEQ ID NO: 390829 - DNA, 140 bp, Artificial Sequence
  Synthetic
aggccctggctgctgatatggtgccgtacttcgtgcgcgctcaagggctcattcgtgcatgcatgttggtgcggaaagtcgctgggggtcattatgtccaaatggctttcatgaggctgggaccttttgggacagcggtg

SEQ ID NO: 390830 - DNA, 140 bp, Artificial Sequence
  Synthetic
caccgctgtcccaaaaggtcccagcctcatgaaagccatttggacataatgacccccagcgactttccgcaccaacatgcatgcacgaatgagcccttgagcgcgcacgaagtacggcaccatatcagcagccagggcct

SEQ ID NO: 390831 - DNA, 140 bp, Artificial Sequence
  Synthetic
atacgccatgctgggtctccctacgcacggacggcatccagacgctgagcttatcactgccaatttgttgtggaggcaagagatgggtagtaacatcacgcgggtggagtccgagtccaacgtacttgggagtcggccat

SEQ ID NO: 390832 - DNA, 140 bp, Artificial Sequence
  Synthetic
atggccgactcccaagtacgttggactcggactccacccgcgtgatgttactacccatctcttgcctccacaacaaattggcagtgataagctcagcgtctggatgccgtccgtgcgtagggagacccagcatggcgtat

SEQ ID NO: 390833 - DNA, 140 bp, Artificial Sequence
  Synthetic
atacgccatgctgggtctccccggcccttcccatttgggccagaccggactacaacccaccattggtggaaccatggaaagaccccgactatgtgccgcccaccgtgcatgggtgtgcatcgtacttgggagtcggccat

SEQ ID NO: 390834 - DNA, 140 bp, Artificial Sequence
  Synthetic
atggccgactcccaagtacgatgcacacccatgcacggtgggcggcacatagtcggggtctttccatggttccaccaatggtgggttgtagtccggtctggcccaaatgggaagggccggggagacccagcatggcgtat

SEQ ID NO: 390835 - DNA, 140 bp, Artificial Sequence
  Synthetic
atacgccatgctgggtctccgaaaagcttcccgcaaccaacatgttccgcggaggatgagagtacctcaggggtcggcactcaatctggcagcctgaccggtcctgtccaactagatgatcgtacttgggagtcggccat

SEQ ID NO: 390836 - DNA, 140 bp, Artificial Sequence
  Synthetic
atggccgactcccaagtacgatcatctagttggacaggaccggtcaggctgccagattgagtgccgacccctgaggtactctcatcctccgcggaacatgttggttgcgggaagcttttcggagacccagcatggcgtat

SEQ ID NO: 390837 - DNA, 140 bp, Artificial Sequence
  Synthetic
aggccctggctgctgatatgcggcgtgtgttggactgtctatcatggtgccggctcaaagaccctagccggcccaaagggcccagtcacccaaatgtacaccaatgtagaccaggacctcgaccttttgggacagcggtg

SEQ ID NO: 390838 - DNA, 140 bp, Artificial Sequence
  Synthetic
caccgctgtcccaaaaggtcgaggtcctggtctacattggtgtacatttgggtgactgggccctttgggccggctagggtctttgagccggcaccatgatagacagtccaacacacgccgcatatcagcagccagggcct

SEQ ID NO: 390839 - DNA, 140 bp, Artificial Sequence
  Synthetic
aggccctggctgctgatatggttaggggcgcttactggcacctatgtttacaaccacctcactcctcttcgagactgggcgcacaacggcctgcgagatctggccgtggctgtggagccagaccttttgggacagcggtg

SEQ ID NO: 390840 - DNA, 140 bp, Artificial Sequence
  Synthetic
caccgctgtcccaaaaggtctggctccacagccacggccagatctcgcaggccgttgtgcgcccagtctcgaagaggagtgaggtggttgtaaacataggtgccagtaagcgcccctaaccatatcagcagccagggcct

SEQ ID NO: 390841 - DNA, 140 bp, Artificial Sequence
  Synthetic
atacgccatgctgggtctccaagagcagagtgtggtgtgttgttccatgtcctactcctggacgggggcactcatcacgccatgtgccgctgaggaagaaaagctccccatcagtccactcgtacttgggagtcggccat

SEQ ID NO: 390842 - DNA, 140 bp, Artificial Sequence
  Synthetic
atggccgactcccaagtacgagtggactgatggggagcttttcttcctcagcggcacatggcgtgatgagtgcccccgtccaggagtaggacatggaacaacacaccacactctgctcttggagacccagcatggcgtat

SEQ ID NO: 390843 - DNA, 140 bp, Artificial Sequence
  Synthetic
aggccctggctgctgatatgtggacatggtggcgggggcccactggggagtcctggcgggccttgcctactattccatggcggggaactgggctaaggttttgattgtgatgctacttttgaccttttgggacagcggtg

SEQ ID NO: 390844 - DNA, 140 bp, Artificial Sequence
  Synthetic
caccgctgtcccaaaaggtcaaaagtagcatcacaatcaaaaccttagcccagttccccgccatggaatagtaggcaaggcccgccaggactccccagtgggcccccgccaccatgtccacatatcagcagccagggcct

SEQ ID NO: 390845 - DNA, 140 bp, Artificial Sequence
  Synthetic
aggccctggctgctgatatgtattccatggcggggaactgggctaaggttttgattgtgatgctactttttgccggcgtcgacggaaacacctacgcgacaggaggggcgacaggccggagaccttttgggacagcggtg

SEQ ID NO: 390846 - DNA, 140 bp, Artificial Sequence
  Synthetic
caccgctgtcccaaaaggtctccggcctgtcgcccctcctgtcgcgtaggtgtttccgtcgacgccggcaaaaagtagcatcacaatcaaaaccttagcccagttccccgccatggaatacatatcagcagccagggcct

SEQ ID NO: 390847 - DNA, 140 bp, Artificial Sequence
  Synthetic
atacgccatgctgggtctcccttgatgaccactataacactactctgaaggagatcaaggaactagcatctggggtaaaggctgagctgctctctgtagaagaagcgtgccgccttgtcccgtacttgggagtcggccat

SEQ ID NO: 390848 - DNA, 140 bp, Artificial Sequence
  Synthetic
atggccgactcccaagtacgggacaaggcggcacgcttcttctacagagagcagctcagcctttaccccagatgctagttccttgatctccttcagagtagtgttatagtggtcatcaagggagacccagcatggcgtat

SEQ ID NO: 390849 - DNA, 140 bp, Artificial Sequence
  Synthetic
aggccctggctgctgatatggtcttcacggacaactcatctcccccggccgtaccgcagacattccaagtggcccatctacacgctcctactggcagcggcaagagcactaaggtgccgggaccttttgggacagcggtg

SEQ ID NO: 390850 - DNA, 140 bp, Artificial Sequence
  Synthetic
caccgctgtcccaaaaggtcccggcaccttagtgctcttgccgctgccagtaggagcgtgtagatgggccacttggaatgtctgcggtacggccgggggagatgagttgtccgtgaagaccatatcagcagccagggcct

SEQ ID NO: 390851 - DNA, 140 bp, Artificial Sequence
  Synthetic
atacgccatgctgggtctccgctggaagacaacactacacctataccaaccaccatcatggcaaaaaacgaggtctttgctgtggccccccataaggggggtcgtaagccagcccgcctgcgtacttgggagtcggccat

SEQ ID NO: 390852 - DNA, 140 bp, Artificial Sequence
  Synthetic
atggccgactcccaagtacgcaggcgggctggcttacgaccccccttatggggggccacagcaaagacctcgttttttgccatgatggtggttggtataggtgtagtgttgtcttccagcggagacccagcatggcgtat

SEQ ID NO: 390853 - DNA, 140 bp, Artificial Sequence
  Synthetic
atacgccatgctgggtctcccggttcggaccagaggccctattgctggcactacgcacccaaaccgtgtagtgttgtgcccgcgtcgcaggtgtgtggaccagtgtattgcttcaccccacgtacttgggagtcggccat

SEQ ID NO: 390854 - DNA, 140 bp, Artificial Sequence
  Synthetic
atggccgactcccaagtacgtggggtgaagcaatacactggtccacacacctgcgacgcgggcacaacactacacggtttgggtgcgtagtgccagcaatagggcctctggtccgaaccgggagacccagcatggcgtat

SEQ ID NO: 390855 - DNA, 140 bp, Artificial Sequence
  Synthetic
aggccctggctgctgatatggcctatgacatcataatatgtgatgagtgccactcaactgactcgactaccatcttgggcatcggcacagtcctggaccaagcggagacggctggagcgcgaccttttgggacagcggtg

SEQ ID NO: 390856 - DNA, 140 bp, Artificial Sequence
  Synthetic
caccgctgtcccaaaaggtcgcgctccagccgtctccgcttggtccaggactgtgccgatgcccaagatggtagtcgagtcagttgagtggcactcatcacatattatgatgtcataggccatatcagcagccagggcct

SEQ ID NO: 390857 - DNA, 140 bp, Artificial Sequence
  Synthetic
atacgccatgctgggtctcctccaatattcgcccaagcagagggtcgagtatcttcttaagatgtggaactcaaagaagacacctttgggtttctcctatgacacccgctgcttcgactccgtacttgggagtcggccat

SEQ ID NO: 390858 - DNA, 140 bp, Artificial Sequence
  Synthetic
atggccgactcccaagtacggagtcgaagcagcgggtgtcataggagaaacccaaaggtgtcttctttgagttccacatcttaagaagatactcgaccctctgcttgggcgaatattggaggagacccagcatggcgtat

SEQ ID NO: 390859 - DNA, 140 bp, Artificial Sequence
  Synthetic
aggccctggctgctgatatgctatggcaaagccatccccatcgagaccatcaagggggggaggcatctcattttctgccactcaaagaagaagtgtgacgagctcgctgcaaagctgtcggaccttttgggacagcggtg

SEQ ID NO: 390860 - DNA, 140 bp, Artificial Sequence
  Synthetic
caccgctgtcccaaaaggtccgacagctttgcagcgagctcgtcacacttcttctttgagtggcagaaaatgagatgcctcccccccttgatggtctcgatggggatggctttgccatagcatatcagcagccagggcct

SEQ ID NO: 390861 - DNA, 140 bp, Artificial Sequence
  Synthetic
atacgccatgctgggtctccctttactgtggtggccctatgttcaacagcaagggacagcactgcggttaccgccgctgccgtgctagtggggtgctacccactagttttggaaacacagcgtacttgggagtcggccat

SEQ ID NO: 390862 - DNA, 140 bp, Artificial Sequence
  Synthetic
atggccgactcccaagtacgctgtgtttccaaaactagtgggtagcaccccactagcacggcagcggcggtaaccgcagtgctgtcccttgctgttgaacatagggccaccacagtaaagggagacccagcatggcgtat

SEQ ID NO: 390863 - DNA, 140 bp, Artificial Sequence
  Synthetic
atacgccatgctgggtctccagttaggatgtatgtagggggtgtagaacacaggctcaacgccgcgtgcaattggactcggggagagcgctgcaatttggaggacagggatagatcagagcgtacttgggagtcggccat

SEQ ID NO: 390864 - DNA, 140 bp, Artificial Sequence
  Synthetic
atggccgactcccaagtacgctctgatctatccctgtcctccaaattgcagcgctctccccgagtccaattgcacgcggcgttgagcctgtgttctacaccccctacatacatcctaactggagacccagcatggcgtat

SEQ ID NO: 390865 - DNA, 140 bp, Artificial Sequence
  Synthetic
atacgccatgctgggtctcctgcagggatcgatgaggacaaaagtgccttgagagctttcacggaagctatgaccaggtactcagcccctccaggcgacccgcctcagcccacttacgaccgtacttgggagtcggccat

SEQ ID NO: 390866 - DNA, 140 bp, Artificial Sequence
  Synthetic
atggccgactcccaagtacggtcgtaagtgggctgaggcgggtcgcctggaggggctgagtacctggtcatagcttccgtgaaagctctcaaggcacttttgtcctcatcgatccctgcaggagacccagcatggcgtat

SEQ ID NO: 390867 - DNA, 140 bp, Artificial Sequence
  Synthetic
atacgccatgctgggtctcccccgcgcggcctgggagactgcccgccacactccagttaactcctggttgggaaatatcattatgtacgcacctaccatctgggtgcgcatggtgattatcgtacttgggagtcggccat

SEQ ID NO: 390868 - DNA, 140 bp, Artificial Sequence
  Synthetic
atggccgactcccaagtacgataatcaccatgcgcacccagatggtaggtgcgtacataatgatatttcccaaccaggagttaactggagtgtggcgggcagtctcccaggccgcgcgggggagacccagcatggcgtat

SEQ ID NO: 390869 - DNA, 140 bp, Artificial Sequence
  Synthetic
aggccctggctgctgatatggactaagcaggcaggagacaacttcccctacctggtagcataccaggccacagtgtgcgccagggctcaggctccacctccatcgtgggatcaaatgtgggaccttttgggacagcggtg

SEQ ID NO: 390870 - DNA, 140 bp, Artificial Sequence
  Synthetic
caccgctgtcccaaaaggtcccacatttgatcccacgatggaggtggagcctgagccctggcgcacactgtggcctggtatgctaccaggtaggggaagttgtctcctgcctgcttagtccatatcagcagccagggcct

SEQ ID NO: 390871 - DNA, 140 bp, Artificial Sequence
  Synthetic
atacgccatgctgggtctccccagccatcattgaacgactccatggcctaagcgcgttctcactccacagttactctccagttgagctcaatagggtagcaggggctctcaggaaacttgcgtacttgggagtcggccat

SEQ ID NO: 390872 - DNA, 140 bp, Artificial Sequence
  Synthetic
atggccgactcccaagtacgcaagtttcctgagagcccctgctaccctattgagctcaactggagagtaactgtggagtgagaacgcgcttaggccatggagtcgttcaatgatggctggggagacccagcatggcgtat

SEQ ID NO: 390873 - DNA, 140 bp, Artificial Sequence
  Synthetic
atacgccatgctgggtctcccaactgggcagtgcgcacaaaggcaaaactcactccattgcctcaagcgggcctcttggacttgtccaggtggttcactgtaggcgcaggcgggaacgaccgtacttgggagtcggccat

SEQ ID NO: 390874 - DNA, 140 bp, Artificial Sequence
  Synthetic
atggccgactcccaagtacggtcgttcccgcctgcgcctacagtgaaccacctggacaagtccaagaggcccgcttgaggcaatggagtgagttttgcctttgtgcgcactgcccagttgggagacccagcatggcgtat

SEQ ID NO: 390875 - DNA, 140 bp, Artificial Sequence
  Synthetic
atacgccatgctgggtctccatttatcacagcgtgtcacgtgcccgatcccgccatttactccttggcctactcctacttacggtaggggtaggcatcttcctgttaccagcccgataggcgtacttgggagtcggccat

SEQ ID NO: 390876 - DNA, 140 bp, Artificial Sequence
  Synthetic
atggccgactcccaagtacgcctatcgggctggtaacaggaagatgcctacccctaccgtaagtaggagtaggccaaggagtaaatggcgggatcgggcacgtgacacgctgtgataaatggagacccagcatggcgtat

SEQ ID NO: 390877 - DNA, 140 bp, Artificial Sequence
  Synthetic
aggccctggctgctgatatgcgagcaattcaagcagaaggcgctcgggctgctgcaaacggccaccaagcaagcggaggctgctgctcccgtggtggagtccaagtggcaagcccttgaggaccttttgggacagcggtg

SEQ ID NO: 390878 - DNA, 140 bp, Artificial Sequence
  Synthetic
caccgctgtcccaaaaggtcctcaagggcttgccacttggactccaccacgggagcagcagcctccgcttgcttggtggccgtttgcagcagcccgagcgccttctgcttgaattgctcgcatatcagcagccagggcct

SEQ ID NO: 390879 - DNA, 140 bp, Artificial Sequence
  Synthetic
atacgccatgctgggtctcctcgggcctacgggaccttgcggtggcagttgagcccgtcatcttctctagcatggagaccaagatcattacctggggggcagacaccgcggcgtgtggagcgtacttgggagtcggccat

SEQ ID NO: 390880 - DNA, 140 bp, Artificial Sequence
  Synthetic
atggccgactcccaagtacgctccacacgccgcggtgtctgccccccaggtaatgatcttggtctccatgctagagaagatgacgggctcaactgccaccgcaaggtcccgtaggcccgaggagacccagcatggcgtat

SEQ ID NO: 390881 - DNA, 140 bp, Artificial Sequence
  Synthetic
aggccctggctgctgatatgtcggaagacttcggagcggtcgcaacctcgtgggagacgccaacctatccccaaggcgcgtcgatccgagggaaggtcctgggcacaaccaggatatccagaccttttgggacagcggtg

SEQ ID NO: 390882 - DNA, 140 bp, Artificial Sequence
  Synthetic
caccgctgtcccaaaaggtctggatatcctggttgtgcccaggaccttccctcggatcgacgcgccttggggataggttggcgtctcccacgaggttgcgaccgctccgaagtcttccgacatatcagcagccagggcct

SEQ ID NO: 390883 - DNA, 140 bp, Artificial Sequence
  Synthetic
atacgccatgctgggtctccctcatgggatacatcccgctcgtgggcgcccccgtaggtggcgtcgccagggccctggcacatggtgtcagggccgtggaagacgggatcaattatgcaacgtacttgggagtcggccat

SEQ ID NO: 390884 - DNA, 140 bp, Artificial Sequence
  Synthetic
atggccgactcccaagtacgttgcataattgatcccgtcttccacggccctgacaccatgtgccagggccctggcgacgccacctacgggggcgcccacgagcgggatgtatcccatgagggagacccagcatggcgtat

SEQ ID NO: 390885 - DNA, 140 bp, Artificial Sequence
  Synthetic
aggccctggctgctgatatgccccccctggagggggagcctggggatccggacctcagcgacgggtcgtggtcgacggttagtagtggggctgacacggaggatgtcgtgtgctgctcaagaccttttgggacagcggtg

SEQ ID NO: 390886 - DNA, 140 bp, Artificial Sequence
  Synthetic
caccgctgtcccaaaaggtcttgagcagcacacgacatcctccgtgtcagccccactactaaccgtcgaccacgacccgtcgctgaggtccggatccccaggctccccctccagggggggcatatcagcagccagggcct

SEQ ID NO: 390887 - DNA, 140 bp, Artificial Sequence
  Synthetic
aggccctggctgctgatatggggaatcagtcgcgttgctgggtggctcttactcctaccgtcgcagcgccatacatcggcgcgtcggttgcatctctacggagtcatgtggatctgatgggaccttttgggacagcggtg

SEQ ID NO: 390888 - DNA, 140 bp, Artificial Sequence
  Synthetic
caccgctgtcccaaaaggtcccatcagatccacatgactccgtagagatgcaaccgacgcgccgatgtatggcgctgcgacggtaggagtaagagccacccagcaacgcgactgattccccatatcagcagccagggcct

SEQ ID NO: 390889 - DNA, 140 bp, Artificial Sequence
  Synthetic
aggccctggctgctgatatgacacgctcccaccggcagcggcaagagcactaaggtgccggctgcgtatgcagcccaagggtacaaggtactcgtcctgaacccgtccgtcgccgccaccgaccttttgggacagcggtg

SEQ ID NO: 390890 - DNA, 140 bp, Artificial Sequence
  Synthetic
caccgctgtcccaaaaggtcggtggcggcgacggacgggttcaggacgagtaccttgtacccttgggctgcatacgcagccggcaccttagtgctcttgccgctgccggtgggagcgtgtcatatcagcagccagggcct

SEQ ID NO: 390891 - DNA, 140 bp, Artificial Sequence
  Synthetic
atacgccatgctgggtctcctgggggccactggggtgttctcgtgggagtggcctatttcagcatgcaggctaattgggccaaagtcatcttggtcctattcctctttgcaggggttgatcgtacttgggagtcggccat

SEQ ID NO: 390892 - DNA, 140 bp, Artificial Sequence
  Synthetic
atggccgactcccaagtacgatcaacccctgcaaagaggaataggaccaagatgactttggcccaattagcctgcatgctgaaataggccactcccacgagaacaccccagtggcccccaggagacccagcatggcgtat

SEQ ID NO: 390893 - DNA, 140 bp, Artificial Sequence
  Synthetic
atacgccatgctgggtctcctatgatacccgctgctttgactccacagtcactgagagcgatatccgtacggaggaggcaatctaccagtgttgtgacctggacccccaagcccgcgtggcgtacttgggagtcggccat

SEQ ID NO: 390894 - DNA, 140 bp, Artificial Sequence
  Synthetic
atggccgactcccaagtacgccacgcgggcttgggggtccaggtcacaacactggtagattgcctcctccgtacggatatcgctctcagtgactgtggagtcaaagcagcgggtatcataggagacccagcatggcgtat

SEQ ID NO: 390895 - DNA, 140 bp, Artificial Sequence
  Synthetic
atacgccatgctgggtctccgcaacgggagctggcatataaacaggactgccctcaactgtaatgatagtttaaccactgggttcttagccagcttgttctatgtcaacaaattcaacagcgtacttgggagtcggccat

SEQ ID NO: 390896 - DNA, 140 bp, Artificial Sequence
  Synthetic
atggccgactcccaagtacgctgttgaatttgttgacatagaacaagctggctaagaacccagtggttaaactatcattacagttgagggcagtcctgtttatatgccagctcccgttgcggagacccagcatggcgtat

SEQ ID NO: 390897 - DNA, 140 bp, Artificial Sequence
  Synthetic
atacgccatgctgggtctccctcagggtgccccgaacgactcggaagctgtaagacccttgattcgtttccgcaaggctggggcccacttggggtcgctaacaacatcacaccatctcaccgtacttgggagtcggccat

SEQ ID NO: 390898 - DNA, 140 bp, Artificial Sequence
  Synthetic
atggccgactcccaagtacggtgagatggtgtgatgttgttagcgaccccaagtgggccccagccttgcggaaacgaatcaagggtcttacagcttccgagtcgttcggggcaccctgagggagacccagcatggcgtat

SEQ ID NO: 390899 - DNA, 140 bp, Artificial Sequence
  Synthetic
aggccctggctgctgatatgctgacaatcttaaatgcccgtgccaggtcccatcgcccgaatttttcacagaactggacggggtgcgcctacataggtttgcgcccccttgcaagcccttgaccttttgggacagcggtg

SEQ ID NO: 390900 - DNA, 140 bp, Artificial Sequence
  Synthetic
caccgctgtcccaaaaggtcaagggcttgcaagggggcgcaaacctatgtaggcgcaccccgtccagttctgtgaaaaattcgggcgatgggacctggcacgggcatttaagattgtcagcatatcagcagccagggcct

SEQ ID NO: 390901 - DNA, 140 bp, Artificial Sequence
  Synthetic
atacgccatgctgggtctccgtggttcgggtgcgtgtggatgaacagcactgggtttacaaaagcctgtggtgcccctccatgcgaggttaaggccaataatggttcatcctggcgctgccgtacttgggagtcggccat

SEQ ID NO: 390902 - DNA, 140 bp, Artificial Sequence
  Synthetic
atggccgactcccaagtacggcagcgccaggatgaaccattattggccttaacctcgcatggaggggcaccacaggcttttgtaaacccagtgctgttcatccacacgcacccgaaccacggagacccagcatggcgtat

SEQ ID NO: 390903 - DNA, 140 bp, Artificial Sequence
  Synthetic
aggccctggctgctgatatggatcacattgacgcaccccatcaccaagtacattatggcttgcatgtccgcggacttggaggtcattaccagcacgtgggttctggtggggggtgtcgtggaccttttgggacagcggtg

SEQ ID NO: 390904 - DNA, 140 bp, Artificial Sequence
  Synthetic
caccgctgtcccaaaaggtccacgacaccccccaccagaacccacgtgctggtaatgacctccaagtccgcggacatgcaagccataatgtacttggtgatggggtgcgtcaatgtgatccatatcagcagccagggcct

SEQ ID NO: 390905 - DNA, 140 bp, Artificial Sequence
  Synthetic
atacgccatgctgggtctcctgctcctttccactacaacgtggcagatcctcccctgctctttcaccactctgcctgccctttctaccggcttgatccacctccaccaaaatatcgtggacgtacttgggagtcggccat

SEQ ID NO: 390906 - DNA, 140 bp, Artificial Sequence
  Synthetic
atggccgactcccaagtacgtccacgatattttggtggaggtggatcaagccggtagaaagggcaggcagagtggtgaaagagcaggggaggatctgccacgttgtagtggaaaggagcaggagacccagcatggcgtat

SEQ ID NO: 390907 - DNA, 140 bp, Artificial Sequence
  Synthetic
aggccctggctgctgatatgtctgcttgcctatggatgatgtttatggtatcccaggttgaggcggctctgtgcaatctaattaacatcaatgctgcttcagccgctggcacccacggctgaccttttgggacagcggtg

SEQ ID NO: 390908 - DNA, 140 bp, Artificial Sequence
  Synthetic
caccgctgtcccaaaaggtcagccgtgggtgccagcggctgaagcagcattgatgttaattagattgcacagagccgcctcaacctgggataccataaacatcatccataggcaagcagacatatcagcagccagggcct

SEQ ID NO: 390909 - DNA, 140 bp, Artificial Sequence
  Synthetic
aggccctggctgctgatatgctcccggctgctgctacctatgtggcctgcgggatgtggcccctgcttctcctactcctaatgctgcccgaaagggcttacgcatttgaccaggaggtgggaccttttgggacagcggtg

SEQ ID NO: 390910 - DNA, 140 bp, Artificial Sequence
  Synthetic
caccgctgtcccaaaaggtcccacctcctggtcaaatgcgtaagccctttcgggcagcattaggagtaggagaagcaggggccacatcccgcaggccacataggtagcagcagccgggagcatatcagcagccagggcct

SEQ ID NO: 390911 - DNA, 140 bp, Artificial Sequence
  Synthetic
aggccctggctgctgatatggaacgtccagctgatcaacaccaacggcagttggcacatcaataggacggccttgaactgcaatgatagccttaacaccggctggttagcagggcttttcgaccttttgggacagcggtg

SEQ ID NO: 390912 - DNA, 140 bp, Artificial Sequence
  Synthetic
caccgctgtcccaaaaggtcgaaaagccctgctaaccagccggtgttaaggctatcattgcagttcaaggccgtcctattgatgtgccaactgccgttggtgttgatcagctggacgttccatatcagcagccagggcct

SEQ ID NO: 390913 - DNA, 140 bp, Artificial Sequence
  Synthetic
aggccctggctgctgatatgctttatagctagggccgaggccatgctgcatgtctatgttccatccttcgacgtgcgcgggtctcgcgactcactgatcatccttgctgtcctggcttgcgaccttttgggacagcggtg

SEQ ID NO: 390914 - DNA, 140 bp, Artificial Sequence
  Synthetic
caccgctgtcccaaaaggtcgcaagccaggacagcaaggatgatcagtgagtcgcgagacccgcgcacgtcgaaggatggaacatagacatgcagcatggcctcggccctagctataaagcatatcagcagccagggcct

SEQ ID NO: 390915 - DNA, 140 bp, Artificial Sequence
  Synthetic
aggccctggctgctgatatgacgtgcgcgggtctcgcgactcactgatcatccttgctgtcctggcttgcccacacatggtatttgacatcacaaaacatctcctggccatcttaggaccgaccttttgggacagcggtg

SEQ ID NO: 390916 - DNA, 140 bp, Artificial Sequence
  Synthetic
caccgctgtcccaaaaggtcggtcctaagatggccaggagatgttttgtgatgtcaaataccatgtgtgggcaagccaggacagcaaggatgatcagtgagtcgcgagacccgcgcacgtcatatcagcagccagggcct

SEQ ID NO: 390917 - DNA, 140 bp, Artificial Sequence
  Synthetic
aggccctggctgctgatatggaatcgtcgggcctagaacctgcagcaacacgtggcatggaacattccccatcaacgcgtacaccacgggcccctgcacaccctccccggcgccaaactagaccttttgggacagcggtg

SEQ ID NO: 390918 - DNA, 140 bp, Artificial Sequence
  Synthetic
caccgctgtcccaaaaggtctagtttggcgccggggagggtgtgcaggggcccgtggtgtacgcgttgatggggaatgttccatgccacgtgttgctgcaggttctaggcccgacgattccatatcagcagccagggcct

SEQ ID NO: 390919 - DNA, 140 bp, Artificial Sequence
  Synthetic
aggccctggctgctgatatgttagtcaccaggcatgcagacgtggtgcccgtgcgcaggagaggggacaccaggggagctctcttgagccccaggcccatatccactcttaaggggtcttgaccttttgggacagcggtg

SEQ ID NO: 390920 - DNA, 140 bp, Artificial Sequence
  Synthetic
caccgctgtcccaaaaggtcaagaccccttaagagtggatatgggcctggggctcaagagagctcccctggtgtcccctctcctgcgcacgggcaccacgtctgcatgcctggtgactaacatatcagcagccagggcct

SEQ ID NO: 390921 - DNA, 140 bp, Artificial Sequence
  Synthetic
aggccctggctgctgatatgctggtggtccgctgctgtgccccatgggacacgctgccggcttgttccgcgcggcggtgtgtactcgaggggtagctaaagcggtggactttgtcccggtgaccttttgggacagcggtg

SEQ ID NO: 390922 - DNA, 140 bp, Artificial Sequence
  Synthetic
caccgctgtcccaaaaggtcaccgggacaaagtccaccgctttagctacccctcgagtacacaccgccgcgcggaacaagccggcagcgtgtcccatggggcacagcagcggaccaccagcatatcagcagccagggcct

SEQ ID NO: 390923 - DNA, 140 bp, Artificial Sequence
  Synthetic
aggccctggctgctgatatgactgggcgaaggtcgtggtagtgctgctgctatttgccggcgtcgacgcgaacacccgcgtcaccgggggaatcacagcccgcgccacatctggaattgcgaccttttgggacagcggtg

SEQ ID NO: 390924 - DNA, 140 bp, Artificial Sequence
  Synthetic
caccgctgtcccaaaaggtcgcaattccagatgtggcgcgggctgtgattcccccggtgacgcgggtgttcgcgtcgacgccggcaaatagcagcagcactaccacgaccttcgcccagtcatatcagcagccagggcct

SEQ ID NO: 390925 - DNA, 140 bp, Artificial Sequence
  Synthetic
atacgccatgctgggtctcccacaccggctggctagcggggcttatctatctcaacaagttcaactcttcaggatgtcccgagaggatggccagctgccgacgccttagcgattttgccacgtacttgggagtcggccat

SEQ ID NO: 390926 - DNA, 140 bp, Artificial Sequence
  Synthetic
atggccgactcccaagtacgtggcaaaatcgctaaggcgtcggcagctggccatcctctcgggacatcctgaagagttgaacttgttgagatagataagccccgctagccagccggtgtgggagacccagcatggcgtat

SEQ ID NO: 390927 - DNA, 140 bp, Artificial Sequence
  Synthetic
aggccctggctgctgatatgaggatgtcccgagaggatggccagctgccgacgccttagcgattttgccaagggctggggccccatcagttacgacaacggaagcggccccgacgaacgcgaccttttgggacagcggtg

SEQ ID NO: 390928 - DNA, 140 bp, Artificial Sequence
  Synthetic
caccgctgtcccaaaaggtcgcgttcgtcggggccgcttccgttgtcgtaactgatggggccccagcccttggcaaaatcgctaaggcgtcggcagctggccatcctctcgggacatcctcatatcagcagccagggcct

SEQ ID NO: 390929 - DNA, 140 bp, Artificial Sequence
  Synthetic
atacgccatgctgggtctcccgtccatgtggaacagggctgagcagttctgggcaaaacacatgtggaactttgtcagtgggatccaatacttggccggtctttcaaccttgccgggcaacgtacttgggagtcggccat

SEQ ID NO: 390930 - DNA, 140 bp, Artificial Sequence
  Synthetic
atggccgactcccaagtacgttgcccggcaaggttgaaagaccggccaagtattggatcccactgacaaagttccacatgtgttttgcccagaactgctcagccctgttccacatggacgggagacccagcatggcgtat

SEQ ID NO: 390931 - DNA, 140 bp, Artificial Sequence
  Synthetic
aggccctggctgctgatatgtagcctactacagaggcttagacgtttcggtgattcccacatctggggacgtcgtggtatgcgccacagacgccctcatgacggggtttaccggcgacttgaccttttgggacagcggtg

SEQ ID NO: 390932 - DNA, 140 bp, Artificial Sequence
  Synthetic
caccgctgtcccaaaaggtcaagtcgccggtaaaccccgtcatgagggcgtctgtggcgcataccacgacgtccccagatgtgggaatcaccgaaacgtctaagcctctgtagtaggctacatatcagcagccagggcct

SEQ ID NO: 390933 - DNA, 140 bp, Artificial Sequence
  Synthetic
aggccctggctgctgatatgattatccttgtaccatcaactacaccatatttaagatcaggatgtacgtgggaggggtcgagcacaggctggaagctgcctgcaactggacgcggggcgagaccttttgggacagcggtg

SEQ ID NO: 390934 - DNA, 140 bp, Artificial Sequence
  Synthetic
caccgctgtcccaaaaggtctcgccccgcgtccagttgcaggcagcttccagcctgtgctcgacccctcccacgtacatcctgatcttaaatatggtgtagttgatggtacaaggataatcatatcagcagccagggcct

SEQ ID NO: 390935 - DNA, 140 bp, Artificial Sequence
  Synthetic
aggccctggctgctgatatgtgactcagtgatagactgcaatacatctgtaatacagaccgttgacttcagcttggaccccaccttctccatagagactacaaccgttcctcaggacgcggaccttttgggacagcggtg

SEQ ID NO: 390936 - DNA, 140 bp, Artificial Sequence
  Synthetic
caccgctgtcccaaaaggtccgcgtcctgaggaacggttgtagtctctatggagaaggtggggtccaagctgaagtcaacggtctgtattacagatgtattgcagtctatcactgagtcacatatcagcagccagggcct

SEQ ID NO: 390937 - DNA, 140 bp, Artificial Sequence
  Synthetic
atacgccatgctgggtctccataccggtatgtcaccccgggggagagaccatcgggcatatttgacacttcagtgatctgcgagtgctacgatgctgggtgcgcctggtacgagctgacacgtacttgggagtcggccat

SEQ ID NO: 390938 - DNA, 140 bp, Artificial Sequence
  Synthetic
atggccgactcccaagtacgtgtcagctcgtaccaggcgcacccagcatcgtagcactcgcagatcactgaagtgtcaaatatgcccgatggtctctcccccggggtgacataccggtatggagacccagcatggcgtat

SEQ ID NO: 390939 - DNA, 140 bp, Artificial Sequence
  Synthetic
aggccctggctgctgatatgtcctgtgtgccaagaccacctggagttctgggagagcgtcttcacagggctaacccaaatagacggccatttcctatcccagaccaagcaatcgggtgaggaccttttgggacagcggtg

SEQ ID NO: 390940 - DNA, 140 bp, Artificial Sequence
  Synthetic
caccgctgtcccaaaaggtcctcacccgattgcttggtctgggataggaaatggccgtctatttgggttagccctgtgaagacgctctcccagaactccaggtggtcttggcacacaggacatatcagcagccagggcct

SEQ ID NO: 390941 - DNA, 140 bp, Artificial Sequence
  Synthetic
aggccctggctgctgatatgcctcgtctcccagctgttcaccttctcgcctcgccggcatgagacagtacaggactgcaattgttcaatctatcccggccacgtgacaggtcaccgcatggaccttttgggacagcggtg

SEQ ID NO: 390942 - DNA, 140 bp, Artificial Sequence
  Synthetic
caccgctgtcccaaaaggtccatgcggtgacctgtcacgtggccgggatagattgaacaattgcagtcctgtactgtctcatgccggcgaggcgagaaggtgaacagctgggagacgaggcatatcagcagccagggcct

SEQ ID NO: 390943 - DNA, 140 bp, Artificial Sequence
  Synthetic
aggccctggctgctgatatgacgacgtggtctccacccttcctcaggccgtgatgggctcctcatacggattccagtactctcctggacagcgggtcgagttcctggtgaatgcctggaagaccttttgggacagcggtg

SEQ ID NO: 390944 - DNA, 140 bp, Artificial Sequence
  Synthetic
caccgctgtcccaaaaggtcttccaggcattcaccaggaactcgacccgctgtccaggagagtactggaatccgtatgaggagcccatcacggcctgaggaagggtggagaccacgtcgtcatatcagcagccagggcct

SEQ ID NO: 390945 - DNA, 140 bp, Artificial Sequence
  Synthetic
aggccctggctgctgatatgcatgtcagctgacctcgaggtagtgacgagcacgtgggtcttagtgggcggcgtcctggcagccctagctgcttactgtctttcagtgggcagcgtggtggaccttttgggacagcggtg

SEQ ID NO: 390946 - DNA, 140 bp, Artificial Sequence
  Synthetic
caccgctgtcccaaaaggtccaccacgctgcccactgaaagacagtaagcagctagggctgccaggacgccgcccactaagacccacgtgctcgtcactacctcgaggtcagctgacatgcatatcagcagccagggcct

SEQ ID NO: 390947 - DNA, 140 bp, Artificial Sequence
  Synthetic
aggccctggctgctgatatgactggggtatcctggcgggcatcgcctactattccatggtggggaactgggctaaggttctgattgtgatgttactctttgccggcgttgacggggatacgaccttttgggacagcggtg

SEQ ID NO: 390948 - DNA, 140 bp, Artificial Sequence
  Synthetic
caccgctgtcccaaaaggtcgtatccccgtcaacgccggcaaagagtaacatcacaatcagaaccttagcccagttccccaccatggaatagtaggcgatgcccgccaggataccccagtcatatcagcagccagggcct

SEQ ID NO: 390949 - DNA, 140 bp, Artificial Sequence
  Synthetic
atacgccatgctgggtctcctccttgtctctgggccgtcccagagaatccagcttgtgaacaccaacggcagctggcacatcaacaggactgccctgaactgcaatgactcccttcaaaccgtacttgggagtcggccat

SEQ ID NO: 390950 - DNA, 140 bp, Artificial Sequence
  Synthetic
atggccgactcccaagtacggtttgaagggagtcattgcagttcagggcagtcctgttgatgtgccagctgccgttggtgttcacaagctggattctctgggacggcccagagacaaggaggagacccagcatggcgtat

SEQ ID NO: 390951 - DNA, 140 bp, Artificial Sequence
  Synthetic
aggccctggctgctgatatgagctggcacatcaacaggactgccctgaactgcaatgactcccttcaaactgggttcattactgcgctgttctacaggcacaatatcaactcgataggatgaccttttgggacagcggtg

SEQ ID NO: 390952 - DNA, 140 bp, Artificial Sequence
  Synthetic
caccgctgtcccaaaaggtcatcctatcgagttgatattgtgcctgtagaacagcgcagtaatgaacccagtttgaagggagtcattgcagttcagggcagtcctgttgatgtgccagctcatatcagcagccagggcct

SEQ ID NO: 390953 - DNA, 140 bp, Artificial Sequence
  Synthetic
atacgccatgctgggtctccccaggtaatcctgccattgcttccctcatgtcttttactgctgccgttacaagccccttgaccacccaacaaaccctcctcttcaacatcttggggggatcgtacttgggagtcggccat

SEQ ID NO: 390954 - DNA, 140 bp, Artificial Sequence
  Synthetic
atggccgactcccaagtacgatccccccaagatgttgaagaggagggtttgttgggtggtcaaggggcttgtaacggcagcagtaaaagacatgagggaagcaatggcaggattacctggggagacccagcatggcgtat

SEQ ID NO: 390955 - DNA, 140 bp, Artificial Sequence
  Synthetic
atacgccatgctgggtctccttgctggcactacgcacctcagcagtgcggtatcgtgcccgcggcgcaggtgtgtggtccagtgtactgcttcaccccaagccctgtcgtagtggggacgcgtacttgggagtcggccat

SEQ ID NO: 390956 - DNA, 140 bp, Artificial Sequence
  Synthetic
atggccgactcccaagtacgcgtccccactacgacagggcttggggtgaagcagtacactggaccacacacctgcgccgcgggcacgataccgcactgctgaggtgcgtagtgccagcaaggagacccagcatggcgtat

SEQ ID NO: 390957 - DNA, 140 bp, Artificial Sequence
  Synthetic
atacgccatgctgggtctccgaatggcctccaaggggtggaggttgctggctcccatcacggcatacgctcagcagacaaggggcctcttggggtgtataatcaccagcttgactggacgcgtacttgggagtcggccat

SEQ ID NO: 390958 - DNA, 140 bp, Artificial Sequence
  Synthetic
atggccgactcccaagtacgcgtccagtcaagctggtgattatacaccccaagaggccccttgtctgctgagcgtatgccgtgatgggagccagcaacctccaccccttggaggccattcggagacccagcatggcgtat

SEQ ID NO: 390959 - DNA, 140 bp, Artificial Sequence
  Synthetic
aggccctggctgctgatatgatgaagattgttccactccatgtgccgactcttggctgtgggaggtgtgggattgggtctgcaccgtgctgagtgacttcaagacgtggctaaaagccaagaccttttgggacagcggtg

SEQ ID NO: 390960 - DNA, 140 bp, Artificial Sequence
  Synthetic
caccgctgtcccaaaaggtcttggcttttagccacgtcttgaagtcactcagcacggtgcagacccaatcccacacctcccacagccaagagtcggcacatggagtggaacaatcttcatcatatcagcagccagggcct

SEQ ID NO: 390961 - DNA, 140 bp, Artificial Sequence
  Synthetic
atacgccatgctgggtctccgattgggtctgcaccgtgctgagtgacttcaagacgtggctaaaagccaagctgatgcctctcatgccaggtatccccttcctctcatgccagaggggttcgtacttgggagtcggccat

SEQ ID NO: 390962 - DNA, 140 bp, Artificial Sequence
  Synthetic
atggccgactcccaagtacgaacccctctggcatgagaggaaggggatacctggcatgagaggcatcagcttggcttttagccacgtcttgaagtcactcagcacggtgcagacccaatcggagacccagcatggcgtat

SEQ ID NO: 390963 - DNA, 140 bp, Artificial Sequence
  Synthetic
aggccctggctgctgatatggcctacctacaactggggtaacaatgacacggacgtcctcgtcctcaacaacaccaggccaccgttgggcaattggttcggctgcacctggatgaactcagaccttttgggacagcggtg

SEQ ID NO: 390964 - DNA, 140 bp, Artificial Sequence
  Synthetic
caccgctgtcccaaaaggtctgagttcatccaggtgcagccgaaccaattgcccaacggtggcctggtgttgttgaggacgaggacgtccgtgtcattgttaccccagttgtaggtaggccatatcagcagccagggcct

SEQ ID NO: 390965 - DNA, 140 bp, Artificial Sequence
  Synthetic
atacgccatgctgggtctccggggcagagctggcaggccacatcaagaacggctcgatgagaatcactgggccgaaaacttgcagcaacacatggcatggcaccttccccatcaatgcttcgtacttgggagtcggccat

SEQ ID NO: 390966 - DNA, 140 bp, Artificial Sequence
  Synthetic
atggccgactcccaagtacgaagcattgatggggaaggtgccatgccatgtgttgctgcaagttttcggcccagtgattctcatcgagccgttcttgatgtggcctgccagctctgccccggagacccagcatggcgtat

SEQ ID NO: 390967 - DNA, 140 bp, Artificial Sequence
  Synthetic
aggccctggctgctgatatggccgaaaacttgcagcaacacatggcatggcaccttccccatcaatgcttacaccacgggccccggcgtacccgtcccagcgccaaattacaaatttgcggaccttttgggacagcggtg

SEQ ID NO: 390968 - DNA, 140 bp, Artificial Sequence
  Synthetic
caccgctgtcccaaaaggtccgcaaatttgtaatttggcgctgggacgggtacgccggggcccgtggtgtaagcattgatggggaaggtgccatgccatgtgttgctgcaagttttcggccatatcagcagccagggcct

SEQ ID NO: 390969 - DNA, 140 bp, Artificial Sequence
  Synthetic
aggccctggctgctgatatgggtgggactcaattcgttcgtagtgggatcgcaactcccatgcgagccggagccggacgtggccgtgctgacatccatgttgacagacccatcacacatagaccttttgggacagcggtg

SEQ ID NO: 390970 - DNA, 140 bp, Artificial Sequence
  Synthetic
caccgctgtcccaaaaggtctatgtgtgatgggtctgtcaacatggatgtcagcacggccacgtccggctccggctcgcatgggagttgcgatcccactacgaacgaattgagtcccacccatatcagcagccagggcct

SEQ ID NO: 390971 - DNA, 140 bp, Artificial Sequence
  Synthetic
aggccctggctgctgatatgctggggggagaatgagacggacgtgctgctccttaacaacacgcggccgccgcagggcaactggttcggctgtacatggatgaatagcactgggttcaccgaccttttgggacagcggtg

SEQ ID NO: 390972 - DNA, 140 bp, Artificial Sequence
  Synthetic
caccgctgtcccaaaaggtcggtgaacccagtgctattcatccatgtacagccgaaccagttgccctgcggcggccgcgtgttgttaaggagcagcacgtccgtctcattctccccccagcatatcagcagccagggcct

SEQ ID NO: 390973 - DNA, 140 bp, Artificial Sequence
  Synthetic
atacgccatgctgggtctccccagcaagcaacctcccgtccctcctcccaggagaaagcggacggttcagctcacagagtctgctgtttccactgctttggcagaactggccgcaaagaccgtacttgggagtcggccat

SEQ ID NO: 390974 - DNA, 140 bp, Artificial Sequence
  Synthetic
atggccgactcccaagtacggtctttgcggccagttctgccaaagcagtggaaacagcagactctgtgagctgaaccgtccgctttctcctgggaggagggacgggaggttgcttgctggggagacccagcatggcgtat

SEQ ID NO: 390975 - DNA, 140 bp, Artificial Sequence
  Synthetic
atacgccatgctgggtctccgaacaccaacggcagctggcacatcaacaggactgccctgaactgcaatgaatctctcaacactgggtggctagctgcgctgttctatgcaaacaagttccgtacttgggagtcggccat

SEQ ID NO: 390976 - DNA, 140 bp, Artificial Sequence
  Synthetic
atggccgactcccaagtacggaacttgtttgcatagaacagcgcagctagccacccagtgttgagagattcattgcagttcagggcagtcctgttgatgtgccagctgccgttggtgttcggagacccagcatggcgtat

SEQ ID NO: 390977 - DNA, 140 bp, Artificial Sequence
  Synthetic
aggccctggctgctgatatggacggatcttattcgtcaatgcctccactagagggggagcccggtgacccggacttgacatcagattcttggtccactgttagcggatcagaggacgtcggaccttttgggacagcggtg

SEQ ID NO: 390978 - DNA, 140 bp, Artificial Sequence
  Synthetic
caccgctgtcccaaaaggtccgacgtcctctgatccgctaacagtggaccaagaatctgatgtcaagtccgggtcaccgggctccccctctagtggaggcattgacgaataagatccgtccatatcagcagccagggcct

SEQ ID NO: 390979 - DNA, 140 bp, Artificial Sequence
  Synthetic
aggccctggctgctgatatgcttgcttaccacagaagaagcttgcgacctgacgcccccccactctgccaaatcaaaatttggctatggggcaaaggatgttcgcagccattcccgcaaggaccttttgggacagcggtg

SEQ ID NO: 390980 - DNA, 140 bp, Artificial Sequence
  Synthetic
caccgctgtcccaaaaggtccttgcgggaatggctgcgaacatcctttgccccatagccaaattttgatttggcagagtgggggggcgtcaggtcgcaagcttcttctgtggtaagcaagcatatcagcagccagggcct

SEQ ID NO: 390981 - DNA, 140 bp, Artificial Sequence
  Synthetic
aggccctggctgctgatatgggacatcagggccgaggaagaggtctatcagtgttgtgacctggagcccgcagcccgcaaggttattactgccctcacagaaagactctacgtgggcggcgaccttttgggacagcggtg

SEQ ID NO: 390982 - DNA, 140 bp, Artificial Sequence
  Synthetic
caccgctgtcccaaaaggtcgccgcccacgtagagtctttctgtgagggcagtaataaccttgcgggctgcgggctccaggtcacaacactgatagacctcttcctcggccctgatgtcccatatcagcagccagggcct

SEQ ID NO: 390983 - DNA, 140 bp, Artificial Sequence
  Synthetic
atacgccatgctgggtctcccagcccgcaaggttattactgccctcacagaaagactctacgtgggcggccccatgcacaacagcaagggagacctttgtgggtatcggagatgccgcgccgtacttgggagtcggccat

SEQ ID NO: 390984 - DNA, 140 bp, Artificial Sequence
  Synthetic
atggccgactcccaagtacggcgcggcatctccgatacccacaaaggtctcccttgctgttgtgcatggggccgcccacgtagagtctttctgtgagggcagtaataaccttgcgggctgggagacccagcatggcgtat

SEQ ID NO: 390985 - DNA, 140 bp, Artificial Sequence
  Synthetic
  misc_feature (65)..(65): n is a, c, g, or t
atacgccatgctgggtctccgcttttgtcgtgagcggcctggcgggggcagcagttggcagtgtnggccttggcaagatcctagtggacatcctcgctggctacggcgccggcgtagctgcgtacttgggagtcggccat

SEQ ID NO: 390986 - DNA, 140 bp, Artificial Sequence
  Synthetic
  misc_feature (76)..(76): n is a, c, g, or t
atggccgactcccaagtacgcagctacgccggcgccgtagccagcgaggatgtccactaggatcttgccaaggccnacactgccaactgctgcccccgccaggccgctcacgacaaaagcggagacccagcatggcgtat

SEQ ID NO: 390987 - DNA, 140 bp, Artificial Sequence
  Synthetic
aggccctggctgctgatatgggataaccgagccctccgagccttcacggaggctatgacgagatactcggctcccccaggagacgccccacagccagcatatgacctggaactaataacagaccttttgggacagcggtg

SEQ ID NO: 390988 - DNA, 140 bp, Artificial Sequence
  Synthetic
caccgctgtcccaaaaggtctgttattagttccaggtcatatgctggctgtggggcgtctcctgggggagccgagtatctcgtcatagcctccgtgaaggctcggagggctcggttatcccatatcagcagccagggcct

SEQ ID NO: 390989 - DNA, 140 bp, Artificial Sequence
  Synthetic
atacgccatgctgggtctcctacgctcccacgatatgggtgcgcatggtactgatgacccactttttctcaatactccagagccaggaagcccttgagaaagcactcgacttcgacatgtcgtacttgggagtcggccat

SEQ ID NO: 390990 - DNA, 140 bp, Artificial Sequence
  Synthetic
atggccgactcccaagtacgacatgtcgaagtcgagtgctttctcaagggcttcctggctctggagtattgagaaaaagtgggtcatcagtaccatgcgcacccatatcgtgggagcgtaggagacccagcatggcgtat

SEQ ID NO: 390991 - DNA, 140 bp, Artificial Sequence
  Synthetic
aggccctggctgctgatatgaccaggagttcgatgagatggaagagtgcgcctcgcaccttccttacatcgagcagggaatgcagctcgccgaacaattcaagcagaaggcgctcgggttgaccttttgggacagcggtg

SEQ ID NO: 390992 - DNA, 140 bp, Artificial Sequence
  Synthetic
caccgctgtcccaaaaggtcaacccgagcgccttctgcttgaattgttcggcgagctgcattccctgctcgatgtaaggaaggtgcgaggcgcactcttccatctcatcgaactcctggtcatatcagcagccagggcct

SEQ ID NO: 390993 - DNA, 140 bp, Artificial Sequence
  Synthetic
aggccctggctgctgatatgatcagcgggatacagtacttagcaggcttgtccactctgcctggaaaccccgcgatagcatcactaatggcattcacagcctccatcaccagcccgctcagaccttttgggacagcggtg

SEQ ID NO: 390994 - DNA, 140 bp, Artificial Sequence
  Synthetic
caccgctgtcccaaaaggtctgagcgggctggtgatggaggctgtgaatgccattagtgatgctatcgcggggtttccaggcagagtggacaagcctgctaagtactgtatcccgctgatcatatcagcagccagggcct

SEQ ID NO: 390995 - DNA, 140 bp, Artificial Sequence
  Synthetic
atacgccatgctgggtctcctaccgtcgcagcgccatacatcggcgcgccgcttgagtctctgcggagtcatgtggatctgatggtgggggctgccactgtttgctcagccctttacatccgtacttgggagtcggccat

SEQ ID NO: 390996 - DNA, 140 bp, Artificial Sequence
  Synthetic
atggccgactcccaagtacggatgtaaagggctgagcaaacagtggcagcccccaccatcagatccacatgactccgcagagactcaagcggcgcgccgatgtatggcgctgcgacggtaggagacccagcatggcgtat

SEQ ID NO: 390997 - DNA, 140 bp, Artificial Sequence
  Synthetic
atacgccatgctgggtctcccccttgtagtcggtgtggtctgcgcagcaatactacgccggcacgttggcccgggcgagggagcagtgcagtggatgaaccggttgatagccttcgcctccgtacttgggagtcggccat

SEQ ID NO: 390998 - DNA, 140 bp, Artificial Sequence
  Synthetic
atggccgactcccaagtacggaggcgaaggctatcaaccggttcatccactgcactgctccctcgcccgggccaacgtgccggcgtagtattgctgcgcagaccacaccgactacaagggggagacccagcatggcgtat

SEQ ID NO: 390999 - DNA, 140 bp, Artificial Sequence
  Synthetic
  misc_feature (101)..(101): n is a, c, g, or t
  misc_feature (110)..(110): n is a, c, g, or t
aggccctggctgctgatatgacttcagcatgcaagccaattgggccaaagtcatcttggtcctattcctctttgcaggggttgatgctagaactgatgtgnctgggagcncggctggccggaccttttgggacagcggtg

SEQ ID NO: 391000 - DNA, 140 bp, Artificial Sequence
  Synthetic
  misc_feature (31)..(31): n is a, c, g, or t
  misc_feature (40)..(40): n is a, c, g, or t
caccgctgtcccaaaaggtccggccagccgngctcccagncacatcagttctagcatcaacccctgcaaagaggaataggaccaagatgactttggcccaattggcttgcatgctgaagtcatatcagcagccagggcct

SEQ ID NO: 391001 - DNA, 140 bp, Artificial Sequence
  Synthetic
  misc_feature (35)..(35): n is a, c, g, or t
  misc_feature (47)..(47): n is a, c, g, or t
  misc_feature (118)..(118): n is a, c, g, or t
atacgccatgctgggtctccaactgcaatgacagnttaaacactggnttcttggctagcttgttctacacccacagtttcaacagctcagggtgtcccggacgactcgcaagctgcanaacgtacttgggagtcggccat

SEQ ID NO: 391002 - DNA, 140 bp, Artificial Sequence
  Synthetic
  misc_feature (23)..(23): n is a, c, g, or t
  misc_feature (94)..(94): n is a, c, g, or t
  misc_feature (106)..(106): n is a, c, g, or t
atggccgactcccaagtacgttntgcagcttgcgagtcgtccgggacaccctgagctgttgaaactgtgggtgtagaacaagctagccaagaanccagtgtttaanctgtcattgcagttggagacccagcatggcgtat

SEQ ID NO: 391003 - DNA, 140 bp, Artificial Sequence
  Synthetic
  misc_feature (68)..(68): n is a, c, g, or t
  misc_feature (78)..(78): n is a, c, g, or t
aggccctggctgctgatatgccacagtttcaacagctcagggtgtcccggacgactcgcaagctgcanaagccttganacatttaaccaaggctggggcccacttggggtcgctaacatcgaccttttgggacagcggtg

SEQ ID NO: 391004 - DNA, 140 bp, Artificial Sequence
  Synthetic
  misc_feature (63)..(63): n is a, c, g, or t
  misc_feature (73)..(73): n is a, c, g, or t
caccgctgtcccaaaaggtcgatgttagcgaccccaagtgggccccagccttggttaaatgtntcaaggcttntgcagcttgcgagtcgtccgggacaccctgagctgttgaaactgtggcatatcagcagccagggcct

SEQ ID NO: 391005 - DNA, 140 bp, Artificial Sequence
  Synthetic
aggccctggctgctgatatgctcccagccctgtcgtggtcggaacaactgatcgcctcggggtccctacttacacctggggggagaatgagtctgatgtcttccttttgaactcgaccaggaccttttgggacagcggtg

SEQ ID NO: 391006 - DNA, 140 bp, Artificial Sequence
  Synthetic
caccgctgtcccaaaaggtcctggtcgagttcaaaaggaagacatcagactcattctccccccaggtgtaagtagggaccccgaggcgatcagttgttccgaccacgacagggctgggagcatatcagcagccagggcct

SEQ ID NO: 391007 - DNA, 140 bp, Artificial Sequence
  Synthetic
aggccctggctgctgatatgtacacctggggggagaatgagtctgatgtcttccttttgaactcgaccagaccgccacaaggtgcgtggttcgggtgcgtgtggatgaacagcaccgggtgaccttttgggacagcggtg

SEQ ID NO: 391008 - DNA, 140 bp, Artificial Sequence
  Synthetic
caccgctgtcccaaaaggtcacccggtgctgttcatccacacgcacccgaaccacgcaccttgtggcggtctggtcgagttcaaaaggaagacatcagactcattctccccccaggtgtacatatcagcagccagggcct

SEQ ID NO: 391009 - DNA, 140 bp, Artificial Sequence
  Synthetic
aggccctggctgctgatatgtgcaatcaaatgggagtatgtcctgttgctcttccttctcctggcggacgcgcgcgtctgtgcctgcttgtggatgatgctgctgatagctcaggctgaggaccttttgggacagcggtg

SEQ ID NO: 391010 - DNA, 140 bp, Artificial Sequence
  Synthetic
caccgctgtcccaaaaggtcctcagcctgagctatcagcagcatcatccacaagcaggcacagacgcgcgcgtccgccaggagaaggaagagcaacaggacatactcccatttgattgcacatatcagcagccagggcct

SEQ ID NO: 391011 - DNA, 140 bp, Artificial Sequence
  Synthetic
atacgccatgctgggtctccaagatcaggaccttcattggcggtatagagcatcggatggaggcagcatgcaactggaccaggggggaagtctgcggcttggagcatagggatcgctcagcgtacttgggagtcggccat

SEQ ID NO: 391012 - DNA, 140 bp, Artificial Sequence
  Synthetic
atggccgactcccaagtacgctgagcgatccctatgctccaagccgcagacttcccccctggtccagttgcatgctgcctccatccgatgctctataccgccaatgaaggtcctgatcttggagacccagcatggcgtat

SEQ ID NO: 391013 - DNA, 140 bp, Artificial Sequence
  Synthetic
atacgccatgctgggtctccgacgcgagagtctctgcttgcctatggatgatgtttatggtatcccaggtcgaggcggctctgtccaacctaattaacatcaatgccgcttcagccgctgcgtacttgggagtcggccat

SEQ ID NO: 391014 - DNA, 140 bp, Artificial Sequence
  Synthetic
atggccgactcccaagtacgcagcggctgaagcggcattgatgttaattaggttggacagagccgcctcgacctgggataccataaacatcatccataggcaagcagagactctcgcgtcggagacccagcatggcgtat

SEQ ID NO: 391015 - DNA, 140 bp, Artificial Sequence
  Synthetic
  misc_feature (62)..(62): n is a, c, g, or t
  misc_feature (85)..(85): n is a, c, g, or t
  misc_feature (115)..(115): n is a, c, g, or t
atacgccatgctgggtctccatcgggaggtggctgggtccctcggcggcgcggtcgttgtcntgctggctattctgacattgtcnccccactacaagtcatggctggctaagggnatgtgcgtacttgggagtcggccat

SEQ ID NO: 391016 - DNA, 140 bp, Artificial Sequence
  Synthetic
  misc_feature (26)..(26): n is a, c, g, or t
  misc_feature (56)..(56): n is a, c, g, or t
  misc_feature (79)..(79): n is a, c, g, or t
atggccgactcccaagtacgcacatncccttagccagccatgacttgtagtggggngacaatgtcagaatagccagcangacaacgaccgcgccgccgagggacccagccacctcccgatggagacccagcatggcgtat

SEQ ID NO: 391017 - DNA, 140 bp, Artificial Sequence
  Synthetic
atacgccatgctgggtctccgtcctggcttgcccacacctgacatttgacatcacaaagcatctcctggccatcttggggcccctctacatactccaggcctcgctcctgcgcgtcccctcgtacttgggagtcggccat

SEQ ID NO: 391018 - DNA, 140 bp, Artificial Sequence
  Synthetic
atggccgactcccaagtacgaggggacgcgcaggagcgaggcctggagtatgtagaggggccccaagatggccaggagatgctttgtgatgtcaaatgtcaggtgtgggcaagccaggacggagacccagcatggcgtat

SEQ ID NO: 391019 - DNA, 140 bp, Artificial Sequence
  Synthetic
  misc_feature (36)..(36): n is a, c, g, or t
  misc_feature (108)..(108): n is a, c, g, or t
aggccctggctgctgatatggactggtacctacatntatgaccaccttactcccctgtcagactgggccgctgagggcctccgcgatttagcggtggcccttgagccngttgtgttcacggaccttttgggacagcggtg

SEQ ID NO: 391020 - DNA, 140 bp, Artificial Sequence
  Synthetic
  misc_feature (33)..(33): n is a, c, g, or t
  misc_feature (105)..(105): n is a, c, g, or t
caccgctgtcccaaaaggtccgtgaacacaacnggctcaagggccaccgctaaatcgcggaggccctcagcggcccagtctgacaggggagtaaggtggtcatanatgtaggtaccagtccatatcagcagccagggcct

SEQ ID NO: 391021 - DNA, 140 bp, Artificial Sequence
  Synthetic
aggccctggctgctgatatgaggccacttacacaaaatgtggttcggggccttggttgacacccaggtgcatggttgactacccatacaggctctggcactacccctgcactgtcaacttgaccttttgggacagcggtg

SEQ ID NO: 391022 - DNA, 140 bp, Artificial Sequence
  Synthetic
caccgctgtcccaaaaggtcaagttgacagtgcaggggtagtgccagagcctgtatgggtagtcaaccatgcacctgggtgtcaaccaaggccccgaaccacattttgtgtaagtggcctcatatcagcagccagggcct

SEQ ID NO: 391023 - DNA, 140 bp, Artificial Sequence
  Synthetic
aggccctggctgctgatatgtgctgacgaccagctgcggtaataccctcacttgttacttgaaggcctctgcagcctgtcgagctgcaaagctccgggactgcacgatgctcgtgtgcgggaccttttgggacagcggtg

SEQ ID NO: 391024 - DNA, 140 bp, Artificial Sequence
  Synthetic
caccgctgtcccaaaaggtcccgcacacgagcatcgtgcagtcccggagctttgcagctcgacaggctgcagaggccttcaagtaacaagtgagggtattaccgcagctggtcgtcagcacatatcagcagccagggcct

SEQ ID NO: 391025 - DNA, 140 bp, Artificial Sequence
  Synthetic
aggccctggctgctgatatggagtcctggcgggccttgcctactattccatggtgggaaactgggctaaggttttgattgtgatgctactttttgccggcgttgacgggttcaccaccacgaccttttgggacagcggtg

SEQ ID NO: 391026 - DNA, 140 bp, Artificial Sequence
  Synthetic
caccgctgtcccaaaaggtcgtggtggtgaacccgtcaacgccggcaaaaagtagcatcacaatcaaaaccttagcccagtttcccaccatggaatagtaggcaaggcccgccaggactccatatcagcagccagggcct

SEQ ID NO: 391027 - DNA, 140 bp, Artificial Sequence
  Synthetic
atacgccatgctgggtctccatgtggaccgtctaccacggggcgggtagcaagaccatcagcggcccgaagggacctgtcaatcaaatgtacaccaatgttgaccaagacctggtggggtcgtacttgggagtcggccat

SEQ ID NO: 391028 - DNA, 140 bp, Artificial Sequence
  Synthetic
atggccgactcccaagtacgaccccaccaggtcttggtcaacattggtgtacatttgattgacaggtcccttcgggccgctgatggtcttgctacccgccccgtggtagacggtccacatggagacccagcatggcgtat

SEQ ID NO: 391029 - DNA, 140 bp, Artificial Sequence
  Synthetic
atacgccatgctgggtctccagtatgctcacttcgttcttcacacaaggccccagccaaaagatccagctggtcaacaccagcggcagttggcacattaatagtacggccttgaactgcacgtacttgggagtcggccat

SEQ ID NO: 391030 - DNA, 140 bp, Artificial Sequence
  Synthetic
atggccgactcccaagtacgtgcagttcaaggccgtactattaatgtgccaactgccgctggtgttgaccagctggatcttttggctggggccttgtgtgaagaacgaagtgagcatactggagacccagcatggcgtat

SEQ ID NO: 391031 - DNA, 140 bp, Artificial Sequence
  Synthetic
  misc_feature (74)..(74): n is a, c, g, or t
  misc_feature (76)..(76): n is a, c, g, or t
atacgccatgctgggtctccttaaggggtcttctggtggtccgctgctgtgccccatgggacacgctgccggcntnttccgcgcggcggtgtgtactcgaggggtagctaaagcggtggacgtacttgggagtcggccat

SEQ ID NO: 391032 - DNA, 140 bp, Artificial Sequence
  Synthetic
  misc_feature (65)..(65): n is a, c, g, or t
  misc_feature (67)..(67): n is a, c, g, or t
atggccgactcccaagtacgtccaccgctttagctacccctcgagtacacaccgccgcgcggaanangccggcagcgtgtcccatggggcacagcagcggaccaccagaagaccccttaaggagacccagcatggcgtat

SEQ ID NO: 391033 - DNA, 140 bp, Artificial Sequence
  Synthetic
aggccctggctgctgatatgccgaccaacggccctactgctggcactaccctccaaaaccttgtggtattgtgcccgcaaagagcgtgtgtggcccggtatattgcttcactcccagcccgaccttttgggacagcggtg

SEQ ID NO: 391034 - DNA, 140 bp, Artificial Sequence
  Synthetic
caccgctgtcccaaaaggtcgggctgggagtgaagcaatataccgggccacacacgctctttgcgggcacaataccacaaggttttggagggtagtgccagcagtagggccgttggtcggcatatcagcagccagggcct

SEQ ID NO: 391035 - DNA, 140 bp, Artificial Sequence
  Synthetic
aggccctggctgctgatatggtgcccgcaaagagcgtgtgtggcccggtatattgcttcactcccagccccgtggtggtgggaacgaccgacaggtcgggcgcgcctacctacaactggggaccttttgggacagcggtg

SEQ ID NO: 391036 - DNA, 140 bp, Artificial Sequence
  Synthetic
caccgctgtcccaaaaggtccccagttgtaggtaggcgcgcccgacctgtcggtcgttcccaccaccacggggctgggagtgaagcaatataccgggccacacacgctctttgcgggcaccatatcagcagccagggcct

SEQ ID NO: 391037 - DNA, 140 bp, Artificial Sequence
  Synthetic
aggccctggctgctgatatgggcataggcacggtcctggaccaagcggaaactgctggagtgcgccttgttgtgctcgcaaccgctaccccgccagggtcggtgactacaccccattccagaccttttgggacagcggtg

SEQ ID NO: 391038 - DNA, 140 bp, Artificial Sequence
  Synthetic
caccgctgtcccaaaaggtctggaatggggtgtagtcaccgaccctggcggggtagcggttgcgagcacaacaaggcgcactccagcagtttccgcttggtccaggaccgtgcctatgcccatatcagcagccagggcct

SEQ ID NO: 391039 - DNA, 140 bp, Artificial Sequence
  Synthetic
aggccctggctgctgatatgacatagaggaggtcgccctgccgacaacgggggaggtacccttttacggcaaggcaatccccctagagctaatcaaggggggcagacacctcatcttctggaccttttgggacagcggtg

SEQ ID NO: 391040 - DNA, 140 bp, Artificial Sequence
  Synthetic
caccgctgtcccaaaaggtccagaagatgaggtgtctgccccccttgattagctctagggggattgccttgccgtaaaagggtacctcccccgttgtcggcagggcgacctcctctatgtcatatcagcagccagggcct

SEQ ID NO: 391041 - DNA, 140 bp, Artificial Sequence
  Synthetic
atacgccatgctgggtctccccactcaaagaaaaagtgtgatgaactggccaaacaactaacatctctcggtctgaatgctgtagcctactacagaggcttagacgtttcggtgattccccgtacttgggagtcggccat

SEQ ID NO: 391042 - DNA, 140 bp, Artificial Sequence
  Synthetic
atggccgactcccaagtacggggaatcaccgaaacgtctaagcctctgtagtaggctacagcattcagaccgagagatgttagttgtttggccagttcatcacactttttctttgagtggggagacccagcatggcgtat

SEQ ID NO: 391043 - DNA, 140 bp, Artificial Sequence
  Synthetic
aggccctggctgctgatatgtacgagctgacaccggctgagaccacaacaaggctgagagcttacttcaacacaccaggccttcctgtgtgccaagaccacctggagttctgggagagcggaccttttgggacagcggtg

SEQ ID NO: 391044 - DNA, 140 bp, Artificial Sequence
  Synthetic
caccgctgtcccaaaaggtccgctctcccagaactccaggtggtcttggcacacaggaaggcctggtgtgttgaagtaagctctcagccttgttgtggtctcagccggtgtcagctcgtacatatcagcagccagggcct

SEQ ID NO: 391045 - DNA, 140 bp, Artificial Sequence
  Synthetic
atacgccatgctgggtctcccacaccaggccttcctgtgtgccaagaccacctggagttctgggagagcgtctttacggggttaacccaaatagacggccatttcctatcccagaccaagcgtacttgggagtcggccat

SEQ ID NO: 391046 - DNA, 140 bp, Artificial Sequence
  Synthetic
atggccgactcccaagtacgcttggtctgggataggaaatggccgtctatttgggttaaccccgtaaagacgctctcccagaactccaggtggtcttggcacacaggaaggcctggtgtgggagacccagcatggcgtat

SEQ ID NO: 391047 - DNA, 140 bp, Artificial Sequence
  Synthetic
aggccctggctgctgatatggggtgtaccatgtcacaaacgactgttccaactcaagcattgtgtatgagacggaggacatgatcatgcacgtccccgggtgcgtgccctgcgttcgggagaccttttgggacagcggtg

SEQ ID NO: 391048 - DNA, 140 bp, Artificial Sequence
  Synthetic
caccgctgtcccaaaaggtctcccgaacgcagggcacgcacccggggacgtgcatgatcatgtcctccgtctcatacacaatgcttgagttggaacagtcgtttgtgacatggtacaccccatatcagcagccagggcct

SEQ ID NO: 391049 - DNA, 140 bp, Artificial Sequence
  Synthetic
atacgccatgctgggtctcccatcatggcctgcatgtcagctgacctcgaggtagtgacgagcacgtgggtcctagtgggcggcgtcctggcagccctagctgcttactgtctttcagtgcgtacttgggagtcggccat

SEQ ID NO: 391050 - DNA, 140 bp, Artificial Sequence
  Synthetic
atggccgactcccaagtacgcactgaaagacagtaagcagctagggctgccaggacgccgcccactaggacccacgtgctcgtcactacctcgaggtcagctgacatgcaggccatgatgggagacccagcatggcgtat

SEQ ID NO: 391051 - DNA, 140 bp, Artificial Sequence
  Synthetic
aggccctggctgctgatatgcgggggcccactggggagtcctggcgggccttgcatactattccatggtggggaactgggctaaggttttgattgtgatgctactctttgccggcgttgagaccttttgggacagcggtg

SEQ ID NO: 391052 - DNA, 140 bp, Artificial Sequence
  Synthetic
caccgctgtcccaaaaggtctcaacgccggcaaagagtagcatcacaatcaaaaccttagcccagttccccaccatggaatagtatgcaaggcccgccaggactccccagtgggcccccgcatatcagcagccagggcct

SEQ ID NO: 391053 - DNA, 140 bp, Artificial Sequence
  Synthetic
aggccctggctgctgatatgcctcaacaccgggttcattgccgcgttgatctacgcacacaagttcaactcgtccgggtgcttggaacgcatgtccagctgccgccccatcaacgagttcgaccttttgggacagcggtg

SEQ ID NO: 391054 - DNA, 140 bp, Artificial Sequence
  Synthetic
caccgctgtcccaaaaggtcgaactcgttgatggggcggcagctggacatgcgttccaagcacccggacgagttgaacttgtgtgcgtagatcaacgcggcaatgaacccggtgttgaggcatatcagcagccagggcct

SEQ ID NO: 391055 - DNA, 140 bp, Artificial Sequence
  Synthetic
atacgccatgctgggtctccgaggccttattgctggcactacgcgccccgaccgtgtggtactatacccgcgtcacaggtgtgtggcccagtgtattgcttcaccccaagccctgttgtgcgtacttgggagtcggccat

SEQ ID NO: 391056 - DNA, 140 bp, Artificial Sequence
  Synthetic
atggccgactcccaagtacgcacaacagggcttggggtgaagcaatacactgggccacacacctgtgacgcgggtatagtaccacacggtcggggcgcgtagtgccagcaataaggcctcggagacccagcatggcgtat

SEQ ID NO: 391057 - DNA, 140 bp, Artificial Sequence
  Synthetic
  misc_feature (86)..(86): n is a, c, g, or t
aggccctggctgctgatatggcttaaagccaagctactgcctctcatgccaggtatccccttcctctcgtgccagaggggttatangggagagtggcgtggagatggcgtaatgcacaccgaccttttgggacagcggtg

SEQ ID NO: 391058 - DNA, 140 bp, Artificial Sequence
  Synthetic
  misc_feature (55)..(55): n is a, c, g, or t
caccgctgtcccaaaaggtcggtgtgcattacgccatctccacgccactctcccntataacccctctggcacgagaggaaggggatacctggcatgagaggcagtagcttggctttaagccatatcagcagccagggcct

SEQ ID NO: 391059 - DNA, 140 bp, Artificial Sequence
  Synthetic
atacgccatgctgggtctcctcatgtgtgttgtacacccgactctggtattcgacatcaccaaactgctgctggccgtcttcggacccctttggattcttcaagccagtttgcttaaagtcgtacttgggagtcggccat

SEQ ID NO: 391060 - DNA, 140 bp, Artificial Sequence
  Synthetic
atggccgactcccaagtacgactttaagcaaactggcttgaagaatccaaaggggtccgaagacggccagcagcagtttggtgatgtcgaataccagagtcgggtgtacaacacacatgaggagacccagcatggcgtat

SEQ ID NO: 391061 - DNA, 140 bp, Artificial Sequence
  Synthetic
atacgccatgctgggtctccatgacagggaggtctcggtcgccgcggaaatcctgcgtccgactaagaagtttcccccagctctaccgatctgggctcgaccagattacaatccacctctcgtacttgggagtcggccat

SEQ ID NO: 391062 - DNA, 140 bp, Artificial Sequence
  Synthetic
atggccgactcccaagtacgagaggtggattgtaatctggtcgagcccagatcggtagagctgggggaaacttcttagtcggacgcaggatttccgcggcgaccgagacctccctgtcatggagacccagcatggcgtat

SEQ ID NO: 391063 - DNA, 140 bp, Artificial Sequence
  Synthetic
aggccctggctgctgatatgggaagatggtcggaggccactacgtgcaaatggccatcatcaagttaggggcgcttactggcacctatgtttataaccatctcactcctcttcgggactggaccttttgggacagcggtg

SEQ ID NO: 391064 - DNA, 140 bp, Artificial Sequence
  Synthetic
caccgctgtcccaaaaggtccagtcccgaagaggagtgagatggttataaacataggtgccagtaagcgcccctaacttgatgatggccatttgcacgtagtggcctccgaccatcttcccatatcagcagccagggcct

SEQ ID NO: 391065 - DNA, 140 bp, Artificial Sequence
  Synthetic
aggccctggctgctgatatggatccgacgttgagtcgtactcctccatgcccccccttgagggagagccgggggaccccgatctcagcgacgggtcttggtctaccgtgagcgaggaggcgaccttttgggacagcggtg

SEQ ID NO: 391066 - DNA, 140 bp, Artificial Sequence
  Synthetic
caccgctgtcccaaaaggtcgcctcctcgctcacggtagaccaagacccgtcgctgagatcggggtcccccggctctccctcaagggggggcatggaggagtacgactcaacgtcggatccatatcagcagccagggcct

SEQ ID NO: 391067 - DNA, 140 bp, Artificial Sequence
  Synthetic
atacgccatgctgggtctccgacgcatctgatgacggatcttattcgtcaatgcctccactagagggggagcccggtgacccggacttgacatcagattcttggtccactgttagcggatcgtacttgggagtcggccat

SEQ ID NO: 391068 - DNA, 140 bp, Artificial Sequence
  Synthetic
atggccgactcccaagtacgatccgctaacagtggaccaagaatctgatgtcaagtccgggtcaccgggctccccctctagtggaggcattgacgaataagatccgtcatcagatgcgtcggagacccagcatggcgtat

SEQ ID NO: 391069 - DNA, 140 bp, Artificial Sequence
  Synthetic
  misc_feature (37)..(37): n is a, c, g, or t
aggccctggctgctgatatgcaattcactcttacgcnatcacaacatggtgtatgccacgactacccgttctgccgtaactcggcagaagaaggtgaccttcgaccgcctgcaggtggtggaccttttgggacagcggtg

SEQ ID NO: 391070 - DNA, 140 bp, Artificial Sequence
  Synthetic
  misc_feature (104)..(104): n is a, c, g, or t
caccgctgtcccaaaaggtccaccacctgcaggcggtcgaaggtcaccttcttctgccgagttacggcagaacgggtagtcgtggcatacaccatgttgtgatngcgtaagagtgaattgcatatcagcagccagggcct

SEQ ID NO: 391071 - DNA, 140 bp, Artificial Sequence
  Synthetic
aggccctggctgctgatatgaaatgtacaccaatgtagaccaggacctcgtcggctggcaggcgccccccggggcgcgttccttgacaccgtgcacctgcggcagctcggacctttatttgaccttttgggacagcggtg

SEQ ID NO: 391072 - DNA, 140 bp, Artificial Sequence
  Synthetic
caccgctgtcccaaaaggtcaaataaaggtccgagctgccgcaggtgcacggtgtcaaggaacgcgccccggggggcgcctgccagccgacgaggtcctggtctacattggtgtacatttcatatcagcagccagggcct

SEQ ID NO: 391073 - DNA, 140 bp, Artificial Sequence
  Synthetic
atacgccatgctgggtctccccctattgcgccaccacaatcttgtgtattccacttcctctcgaagtgcgggtcagaggcagaagaaggtcacctttgacaggctacaagtcctcgatgacgtacttgggagtcggccat

SEQ ID NO: 391074 - DNA, 140 bp, Artificial Sequence
  Synthetic
atggccgactcccaagtacgtcatcgaggacttgtagcctgtcaaaggtgaccttcttctgcctctgacccgcacttcgagaggaagtggaatacacaagattgtggtggcgcaatagggggagacccagcatggcgtat

SEQ ID NO: 391075 - DNA, 140 bp, Artificial Sequence
  Synthetic
aggccctggctgctgatatggtgtacccggatctcggggtccgggtttgcgagaagagagcgcttcacgacgtcgtcaaccaactacctaaggccgtgatgggagccgcttacggcttccgaccttttgggacagcggtg

SEQ ID NO: 391076 - DNA, 140 bp, Artificial Sequence
  Synthetic
caccgctgtcccaaaaggtcggaagccgtaagcggctcccatcacggccttaggtagttggttgacgacgtcgtgaagcgctctcttctcgcaaacccggaccccgagatccgggtacaccatatcagcagccagggcct

SEQ ID NO: 391077 - DNA, 140 bp, Artificial Sequence
  Synthetic
aggccctggctgctgatatgtacgtgggcggccctatgcacaacagcaagggagacctttgtgggtatcggagatgccgcgcaagcggcgtctacacgaccagcttcggaaacacactgagaccttttgggacagcggtg

SEQ ID NO: 391078 - DNA, 140 bp, Artificial Sequence
  Synthetic
caccgctgtcccaaaaggtctcagtgtgtttccgaagctggtcgtgtagacgccgcttgcgcggcatctccgatacccacaaaggtctcccttgctgttgtgcatagggccgcccacgtacatatcagcagccagggcct

SEQ ID NO: 391079 - DNA, 140 bp, Artificial Sequence
  Synthetic
atacgccatgctgggtctcctactctccaggtgagatcaatagggtggcttcatgcctcaggaaacttggggtaccacccttgcgagtctggagacatcgggccagaagtgtccgcgctacgtacttgggagtcggccat

SEQ ID NO: 391080 - DNA, 140 bp, Artificial Sequence
  Synthetic
atggccgactcccaagtacgtagcgcggacacttctggcccgatgtctccagactcgcaagggtggtaccccaagtttcctgaggcatgaagccaccctattgatctcacctggagagtaggagacccagcatggcgtat

SEQ ID NO: 391081 - DNA, 140 bp, Artificial Sequence
  Synthetic
atacgccatgctgggtctccgcaatcattcaaagactccatggcttaagcgcattcacactgcacggatactctccacacgaactcaatcgggtggctggaagcctcaggaaacttggggcgtacttgggagtcggccat

SEQ ID NO: 391082 - DNA, 140 bp, Artificial Sequence
  Synthetic
atggccgactcccaagtacgccccaagtttcctgaggcttccagccacccgattgagttcgtgtggagagtatccgtgcagtgtgaatgcgcttaagccatggagtctttgaatgattgcggagacccagcatggcgtat

SEQ ID NO: 391083 - DNA, 140 bp, Artificial Sequence
  Synthetic
aggccctggctgctgatatgacaggtttgtgactccaggagagcggccctcgggcatgttcgattcctcggtcctgtgtgagtgctatgacgcgggctgtgcttggtacgagctcacaccgaccttttgggacagcggtg

SEQ ID NO: 391084 - DNA, 140 bp, Artificial Sequence
  Synthetic
caccgctgtcccaaaaggtcggtgtgagctcgtaccaagcacagcccgcgtcatagcactcacacaggaccgaggaatcgaacatgcccgagggccgctctcctggagtcacaaacctgtcatatcagcagccagggcct

SEQ ID NO: 391085 - DNA, 140 bp, Artificial Sequence
  Synthetic
aggccctggctgctgatatgctgggcggtaaaaaccaagctcaaactcactccattgcctgccgccgccaaactcgatttatcgagttggttcacggtgggcgccggcgggggagacattgaccttttgggacagcggtg

SEQ ID NO: 391086 - DNA, 140 bp, Artificial Sequence
  Synthetic
caccgctgtcccaaaaggtcaatgtctcccccgccggcgcccaccgtgaaccaactcgataaatcgagtttggcggcggcaggcaatggagtgagtttgagcttggtttttaccgcccagcatatcagcagccagggcct

SEQ ID NO: 391087 - DNA, 140 bp, Artificial Sequence
  Synthetic
aggccctggctgctgatatgtatcacagcatgtctcatgcccgaccccgctatttactcctgtgcctactcctactttccgtaggggtaggcatcttcctgctgcctgctcgataggcaggaccttttgggacagcggtg

SEQ ID NO: 391088 - DNA, 140 bp, Artificial Sequence
  Synthetic
caccgctgtcccaaaaggtcctgcctatcgagcaggcagcaggaagatgcctacccctacggaaagtaggagtaggcacaggagtaaatagcggggtcgggcatgagacatgctgtgatacatatcagcagccagggcct

SEQ ID NO: 391089 - DNA, 140 bp, Artificial Sequence
  Synthetic
aggccctggctgctgatatgccccacctccatcgtgggatcaaatgtggaagtgtctcatacggctgaagcctacgctgcacgggccaacacccctgctgtataggctaggagccgtccagaccttttgggacagcggtg

SEQ ID NO: 391090 - DNA, 140 bp, Artificial Sequence
  Synthetic
caccgctgtcccaaaaggtctggacggctcctagcctatacagcaggggtgttggcccgtgcagcgtaggcttcagccgtatgagacacttccacatttgatcccacgatggaggtggggcatatcagcagccagggcct

SEQ ID NO: 391091 - DNA, 140 bp, Artificial Sequence
  Synthetic
aggccctggctgctgatatgtgtcggccgacctggaggtcgtcacgagcacctgggtgctggtgggcggagtccttgcagctctggccgcgtattgcctgacaacaggcagcgtggtcatgaccttttgggacagcggtg

SEQ ID NO: 391092 - DNA, 140 bp, Artificial Sequence
  Synthetic
caccgctgtcccaaaaggtcatgaccacgctgcctgttgtcaggcaatacgcggccagagctgcaaggactccgcccaccagcacccaggtgctcgtgacgacctccaggtcggccgacacatatcagcagccagggcct

SEQ ID NO: 391093 - DNA, 140 bp, Artificial Sequence
  Synthetic
aggccctggctgctgatatgaagttctctaccaggagttcgatgagatggaggagtgcgcctcacacctcccttacatcgaacaggggatgcagctcgccgagcagttcaaacagaaagcgaccttttgggacagcggtg

SEQ ID NO: 391094 - DNA, 140 bp, Artificial Sequence
  Synthetic
caccgctgtcccaaaaggtcgctttctgtttgaactgctcggcgagctgcatcccctgttcgatgtaagggaggtgtgaggcgcactcctccatctcatcgaactcctggtagagaacttcatatcagcagccagggcct

SEQ ID NO: 391095 - DNA, 140 bp, Artificial Sequence
  Synthetic
aggccctggctgctgatatgaattttgcaacagggaaccttcccggttgctctttctctatcttcctcttggcacttctctcgtgcctgactgtccccgcctcggccattaactaccgcagaccttttgggacagcggtg

SEQ ID NO: 391096 - DNA, 140 bp, Artificial Sequence
  Synthetic
caccgctgtcccaaaaggtctgcggtagttaatggccgaggcggggacagtcaggcacgagagaagtgccaagaggaagatagagaaagagcaaccgggaaggttccctgttgcaaaattcatatcagcagccagggcct

SEQ ID NO: 391097 - DNA, 140 bp, Artificial Sequence
  Synthetic
aggccctggctgctgatatgcagccctggtggtgtcgcagttactccggatcccacaagctgtcgtggacatggtggcgggggcccactggggagtcctggcgggccttgcctactattcgaccttttgggacagcggtg

SEQ ID NO: 391098 - DNA, 140 bp, Artificial Sequence
  Synthetic
caccgctgtcccaaaaggtcgaatagtaggcaaggcccgccaggactccccagtgggcccccgccaccatgtccacgacagcttgtgggatccggagtaactgcgacaccaccagggctgcatatcagcagccagggcct

SEQ ID NO: 391099 - DNA, 140 bp, Artificial Sequence
  Synthetic
aggccctggctgctgatatgagcacaaatcactggacatgtcaaaaacggttccatgaggatcgttgggcctaagacctgcagcaacacgtggcatgggacgttccccatcaacgcgtacgaccttttgggacagcggtg

SEQ ID NO: 391100 - DNA, 140 bp, Artificial Sequence
  Synthetic
caccgctgtcccaaaaggtcgtacgcgttgatggggaacgtcccatgccacgtgttgctgcaggtcttaggcccaacgatcctcatggaaccgtttttgacatgtccagtgatttgtgctcatatcagcagccagggcct

SEQ ID NO: 391101 - DNA, 140 bp, Artificial Sequence
  Synthetic
  misc_feature (115)..(115): n is a, c, g, or t
aggccctggctgctgatatgagcatgcaagctaattgggccaaagtcatcttggtcctattcctcttcgcaggggttgacgctgatactcatgtgtctgggggtagagttggccncaccggaccttttgggacagcggtg

SEQ ID NO: 391102 - DNA, 140 bp, Artificial Sequence
  Synthetic
  misc_feature (26)..(26): n is a, c, g, or t
caccgctgtcccaaaaggtccggtgnggccaactctacccccagacacatgagtatcagcgtcaacccctgcgaagaggaataggaccaagatgactttggcccaattagcttgcatgctcatatcagcagccagggcct

SEQ ID NO: 391103 - DNA, 140 bp, Artificial Sequence
  Synthetic
atacgccatgctgggtctccgttccggcccccgaattcttcacggaggtggatggggtacggttgcacaggtacgctccggcgtgcaaacctctcctacgggatgaggtcacattccaggcgtacttgggagtcggccat

SEQ ID NO: 391104 - DNA, 140 bp, Artificial Sequence
  Synthetic
atggccgactcccaagtacgcctggaatgtgacctcatcccgtaggagaggtttgcacgccggagcgtacctgtgcaaccgtaccccatccacctccgtgaagaattcgggggccggaacggagacccagcatggcgtat

SEQ ID NO: 391105 - DNA, 140 bp, Artificial Sequence
  Synthetic
aggccctggctgctgatatggtacgctccggcgtgcaaacctctcctacgggatgaggtcacattccaggtcgggctcaaccaatacctggttgggtcacagctcccatgtgagcccgaagaccttttgggacagcggtg

SEQ ID NO: 391106 - DNA, 140 bp, Artificial Sequence
  Synthetic
caccgctgtcccaaaaggtcttcgggctcacatgggagctgtgacccaaccaggtattggttgagcccgacctggaatgtgacctcatcccgtaggagaggtttgcacgccggagcgtaccatatcagcagccagggcct

SEQ ID NO: 391107 - DNA, 140 bp, Artificial Sequence
  Synthetic
aggccctggctgctgatatgtcgggctcaaccaatacctggttgggtcacagctcccatgtgagcccgaaccggatgtagcagtgcttacttccatgctcaccgacccctcccacatcacgaccttttgggacagcggtg

SEQ ID NO: 391108 - DNA, 140 bp, Artificial Sequence
  Synthetic
caccgctgtcccaaaaggtcgtgatgtgggaggggtcggtgagcatggaagtaagcactgctacatccggttcgggctcacatgggagctgtgacccaaccaggtattggttgagcccgacatatcagcagccagggcct

SEQ ID NO: 391109 - DNA, 140 bp, Artificial Sequence
  Synthetic
aggccctggctgctgatatgagccctgtcgtggtcggaacaactgatcgccgcggggtccctacttacacctggggggagaacgagtctgacgtcttccttttgaactctaccaggccgcgaccttttgggacagcggtg

SEQ ID NO: 391110 - DNA, 140 bp, Artificial Sequence
  Synthetic
caccgctgtcccaaaaggtcgcggcctggtagagttcaaaaggaagacgtcagactcgttctccccccaggtgtaagtagggaccccgcggcgatcagttgttccgaccacgacagggctcatatcagcagccagggcct

SEQ ID NO: 391111 - DNA, 140 bp, Artificial Sequence
  Synthetic
aggccctggctgctgatatggtggcggcaggagatgggcggaaacatcacccgcgtggagtcagagaacaaggtagtaattctggactctttcgacccgcttcgagcggaggaggatgaggaccttttgggacagcggtg

SEQ ID NO: 391112 - DNA, 140 bp, Artificial Sequence
  Synthetic
caccgctgtcccaaaaggtcctcatcctcctccgctcgaagcgggtcgaaagagtccagaattactaccttgttctctgactccacgcgggtgatgtttccgcccatctcctgccgccaccatatcagcagccagggcct

SEQ ID NO: 391113 - DNA, 140 bp, Artificial Sequence
  Synthetic
  misc_feature (106)..(106): n is a, c, g, or t
atacgccatgctgggtctccgcactgtcccactgactgtttcaggaagcatccggagaccacctacgccaaatgcgggtcgggcccctggatcacaccacgatgcntgattgactatccgcgtacttgggagtcggccat

SEQ ID NO: 391114 - DNA, 140 bp, Artificial Sequence
  Synthetic
  misc_feature (35)..(35): n is a, c, g, or t
atggccgactcccaagtacgcggatagtcaatcangcatcgtggtgtgatccaggggcccgacccgcatttggcgtaggtggtctccggatgcttcctgaaacagtcagtgggacagtgcggagacccagcatggcgtat

SEQ ID NO: 391115 - DNA, 140 bp, Artificial Sequence
  Synthetic
aggccctggctgctgatatgagtcctggaaagacccggactatgtccctccggtggtacatgggtgcccattgccacctaccaaggcccctccgataccacctccacggaggaagaggacgaccttttgggacagcggtg

SEQ ID NO: 391116 - DNA, 140 bp, Artificial Sequence
  Synthetic
caccgctgtcccaaaaggtcgtcctcttcctccgtggaggtggtatcggaggggccttggtaggtggcaatgggcacccatgtaccaccggagggacatagtccgggtctttccaggactcatatcagcagccagggcct

SEQ ID NO: 391117 - DNA, 140 bp, Artificial Sequence
  Synthetic
aggccctggctgctgatatgttgccacctaccaaggcccctccgataccacctccacggaggaagaggacggttgtcctaacagagtccactgtgtcttctgccttggcggagctcgctagaccttttgggacagcggtg

SEQ ID NO: 391118 - DNA, 140 bp, Artificial Sequence
  Synthetic
caccgctgtcccaaaaggtctagcgagctccgccaaggcagaagacacagtggactctgttaggacaaccgtcctcttcctccgtggaggtggtatcggaggggccttggtaggtggcaacatatcagcagccagggcct

SEQ ID NO: 391119 - DNA, 140 bp, Artificial Sequence
  Synthetic
aggccctggctgctgatatgggaccaggggggaagcctgcggcttagagcatagggatcgcgcggaactgtcgcctctgctcctttccactacaacgtggcaagtcctcccctgctctttgaccttttgggacagcggtg

SEQ ID NO: 391120 - DNA, 140 bp, Artificial Sequence
  Synthetic
caccgctgtcccaaaaggtcaaagagcaggggaggacttgccacgttgtagtggaaaggagcagaggcgacagttccgcgcgatccctatgctctaagccgcaggcttcccccctggtcccatatcagcagccagggcct

SEQ ID NO: 391121 - DNA, 140 bp, Artificial Sequence
  Synthetic
aggccctggctgctgatatgcattcccgcaaggccattaaccacatcaactccgtgtgggaggacttgctggaagacaacaataccccaataccaacaacaatcatggccaaaaatgagggaccttttgggacagcggtg

SEQ ID NO: 391122 - DNA, 140 bp, Artificial Sequence
  Synthetic
caccgctgtcccaaaaggtccctcatttttggccatgattgttgttggtattggggtattgttgtcttccagcaagtcctcccacacggagttgatgtggttaatggccttgcgggaatgcatatcagcagccagggcct

SEQ ID NO: 391123 - DNA, 140 bp, Artificial Sequence
  Synthetic
aggccctggctgctgatatgtccttcgacgtgcgcgggtctcgtgactcaatgatcatccttgctgtcctggcttgcccatacctgacatttgacatcacaaaacatctcctggccatctgaccttttgggacagcggtg

SEQ ID NO: 391124 - DNA, 140 bp, Artificial Sequence
  Synthetic
caccgctgtcccaaaaggtcagatggccaggagatgttttgtgatgtcaaatgtcaggtatgggcaagccaggacagcaaggatgatcattgagtcacgagacccgcgcacgtcgaaggacatatcagcagccagggcct

SEQ ID NO: 391125 - DNA, 140 bp, Artificial Sequence
  Synthetic
  misc_feature (79)..(79): n is a, c, g, or t
atacgccatgctgggtctccttacggcaagtattgccagatggccgtgcttaaaatgggggccctgactggtacctacntctacaaccaccttactcccctgtcagactgggccgctgagcgtacttgggagtcggccat

SEQ ID NO: 391126 - DNA, 140 bp, Artificial Sequence
  Synthetic
  misc_feature (62)..(62): n is a, c, g, or t
atggccgactcccaagtacgctcagcggcccagtctgacaggggagtaaggtggttgtagangtaggtaccagtcagggcccccattttaagcacggccatctggcaatacttgccgtaaggagacccagcatggcgtat

SEQ ID NO: 391127 - DNA, 140 bp, Artificial Sequence
  Synthetic
  misc_feature (28)..(28): n is a, c, g, or t
atacgccatgctgggtctccttataagngggctgcctgtctcggctaggttgggcaatgagatcttgctcgggccggccgacacagaaacatcaagggggtggagactccttgcccccgtcgtacttgggagtcggccat

SEQ ID NO: 391128 - DNA, 140 bp, Artificial Sequence
  Synthetic
  misc_feature (113)..(113): n is a, c, g, or t
atggccgactcccaagtacgacgggggcaaggagtctccacccccttgatgtttctgtgtcggccggcccgagcaagatctcattgcccaacctagccgagacaggcagcccncttataaggagacccagcatggcgtat

SEQ ID NO: 391129 - DNA, 140 bp, Artificial Sequence
  Synthetic
aggccctggctgctgatatggaccagggctggggccctatcagtcacgccaacggaagcggccccgaccaacgcccctactgctggcactaccccccaagaccttgtggtattgtgcccggaccttttgggacagcggtg

SEQ ID NO: 391130 - DNA, 140 bp, Artificial Sequence
  Synthetic
caccgctgtcccaaaaggtccgggcacaataccacaaggtcttggggggtagtgccagcagtaggggcgttggtcggggccgcttccgttggcgtgactgatagggccccagccctggtccatatcagcagccagggcct

SEQ ID NO: 391131 - DNA, 140 bp, Artificial Sequence
  Synthetic
atacgccatgctgggtctcctcccggtcgaatctcttgcgactactatgagatcaccagtgttcactgacaactcaacaccccctgcggtgcctcaggcctaccaggtcgcgcacttgcacgtacttgggagtcggccat

SEQ ID NO: 391132 - DNA, 140 bp, Artificial Sequence
  Synthetic
atggccgactcccaagtacgtgcaagtgcgcgacctggtaggcctgaggcaccgcagggggtgttgagttgtcagtgaacactggtgatctcatagtagtcgcaagagattcgaccgggaggagacccagcatggcgtat

SEQ ID NO: 391133 - DNA, 140 bp, Artificial Sequence
  Synthetic
atacgccatgctgggtctccatggtaagttcctggctgatggaggttgcagcgggggggcatacgacataatcatctgtgacgagtgccattccactgactccacgacgatccttggcatcgtacttgggagtcggccat

SEQ ID NO: 391134 - DNA, 140 bp, Artificial Sequence
  Synthetic
atggccgactcccaagtacgatgccaaggatcgtcgtggagtcagtggaatggcactcgtcacagatgattatgtcgtatgcccccccgctgcaacctccatcagccaggaacttaccatggagacccagcatggcgtat

SEQ ID NO: 391135 - DNA, 140 bp, Artificial Sequence
  Synthetic
atacgccatgctgggtctcctcgcaaccgctaccccaccaggatcagtgactacacctcattccaacatagaggaggtcgccctgccgacaacgggggagatacccttttacggcaaggccgtacttgggagtcggccat

SEQ ID NO: 391136 - DNA, 140 bp, Artificial Sequence
  Synthetic
atggccgactcccaagtacggccttgccgtaaaagggtatctcccccgttgtcggcagggcgacctcctctatgttggaatgaggtgtagtcactgatcctggtggggtagcggttgcgaggagacccagcatggcgtat

SEQ ID NO: 391137 - DNA, 140 bp, Artificial Sequence
  Synthetic
atacgccatgctgggtctccgggtgagaatttcccataccttgttgcttatcaggccacagtgtgcgccagagctctggcgcccccaccaagctgggacaccatgtggaagtgcctaatccgtacttgggagtcggccat

SEQ ID NO: 391138 - DNA, 140 bp, Artificial Sequence
  Synthetic
atggccgactcccaagtacggattaggcacttccacatggtgtcccagcttggtgggggcgccagagctctggcgcacactgtggcctgataagcaacaaggtatgggaaattctcacccggagacccagcatggcgtat

SEQ ID NO: 391139 - DNA, 140 bp, Artificial Sequence
  Synthetic
atacgccatgctgggtctcccgtcgatgcacaaacccacgtcaccggggggagtgctgctcggaccacatctggactcgccagtatcttcaatttaggccccaagcagaacatccagctgcgtacttgggagtcggccat

SEQ ID NO: 391140 - DNA, 140 bp, Artificial Sequence
  Synthetic
atggccgactcccaagtacgcagctggatgttctgcttggggcctaaattgaagatactggcgagtccagatgtggtccgagcagcactccccccggtgacgtgggtttgtgcatcgacgggagacccagcatggcgtat

SEQ ID NO: 391141 - DNA, 140 bp, Artificial Sequence
  Synthetic
aggccctggctgctgatatgcttaattgtgatgctactctttgccggtgttgatgggaatacatacgtgacggggggaaggatgggccaagctgccggaggtcttgcgtccctcttttcagaccttttgggacagcggtg

SEQ ID NO: 391142 - DNA, 140 bp, Artificial Sequence
  Synthetic
caccgctgtcccaaaaggtctgaaaagagggacgcaagacctccggcagcttggcccatccttccccccgtcacgtatgtattcccatcaacaccggcaaagagtagcatcacaattaagcatatcagcagccagggcct

SEQ ID NO: 391143 - DNA, 140 bp, Artificial Sequence
  Synthetic
  misc_feature (64)..(64): n is a, c, g, or t
atacgccatgctgggtctcccaacaccagtgatccagtccaacttcgccaaacttgaacagttntgggcgaaacacatgtggaatttcatcagtggcattcaatatctcgctggactgtccgtacttgggagtcggccat

SEQ ID NO: 391144 - DNA, 140 bp, Artificial Sequence
  Synthetic
  misc_feature (77)..(77): n is a, c, g, or t
atggccgactcccaagtacggacagtccagcgagatattgaatgccactgatgaaattccacatgtgtttcgcccanaactgttcaagtttggcgaagttggactggatcactggtgttgggagacccagcatggcgtat

SEQ ID NO: 391145 - DNA, 140 bp, Artificial Sequence
  Synthetic
aggccctggctgctgatatgaaacacatgtggaatttcatcagtggcattcaatatctcgctggactgtctaccctgccaggcaatcctgccatcgcttccctcatgtcctttactgctggaccttttgggacagcggtg

SEQ ID NO: 391146 - DNA, 140 bp, Artificial Sequence
  Synthetic
caccgctgtcccaaaaggtccagcagtaaaggacatgagggaagcgatggcaggattgcctggcagggtagacagtccagcgagatattgaatgccactgatgaaattccacatgtgtttcatatcagcagccagggcct

SEQ ID NO: 391147 - DNA, 140 bp, Artificial Sequence
  Synthetic
atacgccatgctgggtctcccatcacctactccagcgataacagttcggaccagaggccctattgctggcactacgcgcctcaaccgtgcggcattgtacccgcgtcgcaggtgtgtggtcgtacttgggagtcggccat

SEQ ID NO: 391148 - DNA, 140 bp, Artificial Sequence
  Synthetic
atggccgactcccaagtacgaccacacacctgcgacgcgggtacaatgccgcacggttgaggcgcgtagtgccagcaatagggcctctggtccgaactgttatcgctggagtaggtgatgggagacccagcatggcgtat

SEQ ID NO: 391149 - DNA, 140 bp, Artificial Sequence
  Synthetic
aggccctggctgctgatatgagcaccccgaggccacttacaccaaatgcggttcggggccttggttgacacctaggtgcatggttgactacccatacaggctttggcactacccctgcacgaccttttgggacagcggtg

SEQ ID NO: 391150 - DNA, 140 bp, Artificial Sequence
  Synthetic
caccgctgtcccaaaaggtcgtgcaggggtagtgccaaagcctgtatgggtagtcaaccatgcacctaggtgtcaaccaaggccccgaaccgcatttggtgtaagtggcctcggggtgctcatatcagcagccagggcct

SEQ ID NO: 391151 - DNA, 140 bp, Artificial Sequence
  Synthetic
aggccctggctgctgatatggaggacagggatagatcagagctcagcccgctgctgctgtctacaacagagtggcagatactgccctgttccttcaccaccctaccggctctgtccactggaccttttgggacagcggtg

SEQ ID NO: 391152 - DNA, 140 bp, Artificial Sequence
  Synthetic
caccgctgtcccaaaaggtccagtggacagagccggtagggtggtgaaggaacagggcagtatctgccactctgttgtagacagcagcagcgggctgagctctgatctatccctgtcctccatatcagcagccagggcct

SEQ ID NO: 391153 - DNA, 140 bp, Artificial Sequence
  Synthetic
atacgccatgctgggtctcccctcgttagctagttcctcggctagccagttgtccgccccgtctctcaaggccacatgcaccgctcgccatggctcccctggtactgatctcctcgaggccgtacttgggagtcggccat

SEQ ID NO: 391154 - DNA, 140 bp, Artificial Sequence
  Synthetic
atggccgactcccaagtacggcctcgaggagatcagtaccaggggagccatggcgagcggtgcatgtggccttgagagacggggcggacaactggctagccgaggaactagctaacgaggggagacccagcatggcgtat

SEQ ID NO: 391155 - DNA, 140 bp, Artificial Sequence
  Synthetic
  misc_feature (71)..(71): n is a, c, g, or t
atacgccatgctgggtctccttgcctcctagcaagcagccccccgtccctcctcccaggaggaagcggacngttcagctcacagagtccgttgcttctgctgccttggcggagctggccgcgtacttgggagtcggccat

SEQ ID NO: 391156 - DNA, 140 bp, Artificial Sequence
  Synthetic
  misc_feature (70)..(70): n is a, c, g, or t
atggccgactcccaagtacgcggccagctccgccaaggcagcagaagcaacggactctgtgagctgaacngtccgcttcctcctgggaggagggacggggggctgcttgctaggaggcaaggagacccagcatggcgtat

SEQ ID NO: 391157 - DNA, 140 bp, Artificial Sequence
  Synthetic
aggccctggctgctgatatgcgagcccgttgtcttctcagatatggagaccaagatcatcacctggggggcggacaccgcggcgtgtggggacatcatcttgggcctacctgtctccgccgaccttttgggacagcggtg

SEQ ID NO: 391158 - DNA, 140 bp, Artificial Sequence
  Synthetic
caccgctgtcccaaaaggtcggcggagacaggtaggcccaagatgatgtccccacacgccgcggtgtccgccccccaggtgatgatcttggtctccatatctgagaagacaacgggctcgcatatcagcagccagggcct

SEQ ID NO: 391159 - DNA, 140 bp, Artificial Sequence
  Synthetic
aggccctggctgctgatatgcccaggcccgtctcctatttgaagggctcttcgggtggcccactgctctgcccctcggggcacgctgtaggcatcttccgggctgccgtgtgcacccggggaccttttgggacagcggtg

SEQ ID NO: 391160 - DNA, 140 bp, Artificial Sequence
  Synthetic
caccgctgtcccaaaaggtccccgggtgcacacggcagcccggaagatgcctacagcgtgccccgaggggcagagcagtgggccacccgaagagcccttcaaataggagacgggcctgggcatatcagcagccagggcct

SEQ ID NO: 391161 - DNA, 140 bp, Artificial Sequence
  Synthetic
atacgccatgctgggtctcctctccagcgcagcgggtggaatttcttctgacttcatggaagtcgaagaagactcctatggggttctcttatgatacccgctgctttgactccactgtaacgtacttgggagtcggccat

SEQ ID NO: 391162 - DNA, 140 bp, Artificial Sequence
  Synthetic
atggccgactcccaagtacgttacagtggagtcaaagcagcgggtatcataagagaaccccataggagtcttcttcgacttccatgaagtcagaagaaattccacccgctgcgctggagaggagacccagcatggcgtat

SEQ ID NO: 391163 - DNA, 140 bp, Artificial Sequence
  Synthetic
aggccctggctgctgatatgctctccacacgaactcaatcgggtggctggaagcctcaggaaacttggggtacccccgttgagagcgtggagacatcgggcccgagcagtccgcgctaaggaccttttgggacagcggtg

SEQ ID NO: 391164 - DNA, 140 bp, Artificial Sequence
  Synthetic
caccgctgtcccaaaaggtccttagcgcggactgctcgggcccgatgtctccacgctctcaacgggggtaccccaagtttcctgaggcttccagccacccgattgagttcgtgtggagagcatatcagcagccagggcct

SEQ ID NO: 391165 - DNA, 140 bp, Artificial Sequence
  Synthetic
atacgccatgctgggtctccgcagttgagcctgttgtcttttccgacatggagactaagatcatcacctggggggcagacaccgcagcgtgcggggacatcatcacgggcctaccagtctcgtacttgggagtcggccat

SEQ ID NO: 391166 - DNA, 140 bp, Artificial Sequence
  Synthetic
atggccgactcccaagtacgagactggtaggcccgtgatgatgtccccgcacgctgcggtgtctgccccccaggtgatgatcttagtctccatgtcggaaaagacaacaggctcaactgcggagacccagcatggcgtat

SEQ ID NO: 391167 - DNA, 140 bp, Artificial Sequence
  Synthetic
atacgccatgctgggtctccacaacgtcctctgagcccgcctcctctggctgccccccagactccgacgctgagtcctattcttccatgccccccctggagggggagcctggggatccggcgtacttgggagtcggccat

SEQ ID NO: 391168 - DNA, 140 bp, Artificial Sequence
  Synthetic
atggccgactcccaagtacgccggatccccaggctccccctccagggggggcatggaagaataggactcagcgtcggagtctggggggcagccagaggaggcgggctcagaggacgttgtggagacccagcatggcgtat

SEQ ID NO: 391169 - DNA, 140 bp, Artificial Sequence
  Synthetic
aggccctggctgctgatatgttatgaggccgaccaccacatcttgcaccttccaggttgtgtgccctgcgtgagaacggggaatcagtcacgttgctgggtggcccttactcctaccgtcgaccttttgggacagcggtg

SEQ ID NO: 391170 - DNA, 140 bp, Artificial Sequence
  Synthetic
caccgctgtcccaaaaggtcgacggtaggagtaagggccacccagcaacgtgactgattccccgttctcacgcagggcacacaacctggaaggtgcaagatgtggtggtcggcctcataacatatcagcagccagggcct

SEQ ID NO: 391171 - DNA, 140 bp, Artificial Sequence
  Synthetic
aggccctggctgctgatatgtcagagtaggactacacgattacccggtggggtcgcaattaccttgcgagcctgaaccggacgtggccgtgttaacgtccatgctcactgatccctcccagaccttttgggacagcggtg

SEQ ID NO: 391172 - DNA, 140 bp, Artificial Sequence
  Synthetic
caccgctgtcccaaaaggtctgggagggatcagtgagcatggacgttaacacggccacgtccggttcaggctcgcaaggtaattgcgaccccaccgggtaatcgtgtagtcctactctgacatatcagcagccagggcct

SEQ ID NO: 391173 - DNA, 140 bp, Artificial Sequence
  Synthetic
aggccctggctgctgatatgatgaccactgacaacgtaaaatgcccatgccaggttccgtcccccgaattcttcacagaggtggatggggtgcggttgcacaggttcgccccggtgtgcagaccttttgggacagcggtg

SEQ ID NO: 391174 - DNA, 140 bp, Artificial Sequence
  Synthetic
caccgctgtcccaaaaggtctgcacaccggggcgaacctgtgcaaccgcaccccatccacctctgtgaagaattcgggggacggaacctggcatgggcattttacgttgtcagtggtcatcatatcagcagccagggcct

SEQ ID NO: 391175 - DNA, 140 bp, Artificial Sequence
  Synthetic
atacgccatgctgggtctcccatcaacagcaacgggagctggcatataaacaggactgccctcaactgcaatgacagcttgaacactgggttcttggctagcttgttctacacccacaagcgtacttgggagtcggccat

SEQ ID NO: 391176 - DNA, 140 bp, Artificial Sequence
  Synthetic
atggccgactcccaagtacgcttgtgggtgtagaacaagctagccaagaacccagtgttcaagctgtcattgcagttgagggcagtcctgtttatatgccagctcccgttgctgttgatgggagacccagcatggcgtat

SEQ ID NO: 391177 - DNA, 140 bp, Artificial Sequence
  Synthetic
atacgccatgctgggtctccttcaacagctcagggtgtcccgaacgactcgcaagctgcaaaagccttgatacgttcgaccaaggctggggcccacttggggtcgctgacatcggaggcccgtacttgggagtcggccat

SEQ ID NO: 391178 - DNA, 140 bp, Artificial Sequence
  Synthetic
atggccgactcccaagtacgggcctccgatgtcagcgaccccaagtgggccccagccttggtcgaacgtatcaaggcttttgcagcttgcgagtcgttcgggacaccctgagctgttgaaggagacccagcatggcgtat

SEQ ID NO: 391179 - DNA, 140 bp, Artificial Sequence
  Synthetic
aggccctggctgctgatatgtctttcgagccgcttcgagcggaggaagatgagagggaagtatccgttccggcggagatcctgcggaaatccaggaaattcccccgagcaatgcccatatgaccttttgggacagcggtg

SEQ ID NO: 391180 - DNA, 140 bp, Artificial Sequence
  Synthetic
caccgctgtcccaaaaggtcatatgggcattgctcgggggaatttcctggatttccgcaggatctccgccggaacggatacttccctctcatcttcctccgctcgaagcggctcgaaagacatatcagcagccagggcct

SEQ ID NO: 391181 - DNA, 140 bp, Artificial Sequence
  Synthetic
aggccctggctgctgatatgacctcctgtggcggcaggagatgggcgggaacatcacccgcgtggagtcagagaacaaggtagtaattctggactctttcgacccgcttcgagcggaggagaccttttgggacagcggtg

SEQ ID NO: 391182 - DNA, 140 bp, Artificial Sequence
  Synthetic
caccgctgtcccaaaaggtctcctccgctcgaagcgggtcgaaagagtccagaattactaccttgttctctgactccacgcgggtgatgttcccgcccatctcctgccgccacaggaggtcatatcagcagccagggcct

SEQ ID NO: 391183 - DNA, 140 bp, Artificial Sequence
  Synthetic
  misc_feature (93)..(93): n is a, c, g, or t
atacgccatgctgggtctccgggcccctctacatactccaggcctcgctcctgcgcgttccttacttcgtgagggcacacgcactgctcaagntctgcggcttgttacgcggggtagtctcgtacttgggagtcggccat

SEQ ID NO: 391184 - DNA, 140 bp, Artificial Sequence
  Synthetic
  misc_feature (48)..(48): n is a, c, g, or t
atggccgactcccaagtacgagactaccccgcgtaacaagccgcagancttgagcagtgcgtgtgccctcacgaagtaaggaacgcgcaggagcgaggcctggagtatgtagaggggcccggagacccagcatggcgtat

SEQ ID NO: 391185 - DNA, 140 bp, Artificial Sequence
  Synthetic
atacgccatgctgggtctccactccgcgatttagcggtagccctggagccggttgtgttcacgaccatggagaagaaggtcatcgtctggggcgccgacactgccgcgtgcggcgatatccgtacttgggagtcggccat

SEQ ID NO: 391186 - DNA, 140 bp, Artificial Sequence
  Synthetic
atggccgactcccaagtacggatatcgccgcacgcggcagtgtcggcgccccagacgatgaccttcttctccatggtcgtgaacacaaccggctccagggctaccgctaaatcgcggagtggagacccagcatggcgtat

SEQ ID NO: 391187 - DNA, 140 bp, Artificial Sequence
  Synthetic
aggccctggctgctgatatgtgctggcactaccccccaaaaccttgtggtattgtgcccgcgaagagcgtgtgtggcccagtatattgcttcactcccagccccgtggtggtgggaacgagaccttttgggacagcggtg

SEQ ID NO: 391188 - DNA, 140 bp, Artificial Sequence
  Synthetic
caccgctgtcccaaaaggtctcgttcccaccaccacggggctgggagtgaagcaatatactgggccacacacgctcttcgcgggcacaataccacaaggttttggggggtagtgccagcacatatcagcagccagggcct

SEQ ID NO: 391189 - DNA, 140 bp, Artificial Sequence
  Synthetic
atacgccatgctgggtctccgtacggtcctggaccaagcggagactgctggagtgcgcctcgtcgtgctcgcaaccgctacccctccagggtcggtgactacaccccattccaatatagacgtacttgggagtcggccat

SEQ ID NO: 391190 - DNA, 140 bp, Artificial Sequence
  Synthetic
atggccgactcccaagtacgtctatattggaatggggtgtagtcaccgaccctggaggggtagcggttgcgagcacgacgaggcgcactccagcagtctccgcttggtccaggaccgtacggagacccagcatggcgtat

SEQ ID NO: 391191 - DNA, 140 bp, Artificial Sequence
  Synthetic
atacgccatgctgggtctccgtgagaatcttccataccttgttgcttatcaggccacagtatgcgccagagctctggcacctccaccaagctgggataccatgtggaggtgcctgattcgcgtacttgggagtcggccat

SEQ ID NO: 391192 - DNA, 140 bp, Artificial Sequence
  Synthetic
atggccgactcccaagtacgcgaatcaggcacctccacatggtatcccagcttggtggaggtgccagagctctggcgcatactgtggcctgataagcaacaaggtatggaagattctcacggagacccagcatggcgtat

SEQ ID NO: 391193 - DNA, 140 bp, Artificial Sequence
  Synthetic
atacgccatgctgggtctccgcacatcaacaggaccgctctgaattgcaatgactccctccaaactgggttcattgctgcgctgttctacgcacacaggttcaacgcgtccggatgtccacgtacttgggagtcggccat

SEQ ID NO: 391194 - DNA, 140 bp, Artificial Sequence
  Synthetic
atggccgactcccaagtacgtggacatccggacgcgttgaacctgtgtgcgtagaacagcgcagcaatgaacccagtttggagggagtcattgcaattcagagcggtcctgttgatgtgcggagacccagcatggcgtat

SEQ ID NO: 391195 - DNA, 140 bp, Artificial Sequence
  Synthetic
aggccctggctgctgatatgcctgaactgcaatgactccctccagactgggttccttgccgcgctgttctacacacacaagttcaacgcgtccggatgcccggagcgcatggccagctgcgaccttttgggacagcggtg

SEQ ID NO: 391196 - DNA, 140 bp, Artificial Sequence
  Synthetic
caccgctgtcccaaaaggtcgcagctggccatgcgctccgggcatccggacgcgttgaacttgtgtgtgtagaacagcgcggcaaggaacccagtctggagggagtcattgcagttcaggcatatcagcagccagggcct

SEQ ID NO: 391197 - DNA, 140 bp, Artificial Sequence
  Synthetic
aggccctggctgctgatatgcgccgcattgacgagttcgatcaggggtggggtcccatcacttacgctgagccgagcagctcggaccagaggccttattgctggcactacgcgcctcgacgaccttttgggacagcggtg

SEQ ID NO: 391198 - DNA, 140 bp, Artificial Sequence
  Synthetic
caccgctgtcccaaaaggtcgtcgaggcgcgtagtgccagcaataaggcctctggtccgagctgctcggctcagcgtaagtgatgggaccccacccctgatcgaactcgtcaatgcggcgcatatcagcagccagggcct

SEQ ID NO: 391199 - DNA, 140 bp, Artificial Sequence
  Synthetic
aggccctggctgctgatatgactccacggatgccacatccatcttgggcatcggcactgtccttgaccaagcagagactgcgggggcgagactggttgtgctcgccaccgctacccctccgaccttttgggacagcggtg

SEQ ID NO: 391200 - DNA, 140 bp, Artificial Sequence
  Synthetic
caccgctgtcccaaaaggtcggaggggtagcggtggcgagcacaaccagtctcgcccccgcagtctctgcttggtcaaggacagtgccgatgcccaagatggatgtggcatccgtggagtcatatcagcagccagggcct

SEQ ID NO: 391201 - DNA, 140 bp, Artificial Sequence
  Synthetic
aggccctggctgctgatatgattacctcactgttttacagatacaagttcaactcgtccggatgcccagagcgcatggccagctgccgccccatcgacaagttcgctcaagggtggggtcgaccttttgggacagcggtg

SEQ ID NO: 391202 - DNA, 140 bp, Artificial Sequence
  Synthetic
caccgctgtcccaaaaggtcgaccccacccttgagcgaacttgtcgatggggcggcagctggccatgcgctctgggcatccggacgagttgaacttgtatctgtaaaacagtgaggtaatcatatcagcagccagggcct

SEQ ID NO: 391203 - DNA, 140 bp, Artificial Sequence
  Synthetic
aggccctggctgctgatatgcccccacgcattatgtccctgagtccgacgcggcagcccgcgtgacccagatactatcatccctcactgtgacatcccttctcagacgcctccacaagtggaccttttgggacagcggtg

SEQ ID NO: 391204 - DNA, 140 bp, Artificial Sequence
  Synthetic
caccgctgtcccaaaaggtccacttgtggaggcgtctgagaagggatgtcacagtgagggatgatagtatctgggtcacgcgggctgccgcgtcggactcagggacataatgcgtgggggcatatcagcagccagggcct

SEQ ID NO: 391205 - DNA, 140 bp, Artificial Sequence
  Synthetic
atacgccatgctgggtctccatactatcatccctcactgtgacatcccttctcagacgcctccacaagtggatcaatgaagattgttccactccatgtgccggatcttggctgtgggaggcgtacttgggagtcggccat

SEQ ID NO: 391206 - DNA, 140 bp, Artificial Sequence
  Synthetic
atggccgactcccaagtacgcctcccacagccaagatccggcacatggagtggaacaatcttcattgatccacttgtggaggcgtctgagaagggatgtcacagtgagggatgatagtatggagacccagcatggcgtat

SEQ ID NO: 391207 - DNA, 140 bp, Artificial Sequence
  Synthetic
atacgccatgctgggtctcctatgggattgggtctgtactgtgctgagtgacttcaaatcgtggctaaaagccaagctgatgcctcgcatgccaggtatccccttcctctcgtgccagagcgtacttgggagtcggccat

SEQ ID NO: 391208 - DNA, 140 bp, Artificial Sequence
  Synthetic
atggccgactcccaagtacgctctggcacgagaggaaggggatacctggcatgcgaggcatcagcttggcttttagccacgatttgaagtcactcagcacagtacagacccaatcccataggagacccagcatggcgtat

SEQ ID NO: 391209 - DNA, 140 bp, Artificial Sequence
  Synthetic
aggccctggctgctgatatgatttgacatcaccaagctgctgctggccgtcttcggacccctttggattcttcaaaccagtttgctcaaagtgccctacttcgtgcgcgtccaaggccttgaccttttgggacagcggtg

SEQ ID NO: 391210 - DNA, 140 bp, Artificial Sequence
  Synthetic
caccgctgtcccaaaaggtcaaggccttggacgcgcacgaagtagggcactttgagcaaactggtttgaagaatccaaaggggtccgaagacggccagcagcagcttggtgatgtcaaatcatatcagcagccagggcct

SEQ ID NO: 391211 - DNA, 140 bp, Artificial Sequence
  Synthetic
atacgccatgctgggtctcctgttcctcgctaggctcatatggtggttacaatattttatcaccagggccgaggcgcacttgcaagtgtgggtcccccctcttaatgttcggggaggccgcgtacttgggagtcggccat

SEQ ID NO: 391212 - DNA, 140 bp, Artificial Sequence
  Synthetic
atggccgactcccaagtacgcggcctccccgaacattaagaggggggacccacacttgcaagtgcgcctcggccctggtgataaaatattgtaaccaccatatgagcctagcgaggaacaggagacccagcatggcgtat

SEQ ID NO: 391213 - DNA, 140 bp, Artificial Sequence
  Synthetic
atacgccatgctgggtctcctcgttagctagttcttcggctagccagctgtccgccccgtctcttaaggccacatgcaccggccgccatgactcccctggtactgatctccaatgttgcccgtacttgggagtcggccat

SEQ ID NO: 391214 - DNA, 140 bp, Artificial Sequence
  Synthetic
atggccgactcccaagtacgggcaacattggagatcagtaccaggggagtcatggcggccggtgcatgtggccttaagagacggggcggacagctggctagccgaagaactagctaacgaggagacccagcatggcgtat

SEQ ID NO: 391215 - DNA, 140 bp, Artificial Sequence
  Synthetic
aggccctggctgctgatatgctctgacatggagaccaagatcatcacctggggggcagacaccgcggcgtgtggggacatcatctcgggtctgcccgtctccgcccggagggggagggaggaccttttgggacagcggtg

SEQ ID NO: 391216 - DNA, 140 bp, Artificial Sequence
  Synthetic
caccgctgtcccaaaaggtcctccctccccctccgggcggagacgggcagacccgagatgatgtccccacacgccgcggtgtctgccccccaggtgatgatcttggtctccatgtcagagcatatcagcagccagggcct

SEQ ID NO: 391217 - DNA, 140 bp, Artificial Sequence
  Synthetic
aggccctggctgctgatatgtgtgggcatcttccgggctgccgtgtgcacccggggggttgcgaaggcggtggacttcatacccgttgagtctatggaaactaccatgcggtctccggtcgaccttttgggacagcggtg

SEQ ID NO: 391218 - DNA, 140 bp, Artificial Sequence
  Synthetic
caccgctgtcccaaaaggtcgaccggagaccgcatggtagtttccatagactcaacgggtatgaagtccaccgccttcgcaaccccccgggtgcacacggcagcccggaagatgcccacacatatcagcagccagggcct

SEQ ID NO: 391219 - DNA, 140 bp, Artificial Sequence
  Synthetic
aggccctggctgctgatatgtctgccattccaagaagaaatgtgatgagttcgccgcaaagctgtcgggcctcggactcaatgctgtagcatattaccggggtcttgatgtgtccgtcatgaccttttgggacagcggtg

SEQ ID NO: 391220 - DNA, 140 bp, Artificial Sequence
  Synthetic
caccgctgtcccaaaaggtcatgacggacacatcaagaccccggtaatatgctacagcattgagtccgaggcccgacagctttgcggcgaactcatcacatttcttcttggaatggcagacatatcagcagccagggcct

SEQ ID NO: 391221 - DNA, 140 bp, Artificial Sequence
  Synthetic
aggccctggctgctgatatgctcggactcaatgctgtagcatattaccggggtcttgatgtgtccgtcataccgactagcggagacgtcgttgtcgtggcaacagacgctctaatgacgggaccttttgggacagcggtg

SEQ ID NO: 391222 - DNA, 140 bp, Artificial Sequence
  Synthetic
caccgctgtcccaaaaggtcccgtcattagagcgtctgttgccacgacaacgacgtctccgctagtcggtatgacggacacatcaagaccccggtaatatgctacagcattgagtccgagcatatcagcagccagggcct

SEQ ID NO: 391223 - DNA, 140 bp, Artificial Sequence
  Synthetic
aggccctggctgctgatatgcgtgccccaagacgcggtgtcgcgctcacagcggcgaggcaggactggtaggggcaggatgggcatctataggtttgtgactccaggagaacggccctcggaccttttgggacagcggtg

SEQ ID NO: 391224 - DNA, 140 bp, Artificial Sequence
  Synthetic
caccgctgtcccaaaaggtccgagggccgttctcctggagtcacaaacctatagatgcccatcctgcccctaccagtcctgcctcgccgctgtgagcgcgacaccgcgtcttggggcacgcatatcagcagccagggcct

SEQ ID NO: 391225 - DNA, 140 bp, Artificial Sequence
  Synthetic
aggccctggctgctgatatgttgggcatcggcactgtccttgaccaagcagagactgcaggggcgagactggttgtgctcgccactgctacccctccgggctccgtcactgtgccccatcgaccttttgggacagcggtg

SEQ ID NO: 391226 - DNA, 140 bp, Artificial Sequence
  Synthetic
caccgctgtcccaaaaggtcgatggggcacagtgacggagcccggaggggtagcagtggcgagcacaaccagtctcgcccctgcagtctctgcttggtcaaggacagtgccgatgcccaacatatcagcagccagggcct

SEQ ID NO: 391227 - DNA, 140 bp, Artificial Sequence
  Synthetic
aggccctggctgctgatatggtacggagtcacttactctatcactccgctggacctaccagcaatcattcaaagactccatggcttaagcgcatttacactgcacggatactctccgcacgaccttttgggacagcggtg

SEQ ID NO: 391228 - DNA, 140 bp, Artificial Sequence
  Synthetic
caccgctgtcccaaaaggtcgtgcggagagtatccgtgcagtgtaaatgcgcttaagccatggagtctttgaatgattgctggtaggtccagcggagtgatagagtaagtgactccgtaccatatcagcagccagggcct

SEQ ID NO: 391229 - DNA, 140 bp, Artificial Sequence
  Synthetic
aggccctggctgctgatatgaatacatcatggcatgcatgtcggccgacctggaggtcgtcacgagcacctgggtgctagtaggcggggtcctcgcagctctggccgcgtattgcctgacgaccttttgggacagcggtg

SEQ ID NO: 391230 - DNA, 140 bp, Artificial Sequence
  Synthetic
caccgctgtcccaaaaggtcgtcaggcaatacgcggccagagctgcgaggaccccgcctactagcacccaggtgctcgtgacgacctccaggtcggccgacatgcatgccatgatgtattcatatcagcagccagggcct

SEQ ID NO: 391231 - DNA, 140 bp, Artificial Sequence
  Synthetic
aggccctggctgctgatatggagggggctgtgcagtggatgaaccggctgatagcgttcgcttcgcggggtaaccacgtttcccccacgcactatgtgcctgagagcgacgccgcagcgcgaccttttgggacagcggtg

SEQ ID NO: 391232 - DNA, 140 bp, Artificial Sequence
  Synthetic
caccgctgtcccaaaaggtcgcgctgcggcgtcgctctcaggcacatagtgcgtgggggaaacgtggttaccccgcgaagcgaacgctatcagccggttcatccactgcacagccccctccatatcagcagccagggcct

SEQ ID NO: 391233 - DNA, 140 bp, Artificial Sequence
  Synthetic
aggccctggctgctgatatggtggaagacgggatcaattatgcaacagggaatcttcctggttgctctttttctatcttcctcttggcacttctctcgtgcctgactgttcccgcttcgggaccttttgggacagcggtg

SEQ ID NO: 391234 - DNA, 140 bp, Artificial Sequence
  Synthetic
caccgctgtcccaaaaggtcccgaagcgggaacagtcaggcacgagagaagtgccaagaggaagatagaaaaagagcaaccaggaagattccctgttgcataattgatcccgtcttccaccatatcagcagccagggcct

SEQ ID NO: 391235 - DNA, 140 bp, Artificial Sequence
  Synthetic
atacgccatgctgggtctccccgaattcaagcatagtttatgaggccgaccatcacatcttgcaccttccaggttgcgtgccctgcgtgagagcggggaatcagtcacgttgctgggtggcgtacttgggagtcggccat

SEQ ID NO: 391236 - DNA, 140 bp, Artificial Sequence
  Synthetic
atggccgactcccaagtacgccacccagcaacgtgactgattccccgctctcacgcagggcacgcaacctggaaggtgcaagatgtgatggtcggcctcataaactatgcttgaattcggggagacccagcatggcgtat

SEQ ID NO: 391237 - DNA, 140 bp, Artificial Sequence
  Synthetic
aggccctggctgctgatatgatctacacagggcacatcaccgggcatagaatggcctgggacatgatgatgaactggagtccaacaactactctagtccttagccagctcatgaggatccgaccttttgggacagcggtg

SEQ ID NO: 391238 - DNA, 140 bp, Artificial Sequence
  Synthetic
caccgctgtcccaaaaggtcggatcctcatgagctggctaaggactagagtagttgttggactccagttcatcatcatgtcccaggccattctatgcccggtgatgtgccctgtgtagatcatatcagcagccagggcct

SEQ ID NO: 391239 - DNA, 140 bp, Artificial Sequence
  Synthetic
atacgccatgctgggtctcccctattcctctttgctggagttgatgccgaaacccaggtgtctgggggctcggttgcccgagccgccaacggcctggccaacctcttcacccctggagctcgtacttgggagtcggccat

SEQ ID NO: 391240 - DNA, 140 bp, Artificial Sequence
  Synthetic
atggccgactcccaagtacgagctccaggggtgaagaggttggccaggccgttggcggctcgggcaaccgagcccccagacacctgggtttcggcatcaactccagcaaagaggaataggggagacccagcatggcgtat

SEQ ID NO: 391241 - DNA, 140 bp, Artificial Sequence
  Synthetic
atacgccatgctgggtctccaactgccctcaactgcaatgatagtttaaacactgggttctttgctagcctgttctacaccaacaaattcaacagctcagggtgtcccgaacgactcgcacgtacttgggagtcggccat

SEQ ID NO: 391242 - DNA, 140 bp, Artificial Sequence
  Synthetic
atggccgactcccaagtacgtgcgagtcgttcgggacaccctgagctgttgaatttgttggtgtagaacaggctagcaaagaacccagtgtttaaactatcattgcagttgagggcagttggagacccagcatggcgtat

SEQ ID NO: 391243 - DNA, 140 bp, Artificial Sequence
  Synthetic
aggccctggctgctgatatgtctgagcccgccccctctgcttgccccccagactccgacgctgagtcctgttcttccatgccccccctggagggggagcctggggatccggatctcagcggaccttttgggacagcggtg

SEQ ID NO: 391244 - DNA, 140 bp, Artificial Sequence
  Synthetic
caccgctgtcccaaaaggtccgctgagatccggatccccaggctccccctccagggggggcatggaagaacaggactcagcgtcggagtctggggggcaagcagagggggcgggctcagacatatcagcagccagggcct

SEQ ID NO: 391245 - DNA, 140 bp, Artificial Sequence
  Synthetic
aggccctggctgctgatatgtactgctttactcccagccccatcgtggtcgggacaactgaccgcctcggggtccctacttacacctggggggagaatgagtctgatgtcttccttctaagaccttttgggacagcggtg

SEQ ID NO: 391246 - DNA, 140 bp, Artificial Sequence
  Synthetic
caccgctgtcccaaaaggtcttagaaggaagacatcagactcattctccccccaggtgtaagtagggaccccgaggcggtcagttgtcccgaccacgatggggctgggagtaaagcagtacatatcagcagccagggcct

SEQ ID NO: 391247 - DNA, 140 bp, Artificial Sequence
  Synthetic
  misc_feature (64)..(64): n is a, c, g, or t
atacgccatgctgggtctcctaatgacagtttaaatactgggttcctagctagcttgttctacncccagaagtttaacagctcagggtgccccgaacgactcgcaagctgcaaggcccttcgtacttgggagtcggccat

SEQ ID NO: 391248 - DNA, 140 bp, Artificial Sequence
  Synthetic
  misc_feature (77)..(77): n is a, c, g, or t
atggccgactcccaagtacgaagggccttgcagcttgcgagtcgttcggggcaccctgagctgttaaacttctgggngtagaacaagctagctaggaacccagtatttaaactgtcattaggagacccagcatggcgtat

SEQ ID NO: 391249 - DNA, 140 bp, Artificial Sequence
  Synthetic
aggccctggctgctgatatggttatggagcaggggtggcaggcgcgctcgtggcctttaaggtcatgagtggcgagatgccctccaccgaggacctggtcaacttactccctgccatcctgaccttttgggacagcggtg

SEQ ID NO: 391250 - DNA, 140 bp, Artificial Sequence
  Synthetic
caccgctgtcccaaaaggtcaggatggcagggagtaagttgaccaggtcctcggtggagggcatctcgccactcatgaccttaaaggccacgagcgcgcctgccacccctgctccataaccatatcagcagccagggcct

SEQ ID NO: 391251 - DNA, 140 bp, Artificial Sequence
  Synthetic
aggccctggctgctgatatgaggacttgctggaagacactgagacaccaattgacaccaccatcatggcaaaaaatgaggttttctgcgtccaaccagagaaaggaggccgcaagccagcgaccttttgggacagcggtg

SEQ ID NO: 391252 - DNA, 140 bp, Artificial Sequence
  Synthetic
caccgctgtcccaaaaggtcgctggcttgcggcctcctttctctggttggacgcagaaaacctcattttttgccatgatggtggtgtcaattggtgtctcagtgtcttccagcaagtcctcatatcagcagccagggcct

SEQ ID NO: 391253 - DNA, 140 bp, Artificial Sequence
  Synthetic
atacgccatgctgggtctcccatgtctatattccatctttcgacgtgcgtgggcctcgtgactcactgatcatccttgctgtcctggcatgcccacacctgatatttgacatcacaaagtcgtacttgggagtcggccat

SEQ ID NO: 391254 - DNA, 140 bp, Artificial Sequence
  Synthetic
atggccgactcccaagtacgactttgtgatgtcaaatatcaggtgtgggcatgccaggacagcaaggatgatcagtgagtcacgaggcccacgcacgtcgaaagatggaatatagacatgggagacccagcatggcgtat

SEQ ID NO: 391255 - DNA, 140 bp, Artificial Sequence
  Synthetic
aggccctggctgctgatatgcatccttgctgtcctggcatgcccacacctgatatttgacatcacaaagtatctcctagccatcttggggcccctctacatactccaagcctcgctcacggaccttttgggacagcggtg

SEQ ID NO: 391256 - DNA, 140 bp, Artificial Sequence
  Synthetic
caccgctgtcccaaaaggtccgtgagcgaggcttggagtatgtagaggggccccaagatggctaggagatactttgtgatgtcaaatatcaggtgtgggcatgccaggacagcaaggatgcatatcagcagccagggcct

SEQ ID NO: 391257 - DNA, 140 bp, Artificial Sequence
  Synthetic
atacgccatgctgggtctccaatgagatcttgctcgggccggccgactcagaaacatccaaggggtggagactccttgcccccatcacagcatacgcgcagcagacccgcggcttgttcacgtacttgggagtcggccat

SEQ ID NO: 391258 - DNA, 140 bp, Artificial Sequence
  Synthetic
atggccgactcccaagtacgtgaacaagccgcgggtctgctgcgcgtatgctgtgatgggggcaaggagtctccaccccttggatgtttctgagtcggccggcccgagcaagatctcattggagacccagcatggcgtat

SEQ ID NO: 391259 - DNA, 140 bp, Artificial Sequence
  Synthetic
atacgccatgctgggtctccaaggcgcccagcagaacatccagctgatcaacaccaacggcagctggcacatcaatagaacggccttgaactgcaatgatagccttaacaccggctggatcgtacttgggagtcggccat

SEQ ID NO: 391260 - DNA, 140 bp, Artificial Sequence
  Synthetic
atggccgactcccaagtacgatccagccggtgttaaggctatcattgcagttcaaggccgttctattgatgtgccagctgccgttggtgttgatcagctggatgttctgctgggcgccttggagacccagcatggcgtat

SEQ ID NO: 391261 - DNA, 140 bp, Artificial Sequence
  Synthetic
atacgccatgctgggtctccgtcgcggccacactgggatttggggcgtacatgtctaaggcatacggcattgacccaaacattcggtcaggagtcaggaccatcactacgggtgcgccaacgtacttgggagtcggccat

SEQ ID NO: 391262 - DNA, 140 bp, Artificial Sequence
  Synthetic
atggccgactcccaagtacgttggcgcacccgtagtgatggtcctgactcctgaccgaatgtttgggtcaatgccgtatgccttagacatgtacgccccaaatcccagtgtggccgcgacggagacccagcatggcgtat

SEQ ID NO: 391263 - DNA, 140 bp, Artificial Sequence
  Synthetic
aggccctggctgctgatatgaagtgcgcaactccacggggctttaccatgtcaccaatgattgccctaactcgagtattgtgtacgagacggctgatgccatcctacactctccggggtggaccttttgggacagcggtg

SEQ ID NO: 391264 - DNA, 140 bp, Artificial Sequence
  Synthetic
caccgctgtcccaaaaggtccaccccggagagtgtaggatggcatcagccgtctcgtacacaatactcgagttagggcaatcattggtgacatggtaaagccccgtggagttgcgcacttcatatcagcagccagggcct

SEQ ID NO: 391265 - DNA, 140 bp, Artificial Sequence
  Synthetic
aggccctggctgctgatatgcgcaactgcacgtgtgggttccccccctcaacgttcgaggggggcgcgatgccgtcatcttactcatgtgtgttgtacacccgactttggtattcgacatgaccttttgggacagcggtg

SEQ ID NO: 391266 - DNA, 140 bp, Artificial Sequence
  Synthetic
caccgctgtcccaaaaggtcatgtcgaataccaaagtcgggtgtacaacacacatgagtaagatgacggcatcgcgcccccctcgaacgttgagggggggaacccacacgtgcagttgcgcatatcagcagccagggcct

SEQ ID NO: 391267 - DNA, 140 bp, Artificial Sequence
  Synthetic
atacgccatgctgggtctcctgattgtgatgctactctttgccggcgttgacggaaccacccgcgtgtcaggggcggcggcgggttacaatacccgcggctttacatctctctttggatccgtacttgggagtcggccat

SEQ ID NO: 391268 - DNA, 140 bp, Artificial Sequence
  Synthetic
atggccgactcccaagtacggatccaaagagagatgtaaagccgcgggtattgtaacccgccgccgcccctgacacgcgggtggttccgtcaacgccggcaaagagtagcatcacaatcaggagacccagcatggcgtat

SEQ ID NO: 391269 - DNA, 140 bp, Artificial Sequence
  Synthetic
atacgccatgctgggtctccgcacatcaacaggacagccctgaactgcaacgattccctcaacaccgggtttattgctgcgctgttctacacgcacaagttcaactcatctggatgcccacgtacttgggagtcggccat

SEQ ID NO: 391270 - DNA, 140 bp, Artificial Sequence
  Synthetic
atggccgactcccaagtacgtgggcatccagatgagttgaacttgtgcgtgtagaacagcgcagcaataaacccggtgttgagggaatcgttgcagttcagggctgtcctgttgatgtgcggagacccagcatggcgtat

SEQ ID NO: 391271 - DNA, 140 bp, Artificial Sequence
  Synthetic
aggccctggctgctgatatgccacagtgtgtgccagagctctggcacccccaccaagctgggacaccatgtggaagtgcctaatccgcctcaagcctaccctgcatggccccacacctctgaccttttgggacagcggtg

SEQ ID NO: 391272 - DNA, 140 bp, Artificial Sequence
  Synthetic
caccgctgtcccaaaaggtcagaggtgtggggccatgcagggtaggcttgaggcggattaggcacttccacatggtgtcccagcttggtgggggtgccagagctctggcacacactgtggcatatcagcagccagggcct

SEQ ID NO: 391273 - DNA, 140 bp, Artificial Sequence
  Synthetic
aggccctggctgctgatatgagcacgtgggtcctagtgggcggcgtcctggcagccctagctgcttactgtctttcagtgggcagcgtggtgattgtcgggagagttgtcctgtcgggccgaccttttgggacagcggtg

SEQ ID NO: 391274 - DNA, 140 bp, Artificial Sequence
  Synthetic
caccgctgtcccaaaaggtcggcccgacaggacaactctcccgacaatcaccacgctgcccactgaaagacagtaagcagctagggctgccaggacgccgcccactaggacccacgtgctcatatcagcagccagggcct

SEQ ID NO: 391275 - DNA, 140 bp, Artificial Sequence
  Synthetic
aggccctggctgctgatatgatggaggagtgctccaaccatcttccactagtcgagaaacgggtacacctggcagagcaattcaagcagaaggccctaggtcttctaagttccgctggcagaccttttgggacagcggtg

SEQ ID NO: 391276 - DNA, 140 bp, Artificial Sequence
  Synthetic
caccgctgtcccaaaaggtctgccagcggaacttagaagacctagggccttctgcttgaattgctctgccaggtgtacccgtttctcgactagtggaagatggttggagcactcctccatcatatcagcagccagggcct

SEQ ID NO: 391277 - DNA, 140 bp, Artificial Sequence
  Synthetic
aggccctggctgctgatatgtaggtgcatggttgactacccatacaggctttggcactacccctgcactgtcaatttttccatcttcaaggttaggatgtacgtggggggcgtggagcacgaccttttgggacagcggtg

SEQ ID NO: 391278 - DNA, 140 bp, Artificial Sequence
  Synthetic
caccgctgtcccaaaaggtcgtgctccacgccccccacgtacatcctaaccttgaagatggaaaaattgacagtgcaggggtagtgccaaagcctgtatgggtagtcaaccatgcacctacatatcagcagccagggcct

SEQ ID NO: 391279 - DNA, 140 bp, Artificial Sequence
  Synthetic
aggccctggctgctgatatgtctcgctggactgtctaccctgccaggcaatcctgccattgcttccctcatgtcttttactgccgccgttacaagccctctgaccactcaacaaaccctcgaccttttgggacagcggtg

SEQ ID NO: 391280 - DNA, 140 bp, Artificial Sequence
  Synthetic
caccgctgtcccaaaaggtcgagggtttgttgagtggtcagagggcttgtaacggcggcagtaaaagacatgagggaagcaatggcaggattgcctggcagggtagacagtccagcgagacatatcagcagccagggcct

SEQ ID NO: 391281 - DNA, 140 bp, Artificial Sequence
  Synthetic
aggccctggctgctgatatgaggctcaacgccgcatgcaattggactcgaggagagcgttgtgacttggaggacagggatagatcagagcttagcccgctgctgctgtctacaacagagtgaccttttgggacagcggtg

SEQ ID NO: 391282 - DNA, 140 bp, Artificial Sequence
  Synthetic
caccgctgtcccaaaaggtcactctgttgtagacagcagcagcgggctaagctctgatctatccctgtcctccaagtcacaacgctctcctcgagtccaattgcatgcggcgttgagcctcatatcagcagccagggcct

SEQ ID NO: 391283 - DNA, 140 bp, Artificial Sequence
  Synthetic
atacgccatgctgggtctccgtgtgggccttggcaagattctagtggacatcctcgctggctacggcgccggcgtagctggcgctgtggtcacttttaagatcatgagcggcgagatgcccgtacttgggagtcggccat

SEQ ID NO: 391284 - DNA, 140 bp, Artificial Sequence
  Synthetic
atggccgactcccaagtacgggcatctcgccgctcatgatcttaaaagtgaccacagcgccagctacgccggcgccgtagccagcgaggatgtccactagaatcttgccaaggcccacacggagacccagcatggcgtat

SEQ ID NO: 391285 - DNA, 140 bp, Artificial Sequence
  Synthetic
atacgccatgctgggtctccactatgtgacgggcgtcaccactgataatcttaagtgcccatgccaggtcccatcgcccgaatttttcacagaactagatggggtgcgtctgcatagattcgtacttgggagtcggccat

SEQ ID NO: 391286 - DNA, 140 bp, Artificial Sequence
  Synthetic
atggccgactcccaagtacgaatctatgcagacgcaccccatctagttctgtgaaaaattcgggcgatgggacctggcatgggcacttaagattatcagtggtgacgcccgtcacatagtggagacccagcatggcgtat

SEQ ID NO: 391287 - DNA, 140 bp, Artificial Sequence
  Synthetic
aggccctggctgctgatatgcgatctcctcgaggctaacctcttgtgggggtctaccgctaccagggttgagacagacgagaaggtgataatactggactcttttgagccacgtgtggctgaccttttgggacagcggtg

SEQ ID NO: 391288 - DNA, 140 bp, Artificial Sequence
  Synthetic
caccgctgtcccaaaaggtcagccacacgtggctcaaaagagtccagtattatcaccttctcgtctgtctcaaccctggtagcggtagacccccacaagaggttagcctcgaggagatcgcatatcagcagccagggcct

SEQ ID NO: 391289 - DNA, 140 bp, Artificial Sequence
  Synthetic
atacgccatgctgggtctcctacttgaaaggctcctcggggggtccgctgttgtgccccgcggggcacgccgtaggcatattcagggccgcggtgtgtacccgtggagtggctaaagcggcgtacttgggagtcggccat

SEQ ID NO: 391290 - DNA, 140 bp, Artificial Sequence
  Synthetic
atggccgactcccaagtacgccgctttagccactccacgggtacacaccgcggccctgaatatgcctacggcgtgccccgcggggcacaacagcggaccccccgaggagcctttcaagtaggagacccagcatggcgtat

SEQ ID NO: 391291 - DNA, 140 bp, Artificial Sequence
  Synthetic
atacgccatgctgggtctccagcatatgacctggaactaataacatcatgttcatccaacgtctcggtcgcgcatgacgcaacgggtaagaaggtatactacctgacccgagacccagaacgtacttgggagtcggccat

SEQ ID NO: 391292 - DNA, 140 bp, Artificial Sequence
  Synthetic
atggccgactcccaagtacgttctgggtctcgggtcaggtagtataccttcttacccgttgcgtcatgcgcgaccgagacgttggatgaacatgatgttattagttccaggtcatatgctggagacccagcatggcgtat

SEQ ID NO: 391293 - DNA, 140 bp, Artificial Sequence
  Synthetic
atacgccatgctgggtctccactcccttggcgcgagccgcatgggagacagtccgacacactccagtcaattcctggttgggaaacatcatagtctacgctcccacaatatgggtgcgtacgtacttgggagtcggccat

SEQ ID NO: 391294 - DNA, 140 bp, Artificial Sequence
  Synthetic
atggccgactcccaagtacgtacgcacccatattgtgggagcgtagactatgatgtttcccaaccaggaattgactggagtgtgtcggactgtctcccatgcggctcgcgccaagggagtggagacccagcatggcgtat

SEQ ID NO: 391295 - DNA, 140 bp, Artificial Sequence
  Synthetic
aggccctggctgctgatatgcggctgttggcagcataggccttggaaaggtgctcgtggacatcttggcgggttatggggcaggggtggcaggcgcactcgtggcctttaaaatcatgaggaccttttgggacagcggtg

SEQ ID NO: 391296 - DNA, 140 bp, Artificial Sequence
  Synthetic
caccgctgtcccaaaaggtcctcatgattttaaaggccacgagtgcgcctgccacccctgccccataacccgccaagatgtccacgagcacctttccaaggcctatgctgccaacagccgcatatcagcagccagggcct

SEQ ID NO: 391297 - DNA, 140 bp, Artificial Sequence
  Synthetic
aggccctggctgctgatatgcgggggagacatttatcacagcgtgtctcgtgcccgaccccgctatttactcctgtgcctactcctactttccgtaggggtaggcatcttcctgctgcctgaccttttgggacagcggtg

SEQ ID NO: 391298 - DNA, 140 bp, Artificial Sequence
  Synthetic
caccgctgtcccaaaaggtcaggcagcaggaagatgcctacccctacggaaagtaggagtaggcacaggagtaaatagcggggtcgggcacgagacacgctgtgataaatgtctcccccgcatatcagcagccagggcct

SEQ ID NO: 391299 - DNA, 140 bp, Artificial Sequence
  Synthetic
atacgccatgctgggtctcctacaaaagcctgtggagctcctccatgcgaggttcagaccaacaatggaacctggtcctgccccactgattgtttcaggaagcatccggagaccacctaccgtacttgggagtcggccat

SEQ ID NO: 391300 - DNA, 140 bp, Artificial Sequence
  Synthetic
atggccgactcccaagtacggtaggtggtctccggatgcttcctgaaacaatcagtggggcaggaccaggttccattgttggtctgaacctcgcatggaggagctccacaggcttttgtaggagacccagcatggcgtat

SEQ ID NO: 391301 - DNA, 140 bp, Artificial Sequence
  Synthetic
aggccctggctgctgatatggggagacggcatcatgcaaaccacctgcccatgtggagcacaaatcaccggacatgtcaaaaacggttccatgaggatcgttgggcctaaaacctgtagcgaccttttgggacagcggtg

SEQ ID NO: 391302 - DNA, 140 bp, Artificial Sequence
  Synthetic
caccgctgtcccaaaaggtcgctacaggttttaggcccaacgatcctcatggaaccgtttttgacatgtccggtgatttgtgctccacatgggcaggtggtttgcatgatgccgtctccccatatcagcagccagggcct

SEQ ID NO: 391303 - DNA, 140 bp, Artificial Sequence
  Synthetic
atacgccatgctgggtctcctatgggcacgcccggattacaatccaccacttttacagccctggaaggacccggactacgtccctccggtagtacacgggtgcccattgccgcctgctaacgtacttgggagtcggccat

SEQ ID NO: 391304 - DNA, 140 bp, Artificial Sequence
  Synthetic
atggccgactcccaagtacgttagcaggcggcaatgggcacccgtgtactaccggagggacgtagtccgggtccttccagggctgtaaaagtggtggattgtaatccgggcgtgcccataggagacccagcatggcgtat

SEQ ID NO: 391305 - DNA, 140 bp, Artificial Sequence
  Synthetic
aggccctggctgctgatatgcccgtgaccctacaacccccctcgcgagagccgcgtgggagacagcaagacacactccagtcaattcctggctaggcaacataatcatgtttgcccccacgaccttttgggacagcggtg

SEQ ID NO: 391306 - DNA, 140 bp, Artificial Sequence
  Synthetic
caccgctgtcccaaaaggtcgtgggggcaaacatgattatgttgcctagccaggaattgactggagtgtgtcttgctgtctcccacgcggctctcgcgaggggggttgtagggtcacgggcatatcagcagccagggcct

SEQ ID NO: 391307 - DNA, 140 bp, Artificial Sequence
  Synthetic
atacgccatgctgggtctccggtccctacttacacctggggggagaacgagactgatgtcttccttttgaactcgaccagaccgccgcatggtgcgtggtttggatgcgtgtggatgaaccgtacttgggagtcggccat

SEQ ID NO: 391308 - DNA, 140 bp, Artificial Sequence
  Synthetic
atggccgactcccaagtacggttcatccacacgcatccaaaccacgcaccatgcggcggtctggtcgagttcaaaaggaagacatcagtctcgttctccccccaggtgtaagtagggaccggagacccagcatggcgtat

SEQ ID NO: 391309 - DNA, 140 bp, Artificial Sequence
  Synthetic
atacgccatgctgggtctccagactacctacgccaagtgcggatcagggccttggatcacaccacgctgcctgattgattacccgtaccggctgtggcatttcccgtgcaccgccaacttcgtacttgggagtcggccat

SEQ ID NO: 391310 - DNA, 140 bp, Artificial Sequence
  Synthetic
atggccgactcccaagtacgaagttggcggtgcacgggaaatgccacagccggtacgggtaatcaatcaggcagcgtggtgtgatccaaggccctgatccgcacttggcgtaggtagtctggagacccagcatggcgtat

SEQ ID NO: 391311 - DNA, 140 bp, Artificial Sequence
  Synthetic
aggccctggctgctgatatgcgagttcctggtgaatgcctggaaatcaaagaaaagccctatgggcttcgcatatgacacccgctgttttgactcaacggtcactgagagtgacatccgtgaccttttgggacagcggtg

SEQ ID NO: 391312 - DNA, 140 bp, Artificial Sequence
  Synthetic
caccgctgtcccaaaaggtcacggatgtcactctcagtgaccgttgagtcaaaacagcgggtgtcatatgcgaagcccatagggcttttctttgatttccaggcattcaccaggaactcgcatatcagcagccagggcct

SEQ ID NO: 391313 - DNA, 140 bp, Artificial Sequence
  Synthetic
atacgccatgctgggtctccctccgtctttaacatcaggacatttgtcggcggtatagagcatcggatgcaagcggcatgcaactggaccaggggggaagtctgtggcttggagcacaggcgtacttgggagtcggccat

SEQ ID NO: 391314 - DNA, 140 bp, Artificial Sequence
  Synthetic
atggccgactcccaagtacgcctgtgctccaagccacagacttcccccctggtccagttgcatgccgcttgcatccgatgctctataccgccgacaaatgtcctgatgttaaagacggagggagacccagcatggcgtat

SEQ ID NO: 391315 - DNA, 140 bp, Artificial Sequence
  Synthetic
atacgccatgctgggtctccacctccaccaaaatatcgtggacgtccagtacctctatggtgttggatctgcagtggtatcttgggcccttaagtgggaatatgtggtgctcgcgttcctcgtacttgggagtcggccat

SEQ ID NO: 391316 - DNA, 140 bp, Artificial Sequence
  Synthetic
atggccgactcccaagtacgaggaacgcgagcaccacatattcccacttaagggcccaagataccactgcagatccaacaccatagaggtactggacgtccacgatattttggtggaggtggagacccagcatggcgtat

SEQ ID NO: 391317 - DNA, 140 bp, Artificial Sequence
  Synthetic
aggccctggctgctgatatggcagtggtatcttgggcccttaagtgggaatatgtggtgctcgcgttcctgcttctcgcggacgcgagagtctctgcctacctatggatgatgtttatgggaccttttgggacagcggtg

SEQ ID NO: 391318 - DNA, 140 bp, Artificial Sequence
  Synthetic
caccgctgtcccaaaaggtcccataaacatcatccataggtaggcagagactctcgcgtccgcgagaagcaggaacgcgagcaccacatattcccacttaagggcccaagataccactgccatatcagcagccagggcct

SEQ ID NO: 391319 - DNA, 140 bp, Artificial Sequence
  Synthetic
atacgccatgctgggtctcctcagccgctggtgcccaaggcttctggtacgccatcctcttcatctgcattgtctggcatgtcaagggccggttcccagctgctgctgcctacgcagcctcgtacttgggagtcggccat

SEQ ID NO: 391320 - DNA, 140 bp, Artificial Sequence
  Synthetic
atggccgactcccaagtacgaggctgcgtaggcagcagcagctgggaaccggcccttgacatgccagacaatgcagatgaagaggatggcgtaccagaagccttgggcaccagcggctgaggagacccagcatggcgtat

SEQ ID NO: 391321 - DNA, 140 bp, Artificial Sequence
  Synthetic
atacgccatgctgggtctcccatgctgaccattctgacactgtctccgcactacaagttatggctggctaggggattgtggtggatccaatattttatagctaggaccgaggctgtgctgcgtacttgggagtcggccat

SEQ ID NO: 391322 - DNA, 140 bp, Artificial Sequence
  Synthetic
atggccgactcccaagtacgcagcacagcctcggtcctagctataaaatattggatccaccacaatcccctagccagccataacttgtagtgcggagacagtgtcagaatggtcagcatgggagacccagcatggcgtat

SEQ ID NO: 391323 - DNA, 140 bp, Artificial Sequence
  Synthetic
atacgccatgctgggtctccatcttctggccatcttagggcccctccacatactccaggcctcgctcctacgcatcccttactttgtgagggcacaagcgctggttaagatctgcagcttcgtacttgggagtcggccat

SEQ ID NO: 391324 - DNA, 140 bp, Artificial Sequence
  Synthetic
atggccgactcccaagtacgaagctgcagatcttaaccagcgcttgtgccctcacaaagtaagggatgcgtaggagcgaggcctggagtatgtggaggggccctaagatggccagaagatggagacccagcatggcgtat

SEQ ID NO: 391325 - DNA, 140 bp, Artificial Sequence
  Synthetic
aggccctggctgctgatatgcgcatcccttactttgtgagggcacaagcgctggttaagatctgcagcttgttgcgtggggtagtttatggcaagtacttccaaatggtcgtgcttaaaagaccttttgggacagcggtg

SEQ ID NO: 391326 - DNA, 140 bp, Artificial Sequence
  Synthetic
caccgctgtcccaaaaggtcttttaagcacgaccatttggaagtacttgccataaactaccccacgcaacaagctgcagatcttaaccagcgcttgtgccctcacaaagtaagggatgcgcatatcagcagccagggcct

SEQ ID NO: 391327 - DNA, 140 bp, Artificial Sequence
  Synthetic
aggccctggctgctgatatgtgtgttcacgcccatggagaagaaagtcatcgtctggggcgctgacaccgctgcgtgcggagacatcataaggggattacctgtttcggccaggttgggcgaccttttgggacagcggtg

SEQ ID NO: 391328 - DNA, 140 bp, Artificial Sequence
  Synthetic
caccgctgtcccaaaaggtcgcccaacctggccgaaacaggtaatccccttatgatgtctccgcacgcagcggtgtcagcgccccagacgatgactttcttctccatgggcgtgaacacacatatcagcagccagggcct

SEQ ID NO: 391329 - DNA, 140 bp, Artificial Sequence
  Synthetic
  misc_feature (48)..(48): n is a, c, g, or t
atacgccatgctgggtctccactccttgcccccatcacagcatacgcncagcagacccgcggcttgttcagcaccatcgtaacgagcctcactggcagggacaccaatgagaattgtggccgtacttgggagtcggccat

SEQ ID NO: 391330 - DNA, 140 bp, Artificial Sequence
  Synthetic
  misc_feature (93)..(93): n is a, c, g, or t
atggccgactcccaagtacggccacaattctcattggtgtccctgccagtgaggctcgttacgatggtgctgaacaagccgcgggtctgctgngcgtatgctgtgatgggggcaaggagtggagacccagcatggcgtat

SEQ ID NO: 391331 - DNA, 140 bp, Artificial Sequence
  Synthetic
atacgccatgctgggtctccgctggcactatcccccaagaccttgcggcattgtgcgcgcaaggagagtgtgtggtccggtatattgcttcacccctagccccgtggtggtggggacgaccgtacttgggagtcggccat

SEQ ID NO: 391332 - DNA, 140 bp, Artificial Sequence
  Synthetic
atggccgactcccaagtacggtcgtccccaccaccacggggctaggggtgaagcaatataccggaccacacactctccttgcgcgcacaatgccgcaaggtcttgggggatagtgccagcggagacccagcatggcgtat

SEQ ID NO: 391333 - DNA, 140 bp, Artificial Sequence
  Synthetic
aggccctggctgctgatatggcggcccgaagggacctgtcaatcaaatgtacactaatgttgaccaagacttggtggggtggccagcaccccccggagtcagatctcttgctccgtgcacgaccttttgggacagcggtg

SEQ ID NO: 391334 - DNA, 140 bp, Artificial Sequence
  Synthetic
caccgctgtcccaaaaggtcgtgcacggagcaagagatctgactccggggggtgctggccaccccaccaagtcttggtcaacattagtgtacatttgattgacaggtcccttcgggccgccatatcagcagccagggcct

SEQ ID NO: 391335 - DNA, 140 bp, Artificial Sequence
  Synthetic
atacgccatgctgggtctccatatccattcttaagggatcttccggaggtccgctgctgtgccccatgggacaccgcgccggcatattccgtgcggcggtgtgtactcggggggtagccacgtacttgggagtcggccat

SEQ ID NO: 391336 - DNA, 140 bp, Artificial Sequence
  Synthetic
atggccgactcccaagtacgtggctaccccccgagtacacaccgccgcacggaatatgccggcgcggtgtcccatggggcacagcagcggacctccggaagatcccttaagaatggatatggagacccagcatggcgtat

SEQ ID NO: 391337 - DNA, 140 bp, Artificial Sequence
  Synthetic
atacgccatgctgggtctccttgaggtgacaaagatcctgatggccttgctcggttcaatgtacttgctccagtacagtttccttaagacaccatactttgtccgggcacacattctgctcgtacttgggagtcggccat

SEQ ID NO: 391338 - DNA, 140 bp, Artificial Sequence
  Synthetic
atggccgactcccaagtacgagcagaatgtgtgcccggacaaagtatggtgtcttaaggaaactgtactggagcaagtacattgaaccgagcaaggccatcaggatctttgtcacctcaaggagacccagcatggcgtat

SEQ ID NO: 391339 - DNA, 140 bp, Artificial Sequence
  Synthetic
atacgccatgctgggtctccaggcggtagacttcgtcccggttgaatctcttgagactaccatgagatcaccagtgttcactgacaactcaacacccccagcagtgccccagacctaccacgtacttgggagtcggccat

SEQ ID NO: 391340 - DNA, 140 bp, Artificial Sequence
  Synthetic
atggccgactcccaagtacgtggtaggtctggggcactgctgggggtgttgagttgtcagtgaacactggtgatctcatggtagtctcaagagattcaaccgggacgaagtctaccgcctggagacccagcatggcgtat

SEQ ID NO: 391341 - DNA, 140 bp, Artificial Sequence
  Synthetic
aggccctggctgctgatatgtgcttccgcttatgaagtgcgcaacgtgtccgggatataccatgtcacgaacgactgctccaactcaagtattgtgtatgaggcagcggacatgatcatggaccttttgggacagcggtg

SEQ ID NO: 391342 - DNA, 140 bp, Artificial Sequence
  Synthetic
caccgctgtcccaaaaggtccatgatcatgtccgctgcctcatacacaatacttgagttggagcagtcgttcgtgacatggtatatcccggacacgttgcgcacttcataagcggaagcacatatcagcagccagggcct

SEQ ID NO: 391343 - DNA, 140 bp, Artificial Sequence
  Synthetic
aggccctggctgctgatatgctacgacaatacgacgccatgtcgacttgctcgttggggcggctgctttctgctccgctatgtacgtgggggatctctgcggatctgtcttcctcgtctcgaccttttgggacagcggtg

SEQ ID NO: 391344 - DNA, 140 bp, Artificial Sequence
  Synthetic
caccgctgtcccaaaaggtcgagacgaggaagacagatccgcagagatcccccacgtacatagcggagcagaaagcagccgccccaacgagcaagtcgacatggcgtcgtattgtcgtagcatatcagcagccagggcct

SEQ ID NO: 391345 - DNA, 140 bp, Artificial Sequence
  Synthetic
aggccctggctgctgatatgccagctgttcaccttctcgcctcgccggcatgagacagtgcaggactgcaattgctcaatctatcccggccacgtaacaggtcaccgcatggcttgggatgaccttttgggacagcggtg

SEQ ID NO: 391346 - DNA, 140 bp, Artificial Sequence
  Synthetic
caccgctgtcccaaaaggtcatcccaagccatgcggtgacctgttacgtggccgggatagattgagcaattgcagtcctgcactgtctcatgccggcgaggcgagaaggtgaacagctggcatatcagcagccagggcct

SEQ ID NO: 391347 - DNA, 140 bp, Artificial Sequence
  Synthetic
aggccctggctgctgatatgacatctcttggtctgaatgccgtagcctactacagaggcttagacgtttcggtgattcccacgtctggggacgtcgtggtatgcgccacggacgccctcagaccttttgggacagcggtg

SEQ ID NO: 391348 - DNA, 140 bp, Artificial Sequence
  Synthetic
caccgctgtcccaaaaggtctgagggcgtccgtggcgcataccacgacgtccccagacgtgggaatcaccgaaacgtctaagcctctgtagtaggctacggcattcagaccaagagatgtcatatcagcagccagggcct

SEQ ID NO: 391349 - DNA, 140 bp, Artificial Sequence
  Synthetic
atacgccatgctgggtctccatcaacagcactgccctcaattgcaatgactctcttcacactgggttccttgccgggctgttctaccagggcaaattcaatgcgtccggatgcacagagccgtacttgggagtcggccat

SEQ ID NO: 391350 - DNA, 140 bp, Artificial Sequence
  Synthetic
atggccgactcccaagtacggctctgtgcatccggacgcattgaatttgccctggtagaacagcccggcaaggaacccagtgtgaagagagtcattgcaattgagggcagtgctgttgatggagacccagcatggcgtat

SEQ ID NO: 391351 - DNA, 140 bp, Artificial Sequence
  Synthetic
aggccctggctgctgatatgctggattcgttgcctcgctgttctacgcacacaggttcaactcatctggatgcccggagcgcttggccagctgccgccccattgataagtttgctcaggggaccttttgggacagcggtg

SEQ ID NO: 391352 - DNA, 140 bp, Artificial Sequence
  Synthetic
caccgctgtcccaaaaggtcccctgagcaaacttatcaatggggcggcagctggccaagcgctccgggcatccagatgagttgaacctgtgtgcgtagaacagcgaggcaacgaatccagcatatcagcagccagggcct

SEQ ID NO: 391353 - DNA, 140 bp, Artificial Sequence
  Synthetic
aggccctggctgctgatatgctcacccctcttcgggactgggcgcacaacggcctgcgagatctggccgtggctgtagagccggtcgtcttctcccgaatggagaccaagctcatcacgtgaccttttgggacagcggtg

SEQ ID NO: 391354 - DNA, 140 bp, Artificial Sequence
  Synthetic
caccgctgtcccaaaaggtcacgtgatgagcttggtctccattcgggagaagacgaccggctctacagccacggccagatctcgcaggccgttgtgcgcccagtcccgaagaggggtgagcatatcagcagccagggcct

SEQ ID NO: 391355 - DNA, 140 bp, Artificial Sequence
  Synthetic
atacgccatgctgggtctccgtgtgcggtccagtgtattgcttcaccccaagccctgttgtggtggggacaccgatccgctccggtgtccctacgtatacgtggggggagaatgagacagcgtacttgggagtcggccat

SEQ ID NO: 391356 - DNA, 140 bp, Artificial Sequence
  Synthetic
atggccgactcccaagtacgctgtctcattctccccccacgtatacgtagggacaccggagcggatcggtgtccccaccacaacagggcttggggtgaagcaatacactggaccgcacacggagacccagcatggcgtat

SEQ ID NO: 391357 - DNA, 140 bp, Artificial Sequence
  Synthetic
atacgccatgctgggtctcctggaagtgcctaattcgccttaagcccaccctgcacgggcccacgcccctcctctacagactggggtctgtgcagaatgaagtggtgctcacccatcccacgtacttgggagtcggccat

SEQ ID NO: 391358 - DNA, 140 bp, Artificial Sequence
  Synthetic
atggccgactcccaagtacgtgggatgggtgagcaccacttcattctgcacagaccccagtctgtagaggaggggcgtgggcccgtgcagggtgggcttaaggcgaattaggcacttccaggagacccagcatggcgtat

SEQ ID NO: 391359 - DNA, 140 bp, Artificial Sequence
  Synthetic
atacgccatgctgggtctccatggaggagtgttccaaacacctcccactagtcgagcacgggttacaactggctgagcagttcaagcagaaggccttaggtctcctaaatttcgctggcacgtacttgggagtcggccat

SEQ ID NO: 391360 - DNA, 140 bp, Artificial Sequence
  Synthetic
atggccgactcccaagtacgtgccagcgaaatttaggagacctaaggccttctgcttgaactgctcagccagttgtaacccgtgctcgactagtgggaggtgtttggaacactcctccatggagacccagcatggcgtat

SEQ ID NO: 391361 - DNA, 140 bp, Artificial Sequence
  Synthetic
atacgccatgctgggtctcctgtcctgttgcttttcctactcctagcagacgcgcgcgtctgcgcctgcttgtggacgatgctgctgatagctcaggcagaggccgccttagagaacctgcgtacttgggagtcggccat

SEQ ID NO: 391362 - DNA, 140 bp, Artificial Sequence
  Synthetic
atggccgactcccaagtacgcaggttctctaaggcggcctctgcctgagctatcagcagcatcgtccacaagcaggcgcagacgcgcgcgtctgctaggagtaggaaaagcaacaggacaggagacccagcatggcgtat

SEQ ID NO: 391363 - DNA, 140 bp, Artificial Sequence
  Synthetic
atacgccatgctgggtctccgtgtgggccttggcaaaattttggtggacattctgcccggttacggcgccggcgtacgtggcgctgtggttaccttcaagatcatgagcggcgagatgcccgtacttgggagtcggccat

SEQ ID NO: 391364 - DNA, 140 bp, Artificial Sequence
  Synthetic
atggccgactcccaagtacgggcatctcgccgctcatgatcttgaaggtaaccacagcgccacgtacgccggcgccgtaaccgggcagaatgtccaccaaaattttgccaaggcccacacggagacccagcatggcgtat

SEQ ID NO: 391365 - DNA, 140 bp, Artificial Sequence
  Synthetic
atacgccatgctgggtctccccgggcgaaggggccgtgcagtggatgaaccgtctaattgcgttcgcatcgcgaggcaatcacgtgtctcccacgcattacgtccctgagtccgacgcggcgtacttgggagtcggccat

SEQ ID NO: 391366 - DNA, 140 bp, Artificial Sequence
  Synthetic
atggccgactcccaagtacgccgcgtcggactcagggacgtaatgcgtgggagacacgtgattgcctcgcgatgcgaacgcaattagacggttcatccactgcacggccccttcgcccggggagacccagcatggcgtat

SEQ ID NO: 391367 - DNA, 140 bp, Artificial Sequence
  Synthetic
aggccctggctgctgatatgcactgcgggattgggcccacacgggcctgcgagaccttgcggtggcggtggagcccgttgtcttctctgacatggagaccaagatcatcacctggggggcgaccttttgggacagcggtg

SEQ ID NO: 391368 - DNA, 140 bp, Artificial Sequence
  Synthetic
caccgctgtcccaaaaggtcgccccccaggtgatgatcttggtctccatgtcagagaagacaacgggctccaccgccaccgcaaggtctcgcaggcccgtgtgggcccaatcccgcagtgcatatcagcagccagggcct

SEQ ID NO: 391369 - DNA, 140 bp, Artificial Sequence
  Synthetic
aggccctggctgctgatatggatgcatacgacatgcccctgcggagcagatctggcaggtcacatcaagaacggctcgatgagaatcaccgggccgaaaacctgcagcaacacatggcatgaccttttgggacagcggtg

SEQ ID NO: 391370 - DNA, 140 bp, Artificial Sequence
  Synthetic
caccgctgtcccaaaaggtcatgccatgtgttgctgcaggttttcggcccggtgattctcatcgagccgttcttgatgtgacctgccagatctgctccgcaggggcatgtcgtatgcatccatatcagcagccagggcct

SEQ ID NO: 391371 - DNA, 140 bp, Artificial Sequence
  Synthetic
aggccctggctgctgatatgcctggggggcagacaccgcggcgtgtggggacatcatcttgggcctgcccgtctccgcccgaagggggaaggagatacttctgggaccggccgatagtttgaccttttgggacagcggtg

SEQ ID NO: 391372 - DNA, 140 bp, Artificial Sequence
  Synthetic
caccgctgtcccaaaaggtcaaactatcggccggtcccagaagtatctccttcccccttcgggcggagacgggcaggcccaagatgatgtccccacacgccgcggtgtctgccccccaggcatatcagcagccagggcct

SEQ ID NO: 391373 - DNA, 140 bp, Artificial Sequence
  Synthetic
aggccctggctgctgatatgacttgcgtcaacggcgtgtgttggactgtctaccatggcgccggctcgaagaccctagccggcccaaaaggcccaattacccaaatgtacaccaatgtaggaccttttgggacagcggtg

SEQ ID NO: 391374 - DNA, 140 bp, Artificial Sequence
  Synthetic
caccgctgtcccaaaaggtcctacattggtgtacatttgggtaattgggccttttgggccggctagggtcttcgagccggcgccatggtagacagtccaacacacgccgttgacgcaagtcatatcagcagccagggcct

SEQ ID NO: 391375 - DNA, 140 bp, Artificial Sequence
  Synthetic
aggccctggctgctgatatgtgatctcctcgaggctaacctcttgtgggggtctaccgctaccagggttgagacggacgagaaggtaataatactagactcttttgagtcatgtgtggctgaccttttgggacagcggtg

SEQ ID NO: 391376 - DNA, 140 bp, Artificial Sequence
  Synthetic
caccgctgtcccaaaaggtcagccacacatgactcaaaagagtctagtattattaccttctcgtccgtctcaaccctggtagcggtagacccccacaagaggttagcctcgaggagatcacatatcagcagccagggcct

SEQ ID NO: 391377 - DNA, 140 bp, Artificial Sequence
  Synthetic
atacgccatgctgggtctccatccacctcttaccgagacgtggaagcagcaggactaccaagctccgaccgtccacggttgcgctctgcctccggcaaagcagccccctgttccctctcccgtacttgggagtcggccat

SEQ ID NO: 391378 - DNA, 140 bp, Artificial Sequence
  Synthetic
atggccgactcccaagtacgggagagggaacagggggctgctttgccggaggcagagcgcaaccgtggacggtcggagcttggtagtcctgctgcttccacgtctcggtaagaggtggatggagacccagcatggcgtat

SEQ ID NO: 391379 - DNA, 140 bp, Artificial Sequence
  Synthetic
atacgccatgctgggtctcccaggaggaaacggacggtacagctcactgagtccgttgtttctaccgctttggcagagctggccgcaaagacctttggccagtcagagccgagctcagaccgtacttgggagtcggccat

SEQ ID NO: 391380 - DNA, 140 bp, Artificial Sequence
  Synthetic
atggccgactcccaagtacggtctgagctcggctctgactggccaaaggtctttgcggccagctctgccaaagcggtagaaacaacggactcagtgagctgtaccgtccgtttcctcctgggagacccagcatggcgtat

SEQ ID NO: 391381 - DNA, 140 bp, Artificial Sequence
  Synthetic
aggccctggctgctgatatgtcaccacgggcgcccccatcacgtactccacctacggcaagttccttgccgacggtggttgctccgggggcgcctatgacatcataatatgtgatgagtggaccttttgggacagcggtg

SEQ ID NO: 391382 - DNA, 140 bp, Artificial Sequence
  Synthetic
caccgctgtcccaaaaggtccactcatcacatattatgatgtcataggcgcccccggagcaaccaccgtcggcaaggaacttgccgtaggtggagtacgtgatgggggcgcccgtggtgacatatcagcagccagggcct

SEQ ID NO: 391383 - DNA, 140 bp, Artificial Sequence
  Synthetic
atacgccatgctgggtctcccgctctgatgacgggcttcactggcgactttgactcggtgatcgactgcaatacgtgtgtcacccagacagtcgacttcagcttggaccccaccttcacgcgtacttgggagtcggccat

SEQ ID NO: 391384 - DNA, 140 bp, Artificial Sequence
  Synthetic
atggccgactcccaagtacgcgtgaaggtggggtccaagctgaagtcgactgtctgggtgacacacgtattgcagtcgatcaccgagtcaaagtcgccagtgaagcccgtcatcagagcgggagacccagcatggcgtat

SEQ ID NO: 391385 - DNA, 140 bp, Artificial Sequence
  Synthetic
aggccctggctgctgatatgtgagtgctatgacgcgggctgtgcttggtacgagctcacgcccgccgagacctcagttaggctgcgggcttacctaaatacaccagggttgcccgtttgcgaccttttgggacagcggtg

SEQ ID NO: 391386 - DNA, 140 bp, Artificial Sequence
  Synthetic
caccgctgtcccaaaaggtcgcaaacgggcaaccctggtgtatttaggtaagcccgcagcctaactgaggtctcggcgggcgtgagctcgtaccaagcacagcccgcgtcatagcactcacatatcagcagccagggcct

SEQ ID NO: 391387 - DNA, 140 bp, Artificial Sequence
  Synthetic
aggccctggctgctgatatggagacgtcgttgtcgtggcaacagacgctctaatgacgggctacaccggcgactttgactcagtgatcgactgtaatacatgtgtcacccaaacagtcgagaccttttgggacagcggtg

SEQ ID NO: 391388 - DNA, 140 bp, Artificial Sequence
  Synthetic
caccgctgtcccaaaaggtctcgactgtttgggtgacacatgtattacagtcgatcactgagtcaaagtcgccggtgtagcccgtcattagagcgtctgttgccacgacaacgacgtctccatatcagcagccagggcct

SEQ ID NO: 391389 - DNA, 140 bp, Artificial Sequence
  Synthetic
aggccctggctgctgatatgtccaagtggcgagcccttgagaccttctgggcgaagcacatgtggaatttcatcagcgggatacagtacttagcaggcttgtccactctgcctggaaaccgaccttttgggacagcggtg

SEQ ID NO: 391390 - DNA, 140 bp, Artificial Sequence
  Synthetic
caccgctgtcccaaaaggtcggtttccaggcagagtggacaagcctgctaagtactgtatcccgctgatgaaattccacatgtgcttcgcccagaaggtctcaagggctcgccacttggacatatcagcagccagggcct

SEQ ID NO: 391391 - DNA, 140 bp, Artificial Sequence
  Synthetic
aggccctggctgctgatatgtgcgagcctcgacactggctgggtagcggggctcttctactactaccaattcaactcaacaggctgccccgagaggttggccagctgtaaaccccttgccgaccttttgggacagcggtg

SEQ ID NO: 391392 - DNA, 140 bp, Artificial Sequence
  Synthetic
caccgctgtcccaaaaggtcggcaaggggtttacagctggccaacctctcggggcagcctgttgagttgaattggtagtagtagaagagccccgctacccagccagtgtcgaggctcgcacatatcagcagccagggcct

SEQ ID NO: 391393 - DNA, 140 bp, Artificial Sequence
  Synthetic
  misc_feature (32)..(32): n is a, c, g, or t
aggccctggctgctgatatgacagggaatctncccggttgctctttctctatcttcctcttggcacttctctcgtgcatgactgtccccgcttcggccattaactaccgcaatgcttcgggaccttttgggacagcggtg

SEQ ID NO: 391394 - DNA, 140 bp, Artificial Sequence
  Synthetic
  misc_feature (109)..(109): n is a, c, g, or t
caccgctgtcccaaaaggtcccgaagcattgcggtagttaatggccgaagcggggacagtcatgcacgagagaagtgccaagaggaagatagagaaagagcaaccgggnagattccctgtcatatcagcagccagggcct

SEQ ID NO: 391395 - DNA, 140 bp, Artificial Sequence
  Synthetic
  misc_feature (68)..(68): n is a, c, g, or t
aggccctggctgctgatatggggaaaccagtcacgttgctgggtggcccttactcctaccgtcgcagngccatacatcggcgcgccgcttgattccctgcggagtcatgtggatctgatggaccttttgggacagcggtg

SEQ ID NO: 391396 - DNA, 140 bp, Artificial Sequence
  Synthetic
  misc_feature (73)..(73): n is a, c, g, or t
caccgctgtcccaaaaggtccatcagatccacatgactccgcagggaatcaagcggcgcgccgatgtatggcnctgcgacggtaggagtaagggccacccagcaacgtgactggtttccccatatcagcagccagggcct

SEQ ID NO: 391397 - DNA, 140 bp, Artificial Sequence
  Synthetic
  misc_feature (25)..(25): n is a, c, g, or t
  misc_feature (119)..(119): n is a, c, g, or t
aggccctggctgctgatatgggacnacccaggattgcaattgttccatctatacagggcacatcactggccacaggatggcctgggacatgatgatgaactggagtccaacaaccactntgaccttttgggacagcggtg

SEQ ID NO: 391398 - DNA, 140 bp, Artificial Sequence
  Synthetic
  misc_feature (22)..(22): n is a, c, g, or t
  misc_feature (116)..(116): n is a, c, g, or t
caccgctgtcccaaaaggtcanagtggttgttggactccagttcatcatcatgtcccaggccatcctgtggccagtgatgtgccctgtatagatggaacaattgcaatcctgggtngtcccatatcagcagccagggcct

SEQ ID NO: 391399 - DNA, 140 bp, Artificial Sequence
  Synthetic
  misc_feature (37)..(37): n is a, c, g, or t
  misc_feature (59)..(59): n is a, c, g, or t
  misc_feature (65)..(65): n is a, c, g, or t
  misc_feature (84)..(84): n is a, c, g, or t
  misc_feature (107)..(107): n is a, c, g, or t
  misc_feature (116)..(116): n is a, c, g, or t
atacgccatgctgggtctccgccaattgggccaaagncatcttagtcctattcctcttngcaggngttgacgctgagactcacntatctgggggtacgtatggccgnaacatccanggcccgtacttgggagtcggccat

SEQ ID NO: 391400 - DNA, 140 bp, Artificial Sequence
  Synthetic
  misc_feature (25)..(25): n is a, c, g, or t
  misc_feature (34)..(34): n is a, c, g, or t
  misc_feature (57)..(57): n is a, c, g, or t
  misc_feature (76)..(76): n is a, c, g, or t
  misc_feature (82)..(82): n is a, c, g, or t
  misc_feature (104)..(104): n is a, c, g, or t
atggccgactcccaagtacgggccntggatgttncggccatacgtacccccagatangtgagtctcagcgtcaacncctgcnaagaggaataggactaagatgnctttggcccaattggcggagacccagcatggcgtat

SEQ ID NO: 391401 - DNA, 140 bp, Artificial Sequence
  Synthetic
atacgccatgctgggtctcccttaaacactgggttcttggctggcttgttctacgcccacaagtttaacagctcggggtgtcccgaacggctcgcaagctgcaaggttcttgacagcttccgtacttgggagtcggccat

SEQ ID NO: 391402 - DNA, 140 bp, Artificial Sequence
  Synthetic
atggccgactcccaagtacggaagctgtcaagaaccttgcagcttgcgagccgttcgggacaccccgagctgttaaacttgtgggcgtagaacaagccagccaagaacccagtgtttaagggagacccagcatggcgtat

SEQ ID NO: 391403 - DNA, 140 bp, Artificial Sequence
  Synthetic
  misc_feature (67)..(67): n is a, c, g, or t
atacgccatgctgggtctcccagcatccagtgtgtgtggccccgtgtattgctttactcccagcccngtcgtggtcggaaccactgaccgcctcggggtccctacttacacctggggggacgtacttgggagtcggccat

SEQ ID NO: 391404 - DNA, 140 bp, Artificial Sequence
  Synthetic
  misc_feature (74)..(74): n is a, c, g, or t
atggccgactcccaagtacgtccccccaggtgtaagtagggaccccgaggcggtcagtggttccgaccacgacngggctgggagtaaagcaatacacggggccacacacactggatgctgggagacccagcatggcgtat

SEQ ID NO: 391405 - DNA, 140 bp, Artificial Sequence
  Synthetic
  misc_feature (39)..(39): n is a, c, g, or t
  misc_feature (97)..(97): n is a, c, g, or t
atacgccatgctgggtctccgaatgtgtctgatgtcttnctcttgaactccaccagaccgccacgtggtgcgtggttcgggtgcgtatggatgaacngtaccgggtttacaaaaacctgccgtacttgggagtcggccat

SEQ ID NO: 391406 - DNA, 140 bp, Artificial Sequence
  Synthetic
  misc_feature (44)..(44): n is a, c, g, or t
  misc_feature (102)..(102): n is a, c, g, or t
atggccgactcccaagtacggcaggtttttgtaaacccggtacngttcatccatacgcacccgaaccacgcaccacgtggcggtctggtggagttcaagagnaagacatcagacacattcggagacccagcatggcgtat

SEQ ID NO: 391407 - DNA, 140 bp, Artificial Sequence
  Synthetic
aggccctggctgctgatatgcagggccttggatcacaccacgatgcttgattcattatccgtaccggctgtggcattacccatgcaccgtcaactttaccgtctttaagatcaggacgttgaccttttgggacagcggtg

SEQ ID NO: 391408 - DNA, 140 bp, Artificial Sequence
  Synthetic
caccgctgtcccaaaaggtcaacgtcctgatcttaaagacggtaaagttgacggtgcatgggtaatgccacagccggtacggataatgaatcaagcatcgtggtgtgatccaaggccctgcatatcagcagccagggcct

SEQ ID NO: 391409 - DNA, 140 bp, Artificial Sequence
  Synthetic
aggccctggctgctgatatgctcctctccactacaacgtggcaaatcctcccttgctctttcaccactctacctgccctctctaccggcttgatccacctccaccaaaatatcgtggacggaccttttgggacagcggtg

SEQ ID NO: 391410 - DNA, 140 bp, Artificial Sequence
  Synthetic
caccgctgtcccaaaaggtccgtccacgatattttggtggaggtggatcaagccggtagagagggcaggtagagtggtgaaagagcaagggaggatttgccacgttgtagtggagaggagcatatcagcagccagggcct

SEQ ID NO: 391411 - DNA, 140 bp, Artificial Sequence
  Synthetic
atacgccatgctgggtctcccacatcaacaggactgctctgaactgcaatgacaccttccagactgggtttcttgctgcgctgttctatgtgcacaggttcaactcatccggatgcccagcgtacttgggagtcggccat

SEQ ID NO: 391412 - DNA, 140 bp, Artificial Sequence
  Synthetic
atggccgactcccaagtacgctgggcatccggatgagttgaacctgtgcacatagaacagcgcagcaagaaacccagtctggaaggtgtcattgcagttcagagcagtcctgttgatgtgggagacccagcatggcgtat

SEQ ID NO: 391413 - DNA, 140 bp, Artificial Sequence
  Synthetic
  misc_feature (46)..(46): n is a, c, g, or t
  misc_feature (94)..(94): n is a, c, g, or t
atacgccatgctgggtctcctacttctaatgctgcccgaaagggcntatgcatatgaccgggaggtggcggggacctttggtggcgccgtcgtngctgcactgactattctgacattgtccgtacttgggagtcggccat

SEQ ID NO: 391414 - DNA, 140 bp, Artificial Sequence
  Synthetic
  misc_feature (47)..(47): n is a, c, g, or t
  misc_feature (95)..(95): n is a, c, g, or t
atggccgactcccaagtacggacaatgtcagaatagtcagtgcagcnacgacggcgccaccaaaggtccccgccacctcccggtcatatgcatangccctttcgggcagcattagaagtaggagacccagcatggcgtat

SEQ ID NO: 391415 - DNA, 140 bp, Artificial Sequence
  Synthetic
atacgccatgctgggtctccgtgcgtggtcctcgcgactcattggtcattctcgcggtcctggcttgcccacatctgatgtttgacatcacaaagcacctcctggccatcctagggcccccgtacttgggagtcggccat

SEQ ID NO: 391416 - DNA, 140 bp, Artificial Sequence
  Synthetic
atggccgactcccaagtacgggggccctaggatggccaggaggtgctttgtgatgtcaaacatcagatgtgggcaagccaggaccgcgagaatgaccaatgagtcgcgaggaccacgcacggagacccagcatggcgtat

SEQ ID NO: 391417 - DNA, 140 bp, Artificial Sequence
  Synthetic
  misc_feature (69)..(69): n is a, c, g, or t
atacgccatgctgggtctccgtattgccaaatggccgtgcttaaggtgggggctctgactggtacttanatttatgaccatctcactcccctgtcagactgggctgctgagggtctccgccgtacttgggagtcggccat

SEQ ID NO: 391418 - DNA, 140 bp, Artificial Sequence
  Synthetic
  misc_feature (72)..(72): n is a, c, g, or t
atggccgactcccaagtacggcggagaccctcagcagcccagtctgacaggggagtgagatggtcataaatntaagtaccagtcagagcccccaccttaagcacggccatttggcaatacggagacccagcatggcgtat

SEQ ID NO: 391419 - DNA, 140 bp, Artificial Sequence
  Synthetic
aggccctggctgctgatatgtttatgaccatctcactcccctgtcagactgggctgctgagggtctccgcgatttggcggtggccctggaaccagttgtgttcacgcccatggagaagaagaccttttgggacagcggtg

SEQ ID NO: 391420 - DNA, 140 bp, Artificial Sequence
  Synthetic
caccgctgtcccaaaaggtcttcttctccatgggcgtgaacacaactggttccagggccaccgccaaatcgcggagaccctcagcagcccagtctgacaggggagtgagatggtcataaacatatcagcagccagggcct

SEQ ID NO: 391421 - DNA, 140 bp, Artificial Sequence
  Synthetic
atacgccatgctgggtctccggagggagtggattcactccagctcagctccgggacaagatggccatggagctcctgctacataaatgtcagggactatcctggctccatcttagccctacgtacttgggagtcggccat

SEQ ID NO: 391422 - DNA, 140 bp, Artificial Sequence
  Synthetic
atggccgactcccaagtacgtagggctaagatggagccaggatagtccctgacatttatgtagcaggagctccatggccatcttgtcccggagctgagctggagtgaatccactccctccggagacccagcatggcgtat

SEQ ID NO: 391423 - DNA, 140 bp, Artificial Sequence
  Synthetic
aggccctggctgctgatatgcgcgcagcagacccgcggcttgttcagcaccatcgtgacgagccttactggcagggacaccaatgagaattgtggtgaagtacaggtcctgtccaccgccgaccttttgggacagcggtg

SEQ ID NO: 391424 - DNA, 140 bp, Artificial Sequence
  Synthetic
caccgctgtcccaaaaggtcggcggtggacaggacctgtacttcaccacaattctcattggtgtccctgccagtaaggctcgtcacgatggtgctgaacaagccgcgggtctgctgcgcgcatatcagcagccagggcct

SEQ ID NO: 391425 - DNA, 140 bp, Artificial Sequence
  Synthetic
aggccctggctgctgatatgggcactaccccccaaagccttgtggtatcgtgccagcacagaacgtatgtggcccagtgtattgcttcacccctagccccgtggtggtgggaacgaccgagaccttttgggacagcggtg

SEQ ID NO: 391426 - DNA, 140 bp, Artificial Sequence
  Synthetic
caccgctgtcccaaaaggtctcggtcgttcccaccaccacggggctaggggtgaagcaatacactgggccacatacgttctgtgctggcacgataccacaaggctttggggggtagtgcccatatcagcagccagggcct

SEQ ID NO: 391427 - DNA, 140 bp, Artificial Sequence
  Synthetic
  misc_feature (52)..(52): n is a, c, g, or t
  misc_feature (104)..(104): n is a, c, g, or t
atacgccatgctgggtctccaaatgtacactaatgttgaccaagacttggtnggatggccagcgccccctggggtcaggtctcttgctccgtgcacctgtggcncatctgacttgtatctcgtacttgggagtcggccat

SEQ ID NO: 391428 - DNA, 140 bp, Artificial Sequence
  Synthetic
  misc_feature (37)..(37): n is a, c, g, or t
  misc_feature (89)..(89): n is a, c, g, or t
atggccgactcccaagtacgagatacaagtcagatgngccacaggtgcacggagcaagagacctgaccccagggggcgctggccatccnaccaagtcttggtcaacattagtgtacatttggagacccagcatggcgtat

SEQ ID NO: 391429 - DNA, 140 bp, Artificial Sequence
  Synthetic
atacgccatgctgggtctccgcactacccacccaaggcgtgtggtcttgtacccgcgtcgcaggtgtgtggtccagtgtattgcttcaccccaagtcctgtagtggtggggacgaccgatcgtacttgggagtcggccat

SEQ ID NO: 391430 - DNA, 140 bp, Artificial Sequence
  Synthetic
atggccgactcccaagtacgatcggtcgtccccaccactacaggacttggggtgaagcaatacactggaccacacacctgcgacgcgggtacaagaccacacgccttgggtgggtagtgcggagacccagcatggcgtat

SEQ ID NO: 391431 - DNA, 140 bp, Artificial Sequence
  Synthetic
  misc_feature (33)..(33): n is a, c, g, or t
  misc_feature (72)..(72): n is a, c, g, or t
aggccctggctgctgatatgggcggtgtgtacncgaggggtagctaaagcggtggacttcgtcccagtcgantctcttgagacttccatgagatcaccagtgttcactgacaactcgacggaccttttgggacagcggtg

SEQ ID NO: 391432 - DNA, 140 bp, Artificial Sequence
  Synthetic
  misc_feature (69)..(69): n is a, c, g, or t
  misc_feature (108)..(108): n is a, c, g, or t
caccgctgtcccaaaaggtccgtcgagttgtcagtgaacactggtgatctcatggaagtctcaagagantcgactgggacgaagtccaccgctttagctacccctcgngtacacaccgcccatatcagcagccagggcct

SEQ ID NO: 391433 - DNA, 140 bp, Artificial Sequence
  Synthetic
  misc_feature (72)..(72): n is a, c, g, or t
  misc_feature (109)..(109): n is a, c, g, or t
atacgccatgctgggtctccataaagtgctagtgctcaatccctcggttgcggccacactgggatttggggnatacatgtccaaggcatatggcatcgacccgaacatncggtcgggagtcgtacttgggagtcggccat

SEQ ID NO: 391434 - DNA, 140 bp, Artificial Sequence
  Synthetic
  misc_feature (32)..(32): n is a, c, g, or t
  misc_feature (69)..(69): n is a, c, g, or t
atggccgactcccaagtacgactcccgaccgnatgttcgggtcgatgccatatgccttggacatgtatnccccaaatcccagtgtggccgcaaccgagggattgagcactagcactttatggagacccagcatggcgtat

SEQ ID NO: 391435 - DNA, 140 bp, Artificial Sequence
  Synthetic
aggccctggctgctgatatgcttaacaacacgcggccgccgcaaggcaactggttcggctgcacatggatgaacagcaccgggttcaccaagacgtgcgggggccccccatgtaagaccggaccttttgggacagcggtg

SEQ ID NO: 391436 - DNA, 140 bp, Artificial Sequence
  Synthetic
caccgctgtcccaaaaggtccggtcttacatggggggcccccgcacgtcttggtgaacccggtgctgttcatccatgtgcagccgaaccagttgccttgcggcggccgcgtgttgttaagcatatcagcagccagggcct

SEQ ID NO: 391437 - DNA, 140 bp, Artificial Sequence
  Synthetic
  misc_feature (60)..(60): n is a, c, g, or t
atacgccatgctgggtctcccctggaccaagcggagaccgctggagtgcgcctcaccgtnctcgcgaccgctaccccgccagggtcagtgactacaccccattccaacatagaggaggtccgtacttgggagtcggccat

SEQ ID NO: 391438 - DNA, 140 bp, Artificial Sequence
  Synthetic
  misc_feature (81)..(81): n is a, c, g, or t
atggccgactcccaagtacggacctcctctatgttggaatggggtgtagtcactgaccctggcggggtagcggtcgcgagnacggtgaggcgcactccagcggtctccgcttggtccaggggagacccagcatggcgtat

SEQ ID NO: 391439 - DNA, 140 bp, Artificial Sequence
  Synthetic
aggccctggctgctgatatgctaccccgccagggtcagtgactacaccccattccaacatagaggaggtcgccctgccgacaacgggagaagtgcccttttacggcaaagcgattcccctgaccttttgggacagcggtg

SEQ ID NO: 391440 - DNA, 140 bp, Artificial Sequence
  Synthetic
caccgctgtcccaaaaggtcaggggaatcgctttgccgtaaaagggcacttctcccgttgtcggcagggcgacctcctctatgttggaatggggtgtagtcactgaccctggcggggtagcatatcagcagccagggcct

SEQ ID NO: 391441 - DNA, 140 bp, Artificial Sequence
  Synthetic
aggccctggctgctgatatgggcaggtgctgccctgttccttcaccaccctaccggctctgtccactggtttgattcatctccatcagaacatcgtggacgtgcaatacctgtacggtatgaccttttgggacagcggtg

SEQ ID NO: 391442 - DNA, 140 bp, Artificial Sequence
  Synthetic
caccgctgtcccaaaaggtcataccgtacaggtattgcacgtccacgatgttctgatggagatgaatcaaaccagtggacagagccggtagggtggtgaaggaacagggcagcacctgcccatatcagcagccagggcct

SEQ ID NO: 391443 - DNA, 140 bp, Artificial Sequence
  Synthetic
atacgccatgctgggtctccggcatatcaacaggaccgccctgagctgcaatgactccctcaacactgggtttgttgccgcgctgttctacaaatacaggttcaacgcgtccgggtgccccgtacttgggagtcggccat

SEQ ID NO: 391444 - DNA, 140 bp, Artificial Sequence
  Synthetic
atggccgactcccaagtacggggcacccggacgcgttgaacctgtatttgtagaacagcgcggcaacaaacccagtgttgagggagtcattgcagctcagggcggtcctgttgatatgccggagacccagcatggcgtat

SEQ ID NO: 391445 - DNA, 140 bp, Artificial Sequence
  Synthetic
atacgccatgctgggtctcctggcactacgcgcctcaaccgtgtggtattgtgcccacgttgcaggtgtgtggcccagtatactgcttcaccccgagtcctgttgcggtggggactaccgcgtacttgggagtcggccat

SEQ ID NO: 391446 - DNA, 140 bp, Artificial Sequence
  Synthetic
atggccgactcccaagtacgcggtagtccccaccgcaacaggactcggggtgaagcagtatactgggccacacacctgcaacgtgggcacaataccacacggttgaggcgcgtagtgccaggagacccagcatggcgtat

SEQ ID NO: 391447 - DNA, 140 bp, Artificial Sequence
  Synthetic
aggccctggctgctgatatggcccgtaggggccgagagatactgctcggaccggccgatggaatggtctccaaggggtggaggttgctggcgcccatcacggcgtacgcccagcagacaagaccttttgggacagcggtg

SEQ ID NO: 391448 - DNA, 140 bp, Artificial Sequence
  Synthetic
caccgctgtcccaaaaggtcttgtctgctgggcgtacgccgtgatgggcgccagcaacctccaccccttggagaccattccatcggccggtccgagcagtatctctcggcccctacgggccatatcagcagccagggcct

SEQ ID NO: 391449 - DNA, 140 bp, Artificial Sequence
  Synthetic
aggccctggctgctgatatgcttcccatatcttgttgcctatcaggccacagtgtgcgccagagctctggcacccccaccaagctgggacactatgtggaagtgcctaattcgcctcaaggaccttttgggacagcggtg

SEQ ID NO: 391450 - DNA, 140 bp, Artificial Sequence
  Synthetic
caccgctgtcccaaaaggtccttgaggcgaattaggcacttccacatagtgtcccagcttggtgggggtgccagagctctggcgcacactgtggcctgataggcaacaagatatgggaagcatatcagcagccagggcct

SEQ ID NO: 391451 - DNA, 140 bp, Artificial Sequence
  Synthetic
aggccctggctgctgatatgagcccgtcatcttctctgacatggaaaccaaggtcatcacctggggggcagacaccgccgcgtgtggggacatcatcttgggtctacctgtctccgcccggaccttttgggacagcggtg

SEQ ID NO: 391452 - DNA, 140 bp, Artificial Sequence
  Synthetic
caccgctgtcccaaaaggtccgggcggagacaggtagacccaagatgatgtccccacacgcggcggtgtctgccccccaggtgatgaccttggtttccatgtcagagaagatgacgggctcatatcagcagccagggcct

SEQ ID NO: 391453 - DNA, 140 bp, Artificial Sequence
  Synthetic
  misc_feature (23)..(23): n is a, c, g, or t
atacgccatgctgggtctccccnctagtcgagcatgggttacaactggctgagcaattcaagcagaaagccgtaggccttctaaacttcgccggcaagcaagcccaagaggcaacaccagcgtacttgggagtcggccat

SEQ ID NO: 391454 - DNA, 140 bp, Artificial Sequence
  Synthetic
  misc_feature (118)..(118): n is a, c, g, or t
atggccgactcccaagtacgctggtgttgcctcttgggcttgcttgccggcgaagtttagaaggcctacggctttctgcttgaattgctcagccagttgtaacccatgctcgactagnggggagacccagcatggcgtat

SEQ ID NO: 391455 - DNA, 140 bp, Artificial Sequence
  Synthetic
aggccctggctgctgatatgcgtaggccttctaaacttcgccggcaagcaagcccaagaggcaacaccagtgatccagtccaacttcgccaaacttgaacagttctgggcgaagcacatggaccttttgggacagcggtg

SEQ ID NO: 391456 - DNA, 140 bp, Artificial Sequence
  Synthetic
caccgctgtcccaaaaggtccatgtgcttcgcccagaactgttcaagtttggcgaagttggactggatcactggtgttgcctcttgggcttgcttgccggcgaagtttagaaggcctacgcatatcagcagccagggcct

SEQ ID NO: 391457 - DNA, 140 bp, Artificial Sequence
  Synthetic
  misc_feature (85)..(85): n is a, c, g, or t
  misc_feature (109)..(109): n is a, c, g, or t
  misc_feature (112)..(112): n is a, c, g, or t
aggccctggctgctgatatgtgatccagtccaacttcgccaaacttgaacagttctgggcgaagcacatgtggaatttcatcagnggcattcaatacctcgctggactntcnaccttgccgaccttttgggacagcggtg

SEQ ID NO: 391458 - DNA, 140 bp, Artificial Sequence
  Synthetic
  misc_feature (29)..(29): n is a, c, g, or t
  misc_feature (32)..(32): n is a, c, g, or t
  misc_feature (56)..(56): n is a, c, g, or t
caccgctgtcccaaaaggtcggcaaggtnganagtccagcgaggtattgaatgccnctgatgaaattccacatgtgcttcgcccagaactgttcaagtttggcgaagttggactggatcacatatcagcagccagggcct

SEQ ID NO: 391459 - DNA, 140 bp, Artificial Sequence
  Synthetic
  misc_feature (89)..(89): n is a, c, g, or t
atacgccatgctgggtctccgtggcctcgcagattgcgacaccgacggcttctacagcgtttgttgtgagcggcctggcgggggcggcngttggcagcgtgggccttggcaagattttagcgtacttgggagtcggccat

SEQ ID NO: 391460 - DNA, 140 bp, Artificial Sequence
  Synthetic
  misc_feature (52)..(52): n is a, c, g, or t
atggccgactcccaagtacgctaaaatcttgccaaggcccacgctgccaacngccgcccccgccaggccgctcacaacaaacgctgtagaagccgtcggtgtcgcaatctgcgaggccacggagacccagcatggcgtat

SEQ ID NO: 391461 - DNA, 140 bp, Artificial Sequence
  Synthetic
  misc_feature (39)..(39): n is a, c, g, or t
aggccctggctgctgatatgcggcctggcgggggcggcngttggcagcgtgggccttggcaagattttagtggacattctcgctggctacggcgctggcgtagctggtgctgtggtcactgaccttttgggacagcggtg

SEQ ID NO: 391462 - DNA, 140 bp, Artificial Sequence
  Synthetic
  misc_feature (102)..(102): n is a, c, g, or t
caccgctgtcccaaaaggtcagtgaccacagcaccagctacgccagcgccgtagccagcgagaatgtccactaaaatcttgccaaggcccacgctgccaacngccgcccccgccaggccgcatatcagcagccagggcct

SEQ ID NO: 391463 - DNA, 140 bp, Artificial Sequence
  Synthetic
  misc_feature (78)..(78): n is a, c, g, or t
atacgccatgctgggtctcccggcgatcctgcgccgccacgtgggtccaggcgagggggctgtgcagtggatgaaccntctaattgcgttcgcatcgcgaggcaatcacgtgtctcccaccgtacttgggagtcggccat

SEQ ID NO: 391464 - DNA, 140 bp, Artificial Sequence
  Synthetic
  misc_feature (63)..(63): n is a, c, g, or t
atggccgactcccaagtacggtgggagacacgtgattgcctcgcgatgcgaacgcaattaganggttcatccactgcacagccccctcgcctggacccacgtggcggcgcaggatcgccgggagacccagcatggcgtat

SEQ ID NO: 391465 - DNA, 140 bp, Artificial Sequence
  Synthetic
  misc_feature (31)..(31): n is a, c, g, or t
  misc_feature (38)..(38): n is a, c, g, or t
  misc_feature (58)..(58): n is a, c, g, or t
  misc_feature (115)..(115): n is a, c, g, or t
atacgccatgctgggtctcccatccctcacngtgacancccttctcagacgccttcanaagtggatcaatgaagattgctccaccccatgcacagaatcttggctgtgggaggtntggaacgtacttgggagtcggccat

SEQ ID NO: 391466 - DNA, 140 bp, Artificial Sequence
  Synthetic
  misc_feature (26)..(26): n is a, c, g, or t
  misc_feature (83)..(83): n is a, c, g, or t
  misc_feature (103)..(103): n is a, c, g, or t
  misc_feature (110)..(110): n is a, c, g, or t
atggccgactcccaagtacgttccanacctcccacagccaagattctgtgcatggggtggagcaatcttcattgatccacttntgaaggcgtctgagaagggntgtcacngtgagggatgggagacccagcatggcgtat

SEQ ID NO: 391467 - DNA, 140 bp, Artificial Sequence
  Synthetic
aggccctggctgctgatatgtcaaagaccctagccggcccaaagggtccaatcacccaaatgtacaccaatgtagaccaggaccttgttggctggccggcacctcctggggcgcgttcccgaccttttgggacagcggtg

SEQ ID NO: 391468 - DNA, 140 bp, Artificial Sequence
  Synthetic
caccgctgtcccaaaaggtcgggaacgcgccccaggaggtgccggccagccaacaaggtcctggtctacattggtgtacatttgggtgattggaccctttgggccggctagggtctttgacatatcagcagccagggcct

SEQ ID NO: 391469 - DNA, 140 bp, Artificial Sequence
  Synthetic
aggccctggctgctgatatggagacaaccatgaggtccccggtgttcacggacaactcctctccaccagcagtgccccagagcttccaggtggcccacctgcatgctcccaccggcagcggaccttttgggacagcggtg

SEQ ID NO: 391470 - DNA, 140 bp, Artificial Sequence
  Synthetic
caccgctgtcccaaaaggtccgctgccggtgggagcatgcaggtgggccacctggaagctctggggcactgctggtggagaggagttgtccgtgaacaccggggacctcatggttgtctccatatcagcagccagggcct

SEQ ID NO: 391471 - DNA, 140 bp, Artificial Sequence
  Synthetic
aggccctggctgctgatatgtctgcccttcggggcacgctgtcggcatacttccggctgctgtatgcacccggggggttgccatggcggtggaattcatacccgttgagtctatggaaacgaccttttgggacagcggtg

SEQ ID NO: 391472 - DNA, 140 bp, Artificial Sequence
  Synthetic
caccgctgtcccaaaaggtcgtttccatagactcaacgggtatgaattccaccgccatggcaaccccccgggtgcatacagcagccggaagtatgccgacagcgtgccccgaagggcagacatatcagcagccagggcct

SEQ ID NO: 391473 - DNA, 140 bp, Artificial Sequence
  Synthetic
aggccctggctgctgatatgtggactcttttgagccaattgtggctgaaccagatgatgacagggaggtctcagtcgccgcggaaattctgcgtccgaccaagaagtttcccccagctttgaccttttgggacagcggtg

SEQ ID NO: 391474 - DNA, 140 bp, Artificial Sequence
  Synthetic
caccgctgtcccaaaaggtcaaagctgggggaaacttcttggtcggacgcagaatttccgcggcgactgagacctccctgtcatcatctggttcagccacaattggctcaaaagagtccacatatcagcagccagggcct

SEQ ID NO: 391475 - DNA, 140 bp, Artificial Sequence
  Synthetic
aggccctggctgctgatatgagcaagcaaacccccgttcctcctcccaggaggaagcggacggttcagctcaccgagtccgttgtttctactgccttggcagaactggccgcgaagacctgaccttttgggacagcggtg

SEQ ID NO: 391476 - DNA, 140 bp, Artificial Sequence
  Synthetic
caccgctgtcccaaaaggtcaggtcttcgcggccagttctgccaaggcagtagaaacaacggactcggtgagctgaaccgtccgcttcctcctgggaggaggaacgggggtttgcttgctcatatcagcagccagggcct

SEQ ID NO: 391477 - DNA, 140 bp, Artificial Sequence
  Synthetic
atacgccatgctgggtctccatcgatgagttcactcaggggtgggggcccatcacatacgatgggtcctgcggcgcggaccagaggccttattgctggcactacgcgcccaagccgtgtgcgtacttgggagtcggccat

SEQ ID NO: 391478 - DNA, 140 bp, Artificial Sequence
  Synthetic
atggccgactcccaagtacgcacacggcttgggcgcgtagtgccagcaataaggcctctggtccgcgccgcaggacccatcgtatgtgatgggcccccacccctgagtgaactcatcgatggagacccagcatggcgtat

SEQ ID NO: 391479 - DNA, 140 bp, Artificial Sequence
  Synthetic
aggccctggctgctgatatgggctgaagaatcaaagctgccaattagccccctgagcaattcacttttacgccatcacaacatggtgtatgccacgactacccgctctgccgtaactcgggaccttttgggacagcggtg

SEQ ID NO: 391480 - DNA, 140 bp, Artificial Sequence
  Synthetic
caccgctgtcccaaaaggtcccgagttacggcagagcgggtagtcgtggcatacaccatgttgtgatggcgtaaaagtgaattgctcagggggctaattggcagctttgattcttcagcccatatcagcagccagggcct

SEQ ID NO: 391481 - DNA, 140 bp, Artificial Sequence
  Synthetic
aggccctggctgctgatatgccagcgaaaggaggtcggaagcctgctcgtctgatcgtgttcccggatctcggggttcgggtttgcgaaaagagagcgctttacgacgtcatcaaccaacgaccttttgggacagcggtg

SEQ ID NO: 391482 - DNA, 140 bp, Artificial Sequence
  Synthetic
caccgctgtcccaaaaggtcgttggttgatgacgtcgtaaagcgctctcttttcgcaaacccgaaccccgagatccgggaacacgatcagacgagcaggcttccgacctcctttcgctggcatatcagcagccagggcct

SEQ ID NO: 391483 - DNA, 140 bp, Artificial Sequence
  Synthetic
  misc_feature (92)..(92): n is a, c, g, or t
atacgccatgctgggtctccgcccgcaaggccattactgccctcacagaaagactctacgtgggcggccccatgcacaacagtgcaggagcnctttgcgggtaccggagatgccgcgcgacgtacttgggagtcggccat

SEQ ID NO: 391484 - DNA, 140 bp, Artificial Sequence
  Synthetic
  misc_feature (49)..(49): n is a, c, g, or t
atggccgactcccaagtacgtcgcgcggcatctccggtacccgcaaagngctcctgcactgttgtgcatggggccgcccacgtagagtctttctgtgagggcagtaatggccttgcgggcggagacccagcatggcgtat

SEQ ID NO: 391485 - DNA, 140 bp, Artificial Sequence
  Synthetic
aggccctggctgctgatatggctccggctcgtggctgagggacgtttgggactggatatgcacggtgttgactgacttcaagacctggctccagtccaagctcctgccgaggttgccggggaccttttgggacagcggtg

SEQ ID NO: 391486 - DNA, 140 bp, Artificial Sequence
  Synthetic
caccgctgtcccaaaaggtccccggcaacctcggcaggagcttggactggagccaggtcttgaagtcagtcaacaccgtgcatatccagtcccaaacgtccctcagccacgagccggagccatatcagcagccagggcct

SEQ ID NO: 391487 - DNA, 140 bp, Artificial Sequence
  Synthetic
  misc_feature (42)..(42): n is a, c, g, or t
aggccctggctgctgatatgactccatggcttaagcgcattnacactgcacggatactctccacacgaactcaatcgggtggccggaagcctcaggaaacttggggtacccccgttgagagaccttttgggacagcggtg

SEQ ID NO: 391488 - DNA, 140 bp, Artificial Sequence
  Synthetic
  misc_feature (99)..(99): n is a, c, g, or t
caccgctgtcccaaaaggtctctcaacgggggtaccccaagtttcctgaggcttccggccacccgattgagttcgtgtggagagtatccgtgcagtgtnaatgcgcttaagccatggagtcatatcagcagccagggcct

SEQ ID NO: 391489 - DNA, 140 bp, Artificial Sequence
  Synthetic
aggccctggctgctgatatgcggacgccgacctcattgaggccaacctcctgtggcggcaggagatgggcggggatatcacccgcgtggagtcagagaacaaagtggtgattctggactcgaccttttgggacagcggtg

SEQ ID NO: 391490 - DNA, 140 bp, Artificial Sequence
  Synthetic
caccgctgtcccaaaaggtcgagtccagaatcaccactttgttctctgactccacgcgggtgatatccccgcccatctcctgccgccacaggaggttggcctcaatgaggtcggcgtccgcatatcagcagccagggcct

SEQ ID NO: 391491 - DNA, 140 bp, Artificial Sequence
  Synthetic
aggccctggctgctgatatgctccaataccacctccacggagaaagaggacggttgtcctgacagaatccaccgtgtcttctgccttggcggagctcgctacgaagaccttcggcagctcgaccttttgggacagcggtg

SEQ ID NO: 391492 - DNA, 140 bp, Artificial Sequence
  Synthetic
caccgctgtcccaaaaggtcgagctgccgaaggtcttcgtagcgagctccgccaaggcagaagacacggtggattctgtcaggacaaccgtcctctttctccgtggaggtggtattggagcatatcagcagccagggcct

SEQ ID NO: 391493 - DNA, 140 bp, Artificial Sequence
  Synthetic
aggccctggctgctgatatggccagggccctggcacatggtatcagggccgtggaggacgggatcaattatgcaacagggaatcttcccggttgctccttttctatcttcctcttggcacgaccttttgggacagcggtg

SEQ ID NO: 391494 - DNA, 140 bp, Artificial Sequence
  Synthetic
caccgctgtcccaaaaggtcgtgccaagaggaagatagaaaaggagcaaccgggaagattccctgttgcataattgatcccgtcctccacggccctgataccatgtgccagggccctggccatatcagcagccagggcct

SEQ ID NO: 391495 - DNA, 140 bp, Artificial Sequence
  Synthetic
  misc_feature (56)..(56): n is a, c, g, or t
aggccctggctgctgatatgcactggactacccaggattgcaattgttccatctanacagggcacatcaccggccacaggatggcctgggacatgatgatgaactggagtccaacaaccagaccttttgggacagcggtg

SEQ ID NO: 391496 - DNA, 140 bp, Artificial Sequence
  Synthetic
  misc_feature (85)..(85): n is a, c, g, or t
caccgctgtcccaaaaggtctggttgttggactccagttcatcatcatgtcccaggccatcctgtggccggtgatgtgccctgtntagatggaacaattgcaatcctgggtagtccagtgcatatcagcagccagggcct

SEQ ID NO: 391497 - DNA, 140 bp, Artificial Sequence
  Synthetic
atacgccatgctgggtctcccttgctggaggtcactggggtgtcctcgtaggagtggcctacttctgcatgcaagctaattgggccaaagtcatcttagtcctattcctctttgcaggggcgtacttgggagtcggccat

SEQ ID NO: 391498 - DNA, 140 bp, Artificial Sequence
  Synthetic
atggccgactcccaagtacgcccctgcaaagaggaataggactaagatgactttggcccaattagcttgcatgcagaagtaggccactcctacgaggacaccccagtgacctccagcaagggagacccagcatggcgtat

SEQ ID NO: 391499 - DNA, 140 bp, Artificial Sequence
  Synthetic
  misc_feature (54)..(54): n is a, c, g, or t
atacgccatgctgggtctcctaacaccaatgggagctggcacataaacaggacngccctcaactgtaatgacagcttaaacactgggttcttggctagcttgttctacacccacaagttccgtacttgggagtcggccat

SEQ ID NO: 391500 - DNA, 140 bp, Artificial Sequence
  Synthetic
  misc_feature (87)..(87): n is a, c, g, or t
atggccgactcccaagtacggaacttgtgggtgtagaacaagctagccaagaacccagtgtttaagctgtcattacagttgagggcngtcctgtttatgtgccagctcccattggtgttaggagacccagcatggcgtat

SEQ ID NO: 391501 - DNA, 140 bp, Artificial Sequence
  Synthetic
  misc_feature (50)..(50): n is a, c, g, or t
atacgccatgctgggtctccaacagctcagggtgtccccagcggctttcnagctgcaggagccttgatagctttggccaaggttggggcccacttaaggccgctaacatcagcggcccgtcgtacttgggagtcggccat

SEQ ID NO: 391502 - DNA, 140 bp, Artificial Sequence
  Synthetic
  misc_feature (91)..(91): n is a, c, g, or t
atggccgactcccaagtacgacgggccgctgatgttagcggccttaagtgggccccaaccttggccaaagctatcaaggctcctgcagctngaaagccgctggggacaccctgagctgttggagacccagcatggcgtat

SEQ ID NO: 391503 - DNA, 140 bp, Artificial Sequence
  Synthetic
  misc_feature (38)..(38): n is a, c, g, or t
  misc_feature (104)..(104): n is a, c, g, or t
atacgccatgctgggtctccggtgcgtggttcgggtgngtgtggatgaacagtaccgggtttacaaagacctgcggtgctcctccatgcgaggtcaccaccgtnaatgaaacctggccatcgtacttgggagtcggccat

SEQ ID NO: 391504 - DNA, 140 bp, Artificial Sequence
  Synthetic
  misc_feature (37)..(37): n is a, c, g, or t
  misc_feature (103)..(103): n is a, c, g, or t
atggccgactcccaagtacgatggccaggtttcattnacggtggtgacctcgcatggaggagcaccgcaggtctttgtaaacccggtactgttcatccacacncacccgaaccacgcaccggagacccagcatggcgtat

SEQ ID NO: 391505 - DNA, 140 bp, Artificial Sequence
  Synthetic
  misc_feature (30)..(30): n is a, c, g, or t
aggccctggctgctgatatggctgtggcanttcccatgcaccgtcaactttaccatctttaagatcaggacattcattggcggtatagagcatcggatggaagcggcatgcaactggaccgaccttttgggacagcggtg

SEQ ID NO: 391506 - DNA, 140 bp, Artificial Sequence
  Synthetic
  misc_feature (111)..(111): n is a, c, g, or t
caccgctgtcccaaaaggtcggtccagttgcatgccgcttccatccgatgctctataccgccaatgaatgtcctgatcttaaagatggtaaagttgacggtgcatgggaantgccacagccatatcagcagccagggcct

SEQ ID NO: 391507 - DNA, 140 bp, Artificial Sequence
  Synthetic
atacgccatgctgggtctccacatgcggcaaatacctcttcaactgggcggtaaagaccaagctcagactcactccaatcccagctgcgtctcggttggacttgtccggctggttcgttgcgtacttgggagtcggccat

SEQ ID NO: 391508 - DNA, 140 bp, Artificial Sequence
  Synthetic
atggccgactcccaagtacgcaacgaaccagccggacaagtccaaccgagacgcagctgggattggagtgagtctgagcttggtctttaccgcccagttgaagaggtatttgccgcatgtggagacccagcatggcgtat

SEQ ID NO: 391509 - DNA, 140 bp, Artificial Sequence
  Synthetic
  misc_feature (52)..(52): n is a, c, g, or t
  misc_feature (118)..(118): n is a, c, g, or t
aggccctggctgctgatatgtctctgcttgcctatggatgatgtttatggtntcccaggttgaggcggctctgtccaacttaatcaacatcaatgctgcttcagccgctggcacccangggaccttttgggacagcggtg

SEQ ID NO: 391510 - DNA, 140 bp, Artificial Sequence
  Synthetic
  misc_feature (23)..(23): n is a, c, g, or t
  misc_feature (89)..(89): n is a, c, g, or t
caccgctgtcccaaaaggtcccntgggtgccagcggctgaagcagcattgatgttgattaagttggacagagccgcctcaacctggganaccataaacatcatccataggcaagcagagacatatcagcagccagggcct

SEQ ID NO: 391511 - DNA, 140 bp, Artificial Sequence
  Synthetic
  misc_feature (71)..(71): n is a, c, g, or t
  misc_feature (80)..(80): n is a, c, g, or t
  misc_feature (113)..(113): n is a, c, g, or t
atacgccatgctgggtctccctcttgcttctaatgctgcccgaaagggcttatgcatatgaccaggaggtngcagggacncttggtggcgctgtcgthgttgcactgaccatnctgacaccgtacttgggagtcggccat

SEQ ID NO: 391512 - DNA, 140 bp, Artificial Sequence
  Synthetic
  misc_feature (28)..(28): n is a, c, g, or t
  misc_feature (61)..(61): n is a, c, g, or t
  misc_feature (70)..(70): n is a, c, g, or t
atggccgactcccaagtacggtgtcagnatggtcagtgcaachacgacagcgccaccaagngtccctgcnacctcctggtcatatgcataagccctttcgggcagcattagaagcaagagggagacccagcatggcgtat

SEQ ID NO: 391513 - DNA, 140 bp, Artificial Sequence
  Synthetic
atacgccatgctgggtctcccaagtggatcaatgaagactacccaagtccttgcagcggtgattggctgcgtaccatctgggaatgggtttgcatggtgttgtccgacttcaagacatggcgtacttgggagtcggccat

SEQ ID NO: 391514 - DNA, 140 bp, Artificial Sequence
  Synthetic
atggccgactcccaagtacgccatgtcttgaagtcggacaacaccatgcaaacccattcccagatggtacgcagccaatcaccgctgcaaggacttgggtagtcttcattgatccacttgggagacccagcatggcgtat

SEQ ID NO: 391515 - DNA, 140 bp, Artificial Sequence
  Synthetic
  misc_feature (48)..(48): n is a, c, g, or t
  misc_feature (60)..(60): n is a, c, g, or t
  misc_feature (75)..(75): n is a, c, g, or t
  misc_feature (84)..(84): n is a, c, g, or t
  misc_feature (105)..(105): n is a, c, g, or t
  misc_feature (117)..(117): n is a, c, g, or t
atacgccatgctgggtctcctgacgtgcgcggacctcgtgattcgctnatcattcttgcngtcctggcttgcccncacctggtntttgacatcacaaagtacctnctggccatcttnggccgtacttgggagtcggccat

SEQ ID NO: 391516 - DNA, 140 bp, Artificial Sequence
  Synthetic
  misc_feature (24)..(24): n is a, c, g, or t
  misc_feature (36)..(36): n is a, c, g, or t
  misc_feature (57)..(57): n is a, c, g, or t
  misc_feature (66)..(66): n is a, c, g, or t
  misc_feature (81)..(81): n is a, c, g, or t
  misc_feature (93)..(93): n is a, c, g, or t
atggccgactcccaagtacggccnaagatggccagnaggtactttgtgatgtcaaanaccaggtgngggcaagccaggacngcaagaatgatnagcgaatcacgaggtccgcgcacgtcaggagacccagcatggcgtat

SEQ ID NO: 391517 - DNA, 140 bp, Artificial Sequence
  Synthetic
  misc_feature (25)..(25): n is a, c, g, or t
  misc_feature (34)..(34): n is a, c, g, or t
  misc_feature (55)..(55): n is a, c, g, or t
  misc_feature (67)..(67): n is a, c, g, or t
  misc_feature (85)..(85): n is a, c, g, or t
aggccctggctgctgatatggcccncacctggtntttgacatcacaaagtacctnctggccatcttnggccccctctacgtactncaggcctcgctcctgcgcgttccttactttgtgaggaccttttgggacagcggtg

SEQ ID NO: 391518 - DNA, 140 bp, Artificial Sequence
  Synthetic
  misc_feature (56)..(56): n is a, c, g, or t
  misc_feature (74)..(74): n is a, c, g, or t
  misc_feature (86)..(86): n is a, c, g, or t
  misc_feature (107)..(107): n is a, c, g, or t
  misc_feature (116)..(116): n is a, c, g, or t
caccgctgtcccaaaaggtcctcacaaagtaaggaacgcgcaggagcgaggcctgnagtacgtagagggggccnaagatggccagnaggtactttgtgatgtcaaanaccaggtgngggccatatcagcagccagggcct

SEQ ID NO: 391519 - DNA, 140 bp, Artificial Sequence
  Synthetic
atacgccatgctgggtctcctacatctatgaccaccttactcccttgtcagactgggctgctgagggcctccgcgacttggcggtggccgtggagccggttgtgttcacgcccatggagacgtacttgggagtcggccat

SEQ ID NO: 391520 - DNA, 140 bp, Artificial Sequence
  Synthetic
atggccgactcccaagtacgtctccatgggcgtgaacacaaccggctccacggccaccgccaagtcgcggaggccctcagcagcccagtctgacaagggagtaaggtggtcatagatgtaggagacccagcatggcgtat

SEQ ID NO: 391521 - DNA, 140 bp, Artificial Sequence
  Synthetic
  misc_feature (110)..(110): n is a, c, g, or t
atacgccatgctgggtctccagaaaatcatcgtctggggcgctgacaccgccgcgtgtggtgacattatagaggggctccctgtctcggccaggttgggcaatgagatcntgctcgggcccgtacttgggagtcggccat

SEQ ID NO: 391522 - DNA, 140 bp, Artificial Sequence
  Synthetic
  misc_feature (31)..(31): n is a, c, g, or t
atggccgactcccaagtacgggcccgagcangatctcattgcccaacctggccgagacagggagcccctctataatgtcaccacacgcggcggtgtcagcgccccagacgatgattttctggagacccagcatggcgtat

SEQ ID NO: 391523 - DNA, 140 bp, Artificial Sequence
  Synthetic
  misc_feature (58)..(58): n is a, c, g, or t
aggccctggctgctgatatgtctaccacggggcgggtagcaagaccatcagcggcccnaagggacctgtcaatcaaatgtataccaatgttgaccaagacttggtgggatggccagcgccgaccttttgggacagcggtg

SEQ ID NO: 391524 - DNA, 140 bp, Artificial Sequence
  Synthetic
  misc_feature (83)..(83): n is a, c, g, or t
caccgctgtcccaaaaggtcggcgctggccatcccaccaagtcttggtcaacattggtatacatttgattgacaggtcccttngggccgctgatggtcttgctacccgccccgtggtagacatatcagcagccagggcct

SEQ ID NO: 391525 - DNA, 140 bp, Artificial Sequence
  Synthetic
  misc_feature (41)..(41): n is a, c, g, or t
  misc_feature (44)..(44): n is a, c, g, or t
atacgccatgctgggtctccactagaggagctctcttgagnccnagacctatatccactcttaaggggtcttctggcggtccgctgctatgccccatgggacacgctgccggcatattcccgtacttgggagtcggccat

SEQ ID NO: 391526 - DNA, 140 bp, Artificial Sequence
  Synthetic
  misc_feature (97)..(97): n is a, c, g, or t
  misc_feature (100)..(100): n is a, c, g, or t
atggccgactcccaagtacgggaatatgccggcagcgtgtcccatggggcatagcagcggaccgccagaagaccccttaagagtggatataggtctnggnctcaagagagctcctctagtggagacccagcatggcgtat

SEQ ID NO: 391527 - DNA, 140 bp, Artificial Sequence
  Synthetic
aggccctggctgctgatatgctggcgggccttgcctactattccatggtggggaactgggctaaggttttgattgtgatgctactctttgccggcgttgacgggcaaacccacgtgacaggaccttttgggacagcggtg

SEQ ID NO: 391528 - DNA, 140 bp, Artificial Sequence
  Synthetic
caccgctgtcccaaaaggtcctgtcacgtgggtttgcccgtcaacgccggcaaagagtagcatcacaatcaaaaccttagcccagttccccaccatggaatagtaggcaaggcccgccagcatatcagcagccagggcct

SEQ ID NO: 391529 - DNA, 140 bp, Artificial Sequence
  Synthetic
  misc_feature (50)..(50): n is a, c, g, or t
  misc_feature (77)..(77): n is a, c, g, or t
  misc_feature (83)..(83): n is a, c, g, or t
  misc_feature (93)..(93): n is a, c, g, or t
atacgccatgctgggtctccgtcgagtctcttgagactactatgaggtcnccagtgttcactgacaactcaacaccncccgcngtgcctcagncctaccaggtcgctcacctacatgcaccgtacttgggagtcggccat

SEQ ID NO: 391530 - DNA, 140 bp, Artificial Sequence
  Synthetic
  misc_feature (48)..(48): n is a, c, g, or t
  misc_feature (58)..(58): n is a, c, g, or t
  misc_feature (64)..(64): n is a, c, g, or t
  misc_feature (91)..(91): n is a, c, g, or t
atggccgactcccaagtacggtgcatgtaggtgagcgacctggtaggnctgaggcacngcgggnggtgttgagttgtcagtgaacactggngacctcatagtagtctcaagagactcgacggagacccagcatggcgtat

SEQ ID NO: 391531 - DNA, 140 bp, Artificial Sequence
  Synthetic
  misc_feature (84)..(84): n is a, c, g, or t
atacgccatgctgggtctcctggggcatacatgtccaaggcatacggcattgacccgaacattcggtcaggagtcaggaccatnactacgggtgcgccaatcacgtactccacgtatggtcgtacttgggagtcggccat

SEQ ID NO: 391532 - DNA, 140 bp, Artificial Sequence
  Synthetic
  misc_feature (57)..(57): n is a, c, g, or t
atggccgactcccaagtacgaccatacgtggagtacgtgattggcgcacccgtagtnatggtcctgactcctgaccgaatgttcgggtcaatgccgtatgccttggacatgtatgccccaggagacccagcatggcgtat

SEQ ID NO: 391533 - DNA, 140 bp, Artificial Sequence
  Synthetic
  misc_feature (58)..(58): n is a, c, g, or t
  misc_feature (64)..(64): n is a, c, g, or t
  misc_feature (82)..(82): n is a, c, g, or t
atacgccatgctgggtctcccggtcctggaccaagcggagaccgctggagtgcgcctngtcgtnctcgcgaccgctaccccnccaggatcagtgaccacgccccactctaacatagaggacgtacttgggagtcggccat

SEQ ID NO: 391534 - DNA, 140 bp, Artificial Sequence
  Synthetic
  misc_feature (59)..(59): n is a, c, g, or t
  misc_feature (77)..(77): n is a, c, g, or t
  misc_feature (83)..(83): n is a, c, g, or t
atggccgactcccaagtacgtcctctatgttagagtggggcgtggtcactgatcctggnggggtagcggtcgcgagnacgacnaggcgcactccagcggtctccgcttggtccaggaccgggagacccagcatggcgtat

SEQ ID NO: 391535 - DNA, 140 bp, Artificial Sequence
  Synthetic
  misc_feature (28)..(28): n is a, c, g, or t
  misc_feature (36)..(36): n is a, c, g, or t
  misc_feature (62)..(62): n is a, c, g, or t
  misc_feature (93)..(93): n is a, c, g, or t
  misc_feature (114)..(114): n is a, c, g, or t
atacgccatgctgggtctccggtcgccntgccgacnacgggagaaatacccttttacggtanggcgattcccctagagttaatcaaggggggnagacacctcatcttctgtcantcaaagcgtacttgggagtcggccat

SEQ ID NO: 391536 - DNA, 140 bp, Artificial Sequence
  Synthetic
  misc_feature (27)..(27): n is a, c, g, or t
  misc_feature (48)..(48): n is a, c, g, or t
  misc_feature (79)..(79): n is a, c, g, or t
  misc_feature (105)..(105): n is a, c, g, or t
  misc_feature (113)..(113): n is a, c, g, or t
atggccgactcccaagtacgctttgantgacagaagatgaggtgtctnccccccttgattaactctaggggaatcgccntaccgtaaaagggtatttctcccgtngtcggcanggcgaccggagacccagcatggcgtat

SEQ ID NO: 391537 - DNA, 140 bp, Artificial Sequence
  Synthetic
atacgccatgctgggtctcccttaccgatttcgaccagggttggggccctatcagctatgccaacggaagtggctcagaacatcgcccttattgctggcactaccccccaaagccttgcgcgtacttgggagtcggccat

SEQ ID NO: 391538 - DNA, 140 bp, Artificial Sequence
  Synthetic
atggccgactcccaagtacgcgcaaggctttggggggtagtgccagcaataagggcgatgttctgagccacttccgttggcatagctgatagggccccaaccctggtcgaaatcggtaagggagacccagcatggcgtat

SEQ ID NO: 391539 - DNA, 140 bp, Artificial Sequence
  Synthetic
aggccctggctgctgatatggacagggatagatcagagctcagcccgctgctgctgtctacaacagagtggcagatactgccctgctccttcaccaccttaccggctctgtccactggttgaccttttgggacagcggtg

SEQ ID NO: 391540 - DNA, 140 bp, Artificial Sequence
  Synthetic
caccgctgtcccaaaaggtcaaccagtggacagagccggtaaggtggtgaaggagcagggcagtatctgccactctgttgtagacagcagcagcgggctgagctctgatctatccctgtccatatcagcagccagggcct

SEQ ID NO: 391541 - DNA, 140 bp, Artificial Sequence
  Synthetic
aggccctggctgctgatatgggcactacgcgcctcgaccgtgtggtatcgtacccgcgtcgcaggtgtgtggtccggtgtattgcttcaccccaagccctgttgtggtggggacgaccgagaccttttgggacagcggtg

SEQ ID NO: 391542 - DNA, 140 bp, Artificial Sequence
  Synthetic
caccgctgtcccaaaaggtctcggtcgtccccaccacaacagggcttggggtgaagcaatacaccggaccacacacctgcgacgcgggtacgataccacacggtcgaggcgcgtagtgcccatatcagcagccagggcct

SEQ ID NO: 391543 - DNA, 140 bp, Artificial Sequence
  Synthetic
  misc_feature (96)..(96): n is a, c, g, or t
atacgccatgctgggtctcctcttccactaatcgagcacgggctgcaattggctgagcaattcaagcagaaggccacaggtcttctaaacttcgcnggcaagcaagcccaagaggcaacacgtacttgggagtcggccat

SEQ ID NO: 391544 - DNA, 140 bp, Artificial Sequence
  Synthetic
  misc_feature (45)..(45): n is a, c, g, or t
atggccgactcccaagtacgtgttgcctcttgggcttgcttgccngcgaagtttagaagacctgtggccttctgcttgaattgctcagccaattgcagcccgtgctcgattagtggaagaggagacccagcatggcgtat

SEQ ID NO: 391545 - DNA, 140 bp, Artificial Sequence
  Synthetic
aggccctggctgctgatatgggaccagccgatggaatggtctccaaggggtggaggttgctggcgcccatcacggcgtacgcccagcagacaaggggcctcctagggtgtataatcaccagaccttttgggacagcggtg

SEQ ID NO: 391546 - DNA, 140 bp, Artificial Sequence
  Synthetic
caccgctgtcccaaaaggtctggtgattatacaccctaggaggccccttgtctgctgggcgtacgccgtgatgggcgccagcaacctccaccccttggagaccattccatcggctggtcccatatcagcagccagggcct

SEQ ID NO: 391547 - DNA, 140 bp, Artificial Sequence
  Synthetic
  misc_feature (64)..(64): n is a, c, g, or t
atacgccatgctgggtctcctgccaggcaatcctgccattgcttccctcatgtccttcaccgcngccgttacaagccctctgaccactcaacaaaccctcctttttaacatcttggggggcgtacttgggagtcggccat

SEQ ID NO: 391548 - DNA, 140 bp, Artificial Sequence
  Synthetic
  misc_feature (77)..(77): n is a, c, g, or t
atggccgactcccaagtacgccccccaagatgttaaaaaggagggtttgttgagtggtcagagggcttgtaacggcngcggtgaaggacatgagggaagcaatggcaggattgcctggcaggagacccagcatggcgtat

SEQ ID NO: 391549 - DNA, 140 bp, Artificial Sequence
  Synthetic
  misc_feature (101)..(101): n is a, c, g, or t
aggccctggctgctgatatgacaagccctctgaccactcaacaaaccctcctttttaacatcttggggggatgggtggcctcgcagattgcgactccgacngcttctacagcatttgtcggaccttttgggacagcggtg

SEQ ID NO: 391550 - DNA, 140 bp, Artificial Sequence
  Synthetic
  misc_feature (40)..(40): n is a, c, g, or t
caccgctgtcccaaaaggtccgacaaatgctgtagaagcngtcggagtcgcaatctgcgaggccacccatccccccaagatgttaaaaaggagggtttgttgagtggtcagagggcttgtcatatcagcagccagggcct

SEQ ID NO: 391551 - DNA, 140 bp, Artificial Sequence
  Synthetic
atacgccatgctgggtctccccatccgtcgccgccactttaggtttcggggcgtatatgtctaaagcacatggtgtcgaccctaacatcagaactggggtaaggactatcaccacgggcgcgtacttgggagtcggccat

SEQ ID NO: 391552 - DNA, 140 bp, Artificial Sequence
  Synthetic
atggccgactcccaagtacgcgcccgtggtgatagtccttaccccagttctgatgttagggtcgacaccatgtgctttagacatatacgccccgaaacctaaagtggcggcgacggatggggagacccagcatggcgtat

SEQ ID NO: 391553 - DNA, 140 bp, Artificial Sequence
  Synthetic
  misc_feature (94)..(94): n is a, c, g, or t
atacgccatgctgggtctccaccgccacgccccgaagtgcaaacccttgctgcgggacgaagtgtcgttctcggtaggactcaattcgttcgtngtgggatcacaactcccatgcgagcccgtacttgggagtcggccat

SEQ ID NO: 391554 - DNA, 140 bp, Artificial Sequence
  Synthetic
  misc_feature (47)..(47): n is a, c, g, or t
atggccgactcccaagtacgggctcgcatgggagttgtgatcccacnacgaacgaattgagtcctaccgagaacgacacttcgtcccgcagcaagggtttgcacttcggggcgtggcggtggagacccagcatggcgtat

SEQ ID NO: 391555 - DNA, 140 bp, Artificial Sequence
  Synthetic
  misc_feature (62)..(62): n is a, c, g, or t
  misc_feature (95)..(95): n is a, c, g, or t
  misc_feature (110)..(110): n is a, c, g, or t
  misc_feature (116)..(116): n is a, c, g, or t
atacgccatgctgggtctccttagctagttcctcggccagtcagctgtctgccccgtctctnaaagccacatgcaccgctcgccatgactccccnggtactgatctcctngaggcnaacccgtacttgggagtcggccat

SEQ ID NO: 391556 - DNA, 140 bp, Artificial Sequence
  Synthetic
  misc_feature (25)..(25): n is a, c, g, or t
  misc_feature (31)..(31): n is a, c, g, or t
  misc_feature (46)..(46): n is a, c, g, or t
  misc_feature (79)..(79): n is a, c, g, or t
atggccgactcccaagtacgggttngcctcnaggagatcagtaccnggggagtcatggcgagcggtgcatgtggctttnagagacggggcagacagctgactggccgaggaactagctaaggagacccagcatggcgtat

SEQ ID NO: 391557 - DNA, 140 bp, Artificial Sequence
  Synthetic
  misc_feature (31)..(31): n is a, c, g, or t
  misc_feature (69)..(69): n is a, c, g, or t
  misc_feature (97)..(97): n is a, c, g, or t
  misc_feature (116)..(116): n is a, c, g, or t
aggccctggctgctgatatgctctgccaatntgggctcgaccagattacaatccacctcttactgagangtggaagcaacaggactacaagcctccnaccgtccacgggtgcgctntgccgaccttttgggacagcggtg

SEQ ID NO: 391558 - DNA, 140 bp, Artificial Sequence
  Synthetic
  misc_feature (25)..(25): n is a, c, g, or t
  misc_feature (44)..(44): n is a, c, g, or t
  misc_feature (72)..(72): n is a, c, g, or t
  misc_feature (110)..(110): n is a, c, g, or t
caccgctgtcccaaaaggtcggcanagcgcacccgtggacggtnggaggcttgtagtcctgttgcttccacntctcagtaagaggtggattgtaatctggtcgagcccanattggcagagcatatcagcagccagggcct

SEQ ID NO: 391559 - DNA, 140 bp, Artificial Sequence
  Synthetic
atacgccatgctgggtctccaataccccaatatcaacaacaatcatggccaaaaatgaggttttcgctgtaaacccagcgaagggaggtcggaagcctgctcgtctgatcgtgtatccggcgtacttgggagtcggccat

SEQ ID NO: 391560 - DNA, 140 bp, Artificial Sequence
  Synthetic
atggccgactcccaagtacgccggatacacgatcagacgagcaggcttccgacctcccttcgctgggtttacagcgaaaacctcatttttggccatgattgttgttgatattggggtattggagacccagcatggcgtat

SEQ ID NO: 391561 - DNA, 140 bp, Artificial Sequence
  Synthetic
aggccctggctgctgatatgttggcagcataggccttgggaaggtgcttgtggacatcctggcgggttatggagcgggggtggcaggcgcactcgtggcctttaaggtcatgagtggtgagaccttttgggacagcggtg

SEQ ID NO: 391562 - DNA, 140 bp, Artificial Sequence
  Synthetic
caccgctgtcccaaaaggtctcaccactcatgaccttaaaggccacgagtgcgcctgccacccccgctccataacccgccaggatgtccacaagcaccttcccaaggcctatgctgccaacatatcagcagccagggcct

SEQ ID NO: 391563 - DNA, 140 bp, Artificial Sequence
  Synthetic
aggccctggctgctgatatggaggtcgtcactagcacttgggtgctggtaggcggggtcctcgcggctctggccgcgtactgcctgacaacgggcagcgtggtcattgtgggcaggatcagaccttttgggacagcggtg

SEQ ID NO: 391564 - DNA, 140 bp, Artificial Sequence
  Synthetic
caccgctgtcccaaaaggtctgatcctgcccacaatgaccacgctgcccgttgtcaggcagtacgcggccagagccgcgaggaccccgcctaccagcacccaagtgctagtgacgacctccatatcagcagccagggcct

SEQ ID NO: 391565 - DNA, 140 bp, Artificial Sequence
  Synthetic
aggccctggctgctgatatgtcaatactccaaagccaggaagcccttgagaaagcactcgacttcgacatgtacggagtcacctactctatcactccgctggatctaccggcaatcattcgaccttttgggacagcggtg

SEQ ID NO: 391566 - DNA, 140 bp, Artificial Sequence
  Synthetic
caccgctgtcccaaaaggtcgaatgattgccggtagatccagcggagtgatagagtaggtgactccgtacatgtcgaagtcgagtgctttctcaagggcttcctggctttggagtattgacatatcagcagccagggcct

SEQ ID NO: 391567 - DNA, 140 bp, Artificial Sequence
  Synthetic
  misc_feature (61)..(61): n is a, c, g, or t
  misc_feature (94)..(94): n is a, c, g, or t
atacgccatgctgggtctccttctctcgtgcctgactgtccccgcttcggccatcaactancgcaatgcttcgggtatctaccacgtcaccaangactgcccgaattcaagcatagtgtacgtacttgggagtcggccat

SEQ ID NO: 391568 - DNA, 140 bp, Artificial Sequence
  Synthetic
  misc_feature (47)..(47): n is a, c, g, or t
  misc_feature (80)..(80): n is a, c, g, or t
atggccgactcccaagtacgtacactatgcttgaattcgggcagtcnttggtgacgtggtagatacccgaagcattgcgntagttgatggccgaagcggggacagtcaggcacgagagaaggagacccagcatggcgtat

SEQ ID NO: 391569 - DNA, 140 bp, Artificial Sequence
  Synthetic
atacgccatgctgggtctccgcaagctaattgggccaaagtcatcttagtcctattcctctttgcaggggttgacgctgagactcatgtgtctgggggtgcggttggccgaaccgcccaacgtacttgggagtcggccat

SEQ ID NO: 391570 - DNA, 140 bp, Artificial Sequence
  Synthetic
atggccgactcccaagtacgttgggcggttcggccaaccgcacccccagacacatgagtctcagcgtcaacccctgcaaagaggaataggactaagatgactttggcccaattagcttgcggagacccagcatggcgtat

SEQ ID NO: 391571 - DNA, 140 bp, Artificial Sequence
  Synthetic
  misc_feature (108)..(108): n is a, c, g, or t
atacgccatgctgggtctccacagcctaaacactgggttcttggccggcttgttctacgcccacaagtttaacagctcagggtgtcccgaacggctcgcaagatgcangaggcttgacagcgtacttgggagtcggccat

SEQ ID NO: 391572 - DNA, 140 bp, Artificial Sequence
  Synthetic
  misc_feature (33)..(33): n is a, c, g, or t
atggccgactcccaagtacgctgtcaagcctcntgcatcttgcgagccgttcgggacaccctgagctgttaaacttgtgggcgtagaacaagccggccaagaacccagtgtttaggctgtggagacccagcatggcgtat

SEQ ID NO: 391573 - DNA, 140 bp, Artificial Sequence
  Synthetic
atacgccatgctgggtctccgtgccggcatctactgtgtgtgggcccgtatactgcttcacccccagcccagttgtggtcggaaccaccgatcgcctcggggtccctacttacacctgggcgtacttgggagtcggccat

SEQ ID NO: 391574 - DNA, 140 bp, Artificial Sequence
  Synthetic
atggccgactcccaagtacgcccaggtgtaagtagggaccccgaggcgatcggtggttccgaccacaactgggctgggggtgaagcagtatacgggcccacacacagtagatgccggcacggagacccagcatggcgtat

SEQ ID NO: 391575 - DNA, 140 bp, Artificial Sequence
  Synthetic
atacgccatgctgggtctccgggcgaatgagtctgatgccttccttttgaactcaaccagaccgccgcgtggtgcgtggttcggatgcgtgtggatgaacggtaccgggttcacaaaaaccgtacttgggagtcggccat

SEQ ID NO: 391576 - DNA, 140 bp, Artificial Sequence
  Synthetic
atggccgactcccaagtacggtttttgtgaacccggtaccgttcatccacacgcatccgaaccacgcaccacgcggcggtctggttgagttcaaaaggaaggcatcagactcattcgcccggagacccagcatggcgtat

SEQ ID NO: 391577 - DNA, 140 bp, Artificial Sequence
  Synthetic
atacgccatgctgggtctccgggtcagggccttggatcacaccacgatgcttgattcactatccgtaccggctgtggcatttcccatgcaccgtcaattttactgtctttaagatcaggacgtacttgggagtcggccat

SEQ ID NO: 391578 - DNA, 140 bp, Artificial Sequence
  Synthetic
atggccgactcccaagtacgtcctgatcttaaagacagtaaaattgacggtgcatgggaaatgccacagccggtacggatagtgaatcaagcatcgtggtgtgatccaaggccctgacccggagacccagcatggcgtat

SEQ ID NO: 391579 - DNA, 140 bp, Artificial Sequence
  Synthetic
atacgccatgctgggtctcctctctgcttgcctgtggatgatgttcatggtagctcaggttgaggcggctctgtccaacctgattaatatcaatgctgcttcagccgctggcacccatggcgtacttgggagtcggccat

SEQ ID NO: 391580 - DNA, 140 bp, Artificial Sequence
  Synthetic
atggccgactcccaagtacgccatgggtgccagcggctgaagcagcattgatattaatcaggttggacagagccgcctcaacctgagctaccatgaacatcatccacaggcaagcagagaggagacccagcatggcgtat

SEQ ID NO: 391581 - DNA, 140 bp, Artificial Sequence
  Synthetic
atacgccatgctgggtctccctcctacttctaatgctgcccgaaagggcttacgcatatgatcgggaggtggcagggtcccttggtggcgctgtcgttgtcacgctgactattctgacaccgtacttgggagtcggccat

SEQ ID NO: 391582 - DNA, 140 bp, Artificial Sequence
  Synthetic
atggccgactcccaagtacggtgtcagaatagtcagcgtgacaacgacagcgccaccaagggaccctgccacctcccgatcatatgcgtaagccctttcgggcagcattagaagtaggagggagacccagcatggcgtat

SEQ ID NO: 391583 - DNA, 140 bp, Artificial Sequence
  Synthetic
  misc_feature (51)..(51): n is a, c, g, or t
atacgccatgctgggtctcccgacgtgcgcgggcctcgcgactcagtgatnattcttgcagtcctggcttgcccacacctgatgtttgacatcacaaaatacctactggccatcttaggacgtacttgggagtcggccat

SEQ ID NO: 391584 - DNA, 140 bp, Artificial Sequence
  Synthetic
  misc_feature (90)..(90): n is a, c, g, or t
atggccgactcccaagtacgtcctaagatggccagtaggtattttgtgatgtcaaacatcaggtgtgggcaagccaggactgcaagaatnatcactgagtcgcgaggcccgcgcacgtcgggagacccagcatggcgtat

SEQ ID NO: 391585 - DNA, 140 bp, Artificial Sequence
  Synthetic
atacgccatgctgggtctccgcaagtattgtcaaatggctgtgcttaaagtaggggccatgactggtacttacatttatgaccaccttactcccctgtcagattgggccgctgagggcctcgtacttgggagtcggccat

SEQ ID NO: 391586 - DNA, 140 bp, Artificial Sequence
  Synthetic
atggccgactcccaagtacgaggccctcagcggcccaatctgacaggggagtaaggtggtcataaatgtaagtaccagtcatggcccctactttaagcacagccatttgacaatacttgcggagacccagcatggcgtat

SEQ ID NO: 391587 - DNA, 140 bp, Artificial Sequence
  Synthetic
atacgccatgctgggtctccagaaaatcattgtctggggcgctgacactgctgcgtgtggcgacatcataggggggttacccgtctcggccaggctgggcaatgaaatcctgctcgggcccgtacttgggagtcggccat

SEQ ID NO: 391588 - DNA, 140 bp, Artificial Sequence
  Synthetic
atggccgactcccaagtacgggcccgagcaggatttcattgcccagcctggccgagacgggtaacccccctatgatgtcgccacacgcagcagtgtcagcgccccagacaatgattttctggagacccagcatggcgtat

SEQ ID NO: 391589 - DNA, 140 bp, Artificial Sequence
  Synthetic
aggccctggctgctgatatgactggcagagacaccaatgaaaactgtggtgaagtacaggtcctgtccaccgccacgcagtccttcctaggtactgcggttaacggcgtgatgtggaccggaccttttgggacagcggtg

SEQ ID NO: 391590 - DNA, 140 bp, Artificial Sequence
  Synthetic
caccgctgtcccaaaaggtccggtccacatcacgccgttaaccgcagtacctaggaaggactgcgtggcggtggacaggacctgtacttcaccacagttttcattggtgtctctgccagtcatatcagcagccagggcct

SEQ ID NO: 391591 - DNA, 140 bp, Artificial Sequence
  Synthetic
  misc_feature (57)..(57): n is a, c, g, or t
atacgccatgctgggtctcctcctggagtcaaatctctcgcgccgtgcacttgtggngcctcagacttgtatttagtcacgaggcacgcagatgtggtacctgtgcgcaggagaggggaccgtacttgggagtcggccat

SEQ ID NO: 391592 - DNA, 140 bp, Artificial Sequence
  Synthetic
  misc_feature (84)..(84): n is a, c, g, or t
atggccgactcccaagtacggtcccctctcctgcgcacaggtaccacatctgcgtgcctcgtgactaaatacaagtctgaggcnccacaagtgcacggcgcgagagatttgactccaggaggagacccagcatggcgtat

SEQ ID NO: 391593 - DNA, 140 bp, Artificial Sequence
  Synthetic
aggccctggctgctgatatggccatcttggacatgatcgctggtgctcactggggagtcctagcgggcatagcgtatttctccatggtggggaactgggcgaaggtcctggtagtgctgcgaccttttgggacagcggtg

SEQ ID NO: 391594 - DNA, 140 bp, Artificial Sequence
  Synthetic
caccgctgtcccaaaaggtcgcagcactaccaggaccttcgcccagttccccaccatggagaaatacgctatgcccgctaggactccccagtgagcaccagcgatcatgtccaagatggccatatcagcagccagggcct

SEQ ID NO: 391595 - DNA, 140 bp, Artificial Sequence
  Synthetic
atacgccatgctgggtctccttctggcggtccgctgctatgccccatgggacacgccgccggcatattccgcgcggcggtgtgtacccgaggggtggctaaggcggtggactttgtccctcgtacttgggagtcggccat

SEQ ID NO: 391596 - DNA, 140 bp, Artificial Sequence
  Synthetic
atggccgactcccaagtacgagggacaaagtccaccgccttagccacccctcgggtacacaccgccgcgcggaatatgccggcggcgtgtcccatggggcatagcagcggaccgccagaaggagacccagcatggcgtat

SEQ ID NO: 391597 - DNA, 140 bp, Artificial Sequence
  Synthetic
atacgccatgctgggtctccttacgctgagccgcgcgacctggatcagaggccctactgttggcactacgcacctcgaccgtgcggcattgtgcccgcgtcgcagatatgtggtccagtgcgtacttgggagtcggccat

SEQ ID NO: 391598 - DNA, 140 bp, Artificial Sequence
  Synthetic
atggccgactcccaagtacgcactggaccacatatctgcgacgcgggcacaatgccgcacggtcgaggtgcgtagtgccaacagtagggcctctgatccaggtcgcgcggctcagcgtaaggagacccagcatggcgtat

SEQ ID NO: 391599 - DNA, 140 bp, Artificial Sequence
  Synthetic
atacgccatgctgggtctccggtcgccctgccgacgatgggagaagtacccttctacggtaaggcgattcccctggagctaattaaggggggcagacatctcatcttttgccactcaaagcgtacttgggagtcggccat

SEQ ID NO: 391600 - DNA, 140 bp, Artificial Sequence
  Synthetic
atggccgactcccaagtacgctttgagtggcaaaagatgagatgtctgccccccttaattagctccaggggaatcgccttaccgtagaagggtacttctcccatcgtcggcagggcgaccggagacccagcatggcgtat

SEQ ID NO: 391601 - DNA, 140 bp, Artificial Sequence
  Synthetic
atacgccatgctgggtctcccagcttggaccccaccttctccatagagactacaactgttcctcaggacgcggtatcccgcagccagcggagaggccgtactggtagggggaggttgggccgtacttgggagtcggccat

SEQ ID NO: 391602 - DNA, 140 bp, Artificial Sequence
  Synthetic
atggccgactcccaagtacggcccaacctccccctaccagtacggcctctccgctggctgcgggataccgcgtcctgaggaacagttgtagtctctatggagaaggtggggtccaagctgggagacccagcatggcgtat

SEQ ID NO: 391603 - DNA, 140 bp, Artificial Sequence
  Synthetic
aggccctggctgctgatatgcggtatcccgcagccagcggagaggccgtactggtagggggaggttgggcatataccggtatgtcaccccgggtgagagaccatcaggcatatttgacacgaccttttgggacagcggtg

SEQ ID NO: 391604 - DNA, 140 bp, Artificial Sequence
  Synthetic
caccgctgtcccaaaaggtcgtgtcaaatatgcctgatggtctctcacccggggtgacataccggtatatgcccaacctccccctaccagtacggcctctccgctggctgcgggataccgcatatcagcagccagggcct

SEQ ID NO: 391605 - DNA, 140 bp, Artificial Sequence
  Synthetic
aggccctggctgctgatatgcttgcactgccccaccgattgtttccgcaaacatccggaagccacatactctcggtgcggctccggtccctggattacacccaggtgcctggtcgactacgaccttttgggacagcggtg

SEQ ID NO: 391606 - DNA, 140 bp, Artificial Sequence
  Synthetic
caccgctgtcccaaaaggtcgtagtcgaccaggcacctgggtgtaatccagggaccggagccgcaccgagagtatgtggcttccggatgtttgcggaaacaatcggtggggcagtgcaagcatatcagcagccagggcct

SEQ ID NO: 391607 - DNA, 140 bp, Artificial Sequence
  Synthetic
aggccctggctgctgatatggagcccgcctcttctggctgccccccagactccgacgctgagtcctactcttccatgccccccctggagggggagcctggggatccggatctcagcgacggaccttttgggacagcggtg

SEQ ID NO: 391608 - DNA, 140 bp, Artificial Sequence
  Synthetic
caccgctgtcccaaaaggtccgtcgctgagatccggatccccaggctccccctccagggggggcatggaagagtaggactcagcgtcggagtctggggggcagccagaagaggcgggctccatatcagcagccagggcct

SEQ ID NO: 391609 - DNA, 140 bp, Artificial Sequence
  Synthetic
aggccctggctgctgatatgtgccaggcaatcctgccattgcttccctcatgtcttttactgccgccgttacaagccctctgaccacccagcaaaccctccttttcaacatcttgggggggaccttttgggacagcggtg

SEQ ID NO: 391610 - DNA, 140 bp, Artificial Sequence
  Synthetic
caccgctgtcccaaaaggtcccccccaagatgttgaaaaggagggtttgctgggtggtcagagggcttgtaacggcggcagtaaaagacatgagggaagcaatggcaggattgcctggcacatatcagcagccagggcct

SEQ ID NO: 391611 - DNA, 140 bp, Artificial Sequence
  Synthetic
atacgccatgctgggtctccttagtggacattctcgccggctacggcgccggcgtagctggtgctgtggttacttttaagatcatgagcggcgagacgccatctgtggaggacttagtaacgtacttgggagtcggccat

SEQ ID NO: 391612 - DNA, 140 bp, Artificial Sequence
  Synthetic
atggccgactcccaagtacgttactaagtcctccacagatggcgtctcgccgctcatgatcttaaaagtaaccacagcaccagctacgccggcgccgtagccggcgagaatgtccactaaggagacccagcatggcgtat

SEQ ID NO: 391613 - DNA, 140 bp, Artificial Sequence
  Synthetic
aggccctggctgctgatatgtgatgctgctgatagcccaggccgaggctgccttagagaacttggtggtcctcaatgcggcgtccgtggtcggagcgcatggcatgctccccttctttatgaccttttgggacagcggtg

SEQ ID NO: 391614 - DNA, 140 bp, Artificial Sequence
  Synthetic
caccgctgtcccaaaaggtcataaagaaggggagcatgccatgcgctccgaccacggacgccgcattgaggaccaccaagttctctaaggcagcctcggcctgggctatcagcagcatcacatatcagcagccagggcct

SEQ ID NO: 391615 - DNA, 140 bp, Artificial Sequence
  Synthetic
atacgccatgctgggtctccccaccacgagcttacgccatggaccgggagatggttgcatcttgcggaggcggggtttttgtaggtctagcactcctgaccttgtcaccatactgtaaagcgtacttgggagtcggccat

SEQ ID NO: 391616 - DNA, 140 bp, Artificial Sequence
  Synthetic
atggccgactcccaagtacgctttacagtatggtgacaaggtcaggagtgctagacctacaaaaaccccgcctccgcaagatgcaaccatctcccggtccatggcgtaagctcgtggtggggagacccagcatggcgtat

SEQ ID NO: 391617 - DNA, 140 bp, Artificial Sequence
  Synthetic
atacgccatgctgggtctccgggactgggtctgcaccgtactgagtgacttcaaaacgtggctaaaggccaagctgctgcctctcatgccaggcgtccccttcctctcgtgtcagaggggcgtacttgggagtcggccat

SEQ ID NO: 391618 - DNA, 140 bp, Artificial Sequence
  Synthetic
atggccgactcccaagtacgcccctctgacacgagaggaaggggacgcctggcatgagaggcagcagcttggcctttagccacgttttgaagtcactcagtacggtgcagacccagtcccggagacccagcatggcgtat

SEQ ID NO: 391619 - DNA, 140 bp, Artificial Sequence
  Synthetic
atacgccatgctgggtctccgctagtttaatccgagtgccgtacttcgtgcgcgctcaagggctcattcgcgcatgcatgttggtgcggaaagctgccgggggccattatgtccaaatggcgtacttgggagtcggccat

SEQ ID NO: 391620 - DNA, 140 bp, Artificial Sequence
  Synthetic
atggccgactcccaagtacgccatttggacataatggcccccggcagctttccgcaccaacatgcatgcgcgaatgagcccttgagcgcgcacgaagtacggcactcggattaaactagcggagacccagcatggcgtat

SEQ ID NO: 391621 - DNA, 140 bp, Artificial Sequence
  Synthetic
atacgccatgctgggtctccccccagtaagcaaccccccgtccctcctcccaggagaaaacggacggtccaactcactgagtccgctgtttctagcgttttggcagaactggctgcaaagcgtacttgggagtcggccat

SEQ ID NO: 391622 - DNA, 140 bp, Artificial Sequence
  Synthetic
atggccgactcccaagtacgctttgcagccagttctgccaaaacgctagaaacagcggactcagtgagttggaccgtccgttttctcctgggaggagggacggggggttgcttactggggggagacccagcatggcgtat

SEQ ID NO: 391623 - DNA, 140 bp, Artificial Sequence
  Synthetic
atacgccatgctgggtctcctcaatcacttttccgcatcccaacatcgaggaggtgcccctggccaacacaggggaaatccccttctacgccaaaaccatccccattgaggtcatcagggcgtacttgggagtcggccat

SEQ ID NO: 391624 - DNA, 140 bp, Artificial Sequence
  Synthetic
atggccgactcccaagtacgccctgatgacctcaatggggatggttttggcgtagaaggggatttcccctgtgttggccaggggcacctcctcgatgttgggatgcggaaaagtgattgaggagacccagcatggcgtat

SEQ ID NO: 391625 - DNA, 140 bp, Artificial Sequence
  Synthetic
atacgccatgctgggtctcccgggcctgtcaacgctgcctggcaatcctgctattgcgtcgttgatggcttttacagctgccgtcaccagcccactaaccactagccagactctcctcttcgtacttgggagtcggccat

SEQ ID NO: 391626 - DNA, 140 bp, Artificial Sequence
  Synthetic
atggccgactcccaagtacgaagaggagagtctggctagtggttagtgggctggtgacggcagctgtaaaagccatcaacgacgcaatagcaggattgccaggcagcgttgacaggcccgggagacccagcatggcgtat

SEQ ID NO: 391627 - DNA, 140 bp, Artificial Sequence
  Synthetic
atacgccatgctgggtctcctggtttgcggtgacgacttagtcgttatcgctgagagcgacggcgtggaggaggatagccgagccctccgagccttcacggaggctatgacgagatactccgtacttgggagtcggccat

SEQ ID NO: 391628 - DNA, 140 bp, Artificial Sequence
  Synthetic
atggccgactcccaagtacggagtatctcgtcatagcctccgtgaaggctcggagggctcggctatcctcctccacgccgtcgctctcagcgataacgactaagtcgtcaccgcaaaccaggagacccagcatggcgtat

SEQ ID NO: 391629 - DNA, 140 bp, Artificial Sequence
  Synthetic
aggccctggctgctgatatgcagtggataagctcggagtgtgttgctccatgctccgattcctggctgaaggatatctgggactggatatgcgaggtgttgagcgactttaagacctggtgaccttttgggacagcggtg

SEQ ID NO: 391630 - DNA, 140 bp, Artificial Sequence
  Synthetic
caccgctgtcccaaaaggtcaccaggtcttaaagtcgctcaacacctcgcatatccagtcccagatatccttcagccaggaatcggagcatggagcaacacactccgagcttatccactgcatatcagcagccagggcct

SEQ ID NO: 391631 - DNA, 140 bp, Artificial Sequence
  Synthetic
aggccctggctgctgatatgttctctcgtgcctgactgtccccgcttcggccatcaactatcgcaacgtctcgggcatttaccacgtcaccaatgactgcccgaactcaagcatagtgtagaccttttgggacagcggtg

SEQ ID NO: 391632 - DNA, 140 bp, Artificial Sequence
  Synthetic
caccgctgtcccaaaaggtctacactatgcttgagttcgggcagtcattggtgacgtggtaaatgcccgagacgttgcgatagttgatggccgaagcggggacagtcaggcacgagagaacatatcagcagccagggcct

SEQ ID NO: 391633 - DNA, 140 bp, Artificial Sequence
  Synthetic
aggccctggctgctgatatgcgcctcggaagaagcggacggtggtcctcaccgaatcaaccgtatctactgccttggccgagcttgccaccaagagctttggcagctcctcaacttccgggaccttttgggacagcggtg

SEQ ID NO: 391634 - DNA, 140 bp, Artificial Sequence
  Synthetic
caccgctgtcccaaaaggtcccggaagttgaggagctgccaaagctcttggtggcaagctcggccaaggcagtagatacggttgattcggtgaggaccaccgtccgcttcttccgaggcgcatatcagcagccagggcct

SEQ ID NO: 391635 - DNA, 140 bp, Artificial Sequence
  Synthetic
  misc_feature (114)..(114): n is a, c, g, or t
atacgccatgctgggtctccgcaggctaattgggccaaagtcatcctggtcctattcctctttgcaggggtggatgccgaaacctatgtgactggagcggcagttggtcgccangccgcccgtacttgggagtcggccat

SEQ ID NO: 391636 - DNA, 140 bp, Artificial Sequence
  Synthetic
  misc_feature (27)..(27): n is a, c, g, or t
atggccgactcccaagtacgggcggcntggcgaccaactgccgctccagtcacataggtttcggcatccacccctgcaaagaggaataggaccaggatgactttggcccaattagcctgcggagacccagcatggcgtat

SEQ ID NO: 391637 - DNA, 140 bp, Artificial Sequence
  Synthetic
  misc_feature (108)..(108): n is a, c, g, or t
atacgccatgctgggtctccacagcttgaacaccgggttcttggctggcttgttctaccgctacaagtttaacagctcagggtgccccgaacggctcgcaagctgcangagccttgacagcgtacttgggagtcggccat

SEQ ID NO: 391638 - DNA, 140 bp, Artificial Sequence
  Synthetic
  misc_feature (33)..(33): n is a, c, g, or t
atggccgactcccaagtacgctgtcaaggctcntgcagcttgcgagccgttcggggcaccctgagctgttaaacttgtagcggtagaacaagccagccaagaacccggtgttcaagctgtggagacccagcatggcgtat

SEQ ID NO: 391639 - DNA, 140 bp, Artificial Sequence
  Synthetic
atacgccatgctgggtctccgtgtcggcatccattgtgtgtggtcccgtgtactgcttcactcccagccctgttgtggtgggaactactgatcgctccggggtccctacttacaactgggcgtacttgggagtcggccat

SEQ ID NO: 391640 - DNA, 140 bp, Artificial Sequence
  Synthetic
atggccgactcccaagtacgcccagttgtaagtagggaccccggagcgatcagtagttcccaccacaacagggctgggagtgaagcagtacacgggaccacacacaatggatgccgacacggagacccagcatggcgtat

SEQ ID NO: 391641 - DNA, 140 bp, Artificial Sequence
  Synthetic
atacgccatgctgggtctccctgtggcgctcctccatgtcaggttaccactaacaacacttggagttgccccaccgattgcttcaggaaacatccggagaccacctacgccaagtgcgggcgtacttgggagtcggccat

SEQ ID NO: 391642 - DNA, 140 bp, Artificial Sequence
  Synthetic
atggccgactcccaagtacgcccgcacttggcgtaggtggtctccggatgtttcctgaagcaatcggtggggcaactccaagtgttgttagtggtaacctgacatggaggagcgccacagggagacccagcatggcgtat

SEQ ID NO: 391643 - DNA, 140 bp, Artificial Sequence
  Synthetic
  misc_feature (70)..(70): n is a, c, g, or t
  misc_feature (83)..(83): n is a, c, g, or t
  misc_feature (97)..(97): n is a, c, g, or t
atacgccatgctgggtctccttgtcggcggcatagagcatcggatggacgcggcatgcaactggaccagnggagaagtctgtngcttggagcacagngatcgtgcggagttgtcacctctcgtacttgggagtcggccat

SEQ ID NO: 391644 - DNA, 140 bp, Artificial Sequence
  Synthetic
  misc_feature (44)..(44): n is a, c, g, or t
  misc_feature (58)..(58): n is a, c, g, or t
  misc_feature (71)..(71): n is a, c, g, or t
atggccgactcccaagtacgagaggtgacaactccgcacgatcnctgtgctccaagcnacagacttctccnctggtccagttgcatgccgcgtccatccgatgctctatgccgccgacaaggagacccagcatggcgtat

SEQ ID NO: 391645 - DNA, 140 bp, Artificial Sequence
  Synthetic
atacgccatgctgggtctccgtttgggagacggaaggactcatcctgcacacacccgggtgcgtgccctgcgtccgagagggtaacacttctcggtgctgggcgtcgctgacccccacaccgtacttgggagtcggccat

SEQ ID NO: 391646 - DNA, 140 bp, Artificial Sequence
  Synthetic
atggccgactcccaagtacggtgtgggggtcagcgacgcccagcaccgagaagtgttaccctctcggacgcagggcacgcacccgggtgtgtgcaggatgagtccttccgtctcccaaacggagacccagcatggcgtat

SEQ ID NO: 391647 - DNA, 140 bp, Artificial Sequence
  Synthetic
  misc_feature (62)..(62): n is a, c, g, or t
  misc_feature (80)..(80): n is a, c, g, or t
atacgccatgctgggtctccctggtatgctatcctcttcatctgcattgtctggtatgtcangggtcggctcccggctgncgctgcctatgcggcctgcgggatgtggcccctgcttctccgtacttgggagtcggccat

SEQ ID NO: 391648 - DNA, 140 bp, Artificial Sequence
  Synthetic
  misc_feature (61)..(61): n is a, c, g, or t
  misc_feature (79)..(79): n is a, c, g, or t
atggccgactcccaagtacggagaagcaggggccacatcccgcaggccgcataggcagcgncagccgggagccgacccntgacataccagacaatgcagatgaagaggatagcataccagggagacccagcatggcgtat

SEQ ID NO: 391649 - DNA, 140 bp, Artificial Sequence
  Synthetic
atacgccatgctgggtctccctccacactacaagtcatggctggctaggggactgtggtggattcaatattttatagctaggaccgaggctacgctgcatgtctacgttccatcctttgacgtacttgggagtcggccat

SEQ ID NO: 391650 - DNA, 140 bp, Artificial Sequence
  Synthetic
atggccgactcccaagtacgtcaaaggatggaacgtagacatgcagcgtagcctcggtcctagctataaaatattgaatccaccacagtcccctagccagccatgacttgtagtgtggagggagacccagcatggcgtat

SEQ ID NO: 391651 - DNA, 140 bp, Artificial Sequence
  Synthetic
atacgccatgctgggtctccctcatcaacaccaatggcagctggcacattaatcgcactgccttgaattgcaacgactccctcaacaccggattccttgctgcgctgttctatgccaacacgtacttgggagtcggccat

SEQ ID NO: 391652 - DNA, 140 bp, Artificial Sequence
  Synthetic
atggccgactcccaagtacgtgttggcatagaacagcgcagcaaggaatccggtgttgagggagtcgttgcaattcaaggcagtgcgattaatgtgccagctgccattggtgttgatgagggagacccagcatggcgtat

SEQ ID NO: 391653 - DNA, 140 bp, Artificial Sequence
  Synthetic
atacgccatgctgggtctcctggttttgcctactcctgcttgctgcaggggtaggcatctacctccttcccaaccgataaacctagtcacggctagctgtgaggtcatagctgtttcctgcgtacttgggagtcggccat

SEQ ID NO: 391654 - DNA, 140 bp, Artificial Sequence
  Synthetic
atggccgactcccaagtacgcaggaaacagctatgacctcacagctagccgtgactaggtttatcggttgggaaggaggtagatgcctacccctgcagcaagcaggagtaggcaaaaccaggagacccagcatggcgtat

SEQ ID NO: 391655 - DNA, 140 bp, Artificial Sequence
  Synthetic
  misc_feature (74)..(74): n is a, c, g, or t
  misc_feature (108)..(108): n is a, c, g, or t
  misc_feature (110)..(110): n is a, c, g, or t
atacgccatgctgggtctccatatatgaccaccttactcccctgtcagactgggccgccgtgggcctccgcganttggcggtggccctagagccagttgtgttcacgncnatggagaagacgtacttgggagtcggccat

SEQ ID NO: 391656 - DNA, 140 bp, Artificial Sequence
  Synthetic
  misc_feature (31)..(31): n is a, c, g, or t
  misc_feature (33)..(33): n is a, c, g, or t
  misc_feature (67)..(67): n is a, c, g, or t
atggccgactcccaagtacgtcttctccatngncgtgaacacaactggctctagggccaccgccaantcgcggaggcccacggcggcccagtctgacaggggagtaaggtggtcatatatggagacccagcatggcgtat

SEQ ID NO: 391657 - DNA, 140 bp, Artificial Sequence
  Synthetic
atacgccatgctgggtctccaggaccccgtgatcaaaggccttactgctggcactatgcacctcgaccatgtggaatcgtccccgcagaggaggtttgcggccctgtgtattgtttcacccgtacttgggagtcggccat

SEQ ID NO: 391658 - DNA, 140 bp, Artificial Sequence
  Synthetic
atggccgactcccaagtacgggtgaaacaatacacagggccgcaaacctcctctgcggggacgattccacatggtcgaggtgcatagtgccagcagtaaggcctttgatcacggggtcctggagacccagcatggcgtat

SEQ ID NO: 391659 - DNA, 140 bp, Artificial Sequence
  Synthetic
atacgccatgctgggtctccctaaccttttcatttatttaattacctaaattctatatccatatttctaaattatctaatatttccctataaatatttatatctatttcatactatatttcgtacttgggagtcggccat

SEQ ID NO: 391660 - DNA, 140 bp, Artificial Sequence
  Synthetic
atggccgactcccaagtacgaaatatagtatgaaatagatataaatatttatagggaaatattagataatttagaaatatggatatagaatttaggtaattaaataaatgaaaaggttagggagacccagcatggcgtat

SEQ ID NO: 391661 - DNA, 140 bp, Artificial Sequence
  Synthetic
aggccctggctgctgatatgattatctaatatttccctataaatatttatatctatttcatactatatttatctatagtgttagttaatgtggatcgctcgtgtgctagttaatttcccagaccttttgggacagcggtg

SEQ ID NO: 391662 - DNA, 140 bp, Artificial Sequence
  Synthetic
caccgctgtcccaaaaggtctgggaaattaactagcacacgagcgatccacattaactaacactatagataaatatagtatgaaatagatataaatatttatagggaaatattagataatcatatcagcagccagggcct

SEQ ID NO: 391663 - DNA, 140 bp, Artificial Sequence
  Synthetic
  misc_feature (24)..(24): n is a, c, g, or t
aggccctggctgctgatatgcgantcggaaacatcaaaggggtggagactccttgcccccatcacagcgtacgcgcagcagacccgcggcttgttcagcaccatcataacgagccttactgaccttttgggacagcggtg

SEQ ID NO: 391664 - DNA, 140 bp, Artificial Sequence
  Synthetic
  misc_feature (117)..(117): n is a, c, g, or t
caccgctgtcccaaaaggtcagtaaggctcgttatgatggtgctgaacaagccgcgggtctgctgcgcgtacgctgtgatgggggcaaggagtctccacccctttgatgtttccgantcgcatatcagcagccagggcct

SEQ ID NO: 391665 - DNA, 140 bp, Artificial Sequence
  Synthetic
  misc_feature (62)..(62): n is a, c, g, or t
atacgccatgctgggtctccctccggtggggaactggttcggctgtacctggatgaactccnctgggttcactaagacgtgcggcgggcccccctgcaacatcgggggtctcaacaagtccgtacttgggagtcggccat

SEQ ID NO: 391666 - DNA, 140 bp, Artificial Sequence
  Synthetic
  misc_feature (79)..(79): n is a, c, g, or t
atggccgactcccaagtacggacttgttgagacccccgatgttgcaggggggcccgccgcacgtcttagtgaacccagnggagttcatccaggtacagccgaaccagttccccaccggagggagacccagcatggcgtat

SEQ ID NO: 391667 - DNA, 140 bp, Artificial Sequence
  Synthetic
atacgccatgctgggtctccaccacggagcgggtagcaagaccatcagcggcccgaaaggacctgtcaatcagatgtacaccaatgttgatcaagacttggtggggtggccagccccctccgtacttgggagtcggccat

SEQ ID NO: 391668 - DNA, 140 bp, Artificial Sequence
  Synthetic
atggccgactcccaagtacggagggggctggccaccccaccaagtcttgatcaacattggtgtacatctgattgacaggtcctttcgggccgctgatggtcttgctacccgctccgtggtggagacccagcatggcgtat

SEQ ID NO: 391669 - DNA, 140 bp, Artificial Sequence
  Synthetic
atacgccatgctgggtctccccctacaggttgtggcactacccctgcaccgtcaactacaccaggttcaaggtccgcatgtacgtgggaggcgtcgagcacaggcttgaggccgcgtgcacgtacttgggagtcggccat

SEQ ID NO: 391670 - DNA, 140 bp, Artificial Sequence
  Synthetic
atggccgactcccaagtacgtgcacgcggcctcaagcctgtgctcgacgcctcccacgtacatgcggaccttgaacctggtgtagttgacggtgcaggggtagtgccacaacctgtagggggagacccagcatggcgtat

SEQ ID NO: 391671 - DNA, 140 bp, Artificial Sequence
  Synthetic
  misc_feature (89)..(89): n is a, c, g, or t
atacgccatgctgggtctccagaggagctctcttgagccctagaccaatatccactcttaaggggtcttctggtggtccgctgctgtgncccatgggacacgctgccggcatattccgtgcgtacttgggagtcggccat

SEQ ID NO: 391672 - DNA, 140 bp, Artificial Sequence
  Synthetic
  misc_feature (52)..(52): n is a, c, g, or t
atggccgactcccaagtacgcacggaatatgccggcagcgtgtcccatgggncacagcagcggaccaccagaagaccccttaagagtggatattggtctagggctcaagagagctcctctggagacccagcatggcgtat

SEQ ID NO: 391673 - DNA, 140 bp, Artificial Sequence
  Synthetic
atacgccatgctgggtctccctttaccaccctgccagccctatcaacaggtctgatccacctccatcagaacatcgtggacgtgcaatacttgtacggaatagggtccgcagttgtgtcccgtacttgggagtcggccat

SEQ ID NO: 391674 - DNA, 140 bp, Artificial Sequence
  Synthetic
atggccgactcccaagtacgggacacaactgcggaccctattccgtacaagtattgcacgtccacgatgttctgatggaggtggatcagacctgttgatagggctggcagggtggtaaagggagacccagcatggcgtat

SEQ ID NO: 391675 - DNA, 140 bp, Artificial Sequence
  Synthetic
  misc_feature (52)..(52): n is a, c, g, or t
atacgccatgctgggtctcccggcggtgtgcactcgaggggtggccaaagcngtggactttgtcccggttgagtcccttgagactaccatgagatcaccagtattcactgacaattcaaccgtacttgggagtcggccat

SEQ ID NO: 391676 - DNA, 140 bp, Artificial Sequence
  Synthetic
  misc_feature (89)..(89): n is a, c, g, or t
atggccgactcccaagtacggttgaattgtcagtgaatactggtgatctcatggtagtctcaagggactcaaccgggacaaagtccacngctttggccacccctcgagtgcacaccgccgggagacccagcatggcgtat

SEQ ID NO: 391677 - DNA, 140 bp, Artificial Sequence
  Synthetic
atacgccatgctgggtctccaagcggccttggagaaccttgtagtccttaatgccgcgtcccttgcagggacgcacgggcttctctctttccttgtgttcttctgtgccgcgtggtacatcgtacttgggagtcggccat

SEQ ID NO: 391678 - DNA, 140 bp, Artificial Sequence
  Synthetic
atggccgactcccaagtacgatgtaccacgcggcacagaagaacacaaggaaagagagaagcccgtgcgtccctgcaagggacgcggcattaaggactacaaggttctccaaggccgcttggagacccagcatggcgtat

SEQ ID NO: 391679 - DNA, 140 bp, Artificial Sequence
  Synthetic
atacgccatgctgggtctcccacgaagctgccgcgtcgtgtgggggcgctgtcctcgtctgcttgacagttctgaccttgtcaccgcattacaagtccatccttgttaagatcatgtggtcgtacttgggagtcggccat

SEQ ID NO: 391680 - DNA, 140 bp, Artificial Sequence
  Synthetic
atggccgactcccaagtacgaccacatgatcttaacaaggatggacttgtaatgcggtgacaaggtcagaactgtcaagcagacgaggacagcgcccccacacgacgcggcagcttcgtgggagacccagcatggcgtat

SEQ ID NO: 391681 - DNA, 140 bp, Artificial Sequence
  Synthetic
aggccctggctgctgatatgtcctggcgggcctcgcctactattccatggcggggaactgggctaaggtcttgattgtgatgctactctttgccggcgttgatggggagacccgcgtgtcgaccttttgggacagcggtg

SEQ ID NO: 391682 - DNA, 140 bp, Artificial Sequence
  Synthetic
caccgctgtcccaaaaggtcgacacgcgggtctccccatcaacgccggcaaagagtagcatcacaatcaagaccttagcccagttccccgccatggaatagtaggcgaggcccgccaggacatatcagcagccagggcct

SEQ ID NO: 391683 - DNA, 140 bp, Artificial Sequence
  Synthetic
atacgccatgctgggtctccactgtcccgcaagacgctgtggccagaagccaacggcgcggacgtacgggtagagggaaaccggggatatacaggtacgtctcgcaaggagaacggccgtcgtacttgggagtcggccat

SEQ ID NO: 391684 - DNA, 140 bp, Artificial Sequence
  Synthetic
atggccgactcccaagtacgacggccgttctccttgcgagacgtacctgtatatccccggtttccctctacccgtacgtccgcgccgttggcttctggccacagcgtcttgcgggacagtggagacccagcatggcgtat

SEQ ID NO: 391685 - DNA, 140 bp, Artificial Sequence
  Synthetic
  misc_feature (66)..(66): n is a, c, g, or t
  misc_feature (76)..(76): n is a, c, g, or t
atacgccatgctgggtctcccgccctgccgacagtgggggaagtccccttttacggcaaggcgatncccctagagntaatcaaggggggcagacatctcatcttctgccactcaaagaaacgtacttgggagtcggccat

SEQ ID NO: 391686 - DNA, 140 bp, Artificial Sequence
  Synthetic
  misc_feature (65)..(65): n is a, c, g, or t
  misc_feature (75)..(75): n is a, c, g, or t
atggccgactcccaagtacgtttctttgagtggcagaagatgagatgtctgccccccttgattanctctaggggnatcgccttgccgtaaaaggggacttcccccactgtcggcagggcgggagacccagcatggcgtat

SEQ ID NO: 391687 - DNA, 140 bp, Artificial Sequence
  Synthetic
atacgccatgctgggtctccattaataggactgccctgaattgcaacgactccctccagactgggttccttgccgcgctgttctatgtgaataggttcaacgcgtcgggatgcccagagccgtacttgggagtcggccat

SEQ ID NO: 391688 - DNA, 140 bp, Artificial Sequence
  Synthetic
atggccgactcccaagtacggctctgggcatcccgacgcgttgaacctattcacatagaacagcgcggcaaggaacccagtctggagggagtcgttgcaattcagggcagtcctattaatggagacccagcatggcgtat

SEQ ID NO: 391689 - DNA, 140 bp, Artificial Sequence
  Synthetic
atacgccatgctgggtctccccacgactggacttactagtctcttctcatcgggtgctagccagaacatccagctggtcaacaccaacggcagctggcatatcaataggacggccctgaacgtacttgggagtcggccat

SEQ ID NO: 391690 - DNA, 140 bp, Artificial Sequence
  Synthetic
atggccgactcccaagtacgttcagggccgtcctattgatatgccagctgccgttggtgttgaccagctggatgttctggctagcacccgatgagaagagactagtaagtccagtcgtggggagacccagcatggcgtat

SEQ ID NO: 391691 - DNA, 140 bp, Artificial Sequence
  Synthetic
atacgccatgctgggtctccccacatttggcttcgccagcattctcacccctggcgccaagcagaatatccagctgatcaacaccaacggcagttggcacatcaaccgcacggctttgaacgtacttgggagtcggccat

SEQ ID NO: 391692 - DNA, 140 bp, Artificial Sequence
  Synthetic
atggccgactcccaagtacgttcaaagccgtgcggttgatgtgccaactgccgttggtgttgatcagctggatattctgcttggcgccaggggtgagaatgctggcgaagccaaatgtggggagacccagcatggcgtat

SEQ ID NO: 391693 - DNA, 140 bp, Artificial Sequence
  Synthetic
atacgccatgctgggtctcccgggcacctatatatataaccatctcaccccgctgcgggattgggcccacaacggccttcgtgaccttgcaacggctgttgaacctgtcatattttccaacgtacttgggagtcggccat

SEQ ID NO: 391694 - DNA, 140 bp, Artificial Sequence
  Synthetic
atggccgactcccaagtacgttggaaaatatgacaggttcaacagccgttgcaaggtcacgaaggccgttgtgggcccaatcccgcagcggggtgagatggttatatatataggtgcccgggagacccagcatggcgtat

SEQ ID NO: 391695 - DNA, 140 bp, Artificial Sequence
  Synthetic
atacgccatgctgggtctccctcggtccggccgacgccatgactgacaagggctggaggcttcttgcgcccatcacagcttacgcgcaacaaacacgcggcctcttgggatgcattatcacgtacttgggagtcggccat

SEQ ID NO: 391696 - DNA, 140 bp, Artificial Sequence
  Synthetic
atggccgactcccaagtacgtgataatgcatcccaagaggccgcgtgtttgttgcgcgtaagctgtgatgggcgcaagaagcctccagcccttgtcagtcatggcgtcggccggaccgagggagacccagcatggcgtat

SEQ ID NO: 391697 - DNA, 140 bp, Artificial Sequence
  Synthetic
atacgccatgctgggtctccctggactgtctaccacggcgccggagcgaagtctctggctgggccgaaaggccccatcctccagatgtataccaatgtagaccaagacctcgtcggctggcgtacttgggagtcggccat

SEQ ID NO: 391698 - DNA, 140 bp, Artificial Sequence
  Synthetic
atggccgactcccaagtacgccagccgacgaggtcttggtctacattggtatacatctggaggatggggcctttcggcccagccagagacttcgctccggcgccgtggtagacagtccagggagacccagcatggcgtat

SEQ ID NO: 391699 - DNA, 140 bp, Artificial Sequence
  Synthetic
  misc_feature (49)..(49): n is a, c, g, or t
  misc_feature (58)..(58): n is a, c, g, or t
  misc_feature (64)..(64): n is a, c, g, or t
  misc_feature (67)..(67): n is a, c, g, or t
atacgccatgctgggtctccatttcccataccttgtagcttatcaagcnacggtgtgngccagngcnctggcgcctccaccaagctgggacactatgtggaagtgcctaatccgccttaacgtacttgggagtcggccat

SEQ ID NO: 391700 - DNA, 140 bp, Artificial Sequence
  Synthetic
  misc_feature (74)..(74): n is a, c, g, or t
  misc_feature (77)..(77): n is a, c, g, or t
  misc_feature (83)..(83): n is a, c, g, or t
  misc_feature (92)..(92): n is a, c, g, or t
atggccgactcccaagtacgttaaggcggattaggcacttccacatagtgtcccagcttggtggaggcgccagngcnctggcncacaccgtngcttgataagctacaaggtatgggaaatggagacccagcatggcgtat

SEQ ID NO: 391701 - DNA, 140 bp, Artificial Sequence
  Synthetic
atacgccatgctgggtctccggggcgacaccagggggagcctgctttccccccgtcccatctcatacttgaaaggctcttcggggggtccattgctctgccccgcgggacacgctgtaggcgtacttgggagtcggccat

SEQ ID NO: 391702 - DNA, 140 bp, Artificial Sequence
  Synthetic
atggccgactcccaagtacgcctacagcgtgtcccgcggggcagagcaatggaccccccgaagagcctttcaagtatgagatgggacggggggaaagcaggctccccctggtgtcgccccggagacccagcatggcgtat

SEQ ID NO: 391703 - DNA, 140 bp, Artificial Sequence
  Synthetic
  misc_feature (34)..(34): n is a, c, g, or t
  misc_feature (43)..(43): n is a, c, g, or t
  misc_feature (79)..(79): n is a, c, g, or t
  misc_feature (82)..(82): n is a, c, g, or t
  misc_feature (112)..(112): n is a, c, g, or t
atacgccatgctgggtctccttgtcgggagagtngtcctgtcnggccaacctgctgtcattcctgaccgcgaagtgctntancaacagttcgacgaaatggaagagtgttcnaagcacctcgtacttgggagtcggccat

SEQ ID NO: 391704 - DNA, 140 bp, Artificial Sequence
  Synthetic
  misc_feature (29)..(29): n is a, c, g, or t
  misc_feature (59)..(59): n is a, c, g, or t
  misc_feature (62)..(62): n is a, c, g, or t
  misc_feature (98)..(98): n is a, c, g, or t
  misc_feature (107)..(107): n is a, c, g, or t
atggccgactcccaagtacgaggtgcttngaacactcttccatttcgtcgaactgttgntanagcacttcgcggtcaggaatgacagcaggttggccngacaggacnactctcccgacaaggagacccagcatggcgtat

SEQ ID NO: 391705 - DNA, 140 bp, Artificial Sequence
  Synthetic
atacgccatgctgggtctccgacaattcaaccccaccagctgtgccccaaacattccaagttgcccacttgcacgccccgactgggagcggcaagagcaccaaggtgccggctgcttatgcgtacttgggagtcggccat

SEQ ID NO: 391706 - DNA, 140 bp, Artificial Sequence
  Synthetic
atggccgactcccaagtacgcataagcagccggcaccttggtgctcttgccgctcccagtcggggcgtgcaagtgggcaacttggaatgtttggggcacagctggtggggttgaattgtcggagacccagcatggcgtat

SEQ ID NO: 391707 - DNA, 140 bp, Artificial Sequence
  Synthetic
  misc_feature (26)..(26): n is a, c, g, or t
  misc_feature (92)..(92): n is a, c, g, or t
  misc_feature (116)..(116): n is a, c, g, or t
  misc_feature (119)..(119): n is a, c, g, or t
aggccctggctgctgatatggtgatncagtccaacttcgccaaacttgaacagttctgggcgaaacacatgtggaatttcatcagcggcatncaatatctcgctggactatccacnttncgaccttttgggacagcggtg

SEQ ID NO: 391708 - DNA, 140 bp, Artificial Sequence
  Synthetic
  misc_feature (22)..(22): n is a, c, g, or t
  misc_feature (25)..(25): n is a, c, g, or t
  misc_feature (49)..(49): n is a, c, g, or t
  misc_feature (115)..(115): n is a, c, g, or t
caccgctgtcccaaaaggtcgnaangtggatagtccagcgagatattgnatgccgctgatgaaattccacatgtgtttcgcccagaactgttcaagtttggcgaagttggactgnatcaccatatcagcagccagggcct

SEQ ID NO: 391709 - DNA, 140 bp, Artificial Sequence
  Synthetic
  misc_feature (111)..(111): n is a, c, g, or t
atacgccatgctgggtctccaagaacaggggtcagaaccatcaccacaggcagtcctatcacatattccacctatggcaagttcctcgccgatggcggctgctcgggaggngcttatgatcgtacttgggagtcggccat

SEQ ID NO: 391710 - DNA, 140 bp, Artificial Sequence
  Synthetic
  misc_feature (30)..(30): n is a, c, g, or t
atggccgactcccaagtacgatcataagcncctcccgagcagccgccatcggcgaggaacttgccataggtggaatatgtgataggactgcctgtggtgatggttctgacccctgttcttggagacccagcatggcgtat

SEQ ID NO: 391711 - DNA, 140 bp, Artificial Sequence
  Synthetic
  misc_feature (24)..(24): n is a, c, g, or t
  misc_feature (39)..(39): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (67)..(67): n is a, c, g, or t
  misc_feature (69)..(69): n is a, c, g, or t
  misc_feature (75)..(75): n is a, c, g, or t
  misc_feature (90)..(90): n is a, c, g, or t
  misc_feature (96)..(96): n is a, c, g, or t
  misc_feature (99)..(99): n is a, c, g, or t
atacgccatgctgggtctccggtngcctcgcagattgcnactccgacggcntctacngcntttgtcntnagcggnctggcgggggcggcngttggnagngtgggcctcggcaagattttgcgtacttgggagtcggccat

SEQ ID NO: 391712 - DNA, 140 bp, Artificial Sequence
  Synthetic
  misc_feature (42)..(42): n is a, c, g, or t
  misc_feature (45)..(45): n is a, c, g, or t
  misc_feature (51)..(51): n is a, c, g, or t
  misc_feature (66)..(66): n is a, c, g, or t
  misc_feature (72)..(72): n is a, c, g, or t
  misc_feature (74)..(74): n is a, c, g, or t
  misc_feature (81)..(81): n is a, c, g, or t
  misc_feature (84)..(84): n is a, c, g, or t
  misc_feature (90)..(90): n is a, c, g, or t
  misc_feature (102)..(102): n is a, c, g, or t
  misc_feature (117)..(117): n is a, c, g, or t
atggccgactcccaagtacgcaaaatcttgccgaggcccacnctnccaacngccgcccccgccagnccgctnangacaaangcngtagangccgtcggagtngcaatctgcgaggcnaccggagacccagcatggcgtat

SEQ ID NO: 391713 - DNA, 140 bp, Artificial Sequence
  Synthetic
atacgccatgctgggtctcctgctcgccaccgctacgcctccgggttcagtcaccgtaccacaccccaatattgaggaagttgcgctgtccaacattggagagatccccttctacggcaacgtacttgggagtcggccat

SEQ ID NO: 391714 - DNA, 140 bp, Artificial Sequence
  Synthetic
atggccgactcccaagtacgttgccgtagaaggggatctctccaatgttggacagcgcaacttcctcaatattggggtgtggtacggtgactgaacccggaggcgtagcggtggcgagcaggagacccagcatggcgtat

SEQ ID NO: 391715 - DNA, 140 bp, Artificial Sequence
  Synthetic
aggccctggctgctgatatgcaccaaaatcttgctcgccatactcggtccgctcatggtgctccaggctggcataactaaggtgccgtacttcgtgcgcgcacacgggctcattcgtgcagaccttttgggacagcggtg

SEQ ID NO: 391716 - DNA, 140 bp, Artificial Sequence
  Synthetic
caccgctgtcccaaaaggtctgcacgaatgagcccgtgtgcgcgcacgaagtacggcaccttagttatgccagcctggagcaccatgagcggaccgagtatggcgagcaagattttggtgcatatcagcagccagggcct

SEQ ID NO: 391717 - DNA, 140 bp, Artificial Sequence
  Synthetic
  misc_feature (57)..(57): n is a, c, g, or t
  misc_feature (78)..(78): n is a, c, g, or t
  misc_feature (93)..(93): n is a, c, g, or t
  misc_feature (114)..(114): n is a, c, g, or t
  misc_feature (117)..(117): n is a, c, g, or t
  misc_feature (120)..(120): n is a, c, g, or t
atacgccatgctgggtctcctttcaagatcatgagcggcgagatgccatccacagangacttggtaaacttgctcccngccattctatcgccnggagcactagtagtgggggtngtntgncgtacttgggagtcggccat

SEQ ID NO: 391718 - DNA, 140 bp, Artificial Sequence
  Synthetic
  misc_feature (21)..(21): n is a, c, g, or t
  misc_feature (24)..(24): n is a, c, g, or t
  misc_feature (27)..(27): n is a, c, g, or t
  misc_feature (48)..(48): n is a, c, g, or t
  misc_feature (63)..(63): n is a, c, g, or t
  misc_feature (84)..(84): n is a, c, g, or t
atggccgactcccaagtacgncanacnacccccactactagtgctccnggcgatagaatggcngggagcaagtttaccaagtcntctgtggatggcatctcgccgctcatgatcttgaaaggagacccagcatggcgtat

SEQ ID NO: 391719 - DNA, 140 bp, Artificial Sequence
  Synthetic
atacgccatgctgggtctcccttaatgctgtagcatactaccgcggcctcgacgtctccgtcattccactcagtggggacgtcgttgtcgtatcaactgatgccctaatgacgggcttcacgtacttgggagtcggccat

SEQ ID NO: 391720 - DNA, 140 bp, Artificial Sequence
  Synthetic
atggccgactcccaagtacgtgaagcccgtcattagggcatcagttgatacgacaacgacgtccccactgagtggaatgacggagacgtcgaggccgcggtagtatgctacagcattaagggagacccagcatggcgtat

SEQ ID NO: 391721 - DNA, 140 bp, Artificial Sequence
  Synthetic
atacgccatgctgggtctccccaagacgcggtgtcacgcagccagcggcggggtaggactggtcggggccggcttggcatatacaggtttgtaacaccaggggaacggccgtccggcatgcgtacttgggagtcggccat

SEQ ID NO: 391722 - DNA, 140 bp, Artificial Sequence
  Synthetic
atggccgactcccaagtacgcatgccggacggccgttcccctggtgttacaaacctgtatatgccaagccggccccgaccagtcctaccccgccgctggctgcgtgacaccgcgtcttggggagacccagcatggcgtat

SEQ ID NO: 391723 - DNA, 140 bp, Artificial Sequence
  Synthetic
aggccctggctgctgatatgggcttggcatatacaggtttgtaacaccaggggaacggccgtccggcatgtttgactcctcggtcctatgtgagtgctatgacgcgggttgtgcttggtagaccttttgggacagcggtg

SEQ ID NO: 391724 - DNA, 140 bp, Artificial Sequence
  Synthetic
caccgctgtcccaaaaggtctaccaagcacaacccgcgtcatagcactcacataggaccgaggagtcaaacatgccggacggccgttcccctggtgttacaaacctgtatatgccaagcccatatcagcagccagggcct

SEQ ID NO: 391725 - DNA, 140 bp, Artificial Sequence
  Synthetic
atacgccatgctgggtctcccaggggagagtggcgtggagatggcgtgatgcacaccacatgcccctgcggagcagagctagcaggccacatcaagaacggctcaatgagaatcactgggcgtacttgggagtcggccat

SEQ ID NO: 391726 - DNA, 140 bp, Artificial Sequence
  Synthetic
atggccgactcccaagtacgcccagtgattctcattgagccgttcttgatgtggcctgctagctctgctccgcaggggcatgtggtgtgcatcacgccatctccacgccactctcccctgggagacccagcatggcgtat

SEQ ID NO: 391727 - DNA, 140 bp, Artificial Sequence
  Synthetic
atacgccatgctgggtctcctcttggtctaccgtgagcagtgatggtggcacggaagacgttgtgtgctgctcgatgtcttactcgtggacgggcgctttaatcacgccctgtgcctcagcgtacttgggagtcggccat

SEQ ID NO: 391728 - DNA, 140 bp, Artificial Sequence
  Synthetic
atggccgactcccaagtacgctgaggcacagggcgtgattaaagcgcccgtccacgagtaagacatcgagcagcacacaacgtcttccgtgccaccatcactgctcacggtagaccaagaggagacccagcatggcgtat

SEQ ID NO: 391729 - DNA, 140 bp, Artificial Sequence
  Synthetic
aggccctggctgctgatatgttcacaggcctcacccacatagatgcccactttctgtcccagaccaagcaggcgggggataatttcccctacctggtggcgtaccaggctactgtgtgcggaccttttgggacagcggtg

SEQ ID NO: 391730 - DNA, 140 bp, Artificial Sequence
  Synthetic
caccgctgtcccaaaaggtccgcacacagtagcctggtacgccaccaggtaggggaaattatcccccgcctgcttggtctgggacagaaagtgggcatctatgtgggtgaggcctgtgaacatatcagcagccagggcct

SEQ ID NO: 391731 - DNA, 140 bp, Artificial Sequence
  Synthetic
aggccctggctgctgatatgaccaggacctcgtcggctggcaagcgccccccggggcgcgttccctgacaccatgcacctgcggcagctcggacctttacttggtcacgaggcatgctgagaccttttgggacagcggtg

SEQ ID NO: 391732 - DNA, 140 bp, Artificial Sequence
  Synthetic
caccgctgtcccaaaaggtctcagcatgcctcgtgaccaagtaaaggtccgagctgccgcaggtgcatggtgtcagggaacgcgccccggggggcgcttgccagccgacgaggtcctggtcatatcagcagccagggcct

SEQ ID NO: 391733 - DNA, 140 bp, Artificial Sequence
  Synthetic
  misc_feature (34)..(34): n is a, c, g, or t
  misc_feature (40)..(40): n is a, c, g, or t
  misc_feature (55)..(55): n is a, c, g, or t
  misc_feature (61)..(61): n is a, c, g, or t
  misc_feature (78)..(78): n is a, c, g, or t
atacgccatgctgggtctcctttggagggtgtcngccgangagtacgtagaagtncgcagngtgggtgatttccattntgtcaccggggtaacacaagacaacatcaagtgtccctgccacgtacttgggagtcggccat

SEQ ID NO: 391734 - DNA, 140 bp, Artificial Sequence
  Synthetic
  misc_feature (63)..(63): n is a, c, g, or t
  misc_feature (80)..(80): n is a, c, g, or t
  misc_feature (86)..(86): n is a, c, g, or t
  misc_feature (101)..(101): n is a, c, g, or t
  misc_feature (107)..(107): n is a, c, g, or t
atggccgactcccaagtacgtggcagggacacttgatgttgtcttgtgttaccccggtgacanaatggaaatcacccacnctgcgnacttctacgtactcntcggcngacaccctccaaaggagacccagcatggcgtat

SEQ ID NO: 391735 - DNA, 140 bp, Artificial Sequence
  Synthetic
atacgccatgctgggtctcctgtcattccggtgcgccggcggggtgacggcagggggagcctactctcccccaggcctgtctcctatttaaagggctcctcgggtggtccactgctctgccgtacttgggagtcggccat

SEQ ID NO: 391736 - DNA, 140 bp, Artificial Sequence
  Synthetic
atggccgactcccaagtacggcagagcagtggaccacccgaggagccctttaaataggagacaggcctgggggagagtaggctccccctgccgtcaccccgccggcgcaccggaatgacaggagacccagcatggcgtat

SEQ ID NO: 391737 - DNA, 140 bp, Artificial Sequence
  Synthetic
atacgccatgctgggtctccgggtagcgtccaaaatgaagtcacactgacgcaccccatcaccaaatacatcatggcctgcatgtcagcagacttggaggtcgtcaccagcacctgggtgcgtacttgggagtcggccat

SEQ ID NO: 391738 - DNA, 140 bp, Artificial Sequence
  Synthetic
atggccgactcccaagtacgcacccaggtgctggtgacgacctccaagtctgctgacatgcaggccatgatgtatttggtgatggggtgcgtcagtgtgacttcattttggacgctacccggagacccagcatggcgtat

SEQ ID NO: 391739 - DNA, 140 bp, Artificial Sequence
  Synthetic
  misc_feature (87)..(87): n is a, c, g, or t
aggccctggctgctgatatggccggacgtggccgtgctaacatccatgttgacagacccatcacacataacggcggaggcggcgggncggagactggcccgagggtcaccaccctcgttagaccttttgggacagcggtg

SEQ ID NO: 391740 - DNA, 140 bp, Artificial Sequence
  Synthetic
  misc_feature (54)..(54): n is a, c, g, or t
caccgctgtcccaaaaggtctaacgagggtggtgaccctcgggccagtctccgncccgccgcctccgccgttatgtgtgatgggtctgtcaacatggatgttagcacggccacgtccggccatatcagcagccagggcct

SEQ ID NO: 391741 - DNA, 140 bp, Artificial Sequence
  Synthetic
atacgccatgctgggtctcctaccagacagagaagtcctctataaggagtttgatgaaatggaggagtgtgcatcacaccttccatacatcgaacaggggatgcagcttgcggaacagttcgtacttgggagtcggccat

SEQ ID NO: 391742 - DNA, 140 bp, Artificial Sequence
  Synthetic
atggccgactcccaagtacgaactgttccgcaagctgcatcccctgttcgatgtatggaaggtgtgatgcacactcctccatttcatcaaactccttatagaggacttctctgtctggtaggagacccagcatggcgtat

SEQ ID NO: 391743 - DNA, 140 bp, Artificial Sequence
  Synthetic
aggccctggctgctgatatgtgtgggggtctgccgctaccagggtcgagacggacgagaaggtgataatattggactcttttgagccatgtgtggctgaaccaggtgatgacagagaggtgaccttttgggacagcggtg

SEQ ID NO: 391744 - DNA, 140 bp, Artificial Sequence
  Synthetic
caccgctgtcccaaaaggtcacctctctgtcatcacctggttcagccacacatggctcaaaagagtccaatattatcaccttctcgtccgtctcgaccctggtagcggcagacccccacacatatcagcagccagggcct

SEQ ID NO: 391745 - DNA, 140 bp, Artificial Sequence
  Synthetic
atacgccatgctgggtctccgcaaagcacatgtggaacttcattagtggcatccaatacctggcaggactgtcgacgctgccggggaacccggcaatagcgtccctgatggcttttacagcgtacttgggagtcggccat

SEQ ID NO: 391746 - DNA, 140 bp, Artificial Sequence
  Synthetic
atggccgactcccaagtacgctgtaaaagccatcagggacgctattgccgggttccccggcagcgtcgacagtcctgccaggtattggatgccactaatgaagttccacatgtgctttgcggagacccagcatggcgtat

SEQ ID NO: 391747 - DNA, 140 bp, Artificial Sequence
  Synthetic
  misc_feature (98)..(98): n is a, c, g, or t
atacgccatgctgggtctccaagcaacaggactataagcctccgaccgttcatgggtgcgctttgcctcccagcaagcaaacccccgttcctcctccnaggaggaagcggacggtccagccgtacttgggagtcggccat

SEQ ID NO: 391748 - DNA, 140 bp, Artificial Sequence
  Synthetic
  misc_feature (43)..(43): n is a, c, g, or t
atggccgactcccaagtacggctggaccgtccgcttcctcctnggaggaggaacgggggtttgcttgctgggaggcaaagcgcacccatgaacggtcggaggcttatagtcctgttgcttggagacccagcatggcgtat

SEQ ID NO: 391749 - DNA, 140 bp, Artificial Sequence
  Synthetic
atacgccatgctgggtctcccttcgtgggctctggcatagtaggcgcagccgtcggcagtgtggggattgggaaggtgctcgtcgacatcttggccggttacggcgcaggtgtggcaggccgtacttgggagtcggccat

SEQ ID NO: 391750 - DNA, 140 bp, Artificial Sequence
  Synthetic
atggccgactcccaagtacggcctgccacacctgcgccgtaaccggccaagatgtcgacgagcaccttcccaatccccacactgccgacggctgcgcctactatgccagagcccacgaagggagacccagcatggcgtat

SEQ ID NO: 391751 - DNA, 140 bp, Artificial Sequence
  Synthetic
  misc_feature (106)..(106): n is a, c, g, or t
atacgccatgctgggtctccgcatcgtatgcgctgcaatactacgccggcacgtgggcccgggggagggagcggtgcagtggatgaacaggctgatagcgttcgcntcccgggggaaccacgtacttgggagtcggccat

SEQ ID NO: 391752 - DNA, 140 bp, Artificial Sequence
  Synthetic
  misc_feature (35)..(35): n is a, c, g, or t
atggccgactcccaagtacgtggttcccccgggangcgaacgctatcagcctgttcatccactgcaccgctccctcccccgggcccacgtgccggcgtagtattgcagcgcatacgatgcggagacccagcatggcgtat

SEQ ID NO: 391753 - DNA, 140 bp, Artificial Sequence
  Synthetic
  misc_feature (62)..(62): n is a, c, g, or t
  misc_feature (96)..(96): n is a, c, g, or t
  misc_feature (101)..(101): n is a, c, g, or t
  misc_feature (107)..(107): n is a, c, g, or t
  misc_feature (110)..(110): n is a, c, g, or t
  misc_feature (114)..(114): n is a, c, g, or t
  misc_feature (116)..(116): n is a, c, g, or t
atacgccatgctgggtctcccgccatcacaacatggtgtatgccacgaccacccgttctgcngtaactcggcagaaaaaggtgacctttgaccgcntacangtgttnganaacnantacccgtacttgggagtcggccat

SEQ ID NO: 391754 - DNA, 140 bp, Artificial Sequence
  Synthetic
  misc_feature (25)..(25): n is a, c, g, or t
  misc_feature (27)..(27): n is a, c, g, or t
  misc_feature (31)..(31): n is a, c, g, or t
  misc_feature (34)..(34): n is a, c, g, or t
  misc_feature (40)..(40): n is a, c, g, or t
  misc_feature (45)..(45): n is a, c, g, or t
  misc_feature (79)..(79): n is a, c, g, or t
atggccgactcccaagtacgggtantngttntcnaacacntgtangcggtcaaaggtcacctttttctgccgagttacngcagaacgggtggtcgtggcatacaccatgttgtgatggcgggagacccagcatggcgtat

SEQ ID NO: 391755 - DNA, 140 bp, Artificial Sequence
  Synthetic
atacgccatgctgggtctccgtgcccgtgtggggctgaaatatccggacatgttaagaacggatccatgcggatcgtcggtccgagagcttgcagcaacacgtggcacggaacattcccccgtacttgggagtcggccat

SEQ ID NO: 391756 - DNA, 140 bp, Artificial Sequence
  Synthetic
atggccgactcccaagtacgggggaatgttccgtgccacgtgttgctgcaagctctcggaccgacgatccgcatggatccgttcttaacatgtccggatatttcagccccacacgggcacggagacccagcatggcgtat

SEQ ID NO: 391757 - DNA, 140 bp, Artificial Sequence
  Synthetic
aggccctggctgctgatatgttggcgggacaactattcaccttccagccccgccgtcattggaccgtgcaggaatgcaactgctccatttatacaggccacgttaccggccacaggatgggaccttttgggacagcggtg

SEQ ID NO: 391758 - DNA, 140 bp, Artificial Sequence
  Synthetic
caccgctgtcccaaaaggtcccatcctgtggccggtaacgtggcctgtataaatggagcagttgcattcctgcacggtccaatgacggcggggctggaaggtgaatagttgtcccgccaacatatcagcagccagggcct

SEQ ID NO: 391759 - DNA, 140 bp, Artificial Sequence
  Synthetic
  misc_feature (26)..(26): n is a, c, g, or t
aggccctggctgctgatatgtcgggnttcgggtttgcgagaagagagcacttcacgacgtcatcaaccaactacctgaggccgtgatgggagccgcttacggcttccagtactccccagcgaccttttgggacagcggtg

SEQ ID NO: 391760 - DNA, 140 bp, Artificial Sequence
  Synthetic
  misc_feature (115)..(115): n is a, c, g, or t
caccgctgtcccaaaaggtcgctggggagtactggaagccgtaagcggctcccatcacggcctcaggtagttggttgatgacgtcgtgaagtgctctcttctcgcaaacccgaancccgacatatcagcagccagggcct

SEQ ID NO: 391761 - DNA, 140 bp, Artificial Sequence
  Synthetic
atacgccatgctgggtctcctgcgagcccgaaccagacgtggcggtgctaacgtccatgctcaccgacccctcacacatcacagctgagtcggctaaacggaggctggacagggggtccccgtacttgggagtcggccat

SEQ ID NO: 391762 - DNA, 140 bp, Artificial Sequence
  Synthetic
atggccgactcccaagtacggggaccccctgtccagcctccgtttagccgactcagctgtgatgtgtgaggggtcggtgagcatggacgttagcaccgccacgtctggttcgggctcgcaggagacccagcatggcgtat

SEQ ID NO: 391763 - DNA, 140 bp, Artificial Sequence
  Synthetic
  misc_feature (75)..(75): n is a, c, g, or t
atacgccatgctgggtctccagtggcgtctacaccaccagcttcggaaacacactaacgtgctatctcaaagctncagccgctattaaagcggcggggctgagagactgcactatgctggcgtacttgggagtcggccat

SEQ ID NO: 391764 - DNA, 140 bp, Artificial Sequence
  Synthetic
  misc_feature (66)..(66): n is a, c, g, or t
atggccgactcccaagtacgccagcatagtgcagtctctcagccccgccgctttaatagcggctgnagctttgagatagcacgttagtgtgtttccgaagctggtggtgtagacgccactggagacccagcatggcgtat

SEQ ID NO: 391765 - DNA, 140 bp, Artificial Sequence
  Synthetic
atacgccatgctgggtctccggccaatctcttgtggagacaggagatgggcgcaaacatcacccgcgtagagtcggagaacaaggtggtcatcttagactcctttgaaccgctcaaagcacgtacttgggagtcggccat

SEQ ID NO: 391766 - DNA, 140 bp, Artificial Sequence
  Synthetic
atggccgactcccaagtacgtgctttgagcggttcaaaggagtctaagatgaccaccttgttctccgactctacgcgggtgatgtttgcgcccatctcctgtctccacaagagattggccggagacccagcatggcgtat

SEQ ID NO: 391767 - DNA, 140 bp, Artificial Sequence
  Synthetic
atacgccatgctgggtctcccgcccctgctggagccgtggaagagaccagactacgaccctcccaaagtgcacgggtgccccctaccacctgcggggctccctccagtgccgcctcctcgcgtacttgggagtcggccat

SEQ ID NO: 391768 - DNA, 140 bp, Artificial Sequence
  Synthetic
atggccgactcccaagtacgcgaggaggcggcactggagggagccccgcaggtggtagggggcacccgtgcactttgggagggtcgtagtctggtctcttccacggctccagcaggggcgggagacccagcatggcgtat

SEQ ID NO: 391769 - DNA, 140 bp, Artificial Sequence
  Synthetic
  misc_feature (47)..(47): n is a, c, g, or t
atacgccatgctgggtctccagcggcgtgacgactgccccatcgggnccaacctccaacgacggtgactcggggtcggaagctgaatcatactcctccatgccccccctcgagggggagccgtacttgggagtcggccat

SEQ ID NO: 391770 - DNA, 140 bp, Artificial Sequence
  Synthetic
  misc_feature (94)..(94): n is a, c, g, or t
atggccgactcccaagtacggctccccctcgagggggggcatggaggagtatgattcagcttccgaccccgagtcaccgtcgttggaggttggncccgatggggcagtcgtcacgccgctggagacccagcatggcgtat

SEQ ID NO: 391771 - DNA, 140 bp, Artificial Sequence
  Synthetic
atacgccatgctgggtctcccctgattacaccgtgtgcagccgaggaaaccaagttgcccatcaatgcgttaagcaactcactgctgcgccaccacaacatggtgtacgccactacctcgcgtacttgggagtcggccat

SEQ ID NO: 391772 - DNA, 140 bp, Artificial Sequence
  Synthetic
atggccgactcccaagtacgcgaggtagtggcgtacaccatgttgtggtggcgcagcagtgagttgcttaacgcattgatgggcaacttggtttcctcggctgcacacggtgtaatcaggggagacccagcatggcgtat

SEQ ID NO: 391773 - DNA, 140 bp, Artificial Sequence
  Synthetic
  misc_feature (48)..(48): n is a, c, g, or t
  misc_feature (120)..(120): n is a, c, g, or t
atacgccatgctgggtctcctcagtcacgttgttgggtggccctcacncctaccgtcgccgcgccatacatcggcgcgccacttgagtctctacggagtcatgtggatttgatggtgggncgtacttgggagtcggccat

SEQ ID NO: 391774 - DNA, 140 bp, Artificial Sequence
  Synthetic
  misc_feature (21)..(21): n is a, c, g, or t
  misc_feature (93)..(93): n is a, c, g, or t
atggccgactcccaagtacgncccaccatcaaatccacatgactccgtagagactcaagtggcgcgccgatgtatggcgcggcgacggtaggngtgagggccacccaacaacgtgactgaggagacccagcatggcgtat

SEQ ID NO: 391775 - DNA, 140 bp, Artificial Sequence
  Synthetic
atacgccatgctgggtctccccacagtgaaggcggaactgctatccgtagaggaagcgtgccgcctgacgcccccacactcggccaagtccaaatttggctatggggcaaaggacgtccgcgtacttgggagtcggccat

SEQ ID NO: 391776 - DNA, 140 bp, Artificial Sequence
  Synthetic
atggccgactcccaagtacgcggacgtcctttgccccatagccaaatttggacttggccgagtgtgggggcgtcaggcggcacgcttcctctacggatagcagttccgccttcactgtggggagacccagcatggcgtat

SEQ ID NO: 391777 - DNA, 140 bp, Artificial Sequence
  Synthetic
atacgccatgctgggtctccgaggttttctgtgtccaaccagagaaggggggccggaagccagctcgccttatcgtgtaccccgatctgggagtgcgcgtgtgcgagaagatggctctgtcgtacttgggagtcggccat

SEQ ID NO: 391778 - DNA, 140 bp, Artificial Sequence
  Synthetic
atggccgactcccaagtacgacagagccatcttctcgcacacgcgcactcccagatcggggtacacgataaggcgagctggcttccggccccccttctctggttggacacagaaaacctcggagacccagcatggcgtat

SEQ ID NO: 391779 - DNA, 140 bp, Artificial Sequence
  Synthetic
aggccctggctgctgatatgtcttctgtgctgcctggtacatcaagggcaagctggtccctggggcggcatatgctttctatggcgtatggccgctgctcctgctcctgctggcgttaccgaccttttgggacagcggtg

SEQ ID NO: 391780 - DNA, 140 bp, Artificial Sequence
  Synthetic
caccgctgtcccaaaaggtcggtaacgccagcaggagcaggagcagcggccatacgccatagaaagcatatgccgccccagggaccagcttgcccttgatgtaccaggcagcacagaagacatatcagcagccagggcct

SEQ ID NO: 391781 - DNA, 140 bp, Artificial Sequence
  Synthetic
atacgccatgctgggtctccgtctaagaagaaccctatggggttctcgtatgacacccgctgcttcgactccacggtcaccgaacatgacatccgagtcgaggaatccatttaccaatgccgtacttgggagtcggccat

SEQ ID NO: 391782 - DNA, 140 bp, Artificial Sequence
  Synthetic
atggccgactcccaagtacggcattggtaaatggattcctcgactcggatgtcatgttcggtgaccgtggagtcgaagcagcgggtgtcatacgagaaccccatagggttcttcttagacggagacccagcatggcgtat

SEQ ID NO: 391783 - DNA, 140 bp, Artificial Sequence
  Synthetic
  misc_feature (24)..(24): n is a, c, g, or t
  misc_feature (48)..(48): n is a, c, g, or t
  misc_feature (96)..(96): n is a, c, g, or t
  misc_feature (105)..(105): n is a, c, g, or t
atacgccatgctgggtctcctgcnacagggaatcttcccggttgctcnttctctatcttcctcttggcacttctctcgtgcttgactgtcccagcntcagccatnaactaccgcaatgctcgtacttgggagtcggccat

SEQ ID NO: 391784 - DNA, 140 bp, Artificial Sequence
  Synthetic
  misc_feature (36)..(36): n is a, c, g, or t
  misc_feature (45)..(45): n is a, c, g, or t
  misc_feature (93)..(93): n is a, c, g, or t
  misc_feature (117)..(117): n is a, c, g, or t
atggccgactcccaagtacgagcattgcggtagttnatggctgangctgggacagtcaagcacgagagaagtgccaagaggaagatagagaangagcaaccgggaagattccctgtngcaggagacccagcatggcgtat

SEQ ID NO: 391785 - DNA, 140 bp, Artificial Sequence
  Synthetic
  misc_feature (46)..(46): n is a, c, g, or t
  misc_feature (55)..(55): n is a, c, g, or t
  misc_feature (89)..(89): n is a, c, g, or t
aggccctggctgctgatatgttctctcgtgcttgactgtcccagcntcagccatnaactaccgcaatgcttcgggcatctaccatatcnccaatgactgcccgaattcgagcatagtgtagaccttttgggacagcggtg

SEQ ID NO: 391786 - DNA, 140 bp, Artificial Sequence
  Synthetic
  misc_feature (52)..(52): n is a, c, g, or t
  misc_feature (86)..(86): n is a, c, g, or t
  misc_feature (95)..(95): n is a, c, g, or t
caccgctgtcccaaaaggtctacactatgctcgaattcgggcagtcattggngatatggtagatgcccgaagcattgcggtagttnatggctgangctgggacagtcaagcacgagagaacatatcagcagccagggcct

SEQ ID NO: 391787 - DNA, 140 bp, Artificial Sequence
  Synthetic
  misc_feature (49)..(49): n is a, c, g, or t
atacgccatgctgggtctccatcgcaggtgccgcgcaagcggcgtcctnaccaccagctgtggcaataccctgacatgttacttgaaagccagcgcagcctgtcgagctgcaaagctccacgtacttgggagtcggccat

SEQ ID NO: 391788 - DNA, 140 bp, Artificial Sequence
  Synthetic
  misc_feature (92)..(92): n is a, c, g, or t
atggccgactcccaagtacgtggagctttgcagctcgacaggctgcgctggctttcaagtaacatgtcagggtattgccacagctggtggtnaggacgccgcttgcgcggcacctgcgatggagacccagcatggcgtat

SEQ ID NO: 391789 - DNA, 140 bp, Artificial Sequence
  Synthetic
  misc_feature (47)..(47): n is a, c, g, or t
atacgccatgctgggtctccatgaccaggtattccgccccacccggngacccgccgcagccagaatacgacttggagctaataacatcttgctcttccaacgtatcagtcgctcacgatgcgtacttgggagtcggccat

SEQ ID NO: 391790 - DNA, 140 bp, Artificial Sequence
  Synthetic
  misc_feature (94)..(94): n is a, c, g, or t
atggccgactcccaagtacgcatcgtgagcgactgatacgttggaagagcaagatgttattagctccaagtcgtattctggctgcggcgggtcnccgggtggggcggaatacctggtcatggagacccagcatggcgtat

SEQ ID NO: 391791 - DNA, 140 bp, Artificial Sequence
  Synthetic
aggccctggctgctgatatggaggaggatgaacgggaggtctccgtggccgcagaaatcctgcggaagtctcggagattcaccccggccctgcccatttgggcacggccggactacaaccgaccttttgggacagcggtg

SEQ ID NO: 391792 - DNA, 140 bp, Artificial Sequence
  Synthetic
caccgctgtcccaaaaggtcggttgtagtccggccgtgcccaaatgggcagggccggggtgaatctccgagacttccgcaggatttctgcggccacggagacctcccgttcatcctcctccatatcagcagccagggcct

SEQ ID NO: 391793 - DNA, 140 bp, Artificial Sequence
  Synthetic
atacgccatgctgggtctccgcaagccaattgggccaaagtcatcctagtcttattcctctttgcaggggttgacgctgagacttacacatctgggggtgcggccgcccaaactacccgtcgtacttgggagtcggccat

SEQ ID NO: 391794 - DNA, 140 bp, Artificial Sequence
  Synthetic
atggccgactcccaagtacgacgggtagtttgggcggccgcacccccagatgtgtaagtctcagcgtcaacccctgcaaagaggaataagactaggatgactttggcccaattggcttgcggagacccagcatggcgtat

SEQ ID NO: 391795 - DNA, 140 bp, Artificial Sequence
  Synthetic
atacgccatgctgggtctcccctgaatacccctgggctgcctgtatgtcaagaccaccttgagttctgggagggagtgtttactggacttacccacattgatgcccacttcctctcgcagcgtacttgggagtcggccat

SEQ ID NO: 391796 - DNA, 140 bp, Artificial Sequence
  Synthetic
atggccgactcccaagtacgctgcgagaggaagtgggcatcaatgtgggtaagtccagtaaacactccctcccagaactcaaggtggtcttgacatacaggcagcccaggggtattcaggggagacccagcatggcgtat

SEQ ID NO: 391797 - DNA, 140 bp, Artificial Sequence
  Synthetic
atacgccatgctgggtctccacagcttaaacactgggttcttggccagtttgttctacacccacaggtttaacagctcaggatgccccgaacggctcgcaagttgcaagagccttgacaccgtacttgggagtcggccat

SEQ ID NO: 391798 - DNA, 140 bp, Artificial Sequence
  Synthetic
atggccgactcccaagtacggtgtcaaggctcttgcaacttgcgagccgttcggggcatcctgagctgttaaacctgtgggtgtagaacaaactggccaagaacccagtgtttaagctgtggagacccagcatggcgtat

SEQ ID NO: 391799 - DNA, 140 bp, Artificial Sequence
  Synthetic
aggccctggctgctgatatgaacagctcaggatgccccgaacggctcgcaagttgcaagagccttgacacttttgaccaaggctggggcccacttggggttgctaacatcagtggctcgtgaccttttgggacagcggtg

SEQ ID NO: 391800 - DNA, 140 bp, Artificial Sequence
  Synthetic
caccgctgtcccaaaaggtcacgagccactgatgttagcaaccccaagtgggccccagccttggtcaaaagtgtcaaggctcttgcaacttgcgagccgttcggggcatcctgagctgttcatatcagcagccagggcct

SEQ ID NO: 391801 - DNA, 140 bp, Artificial Sequence
  Synthetic
atacgccatgctgggtctccgcggggagcccacactccggcctctaggccatcctgttttttttttttttttttttttttttttttttttttttttttttttttttttttaaatctttggcgtacttgggagtcggccat

SEQ ID NO: 391802 - DNA, 140 bp, Artificial Sequence
  Synthetic
atggccgactcccaagtacgccaaagatttaaaaaaaaaaaaaaaaaaaaaaaaaaaaaaaaaaaaaaaaaaaaaaaaaaaaaacaggatggcctagaggccggagtgtgggctccccgcggagacccagcatggcgtat

SEQ ID NO: 391803 - DNA, 140 bp, Artificial Sequence
  Synthetic
atacgccatgctgggtctccgggtcagggccctggatcacgccacgatgtttgattcattacccgtacaggctgtggcattacccttgcaccgtcaactttaccgtctttaagatcaggacgtacttgggagtcggccat

SEQ ID NO: 391804 - DNA, 140 bp, Artificial Sequence
  Synthetic
atggccgactcccaagtacgtcctgatcttaaagacggtaaagttgacggtgcaagggtaatgccacagcctgtacgggtaatgaatcaaacatcgtggcgtgatccagggccctgacccggagacccagcatggcgtat

SEQ ID NO: 391805 - DNA, 140 bp, Artificial Sequence
  Synthetic
atacgccatgctgggtctccaggggggaaccctgtaacttggagcacagggatcgcgcagaactatcacctctgctcctttccactacaacgtggcaagtccttccctgctctttcaccacgtacttgggagtcggccat

SEQ ID NO: 391806 - DNA, 140 bp, Artificial Sequence
  Synthetic
atggccgactcccaagtacgtggtgaaagagcagggaaggacttgccacgttgtagtggaaaggagcagaggtgatagttctgcgcgatccctgtgctccaagttacagggttcccccctggagacccagcatggcgtat

SEQ ID NO: 391807 - DNA, 140 bp, Artificial Sequence
  Synthetic
aggccctggctgctgatatgataaagtcgctcacagagcggctttatatcgggggtcctctgactaattcaaaagggcagaactgcggttatcgccggtgccgcgcgagcggcgtgctgagaccttttgggacagcggtg

SEQ ID NO: 391808 - DNA, 140 bp, Artificial Sequence
  Synthetic
caccgctgtcccaaaaggtctcagcacgccgctcgcgcggcaccggcgataaccgcagttctgcccttttgaattagtcagaggacccccgatataaagccgctctgtgagcgactttatcatatcagcagccagggcct

SEQ ID NO: 391809 - DNA, 140 bp, Artificial Sequence
  Synthetic
aggccctggctgctgatatgcaagtgggaatatgtggtgctcgcattcctgcttcttgcagatgcgagagtctctgcttgcctgtggatgatgtttatggtatctcaagttgaggcagctgaccttttgggacagcggtg

SEQ ID NO: 391810 - DNA, 140 bp, Artificial Sequence
  Synthetic
caccgctgtcccaaaaggtcagctgcctcaacttgagataccataaacatcatccacaggcaagcagagactctcgcatctgcaagaagcaggaatgcgagcaccacatattcccacttgcatatcagcagccagggcct

SEQ ID NO: 391811 - DNA, 140 bp, Artificial Sequence
  Synthetic
  misc_feature (113)..(113): n is a, c, g, or t
atacgccatgctgggtctccggctcccggctgccgctacctatgcggcttgcgggatgtggcccctgcttctcctacttctgatgctgcctgaaagggcttatgcatatgacnaggaggtcgtacttgggagtcggccat

SEQ ID NO: 391812 - DNA, 140 bp, Artificial Sequence
  Synthetic
  misc_feature (28)..(28): n is a, c, g, or t
atggccgactcccaagtacgacctcctngtcatatgcataagccctttcaggcagcatcagaagtaggagaagcaggggccacatcccgcaagccgcataggtagcggcagccgggagccggagacccagcatggcgtat

SEQ ID NO: 391813 - DNA, 140 bp, Artificial Sequence
  Synthetic
aggccctggctgctgatatgtctcccagctgttcaccttctcgcctcgccggcatgagacagtacaggactgcaattgttcaatctatcccggccacataacaggccatcgtatggcttggaccttttgggacagcggtg

SEQ ID NO: 391814 - DNA, 140 bp, Artificial Sequence
  Synthetic
caccgctgtcccaaaaggtccaagccatacgatggcctgttatgtggccgggatagattgaacaattgcagtcctgtactgtctcatgccggcgaggcgagaaggtgaacagctgggagacatatcagcagccagggcct

SEQ ID NO: 391815 - DNA, 140 bp, Artificial Sequence
  Synthetic
atacgccatgctgggtctcctattttatagctaggatcgaggccatggtgcatgtctacgttccatccttcgacgtgcgaggccctcgcgactcattaatcatcctcgcgatcctggccccgtacttgggagtcggccat

SEQ ID NO: 391816 - DNA, 140 bp, Artificial Sequence
  Synthetic
atggccgactcccaagtacggggccaggatcgcgaggatgattaatgagtcgcgagggcctcgcacgtcgaaggatggaacgtagacatgcaccatggcctcgatcctagctataaaataggagacccagcatggcgtat

SEQ ID NO: 391817 - DNA, 140 bp, Artificial Sequence
  Synthetic
  misc_feature (27)..(27): n is a, c, g, or t
atacgccatgctgggtctccggcacangcgctgattaagatctgcagtttggtgcgcggggtagtctgtggcaagtattgtcaaatggctatgcttaaagtaggggccctgactggcacccgtacttgggagtcggccat

SEQ ID NO: 391818 - DNA, 140 bp, Artificial Sequence
  Synthetic
  misc_feature (114)..(114): n is a, c, g, or t
atggccgactcccaagtacgggtgccagtcagggcccctactttaagcatagccatttgacaatacttgccacagactaccccgcgcaccaaactgcagatcttaatcagcgcntgtgccggagacccagcatggcgtat

SEQ ID NO: 391819 - DNA, 140 bp, Artificial Sequence
  Synthetic
atacgccatgctgggtctcctacatttatgaccatcttactcccctgtcagactgggccgctgagggcctccgtgatctggcggtggccctggagccggttgtgttcacgcccatggagacgtacttgggagtcggccat

SEQ ID NO: 391820 - DNA, 140 bp, Artificial Sequence
  Synthetic
atggccgactcccaagtacgtctccatgggcgtgaacacaaccggctccagggccaccgccagatcacggaggccctcagcggcccagtctgacaggggagtaagatggtcataaatgtaggagacccagcatggcgtat

SEQ ID NO: 391821 - DNA, 140 bp, Artificial Sequence
  Synthetic
aggccctggctgctgatatgtcctcgccgcgctgttctacgcgcacaggttcaactcgtccggatgcccagagcgcatggccagctgccgctccattgacaagttcgaccagggatgggggaccttttgggacagcggtg

SEQ ID NO: 391822 - DNA, 140 bp, Artificial Sequence
  Synthetic
caccgctgtcccaaaaggtcccccatccctggtcgaacttgtcaatggagcggcagctggccatgcgctctgggcatccggacgagttgaacctgtgcgcgtagaacagcgcggcgaggacatatcagcagccagggcct

SEQ ID NO: 391823 - DNA, 140 bp, Artificial Sequence
  Synthetic
aggccctggctgctgatatgcctggcgggcctcgcctactattccatggtggggaactgggctaaggtcttgattgtgatgctactctttgccggcgtcgacggcgggacccacgtgacagaccttttgggacagcggtg

SEQ ID NO: 391824 - DNA, 140 bp, Artificial Sequence
  Synthetic
caccgctgtcccaaaaggtctgtcacgtgggtcccgccgtcgacgccggcaaagagtagcatcacaatcaagaccttagcccagttccccaccatggaatagtaggcgaggcccgccaggcatatcagcagccagggcct

SEQ ID NO: 391825 - DNA, 140 bp, Artificial Sequence
  Synthetic
atacgccatgctgggtctcctcccatcacttattatcagggtgacagcccggaccagaggccttattgctggcactacccacctcgaccgtgtggtatagtgcccgcgtcggaggtgtgtcgtacttgggagtcggccat

SEQ ID NO: 391826 - DNA, 140 bp, Artificial Sequence
  Synthetic
atggccgactcccaagtacgacacacctccgacgcgggcactataccacacggtcgaggtgggtagtgccagcaataaggcctctggtccgggctgtcaccctgataataagtgatgggaggagacccagcatggcgtat

SEQ ID NO: 391827 - DNA, 140 bp, Artificial Sequence
  Synthetic
  misc_feature (104)..(104): n is a, c, g, or t
  misc_feature (119)..(119): n is a, c, g, or t
aggccctggctgctgatatgactggcagggacaccaatgaaaattgtggtgaagtacaggtcctgtccaccgccacgcagtccttcctgggtaccgcgatcaanggcgtaatgtggacnggaccttttgggacagcggtg

SEQ ID NO: 391828 - DNA, 140 bp, Artificial Sequence
  Synthetic
  misc_feature (22)..(22): n is a, c, g, or t
  misc_feature (37)..(37): n is a, c, g, or t
caccgctgtcccaaaaggtccngtccacattacgccnttgatcgcggtacccaggaaggactgcgtggcggtggacaggacctgtacttcaccacaattttcattggtgtccctgccagtcatatcagcagccagggcct

SEQ ID NO: 391829 - DNA, 140 bp, Artificial Sequence
  Synthetic
atacgccatgctgggtctccttaacaggactgctctgaactgcaatgactccctcaacaccgggttccttgcagcgctgttctacacacacaggttcaacgattccggttgcccagagcgcgtacttgggagtcggccat

SEQ ID NO: 391830 - DNA, 140 bp, Artificial Sequence
  Synthetic
atggccgactcccaagtacgcgctctgggcaaccggaatcgttgaacctgtgtgtgtagaacagcgctgcaaggaacccggtgttgagggagtcattgcagttcagagcagtcctgttaaggagacccagcatggcgtat

SEQ ID NO: 391831 - DNA, 140 bp, Artificial Sequence
  Synthetic
atacgccatgctgggtctcctcacctacaccgagcccccccgctcggatcagaggccctattgctggcactacgcgcctcgcccgtgcggtattgtacctgcggcgcaggtgtgtggtcccgtacttgggagtcggccat

SEQ ID NO: 391832 - DNA, 140 bp, Artificial Sequence
  Synthetic
atggccgactcccaagtacgggaccacacacctgcgccgcaggtacaataccgcacgggcgaggcgcgtagtgccagcaatagggcctctgatccgagcgggggggctcggtgtaggtgaggagacccagcatggcgtat

SEQ ID NO: 391833 - DNA, 140 bp, Artificial Sequence
  Synthetic
  misc_feature (46)..(46): n is a, c, g, or t
atacgccatgctgggtctccgtgctgcgttgtgcacccgaggggtngccaaagcagtggacttcgtcccagtcgaatctcttgagactactatgagatcaccagtgtttactgacaactccgtacttgggagtcggccat

SEQ ID NO: 391834 - DNA, 140 bp, Artificial Sequence
  Synthetic
  misc_feature (95)..(95): n is a, c, g, or t
atggccgactcccaagtacggagttgtcagtaaacactggtgatctcatagtagtctcaagagattcgactgggacgaagtccactgctttggcnacccctcgggtgcacaacgcagcacggagacccagcatggcgtat

SEQ ID NO: 391835 - DNA, 140 bp, Artificial Sequence
  Synthetic
atacgccatgctgggtctcccaactggaagtggcaagagcaccaaagttccagcagcgtatgcagcccagggttataaagtgttagtgctcaatccttcagttgcggccacactgggattcgtacttgggagtcggccat

SEQ ID NO: 391836 - DNA, 140 bp, Artificial Sequence
  Synthetic
atggccgactcccaagtacgaatcccagtgtggccgcaactgaaggattgagcactaacactttataaccctgggctgcatacgctgctggaactttggtgctcttgccacttccagttgggagacccagcatggcgtat

SEQ ID NO: 391837 - DNA, 140 bp, Artificial Sequence
  Synthetic
aggccctggctgctgatatggttgcttttccttctcctggcagacgcgcgcgtctgtgcctgcttgtggatgatgctgctgatagcccaggctgaggccgccttagagaacctggtggtcgaccttttgggacagcggtg

SEQ ID NO: 391838 - DNA, 140 bp, Artificial Sequence
  Synthetic
caccgctgtcccaaaaggtcgaccaccaggttctctaaggcggcctcagcctgggctatcagcagcatcatccacaagcaggcacagacgcgcgcgtctgccaggagaaggaaaagcaaccatatcagcagccagggcct

SEQ ID NO: 391839 - DNA, 140 bp, Artificial Sequence
  Synthetic
aggccctggctgctgatatgtgcatgcatgttagtgcggaaagtcgctgggggtcattatgtccaaatggccttcatgaagcttgccgcgctgacaggtacgtacgtttatgaccatcttgaccttttgggacagcggtg

SEQ ID NO: 391840 - DNA, 140 bp, Artificial Sequence
  Synthetic
caccgctgtcccaaaaggtcaagatggtcataaacgtacgtacctgtcagcgcggcaagcttcatgaaggccatttggacataatgacccccagcgactttccgcactaacatgcatgcacatatcagcagccagggcct

SEQ ID NO: 391841 - DNA, 140 bp, Artificial Sequence
  Synthetic
  misc_feature (58)..(58): n is a, c, g, or t
  misc_feature (96)..(96): n is a, c, g, or t
  misc_feature (112)..(112): n is a, c, g, or t
atacgccatgctgggtctccagaacttcccataccttgttgcctaccaggccacagtntgcgccagagctctggcgcccccgccgagctgggacancatgtggaagtgcctnatccgcctcgtacttgggagtcggccat

SEQ ID NO: 391842 - DNA, 140 bp, Artificial Sequence
  Synthetic
  misc_feature (29)..(29): n is a, c, g, or t
  misc_feature (45)..(45): n is a, c, g, or t
  misc_feature (83)..(83): n is a, c, g, or t
atggccgactcccaagtacgaggcggatnaggcacttccacatgntgtcccagctcggcgggggcgccagagctctggcgcanactgtggcctggtaggcaacaaggtatgggaagttctggagacccagcatggcgtat

SEQ ID NO: 391843 - DNA, 140 bp, Artificial Sequence
  Synthetic
aggccctggctgctgatatgcagttgagcccgtcgtcttctctgacatggagaccaagatcatcacctggggggcggacaccgcggcatgtggggacatcatcttgggtttgcccgtctcgaccttttgggacagcggtg

SEQ ID NO: 391844 - DNA, 140 bp, Artificial Sequence
  Synthetic
caccgctgtcccaaaaggtcgagacgggcaaacccaagatgatgtccccacatgccgcggtgtccgccccccaggtgatgatcttggtctccatgtcagagaagacgacgggctcaactgcatatcagcagccagggcct

SEQ ID NO: 391845 - DNA, 140 bp, Artificial Sequence
  Synthetic
  misc_feature (78)..(78): n is a, c, g, or t
  misc_feature (87)..(87): n is a, c, g, or t
  misc_feature (91)..(91): n is a, c, g, or t
  misc_feature (93)..(93): n is a, c, g, or t
  misc_feature (96)..(96): n is a, c, g, or t
aggccctggctgctgatatgcggcgtcctggcagctctagctgcttactgtctttcagtgggcagtgtggtgattgtngggagagtngtcntntcnggccagcctgctgtcattcctgacgaccttttgggacagcggtg

SEQ ID NO: 391846 - DNA, 140 bp, Artificial Sequence
  Synthetic
  misc_feature (45)..(45): n is a, c, g, or t
  misc_feature (48)..(48): n is a, c, g, or t
  misc_feature (50)..(50): n is a, c, g, or t
  misc_feature (54)..(54): n is a, c, g, or t
  misc_feature (63)..(63): n is a, c, g, or t
caccgctgtcccaaaaggtcgtcaggaatgacagcaggctggccnganangacnactctcccnacaatcaccacactgcccactgaaagacagtaagcagctagagctgccaggacgccgcatatcagcagccagggcct

SEQ ID NO: 391847 - DNA, 140 bp, Artificial Sequence
  Synthetic
  misc_feature (22)..(22): n is a, c, g, or t
  misc_feature (26)..(26): n is a, c, g, or t
  misc_feature (28)..(28): n is a, c, g, or t
  misc_feature (31)..(31): n is a, c, g, or t
  misc_feature (40)..(40): n is a, c, g, or t
  misc_feature (64)..(64): n is a, c, g, or t
  misc_feature (70)..(70): n is a, c, g, or t
  misc_feature (103)..(103): n is a, c, g, or t
  misc_feature (115)..(115): n is a, c, g, or t
atacgccatgctgggtctccangccntnggncttctaaanttcgccggcaagcaagcccaagangtaacnccagtggtccagtccaacttcgccaaacttgancagttctgggcnaagcacgtacttgggagtcggccat

SEQ ID NO: 391848 - DNA, 140 bp, Artificial Sequence
  Synthetic
  misc_feature (26)..(26): n is a, c, g, or t
  misc_feature (38)..(38): n is a, c, g, or t
  misc_feature (71)..(71): n is a, c, g, or t
  misc_feature (77)..(77): n is a, c, g, or t
  misc_feature (101)..(101): n is a, c, g, or t
  misc_feature (110)..(110): n is a, c, g, or t
  misc_feature (113)..(113): n is a, c, g, or t
  misc_feature (115)..(115): n is a, c, g, or t
  misc_feature (119)..(119): n is a, c, g, or t
atggccgactcccaagtacgtgcttngcccagaactgntcaagtttggcgaagttggactggaccactggngttacntcttgggcttgcttgccggcgaantttagaagnccnanggcntggagacccagcatggcgtat

SEQ ID NO: 391849 - DNA, 140 bp, Artificial Sequence
  Synthetic
  misc_feature (53)..(53): n is a, c, g, or t
  misc_feature (56)..(56): n is a, c, g, or t
  misc_feature (59)..(59): n is a, c, g, or t
  misc_feature (63)..(63): n is a, c, g, or t
  misc_feature (68)..(68): n is a, c, g, or t
  misc_feature (104)..(104): n is a, c, g, or t
  misc_feature (107)..(107): n is a, c, g, or t
atacgccatgctgggtctccacaagccctctgaccacccagcaaaccctcctnttnaanatcntaggngggtgggtggcttcgcagattgcgactccgacagcntcnacagcttttgtcgcgtacttgggagtcggccat

SEQ ID NO: 391850 - DNA, 140 bp, Artificial Sequence
  Synthetic
  misc_feature (34)..(34): n is a, c, g, or t
  misc_feature (37)..(37): n is a, c, g, or t
  misc_feature (73)..(73): n is a, c, g, or t
  misc_feature (78)..(78): n is a, c, g, or t
  misc_feature (82)..(82): n is a, c, g, or t
  misc_feature (85)..(85): n is a, c, g, or t
  misc_feature (88)..(88): n is a, c, g, or t
atggccgactcccaagtacgcgacaaaagctgtngangctgtcggagtcgcaatctgcgaagccacccacccncctangatnttnaanaggagggtttgctgggtggtcagagggcttgtggagacccagcatggcgtat

SEQ ID NO: 391851 - DNA, 140 bp, Artificial Sequence
  Synthetic
  misc_feature (29)..(29): n is a, c, g, or t
  misc_feature (32)..(32): n is a, c, g, or t
  misc_feature (44)..(44): n is a, c, g, or t
  misc_feature (50)..(50): n is a, c, g, or t
  misc_feature (74)..(74): n is a, c, g, or t
  misc_feature (77)..(77): n is a, c, g, or t
  misc_feature (96)..(96): n is a, c, g, or t
  misc_feature (119)..(119): n is a, c, g, or t
atacgccatgctgggtctccttagtgganatnctcgccggttanggcgcnggcgtagctggcgctgtggttacnttnaagatcatgagcggcgagntgccatccacagaggacttagtnacgtacttgggagtcggccat

SEQ ID NO: 391852 - DNA, 140 bp, Artificial Sequence
  Synthetic
  misc_feature (22)..(22): n is a, c, g, or t
  misc_feature (45)..(45): n is a, c, g, or t
  misc_feature (64)..(64): n is a, c, g, or t
  misc_feature (67)..(67): n is a, c, g, or t
  misc_feature (91)..(91): n is a, c, g, or t
  misc_feature (97)..(97): n is a, c, g, or t
  misc_feature (109)..(109): n is a, c, g, or t
  misc_feature (112)..(112): n is a, c, g, or t
atggccgactcccaagtacgtnactaagtcctctgtggatggcanctcgccgctcatgatcttnaangtaaccacagcgccagctacgccngcgccntaaccggcgagnatntccactaaggagacccagcatggcgtat

SEQ ID NO: 391853 - DNA, 140 bp, Artificial Sequence
  Synthetic
aggccctggctgctgatatggagacggctggagcgcgactcgtcgtgctcgccaccgccacacctccgggatcggtcaccgtgccacatcccaatatcgaggaggtggccctgtccaacagaccttttgggacagcggtg

SEQ ID NO: 391854 - DNA, 140 bp, Artificial Sequence
  Synthetic
caccgctgtcccaaaaggtctgttggacagggccacctcctcgatattgggatgtggcacggtgaccgatcccggaggtgtggcggtggcgagcacgacgagtcgcgctccagccgtctccatatcagcagccagggcct

SEQ ID NO: 391855 - DNA, 140 bp, Artificial Sequence
  Synthetic
  misc_feature (62)..(62): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
aggccctggctgctgatatgttataagggagagtggcgtggagatggcgtaatgcacaccanatgcccntgnggngcngagctggcaggccatatcaagaacggctcgatgaggatcactgaccttttgggacagcggtg

SEQ ID NO: 391856 - DNA, 140 bp, Artificial Sequence
  Synthetic
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (79)..(79): n is a, c, g, or t
caccgctgtcccaaaaggtcagtgatcctcatcgagccgttcttgatatggcctgccagctcngcnccncangggcatntggtgtgcattacgccatctccacgccactctcccttataacatatcagcagccagggcct

SEQ ID NO: 391857 - DNA, 140 bp, Artificial Sequence
  Synthetic
  misc_feature (24)..(24): n is a, c, g, or t
  misc_feature (54)..(54): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (96)..(96): n is a, c, g, or t
atacgccatgctgggtctccccangtcccggctccagagttcttcacggaggtngacggcgtcagattacancgncangccccgaaaagcaaaccnttgctgcgggacgaagtgtcgttccgtacttgggagtcggccat

SEQ ID NO: 391858 - DNA, 140 bp, Artificial Sequence
  Synthetic
  misc_feature (45)..(45): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (87)..(87): n is a, c, g, or t
  misc_feature (117)..(117): n is a, c, g, or t
atggccgactcccaagtacggaacgacacttcgtcccgcagcaanggtttgcttttcggggcntgncgntgtaatctgacgccgtcnacctccgtgaagaactctggagccgggacntggggagacccagcatggcgtat

SEQ ID NO: 391859 - DNA, 140 bp, Artificial Sequence
  Synthetic
  misc_feature (26)..(26): n is a, c, g, or t
  misc_feature (95)..(95): n is a, c, g, or t
atacgccatgctgggtctcctctgtnggactcaattcgttcgtagtgggatcacagctcccatgcgagccagagccagacgtggccgtgctgacntccatgttgacagacccatcacacacgtacttgggagtcggccat

SEQ ID NO: 391860 - DNA, 140 bp, Artificial Sequence
  Synthetic
  misc_feature (46)..(46): n is a, c, g, or t
  misc_feature (115)..(115): n is a, c, g, or t
atggccgactcccaagtacgtgtgtgatgggtctgtcaacatggangtcagcacggccacgtctggctctggctcgcatgggagctgtgatcccactacgaacgaattgagtccnacagaggagacccagcatggcgtat

SEQ ID NO: 391861 - DNA, 140 bp, Artificial Sequence
  Synthetic
  misc_feature (21)..(21): n is a, c, g, or t
  misc_feature (25)..(25): n is a, c, g, or t
  misc_feature (37)..(37): n is a, c, g, or t
  misc_feature (45)..(45): n is a, c, g, or t
  misc_feature (84)..(84): n is a, c, g, or t
  misc_feature (86)..(86): n is a, c, g, or t
  misc_feature (93)..(93): n is a, c, g, or t
  misc_feature (99)..(99): n is a, c, g, or t
  misc_feature (105)..(105): n is a, c, g, or t
atacgccatgctgggtctccntgcnccgctcgccatnactccccnggcactgatctcctcgaggctaacctcttgtgggggtcngntgctacnagggtngagacngacgagaaggtgatacgtacttgggagtcggccat

SEQ ID NO: 391862 - DNA, 140 bp, Artificial Sequence
  Synthetic
  misc_feature (36)..(36): n is a, c, g, or t
  misc_feature (42)..(42): n is a, c, g, or t
  misc_feature (48)..(48): n is a, c, g, or t
  misc_feature (55)..(55): n is a, c, g, or t
  misc_feature (57)..(57): n is a, c, g, or t
  misc_feature (96)..(96): n is a, c, g, or t
  misc_feature (104)..(104): n is a, c, g, or t
  misc_feature (116)..(116): n is a, c, g, or t
  misc_feature (120)..(120): n is a, c, g, or t
atggccgactcccaagtacgtatcaccttctcgtcngtctcnaccctngtagcancngacccccacaagaggttagcctcgaggagatcagtgccnggggagtnatggcgagcggngcanggagacccagcatggcgtat

SEQ ID NO: 391863 - DNA, 140 bp, Artificial Sequence
  Synthetic
  misc_feature (28)..(28): n is a, c, g, or t
  misc_feature (46)..(46): n is a, c, g, or t
  misc_feature (52)..(52): n is a, c, g, or t
  misc_feature (61)..(61): n is a, c, g, or t
  misc_feature (69)..(69): n is a, c, g, or t
  misc_feature (100)..(100): n is a, c, g, or t
  misc_feature (112)..(112): n is a, c, g, or t
  misc_feature (116)..(116): n is a, c, g, or t
atacgccatgctgggtctccctctgccnatttgggctcgcccagantacaanccacctctnactgagangtggaagcaacaggactacaagcctccaacngtccatggatgngctntgcccgtacttgggagtcggccat

SEQ ID NO: 391864 - DNA, 140 bp, Artificial Sequence
  Synthetic
  misc_feature (25)..(25): n is a, c, g, or t
  misc_feature (29)..(29): n is a, c, g, or t
  misc_feature (41)..(41): n is a, c, g, or t
  misc_feature (72)..(72): n is a, c, g, or t
  misc_feature (80)..(80): n is a, c, g, or t
  misc_feature (89)..(89): n is a, c, g, or t
  misc_feature (95)..(95): n is a, c, g, or t
  misc_feature (113)..(113): n is a, c, g, or t
atggccgactcccaagtacgggcanagcncatccatggacngttggaggcttgtagtcctgttgcttccacntctcagtnagaggtggnttgtantctgggcgagcccaaatnggcagagggagacccagcatggcgtat

SEQ ID NO: 391865 - DNA, 140 bp, Artificial Sequence
  Synthetic
  misc_feature (37)..(37): n is a, c, g, or t
  misc_feature (42)..(42): n is a, c, g, or t
  misc_feature (75)..(75): n is a, c, g, or t
  misc_feature (83)..(83): n is a, c, g, or t
  misc_feature (93)..(93): n is a, c, g, or t
  misc_feature (101)..(101): n is a, c, g, or t
  misc_feature (113)..(113): n is a, c, g, or t
  misc_feature (119)..(119): n is a, c, g, or t
atacgccatgctgggtctccaccttcggccagtcagngctgngctcagactctggtgcagacctcaccaccccanctgagacnacagactcgngccccatnatcgtggatgangcatcngcgtacttgggagtcggccat

SEQ ID NO: 391866 - DNA, 140 bp, Artificial Sequence
  Synthetic
  misc_feature (22)..(22): n is a, c, g, or t
  misc_feature (28)..(28): n is a, c, g, or t
  misc_feature (40)..(40): n is a, c, g, or t
  misc_feature (48)..(48): n is a, c, g, or t
  misc_feature (58)..(58): n is a, c, g, or t
  misc_feature (66)..(66): n is a, c, g, or t
  misc_feature (99)..(99): n is a, c, g, or t
  misc_feature (104)..(104): n is a, c, g, or t
atggccgactcccaagtacgcngatgcntcatccacgatnatggggcncgagtctgtngtctcagntggggtggtgaggtctgcaccagagtctgagcncagcnctgactggccgaaggtggagacccagcatggcgtat

SEQ ID NO: 391867 - DNA, 140 bp, Artificial Sequence
  Synthetic
  misc_feature (60)..(60): n is a, c, g, or t
  misc_feature (72)..(72): n is a, c, g, or t
  misc_feature (106)..(106): n is a, c, g, or t
  misc_feature (108)..(108): n is a, c, g, or t
atacgccatgctgggtctcccgtgtgctgctcaatgtcatattcatggactggggcgctngtgacaccctgngcagctgaagaatcaaagctgccaattagccccntnagcaattcacttcgtacttgggagtcggccat

SEQ ID NO: 391868 - DNA, 140 bp, Artificial Sequence
  Synthetic
  misc_feature (33)..(33): n is a, c, g, or t
  misc_feature (35)..(35): n is a, c, g, or t
  misc_feature (69)..(69): n is a, c, g, or t
  misc_feature (81)..(81): n is a, c, g, or t
atggccgactcccaagtacgaagtgaattgctnanggggctaattggcagctttgattcttcagctgcncagggtgtcacnagcgccccagtccatgaatatgacattgagcagcacacgggagacccagcatggcgtat

SEQ ID NO: 391869 - DNA, 140 bp, Artificial Sequence
  Synthetic
aggccctggctgctgatatgcatgcaccaacaggcagcgggaagagcaccaaggtccctgccgcatatgccagtcaggggtataaggtacttgtactaaatccctctgtcgcggccacacgaccttttgggacagcggtg

SEQ ID NO: 391870 - DNA, 140 bp, Artificial Sequence
  Synthetic
caccgctgtcccaaaaggtcgtgtggccgcgacagagggatttagtacaagtaccttatacccctgactggcatatgcggcagggaccttggtgctcttcccgctgcctgttggtgcatgcatatcagcagccagggcct

SEQ ID NO: 391871 - DNA, 140 bp, Artificial Sequence
  Synthetic
aggccctggctgctgatatgtgagcaactctttgctgcgtcaccacaacatggtttacgctacaacatcccgcagcgcaagccagcggcagaagaaggtcacctttgacagactgcaagtgaccttttgggacagcggtg

SEQ ID NO: 391872 - DNA, 140 bp, Artificial Sequence
  Synthetic
caccgctgtcccaaaaggtcacttgcagtctgtcaaaggtgaccttcttctgccgctggcttgcgctgcgggatgttgtagcgtaaaccatgttgtggtgacgcagcaaagagttgctcacatatcagcagccagggcct

SEQ ID NO: 391873 - DNA, 140 bp, Artificial Sequence
  Synthetic
  misc_feature (51)..(51): n is a, c, g, or t
  misc_feature (60)..(60): n is a, c, g, or t
  misc_feature (69)..(69): n is a, c, g, or t
  misc_feature (93)..(93): n is a, c, g, or t
atacgccatgctgggtctccagcgcagcgggtggaatatcttctgacttcntggaagtcnaagaagacncccatggggttctcttatgatacncgctgctttgactccactgtgactgaacgtacttgggagtcggccat

SEQ ID NO: 391874 - DNA, 140 bp, Artificial Sequence
  Synthetic
  misc_feature (48)..(48): n is a, c, g, or t
  misc_feature (72)..(72): n is a, c, g, or t
  misc_feature (81)..(81): n is a, c, g, or t
  misc_feature (90)..(90): n is a, c, g, or t
atggccgactcccaagtacgttcagtcacagtggagtcaaagcagcgngtatcataagagaaccccatgggngtcttcttngacttccangaagtcagaagatattccacccgctgcgctggagacccagcatggcgtat

SEQ ID NO: 391875 - DNA, 140 bp, Artificial Sequence
  Synthetic
  misc_feature (25)..(25): n is a, c, g, or t
  misc_feature (35)..(35): n is a, c, g, or t
atacgccatgctgggtctccgcccnggtgtgcccntcccagcgccgaactacaaattcgcgctttggagggtgtccgccgaggagtacgtggaggttcgcagagtgggtgatttccattacgtacttgggagtcggccat

SEQ ID NO: 391876 - DNA, 140 bp, Artificial Sequence
  Synthetic
  misc_feature (106)..(106): n is a, c, g, or t
  misc_feature (116)..(116): n is a, c, g, or t
atggccgactcccaagtacgtaatggaaatcacccactctgcgaacctccacgtactcctcggcggacaccctccaaagcgcgaatttgtagttcggcgctgggangggcacaccngggcggagacccagcatggcgtat

SEQ ID NO: 391877 - DNA, 140 bp, Artificial Sequence
  Synthetic
  misc_feature (22)..(22): n is a, c, g, or t
  misc_feature (53)..(53): n is a, c, g, or t
  misc_feature (55)..(55): n is a, c, g, or t
  misc_feature (67)..(67): n is a, c, g, or t
  misc_feature (77)..(77): n is a, c, g, or t
  misc_feature (94)..(94): n is a, c, g, or t
  misc_feature (106)..(106): n is a, c, g, or t
  misc_feature (120)..(120): n is a, c, g, or t
atacgccatgctgggtctcctnctctcgtgcctgactgtccccgcttcggccntnaactatcgcaangcttcgggcntctaccatgtcaccaangactgcccgaangcaagcatagtatncgtacttgggagtcggccat

SEQ ID NO: 391878 - DNA, 140 bp, Artificial Sequence
  Synthetic
  misc_feature (21)..(21): n is a, c, g, or t
  misc_feature (35)..(35): n is a, c, g, or t
  misc_feature (47)..(47): n is a, c, g, or t
  misc_feature (64)..(64): n is a, c, g, or t
  misc_feature (74)..(74): n is a, c, g, or t
  misc_feature (86)..(86): n is a, c, g, or t
  misc_feature (88)..(88): n is a, c, g, or t
  misc_feature (119)..(119): n is a, c, g, or t
atggccgactcccaagtacgnatactatgcttgcnttcgggcagtcnttggtgacatggtagangcccgaagcnttgcgatagttnanggccgaagcggggacagtcaggcacgagagnaggagacccagcatggcgtat

SEQ ID NO: 391879 - DNA, 140 bp, Artificial Sequence
  Synthetic
  misc_feature (40)..(40): n is a, c, g, or t
  misc_feature (72)..(72): n is a, c, g, or t
  misc_feature (118)..(118): n is a, c, g, or t
atacgccatgctgggtctccaaacggggaatctgtcacgntgctgggtggcccttactcctaccgtcgcagngccatacatcggcgcgccgcttgagtccttgcggagtcatgtgganctcgtacttgggagtcggccat

SEQ ID NO: 391880 - DNA, 140 bp, Artificial Sequence
  Synthetic
  misc_feature (23)..(23): n is a, c, g, or t
  misc_feature (69)..(69): n is a, c, g, or t
  misc_feature (101)..(101): n is a, c, g, or t
atggccgactcccaagtacgagntccacatgactccgcaaggactcaagcggcgcgccgatgtatggcnctgcgacggtaggagtaagggccacccagcancgtgacagattccccgtttggagacccagcatggcgtat

SEQ ID NO: 391881 - DNA, 140 bp, Artificial Sequence
  Synthetic
  misc_feature (46)..(46): n is a, c, g, or t
  misc_feature (73)..(73): n is a, c, g, or t
  misc_feature (91)..(91): n is a, c, g, or t
  misc_feature (111)..(111): n is a, c, g, or t
aggccctggctgctgatatggggagaatgagtctgatgtcttcctnttgaactcgaccagaccgccacgtggngcgtggttcgggtgcgtntggatgaacagcaccgggtntacaaaaacgaccttttgggacagcggtg

SEQ ID NO: 391882 - DNA, 140 bp, Artificial Sequence
  Synthetic
  misc_feature (30)..(30): n is a, c, g, or t
  misc_feature (50)..(50): n is a, c, g, or t
  misc_feature (68)..(68): n is a, c, g, or t
  misc_feature (95)..(95): n is a, c, g, or t
caccgctgtcccaaaaggtcgtttttgtanacccggtgctgttcatccanacgcacccgaaccacgcnccacgtggcggtctggtcgagttcaanaggaagacatcagactcattctccccatatcagcagccagggcct

SEQ ID NO: 391883 - DNA, 140 bp, Artificial Sequence
  Synthetic
  misc_feature (59)..(59): n is a, c, g, or t
  misc_feature (68)..(68): n is a, c, g, or t
  misc_feature (117)..(117): n is a, c, g, or t
atacgccatgctgggtctcctcagggccttggatcacaccacgatgcttggttcactanccgtaccgnctgtggcattacccatgcaccgtcaattttaccatctttaagatcagantgtcgtacttgggagtcggccat

SEQ ID NO: 391884 - DNA, 140 bp, Artificial Sequence
  Synthetic
  misc_feature (24)..(24): n is a, c, g, or t
  misc_feature (73)..(73): n is a, c, g, or t
  misc_feature (82)..(82): n is a, c, g, or t
atggccgactcccaagtacgacantctgatcttaaagatggtaaaattgacggtgcatgggtaatgccacagncggtacggntagtgaaccaagcatcgtggtgtgatccaaggccctgaggagacccagcatggcgtat

SEQ ID NO: 391885 - DNA, 140 bp, Artificial Sequence
  Synthetic
  misc_feature (33)..(33): n is a, c, g, or t
  misc_feature (63)..(63): n is a, c, g, or t
  misc_feature (93)..(93): n is a, c, g, or t
  misc_feature (108)..(108): n is a, c, g, or t
atacgccatgctgggtctccgctccttaccacnacaacgtggcaagttctcccctgctctttnaccactctacctgccctttctactggcttnatccacctccaccanaatatcgtggaccgtacttgggagtcggccat

SEQ ID NO: 391886 - DNA, 140 bp, Artificial Sequence
  Synthetic
  misc_feature (33)..(33): n is a, c, g, or t
  misc_feature (48)..(48): n is a, c, g, or t
  misc_feature (78)..(78): n is a, c, g, or t
  misc_feature (108)..(108): n is a, c, g, or t
atggccgactcccaagtacggtccacgatattntggtggaggtggatnaagccagtagaaagggcaggtagagtggtnaaagagcaggggagaacttgccacgttgtngtggtaaggagcggagacccagcatggcgtat

SEQ ID NO: 391887 - DNA, 140 bp, Artificial Sequence
  Synthetic
aggccctggctgctgatatgggccttagcgcattttcactccatagttactctccaggtgagatcaatagggtggcttcatgcctcaggaaacttggggtaccacccttgcgagtctggagaccttttgggacagcggtg

SEQ ID NO: 391888 - DNA, 140 bp, Artificial Sequence
  Synthetic
caccgctgtcccaaaaggtctccagactcgcaagggtggtaccccaagtttcctgaggcatgaagccaccctattgatctcacctggagagtaactatggagtgaaaatgcgctaaggcccatatcagcagccagggcct

SEQ ID NO: 391889 - DNA, 140 bp, Artificial Sequence
  Synthetic
  misc_feature (22)..(22): n is a, c, g, or t
  misc_feature (43)..(43): n is a, c, g, or t
  misc_feature (67)..(67): n is a, c, g, or t
  misc_feature (106)..(106): n is a, c, g, or t
  misc_feature (112)..(112): n is a, c, g, or t
atacgccatgctgggtctcccngcttgcctatggatgatgttnatggtatctcaagttgaggcggcnctgtccaacctgattaacatcaatgctgcttcagctgcnggcacncacggcttcgtacttgggagtcggccat

SEQ ID NO: 391890 - DNA, 140 bp, Artificial Sequence
  Synthetic
  misc_feature (29)..(29): n is a, c, g, or t
  misc_feature (35)..(35): n is a, c, g, or t
  misc_feature (74)..(74): n is a, c, g, or t
  misc_feature (98)..(98): n is a, c, g, or t
  misc_feature (119)..(119): n is a, c, g, or t
atggccgactcccaagtacgaagccgtgngtgccngcagctgaagcagcattgatgttaatcaggttggacagngccgcctcaacttgagataccatnaacatcatccataggcaagcngggagacccagcatggcgtat

SEQ ID NO: 391891 - DNA, 140 bp, Artificial Sequence
  Synthetic
  misc_feature (48)..(48): n is a, c, g, or t
  misc_feature (66)..(66): n is a, c, g, or t
  misc_feature (68)..(68): n is a, c, g, or t
  misc_feature (96)..(96): n is a, c, g, or t
aggccctggctgctgatatgcgtgcgcggtcctcgcgactcattgatnattcttgcagtcctggcntncccacatctgatatttgacatcacaaantaccttctggccatcttagggcccgaccttttgggacagcggtg

SEQ ID NO: 391892 - DNA, 140 bp, Artificial Sequence
  Synthetic
  misc_feature (45)..(45): n is a, c, g, or t
  misc_feature (73)..(73): n is a, c, g, or t
  misc_feature (75)..(75): n is a, c, g, or t
  misc_feature (93)..(93): n is a, c, g, or t
caccgctgtcccaaaaggtcgggccctaagatggccagaaggtantttgtgatgtcaaatatcagatgtgggnangccaggactgcaagaatnatcaatgagtcgcgaggaccgcgcacgcatatcagcagccagggcct

SEQ ID NO: 391893 - DNA, 140 bp, Artificial Sequence
  Synthetic
  misc_feature (46)..(46): n is a, c, g, or t
  misc_feature (77)..(77): n is a, c, g, or t
  misc_feature (79)..(79): n is a, c, g, or t
  misc_feature (94)..(94): n is a, c, g, or t
aggccctggctgctgatatgcacatctgatatttgacatcacaaantaccttctggccatcttagggcccctctacntnctccaggcctcactnctacgcgtcccttactttgtgagggcgaccttttgggacagcggtg

SEQ ID NO: 391894 - DNA, 140 bp, Artificial Sequence
  Synthetic
  misc_feature (47)..(47): n is a, c, g, or t
  misc_feature (62)..(62): n is a, c, g, or t
  misc_feature (64)..(64): n is a, c, g, or t
  misc_feature (95)..(95): n is a, c, g, or t
caccgctgtcccaaaaggtcgccctcacaaagtaagggacgcgtagnagtgaggcctggagnangtagaggggccctaagatggccagaaggtantttgtgatgtcaaatatcagatgtgcatatcagcagccagggcct

SEQ ID NO: 391895 - DNA, 140 bp, Artificial Sequence
  Synthetic
  misc_feature (34)..(34): n is a, c, g, or t
  misc_feature (113)..(113): n is a, c, g, or t
  misc_feature (115)..(115): n is a, c, g, or t
atacgccatgctgggtctccatcacggggcgggnagcaagaccatcagcggcccgaagggacctgttaatcaaatgtacaccaatgttgaccaagacttggtggggtggccancnccccccgtacttgggagtcggccat

SEQ ID NO: 391896 - DNA, 140 bp, Artificial Sequence
  Synthetic
  misc_feature (26)..(26): n is a, c, g, or t
  misc_feature (28)..(28): n is a, c, g, or t
  misc_feature (107)..(107): n is a, c, g, or t
atggccgactcccaagtacggggggngntggccaccccaccaagtcttggtcaacattggtgtacatttgattaacaggtcccttcgggccgctgatggtcttgctncccgccccgtgatggagacccagcatggcgtat

SEQ ID NO: 391897 - DNA, 140 bp, Artificial Sequence
  Synthetic
  misc_feature (21)..(21): n is a, c, g, or t
  misc_feature (36)..(36): n is a, c, g, or t
  misc_feature (51)..(51): n is a, c, g, or t
  misc_feature (60)..(60): n is a, c, g, or t
  misc_feature (75)..(75): n is a, c, g, or t
atacgccatgctgggtctccnccccccgcggtgccncagacctatcaggtngcacacctncatgcaccaacaggnagtggcaagagcactaaagtcccggcagcgtacgcagcccagggccgtacttgggagtcggccat

SEQ ID NO: 391898 - DNA, 140 bp, Artificial Sequence
  Synthetic
  misc_feature (66)..(66): n is a, c, g, or t
  misc_feature (81)..(81): n is a, c, g, or t
  misc_feature (90)..(90): n is a, c, g, or t
  misc_feature (105)..(105): n is a, c, g, or t
  misc_feature (120)..(120): n is a, c, g, or t
atggccgactcccaagtacggccctgggctgcgtacgctgccgggactttagtgctcttgccactncctgttggtgcatgnaggtgtgcnacctgataggtctgnggcaccgcggggggnggagacccagcatggcgtat

SEQ ID NO: 391899 - DNA, 140 bp, Artificial Sequence
  Synthetic
atacgccatgctgggtctccagcttgtaaacaccaacggcagttggcacatcaacaggactgccttgaattgcaacgactccctccagactgggttccttgccgcgctgttctacacacacgtacttgggagtcggccat

SEQ ID NO: 391900 - DNA, 140 bp, Artificial Sequence
  Synthetic
atggccgactcccaagtacgtgtgtgtagaacagcgcggcaaggaacccagtctggagggagtcgttgcaattcaaggcagtcctgttgatgtgccaactgccgttggtgtttacaagctggagacccagcatggcgtat

SEQ ID NO: 391901 - DNA, 140 bp, Artificial Sequence
  Synthetic
aggccctggctgctgatatggtactgggttcactaagacgtgcggaggccccccgtgtaacatcgggggggtcggtaaccgcaccttgatctgccccacggactgcttccggaagcacccgaccttttgggacagcggtg

SEQ ID NO: 391902 - DNA, 140 bp, Artificial Sequence
  Synthetic
caccgctgtcccaaaaggtcgggtgcttccggaagcagtccgtggggcagatcaaggtgcggttaccgacccccccgatgttacacggggggcctccgcacgtcttagtgaacccagtaccatatcagcagccagggcct

SEQ ID NO: 391903 - DNA, 140 bp, Artificial Sequence
  Synthetic
atacgccatgctgggtctcccagtttcaactcgtccggatgcccagaacgcatggccagctgtcgctccatcgatgagttcgctcaggggtggggccccatcacctacgctgggtcctgccgtacttgggagtcggccat

SEQ ID NO: 391904 - DNA, 140 bp, Artificial Sequence
  Synthetic
atggccgactcccaagtacggcaggacccagcgtaggtgatggggccccacccctgagcgaactcatcgatggagcgacagctggccatgcgttctgggcatccggacgagttgaaactgggagacccagcatggcgtat

SEQ ID NO: 391905 - DNA, 140 bp, Artificial Sequence
  Synthetic
aggccctggctgctgatatgtggggggagaatgagacggacgtgctgattctcaacaacacgcggccgccgcaaggcaactggttcggctgtacatggatgaatagcaccgggttcaccagaccttttgggacagcggtg

SEQ ID NO: 391906 - DNA, 140 bp, Artificial Sequence
  Synthetic
caccgctgtcccaaaaggtctggtgaacccggtgctattcatccatgtacagccgaaccagttgccttgcggcggccgcgtgttgttgagaatcagcacgtccgtctcattctccccccacatatcagcagccagggcct

SEQ ID NO: 391907 - DNA, 140 bp, Artificial Sequence
  Synthetic
aggccctggctgctgatatgcaaatgcggctcggggccttggttgacacctaggtgcatggttgactatccatacaggctttggcactacccctgcaccgtcaactttaccatcttcaaggaccttttgggacagcggtg

SEQ ID NO: 391908 - DNA, 140 bp, Artificial Sequence
  Synthetic
caccgctgtcccaaaaggtccttgaagatggtaaagttgacggtgcaggggtagtgccaaagcctgtatggatagtcaaccatgcacctaggtgtcaaccaaggccccgagccgcatttgcatatcagcagccagggcct

SEQ ID NO: 391909 - DNA, 140 bp, Artificial Sequence
  Synthetic
atacgccatgctgggtctccaaagtgccgtacttcgtgcgcgctcaagggctcattcgcgcatgcatgttagtgcggaaaattgccggaggccaatatgtccagatggccttcatgaagccgtacttgggagtcggccat

SEQ ID NO: 391910 - DNA, 140 bp, Artificial Sequence
  Synthetic
atggccgactcccaagtacggcttcatgaaggccatctggacatattggcctccggcaattttccgcactaacatgcatgcgcgaatgagcccttgagcgcgcacgaagtacggcactttggagacccagcatggcgtat

SEQ ID NO: 391911 - DNA, 140 bp, Artificial Sequence
  Synthetic
atacgccatgctgggtctccagcggggctcttctattaccacaaattcaactcttcaggctgccccgagaggatggccagctgcagaccccttgccgatttcgaccagggctggggccctcgtacttgggagtcggccat

SEQ ID NO: 391912 - DNA, 140 bp, Artificial Sequence
  Synthetic
atggccgactcccaagtacgagggccccagccctggtcgaaatcggcaaggggtctgcagctggccatcctctcggggcagcctgaagagttgaatttgtggtaatagaagagccccgctggagacccagcatggcgtat

SEQ ID NO: 391913 - DNA, 140 bp, Artificial Sequence
  Synthetic
aggccctggctgctgatatgggatggccagctgcagaccccttgccgatttcgaccagggctggggccctatcagctacgccaacggaagcggccccgaacaccgcccctactgctggcagaccttttgggacagcggtg

SEQ ID NO: 391914 - DNA, 140 bp, Artificial Sequence
  Synthetic
caccgctgtcccaaaaggtctgccagcagtaggggcggtgttcggggccgcttccgttggcgtagctgatagggccccagccctggtcgaaatcggcaaggggtctgcagctggccatcccatatcagcagccagggcct

SEQ ID NO: 391915 - DNA, 140 bp, Artificial Sequence
  Synthetic
aggccctggctgctgatatgcgtcctggcagctctagctgcttactgtctttcagtgggcagcgtagtgattgtcgggagagtcgtcctgtcgggccagcctgctgtcatccctgaccgcgaccttttgggacagcggtg

SEQ ID NO: 391916 - DNA, 140 bp, Artificial Sequence
  Synthetic
caccgctgtcccaaaaggtcgcggtcagggatgacagcaggctggcccgacaggacgactctcccgacaatcactacgctgcccactgaaagacagtaagcagctagagctgccaggacgcatatcagcagccagggcct

SEQ ID NO: 391917 - DNA, 140 bp, Artificial Sequence
  Synthetic
atacgccatgctgggtctcctccgttagttgagcatggactgcaactggctgagcaattcaagcagaaggccgtaggcctcctaaatttcgctggcaagcaagcccaagaggcaacaccacgtacttgggagtcggccat

SEQ ID NO: 391918 - DNA, 140 bp, Artificial Sequence
  Synthetic
atggccgactcccaagtacgtggtgttgcctcttgggcttgcttgccagcgaaatttaggaggcctacggccttctgcttgaattgctcagccagttgcagtccatgctcaactaacggaggagacccagcatggcgtat

SEQ ID NO: 391919 - DNA, 140 bp, Artificial Sequence
  Synthetic
atacgccatgctgggtctcccagctgatcaacagtaatggcagttggcacatcaataggacggccttgaactgtaacgacagcctcaacaccggctggttagcagggcttttctatcacacgtacttgggagtcggccat

SEQ ID NO: 391920 - DNA, 140 bp, Artificial Sequence
  Synthetic
atggccgactcccaagtacgtgtgatagaaaagccctgctaaccagccggtgttgaggctgtcgttacagttcaaggccgtcctattgatgtgccaactgccattactgttgatcagctgggagacccagcatggcgtat

SEQ ID NO: 391921 - DNA, 140 bp, Artificial Sequence
  Synthetic
aggccctggctgctgatatgctgctgcctctcatgccaggcatccccttcctctcgtgccagaggggttataagggggagtggcgcggagatggcgtaatgcacaccacatgcccctgcggaccttttgggacagcggtg

SEQ ID NO: 391922 - DNA, 140 bp, Artificial Sequence
  Synthetic
caccgctgtcccaaaaggtccgcaggggcatgtggtgtgcattacgccatctccgcgccactcccccttataacccctctggcacgagaggaaggggatgcctggcatgagaggcagcagcatatcagcagccagggcct

SEQ ID NO: 391923 - DNA, 140 bp, Artificial Sequence
  Synthetic
atacgccatgctgggtctcccaccacgggccccggtgtacccatcccggcgccgaactacaagttcgcgctttggagggtgtccgccgaggagtacgtggaggttcgccgggtgggtgaccgtacttgggagtcggccat

SEQ ID NO: 391924 - DNA, 140 bp, Artificial Sequence
  Synthetic
atggccgactcccaagtacggtcacccacccggcgaacctccacgtactcctcggcggacaccctccaaagcgcgaacttgtagttcggcgccgggatgggtacaccggggcccgtggtgggagacccagcatggcgtat

SEQ ID NO: 391925 - DNA, 140 bp, Artificial Sequence
  Synthetic
aggccctggctgctgatatggggcgacagcagggggagcctgctctcccccaggcccatctcatacttgaagggctcttcgggtggtccgttgctctgcccctcggggcacgccgtgggcgaccttttgggacagcggtg

SEQ ID NO: 391926 - DNA, 140 bp, Artificial Sequence
  Synthetic
caccgctgtcccaaaaggtcgcccacggcgtgccccgaggggcagagcaacggaccacccgaagagcccttcaagtatgagatgggcctgggggagagcaggctccccctgctgtcgccccatatcagcagccagggcct

SEQ ID NO: 391927 - DNA, 140 bp, Artificial Sequence
  Synthetic
aggccctggctgctgatatggtaggactcaattcgttcgtggtgggatcccaactcccatgcgaaccagagccggacgtggctgtactgacatccatgctgacagacccatcacacataagaccttttgggacagcggtg

SEQ ID NO: 391928 - DNA, 140 bp, Artificial Sequence
  Synthetic
caccgctgtcccaaaaggtcttatgtgtgatgggtctgtcagcatggatgtcagtacagccacgtccggctctggttcgcatgggagttgggatcccaccacgaacgaattgagtcctaccatatcagcagccagggcct

SEQ ID NO: 391929 - DNA, 140 bp, Artificial Sequence
  Synthetic
  misc_feature (91)..(91): n is a, c, g, or t
atacgccatgctgggtctccgccggacgtggctgtactgacatccatgctgacagacccatcacacataacagcggagacggcgagccganggctggctcgggggtccccaccctcgttacgtacttgggagtcggccat

SEQ ID NO: 391930 - DNA, 140 bp, Artificial Sequence
  Synthetic
  misc_feature (50)..(50): n is a, c, g, or t
atggccgactcccaagtacgtaacgagggtggggacccccgagccagccntcggctcgccgtctccgctgttatgtgtgatgggtctgtcagcatggatgtcagtacagccacgtccggcggagacccagcatggcgtat

SEQ ID NO: 391931 - DNA, 140 bp, Artificial Sequence
  Synthetic
aggccctggctgctgatatgctggactcttttgagtcgtgtgtggctgagccagatgataacagggaggtctcggtcgccgcagaaattctgcgtccgaccaagaagtttcccccagctcgaccttttgggacagcggtg

SEQ ID NO: 391932 - DNA, 140 bp, Artificial Sequence
  Synthetic
caccgctgtcccaaaaggtcgagctgggggaaacttcttggtcggacgcagaatttctgcggcgaccgagacctccctgttatcatctggctcagccacacacgactcaaaagagtccagcatatcagcagccagggcct

SEQ ID NO: 391933 - DNA, 140 bp, Artificial Sequence
  Synthetic
atacgccatgctgggtctcccagcaagcaaacccccgttcctcctcccaggaggaagcggacggttcaactcactgagtccgttgtttctactgccctggcagaactggccgcaaagacccgtacttgggagtcggccat

SEQ ID NO: 391934 - DNA, 140 bp, Artificial Sequence
  Synthetic
atggccgactcccaagtacgggtctttgcggccagttctgccagggcagtagaaacaacggactcagtgagttgaaccgtccgcttcctcctgggaggaggaacgggggtttgcttgctgggagacccagcatggcgtat

SEQ ID NO: 391935 - DNA, 140 bp, Artificial Sequence
  Synthetic
aggccctggctgctgatatggcagcgggtggaatttcttctgacttcttggaagtcgaagaagactcctatggggttctcttatgatacccgctgctttgactccaccgtaaccgaaaaggaccttttgggacagcggtg

SEQ ID NO: 391936 - DNA, 140 bp, Artificial Sequence
  Synthetic
caccgctgtcccaaaaggtccttttcggttacggtggagtcaaagcagcgggtatcataagagaaccccataggagtcttcttcgacttccaagaagtcagaagaaattccacccgctgccatatcagcagccagggcct

SEQ ID NO: 391937 - DNA, 140 bp, Artificial Sequence
  Synthetic
  misc_feature (24)..(24): n is a, c, g, or t
  misc_feature (45)..(45): n is a, c, g, or t
  misc_feature (60)..(60): n is a, c, g, or t
  misc_feature (87)..(87): n is a, c, g, or t
  misc_feature (105)..(105): n is a, c, g, or t
  misc_feature (107)..(107): n is a, c, g, or t
  misc_feature (114)..(114): n is a, c, g, or t
atacgccatgctgggtctccgggngtggcctatttcagcatgcangctaattgggcaaangtcatcttagtcctattcctcttcgcnggggttgacgctgacacncncgtatcngggggtcgtacttgggagtcggccat

SEQ ID NO: 391938 - DNA, 140 bp, Artificial Sequence
  Synthetic
  misc_feature (27)..(27): n is a, c, g, or t
  misc_feature (34)..(34): n is a, c, g, or t
  misc_feature (36)..(36): n is a, c, g, or t
  misc_feature (54)..(54): n is a, c, g, or t
  misc_feature (81)..(81): n is a, c, g, or t
  misc_feature (96)..(96): n is a, c, g, or t
  misc_feature (117)..(117): n is a, c, g, or t
atggccgactcccaagtacgacccccngatacgngngtgtcagcgtcaaccccngcgaagaggaataggactaagatgacntttgcccaattagcntgcatgctgaaataggccacncccggagacccagcatggcgtat

SEQ ID NO: 391939 - DNA, 140 bp, Artificial Sequence
  Synthetic
  misc_feature (42)..(42): n is a, c, g, or t
atacgccatgctgggtctccctcagggtgtcccgaacggctngcaagttgcaggagccttgacagctttgaccaaggctggggcccacttggggtcgctaacatcagcggcccgtctgatcgtacttgggagtcggccat

SEQ ID NO: 391940 - DNA, 140 bp, Artificial Sequence
  Synthetic
  misc_feature (99)..(99): n is a, c, g, or t
atggccgactcccaagtacgatcagacgggccgctgatgttagcgaccccaagtgggccccagccttggtcaaagctgtcaaggctcctgcaacttgcnagccgttcgggacaccctgagggagacccagcatggcgtat

SEQ ID NO: 391941 - DNA, 140 bp, Artificial Sequence
  Synthetic
aggccctggctgctgatatggatgtttgggactggatatgcacggtgttgactgacttcaagacctggctccaatccaagctcctgccgcggttgccgggactccccttcctctcatgccgaccttttgggacagcggtg

SEQ ID NO: 391942 - DNA, 140 bp, Artificial Sequence
  Synthetic
caccgctgtcccaaaaggtcggcatgagaggaaggggagtcccggcaaccgcggcaggagcttggattggagccaggtcttgaagtcagtcaacaccgtgcatatccagtcccaaacatccatatcagcagccagggcct

SEQ ID NO: 391943 - DNA, 140 bp, Artificial Sequence
  Synthetic
  misc_feature (39)..(39): n is a, c, g, or t
  misc_feature (50)..(50): n is a, c, g, or t
  misc_feature (65)..(65): n is a, c, g, or t
  misc_feature (80)..(80): n is a, c, g, or t
  misc_feature (117)..(117): n is a, c, g, or t
atacgccatgctgggtctcctgcgggatgtggcccctgntcctcctactnctaatgctgcccganagggcttacgcatangaccgggaggtggcagggtcccttggtggcgccgtcnttgcgtacttgggagtcggccat

SEQ ID NO: 391944 - DNA, 140 bp, Artificial Sequence
  Synthetic
  misc_feature (24)..(24): n is a, c, g, or t
  misc_feature (61)..(61): n is a, c, g, or t
  misc_feature (76)..(76): n is a, c, g, or t
  misc_feature (91)..(91): n is a, c, g, or t
  misc_feature (102)..(102): n is a, c, g, or t
atggccgactcccaagtacgcaangacggcgccaccaagggaccctgccacctcccggtcntatgcgtaagccctntcgggcagcattagnagtaggaggancaggggccacatcccgcaggagacccagcatggcgtat

SEQ ID NO: 391945 - DNA, 140 bp, Artificial Sequence
  Synthetic
  misc_feature (29)..(29): n is a, c, g, or t
  misc_feature (33)..(33): n is a, c, g, or t
  misc_feature (84)..(84): n is a, c, g, or t
  misc_feature (102)..(102): n is a, c, g, or t
  misc_feature (104)..(104): n is a, c, g, or t
atacgccatgctgggtctcccgaggctangctncatgtctatgttccatccttcgacgtgcgcggtcctcgcgactcattgatnattcttgcagtcctggcntncccacatctgatatttcgtacttgggagtcggccat

SEQ ID NO: 391946 - DNA, 140 bp, Artificial Sequence
  Synthetic
  misc_feature (37)..(37): n is a, c, g, or t
  misc_feature (39)..(39): n is a, c, g, or t
  misc_feature (57)..(57): n is a, c, g, or t
  misc_feature (108)..(108): n is a, c, g, or t
  misc_feature (112)..(112): n is a, c, g, or t
atggccgactcccaagtacgaaatatcagatgtgggnangccaggactgcaagaatnatcaatgagtcgcgaggaccgcgcacgtcgaaggatggaacatagacatgnagcntagcctcgggagacccagcatggcgtat

SEQ ID NO: 391947 - DNA, 140 bp, Artificial Sequence
  Synthetic
aggccctggctgctgatatggagagccatagtggtctgcggaaccggtgagtacaccggaatcgccgggttgaccgggtcctttcttggattaaacccgctcaatgcccggaaatttggggaccttttgggacagcggtg

SEQ ID NO: 391948 - DNA, 140 bp, Artificial Sequence
  Synthetic
caccgctgtcccaaaaggtccccaaatttccgggcattgagcgggtttaatccaagaaaggacccggtcaacccggcgattccggtgtactcaccggttccgcagaccactatggctctccatatcagcagccagggcct

SEQ ID NO: 391949 - DNA, 140 bp, Artificial Sequence
  Synthetic
atacgccatgctgggtctcctctcagcacttaccgtacatcgagcaagggatgatgctcgccgagcagttcaagcagaaggccctcggcctcctgcagaccgcttcccgccaggcagaggcgtacttgggagtcggccat

SEQ ID NO: 391950 - DNA, 140 bp, Artificial Sequence
  Synthetic
atggccgactcccaagtacgcctctgcctggcgggaagcggtctgcaggaggccgagggccttctgcttgaactgctcggcgagcatcatcccttgctcgatgtacggtaagtgctgagaggagacccagcatggcgtat

SEQ ID NO: 391951 - DNA, 140 bp, Artificial Sequence
  Synthetic
  misc_feature (22)..(22): n is a, c, g, or t
  misc_feature (119)..(119): n is a, c, g, or t
aggccctggctgctgatatganacaggggaatcagtcacgttgctgggtggccttaactcctaccgtcgcagcgccatacatcggtgcgccacttgagtctctacggagtcatgtggantgaccttttgggacagcggtg

SEQ ID NO: 391952 - DNA, 140 bp, Artificial Sequence
  Synthetic
  misc_feature (22)..(22): n is a, c, g, or t
  misc_feature (119)..(119): n is a, c, g, or t
caccgctgtcccaaaaggtcantccacatgactccgtagagactcaagtggcgcaccgatgtatggcgctgcgacggtaggagttaaggccacccagcaacgtgactgattcccctgtntcatatcagcagccagggcct

SEQ ID NO: 391953 - DNA, 140 bp, Artificial Sequence
  Synthetic
atacgccatgctgggtctccccactggaccacccaggattgcaattgttccatctacacagggcacatcaccggccacagaatggcctgggacatgatgatgaactggagtccaacaacccgtacttgggagtcggccat

SEQ ID NO: 391954 - DNA, 140 bp, Artificial Sequence
  Synthetic
atggccgactcccaagtacgggttgttggactccagttcatcatcatgtcccaggccattctgtggccggtgatgtgccctgtgtagatggaacaattgcaatcctgggtggtccagtggggagacccagcatggcgtat

SEQ ID NO: 391955 - DNA, 140 bp, Artificial Sequence
  Synthetic
atacgccatgctgggtctcctgcaagccaattgggccaaagtcatcttagtcctgttcctttttgcaggggttgatgccagcacctacacgaccgggggggtggctggcagaggcgccagcgtacttgggagtcggccat

SEQ ID NO: 391956 - DNA, 140 bp, Artificial Sequence
  Synthetic
atggccgactcccaagtacgctggcgcctctgccagccacccccccggtcgtgtaggtgctggcatcaacccctgcaaaaaggaacaggactaagatgactttggcccaattggcttgcaggagacccagcatggcgtat

SEQ ID NO: 391957 - DNA, 140 bp, Artificial Sequence
  Synthetic
  misc_feature (49)..(49): n is a, c, g, or t
  misc_feature (58)..(58): n is a, c, g, or t
atacgccatgctgggtctccactttgcccaaggttggggcccactcaangccgctaanatcagcggcccgtctaatgaccggccttattgctggcactacgcacctcggccgtgcgggatcgtacttgggagtcggccat

SEQ ID NO: 391958 - DNA, 140 bp, Artificial Sequence
  Synthetic
  misc_feature (83)..(83): n is a, c, g, or t
  misc_feature (92)..(92): n is a, c, g, or t
atggccgactcccaagtacgatcccgcacggccgaggtgcgtagtgccagcaataaggccggtcattagacgggccgctgatnttagcggcnttgagtgggccccaaccttgggcaaagtggagacccagcatggcgtat

SEQ ID NO: 391959 - DNA, 140 bp, Artificial Sequence
  Synthetic
  misc_feature (65)..(65): n is a, c, g, or t
aggccctggctgctgatatgggggagaatgagactgatgtcttccttttgaactcgaccagaccnccgcatggcgcgtggtttggatgtgtgtggatgaacagcaccgggtttacaaaaggaccttttgggacagcggtg

SEQ ID NO: 391960 - DNA, 140 bp, Artificial Sequence
  Synthetic
  misc_feature (76)..(76): n is a, c, g, or t
caccgctgtcccaaaaggtccttttgtaaacccggtgctgttcatccacacacatccaaaccacgcgccatgcggnggtctggtcgagttcaaaaggaagacatcagtctcattctcccccatatcagcagccagggcct

SEQ ID NO: 391961 - DNA, 140 bp, Artificial Sequence
  Synthetic
atacgccatgctgggtctccgcagaggaggacgagcgggagatttccgtgcccgcagaaatcctgcggaagtctcggaaattcacccaggccctgcccatttgggcgcggccggactacacgtacttgggagtcggccat

SEQ ID NO: 391962 - DNA, 140 bp, Artificial Sequence
  Synthetic
atggccgactcccaagtacgtgtagtccggccgcgcccaaatgggcagggcctgggtgaatttccgagacttccgcaggatttctgcgggcacggaaatctcccgctcgtcctcctctgcggagacccagcatggcgtat

SEQ ID NO: 391963 - DNA, 140 bp, Artificial Sequence
  Synthetic
  misc_feature (84)..(84): n is a, c, g, or t
atacgccatgctgggtctcccggatcggggccctggatcacaccacggtgtttgatcgattacccgtaccgtctgtggcatttnccatgcaccatcaacttcactgtctttaagatcaggcgtacttgggagtcggccat

SEQ ID NO: 391964 - DNA, 140 bp, Artificial Sequence
  Synthetic
  misc_feature (57)..(57): n is a, c, g, or t
atggccgactcccaagtacgcctgatcttaaagacagtgaagttgatggtgcatggnaaatgccacagacggtacgggtaatcgatcaaacaccgtggtgtgatccagggccccgatccgggagacccagcatggcgtat

SEQ ID NO: 391965 - DNA, 140 bp, Artificial Sequence
  Synthetic
  misc_feature (34)..(34): n is a, c, g, or t
aggccctggctgctgatatggtctgtggcatttnccatgcaccatcaacttcactgtctttaagatcaggacatttgtcggcggtatagagcatcggatgcaggcggcatgcaactggacgaccttttgggacagcggtg

SEQ ID NO: 391966 - DNA, 140 bp, Artificial Sequence
  Synthetic
  misc_feature (107)..(107): n is a, c, g, or t
caccgctgtcccaaaaggtcgtccagttgcatgccgcctgcatccgatgctctataccgccgacaaatgtcctgatcttaaagacagtgaagttgatggtgcatggnaaatgccacagaccatatcagcagccagggcct

SEQ ID NO: 391967 - DNA, 140 bp, Artificial Sequence
  Synthetic
  misc_feature (103)..(103): n is a, c, g, or t
aggccctggctgctgatatgttaagtgggaatatgtggtgctcgtgttcctgcttctcgcggacgcgagagtctctgcttgcctgtggatgatgtttatggtntctcaggtcgaggcggcgaccttttgggacagcggtg

SEQ ID NO: 391968 - DNA, 140 bp, Artificial Sequence
  Synthetic
  misc_feature (38)..(38): n is a, c, g, or t
caccgctgtcccaaaaggtcgccgcctcgacctgaganaccataaacatcatccacaggcaagcagagactctcgcgtccgcgagaagcaggaacacgagcaccacatattcccacttaacatatcagcagccagggcct

SEQ ID NO: 391969 - DNA, 140 bp, Artificial Sequence
  Synthetic
aggccctggctgctgatatgagcctggggatccggatcttagcgacgggtcatggtcgacggtcagtagtgaggccggcacggaggacgtcgtgtgctgctcaatgtcttactcctggacgaccttttgggacagcggtg

SEQ ID NO: 391970 - DNA, 140 bp, Artificial Sequence
  Synthetic
caccgctgtcccaaaaggtcgtccaggagtaagacattgagcagcacacgacgtcctccgtgccggcctcactactgaccgtcgaccatgacccgtcgctaagatccggatccccaggctcatatcagcagccagggcct

SEQ ID NO: 391971 - DNA, 140 bp, Artificial Sequence
  Synthetic
  misc_feature (26)..(26): n is a, c, g, or t
  misc_feature (38)..(38): n is a, c, g, or t
  misc_feature (107)..(107): n is a, c, g, or t
atacgccatgctgggtctcccggctnccagctgctgcnacctacgcggcctgcggaatgtggcccctgctcctcctggttcttatgctgcccgagagggcttacgcntatgaccgggaggcgtacttgggagtcggccat

SEQ ID NO: 391972 - DNA, 140 bp, Artificial Sequence
  Synthetic
  misc_feature (34)..(34): n is a, c, g, or t
  misc_feature (103)..(103): n is a, c, g, or t
  misc_feature (115)..(115): n is a, c, g, or t
atggccgactcccaagtacgcctcccggtcatangcgtaagccctctcgggcagcataagaaccaggaggagcaggggccacattccgcaggccgcgtaggtngcagcagctggnagccgggagacccagcatggcgtat

SEQ ID NO: 391973 - DNA, 140 bp, Artificial Sequence
  Synthetic
  misc_feature (33)..(33): n is a, c, g, or t
  misc_feature (39)..(39): n is a, c, g, or t
  misc_feature (45)..(45): n is a, c, g, or t
  misc_feature (63)..(63): n is a, c, g, or t
  misc_feature (72)..(72): n is a, c, g, or t
  misc_feature (102)..(102): n is a, c, g, or t
atacgccatgctgggtctccatatttcatagcnaggacngaggcnaccctgcatgtctatgtnccatccttngacgtgcgcgggcctcgcgactcactgatnattctcgcggtcctggcccgtacttgggagtcggccat

SEQ ID NO: 391974 - DNA, 140 bp, Artificial Sequence
  Synthetic
  misc_feature (39)..(39): n is a, c, g, or t
  misc_feature (69)..(69): n is a, c, g, or t
  misc_feature (78)..(78): n is a, c, g, or t
  misc_feature (96)..(96): n is a, c, g, or t
  misc_feature (102)..(102): n is a, c, g, or t
  misc_feature (108)..(108): n is a, c, g, or t
atggccgactcccaagtacgggccaggaccgcgagaatnatcagtgagtcgcgaggcccgcgcacgtcnaaggatggnacatagacatgcagggtngcctcngtcctngctatgaaatatggagacccagcatggcgtat

SEQ ID NO: 391975 - DNA, 140 bp, Artificial Sequence
  Synthetic
  misc_feature (97)..(97): n is a, c, g, or t
  misc_feature (103)..(103): n is a, c, g, or t
atacgccatgctgggtctccgggcacatgcgctgattaagatctgcagcttgttgcgtggggtagtctatggcaagtattgccaaatggccgtgctnaaggtnggggccttgactggcaccgtacttgggagtcggccat

SEQ ID NO: 391976 - DNA, 140 bp, Artificial Sequence
  Synthetic
  misc_feature (38)..(38): n is a, c, g, or t
  misc_feature (44)..(44): n is a, c, g, or t
atggccgactcccaagtacggtgccagtcaaggccccnaccttnagcacggccatttggcaatacttgccatagactaccccacgcaacaagctgcagatcttaatcagcgcatgtgcccggagacccagcatggcgtat

SEQ ID NO: 391977 - DNA, 140 bp, Artificial Sequence
  Synthetic
aggccctggctgctgatatggaggaactactgtcttcacgcagaaagcgtctagccatggcgttagtatgagtgtcgtgcagcctccaggaccccccctcccgggagagccatagtggtcgaccttttgggacagcggtg

SEQ ID NO: 391978 - DNA, 140 bp, Artificial Sequence
  Synthetic
caccgctgtcccaaaaggtcgaccactatggctctcccgggagggggggtcctggaggctgcacgacactcatactaacgccatggctagacgctttctgcgtgaagacagtagttcctccatatcagcagccagggcct

SEQ ID NO: 391979 - DNA, 140 bp, Artificial Sequence
  Synthetic
  misc_feature (110)..(110): n is a, c, g, or t
atacgccatgctgggtctccaagaagatcatcgtctggggcgctgacaccgctgcgtgcggcgacatcattgggggcctacccgtttcagccaggttgggcaatgagatnttgctcgggccgtacttgggagtcggccat

SEQ ID NO: 391980 - DNA, 140 bp, Artificial Sequence
  Synthetic
  misc_feature (31)..(31): n is a, c, g, or t
atggccgactcccaagtacggcccgagcaanatctcattgcccaacctggctgaaacgggtaggcccccaatgatgtcgccgcacgcagcggtgtcagcgccccagacgatgatcttcttggagacccagcatggcgtat

SEQ ID NO: 391981 - DNA, 140 bp, Artificial Sequence
  Synthetic
  misc_feature (39)..(39): n is a, c, g, or t
  misc_feature (76)..(76): n is a, c, g, or t
atacgccatgctgggtctcccggcagactcggaaacatngaaggggtggagactccttgcccccatcacggcgtangcgcagcagacccgtggcttgttcagtaccatcataaccagtctcgtacttgggagtcggccat

SEQ ID NO: 391982 - DNA, 140 bp, Artificial Sequence
  Synthetic
  misc_feature (65)..(65): n is a, c, g, or t
  misc_feature (102)..(102): n is a, c, g, or t
atggccgactcccaagtacgagactggttatgatggtactgaacaagccacgggtctgctgcgcntacgccgtgatgggggcaaggagtctccaccccttcnatgtttccgagtctgccgggagacccagcatggcgtat

SEQ ID NO: 391983 - DNA, 140 bp, Artificial Sequence
  Synthetic
  misc_feature (78)..(78): n is a, c, g, or t
  misc_feature (118)..(118): n is a, c, g, or t
aggccctggctgctgatatgcaatcaaatgtacaccaatgttgaccaagacctggtggggtggccagcgccccccggngtcagatctcttgcgccgtgcacctgtggcgcgtcagacntggaccttttgggacagcggtg

SEQ ID NO: 391984 - DNA, 140 bp, Artificial Sequence
  Synthetic
  misc_feature (23)..(23): n is a, c, g, or t
  misc_feature (63)..(63): n is a, c, g, or t
caccgctgtcccaaaaggtccangtctgacgcgccacaggtgcacggcgcaagagatctgacnccggggggcgctggccaccccaccaggtcttggtcaacattggtgtacatttgattgcatatcagcagccagggcct

SEQ ID NO: 391985 - DNA, 140 bp, Artificial Sequence
  Synthetic
aggccctggctgctgatatgcttccggtggtccgctgctgtgccccatgggacacgctgccggcatattccgcgcggcggtgtgcactcgaggggtagccaaagcggtggactttgtcccgaccttttgggacagcggtg

SEQ ID NO: 391986 - DNA, 140 bp, Artificial Sequence
  Synthetic
caccgctgtcccaaaaggtcgggacaaagtccaccgctttggctacccctcgagtgcacaccgccgcgcggaatatgccggcagcgtgtcccatggggcacagcagcggaccaccggaagcatatcagcagccagggcct

SEQ ID NO: 391987 - DNA, 140 bp, Artificial Sequence
  Synthetic
aggccctggctgctgatatgggagtcctggcgggccttgcctactattccatggtagggaactgggctaaggtcctgattgtggcgctactcttcgccggcgttgacggggagacctacagaccttttgggacagcggtg

SEQ ID NO: 391988 - DNA, 140 bp, Artificial Sequence
  Synthetic
caccgctgtcccaaaaggtctgtaggtctccccgtcaacgccggcgaagagtagcgccacaatcaggaccttagcccagttccctaccatggaatagtaggcaaggcccgccaggactcccatatcagcagccagggcct

SEQ ID NO: 391989 - DNA, 140 bp, Artificial Sequence
  Synthetic
  misc_feature (59)..(59): n is a, c, g, or t
atacgccatgctgggtctccccaacagggagtggcaagagcaccaaagtcccggcggcntatgctgcccagggctataaggtgctggtgcttaacccctcggttgcggccacactgggatcgtacttgggagtcggccat

SEQ ID NO: 391990 - DNA, 140 bp, Artificial Sequence
  Synthetic
  misc_feature (82)..(82): n is a, c, g, or t
atggccgactcccaagtacgatcccagtgtggccgcaaccgaggggttaagcaccagcaccttatagccctgggcagcatangccgccgggactttggtgctcttgccactccctgttggggagacccagcatggcgtat

SEQ ID NO: 391991 - DNA, 140 bp, Artificial Sequence
  Synthetic
atacgccatgctgggtctccacagtcctggatcaagcggagaccgctggagcgcgccttgtcgtgctcgcgaccgctaccccgccagggtcagtgactacacctcattctaacatagaggcgtacttgggagtcggccat

SEQ ID NO: 391992 - DNA, 140 bp, Artificial Sequence
  Synthetic
atggccgactcccaagtacgcctctatgttagaatgaggtgtagtcactgaccctggcggggtagcggtcgcgagcacgacaaggcgcgctccagcggtctccgcttgatccaggactgtggagacccagcatggcgtat

SEQ ID NO: 391993 - DNA, 140 bp, Artificial Sequence
  Synthetic
aggccctggctgctgatatggaccgctaccccgccagggtcagtgactacacctcattctaacatagaggaggtcgctctgccgacaacgggggaagtacccttttacggcaaggcgatcgaccttttgggacagcggtg

SEQ ID NO: 391994 - DNA, 140 bp, Artificial Sequence
  Synthetic
caccgctgtcccaaaaggtcgatcgccttgccgtaaaagggtacttcccccgttgtcggcagagcgacctcctctatgttagaatgaggtgtagtcactgaccctggcggggtagcggtccatatcagcagccagggcct

SEQ ID NO: 391995 - DNA, 140 bp, Artificial Sequence
  Synthetic
aggccctggctgctgatatgtggcacatcaacaggactgctctgaactgcaatgactccctcaacaccgggttcctcgccgcgctgttctacacacacaggttcaacgcgtccggatgtcgaccttttgggacagcggtg

SEQ ID NO: 391996 - DNA, 140 bp, Artificial Sequence
  Synthetic
caccgctgtcccaaaaggtcgacatccggacgcgttgaacctgtgtgtgtagaacagcgcggcgaggaacccggtgttgagggagtcattgcagttcagagcagtcctgttgatgtgccacatatcagcagccagggcct

SEQ ID NO: 391997 - DNA, 140 bp, Artificial Sequence
  Synthetic
atacgccatgctgggtctccactgcaatgatagccttcacaccgggtttgtagcggggcttttctatgcccacagattcaactctacaggctgtcccgagaggttggccagctgcaagcgcgtacttgggagtcggccat

SEQ ID NO: 391998 - DNA, 140 bp, Artificial Sequence
  Synthetic
atggccgactcccaagtacgcgcttgcagctggccaacctctcgggacagcctgtagagttgaatctgtgggcatagaaaagccccgctacaaacccggtgtgaaggctatcattgcagtggagacccagcatggcgtat

SEQ ID NO: 391999 - DNA, 140 bp, Artificial Sequence
  Synthetic
aggccctggctgctgatatgcacagattcaactctacaggctgtcccgagaggttggccagctgcaagcgcctcactgactttgcccagggctggggccctatcagttacaccaatggaagaccttttgggacagcggtg

SEQ ID NO: 392000 - DNA, 140 bp, Artificial Sequence
  Synthetic
caccgctgtcccaaaaggtcttccattggtgtaactgatagggccccagccctgggcaaagtcagtgaggcgcttgcagctggccaacctctcgggacagcctgtagagttgaatctgtgcatatcagcagccagggcct

SEQ ID NO: 392001 - DNA, 140 bp, Artificial Sequence
  Synthetic
  misc_feature (28)..(28): n is a, c, g, or t
  misc_feature (47)..(47): n is a, c, g, or t
  misc_feature (55)..(55): n is a, c, g, or t
  misc_feature (61)..(61): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (89)..(89): n is a, c, g, or t
  misc_feature (99)..(99): n is a, c, g, or t
  misc_feature (102)..(102): n is a, c, g, or t
  misc_feature (106)..(106): n is a, c, g, or t
  misc_feature (116)..(116): n is a, c, g, or t
atacgccatgctgggtctcctctggcgnctccgccaagctgggacancatgtggnagtgcntaattcgncncnagcntnctntgcgcgngcccacaccnctnctcnacaggttggngtctcgtacttgggagtcggccat

SEQ ID NO: 392002 - DNA, 140 bp, Artificial Sequence
  Synthetic
  misc_feature (25)..(25): n is a, c, g, or t
  misc_feature (35)..(35): n is a, c, g, or t
  misc_feature (39)..(39): n is a, c, g, or t
  misc_feature (42)..(42): n is a, c, g, or t
  misc_feature (52)..(52): n is a, c, g, or t
  misc_feature (59)..(59): n is a, c, g, or t
  misc_feature (62)..(62): n is a, c, g, or t
  misc_feature (64)..(64): n is a, c, g, or t
  misc_feature (68)..(68): n is a, c, g, or t
  misc_feature (70)..(70): n is a, c, g, or t
  misc_feature (72)..(72): n is a, c, g, or t
  misc_feature (80)..(80): n is a, c, g, or t
  misc_feature (86)..(86): n is a, c, g, or t
  misc_feature (94)..(94): n is a, c, g, or t
  misc_feature (113)..(113): n is a, c, g, or t
atggccgactcccaagtacgagacnccaacctgtngagnagnggtgtgggcncgcgcanagnangctngngncgaattangcactnccacatgntgtcccagcttggcggagncgccagaggagacccagcatggcgtat

SEQ ID NO: 392003 - DNA, 140 bp, Artificial Sequence
  Synthetic
  misc_feature (51)..(51): n is a, c, g, or t
  misc_feature (99)..(99): n is a, c, g, or t
aggccctggctgctgatatgaccagtgatccagtccaacttcgctaaactngaacagttctgggcgaagcacatgtggaacttcatcagcggcgttcantatctcgctggactgtctactgaccttttgggacagcggtg

SEQ ID NO: 392004 - DNA, 140 bp, Artificial Sequence
  Synthetic
  misc_feature (42)..(42): n is a, c, g, or t
  misc_feature (90)..(90): n is a, c, g, or t
caccgctgtcccaaaaggtcagtagacagtccagcgagatantgaacgccgctgatgaagttccacatgtgcttcgcccagaactgttcnagtttagcgaagttggactggatcactggtcatatcagcagccagggcct

SEQ ID NO: 392005 - DNA, 140 bp, Artificial Sequence
  Synthetic
aggccctggctgctgatatgaacaccggctttgtagcagggcttttctattaccacaaattcaactcttcaggctgtcccgagaggttggccagctgccgacgcatcaccgattttgcccgaccttttgggacagcggtg

SEQ ID NO: 392006 - DNA, 140 bp, Artificial Sequence
  Synthetic
caccgctgtcccaaaaggtcgggcaaaatcggtgatgcgtcggcagctggccaacctctcgggacagcctgaagagttgaatttgtggtaatagaaaagccctgctacaaagccggtgttcatatcagcagccagggcct

SEQ ID NO: 392007 - DNA, 140 bp, Artificial Sequence
  Synthetic
  misc_feature (112)..(112): n is a, c, g, or t
atacgccatgctgggtctccggtgggtggcctcgcaaattgcgactccgacagcttccaccgcatttgtcgtgagcgggttggcgggggcggcagttggcagtgtgggcctnggcaagatcgtacttgggagtcggccat

SEQ ID NO: 392008 - DNA, 140 bp, Artificial Sequence
  Synthetic
  misc_feature (29)..(29): n is a, c, g, or t
atggccgactcccaagtacgatcttgccnaggcccacactgccaactgccgcccccgccaacccgctcacgacaaatgcggtggaagctgtcggagtcgcaatttgcgaggccacccaccggagacccagcatggcgtat

SEQ ID NO: 392009 - DNA, 140 bp, Artificial Sequence
  Synthetic
  misc_feature (22)..(22): n is a, c, g, or t
atacgccatgctgggtctcctntggtagacattctcgccggttacggcgccggcgtagccggcgctgtggtcactttcaagatcatgagcggcgagatgccgtccacagaggacttggtacgtacttgggagtcggccat

SEQ ID NO: 392010 - DNA, 140 bp, Artificial Sequence
  Synthetic
  misc_feature (119)..(119): n is a, c, g, or t
atggccgactcccaagtacgtaccaagtcctctgtggacggcatctcgccgctcatgatcttgaaagtgaccacagcgccggctacgccggcgccgtaaccggcgagaatgtctaccanaggagacccagcatggcgtat

SEQ ID NO: 392011 - DNA, 140 bp, Artificial Sequence
  Synthetic
aggccctggctgctgatatgggggggttgcgaaggcggtggacttcatacccgttgagtctatggaaactaccatgcggtctccggtcttcacagacaactcatcccccccggctgtaccgaccttttgggacagcggtg

SEQ ID NO: 392012 - DNA, 140 bp, Artificial Sequence
  Synthetic
caccgctgtcccaaaaggtcggtacagccgggggggatgagttgtctgtgaagaccggagaccgcatggtagtttccatagactcaacgggtatgaagtccaccgccttcgcaacccccccatatcagcagccagggcct

SEQ ID NO: 392013 - DNA, 140 bp, Artificial Sequence
  Synthetic
aggccctggctgctgatatggtcttcggacccctttggattcttcaagccagtttgcttaaagtgccctacttcgtgcgcgttcaaggccttctccggatctgcgcgctagcgcggaagagaccttttgggacagcggtg

SEQ ID NO: 392014 - DNA, 140 bp, Artificial Sequence
  Synthetic
caccgctgtcccaaaaggtctcttccgcgctagcgcgcagatccggagaaggccttgaacgcgcacgaagtagggcactttaagcaaactggcttgaagaatccaaaggggtccgaagaccatatcagcagccagggcct

SEQ ID NO: 392015 - DNA, 140 bp, Artificial Sequence
  Synthetic
aggccctggctgctgatatggctataagggagagtggcgtggcgatggcgtgatgcacaccacatgcccttgcggagcagagctggcaggccacatcaagaacggctcgatgagaatcacgaccttttgggacagcggtg

SEQ ID NO: 392016 - DNA, 140 bp, Artificial Sequence
  Synthetic
caccgctgtcccaaaaggtcgtgattctcatcgagccgttcttgatgtggcctgccagctctgctccgcaagggcatgtggtgtgcatcacgccatcgccacgccactctcccttatagccatatcagcagccagggcct

SEQ ID NO: 392017 - DNA, 140 bp, Artificial Sequence
  Synthetic
atacgccatgctgggtctccgcgctttggagggtgtccgccgaggagtacgtggaggttcgcagagtgggtgatttccattacatcaccggggtaacacaagacaacatcaagtgcccctcgtacttgggagtcggccat

SEQ ID NO: 392018 - DNA, 140 bp, Artificial Sequence
  Synthetic
atggccgactcccaagtacgaggggcacttgatgttgtcttgtgttaccccggtgatgtaatggaaatcacccactctgcgaacctccacgtactcctcggcggacaccctccaaagcgcggagacccagcatggcgtat

SEQ ID NO: 392019 - DNA, 140 bp, Artificial Sequence
  Synthetic
  misc_feature (24)..(24): n is a, c, g, or t
  misc_feature (51)..(51): n is a, c, g, or t
aggccctggctgctgatatgctcngtaggactcaattcgttcgtggtgggntcacaactcccatgcgagccagagccggacgtggccgtgctgacatccatgctgacagacccatcacacgaccttttgggacagcggtg

SEQ ID NO: 392020 - DNA, 140 bp, Artificial Sequence
  Synthetic
  misc_feature (90)..(90): n is a, c, g, or t
  misc_feature (117)..(117): n is a, c, g, or t
caccgctgtcccaaaaggtcgtgtgatgggtctgtcagcatggatgtcagcacggccacgtccggctctggctcgcatgggagttgtgancccaccacgaacgaattgagtcctacngagcatatcagcagccagggcct

SEQ ID NO: 392021 - DNA, 140 bp, Artificial Sequence
  Synthetic
  misc_feature (88)..(88): n is a, c, g, or t
aggccctggctgctgatatgcagagccggacgtggccgtgctgacatccatgctgacagacccatcacacataacggcggaggcagcnggccgaagactggctcgggggtcaccaccctcgaccttttgggacagcggtg

SEQ ID NO: 392022 - DNA, 140 bp, Artificial Sequence
  Synthetic
  misc_feature (53)..(53): n is a, c, g, or t
caccgctgtcccaaaaggtcgagggtggtgacccccgagccagtcttcggccngctgcctccgccgttatgtgtgatgggtctgtcagcatggatgtcagcacggccacgtccggctctgcatatcagcagccagggcct

SEQ ID NO: 392023 - DNA, 140 bp, Artificial Sequence
  Synthetic
  misc_feature (33)..(33): n is a, c, g, or t
atacgccatgctgggtctccctcttgtgggggnctgccgctacccgggttgagacagacgagaaggtgataatactggactcttttgagccatgtgtggctgtaccggatgatgacagggcgtacttgggagtcggccat

SEQ ID NO: 392024 - DNA, 140 bp, Artificial Sequence
  Synthetic
  misc_feature (108)..(108): n is a, c, g, or t
atggccgactcccaagtacgccctgtcatcatccggtacagccacacatggctcaaaagagtccagtattatcaccttctcgtctgtctcaacccgggtagcggcagncccccacaagagggagacccagcatggcgtat

SEQ ID NO: 392025 - DNA, 140 bp, Artificial Sequence
  Synthetic
  misc_feature (34)..(34): n is a, c, g, or t
  misc_feature (41)..(41): n is a, c, g, or t
  misc_feature (43)..(43): n is a, c, g, or t
  misc_feature (100)..(100): n is a, c, g, or t
  misc_feature (120)..(120): n is a, c, g, or t
atacgccatgctgggtctccaggtctcggtcgcngcggaantnctgcgtccgaccaagaagttccccccagctctaccgatctgggcccgaccagattanaatccacctcttactgagancgtacttgggagtcggccat

SEQ ID NO: 392026 - DNA, 140 bp, Artificial Sequence
  Synthetic
  misc_feature (21)..(21): n is a, c, g, or t
  misc_feature (41)..(41): n is a, c, g, or t
  misc_feature (98)..(98): n is a, c, g, or t
  misc_feature (100)..(100): n is a, c, g, or t
  misc_feature (107)..(107): n is a, c, g, or t
atggccgactcccaagtacgntctcagtaagaggtggattntaatctggtcgggcccagatcggtagagctggggggaacttcttggtcggacgcagnanttccgcngcgaccgagacctggagacccagcatggcgtat

SEQ ID NO: 392027 - DNA, 140 bp, Artificial Sequence
  Synthetic
atacgccatgctgggtctcctcgtgtgctgttcaatgtcatattcatggactggggcgcttgtgacaccttgtgcggctgaagaatcaaagctgccaattagccccctgagcaattcactcgtacttgggagtcggccat

SEQ ID NO: 392028 - DNA, 140 bp, Artificial Sequence
  Synthetic
atggccgactcccaagtacgagtgaattgctcagggggctaattggcagctttgattcttcagccgcacaaggtgtcacaagcgccccagtccatgaatatgacattgaacagcacacgaggagacccagcatggcgtat

SEQ ID NO: 392029 - DNA, 140 bp, Artificial Sequence
  Synthetic
atacgccatgctgggtctcctacaatgaagtgctcaaggagatcaaggcacgagcatccagagtgaaggcacgcttgcttaccacagaggaagcttgcgacctgacgcccccccactcagcgtacttgggagtcggccat

SEQ ID NO: 392030 - DNA, 140 bp, Artificial Sequence
  Synthetic
atggccgactcccaagtacgctgagtgggggggcgtcaggtcgcaagcttcctctgtggtaagcaagcgtgccttcactctggatgctcgtgccttgatctccttgagcacttcattgtaggagacccagcatggcgtat

SEQ ID NO: 392031 - DNA, 140 bp, Artificial Sequence
  Synthetic
aggccctggctgctgatatgaagatccagcttgtaaacaccagcggcagctggcacatcaacaggactgccctgaactgcaatgactccctccagactgggttccttgccgcgctgttctgaccttttgggacagcggtg

SEQ ID NO: 392032 - DNA, 140 bp, Artificial Sequence
  Synthetic
caccgctgtcccaaaaggtcagaacagcgcggcaaggaacccagtctggagggagtcattgcagttcagggcagtcctgttgatgtgccagctgccgctggtgtttacaagctggatcttcatatcagcagccagggcct

SEQ ID NO: 392033 - DNA, 140 bp, Artificial Sequence
  Synthetic
  misc_feature (22)..(22): n is a, c, g, or t
atacgccatgctgggtctcctnctcctcaccactacaacatggcaagtcctcccctgctctttcaccactctacctgccctttccaccggcttgatccacctccaccaaaacatcgtggacgtacttgggagtcggccat

SEQ ID NO: 392034 - DNA, 140 bp, Artificial Sequence
  Synthetic
  misc_feature (119)..(119): n is a, c, g, or t
atggccgactcccaagtacgtccacgatgttttggtggaggtggatcaagccggtggaaagggcaggtagagtggtgaaagagcaggggaggacttgccatgttgtagtggtgaggagnaggagacccagcatggcgtat

SEQ ID NO: 392035 - DNA, 140 bp, Artificial Sequence
  Synthetic
atacgccatgctgggtctcccacttctctcgtgcctgactgtccccgcttctgccgttaactatcgtaacacctcgggcatctatcatgttaccaatgactgcccgaattcaagcatagtcgtacttgggagtcggccat

SEQ ID NO: 392036 - DNA, 140 bp, Artificial Sequence
  Synthetic
atggccgactcccaagtacgactatgcttgaattcgggcagtcattggtaacatgatagatgcccgaggtgttacgatagttaacggcagaagcggggacagtcaggcacgagagaagtgggagacccagcatggcgtat

SEQ ID NO: 392037 - DNA, 140 bp, Artificial Sequence
  Synthetic
aggccctggctgctgatatggtgctcacttccatgctcaccgacccctcccacattacagcagagacggctaagcgtaggctggccagggggtctcccccctccttggccagctcttcaggaccttttgggacagcggtg

SEQ ID NO: 392038 - DNA, 140 bp, Artificial Sequence
  Synthetic
caccgctgtcccaaaaggtcctgaagagctggccaaggaggggggagaccccctggccagcctacgcttagccgtctctgctgtaatgtgggaggggtcggtgagcatggaagtgagcaccatatcagcagccagggcct

SEQ ID NO: 392039 - DNA, 140 bp, Artificial Sequence
  Synthetic
atacgccatgctgggtctccttgcttgctgggggccactggggtgtcctcgtgggagtggcctatttcagcatgcaagccaattgggccaaagtcatcttggtcttattcctctttgcagcgtacttgggagtcggccat

SEQ ID NO: 392040 - DNA, 140 bp, Artificial Sequence
  Synthetic
atggccgactcccaagtacgctgcaaagaggaataagaccaagatgactttggcccaattggcttgcatgctgaaataggccactcccacgaggacaccccagtggcccccagcaagcaaggagacccagcatggcgtat

SEQ ID NO: 392041 - DNA, 140 bp, Artificial Sequence
  Synthetic
atacgccatgctgggtctcccattaacagcaacgggagctggcatgtaaacaggactgccctcaactgcaacgacagtttaaacactgggttcttggctagcctgttctacaccaacaggcgtacttgggagtcggccat

SEQ ID NO: 392042 - DNA, 140 bp, Artificial Sequence
  Synthetic
atggccgactcccaagtacgcctgttggtgtagaacaggctagccaagaacccagtgtttaaactgtcgttgcagttgagggcagtcctgtttacatgccagctcccgttgctgttaatgggagacccagcatggcgtat

SEQ ID NO: 392043 - DNA, 140 bp, Artificial Sequence
  Synthetic
atacgccatgctgggtctcccatctgaagacaggccttactgctggcactacccgcctcgaccctgcgggattgtgccggcactcagtgtgtgtggccccgtgtattgctttactcccagcgtacttgggagtcggccat

SEQ ID NO: 392044 - DNA, 140 bp, Artificial Sequence
  Synthetic
atggccgactcccaagtacgctgggagtaaagcaatacacggggccacacacactgagtgccggcacaatcccgcagggtcgaggcgggtagtgccagcagtaaggcctgtcttcagatgggagacccagcatggcgtat

SEQ ID NO: 392045 - DNA, 140 bp, Artificial Sequence
  Synthetic
aggccctggctgctgatatggcgctgagcaactcgttgctacgacaccacaatctggtatattccaccacctcacgcagcgcttgccaaaggcagaagaaagtcacatttgacagactgcgaccttttgggacagcggtg

SEQ ID NO: 392046 - DNA, 140 bp, Artificial Sequence
  Synthetic
caccgctgtcccaaaaggtcgcagtctgtcaaatgtgactttcttctgcctttggcaagcgctgcgtgaggtggtggaatataccagattgtggtgtcgtagcaacgagttgctcagcgccatatcagcagccagggcct

SEQ ID NO: 392047 - DNA, 140 bp, Artificial Sequence
  Synthetic
atacgccatgctgggtctcccctgccccactgactgtttcaggaagcatccggagaccacctacgccaaatgcgggtcaggcccctggatcacaccacgatgcttgattcactatccatacgtacttgggagtcggccat

SEQ ID NO: 392048 - DNA, 140 bp, Artificial Sequence
  Synthetic
atggccgactcccaagtacgtatggatagtgaatcaagcatcgtggtgtgatccaggggcctgacccgcatttggcgtaggtggtctccggatgcttcctgaaacagtcagtggggcaggggagacccagcatggcgtat

SEQ ID NO: 392049 - DNA, 140 bp, Artificial Sequence
  Synthetic
aggccctggctgctgatatgggacctttattggcggtatagaacatcggatggaggcagcatgcaactggaccaggggggaagtctgcggcttggagcatagggatcgcgcagaactgtcgaccttttgggacagcggtg

SEQ ID NO: 392050 - DNA, 140 bp, Artificial Sequence
  Synthetic
caccgctgtcccaaaaggtcgacagttctgcgcgatccctatgctccaagccgcagacttcccccctggtccagttgcatgctgcctccatccgatgttctataccgccaataaaggtcccatatcagcagccagggcct

SEQ ID NO: 392051 - DNA, 140 bp, Artificial Sequence
  Synthetic
atacgccatgctgggtctccgcccctgctccttaccactacaacgtggcaagtcctcccctgctcttttaccactctacctgccctttctaccggcttgattcacctccaccaaaatgtccgtacttgggagtcggccat

SEQ ID NO: 392052 - DNA, 140 bp, Artificial Sequence
  Synthetic
atggccgactcccaagtacggacattttggtggaggtgaatcaagccggtagaaagggcaggtagagtggtaaaagagcaggggaggacttgccacgttgtagtggtaaggagcaggggcggagacccagcatggcgtat

SEQ ID NO: 392053 - DNA, 140 bp, Artificial Sequence
  Synthetic
atacgccatgctgggtctcctggcttctggtacgccatcttcttcatctgcatcgcctggcacgtcaagggtcggcttccggctgctgctacctacgtggcctgcgggatgtggcccctgcgtacttgggagtcggccat

SEQ ID NO: 392054 - DNA, 140 bp, Artificial Sequence
  Synthetic
atggccgactcccaagtacgcaggggccacatcccgcaggccacgtaggtagcagcagccggaagccgacccttgacgtgccaggcgatgcagatgaagaagatggcgtaccagaagccaggagacccagcatggcgtat

SEQ ID NO: 392055 - DNA, 140 bp, Artificial Sequence
  Synthetic
atacgccatgctgggtctcccactgtctccccactacaagtcatggctggctaagggactatggtggattcagtatttcatagctagggccgaggccttggtgcatgtctatgttccatccgtacttgggagtcggccat

SEQ ID NO: 392056 - DNA, 140 bp, Artificial Sequence
  Synthetic
atggccgactcccaagtacggatggaacatagacatgcaccaaggcctcggccctagctatgaaatactgaatccaccatagtcccttagccagccatgacttgtagtggggagacagtgggagacccagcatggcgtat

SEQ ID NO: 392057 - DNA, 140 bp, Artificial Sequence
  Synthetic
atacgccatgctgggtctccatggcaagtattgccaaatggtcgtgcttaaaatgggggccctgactggtacttacatctatgaccaccttactcccctgtcagactgggccgctgagggcgtacttgggagtcggccat

SEQ ID NO: 392058 - DNA, 140 bp, Artificial Sequence
  Synthetic
atggccgactcccaagtacgccctcagcggcccagtctgacaggggagtaaggtggtcatagatgtaagtaccagtcagggcccccattttaagcacgaccatttggcaatacttgccatggagacccagcatggcgtat

SEQ ID NO: 392059 - DNA, 140 bp, Artificial Sequence
  Synthetic
aggccctggctgctgatatgacttacatctatgaccaccttactcccctgtcagactgggccgctgagggcctccgcgatttagcggtagccctggagccggttgtgttcacgcccatgggaccttttgggacagcggtg

SEQ ID NO: 392060 - DNA, 140 bp, Artificial Sequence
  Synthetic
caccgctgtcccaaaaggtcccatgggcgtgaacacaaccggctccagggctaccgctaaatcgcggaggccctcagcggcccagtctgacaggggagtaaggtggtcatagatgtaagtcatatcagcagccagggcct

SEQ ID NO: 392061 - DNA, 140 bp, Artificial Sequence
  Synthetic
aggccctggctgctgatatgatgaaggttggggtaaacactccggcctcctaggccatttcctgttttttttttttttttccccctttttttttttttttttttttttttttttttccccgaccttttgggacagcggtg

SEQ ID NO: 392062 - DNA, 140 bp, Artificial Sequence
  Synthetic
caccgctgtcccaaaaggtcggggaaaaaaaaaaaaaaaaaaaaaaaaaaaaaaagggggaaaaaaaaaaaaaaaacaggaaatggcctaggaggccggagtgtttaccccaaccttcatcatatcagcagccagggcct

SEQ ID NO: 392063 - DNA, 140 bp, Artificial Sequence
  Synthetic
atacgccatgctgggtctccctcactggcagggacaccaatgaaaattgtggtgaagtacaggtcctgtccaccgccacgcagtccttcctgggtactgcggtcaacggcgtgatgtggtcgtacttgggagtcggccat

SEQ ID NO: 392064 - DNA, 140 bp, Artificial Sequence
  Synthetic
atggccgactcccaagtacgaccacatcacgccgttgaccgcagtacccaggaaggactgcgtggcggtggacaggacctgtacttcaccacaattttcattggtgtccctgccagtgagggagacccagcatggcgtat

SEQ ID NO: 392065 - DNA, 140 bp, Artificial Sequence
  Synthetic
aggccctggctgctgatatgtgatggcttttacagctgccgtcaccagcccactaaccactagccaaaccctcctcttcaacatattgggggggtgggtggctgcccagctcgccgccccgaccttttgggacagcggtg

SEQ ID NO: 392066 - DNA, 140 bp, Artificial Sequence
  Synthetic
caccgctgtcccaaaaggtcggggcggcgagctgggcagccacccacccccccaatatgttgaagaggagggtttggctagtggttagtgggctggtgacggcagctgtaaaagccatcacatatcagcagccagggcct

SEQ ID NO: 392067 - DNA, 140 bp, Artificial Sequence
  Synthetic
atacgccatgctgggtctcccaccaacaggaagtggcaagagcaccaaagtcccggcagcgtacgcagctcagggttataaagtgttagtgcttaacccctcggttgcggccacactgggcgtacttgggagtcggccat

SEQ ID NO: 392068 - DNA, 140 bp, Artificial Sequence
  Synthetic
atggccgactcccaagtacgcccagtgtggccgcaaccgaggggttaagcactaacactttataaccctgagctgcgtacgctgccgggactttggtgctcttgccacttcctgttggtgggagacccagcatggcgtat

SEQ ID NO: 392069 - DNA, 140 bp, Artificial Sequence
  Synthetic
aggccctggctgctgatatggattgtgatgctactttttgccggcgttgacgggactaccagcgtgacggggggagtggagggtcgcaacgccctcgggctgacgtctctcttttcaccggaccttttgggacagcggtg

SEQ ID NO: 392070 - DNA, 140 bp, Artificial Sequence
  Synthetic
caccgctgtcccaaaaggtccggtgaaaagagagacgtcagcccgagggcgttgcgaccctccactccccccgtcacgctggtagtcccgtcaacgccggcaaaaagtagcatcacaatccatatcagcagccagggcct

SEQ ID NO: 392071 - DNA, 140 bp, Artificial Sequence
  Synthetic
aggccctggctgctgatatgatcaatcgtacggccctgaactgtaatgcgagcctcgacactggctgggtagcggggctcttctattaccacaaattcaactcttcaggctgccccgagagaccttttgggacagcggtg

SEQ ID NO: 392072 - DNA, 140 bp, Artificial Sequence
  Synthetic
caccgctgtcccaaaaggtctctcggggcagcctgaagagttgaatttgtggtaatagaagagccccgctacccagccagtgtcgaggctcgcattacagttcagggccgtacgattgatcatatcagcagccagggcct

SEQ ID NO: 392073 - DNA, 140 bp, Artificial Sequence
  Synthetic
atacgccatgctgggtctcccacttacactgagcctaacagcccggaccagaggccctactgctggcactacgcgcctcgacggtgtggtatcgtgcccgcgtcggaggtgtgcggtccacgtacttgggagtcggccat

SEQ ID NO: 392074 - DNA, 140 bp, Artificial Sequence
  Synthetic
atggccgactcccaagtacgtggaccgcacacctccgacgcgggcacgataccacaccgtcgaggcgcgtagtgccagcagtagggcctctggtccgggctgttaggctcagtgtaagtgggagacccagcatggcgtat

SEQ ID NO: 392075 - DNA, 140 bp, Artificial Sequence
  Synthetic
atacgccatgctgggtctcctggtgattgtcgggagagttgtcctgtcgggccagcctgctgtcattcctgaccgcgaggtgctctaccaacagttcgacgaaatggaggagtgctctaacgtacttgggagtcggccat

SEQ ID NO: 392076 - DNA, 140 bp, Artificial Sequence
  Synthetic
atggccgactcccaagtacgttagagcactcctccatttcgtcgaactgttggtagagcacctcgcggtcaggaatgacagcaggctggcccgacaggacaactctcccgacaatcaccaggagacccagcatggcgtat

SEQ ID NO: 392077 - DNA, 140 bp, Artificial Sequence
  Synthetic
atacgccatgctgggtctccatcaatcgaacggccctgaactgcaatgcgagcctcaacactggttggttagcggggctcctctatgccaacaaatttaatgcttcaggctgccccgagacgtacttgggagtcggccat

SEQ ID NO: 392078 - DNA, 140 bp, Artificial Sequence
  Synthetic
atggccgactcccaagtacgtctcggggcagcctgaagcattaaatttgttggcatagaggagccccgctaaccaaccagtgttgaggctcgcattgcagttcagggccgttcgattgatggagacccagcatggcgtat

SEQ ID NO: 392079 - DNA, 140 bp, Artificial Sequence
  Synthetic
atacgccatgctgggtctccggttacttttaagatcatgagcggcgagatgccatccacagaggacttggtaaacttgctcccagccattctatcgcctggggcactggtagtgggggtgcgtacttgggagtcggccat

SEQ ID NO: 392080 - DNA, 140 bp, Artificial Sequence
  Synthetic
atggccgactcccaagtacgcacccccactaccagtgccccaggcgatagaatggctgggagcaagtttaccaagtcctctgtggatggcatctcgccgctcatgatcttaaaagtaaccggagacccagcatggcgtat

SEQ ID NO: 392081 - DNA, 140 bp, Artificial Sequence
  Synthetic
aggccctggctgctgatatgtatgggcacgcccggactacaatcctccactgctagagtcctggaaggacccggactacgtccctccggtggtacacggatgcccattgccacctaccaagaccttttgggacagcggtg

SEQ ID NO: 392082 - DNA, 140 bp, Artificial Sequence
  Synthetic
caccgctgtcccaaaaggtcttggtaggtggcaatgggcatccgtgtaccaccggagggacgtagtccgggtccttccaggactctagcagtggaggattgtagtccgggcgtgcccatacatatcagcagccagggcct

SEQ ID NO: 392083 - DNA, 140 bp, Artificial Sequence
  Synthetic
aggccctggctgctgatatgggaggggtgggcaacaacaccttgcactgccccactgactgtttccgcaagcatccggaagccacatactctcggtgcggctccggtccctggatcacacgaccttttgggacagcggtg

SEQ ID NO: 392084 - DNA, 140 bp, Artificial Sequence
  Synthetic
caccgctgtcccaaaaggtcgtgtgatccagggaccggagccgcaccgagagtatgtggcttccggatgcttgcggaaacagtcagtggggcagtgcaaggtgttgttgcccacccctcccatatcagcagccagggcct

SEQ ID NO: 392085 - DNA, 140 bp, Artificial Sequence
  Synthetic
aggccctggctgctgatatggttcttgtcgggttgatggcgctgactctatcaccacattacaagcgctatattagctggtgcttatggtggctccaatattttttgaccagagtagaaggaccttttgggacagcggtg

SEQ ID NO: 392086 - DNA, 140 bp, Artificial Sequence
  Synthetic
caccgctgtcccaaaaggtccttctactctggtcaaaaaatattggagccaccataagcaccagctaatatagcgcttgtaatgtggtgatagagtcagcgccatcaacccgacaagaaccatatcagcagccagggcct

SEQ ID NO: 392087 - DNA, 140 bp, Artificial Sequence
  Synthetic
aggccctggctgctgatatgcacatgcaccgctcaccatgactcccctggtactgatctcctcgaggctaacctcttgtgggggtctaccgctaccagggttgagacagacgagaaggtggaccttttgggacagcggtg

SEQ ID NO: 392088 - DNA, 140 bp, Artificial Sequence
  Synthetic
caccgctgtcccaaaaggtccaccttctcgtctgtctcaaccctggtagcggtagacccccacaagaggttagcctcgaggagatcagtaccaggggagtcatggtgagcggtgcatgtgcatatcagcagccagggcct

SEQ ID NO: 392089 - DNA, 140 bp, Artificial Sequence
  Synthetic
atacgccatgctgggtctccacctcttgtgggggtctaccgctaccagggttgagacagacgagaaggtgataatattggactcttttgagccacgtgtggctgaaccagatgatgacagcgtacttgggagtcggccat

SEQ ID NO: 392090 - DNA, 140 bp, Artificial Sequence
  Synthetic
atggccgactcccaagtacgctgtcatcatctggttcagccacacgtggctcaaaagagtccaatattatcaccttctcgtctgtctcaaccctggtagcggtagacccccacaagaggtggagacccagcatggcgtat

SEQ ID NO: 392091 - DNA, 140 bp, Artificial Sequence
  Synthetic
aggccctggctgctgatatgaaggtatactacctgacccgagaccctgaaactcccttggcacgagccgcatgggagacagtccgacacactccagtcaattcctggttgggaaacatcagaccttttgggacagcggtg

SEQ ID NO: 392092 - DNA, 140 bp, Artificial Sequence
  Synthetic
caccgctgtcccaaaaggtctgatgtttcccaaccaggaattgactggagtgtgtcggactgtctcccatgcggctcgtgccaagggagtttcagggtctcgggtcaggtagtataccttcatatcagcagccagggcct

SEQ ID NO: 392093 - DNA, 140 bp, Artificial Sequence
  Synthetic
atacgccatgctgggtctccgctttctatggcgtatggccgctgctcctgctcctactggcgttaccaccacgagcttacgccttggaccgggagatggctgcatcgtgcgggggtgcggcgtacttgggagtcggccat

SEQ ID NO: 392094 - DNA, 140 bp, Artificial Sequence
  Synthetic
atggccgactcccaagtacgccgcacccccgcacgatgcagccatctcccggtccaaggcgtaagctcgtggtggtaacgccagtaggagcaggagcagcggccatacgccatagaaagcggagacccagcatggcgtat

SEQ ID NO: 392095 - DNA, 140 bp, Artificial Sequence
  Synthetic
atacgccatgctgggtctcctgtgtggcggcttattcttggctggtcagatgttttctttccaaccacgacgccactggactacccaggattgcaattgctccatctacacagggcacatcgtacttgggagtcggccat

SEQ ID NO: 392096 - DNA, 140 bp, Artificial Sequence
  Synthetic
atggccgactcccaagtacgatgtgccctgtgtagatggagcaattgcaatcctgggtagtccagtggcgtcgtggttggaaagaaaacatctgaccagccaagaataagccgccacacaggagacccagcatggcgtat

SEQ ID NO: 392097 - DNA, 140 bp, Artificial Sequence
  Synthetic
aggccctggctgctgatatgcatgcaggccaattgggccaaagtcatcttggtcctattcctctttgcaggggtcgacgctagaacccatgtgtctgggggctcggctgctcaaaccactgaccttttgggacagcggtg

SEQ ID NO: 392098 - DNA, 140 bp, Artificial Sequence
  Synthetic
caccgctgtcccaaaaggtcagtggtttgagcagccgagcccccagacacatgggttctagcgtcgacccctgcaaagaggaataggaccaagatgactttggcccaattggcctgcatgcatatcagcagccagggcct

SEQ ID NO: 392099 - DNA, 140 bp, Artificial Sequence
  Synthetic
aggccctggctgctgatatgtttaacagctcagggtgtcccgaacgactcacaagctgcaaaagccttgatgcgtttaaccaaggttggggcccgcttggggtcgctaacatcagcggccgaccttttgggacagcggtg

SEQ ID NO: 392100 - DNA, 140 bp, Artificial Sequence
  Synthetic
caccgctgtcccaaaaggtcggccgctgatgttagcgaccccaagcgggccccaaccttggttaaacgcatcaaggcttttgcagcttgtgagtcgttcgggacaccctgagctgttaaacatatcagcagccagggcct

SEQ ID NO: 392101 - DNA, 140 bp, Artificial Sequence
  Synthetic
atacgccatgctgggtctccagcctgtggcgctcctccatgcgaggttaggaccaataatggaacctggccctgccctactgattgtttcaggaagcatccggagaccacctacgccaaacgtacttgggagtcggccat

SEQ ID NO: 392102 - DNA, 140 bp, Artificial Sequence
  Synthetic
atggccgactcccaagtacgtttggcgtaggtggtctccggatgcttcctgaaacaatcagtagggcagggccaggttccattattggtcctaacctcgcatggaggagcgccacaggctggagacccagcatggcgtat

SEQ ID NO: 392103 - DNA, 140 bp, Artificial Sequence
  Synthetic
aggccctggctgctgatatgagggtgtctgcggaggaatacgtggaaataaagcaggtgggggacttccactacgtgacgggcatgactgctgacaatcttaaatgcccatgccaggtccgaccttttgggacagcggtg

SEQ ID NO: 392104 - DNA, 140 bp, Artificial Sequence
  Synthetic
caccgctgtcccaaaaggtcggacctggcatgggcatttaagattgtcagcagtcatgcccgtcacgtagtggaagtcccccacctgctttatttccacgtattcctccgcagacaccctcatatcagcagccagggcct

SEQ ID NO: 392105 - DNA, 140 bp, Artificial Sequence
  Synthetic
atacgccatgctgggtctcccattgtctccctactacaagtcatggctggccaaaggactgtggtggattcagtattttatagctagggccgaggccttgctgcatgtctatgttccatccgtacttgggagtcggccat

SEQ ID NO: 392106 - DNA, 140 bp, Artificial Sequence
  Synthetic
atggccgactcccaagtacggatggaacatagacatgcagcaaggcctcggccctagctataaaatactgaatccaccacagtcctttggccagccatgacttgtagtagggagacaatgggagacccagcatggcgtat

SEQ ID NO: 392107 - DNA, 140 bp, Artificial Sequence
  Synthetic
atacgccatgctgggtctcccttgtccacaccttttatttgacatcacaaagcatctcctggccattttagggcccctctacatacttcaggcctcgctcctgcgcatcccttacttcgtcgtacttgggagtcggccat

SEQ ID NO: 392108 - DNA, 140 bp, Artificial Sequence
  Synthetic
atggccgactcccaagtacgacgaagtaagggatgcgcaggagcgaggcctgaagtatgtagaggggccctaaaatggccaggagatgctttgtgatgtcaaataaaaggtgtggacaagggagacccagcatggcgtat

SEQ ID NO: 392109 - DNA, 140 bp, Artificial Sequence
  Synthetic
atacgccatgctgggtctccaggccatttctggttttttttttttttttttttttttttcccccccccaagggggggggccccctttccccccccaggggggggggggggggggttttttcgtacttgggagtcggccat

SEQ ID NO: 392110 - DNA, 140 bp, Artificial Sequence
  Synthetic
atggccgactcccaagtacgaaaaaacccccccccccccccccctggggggggaaagggggcccccccccttgggggggggaaaaaaaaaaaaaaaaaaaaaaaaaaccagaaatggcctggagacccagcatggcgtat

SEQ ID NO: 392111 - DNA, 140 bp, Artificial Sequence
  Synthetic
atacgccatgctgggtctccgcctcccggagtcaaatctcttacgccgtgtacctgtggcgcgtctgacttgtacttagtcaccaggcatgcagacgtggtgcccgtgcgcaggagagggcgtacttgggagtcggccat

SEQ ID NO: 392112 - DNA, 140 bp, Artificial Sequence
  Synthetic
atggccgactcccaagtacgccctctcctgcgcacgggcaccacgtctgcatgcctggtgactaagtacaagtcagacgcgccacaggtacacggcgtaagagatttgactccgggaggcggagacccagcatggcgtat

SEQ ID NO: 392113 - DNA, 140 bp, Artificial Sequence
  Synthetic
aggccctggctgctgatatggtcgtggacatggtggcgggggcccactggggaatcctggcgggccttgcctactattccatggtggggaactgggctaaggtcttgattgtgatgctacgaccttttgggacagcggtg

SEQ ID NO: 392114 - DNA, 140 bp, Artificial Sequence
  Synthetic
caccgctgtcccaaaaggtcgtagcatcacaatcaagaccttagcccagttccccaccatggaatagtaggcaaggcccgccaggattccccagtgggcccccgccaccatgtccacgaccatatcagcagccagggcct

SEQ ID NO: 392115 - DNA, 140 bp, Artificial Sequence
  Synthetic
aggccctggctgctgatatgttaactgcaatgactccctccagactgggtttcttgccgcgctgttctatgcaaacaagttcaactcgtccggatgcccagagcgcatggccagctgccagaccttttgggacagcggtg

SEQ ID NO: 392116 - DNA, 140 bp, Artificial Sequence
  Synthetic
caccgctgtcccaaaaggtctggcagctggccatgcgctctgggcatccggacgagttgaacttgtttgcatagaacagcgcggcaagaaacccagtctggagggagtcattgcagttaacatatcagcagccagggcct

SEQ ID NO: 392117 - DNA, 140 bp, Artificial Sequence
  Synthetic
atacgccatgctgggtctccgggacgtcgtggtatgtgccacggacgccctcatgacggggtttaccggcgactttgactcagtgatagactgcaatacatctgtgatacagactgttgacgtacttgggagtcggccat

SEQ ID NO: 392118 - DNA, 140 bp, Artificial Sequence
  Synthetic
atggccgactcccaagtacgtcaacagtctgtatcacagatgtattgcagtctatcactgagtcaaagtcgccggtaaaccccgtcatgagggcgtccgtggcacataccacgacgtcccggagacccagcatggcgtat

SEQ ID NO: 392119 - DNA, 140 bp, Artificial Sequence
  Synthetic
aggccctggctgctgatatgttctatcaccagaggttcaactcctcaggctgtcccgctaggttggccagctgccaaccccttactgcttttggccagggctgggcccctatcagtcatggaccttttgggacagcggtg

SEQ ID NO: 392120 - DNA, 140 bp, Artificial Sequence
  Synthetic
caccgctgtcccaaaaggtccatgactgataggggcccagccctggccaaaagcagtaaggggttggcagctggccaacctagcgggacagcctgaggagttgaacctctggtgatagaacatatcagcagccagggcct

SEQ ID NO: 392121 - DNA, 140 bp, Artificial Sequence
  Synthetic
aggccctggctgctgatatgtgctctttctctatcttccttctggccctgctctcttgtctaactgtgcccgcttcagcctaccaagtacgcaacaccacagggctttaccacgtcaccagaccttttgggacagcggtg

SEQ ID NO: 392122 - DNA, 140 bp, Artificial Sequence
  Synthetic
caccgctgtcccaaaaggtctggtgacgtggtaaagccctgtggtgttgcgtacttggtaggctgaagcgggcacagttagacaagagagcagggccagaaggaagatagagaaagagcacatatcagcagccagggcct

SEQ ID NO: 392123 - DNA, 140 bp, Artificial Sequence
  Synthetic
atacgccatgctgggtctcctgggggagctgccggccgcaccacggctggacttgccagcctcttcagtcgaggcgcccagcagaagatccagctggttaacgccagcggcagttggcaccgtacttgggagtcggccat

SEQ ID NO: 392124 - DNA, 140 bp, Artificial Sequence
  Synthetic
atggccgactcccaagtacggtgccaactgccgctggcgttaaccagctggatcttctgctgggcgcctcgactgaagaggctggcaagtccagccgtggtgcggccggcagctcccccaggagacccagcatggcgtat

SEQ ID NO: 392125 - DNA, 140 bp, Artificial Sequence
  Synthetic
atacgccatgctgggtctcccactcttgaccttgtcaccgcactacaagatgatcctcgttaagctcatatggtggttacaatatcttaccaccagagccgaggcgctcttgcacgtgtgcgtacttgggagtcggccat

SEQ ID NO: 392126 - DNA, 140 bp, Artificial Sequence
  Synthetic
atggccgactcccaagtacgcacacgtgcaagagcgcctcggctctggtggtaagatattgtaaccaccatatgagcttaacgaggatcatcttgtagtgcggtgacaaggtcaagagtgggagacccagcatggcgtat

SEQ ID NO: 392127 - DNA, 140 bp, Artificial Sequence
  Synthetic
aggccctggctgctgatatggattggcgagctgccgaccccttgccgattttgcccagggctggggccctatcagttatgctaatgaaagcggcacagaccaacgcccctactgctggcagaccttttgggacagcggtg

SEQ ID NO: 392128 - DNA, 140 bp, Artificial Sequence
  Synthetic
caccgctgtcccaaaaggtctgccagcagtaggggcgttggtctgtgccgctttcattagcataactgatagggccccagccctgggcaaaatcggcaaggggtcggcagctcgccaatccatatcagcagccagggcct

SEQ ID NO: 392129 - DNA, 140 bp, Artificial Sequence
  Synthetic
aggccctggctgctgatatggccatactcggtccgctcatggtgctccaggctggcataactagagtgccgtacttcgtgcgcgctcaagggctcattcgtgcatgcatgttggtgcggagaccttttgggacagcggtg

SEQ ID NO: 392130 - DNA, 140 bp, Artificial Sequence
  Synthetic
caccgctgtcccaaaaggtctccgcaccaacatgcatgcacgaatgagcccttgagcgcgcacgaagtacggcactctagttatgccagcctggagcaccatgagcggaccgagtatggccatatcagcagccagggcct

SEQ ID NO: 392131 - DNA, 140 bp, Artificial Sequence
  Synthetic
aggccctggctgctgatatgcgcctatcacggcctactcccaacagacgcggggcctacttggctgcatcatcaccagcctcacaggccgggacaagaaccaggtcgagggggaggtccagaccttttgggacagcggtg

SEQ ID NO: 392132 - DNA, 140 bp, Artificial Sequence
  Synthetic
caccgctgtcccaaaaggtctggacctccccctcgacctggttcttgtcccggcctgtgaggctggtgatgatgcagccaagtaggccccgcgtctgttgggagtaggccgtgataggcgcatatcagcagccagggcct

SEQ ID NO: 392133 - DNA, 140 bp, Artificial Sequence
  Synthetic
aggccctggctgctgatatgttctcggtaggactcaattcgttcgtagtgggatcgcaactcccatgcgaaccggagccggacgtggccgtattgacatccatgctgacagacccatcacgaccttttgggacagcggtg

SEQ ID NO: 392134 - DNA, 140 bp, Artificial Sequence
  Synthetic
caccgctgtcccaaaaggtcgtgatgggtctgtcagcatggatgtcaatacggccacgtccggctccggttcgcatgggagttgcgatcccactacgaacgaattgagtcctaccgagaacatatcagcagccagggcct

SEQ ID NO: 392135 - DNA, 140 bp, Artificial Sequence
  Synthetic
aggccctggctgctgatatgcagctctaccgatctgggctcggccagattacaatccacctctcaccgagacatggaagcaacaggactacaagcctccgaccgtccacgggtgtgccttgaccttttgggacagcggtg

SEQ ID NO: 392136 - DNA, 140 bp, Artificial Sequence
  Synthetic
caccgctgtcccaaaaggtcaaggcacacccgtggacggtcggaggcttgtagtcctgttgcttccatgtctcggtgagaggtggattgtaatctggccgagcccagatcggtagagctgcatatcagcagccagggcct

SEQ ID NO: 392137 - DNA, 140 bp, Artificial Sequence
  Synthetic
aggccctggctgctgatatgaagaccttcggccagtctgagctgggttcagactctggtgcagacctcaccactccaactgagaccacagactcgggccccatcctcgtggatgacgcatgaccttttgggacagcggtg

SEQ ID NO: 392138 - DNA, 140 bp, Artificial Sequence
  Synthetic
caccgctgtcccaaaaggtcatgcgtcatccacgaggatggggcccgagtctgtggtctcagttggagtggtgaggtctgcaccagagtctgaacccagctcagactggccgaaggtcttcatatcagcagccagggcct

SEQ ID NO: 392139 - DNA, 140 bp, Artificial Sequence
  Synthetic
aggccctggctgctgatatgctgggcaaagcacatgtggaatttcatcagcgggatacagtacctagcaggcttgtccactctgcctgggaaccccgcaatagcatcactgatggcatttgaccttttgggacagcggtg

SEQ ID NO: 392140 - DNA, 140 bp, Artificial Sequence
  Synthetic
caccgctgtcccaaaaggtcaaatgccatcagtgatgctattgcggggttcccaggcagagtggacaagcctgctaggtactgtatcccgctgatgaaattccacatgtgctttgcccagcatatcagcagccagggcct

SEQ ID NO: 392141 - DNA, 140 bp, Artificial Sequence
  Synthetic
aggccctggctgctgatatgcctggcgggcatagcgtatttctccatggtggggaactgggcgaaggtcgtggtagtgctgctgctatttgccggcgtcgacgcgaagacccacgtcaccgaccttttgggacagcggtg

SEQ ID NO: 392142 - DNA, 140 bp, Artificial Sequence
  Synthetic
caccgctgtcccaaaaggtcggtgacgtgggtcttcgcgtcgacgccggcaaatagcagcagcactaccacgaccttcgcccagttccccaccatggagaaatacgctatgcccgccaggcatatcagcagccagggcct

SEQ ID NO: 392143 - DNA, 140 bp, Artificial Sequence
  Synthetic
aggccctggctgctgatatggggtgcggttgcacaggtacgctccggcgtgcaaacctctcctacgggatgaggtcacattccaggtcgggctcaaccaatacgtggttgggtcacagctgaccttttgggacagcggtg

SEQ ID NO: 392144 - DNA, 140 bp, Artificial Sequence
  Synthetic
caccgctgtcccaaaaggtcagctgtgacccaaccacgtattggttgagcccgacctggaatgtgacctcatcccgtaggagaggtttgcacgccggagcgtacctgtgcaaccgcaccccatatcagcagccagggcct

SEQ ID NO: 392145 - DNA, 140 bp, Artificial Sequence
  Synthetic
aggccctggctgctgatatgctctgggggcgcctacgacatcataatatgtgatgagtgccactcaactgactcgactaccatcttgggcatcggcacagtcctggaccaagcggagacggaccttttgggacagcggtg

SEQ ID NO: 392146 - DNA, 140 bp, Artificial Sequence
  Synthetic
caccgctgtcccaaaaggtccgtctccgcttggtccaggactgtgccgatgcccaagatggtagtcgagtcagttgagtggcactcatcacatattatgatgtcgtaggcgcccccagagcatatcagcagccagggcct

SEQ ID NO: 392147 - DNA, 140 bp, Artificial Sequence
  Synthetic
aggccctggctgctgatatggagccgggggatcccgatctcagcgacgggtcttggtctaccgtgagtgaggaggctagtgagaacatcgtctgctgctcgatgtcctacacatggacaggaccttttgggacagcggtg

SEQ ID NO: 392148 - DNA, 140 bp, Artificial Sequence
  Synthetic
caccgctgtcccaaaaggtcctgtccatgtgtaggacatcgagcagcagacgatgttctcactagcctcctcactcacggtagaccaagacccgtcgctgagatcgggatcccccggctccatatcagcagccagggcct

SEQ ID NO: 392149 - DNA, 140 bp, Artificial Sequence
  Synthetic
atacgccatgctgggtctccattaacaccaatgggagctggcatataaacaggacttccctcaactgcaatgatagtctaaacactgggttcttggctagcttgttctacacccacaggtcgtacttgggagtcggccat

SEQ ID NO: 392150 - DNA, 140 bp, Artificial Sequence
  Synthetic
atggccgactcccaagtacgacctgtgggtgtagaacaagctagccaagaacccagtgtttagactatcattgcagttgagggaagtcctgtttatatgccagctcccattggtgttaatggagacccagcatggcgtat

SEQ ID NO: 392151 - DNA, 140 bp, Artificial Sequence
  Synthetic
atacgccatgctgggtctcctcaacagctcagggtgtcccgaacgactcgcacgctgcagaagccttgatacattcgaccaaggctggggcccacttggggtcgctaacatcagcgggcccgtacttgggagtcggccat

SEQ ID NO: 392152 - DNA, 140 bp, Artificial Sequence
  Synthetic
atggccgactcccaagtacgggcccgctgatgttagcgaccccaagtgggccccagccttggtcgaatgtatcaaggcttctgcagcgtgcgagtcgttcgggacaccctgagctgttgaggagacccagcatggcgtat

SEQ ID NO: 392153 - DNA, 140 bp, Artificial Sequence
  Synthetic
atacgccatgctgggtctcccggctgtggcattacccatgcaccgtcaactttaccatctttaaggtcagggccttcattggcggtatagagcatcggatggaggcagcatgcaactggacgtacttgggagtcggccat

SEQ ID NO: 392154 - DNA, 140 bp, Artificial Sequence
  Synthetic
atggccgactcccaagtacgtccagttgcatgctgcctccatccgatgctctataccgccaatgaaggccctgaccttaaagatggtaaagttgacggtgcatgggtaatgccacagccgggagacccagcatggcgtat

SEQ ID NO: 392155 - DNA, 140 bp, Artificial Sequence
  Synthetic
atacgccatgctgggtctccctcaagtgggaatatgtggtgctcgcgttcctgcttcttgcagacgcgagagtctctgcttgcctatggatgatggttatggtatctcaggttgaggcagcgtacttgggagtcggccat

SEQ ID NO: 392156 - DNA, 140 bp, Artificial Sequence
  Synthetic
atggccgactcccaagtacgctgcctcaacctgagataccataaccatcatccataggcaagcagagactctcgcgtctgcaagaagcaggaacgcgagcaccacatattcccacttgagggagacccagcatggcgtat

SEQ ID NO: 392157 - DNA, 140 bp, Artificial Sequence
  Synthetic
atacgccatgctgggtctcctttttttttttccttttttttttggttttccttttttccccctttttttttttttcccctaaaaggggggcccccttttacccccaaccccgggaaattgcgtacttgggagtcggccat

SEQ ID NO: 392158 - DNA, 140 bp, Artificial Sequence
  Synthetic
atggccgactcccaagtacgcaatttcccggggttgggggtaaaagggggccccccttttaggggaaaaaaaaaaaaagggggaaaaaaggaaaaccaaaaaaaaaaggaaaaaaaaaaaggagacccagcatggcgtat

SEQ ID NO: 392159 - DNA, 140 bp, Artificial Sequence
  Synthetic
aggccctggctgctgatatgcctggcgggcctcgcctactattccatggtggggaactgggctaaggtgttgattgtgatgctgctctttgccggcgtcgacggggccacttacgtggcagaccttttgggacagcggtg

SEQ ID NO: 392160 - DNA, 140 bp, Artificial Sequence
  Synthetic
caccgctgtcccaaaaggtctgccacgtaagtggccccgtcgacgccggcaaagagcagcatcacaatcaacaccttagcccagttccccaccatggaatagtaggcgaggcccgccaggcatatcagcagccagggcct

SEQ ID NO: 392161 - DNA, 140 bp, Artificial Sequence
  Synthetic
atacgccatgctgggtctccaggccattttccgtttttttttttccccttttttttttttttccccttttttttttcccccccccccttcccttttttttttttctttaaggggggggcccgtacttgggagtcggccat

SEQ ID NO: 392162 - DNA, 140 bp, Artificial Sequence
  Synthetic
atggccgactcccaagtacgggccccccccttaaagaaaaaaaaaaaagggaagggggggggggaaaaaaaaaaggggaaaaaaaaaaaaaaggggaaaaaaaaaaacggaaaatggcctggagacccagcatggcgtat

SEQ ID NO: 392163 - DNA, 140 bp, Artificial Sequence
  Synthetic
atacgccatgctgggtctcctcaacagaactgccctgagctgcaatgagtccctcaacactgggtggcttgccgcgctgatctacaaacacaagctcaatgcgtccgcatgcgaagagcgcgtacttgggagtcggccat

SEQ ID NO: 392164 - DNA, 140 bp, Artificial Sequence
  Synthetic
atggccgactcccaagtacgcgctcttcgcatgcggacgcattgagcttgtgtttgtagatcagcgcggcaagccacccagtgttgagggactcattgcagctcagggcagttctgttgaggagacccagcatggcgtat

SEQ ID NO: 392165 - DNA, 140 bp, Artificial Sequence
  Synthetic
atacgccatgctgggtctccggcgtcgacgcggaaacccacgtcaccgggggaagtgccggcagcaccgtggccagttttgctgggctcttctcaacaggcgcccggcagaacatccagccgtacttgggagtcggccat

SEQ ID NO: 392166 - DNA, 140 bp, Artificial Sequence
  Synthetic
atggccgactcccaagtacggctggatgttctgccgggcgcctgttgagaagagcccagcaaaactggccacggtgctgccggcacttcccccggtgacgtgggtttccgcgtcgacgccggagacccagcatggcgtat

SEQ ID NO: 392167 - DNA, 140 bp, Artificial Sequence
  Synthetic
atacgccatgctgggtctccaccgcgaggtgctctaccaacagttcgacgaaatggaggagtgctccaaacatcttccactagtcgagcacgggttacaactggcagagcaattcaagcacgtacttgggagtcggccat

SEQ ID NO: 392168 - DNA, 140 bp, Artificial Sequence
  Synthetic
atggccgactcccaagtacgtgcttgaattgctctgccagttgtaacccgtgctcgactagtggaagatgtttggagcactcctccatttcgtcgaactgttggtagagcacctcgcggtggagacccagcatggcgtat

SEQ ID NO: 392169 - DNA, 140 bp, Artificial Sequence
  Synthetic
aggccctggctgctgatatgcaccagtgatccagtccaatttcgctaaacttgaacagttctgggcgaaacacatgtggaacttcatcagcggcattcaatatctcgctggactgtctacgaccttttgggacagcggtg

SEQ ID NO: 392170 - DNA, 140 bp, Artificial Sequence
  Synthetic
caccgctgtcccaaaaggtcgtagacagtccagcgagatattgaatgccgctgatgaagttccacatgtgtttcgcccagaactgttcaagtttagcgaaattggactggatcactggtgcatatcagcagccagggcct

SEQ ID NO: 392171 - DNA, 140 bp, Artificial Sequence
  Synthetic
atacgccatgctgggtctcccttaccaggctcatatggtggctacaatatctcatcaccagggccgaggcgctcctgcaagtgtgggtcccccctctcaacgttcgggggggccgcgatgcgtacttgggagtcggccat

SEQ ID NO: 392172 - DNA, 140 bp, Artificial Sequence
  Synthetic
atggccgactcccaagtacgcatcgcggcccccccgaacgttgagaggggggacccacacttgcaggagcgcctcggccctggtgatgagatattgtagccaccatatgagcctggtaagggagacccagcatggcgtat

SEQ ID NO: 392173 - DNA, 140 bp, Artificial Sequence
  Synthetic
atacgccatgctgggtctccctgtcatcctcctcatgtgtgcgatccatccagagctgatttttaccatcactaaaattttgctcgctatactcggtccactcatggtgctccaggctggcgtacttgggagtcggccat

SEQ ID NO: 392174 - DNA, 140 bp, Artificial Sequence
  Synthetic
atggccgactcccaagtacgccagcctggagcaccatgagtggaccgagtatagcgagcaaaattttagtgatggtaaaaatcagctctggatggatcgcacacatgaggaggatgacagggagacccagcatggcgtat

SEQ ID NO: 392175 - DNA, 140 bp, Artificial Sequence
  Synthetic
atacgccatgctgggtctccccattaagtgggagtacgtcgttctcctgttccttctgcttgcagacgcgcgcgtctgctcctgcttgtggatgatgttactcatatcccaagcggaggccgtacttgggagtcggccat

SEQ ID NO: 392176 - DNA, 140 bp, Artificial Sequence
  Synthetic
atggccgactcccaagtacggcctccgcttgggatatgagtaacatcatccacaagcaggagcagacgcgcgcgtctgcaagcagaaggaacaggagaacgacgtactcccacttaatggggagacccagcatggcgtat

SEQ ID NO: 392177 - DNA, 140 bp, Artificial Sequence
  Synthetic
aggccctggctgctgatatggtcattccggtgcgccggcggggcgacagcagggggagcctactctcccccaggcccgtctcctacttgaagggctcttcgggtggtccactgctctgccgaccttttgggacagcggtg

SEQ ID NO: 392178 - DNA, 140 bp, Artificial Sequence
  Synthetic
caccgctgtcccaaaaggtcggcagagcagtggaccacccgaagagcccttcaagtaggagacgggcctgggggagagtaggctccccctgctgtcgccccgccggcgcaccggaatgaccatatcagcagccagggcct

SEQ ID NO: 392179 - DNA, 140 bp, Artificial Sequence
  Synthetic
aggccctggctgctgatatgcttcggacccctttggattcttcaagccagtctgcttaaagtgccctactttgtgcgcgttcaaggccttctccggatctgcgcgctagcgcgcaagatggaccttttgggacagcggtg

SEQ ID NO: 392180 - DNA, 140 bp, Artificial Sequence
  Synthetic
caccgctgtcccaaaaggtccatcttgcgcgctagcgcgcagatccggagaaggccttgaacgcgcacaaagtagggcactttaagcagactggcttgaagaatccaaaggggtccgaagcatatcagcagccagggcct

SEQ ID NO: 392181 - DNA, 140 bp, Artificial Sequence
  Synthetic
atacgccatgctgggtctccttacaatgagacactcaaggagatcaaggcacgagcatccagagtgaaggcacgcttgcttaccacagaggaagcttgcgacctgacgcccccccactctcgtacttgggagtcggccat

SEQ ID NO: 392182 - DNA, 140 bp, Artificial Sequence
  Synthetic
atggccgactcccaagtacgagagtgggggggcgtcaggtcgcaagcttcctctgtggtaagcaagcgtgccttcactctggatgctcgtgccttgatctccttgagtgtctcattgtaaggagacccagcatggcgtat

SEQ ID NO: 392183 - DNA, 140 bp, Artificial Sequence
  Synthetic
atacgccatgctgggtctccgccaaatcaaaatttggctatggggcgaaggatgttcgcagccattcccgcaaggccattaaccacatcaactccgtgtgggaggacttgctggaagacacgtacttgggagtcggccat

SEQ ID NO: 392184 - DNA, 140 bp, Artificial Sequence
  Synthetic
atggccgactcccaagtacgtgtcttccagcaagtcctcccacacggagttgatgtggttaatggccttgcgggaatggctgcgaacatccttcgccccatagccaaattttgatttggcggagacccagcatggcgtat

SEQ ID NO: 392185 - DNA, 140 bp, Artificial Sequence
  Synthetic
aggccctggctgctgatatgtcccatggggttctcttatgatacccgctgctttgactccactgtaaccgaaaaggacatcaggaccgaggaagaggtctatcagtgttgtgacctggaggaccttttgggacagcggtg

SEQ ID NO: 392186 - DNA, 140 bp, Artificial Sequence
  Synthetic
caccgctgtcccaaaaggtcctccaggtcacaacactgatagacctcttcctcggtcctgatgtccttttcggttacagtggagtcaaagcagcgggtatcataagagaaccccatgggacatatcagcagccagggcct

SEQ ID NO: 392187 - DNA, 140 bp, Artificial Sequence
  Synthetic
aggccctggctgctgatatgcggccctatgcataacagcaagggagacctttgtgggtatcggagatgccgcgcaagcggcgtctacacgaccagcttcgggaacacactgacgtgctatgaccttttgggacagcggtg

SEQ ID NO: 392188 - DNA, 140 bp, Artificial Sequence
  Synthetic
caccgctgtcccaaaaggtcatagcacgtcagtgtgttcccgaagctggtcgtgtagacgccgcttgcgcggcatctccgatacccacaaaggtctcccttgctgttatgcatagggccgcatatcagcagccagggcct

SEQ ID NO: 392189 - DNA, 140 bp, Artificial Sequence
  Synthetic
atacgccatgctgggtctccactggagagatccccttttatggcaaggccatccccatcgagaccatcaaggggggaaggcatctcatcttctgtcattccaaaaagaaatgcgatgaaccgtacttgggagtcggccat

SEQ ID NO: 392190 - DNA, 140 bp, Artificial Sequence
  Synthetic
atggccgactcccaagtacggttcatcgcatttctttttggaatgacagaagatgagatgccttccccccttgatggtctcgatggggatggccttgccataaaaggggatctctccagtggagacccagcatggcgtat

SEQ ID NO: 392191 - DNA, 140 bp, Artificial Sequence
  Synthetic
aggccctggctgctgatatgttgagagcgtggagacatcgggcccgagcagtccgcgctaagcttatcgctcagggaggtaaagccaaaatctgtggcatatacctctttaactgggcgggaccttttgggacagcggtg

SEQ ID NO: 392192 - DNA, 140 bp, Artificial Sequence
  Synthetic
caccgctgtcccaaaaggtcccgcccagttaaagaggtatatgccacagattttggctttacctccctgagcgataagcttagcgcggactgctcgggcccgatgtctccacgctctcaacatatcagcagccagggcct

SEQ ID NO: 392193 - DNA, 140 bp, Artificial Sequence
  Synthetic
aggccctggctgctgatatggccgcgcaggggccccagagtgggtgtgcgcgcgactcggaagacttcggagcggtcgcaacctcgtggcaggcgccagcctatccccaaggcgcgccgggaccttttgggacagcggtg

SEQ ID NO: 392194 - DNA, 140 bp, Artificial Sequence
  Synthetic
caccgctgtcccaaaaggtcccggcgcgccttggggataggctggcgcctgccacgaggttgcgaccgctccgaagtcttccgagtcgcgcgcacacccactctggggcccctgcgcggccatatcagcagccagggcct

SEQ ID NO: 392195 - DNA, 140 bp, Artificial Sequence
  Synthetic
aggccctggctgctgatatgagccaagctcatgccacaactgcctgggattccctttgtgtcctgccaacgcgggtataggggggtctggcgaggggatggcattatgcacactcgctgcgaccttttgggacagcggtg

SEQ ID NO: 392196 - DNA, 140 bp, Artificial Sequence
  Synthetic
caccgctgtcccaaaaggtcgcagcgagtgtgcataatgccatcccctcgccagacccccctatacccgcgttggcaggacacaaagggaatcccaggcagttgtggcatgagcttggctcatatcagcagccagggcct

SEQ ID NO: 392197 - DNA, 140 bp, Artificial Sequence
  Synthetic
atacgccatgctgggtctccggttgctctttctctatcttcctcctggcacttctctcgtgcctgacaacaccggcatccgctgtgcactaccggaatgcctcgggcatttaccatcttacgtacttgggagtcggccat

SEQ ID NO: 392198 - DNA, 140 bp, Artificial Sequence
  Synthetic
atggccgactcccaagtacgtaagatggtaaatgcccgaggcattccggtagtgcacagcggatgccggtgttgtcaggcacgagagaagtgccaggaggaagatagagaaagagcaaccggagacccagcatggcgtat

SEQ ID NO: 392199 - DNA, 140 bp, Artificial Sequence
  Synthetic
atacgccatgctgggtctccgtgctgggtggccctgactcccactgttgctgcgccccgccttaatgctccattagagtctctgcggaggcacgtggacctgatggtgggcgctgctactcgtacttgggagtcggccat

SEQ ID NO: 392200 - DNA, 140 bp, Artificial Sequence
  Synthetic
atggccgactcccaagtacgagtagcagcgcccaccatcaggtccacgtgcctccgcagagactctaatggagcattaaggcggggcgcagcaacagtgggagtcagggccacccagcacggagacccagcatggcgtat

SEQ ID NO: 392201 - DNA, 140 bp, Artificial Sequence
  Synthetic
atacgccatgctgggtctccgcaattgctccatctacactggccacatcaccggccatcgaatggcctgggacatgatgatgaactggagccccaccaccacgctcctactggcccagctcgtacttgggagtcggccat

SEQ ID NO: 392202 - DNA, 140 bp, Artificial Sequence
  Synthetic
atggccgactcccaagtacgagctgggccagtaggagcgtggtggtggggctccagttcatcatcatgtcccaggccattcgatggccggtgatgtggccagtgtagatggagcaattgcggagacccagcatggcgtat

SEQ ID NO: 392203 - DNA, 140 bp, Artificial Sequence
  Synthetic
aggccctggctgctgatatgccacgccatgctccggttcgtggctaagggacgtttgggactggatatgtacggtgttgaccgacttcaagacctggctccagtccaagctcctgccgcggaccttttgggacagcggtg

SEQ ID NO: 392204 - DNA, 140 bp, Artificial Sequence
  Synthetic
caccgctgtcccaaaaggtccgcggcaggagcttggactggagccaggtcttgaagtcggtcaacaccgtacatatccagtcccaaacgtcccttagccacgaaccggagcatggcgtggcatatcagcagccagggcct

SEQ ID NO: 392205 - DNA, 140 bp, Artificial Sequence
  Synthetic
atacgccatgctgggtctccgtcgtcctggtcctcttcctctttgctggggtcgaggcgagcacgtttatcacaggcgggaccgcggcccgcaccacccagtcgttcgcctcgatcttcacgtacttgggagtcggccat

SEQ ID NO: 392206 - DNA, 140 bp, Artificial Sequence
  Synthetic
atggccgactcccaagtacgtgaagatcgaggcgaacgactgggtggtgcgggccgcggtcccgcctgtgataaacgtgctcgcctcgaccccagcaaagaggaagaggaccaggacgacggagacccagcatggcgtat

SEQ ID NO: 392207 - DNA, 140 bp, Artificial Sequence
  Synthetic
atacgccatgctgggtctcccattgccggcttgttctacagtcacaggtttaatagctctggctgtccccagaggctcgctgcatgcaagcgtctggaggactttcagcagggctggggccgtacttgggagtcggccat

SEQ ID NO: 392208 - DNA, 140 bp, Artificial Sequence
  Synthetic
atggccgactcccaagtacggccccagccctgctgaaagtcctccagacgcttgcatgcagcgagcctctggggacagccagagctattaaacctgtgactgtagaacaagccggcaatgggagacccagcatggcgtat

SEQ ID NO: 392209 - DNA, 140 bp, Artificial Sequence
  Synthetic
atacgccatgctgggtctccgtggccccgtgtactgtttcactcccagtcccgtggtggtcggtaccaccgatcgcctcggggcccccacctatagctggggagagaatgagactgatgtcgtacttgggagtcggccat

SEQ ID NO: 392210 - DNA, 140 bp, Artificial Sequence
  Synthetic
atggccgactcccaagtacgacatcagtctcattctctccccagctataggtgggggccccgaggcgatcggtggtaccgaccaccacgggactgggagtgaaacagtacacggggccacggagacccagcatggcgtat

SEQ ID NO: 392211 - DNA, 140 bp, Artificial Sequence
  Synthetic
atacgccatgctgggtctccaaagtgtcgaccttcaatggtacttgggattgcccgaccgattgcttcaggaaacatccggagacgacctacaccaagtgtggggcggggccctggctcacgtacttgggagtcggccat

SEQ ID NO: 392212 - DNA, 140 bp, Artificial Sequence
  Synthetic
atggccgactcccaagtacgtgagccagggccccgccccacacttggtgtaggtcgtctccggatgtttcctgaagcaatcggtcgggcaatcccaagtaccattgaaggtcgacactttggagacccagcatggcgtat

SEQ ID NO: 392213 - DNA, 140 bp, Artificial Sequence
  Synthetic
atacgccatgctgggtctccacatcgactggacgccgcgtgcaactggacccggggagagccatgtggacttcaccatagggatcgcacggagctgtcgcccctgctcctttccaccactcgtacttgggagtcggccat

SEQ ID NO: 392214 - DNA, 140 bp, Artificial Sequence
  Synthetic
atggccgactcccaagtacgagtggtggaaaggagcaggggcgacagctccgtgcgatccctatggtgaagtccacatggctctccccgggtccagttgcacgcggcgtccagtcgatgtggagacccagcatggcgtat

SEQ ID NO: 392215 - DNA, 140 bp, Artificial Sequence
  Synthetic
atacgccatgctgggtctccgcattgggtcggctgtggtgtcgtgggcgcttaagtgggagtacattgtgctcgcatttctgctgctcgcagacgctagagtctgcgcgtgcttgtggatcgtacttgggagtcggccat

SEQ ID NO: 392216 - DNA, 140 bp, Artificial Sequence
  Synthetic
atggccgactcccaagtacgatccacaagcacgcgcagactctagcgtctgcgagcagcagaaatgcgagcacaatgtactcccacttaagcgcccacgacaccacagccgacccaatgcggagacccagcatggcgtat

SEQ ID NO: 392217 - DNA, 140 bp, Artificial Sequence
  Synthetic
atacgccatgctgggtctcctttttctgcataacctggtacatcaagggtaggctcccagcagccactgcctatgcattctgcgggttgtggcccctactcctcctgctcctcgctttgccgtacttgggagtcggccat

SEQ ID NO: 392218 - DNA, 140 bp, Artificial Sequence
  Synthetic
atggccgactcccaagtacggcaaagcgaggagcaggaggagtaggggccacaacccgcagaatgcataggcagtggctgctgggagcctacccttgatgtaccaggttatgcagaaaaaggagacccagcatggcgtat

SEQ ID NO: 392219 - DNA, 140 bp, Artificial Sequence
  Synthetic
aggccctggctgctgatatgccggatcccacaagctgtcgtggacatggtggcgggggcccactggggagtcctggcgggccttgcctactattccatggtagggaactgggctaaggttgaccttttgggacagcggtg

SEQ ID NO: 392220 - DNA, 140 bp, Artificial Sequence
  Synthetic
caccgctgtcccaaaaggtcaaccttagcccagttccctaccatggaatagtaggcaaggcccgccaggactccccagtgggcccccgccaccatgtccacgacagcttgtgggatccggcatatcagcagccagggcct

SEQ ID NO: 392221 - DNA, 140 bp, Artificial Sequence
  Synthetic
atacgccatgctgggtctccgtggttagcttgggggatatggtggcttcagtactacttagccagggtcgaggccttgctgcatgtctatgtacctcccttggaggtcagaggcagtcggcgtacttgggagtcggccat

SEQ ID NO: 392222 - DNA, 140 bp, Artificial Sequence
  Synthetic
atggccgactcccaagtacgccgactgcctctgacctccaagggaggtacatagacatgcagcaaggcctcgaccctggctaagtagtactgaagccaccatatcccccaagctaaccacggagacccagcatggcgtat

SEQ ID NO: 392223 - DNA, 140 bp, Artificial Sequence
  Synthetic
atacgccatgctgggtctcccctccctactgcgcatcccctactttgtgagagcgcatgccctcattaaggtttgtgggttgctacgagggatgacccacggcaggtatttccagatggccgtacttgggagtcggccat

SEQ ID NO: 392224 - DNA, 140 bp, Artificial Sequence
  Synthetic
atggccgactcccaagtacggccatctggaaatacctgccgtgggtcatccctcgtagcaacccacaaaccttaatgagggcatgcgctctcacaaagtaggggatgcgcagtagggaggggagacccagcatggcgtat

SEQ ID NO: 392225 - DNA, 140 bp, Artificial Sequence
  Synthetic
atacgccatgctgggtctccctggtggtgctgctgctatttgccggcgtcgacgcggatacccacgtcaccgggggagctgccgccttcagcacgagtggatttgttagcttcttctccacgtacttgggagtcggccat

SEQ ID NO: 392226 - DNA, 140 bp, Artificial Sequence
  Synthetic
atggccgactcccaagtacgtggagaagaagctaacaaatccactcgtgctgaaggcggcagctcccccggtgacgtgggtatccgcgtcgacgccggcaaatagcagcagcaccaccagggagacccagcatggcgtat

SEQ ID NO: 392227 - DNA, 140 bp, Artificial Sequence
  Synthetic
atacgccatgctgggtctccctagagcccgtcgtgttcacccccatggagaagaaagtgatagtctggggtgctgacacggcagcatgcggtgacatcgtgaaaggcttgcctgtctcagcgtacttgggagtcggccat

SEQ ID NO: 392228 - DNA, 140 bp, Artificial Sequence
  Synthetic
atggccgactcccaagtacgctgagacaggcaagcctttcacgatgtcaccgcatgctgccgtgtcagcaccccagactatcactttcttctccatgggggtgaacacgacgggctctagggagacccagcatggcgtat

SEQ ID NO: 392229 - DNA, 140 bp, Artificial Sequence
  Synthetic
atacgccatgctgggtctccaggcttaatgggcaccattgtgaccagtctaacggggagagacgccaatgagatctgtggcgagattcaagtgttgtcaacagccacccaatccttcctgcgtacttgggagtcggccat

SEQ ID NO: 392230 - DNA, 140 bp, Artificial Sequence
  Synthetic
atggccgactcccaagtacgcaggaaggattgggtggctgttgacaacacttgaatctcgccacagatctcattggcgtctctccccgttagactggtcacaatggtgcccattaagcctggagacccagcatggcgtat

SEQ ID NO: 392231 - DNA, 140 bp, Artificial Sequence
  Synthetic
atacgccatgctgggtctccttgaccaagacctggtgggttggccatccccccctggggctaagtctctggtgccgtgcacctgcggggcctcggacttgttcttggtgaccagacgcgccgtacttgggagtcggccat

SEQ ID NO: 392232 - DNA, 140 bp, Artificial Sequence
  Synthetic
atggccgactcccaagtacggcgcgtctggtcaccaagaacaagtccgaggccccgcaggtgcacggcaccagagacttagccccagggggggatggccaacccaccaggtcttggtcaaggagacccagcatggcgtat

SEQ ID NO: 392233 - DNA, 140 bp, Artificial Sequence
  Synthetic
atacgccatgctgggtctcctgccccctagggcacgccgtcggcattttccgtgctgcggtgtgtacccggggtgtggctaaggcggtggattttgtgccggtcgagtctcttgagacgacgtacttgggagtcggccat

SEQ ID NO: 392234 - DNA, 140 bp, Artificial Sequence
  Synthetic
atggccgactcccaagtacgtcgtctcaagagactcgaccggcacaaaatccaccgccttagccacaccccgggtacacaccgcagcacggaaaatgccgacggcgtgccctagggggcaggagacccagcatggcgtat

SEQ ID NO: 392235 - DNA, 140 bp, Artificial Sequence
  Synthetic
atacgccatgctgggtctcccaccaaggtgcctgcggcatacgccgcacagggctacaaggtgcttgtgctcaacccctctgtcgctgcaactttgggttttggttcctacatgtccaagcgtacttgggagtcggccat

SEQ ID NO: 392236 - DNA, 140 bp, Artificial Sequence
  Synthetic
atggccgactcccaagtacgcttggacatgtaggaaccaaaacccaaagttgcagcgacagaggggttgagcacaagcaccttgtagccctgtgcggcgtatgccgcaggcaccttggtgggagacccagcatggcgtat

SEQ ID NO: 392237 - DNA, 140 bp, Artificial Sequence
  Synthetic
atacgccatgctgggtctccgttgctcgggcggagcttatgacatcatcatctgtgacgagtgccactccacggactctacgaccatccttggtataggcaccgtcctagaccaagcagacgtacttgggagtcggccat

SEQ ID NO: 392238 - DNA, 140 bp, Artificial Sequence
  Synthetic
atggccgactcccaagtacgtctgcttggtctaggacggtgcctataccaaggatggtcgtagagtccgtggagtggcactcgtcacagatgatgatgtcataagctccgcccgagcaacggagacccagcatggcgtat

SEQ ID NO: 392239 - DNA, 140 bp, Artificial Sequence
  Synthetic
atacgccatgctgggtctccagcagggctcctttatcaccacaaattcaactcatcaggctgtcccgcgaggttggctagctgccgacctctaaccgactttgaccaaggctggggccctcgtacttgggagtcggccat

SEQ ID NO: 392240 - DNA, 140 bp, Artificial Sequence
  Synthetic
atggccgactcccaagtacgagggccccagccttggtcaaagtcggttagaggtcggcagctagccaacctcgcgggacagcctgatgagttgaatttgtggtgataaaggagccctgctggagacccagcatggcgtat

SEQ ID NO: 392241 - DNA, 140 bp, Artificial Sequence
  Synthetic
atacgccatgctgggtctccgcgctgttctatgtaaacaggttcaacgactcgggatgcccagagcgcatggccagctgccgccccattgaagagtttgaccaggggtggggtcccatcacgtacttgggagtcggccat

SEQ ID NO: 392242 - DNA, 140 bp, Artificial Sequence
  Synthetic
atggccgactcccaagtacgtgatgggaccccacccctggtcaaactcttcaatggggcggcagctggccatgcgctctgggcatcccgagtcgttgaacctgtttacatagaacagcgcggagacccagcatggcgtat

SEQ ID NO: 392243 - DNA, 140 bp, Artificial Sequence
  Synthetic
  misc_feature (69)..(69): n is a, c, g, or t
atacgccatgctgggtctccggacgccctcatgacgggatacaccggcaacttcgactcagtaatagantgcaacacatccgtcatacaaactgtggatttcggtttagaccccaccttccgtacttgggagtcggccat

SEQ ID NO: 392244 - DNA, 140 bp, Artificial Sequence
  Synthetic
  misc_feature (72)..(72): n is a, c, g, or t
atggccgactcccaagtacggaaggtggggtctaaaccgaaatccacagtttgtatgacggatgtgttgcantctattactgagtcgaagttgccggtgtatcccgtcatgagggcgtccggagacccagcatggcgtat

SEQ ID NO: 392245 - DNA, 140 bp, Artificial Sequence
  Synthetic
atacgccatgctgggtctccgcgtccctacgtacagttggggggagaatgagacggacgtgctgcttctcaacaacacgcggccgccgcagggcaactggttcggctgtacatggatgaacgtacttgggagtcggccat

SEQ ID NO: 392246 - DNA, 140 bp, Artificial Sequence
  Synthetic
atggccgactcccaagtacgttcatccatgtacagccgaaccagttgccctgcggcggccgcgtgttgttgagaagcagcacgtccgtctcattctccccccaactgtacgtagggacgcggagacccagcatggcgtat

SEQ ID NO: 392247 - DNA, 140 bp, Artificial Sequence
  Synthetic
aggccctggctgctgatatgaacaacacgcggccgccgcagggcaactggttcggctgtacatggatgaatagcactgggttcaccaagacgtgcgggggccccccgtgcaacatcgggggaccttttgggacagcggtg

SEQ ID NO: 392248 - DNA, 140 bp, Artificial Sequence
  Synthetic
caccgctgtcccaaaaggtcccccgatgttgcacggggggcccccgcacgtcttggtgaacccagtgctattcatccatgtacagccgaaccagttgccctgcggcggccgcgtgttgttcatatcagcagccagggcct

SEQ ID NO: 392249 - DNA, 140 bp, Artificial Sequence
  Synthetic
aggccctggctgctgatatgaggcgccaagcagaacatccagctaatcaacaccaacggcagctggcacatcaatagcacggccttgaactgcaatgatagcctcaacaccggctggatagaccttttgggacagcggtg

SEQ ID NO: 392250 - DNA, 140 bp, Artificial Sequence
  Synthetic
caccgctgtcccaaaaggtctatccagccggtgttgaggctatcattgcagttcaaggccgtgctattgatgtgccagctgccgttggtgttgattagctggatgttctgcttggcgcctcatatcagcagccagggcct

SEQ ID NO: 392251 - DNA, 140 bp, Artificial Sequence
  Synthetic
atacgccatgctgggtctcccaggtgaaagaccgtctggcatgtttgacacctctgttctttgtgaatgctatgacgcggggtgtgcttggtatgagcttacaccggcagagactacagtcgtacttgggagtcggccat

SEQ ID NO: 392252 - DNA, 140 bp, Artificial Sequence
  Synthetic
atggccgactcccaagtacgactgtagtctctgccggtgtaagctcataccaagcacaccccgcgtcatagcattcacaaagaacagaggtgtcaaacatgccagacggtctttcacctgggagacccagcatggcgtat

SEQ ID NO: 392253 - DNA, 140 bp, Artificial Sequence
  Synthetic
atacgccatgctgggtctcccacttcctttcccagacgaagcagcagggtgaaaatttcccctacctggttgcctaccaggctacagtctgcgccagggcctcagctccccccccatcatcgtacttgggagtcggccat

SEQ ID NO: 392254 - DNA, 140 bp, Artificial Sequence
  Synthetic
atggccgactcccaagtacgatgatggggggggagctgaggccctggcgcagactgtagcctggtaggcaaccaggtaggggaaattttcaccctgctgcttcgtctgggaaaggaagtgggagacccagcatggcgtat

SEQ ID NO: 392255 - DNA, 140 bp, Artificial Sequence
  Synthetic
atacgccatgctgggtctccgacccatcccatcaccaaatacatcatggcatgtatgtcagcggacctagaggtggtaaccagcacatgggttctggtggggggcgttgttgcggccttgcgtacttgggagtcggccat

SEQ ID NO: 392256 - DNA, 140 bp, Artificial Sequence
  Synthetic
atggccgactcccaagtacgcaaggccgcaacaacgccccccaccagaacccatgtgctggttaccacctctaggtccgctgacatacatgccatgatgtatttggtgatgggatgggtcggagacccagcatggcgtat

SEQ ID NO: 392257 - DNA, 140 bp, Artificial Sequence
  Synthetic
atacgccatgctgggtctccagttcgacgagatggaggagtgtgccaagcatatccccctggttgagcatggcatgcagctcgccgagcagttcaaacagaaggctatcggcgtgttgcacgtacttgggagtcggccat

SEQ ID NO: 392258 - DNA, 140 bp, Artificial Sequence
  Synthetic
atggccgactcccaagtacgtgcaacacgccgatagccttctgtttgaactgctcggcgagctgcatgccatgctcaaccagggggatatgcttggcacactcctccatctcgtcgaactggagacccagcatggcgtat

SEQ ID NO: 392259 - DNA, 140 bp, Artificial Sequence
  Synthetic
aggccctggctgctgatatgccccacagtggccaccagggacggcaaactccccacaacgcagcttcgacgtcacatcgatctgcttgtcgggagcgccaccctctgctcggccctctatgaccttttgggacagcggtg

SEQ ID NO: 392260 - DNA, 140 bp, Artificial Sequence
  Synthetic
caccgctgtcccaaaaggtcatagagggccgagcagagggtggcgctcccgacaagcagatcgatgtgacgtcgaagctgcgttgtggggagtttgccgtccctggtggccactgtggggcatatcagcagccagggcct

SEQ ID NO: 392261 - DNA, 140 bp, Artificial Sequence
  Synthetic
atacgccatgctgggtctccggtatccaatacctggccgggttgtccacgctgccggggaatcctgctatagcctcactcatgtccttcaccgctgccgtcaccagccccctcaccacgccgtacttgggagtcggccat

SEQ ID NO: 392262 - DNA, 140 bp, Artificial Sequence
  Synthetic
atggccgactcccaagtacggcgtggtgagggggctggtgacggcagcggtgaaggacatgagtgaggctatagcaggattccccggcagcgtggacaacccggccaggtattggataccggagacccagcatggcgtat

SEQ ID NO: 392263 - DNA, 140 bp, Artificial Sequence
  Synthetic
atacgccatgctgggtctcctgctgtcggcagtgtgggtttggggaagattctggtcgacatccttgctggttacggtgccggcgtggccggtgccgtcgtcactttcaagatcatgagccgtacttgggagtcggccat

SEQ ID NO: 392264 - DNA, 140 bp, Artificial Sequence
  Synthetic
atggccgactcccaagtacggctcatgatcttgaaagtgacgacggcaccggccacgccggcaccgtaaccagcaaggatgtcgaccagaatcttccccaaacccacactgccgacagcaggagacccagcatggcgtat

SEQ ID NO: 392265 - DNA, 140 bp, Artificial Sequence
  Synthetic
atacgccatgctgggtctccgccacgtggggcctggcgagggggctgtgcagtggatgaatcgcctcattgcattcgcctcgcgaggcaaccatgtgtccccgacgcactacgtcccagacgtacttgggagtcggccat

SEQ ID NO: 392266 - DNA, 140 bp, Artificial Sequence
  Synthetic
atggccgactcccaagtacgtctgggacgtagtgcgtcggggacacatggttgcctcgcgaggcgaatgcaatgaggcgattcatccactgcacagccccctcgccaggccccacgtggcggagacccagcatggcgtat

SEQ ID NO: 392267 - DNA, 140 bp, Artificial Sequence
  Synthetic
atacgccatgctgggtctccccctgtgacaccagctggttgcgggagatttgggattgggtctgtaccgtcctgagtgactttaaaacgtggctcaaggctaagcttctgcccgccatgccgtacttgggagtcggccat

SEQ ID NO: 392268 - DNA, 140 bp, Artificial Sequence
  Synthetic
atggccgactcccaagtacggcatggcgggcagaagcttagccttgagccacgttttaaagtcactcaggacggtacagacccaatcccaaatctcccgcaaccagctggtgtcacagggggagacccagcatggcgtat

SEQ ID NO: 392269 - DNA, 140 bp, Artificial Sequence
  Synthetic
atacgccatgctgggtctccccacatcaaaaatggttcgatgaggatcgtcgggccaaggacttgcagtaacacctggcatggcacttttcccatcaatgcaactaccacgggtagtggacgtacttgggagtcggccat

SEQ ID NO: 392270 - DNA, 140 bp, Artificial Sequence
  Synthetic
atggccgactcccaagtacgtccactacccgtggtagttgcattgatgggaaaagtgccatgccaggtgttactgcaagtccttggcccgacgatcctcatcgaaccatttttgatgtggggagacccagcatggcgtat

SEQ ID NO: 392271 - DNA, 140 bp, Artificial Sequence
  Synthetic
atacgccatgctgggtctccgcatgacgcaagacaacatcaaatgcccctgccaggttcctgctcctgagtttttcactgaagtggacggcgtcaggctacaccgctacgctccagactgcgtacttgggagtcggccat

SEQ ID NO: 392272 - DNA, 140 bp, Artificial Sequence
  Synthetic
atggccgactcccaagtacgcagtctggagcgtagcggtgtagcctgacgccgtccacttcagtgaaaaactcaggagcaggaacctggcaggggcatttgatgttgtcttgcgtcatgcggagacccagcatggcgtat

SEQ ID NO: 392273 - DNA, 140 bp, Artificial Sequence
  Synthetic
atacgccatgctgggtctccctgacatccatgttaacagacccgtcccatctgactgcggagacggcccgccggagactggctcgggggtccccaccttctttggccagctcatcggcaacgtacttgggagtcggccat

SEQ ID NO: 392274 - DNA, 140 bp, Artificial Sequence
  Synthetic
atggccgactcccaagtacgttgccgatgagctggccaaagaaggtggggacccccgagccagtctccggcgggccgtctccgcagtcagatgggacgggtctgttaacatggatgtcagggagacccagcatggcgtat

SEQ ID NO: 392275 - DNA, 140 bp, Artificial Sequence
  Synthetic
atacgccatgctgggtctccgggcagcaacatcactagggtcgaatcggagaacaaggtagtggtgctggactcttttgagccccttgtggctgagccggacgatgttgagatctccacgcgtacttgggagtcggccat

SEQ ID NO: 392276 - DNA, 140 bp, Artificial Sequence
  Synthetic
atggccgactcccaagtacgcgtggagatctcaacatcgtccggctcagccacaaggggctcaaaagagtccagcaccactaccttgttctccgattcgaccctagtgatgttgctgcccggagacccagcatggcgtat

SEQ ID NO: 392277 - DNA, 140 bp, Artificial Sequence
  Synthetic
atacgccatgctgggtctcccggactacatccctccggttgtgcatgggtgcgccctacccccaaacaagccagcccccgtgcctcctccgaggaggaaacgggttgtcgcgctgtctgacgtacttgggagtcggccat

SEQ ID NO: 392278 - DNA, 140 bp, Artificial Sequence
  Synthetic
atggccgactcccaagtacgtcagacagcgcgacaacccgtttcctcctcggaggaggcacgggggctggcttgtttgggggtagggcgcacccatgcacaaccggagggatgtagtccgggagacccagcatggcgtat

SEQ ID NO: 392279 - DNA, 140 bp, Artificial Sequence
  Synthetic
atacgccatgctgggtctccaccaacccggatccttccatcgcggacgatagatctgatgacgggtccttctcgtcgatgcctccgctcgagggggaaccgggtgatcctgatctgacttcgtacttgggagtcggccat

SEQ ID NO: 392280 - DNA, 140 bp, Artificial Sequence
  Synthetic
atggccgactcccaagtacgaagtcagatcaggatcacccggttccccctcgagcggaggcatcgacgagaaggacccgtcatcagatctatcgtccgcgatggaaggatccgggttggtggagacccagcatggcgtat

SEQ ID NO: 392281 - DNA, 140 bp, Artificial Sequence
  Synthetic
atacgccatgctgggtctccgccaaaactaccaatcagcccactgagcaactctctgttgcgtcaccacaacatggtgtacgctacgacgtcacggtcggccacggcacgacaaaagaagcgtacttgggagtcggccat

SEQ ID NO: 392282 - DNA, 140 bp, Artificial Sequence
  Synthetic
atggccgactcccaagtacgcttcttttgtcgtgccgtggccgaccgtgacgtcgtagcgtacaccatgttgtggtgacgcaacagagagttgctcagtgggctgattggtagttttggcggagacccagcatggcgtat

SEQ ID NO: 392283 - DNA, 140 bp, Artificial Sequence
  Synthetic
atacgccatgctgggtctcctggaagaggcctgtagcttgacgcccccgcattcagccagatctaagtttggctatggggcaaaagatgttcgaagcctatcccgcaaggccattgaccacgtacttgggagtcggccat

SEQ ID NO: 392284 - DNA, 140 bp, Artificial Sequence
  Synthetic
atggccgactcccaagtacgtggtcaatggccttgcgggataggcttcgaacatcttttgccccatagccaaacttagatctggctgaatgcgggggcgtcaagctacaggcctcttccaggagacccagcatggcgtat

SEQ ID NO: 392285 - DNA, 140 bp, Artificial Sequence
  Synthetic
atacgccatgctgggtctccggtggtcgcaagcccgcacggctaatcgtattccccgacctaggggtccgggtatgcgagaagcgggcactttacaacgtcatccagaagctccctcaggcgtacttgggagtcggccat

SEQ ID NO: 392286 - DNA, 140 bp, Artificial Sequence
  Synthetic
atggccgactcccaagtacgcctgagggagcttctggatgacgttgtaaagtgcccgcttctcgcatacccggacccctaggtcggggaatacgattagccgtgcgggcttgcgaccaccggagacccagcatggcgtat

SEQ ID NO: 392287 - DNA, 140 bp, Artificial Sequence
  Synthetic
atacgccatgctgggtctccatacgacacccgctgctttgactccacggtgactgaaagggacatacaggtagaggaggagatctaccagtgttgtgacctggatcccgagacccgcaagcgtacttgggagtcggccat

SEQ ID NO: 392288 - DNA, 140 bp, Artificial Sequence
  Synthetic
atggccgactcccaagtacgcttgcgggtctcgggatccaggtcacaacactggtagatctcctcctctacctgtatgtccctttcagtcaccgtggagtcaaagcagcgggtgtcgtatggagacccagcatggcgtat

SEQ ID NO: 392289 - DNA, 140 bp, Artificial Sequence
  Synthetic
aggccctggctgctgatatggtaggcatattcagggccgcggtgtgcacccgtggagtggctaaggcggtggactttatccccgtggagagcctagagacaaccatgaggtccccggtgtgaccttttgggacagcggtg

SEQ ID NO: 392290 - DNA, 140 bp, Artificial Sequence
  Synthetic
caccgctgtcccaaaaggtcacaccggggacctcatggttgtctctaggctctccacggggataaagtccaccgccttagccactccacgggtgcacaccgcggccctgaatatgcctaccatatcagcagccagggcct

SEQ ID NO: 392291 - DNA, 140 bp, Artificial Sequence
  Synthetic
atacgccatgctgggtctcctcaccacgagttttgggaacacactgacatgctacctcaaggccacagccgccgccaaggctgcaggtctgaaggattacagcatgctggtctgcggtgacgtacttgggagtcggccat

SEQ ID NO: 392292 - DNA, 140 bp, Artificial Sequence
  Synthetic
atggccgactcccaagtacgtcaccgcagaccagcatgctgtaatccttcagacctgcagccttggcggcggctgtggccttgaggtagcatgtcagtgtgttcccaaaactcgtggtgaggagacccagcatggcgtat

SEQ ID NO: 392293 - DNA, 140 bp, Artificial Sequence
  Synthetic
atacgccatgctgggtctccgacgtcccgcagccagcatatgacttagagctgataacatcatgctcttccaatgtctctgtggcacacgacgcgacggggaagagggtctactatttaacgtacttgggagtcggccat

SEQ ID NO: 392294 - DNA, 140 bp, Artificial Sequence
  Synthetic
atggccgactcccaagtacgttaaatagtagaccctcttccccgtcgcgtcgtgtgccacagagacattggaagagcatgatgttatcagctctaagtcatatgctggctgcgggacgtcggagacccagcatggcgtat

SEQ ID NO: 392295 - DNA, 140 bp, Artificial Sequence
  Synthetic
atacgccatgctgggtctccaatttgggcgcggatgatactgatgacccacttcttctcaatactccaaagccaggaagcccttgaaaaggcgttggacttcgatatgtacggagtcacacgtacttgggagtcggccat

SEQ ID NO: 392296 - DNA, 140 bp, Artificial Sequence
  Synthetic
atggccgactcccaagtacgtgtgactccgtacatatcgaagtccaacgccttttcaagggcttcctggctttggagtattgagaagaagtgggtcatcagtatcatccgcgcccaaattggagacccagcatggcgtat

SEQ ID NO: 392297 - DNA, 140 bp, Artificial Sequence
  Synthetic
atacgccatgctgggtctcctggcagcgtgcctcagaaaacttggggtacccccattgagagcttggagacatcgggctagagcagtgcgcgccaagctcatcgctcagggaggcagagccgtacttgggagtcggccat

SEQ ID NO: 392298 - DNA, 140 bp, Artificial Sequence
  Synthetic
atggccgactcccaagtacggctctgcctccctgagcgatgagcttggcgcgcactgctctagcccgatgtctccaagctctcaatgggggtaccccaagttttctgaggcacgctgccaggagacccagcatggcgtat

SEQ ID NO: 392299 - DNA, 140 bp, Artificial Sequence
  Synthetic
atacgccatgctgggtctccgcgttgctagtaccaaccctattttcattcttcgccaaaagcactctgattgacaaatacgatttatctaatttacacgaaattgcttctgggggcgcaccgtacttgggagtcggccat

SEQ ID NO: 392300 - DNA, 140 bp, Artificial Sequence
  Synthetic
atggccgactcccaagtacggtgcgcccccagaagcaatttcgtgtaaattagataaatcgtatttgtcaatcagagtgcttttggcgaagaatgaaaatagggttggtactagcaacgcggagacccagcatggcgtat

SEQ ID NO: 392301 - DNA, 140 bp, Artificial Sequence
  Synthetic
atacgccatgctgggtctccacggtgggcgccggcgagggggacgtttatcacagcgcgtccttagcccgacctcgctattttctcctgtgcctactcctacttaccgtaggggtaggcacgtacttgggagtcggccat

SEQ ID NO: 392302 - DNA, 140 bp, Artificial Sequence
  Synthetic
atggccgactcccaagtacgtgcctacccctacggtaagtaggagtaggcacaggagaaaatagcgaggtcgggctaaggacgcgctgtgataaacgtccccctcgccggcgcccaccgtggagacccagcatggcgtat

SEQ ID NO: 392303 - DNA, 140 bp, Artificial Sequence
  Synthetic
aggccctggctgctgatatgacctcgctattttctcctgtgcctactcctacttaccgtaggggtaggcatctttttattgcccgcccgataggggtaacactccgaccttagggtcaacgaccttttgggacagcggtg

SEQ ID NO: 392304 - DNA, 140 bp, Artificial Sequence
  Synthetic
caccgctgtcccaaaaggtcgttgaccctaaggtcggagtgttacccctatcgggcgggcaataaaaagatgcctacccctacggtaagtaggagtaggcacaggagaaaatagcgaggtcatatcagcagccagggcct

SEQ ID NO: 392305 - DNA, 140 bp, Artificial Sequence
  Synthetic
  misc_feature (55)..(55): n is a, c, g, or t
  misc_feature (82)..(82): n is a, c, g, or t
aggccctggctgctgatatgggccgtcttggggccccaatgatccccggcgtagntcccgcaacttgggtaaggtcatcganaccctaacatgcggcttcgccgacctcatgggatatatgaccttttgggacagcggtg

SEQ ID NO: 392306 - DNA, 140 bp, Artificial Sequence
  Synthetic
  misc_feature (59)..(59): n is a, c, g, or t
  misc_feature (86)..(86): n is a, c, g, or t
caccgctgtcccaaaaggtcatatatcccatgaggtcggcgaagccgcatgttagggtntcgatgaccttacccaagttgcggganctacgccggggatcattggggccccaagacggcccatatcagcagccagggcct

SEQ ID NO: 392307 - DNA, 140 bp, Artificial Sequence
  Synthetic
  misc_feature (41)..(41): n is a, c, g, or t
  misc_feature (56)..(56): n is a, c, g, or t
  misc_feature (84)..(84): n is a, c, g, or t
atacgccatgctgggtctccggttgctccttttctatcttnctcttggcacttctntcgtgcctgacaacaccggcgtccgcgntaaattaccggaacgcctcgggcgtctatcatatcacgtacttgggagtcggccat

SEQ ID NO: 392308 - DNA, 140 bp, Artificial Sequence
  Synthetic
  misc_feature (57)..(57): n is a, c, g, or t
  misc_feature (85)..(85): n is a, c, g, or t
  misc_feature (100)..(100): n is a, c, g, or t
atggccgactcccaagtacgtgatatgatagacgcccgaggcgttccggtaatttancgcggacgccggtgttgtcaggcacganagaagtgccaagagnaagatagaaaaggagcaaccggagacccagcatggcgtat

SEQ ID NO: 392309 - DNA, 140 bp, Artificial Sequence
  Synthetic
  misc_feature (34)..(34): n is a, c, g, or t
aggccctggctgctgatatgaccggcgtccgcgntaaattaccggaacgcctcgggcgtctatcatatcaccaatgactgcccgaactccagcattgtgtatgagacagaacaccagatcgaccttttgggacagcggtg

SEQ ID NO: 392310 - DNA, 140 bp, Artificial Sequence
  Synthetic
  misc_feature (107)..(107): n is a, c, g, or t
caccgctgtcccaaaaggtcgatctggtgttctgtctcatacacaatgctggagttcgggcagtcattggtgatatgatagacgcccgaggcgttccggtaatttancgcggacgccggtcatatcagcagccagggcct

SEQ ID NO: 392311 - DNA, 140 bp, Artificial Sequence
  Synthetic
  misc_feature (67)..(67): n is a, c, g, or t
atacgccatgctgggtctcccactggagtccatgcgtaggcatgtagacttgatggtgggcgccgcnaccatgtgctccgccttgtatgtcggagacgtgtgtgggggtattttcctagtcgtacttgggagtcggccat

SEQ ID NO: 392312 - DNA, 140 bp, Artificial Sequence
  Synthetic
  misc_feature (74)..(74): n is a, c, g, or t
atggccgactcccaagtacgactaggaaaatacccccacacacgtctccgacatacaaggcggagcacatggtngcggcgcccaccatcaagtctacatgcctacgcatggactccagtgggagacccagcatggcgtat

SEQ ID NO: 392313 - DNA, 140 bp, Artificial Sequence
  Synthetic
atacgccatgctgggtctccgacatgatgatgaactggagccctaccaccactctggttttggcccaggtcatgcgactcccctctgctctcggcgacatgttcgccggaggtcactgggcgtacttgggagtcggccat

SEQ ID NO: 392314 - DNA, 140 bp, Artificial Sequence
  Synthetic
atggccgactcccaagtacgcccagtgacctccggcgaacatgtcgccgagagcagaggggagtcgcatgacctgggccaaaaccagagtggtggtagggctccagttcatcatcatgtcggagacccagcatggcgtat

SEQ ID NO: 392315 - DNA, 140 bp, Artificial Sequence
  Synthetic
  misc_feature (35)..(35): n is a, c, g, or t
  misc_feature (71)..(71): n is a, c, g, or t
  misc_feature (75)..(75): n is a, c, g, or t
  misc_feature (81)..(81): n is a, c, g, or t
  misc_feature (88)..(88): n is a, c, g, or t
atacgccatgctgggtctccgtcgggcggggctgncggacatactaccagcggcctcgccagcatgttcantcgngggccnagccagnatatccagctcattaacaccaacgggagctggcgtacttgggagtcggccat

SEQ ID NO: 392316 - DNA, 140 bp, Artificial Sequence
  Synthetic
  misc_feature (53)..(53): n is a, c, g, or t
  misc_feature (60)..(60): n is a, c, g, or t
  misc_feature (66)..(66): n is a, c, g, or t
  misc_feature (70)..(70): n is a, c, g, or t
  misc_feature (106)..(106): n is a, c, g, or t
atggccgactcccaagtacgccagctcccgttggtgttaatgagctggatatnctggctnggcccncgantgaacatgctggcgaggccgctggtagtatgtccgncagccccgcccgacggagacccagcatggcgtat

SEQ ID NO: 392317 - DNA, 140 bp, Artificial Sequence
  Synthetic
atacgccatgctgggtctccggtcttggcagctccaacatctctggtccgtctgatgacaagccttactgctggcactacgcacccaggccatgcggtgtcgtgcccgcgggcaaagtatcgtacttgggagtcggccat

SEQ ID NO: 392318 - DNA, 140 bp, Artificial Sequence
  Synthetic
atggccgactcccaagtacgatactttgcccgcgggcacgacaccgcatggcctgggtgcgtagtgccagcagtaaggcttgtcatcagacggaccagagatgttggagctgccaagaccggagacccagcatggcgtat

SEQ ID NO: 392319 - DNA, 140 bp, Artificial Sequence
  Synthetic
atacgccatgctgggtctccgtggccccgtgtactgcttcacacccagtcccgtagtggtcggtactaccgatcgcttagggctccccacgtacacctggggggvaaatgagactgacgtcgtacttgggagtcggccat

SEQ ID NO: 392320 - DNA, 140 bp, Artificial Sequence
  Synthetic
atggccgactcccaagtacgacgtcagtctcatttvccccccaggtgtacgtggggagccctaagcgatcggtagtaccgaccactacgggactgggtgtgaagcagtacacggggccacggagacccagcatggcgtat

SEQ ID NO: 392321 - DNA, 140 bp, Artificial Sequence
  Synthetic
  misc_feature (104)..(104): n is a, c, g, or t
aggccctggctgctgatatggatcgcttagggctccccacgtacacctggggggvaaatgagactgacgtcttcctgctgaactccaccaggcctcccagtggngggtggtttgggtgcagaccttttgggacagcggtg

SEQ ID NO: 392322 - DNA, 140 bp, Artificial Sequence
  Synthetic
  misc_feature (37)..(37): n is a, c, g, or t
caccgctgtcccaaaaggtctgcacccaaaccacccnccactgggaggcctggtggagttcagcaggaagacgtcagtctcatttvccccccaggtgtacgtggggagccctaagcgatccatatcagcagccagggcct

SEQ ID NO: 392323 - DNA, 140 bp, Artificial Sequence
  Synthetic
atacgccatgctgggtctccgaaacatccggatgcgacctacgccaagtgcgggtcagggccctggctcacgcctaggtgtatggtccattatccgtatcggctgtggcactatccgtgccgtacttgggagtcggccat

SEQ ID NO: 392324 - DNA, 140 bp, Artificial Sequence
  Synthetic
atggccgactcccaagtacggcacggatagtgccacagccgatacggataatggaccatacacctaggcgtgagccagggccctgacccgcacttggcgtaggtcgcatccggatgtttcggagacccagcatggcgtat

SEQ ID NO: 392325 - DNA, 140 bp, Artificial Sequence
  Synthetic
aggccctggctgctgatatggcgggatgtggcccctgcttctcctacttctcatgctgcccgaaagggcttatgcatttgaccaggaggtggcagggtctcttggcggcgtgatcattgtgaccttttgggacagcggtg

SEQ ID NO: 392326 - DNA, 140 bp, Artificial Sequence
  Synthetic
caccgctgtcccaaaaggtcacaatgatcacgccgccaagagaccctgccacctcctggtcaaatgcataagccctttcgggcagcatgagaagtaggagaagcaggggccacatcccgccatatcagcagccagggcct

SEQ ID NO: 392327 - DNA, 140 bp, Artificial Sequence
  Synthetic
  misc_feature (49)..(49): n is a, c, g, or t
atacgccatgctgggtctcctcgaggatagagaccgcacagagctgtcnccactgctcctatccactacccagtggcaggtgcttccttgctctttcacgactctcccagccctatcgaccgtacttgggagtcggccat

SEQ ID NO: 392328 - DNA, 140 bp, Artificial Sequence
  Synthetic
  misc_feature (92)..(92): n is a, c, g, or t
atggccgactcccaagtacggtcgatagggctgggagagtcgtgaaagagcaaggaagcacctgccactgggtagtggataggagcagtggngacagctctgtgcggtctctatcctcgaggagacccagcatggcgtat

SEQ ID NO: 392329 - DNA, 140 bp, Artificial Sequence
  Synthetic
atacgccatgctgggtctcccttgcgtttctgctactcgcagacgccagggtctgcgcctgcctctggatgatgctgctcgtgtcgcaagtcgaggcggctatggctaacctgattaacacgtacttgggagtcggccat

SEQ ID NO: 392330 - DNA, 140 bp, Artificial Sequence
  Synthetic
atggccgactcccaagtacgtgttaatcaggttagccatagccgcctcgacttgcgacacgagcagcatcatccagaggcaggcgcagaccctggcgtctgcgagtagcagaaacgcaagggagacccagcatggcgtat

SEQ ID NO: 392331 - DNA, 140 bp, Artificial Sequence
  Synthetic
atacgccatgctgggtctccttacgcagcttgcgggatgtggcccctgctgctcttgctccttgcgttacccgaaagggcatacgcattggacgcagaagtcgcaggatccctcggcggacgtacttgggagtcggccat

SEQ ID NO: 392332 - DNA, 140 bp, Artificial Sequence
  Synthetic
atggccgactcccaagtacgtccgccgagggatcctgcgacttctgcgtccaatgcgtatgccctttcgggtaacgcaaggagcaagagcagcaggggccacatcccgcaagctgcgtaaggagacccagcatggcgtat

SEQ ID NO: 392333 - DNA, 140 bp, Artificial Sequence
  Synthetic
atacgccatgctgggtctccaggctcttctgtatgtctacatcccgcccctagaagttaggggcggccgagattccctgatcatcctcgcggtcttgctccaccctgggctggtttttgacgtacttgggagtcggccat

SEQ ID NO: 392334 - DNA, 140 bp, Artificial Sequence
  Synthetic
atggccgactcccaagtacgtcaaaaaccagcccagggtggagcaagaccgcgaggatgatcagggaatctcggccgcccctaacttctaggggcgggatgtagacatacagaagagcctggagacccagcatggcgtat

SEQ ID NO: 392335 - DNA, 140 bp, Artificial Sequence
  Synthetic
atacgccatgctgggtctccatttgtggattcgtgcggggggtggctcacggcaagttcgtccagatggctatgctcaagctgggcgccctaaccggcacgtatgtgtatgaccatctcacgtacttgggagtcggccat

SEQ ID NO: 392336 - DNA, 140 bp, Artificial Sequence
  Synthetic
atggccgactcccaagtacgtgagatggtcatacacatacgtgccggttagggcgcccagcttgagcatagccatctggacgaacttgccgtgagccaccccccgcacgaatccacaaatggagacccagcatggcgtat

SEQ ID NO: 392337 - DNA, 140 bp, Artificial Sequence
  Synthetic
  misc_feature (84)..(84): n is a, c, g, or t
aggccctggctgctgatatgtatgctcaagctgggcgccctaaccggcacgtatgtgtatgaccatctcactccgttgtcggantgggccgccgatggcctgaaggacctagcagtggccgaccttttgggacagcggtg

SEQ ID NO: 392338 - DNA, 140 bp, Artificial Sequence
  Synthetic
  misc_feature (57)..(57): n is a, c, g, or t
caccgctgtcccaaaaggtcggccactgctaggtccttcaggccatcggcggcccantccgacaacggagtgagatggtcatacacatacgtgccggttagggcgcccagcttgagcatacatatcagcagccagggcct

SEQ ID NO: 392339 - DNA, 140 bp, Artificial Sequence
  Synthetic
atacgccatgctgggtctccctagactgggcaatgagatactgctcggtcctgcagacggtgagcacgcgaaggggtggaggcttctcgctcccatcaccgcgtacgcacaacagacccgcgtacttgggagtcggccat

SEQ ID NO: 392340 - DNA, 140 bp, Artificial Sequence
  Synthetic
atggccgactcccaagtacgcgggtctgttgtgcgtacgcggtgatgggagcgagaagcctccaccccttcgcgtgctcaccgtctgcaggaccgagcagtatctcattgcccagtctagggagacccagcatggcgtat

SEQ ID NO: 392341 - DNA, 140 bp, Artificial Sequence
  Synthetic
  misc_feature (77)..(77): n is a, c, g, or t
atacgccatgctgggtctccggtacatcgatcaacggtgtgttgtggacggtgtatcatggagccggcagcaagacnatttgcggcccgaaagggccagtcaatcagatgtacactaatgcgtacttgggagtcggccat

SEQ ID NO: 392342 - DNA, 140 bp, Artificial Sequence
  Synthetic
  misc_feature (64)..(64): n is a, c, g, or t
atggccgactcccaagtacgcattagtgtacatctgattgactggccctttcgggccgcaaatngtcttgctgccggctccatgatacaccgtccacaacacaccgttgatcgatgtaccggagacccagcatggcgtat

SEQ ID NO: 392343 - DNA, 140 bp, Artificial Sequence
  Synthetic
  misc_feature (27)..(27): n is a, c, g, or t
aggccctggctgctgatatgcaagacnatttgcggcccgaaagggccagtcaatcagatgtacactaatgtagaccaagacctagtgggttggcctgctcctcctggtgctaagtccctagaccttttgggacagcggtg

SEQ ID NO: 392344 - DNA, 140 bp, Artificial Sequence
  Synthetic
  misc_feature (114)..(114): n is a, c, g, or t
caccgctgtcccaaaaggtctagggacttagcaccaggaggagcaggccaacccactaggtcttggtctacattagtgtacatctgattgactggccctttcgggccgcaaatngtcttgcatatcagcagccagggcct

SEQ ID NO: 392345 - DNA, 140 bp, Artificial Sequence
  Synthetic
atacgccatgctgggtctccgccccaggcctatctcaactctcaagggctcctccggtggtccgctgctgtgccccctggggcatgccgtaggcattttccgcgctgcggtgtgcacccgcgtacttgggagtcggccat

SEQ ID NO: 392346 - DNA, 140 bp, Artificial Sequence
  Synthetic
atggccgactcccaagtacgcgggtgcacaccgcagcgcggaaaatgcctacggcatgccccagggggcacagcagcggaccaccggaggagcccttgagagttgagataggcctggggcggagacccagcatggcgtat

SEQ ID NO: 392347 - DNA, 140 bp, Artificial Sequence
  Synthetic
aggccctggctgctgatatgcgttgctgggtagcgctcactcccacgctcgcggccaggaatgccagcgtccccaccacgacaatacgacgtcacgtcgatttgctcgttggggcggctggaccttttgggacagcggtg

SEQ ID NO: 392348 - DNA, 140 bp, Artificial Sequence
  Synthetic
caccgctgtcccaaaaggtccagccgccccaacgagcaaatcgacgtgacgtcgtattgtcgtggtggggacgctggcattcctggccgcgagcgtgggagtgagcgctacccagcaacgcatatcagcagccagggcct

SEQ ID NO: 392349 - DNA, 140 bp, Artificial Sequence
  Synthetic
atacgccatgctgggtctcccaaacctaccaagtggcccatttgcacgccccgacggggagtggcaagagcaccaaagtgcccgcggcgtatgctgcgcaaggctacaaggtgctagtgccgtacttgggagtcggccat

SEQ ID NO: 392350 - DNA, 140 bp, Artificial Sequence
  Synthetic
atggccgactcccaagtacggcactagcaccttgtagccttgcgcagcatacgccgcgggcactttggtgctcttgccactccccgtcggggcgtgcaaatgggccacttggtaggtttgggagacccagcatggcgtat

SEQ ID NO: 392351 - DNA, 140 bp, Artificial Sequence
  Synthetic
aggccctggctgctgatatgctgcaactgctcaatctatcccggccacgtatcaggtcaccgcatggcttgggatatgatgatgaactggtcacctacaacagccctagtggtatcgcaggaccttttgggacagcggtg

SEQ ID NO: 392352 - DNA, 140 bp, Artificial Sequence
  Synthetic
caccgctgtcccaaaaggtcctgcgataccactagggctgttgtaggtgaccagttcatcatcatatcccaagccatgcggtgacctgatacgtggccgggatagattgagcagttgcagcatatcagcagccagggcct

SEQ ID NO: 392353 - DNA, 140 bp, Artificial Sequence
  Synthetic
atacgccatgctgggtctcctcaacccctccgttgcggcgactttgggttttggttcctacatgtccaaggcgcatggcatcgacccgaacatacggtcaggtgtcaggaccatcactaccgtacttgggagtcggccat

SEQ ID NO: 392354 - DNA, 140 bp, Artificial Sequence
  Synthetic
atggccgactcccaagtacggtagtgatggtcctgacacctgaccgtatgttcgggtcgatgccatgcgccttggacatgtaggaaccaaaacccaaagtcgccgcaacggaggggttgaggagacccagcatggcgtat

SEQ ID NO: 392355 - DNA, 140 bp, Artificial Sequence
  Synthetic
aggccctggctgctgatatggggaatcctggcgggccttgcctactattccatggtggggaactgggccaaggtcttgattgtgatgctactctttgccggcgttgatggaacaacccacgaccttttgggacagcggtg

SEQ ID NO: 392356 - DNA, 140 bp, Artificial Sequence
  Synthetic
caccgctgtcccaaaaggtcgtgggttgttccatcaacgccggcaaagagtagcatcacaatcaagaccttggcccagttccccaccatggaatagtaggcaaggcccgccaggattccccatatcagcagccagggcct

SEQ ID NO: 392357 - DNA, 140 bp, Artificial Sequence
  Synthetic
atacgccatgctgggtctccgctgtgggggaggcgcttatgacatcatcatctgtgacgagtgccactccacggactccacaacgatcctcggcattggcacggtcttagatcaagcagacgtacttgggagtcggccat

SEQ ID NO: 392358 - DNA, 140 bp, Artificial Sequence
  Synthetic
atggccgactcccaagtacgtctgcttgatctaagaccgtgccaatgccgaggatcgttgtggagtccgtggagtggcactcgtcacagatgatgatgtcataagcgcctcccccacagcggagacccagcatggcgtat

SEQ ID NO: 392359 - DNA, 140 bp, Artificial Sequence
  Synthetic
  misc_feature (95)..(95): n is a, c, g, or t
  misc_feature (116)..(116): n is a, c, g, or t
aggccctggctgctgatatgacggactccacaacgatcctcggcattggcacggtcttagatcaagcagagaccgctggagtacgcctcgtagtncttgcgactgctactccgccnggatgaccttttgggacagcggtg

SEQ ID NO: 392360 - DNA, 140 bp, Artificial Sequence
  Synthetic
  misc_feature (25)..(25): n is a, c, g, or t
  misc_feature (46)..(46): n is a, c, g, or t
caccgctgtcccaaaaggtcatccnggcggagtagcagtcgcaagnactacgaggcgtactccagcggtctctgcttgatctaagaccgtgccaatgccgaggatcgttgtggagtccgtcatatcagcagccagggcct

SEQ ID NO: 392361 - DNA, 140 bp, Artificial Sequence
  Synthetic
atacgccatgctgggtctccggcacatcaacaggactgccctgaactgcaatgactctctccaaacagggtttcttgccgcgctgttctacacacacaaattcaactcatccggatgccccgtacttgggagtcggccat

SEQ ID NO: 392362 - DNA, 140 bp, Artificial Sequence
  Synthetic
atggccgactcccaagtacggggcatccggatgagttgaatttgtgtgtgtagaacagcgcggcaagaaaccctgtttggagagagtcattgcagttcagggcagtcctgttgatgtgccggagacccagcatggcgtat

SEQ ID NO: 392363 - DNA, 140 bp, Artificial Sequence
  Synthetic
  misc_feature (42)..(42): n is a, c, g, or t
atacgccatgctgggtctccgggcagacacctcatcttttgncattccaagaagaagtgcgatgagttagccaagcagctgtcctctctcggcctcaacgcagtggcctactacagaggccgtacttgggagtcggccat

SEQ ID NO: 392364 - DNA, 140 bp, Artificial Sequence
  Synthetic
  misc_feature (99)..(99): n is a, c, g, or t
atggccgactcccaagtacggcctctgtagtaggccactgcgttgaggccgagagaggacagctgcttggctaactcatcgcacttcttcttggaatgncaaaagatgaggtgtctgcccggagacccagcatggcgtat

SEQ ID NO: 392365 - DNA, 140 bp, Artificial Sequence
  Synthetic
atacgccatgctgggtctccgtcccatcacttacagtgagcagcatgacccggaccagaggccttattgttggcactacgcgccccaaccgtgcggtattgtacccgcgtcagaggtgtgcgtacttgggagtcggccat

SEQ ID NO: 392366 - DNA, 140 bp, Artificial Sequence
  Synthetic
atggccgactcccaagtacgcacacctctgacgcgggtacaataccgcacggttggggcgcgtagtgccaacaataaggcctctggtccgggtcatgctgctcactgtaagtgatgggacggagacccagcatggcgtat

SEQ ID NO: 392367 - DNA, 140 bp, Artificial Sequence
  Synthetic
atacgccatgctgggtctccgtaacacgtctgtcatccagaccgtggacttcagcttggaccccactttttctatagagaccacaaccgtgcctcaggatgcagtgtctcggagtcaacgcgtacttgggagtcggccat

SEQ ID NO: 392368 - DNA, 140 bp, Artificial Sequence
  Synthetic
atggccgactcccaagtacgcgttgactccgagacactgcatcctgaggcacggttgtggtctctatagaaaaagtggggtccaagctgaagtccacggtctggatgacagacgtgttacggagacccagcatggcgtat

SEQ ID NO: 392369 - DNA, 140 bp, Artificial Sequence
  Synthetic
aggccctggctgctgatatgtctatagagaccacaaccgtgcctcaggatgcagtgtctcggagtcaacgaagggggcgcactggtagggggaggttggggatctaccggtacgtaacccgaccttttgggacagcggtg

SEQ ID NO: 392370 - DNA, 140 bp, Artificial Sequence
  Synthetic
caccgctgtcccaaaaggtcgggttacgtaccggtagatccccaacctccccctaccagtgcgcccccttcgttgactccgagacactgcatcctgaggcacggttgtggtctctatagacatatcagcagccagggcct

SEQ ID NO: 392371 - DNA, 140 bp, Artificial Sequence
  Synthetic
atacgccatgctgggtctcccaggttaagggcttacttcaacacaccaggcctccccgtctgccaggaccatcttgaattctgggagggcgtttttacaggtttaacccatatagatgcccgtacttgggagtcggccat

SEQ ID NO: 392372 - DNA, 140 bp, Artificial Sequence
  Synthetic
atggccgactcccaagtacgggcatctatatgggttaaacctgtaaaaacgccctcccagaattcaagatggtcctggcagacggggaggcctggtgtgttgaagtaagcccttaacctgggagacccagcatggcgtat

SEQ ID NO: 392373 - DNA, 140 bp, Artificial Sequence
  Synthetic
atacgccatgctgggtctccgggataccatgtggaagtgcctcatccgtcttaagccaactttgcacggacccacccccctcctatatcggctaggggcagtgcagaacgaggtcacactcgtacttgggagtcggccat

SEQ ID NO: 392374 - DNA, 140 bp, Artificial Sequence
  Synthetic
atggccgactcccaagtacgagtgtgacctcgttctgcactgcccctagccgatataggaggggggtgggtccgtgcaaagttggcttaagacggatgaggcacttccacatggtatcccggagacccagcatggcgtat

SEQ ID NO: 392375 - DNA, 140 bp, Artificial Sequence
  Synthetic
atacgccatgctgggtctccgctgcgtactgcctggctgtagggagtgtggtggtggttgggagagtcatcttgtcagggcagcctgccatcataccagaccgcgaggtgctttatcagccgtacttgggagtcggccat

SEQ ID NO: 392376 - DNA, 140 bp, Artificial Sequence
  Synthetic
atggccgactcccaagtacggctgataaagcacctcgcggtctggtatgatggcaggctgccctgacaagatgactctcccaaccaccaccacactccctacagccaggcagtacgcagcggagacccagcatggcgtat

SEQ ID NO: 392377 - DNA, 140 bp, Artificial Sequence
  Synthetic
aggccctggctgctgatatgcttgtcagggcagcctgccatcataccagaccgcgaggtgctttatcagcagttcgacgaaatggaggagtgctctaagtacatccccatggtcgagcatgaccttttgggacagcggtg

SEQ ID NO: 392378 - DNA, 140 bp, Artificial Sequence
  Synthetic
caccgctgtcccaaaaggtcatgctcgaccatggggatgtacttagagcactcctccatttcgtcgaactgctgataaagcacctcgcggtctggtatgatggcaggctgccctgacaagcatatcagcagccagggcct

SEQ ID NO: 392379 - DNA, 140 bp, Artificial Sequence
  Synthetic
atacgccatgctgggtctccttgctaagctcgagcaattctgggcaaagcatatgtggaactttgtcagtggcgtccaataccttgccggcttgtctaccttgccggggaaccccgccatcgtacttgggagtcggccat

SEQ ID NO: 392380 - DNA, 140 bp, Artificial Sequence
  Synthetic
atggccgactcccaagtacgatggcggggttccccggcaaggtagacaagccggcaaggtattggacgccactgacaaagttccacatatgctttgcccagaattgctcgagcttagcaaggagacccagcatggcgtat

SEQ ID NO: 392381 - DNA, 140 bp, Artificial Sequence
  Synthetic
  misc_feature (89)..(89): n is a, c, g, or t
  misc_feature (113)..(113): n is a, c, g, or t
  misc_feature (116)..(116): n is a, c, g, or t
atacgccatgctgggtctccgcgacccccacggcctccacagctttcgttgtgagtggcctcgctggagctgcggtcggcagcgtgggnctggggaagatcctggtcgacatnctngctgcgtacttgggagtcggccat

SEQ ID NO: 392382 - DNA, 140 bp, Artificial Sequence
  Synthetic
  misc_feature (25)..(25): n is a, c, g, or t
  misc_feature (28)..(28): n is a, c, g, or t
  misc_feature (52)..(52): n is a, c, g, or t
atggccgactcccaagtacgcagcnagnatgtcgaccaggatcttccccagncccacgctgccgaccgcagctccagcgaggccactcacaacgaaagctgtggaggccgtgggggtcgcggagacccagcatggcgtat

SEQ ID NO: 392383 - DNA, 140 bp, Artificial Sequence
  Synthetic
aggccctggctgctgatatggtgcatgcatgctggtgcggaaagtcgctgggggtcattatgtccaaatggctttcatgaagctggccgcactgacaggtacgtacgtttatgaccatctgaccttttgggacagcggtg

SEQ ID NO: 392384 - DNA, 140 bp, Artificial Sequence
  Synthetic
caccgctgtcccaaaaggtcagatggtcataaacgtacgtacctgtcagtgcggccagcttcatgaaagccatttggacataatgacccccagcgactttccgcaccagcatgcatgcaccatatcagcagccagggcct

SEQ ID NO: 392385 - DNA, 140 bp, Artificial Sequence
  Synthetic
aggccctggctgctgatatgttctccatggtggggaactgggcgaaggtcctggtagtgctgctgctatttgccggcgtcgacgcggaaacccacgtcaccgggggaagtgccggccacagaccttttgggacagcggtg

SEQ ID NO: 392386 - DNA, 140 bp, Artificial Sequence
  Synthetic
caccgctgtcccaaaaggtctgtggccggcacttcccccggtgacgtgggtttccgcgtcgacgccggcaaatagcagcagcactaccaggaccttcgcccagttccccaccatggagaacatatcagcagccagggcct

SEQ ID NO: 392387 - DNA, 140 bp, Artificial Sequence
  Synthetic
atacgccatgctgggtctccatcgccgggtgccctagtggtgggggtcgtctgtgcggctatactgaggcgccatgtgggccctggagagggggccgtacagtggatgaaccgcctcattcgtacttgggagtcggccat

SEQ ID NO: 392388 - DNA, 140 bp, Artificial Sequence
  Synthetic
atggccgactcccaagtacgaatgaggcggttcatccactgtacggccccctctccagggcccacatggcgcctcagtatagccgcacagacgacccccaccactagggcacccggcgatggagacccagcatggcgtat

SEQ ID NO: 392389 - DNA, 140 bp, Artificial Sequence
  Synthetic
aggccctggctgctgatatggccatgtgggccctggagagggggccgtacagtggatgaaccgcctcattgccttcgcgtcccggggcaatcatgtgtcgcctacacactatgtccctgagaccttttgggacagcggtg

SEQ ID NO: 392390 - DNA, 140 bp, Artificial Sequence
  Synthetic
caccgctgtcccaaaaggtctcagggacatagtgtgtaggcgacacatgattgccccgggacgcgaaggcaatgaggcggttcatccactgtacggccccctctccagggcccacatggccatatcagcagccagggcct

SEQ ID NO: 392391 - DNA, 140 bp, Artificial Sequence
  Synthetic
  misc_feature (29)..(29): n is a, c, g, or t
atacgccatgctgggtctccccctgcganaccaactggctgcgggagatttgggactgggtctgcaccgtcctgagtgacttcaagtcgtggcttaaggctaagctcatgccctccatgccgtacttgggagtcggccat

SEQ ID NO: 392392 - DNA, 140 bp, Artificial Sequence
  Synthetic
  misc_feature (112)..(112): n is a, c, g, or t
atggccgactcccaagtacggcatggagggcatgagcttagccttaagccacgacttgaagtcactcaggacggtgcagacccagtcccaaatctcccgcagccagttggtntcgcagggggagacccagcatggcgtat

SEQ ID NO: 392393 - DNA, 140 bp, Artificial Sequence
  Synthetic
atacgccatgctgggtctccccacatcaaaaatggttcgatgagaatagtcgggcccaagacttgcagtaatacctggcatggcacctttcccatcaatgcgtctaccacaggagccggccgtacttgggagtcggccat

SEQ ID NO: 392394 - DNA, 140 bp, Artificial Sequence
  Synthetic
atggccgactcccaagtacggccggctcctgtggtagacgcattgatgggaaaggtgccatgccaggtattactgcaagtcttgggcccgactattctcatcgaaccatttttgatgtggggagacccagcatggcgtat

SEQ ID NO: 392395 - DNA, 140 bp, Artificial Sequence
  Synthetic
atacgccatgctgggtctccgtatgacgcaagataacatcaagtgcccgtgccaggtacctgctcctgaattcttcactgaagtggacggggtcagactgcaccgctacgccccaccttgcgtacttgggagtcggccat

SEQ ID NO: 392396 - DNA, 140 bp, Artificial Sequence
  Synthetic
atggccgactcccaagtacgcaaggtggggcgtagcggtgcagtctgaccccgtccacttcagtgaagaattcaggagcaggtacctggcacgggcacttgatgttatcttgcgtcatacggagacccagcatggcgtat

SEQ ID NO: 392397 - DNA, 140 bp, Artificial Sequence
  Synthetic
  misc_feature (80)..(80): n is a, c, g, or t
  misc_feature (89)..(89): n is a, c, g, or t
  misc_feature (119)..(119): n is a, c, g, or t
aggccctggctgctgatatgttcttcactgaagtggacggggtcagactgcaccgctacgccccaccttgcaagcccttncttcgagangaagtgcaattcaccgtagggcttaacacntgaccttttgggacagcggtg

SEQ ID NO: 392398 - DNA, 140 bp, Artificial Sequence
  Synthetic
  misc_feature (22)..(22): n is a, c, g, or t
  misc_feature (52)..(52): n is a, c, g, or t
  misc_feature (61)..(61): n is a, c, g, or t
caccgctgtcccaaaaggtcangtgttaagccctacggtgaattgcacttcntctcgaagnaagggcttgcaaggtggggcgtagcggtgcagtctgaccccgtccacttcagtgaagaacatatcagcagccagggcct

SEQ ID NO: 392399 - DNA, 140 bp, Artificial Sequence
  Synthetic
aggccctggctgctgatatgctctctcctggtgccctggtcgtcggggtcgtgtgcgcagcaatactgcgccggcacgtgggcccgggagagggggctgtgcagtggatgaaccggctgagaccttttgggacagcggtg

SEQ ID NO: 392400 - DNA, 140 bp, Artificial Sequence
  Synthetic
caccgctgtcccaaaaggtctcagccggttcatccactgcacagccccctctcccgggcccacgtgccggcgcagtattgctgcgcacacgaccccgacgaccagggcaccaggagagagcatatcagcagccagggcct

SEQ ID NO: 392401 - DNA, 140 bp, Artificial Sequence
  Synthetic
  misc_feature (27)..(27): n is a, c, g, or t
  misc_feature (90)..(90): n is a, c, g, or t
atacgccatgctgggtctccccggagnttggcccgagggtctccaccctcggaggccagctcctcggcgagccagctttctgctccatcnctcaaggccacttgcactactaaccatcaccgtacttgggagtcggccat

SEQ ID NO: 392402 - DNA, 140 bp, Artificial Sequence
  Synthetic
  misc_feature (51)..(51): n is a, c, g, or t
  misc_feature (114)..(114): n is a, c, g, or t
atggccgactcccaagtacggtgatggttagtagtgcaagtggccttgagngatggagcagaaagctggctcgccgaggagctggcctccgagggtggagaccctcgggccaanctccggggagacccagcatggcgtat

SEQ ID NO: 392403 - DNA, 140 bp, Artificial Sequence
  Synthetic
  misc_feature (98)..(98): n is a, c, g, or t
  misc_feature (111)..(111): n is a, c, g, or t
atacgccatgctgggtctccgggcggtaacatcaccagggttgagtctgagaataaggtggtggtgctggactcctttgaaccccttgtggccgaaanggatagcggcgangtctctgtgcgtacttgggagtcggccat

SEQ ID NO: 392404 - DNA, 140 bp, Artificial Sequence
  Synthetic
  misc_feature (30)..(30): n is a, c, g, or t
  misc_feature (43)..(43): n is a, c, g, or t
atggccgactcccaagtacgcacagagacntcgccgctatccntttcggccacaaggggttcaaaggagtccagcaccaccaccttattctcagactcaaccctggtgatgttaccgcccggagacccagcatggcgtat

SEQ ID NO: 392405 - DNA, 140 bp, Artificial Sequence
  Synthetic
  misc_feature (64)..(64): n is a, c, g, or t
atacgccatgctgggtctcccggattacacccctccggttgttcatgggtgtgctctgcccccnagcaagccaactcccgtccctccccctaggaggaaacgggcgattgtgctcaccgacgtacttgggagtcggccat

SEQ ID NO: 392406 - DNA, 140 bp, Artificial Sequence
  Synthetic
  misc_feature (77)..(77): n is a, c, g, or t
atggccgactcccaagtacgtcggtgagcacaatcgcccgtttcctcctagggggagggacgggagttggcttgctngggggcagagcacacccatgaacaaccggaggggtgtaatccgggagacccagcatggcgtat

SEQ ID NO: 392407 - DNA, 140 bp, Artificial Sequence
  Synthetic
  misc_feature (77)..(77): n is a, c, g, or t
aggccctggctgctgatatgccaactcccgtccctccccctaggaggaaacgggcgattgtgctcaccgagtctaangtctccagcgccctggctgacctggcagcaaaggtcctcagccgaccttttgggacagcggtg

SEQ ID NO: 392408 - DNA, 140 bp, Artificial Sequence
  Synthetic
  misc_feature (64)..(64): n is a, c, g, or t
caccgctgtcccaaaaggtcggctgaggacctttgctgccaggtcagccagggcgctggagacnttagactcggtgagcacaatcgcccgtttcctcctagggggagggacgggagttggcatatcagcagccagggcct

SEQ ID NO: 392409 - DNA, 140 bp, Artificial Sequence
  Synthetic
atacgccatgctgggtctcccttctcatcaatgcctccgctcgagggggagccgggcgacccggacttgacctctgactcgtggtccactgtcagcggttcggaggacgttgtgtgttgccgtacttgggagtcggccat

SEQ ID NO: 392410 - DNA, 140 bp, Artificial Sequence
  Synthetic
atggccgactcccaagtacggcaacacacaacgtcctccgaaccgctgacagtggaccacgagtcagaggtcaagtccgggtcgcccggctccccctcgagcggaggcattgatgagaagggagacccagcatggcgtat

SEQ ID NO: 392411 - DNA, 140 bp, Artificial Sequence
  Synthetic
  misc_feature (50)..(50): n is a, c, g, or t
  misc_feature (110)..(110): n is a, c, g, or t
atacgccatgctgggtctcctcaatgtcatactcatggacaggggcgctngttacgccctgtgcggccgaagagccgaaactgccaatcagtcctttgagcaactccctnctgcgccacccgtacttgggagtcggccat

SEQ ID NO: 392412 - DNA, 140 bp, Artificial Sequence
  Synthetic
  misc_feature (31)..(31): n is a, c, g, or t
  misc_feature (91)..(91): n is a, c, g, or t
atggccgactcccaagtacgggtggcgcagnagggagttgctcaaaggactgattggcagtttcggctcttcggccgcacagggcgtaacnagcgcccctgtccatgagtatgacattgaggagacccagcatggcgtat

SEQ ID NO: 392413 - DNA, 140 bp, Artificial Sequence
  Synthetic
  misc_feature (33)..(33): n is a, c, g, or t
atacgccatgctgggtctccactcaaggagatnaaggcacgagcatctggagtgaaggcgccgaccctctctgttgaggaggcttgcgccctgacgcccccccattcagccaaatccaagcgtacttgggagtcggccat

SEQ ID NO: 392414 - DNA, 140 bp, Artificial Sequence
  Synthetic
  misc_feature (108)..(108): n is a, c, g, or t
atggccgactcccaagtacgcttggatttggctgaatgggggggcgtcagggcgcaagcctcctcaacagagagggtcggcgccttcactccagatgctcgtgccttnatctccttgagtggagacccagcatggcgtat

SEQ ID NO: 392415 - DNA, 140 bp, Artificial Sequence
  Synthetic
aggccctggctgctgatatggtagcataccaggccacagtgtgcgccagggcccaagccccacctccatcgtgggaccaaatgtggaagtgtctcatacggctaaagcctacgttgcacggaccttttgggacagcggtg

SEQ ID NO: 392416 - DNA, 140 bp, Artificial Sequence
  Synthetic
caccgctgtcccaaaaggtccgtgcaacgtaggctttagccgtatgagacacttccacatttggtcccacgatggaggtggggcttgggccctggcgcacactgtggcctggtatgctaccatatcagcagccagggcct

SEQ ID NO: 392417 - DNA, 140 bp, Artificial Sequence
  Synthetic
aggccctggctgctgatatgctcacacaccccataaccaaatacatcatggcatgcatgtcggctgacctggaggtcgtcacgagcacctgggtgctggtaggcggagtccttgcagctcgaccttttgggacagcggtg

SEQ ID NO: 392418 - DNA, 140 bp, Artificial Sequence
  Synthetic
caccgctgtcccaaaaggtcgagctgcaaggactccgcctaccagcacccaggtgctcgtgacgacctccaggtcagccgacatgcatgccatgatgtatttggttatggggtgtgtgagcatatcagcagccagggcct

SEQ ID NO: 392419 - DNA, 140 bp, Artificial Sequence
  Synthetic
atacgccatgctgggtctcccagggtgtgcgaaaagcgggccctttacaacgtggtccagaagctcccccaggccgtgatgggggaggcttatggattccaatactccccagcgcagcggcgtacttgggagtcggccat

SEQ ID NO: 392420 - DNA, 140 bp, Artificial Sequence
  Synthetic
atggccgactcccaagtacgccgctgcgctggggagtattggaatccataagcctcccccatcacggcctgggggagcttctggaccacgttgtaaagggcccgcttttcgcacaccctgggagacccagcatggcgtat

SEQ ID NO: 392421 - DNA, 140 bp, Artificial Sequence
  Synthetic
atacgccatgctgggtctccaggtcgaggaagaagtctatcagtgttgtgacctagacccggaagcccgcaaggtgatatcatcccttacagagagactctacaagggtggccccatgttcgtacttgggagtcggccat

SEQ ID NO: 392422 - DNA, 140 bp, Artificial Sequence
  Synthetic
atggccgactcccaagtacgaacatggggccacccttgtagagtctctctgtaagggatgatatcaccttgcgggcttccgggtctaggtcacaacactgatagacttcttcctcgacctggagacccagcatggcgtat

SEQ ID NO: 392423 - DNA, 140 bp, Artificial Sequence
  Synthetic
  misc_feature (75)..(75): n is a, c, g, or t
aggccctggctgctgatatgaaggtgatatcatcccttacagagagactctacaagggtggccccatgtttaacngcaagggagacctatgcggctaccggcgatgccgcgcaagcggcggaccttttgggacagcggtg

SEQ ID NO: 392424 - DNA, 140 bp, Artificial Sequence
  Synthetic
  misc_feature (66)..(66): n is a, c, g, or t
caccgctgtcccaaaaggtccgccgcttgcgcggcatcgccggtagccgcataggtctcccttgcngttaaacatggggccacccttgtagagtctctctgtaagggatgatatcaccttcatatcagcagccagggcct

SEQ ID NO: 392425 - DNA, 140 bp, Artificial Sequence
  Synthetic
atacgccatgctgggtctccaatcaagggcccaagcagcaaatccagcttgtgaacaccaatggcagctggcatatcaacaggaccgccctcaactgtaatgactccctccagactgggtcgtacttgggagtcggccat

SEQ ID NO: 392426 - DNA, 140 bp, Artificial Sequence
  Synthetic
atggccgactcccaagtacgacccagtctggagggagtcattacagttgagggcggtcctgttgatatgccagctgccattggtgttcacaagctggatttgctgcttgggcccttgattggagacccagcatggcgtat

SEQ ID NO: 392427 - DNA, 140 bp, Artificial Sequence
  Synthetic
  misc_feature (27)..(27): n is a, c, g, or t
  misc_feature (42)..(42): n is a, c, g, or t
  misc_feature (96)..(96): n is a, c, g, or t
atacgccatgctgggtctcctgacganctagtcatcatcgcngagagcgacggcgtggaggaggataagcaggccctccgagctttcacggaagcnatgacgaggtactcagctcccccacgtacttgggagtcggccat

SEQ ID NO: 392428 - DNA, 140 bp, Artificial Sequence
  Synthetic
  misc_feature (45)..(45): n is a, c, g, or t
  misc_feature (99)..(99): n is a, c, g, or t
  misc_feature (114)..(114): n is a, c, g, or t
atggccgactcccaagtacgtgggggagctgagtacctcgtcatngcttccgtgaaagctcggagggcctgcttatcctcctccacgccgtcgctctcngcgatgatgactagntcgtcaggagacccagcatggcgtat

SEQ ID NO: 392429 - DNA, 140 bp, Artificial Sequence
  Synthetic
  misc_feature (46)..(46): n is a, c, g, or t
  misc_feature (87)..(87): n is a, c, g, or t
aggccctggctgctgatatgaggccctccgagctttcacggaagcnatgacgaggtactcagctcccccaggcgacgccccacagcnagcatacgacctggaactaataacatcttgttcgaccttttgggacagcggtg

SEQ ID NO: 392430 - DNA, 140 bp, Artificial Sequence
  Synthetic
  misc_feature (54)..(54): n is a, c, g, or t
  misc_feature (95)..(95): n is a, c, g, or t
caccgctgtcccaaaaggtcgaacaagatgttattagttccaggtcgtatgctngctgtggggcgtcgcctgggggagctgagtacctcgtcatngcttccgtgaaagctcggagggcctcatatcagcagccagggcct

SEQ ID NO: 392431 - DNA, 140 bp, Artificial Sequence
  Synthetic
aggccctggctgctgatatggcatatcaacaggaccgccctcaactgtaatgactccctccagactgggttcattgccgcgctgttctacgcgcacaagttcaactcgtccggatgcctggaccttttgggacagcggtg

SEQ ID NO: 392432 - DNA, 140 bp, Artificial Sequence
  Synthetic
caccgctgtcccaaaaggtccaggcatccggacgagttgaacttgtgcgcgtagaacagcgcggcaatgaacccagtctggagggagtcattacagttgagggcggtcctgttgatatgccatatcagcagccagggcct

SEQ ID NO: 392433 - DNA, 140 bp, Artificial Sequence
  Synthetic
atacgccatgctgggtctcccgacacactccggtgaactcttggctggggaacatcatactctacgcgcccaccatatgggtgcgcatggtattgatgactcatttcttctccatactcccgtacttgggagtcggccat

SEQ ID NO: 392434 - DNA, 140 bp, Artificial Sequence
  Synthetic
atggccgactcccaagtacgggagtatggagaagaaatgagtcatcaataccatgcgcacccatatggtgggcgcgtagagtatgatgttccccagccaagagttcaccggagtgtgtcgggagacccagcatggcgtat

SEQ ID NO: 392435 - DNA, 140 bp, Artificial Sequence
  Synthetic
aggccctggctgctgatatgactcccacgctcgcggccaggaacgccagcatccccactacgacaatacgacgccatgtcgatttgctcgttggggcggctgctttctgctccgctatgtgaccttttgggacagcggtg

SEQ ID NO: 392436 - DNA, 140 bp, Artificial Sequence
  Synthetic
caccgctgtcccaaaaggtcacatagcggagcagaaagcagccgccccaacgagcaaatcgacatggcgtcgtattgtcgtagtggggatgctggcgttcctggccgcgagcgtgggagtcatatcagcagccagggcct

SEQ ID NO: 392437 - DNA, 140 bp, Artificial Sequence
  Synthetic
  misc_feature (90)..(90): n is a, c, g, or t
atacgccatgctgggtctcccggcttgagcgcattcacactccatgggtactctcctcacgaactcaatcgggtggctggaagcctcagnaaacttggggttcccccgttgagggtgtggcgtacttgggagtcggccat

SEQ ID NO: 392438 - DNA, 140 bp, Artificial Sequence
  Synthetic
  misc_feature (51)..(51): n is a, c, g, or t
atggccgactcccaagtacgccacaccctcaacgggggaaccccaagtttnctgaggcttccagccacccgattgagttcgtgaggagagtacccatggagtgtgaatgcgctcaagccgggagacccagcatggcgtat

SEQ ID NO: 392439 - DNA, 140 bp, Artificial Sequence
  Synthetic
  misc_feature (28)..(28): n is a, c, g, or t
atacgccatgctgggtctcctcaaactnactccattgctcgctgctagcaagctcgacttgtcgggctggttcacagtgggcgccggcgggggggacatatatcacagcgtgtcccatgccgtacttgggagtcggccat

SEQ ID NO: 392440 - DNA, 140 bp, Artificial Sequence
  Synthetic
  misc_feature (113)..(113): n is a, c, g, or t
atggccgactcccaagtacggcatgggacacgctgtgatatatgtcccccccgccggcgcccactgtgaaccagcccgacaagtcgagcttgctagcagcgagcaatggagtnagtttgaggagacccagcatggcgtat

SEQ ID NO: 392441 - DNA, 140 bp, Artificial Sequence
  Synthetic
atacgccatgctgggtctccttcacagtgggcgccggcgggggggacatatatcacagcgtgtcccatgcccgaccccgctatttactcctgtgcctactcctactttccgtaggggtagcgtacttgggagtcggccat

SEQ ID NO: 392442 - DNA, 140 bp, Artificial Sequence
  Synthetic
atggccgactcccaagtacgctacccctacggaaagtaggagtaggcacaggagtaaatagcggggtcgggcatgggacacgctgtgatatatgtcccccccgccggcgcccactgtgaaggagacccagcatggcgtat

SEQ ID NO: 392443 - DNA, 140 bp, Artificial Sequence
  Synthetic
atacgccatgctgggtctccgcatcaacaccgggttcatagctggcttgatctaccactggaaatttaactcctccggctgccccgaaaggctcgcctcatgcaagaggttgagcgacttcgtacttgggagtcggccat

SEQ ID NO: 392444 - DNA, 140 bp, Artificial Sequence
  Synthetic
atggccgactcccaagtacgaagtcgctcaacctcttgcatgaggcgagcctttcggggcagccggaggagttaaatttccagtggtagatcaagccagctatgaacccggtgttgatgcggagacccagcatggcgtat

SEQ ID NO: 392445 - DNA, 140 bp, Artificial Sequence
  Synthetic
atacgccatgctgggtctccggcgtcctctggtccgtctaccacggagctgggacgcggttcctcgcagcgaggaaaggccctgtcgctcaaatgtacaccaacgtcgaccaagacctcgcgtacttgggagtcggccat

SEQ ID NO: 392446 - DNA, 140 bp, Artificial Sequence
  Synthetic
atggccgactcccaagtacgcgaggtcttggtcgacgttggtgtacatttgagcgacagggcctttcctcgctgcgaggaaccgcgtcccagctccgtggtagacggaccagaggacgccggagacccagcatggcgtat

SEQ ID NO: 392447 - DNA, 140 bp, Artificial Sequence
  Synthetic
aggccctggctgctgatatgatatgggcacgcccggattacaaccctccactgctagagtcctggaaggacccggactacgtccctccggtggtgcacgggtgcccattgccacctaccagaccttttgggacagcggtg

SEQ ID NO: 392448 - DNA, 140 bp, Artificial Sequence
  Synthetic
caccgctgtcccaaaaggtctggtaggtggcaatgggcacccgtgcaccaccggagggacgtagtccgggtccttccaggactctagcagtggagggttgtaatccgggcgtgcccatatcatatcagcagccagggcct

SEQ ID NO: 392449 - DNA, 140 bp, Artificial Sequence
  Synthetic
aggccctggctgctgatatgcccggactacgtccctccggtggtgcacgggtgcccattgccacctaccaaggcccctccaataccacctccacggaggaaaaagacggttgtcctgacagaccttttgggacagcggtg

SEQ ID NO: 392450 - DNA, 140 bp, Artificial Sequence
  Synthetic
caccgctgtcccaaaaggtctgtcaggacaaccgtctttttcctccgtggaggtggtattggaggggccttggtaggtggcaatgggcacccgtgcaccaccggagggacgtagtccgggcatatcagcagccagggcct

SEQ ID NO: 392451 - DNA, 140 bp, Artificial Sequence
  Synthetic
aggccctggctgctgatatggtcaacgttacctggtaaccccgccattgcttcattgatggcttttacagctgctgtcaccagcccactaaccactagccaaaccctcctcttcaacatagaccttttgggacagcggtg

SEQ ID NO: 392452 - DNA, 140 bp, Artificial Sequence
  Synthetic
caccgctgtcccaaaaggtctatgttgaagaggagggtttggctagtggttagtgggctggtgacagcagctgtaaaagccatcaatgaagcaatggcggggttaccaggtaacgttgaccatatcagcagccagggcct

SEQ ID NO: 392453 - DNA, 140 bp, Artificial Sequence
  Synthetic
atacgccatgctgggtctccgacatgatgatgaactggagccccaccaccacattggttttggcccagttcatgcggctccccgctaccctcggcgacatgttcgccggaggtcactgggcgtacttgggagtcggccat

SEQ ID NO: 392454 - DNA, 140 bp, Artificial Sequence
  Synthetic
atggccgactcccaagtacgcccagtgacctccggcgaacatgtcgccgagggtagcggggagccgcatgaactgggccaaaaccaatgtggtggtggggctccagttcatcatcatgtcggagacccagcatggcgtat

SEQ ID NO: 392455 - DNA, 140 bp, Artificial Sequence
  Synthetic
  misc_feature (39)..(39): n is a, c, g, or t
  misc_feature (51)..(51): n is a, c, g, or t
  misc_feature (91)..(91): n is a, c, g, or t
atacgccatgctgggtctccgacaggcgggtccgcagcntttggtaccagnggcctcgtcagcgtcttcagtccgggggccaagcagaatntccagctcatctacaccaacgggagttggcgtacttgggagtcggccat

SEQ ID NO: 392456 - DNA, 140 bp, Artificial Sequence
  Synthetic
  misc_feature (50)..(50): n is a, c, g, or t
  misc_feature (90)..(90): n is a, c, g, or t
  misc_feature (102)..(102): n is a, c, g, or t
atggccgactcccaagtacgccaactcccgttggtgtagatgagctgganattctgcttggcccccggactgaagacgctgacgaggccnctggtaccaaangctgcggacccgcctgtcggagacccagcatggcgtat

SEQ ID NO: 392457 - DNA, 140 bp, Artificial Sequence
  Synthetic
  misc_feature (39)..(39): n is a, c, g, or t
  misc_feature (99)..(99): n is a, c, g, or t
atacgccatgctgggtctcccatagccagtttgttctancattctaaattcaactcctccggttgcccccaaaggctcgcctcgtgcaagaggttgagngactttgatcaaggctgggggcgtacttgggagtcggccat

SEQ ID NO: 392458 - DNA, 140 bp, Artificial Sequence
  Synthetic
  misc_feature (42)..(42): n is a, c, g, or t
  misc_feature (102)..(102): n is a, c, g, or t
atggccgactcccaagtacgcccccagccttgatcaaagtcnctcaacctcttgcacgaggcgagcctttgggggcaaccggaggagttgaatttagaatgntagaacaaactggctatgggagacccagcatggcgtat

SEQ ID NO: 392459 - DNA, 140 bp, Artificial Sequence
  Synthetic
aggccctggctgctgatatggatcgcttagggcaccccacgtacagctggggggaaaatgagactgatgtcatcatattgaactccaccaggcctcccaacggcgggtggtttgggtgcagaccttttgggacagcggtg

SEQ ID NO: 392460 - DNA, 140 bp, Artificial Sequence
  Synthetic
caccgctgtcccaaaaggtctgcacccaaaccacccgccgttgggaggcctggtggagttcaatatgatgacatcagtctcattttccccccagctgtacgtggggtgccctaagcgatccatatcagcagccagggcct

SEQ ID NO: 392461 - DNA, 140 bp, Artificial Sequence
  Synthetic
aggccctggctgctgatatgcttacgaagtgcgcaacgtgtccggggtgtaccatgtcacgaacgactgctccaactcaagtattgtgtatgaggcagcggacatgatcatgcacaccccgaccttttgggacagcggtg

SEQ ID NO: 392462 - DNA, 140 bp, Artificial Sequence
  Synthetic
caccgctgtcccaaaaggtcggggtgtgcatgatcatgtccgctgcctcatacacaatacttgagttggagcagtcgttcgtgacatggtacaccccggacacgttgcgcacttcgtaagcatatcagcagccagggcct

SEQ ID NO: 392463 - DNA, 140 bp, Artificial Sequence
  Synthetic
  misc_feature (30)..(30): n is a, c, g, or t
atacgccatgctgggtctccttacgcagcntgcgggatgtggcccctactgctcttgctcctcgcattgcccgagagggcatatgcatgggacgcagaagtcgcaggatccctcggcggacgtacttgggagtcggccat

SEQ ID NO: 392464 - DNA, 140 bp, Artificial Sequence
  Synthetic
  misc_feature (111)..(111): n is a, c, g, or t
atggccgactcccaagtacgtccgccgagggatcctgcgacttctgcgtcccatgcatatgccctctcgggcaatgcgaggagcaagagcagtaggggccacatcccgcangctgcgtaaggagacccagcatggcgtat

SEQ ID NO: 392465 - DNA, 140 bp, Artificial Sequence
  Synthetic
aggccctggctgctgatatggtcctggcgggcctcgcctactattccatggtggggaactgggctaaggtcttggttgtgatgctactcttcgccggcgttgacggggaaacccgcgtgagaccttttgggacagcggtg

SEQ ID NO: 392466 - DNA, 140 bp, Artificial Sequence
  Synthetic
caccgctgtcccaaaaggtctcacgcgggtttccccgtcaacgccggcgaagagtagcatcacaaccaagaccttagcccagttccccaccatggaatagtaggcgaggcccgccaggaccatatcagcagccagggcct

SEQ ID NO: 392467 - DNA, 140 bp, Artificial Sequence
  Synthetic
aggccctggctgctgatatgccagtgtattgcttcaccccaagccctgttgtggtggggacgaccgatcgcttcggcgtccctacgtacagttggggggagaatgagacggacgtgctgcgaccttttgggacagcggtg

SEQ ID NO: 392468 - DNA, 140 bp, Artificial Sequence
  Synthetic
caccgctgtcccaaaaggtcgcagcacgtccgtctcattctccccccaactgtacgtagggacgccgaagcgatcggtcgtccccaccacaacagggcttggggtgaagcaatacactggcatatcagcagccagggcct

SEQ ID NO: 392469 - DNA, 140 bp, Artificial Sequence
  Synthetic
aggccctggctgctgatatgtttccatggtggggaactgggcgaaggtcctggcagtgctgctgctatttgccggcgttgacgcggacacccacgtcaccgggggatccgccggccatacgaccttttgggacagcggtg

SEQ ID NO: 392470 - DNA, 140 bp, Artificial Sequence
  Synthetic
caccgctgtcccaaaaggtcgtatggccggcggatcccccggtgacgtgggtgtccgcgtcaacgccggcaaatagcagcagcactgccaggaccttcgcccagttccccaccatggaaacatatcagcagccagggcct

SEQ ID NO: 392471 - DNA, 140 bp, Artificial Sequence
  Synthetic
atacgccatgctgggtctcctgcaatgacagccttcaaaccggctggctagcagggcttttctattcaaggaacttcaactcctcaggctgtcccgagaggttggccagctgccgacgcccgtacttgggagtcggccat

SEQ ID NO: 392472 - DNA, 140 bp, Artificial Sequence
  Synthetic
atggccgactcccaagtacgggcgtcggcagctggccaacctctcgggacagcctgaggagttgaagttccttgaatagaaaagccctgctagccagccggtttgaaggctgtcattgcaggagacccagcatggcgtat

SEQ ID NO: 392473 - DNA, 140 bp, Artificial Sequence
  Synthetic
aggccctggctgctgatatggaacttcaactcctcaggctgtcccgagaggttggccagctgccgacgccttaccgatttcgcccagggctggggccctattggctatgccaatggaagcgaccttttgggacagcggtg

SEQ ID NO: 392474 - DNA, 140 bp, Artificial Sequence
  Synthetic
caccgctgtcccaaaaggtcgcttccattggcatagccaatagggccccagccctgggcgaaatcggtaaggcgtcggcagctggccaacctctcgggacagcctgaggagttgaagttccatatcagcagccagggcct

SEQ ID NO: 392475 - DNA, 140 bp, Artificial Sequence
  Synthetic
aggccctggctgctgatatggggaatgcagctcgccgagcaattcaagcaaaaggcgctcgggttgttgcaaacggccaccaagcaagcggaggctgctgctcccgtggtggagtccaaggaccttttgggacagcggtg

SEQ ID NO: 392476 - DNA, 140 bp, Artificial Sequence
  Synthetic
caccgctgtcccaaaaggtccttggactccaccacgggagcagcagcctccgcttgcttggtggccgtttgcaacaacccgagcgccttttgcttgaattgctcggcgagctgcattccccatatcagcagccagggcct

SEQ ID NO: 392477 - DNA, 140 bp, Artificial Sequence
  Synthetic
aggccctggctgctgatatgtcatgaagctggccgcactgacaggtacgtacgtttatgatcatcttactccactgcgggactgggcccacgcgggcctacgagaccttgcggtggcagtgaccttttgggacagcggtg

SEQ ID NO: 392478 - DNA, 140 bp, Artificial Sequence
  Synthetic
caccgctgtcccaaaaggtcactgccaccgcaaggtctcgtaggcccgcgtgggcccagtcccgcagtggagtaagatgatcataaacgtacgtacctgtcagtgcggccagcttcatgacatatcagcagccagggcct

SEQ ID NO: 392479 - DNA, 140 bp, Artificial Sequence
  Synthetic
aggccctggctgctgatatgcagacaccgcggcgtgtggggacatcatcttgggcctgcccgtctccgcccgcagggggagggagatactcctcggaccggcagatagtctcgagggacagaccttttgggacagcggtg

SEQ ID NO: 392480 - DNA, 140 bp, Artificial Sequence
  Synthetic
caccgctgtcccaaaaggtctgtccctcgagactatctgccggtccgaggagtatctccctccccctgcgggcggagacgggcaggcccaagatgatgtccccacacgccgcggtgtctgcatatcagcagccagggcct

SEQ ID NO: 392481 - DNA, 140 bp, Artificial Sequence
  Synthetic
aggccctggctgctgatatgtagcagggctcttctattaccacagattcaactcttcaggctgtcccgagaggttggccagctgccgaccccttaccgactttgaccagggctggggcccgaccttttgggacagcggtg

SEQ ID NO: 392482 - DNA, 140 bp, Artificial Sequence
  Synthetic
caccgctgtcccaaaaggtcgggccccagccctggtcaaagtcggtaaggggtcggcagctggccaacctctcgggacagcctgaagagttgaatctgtggtaatagaagagccctgctacatatcagcagccagggcct

SEQ ID NO: 392483 - DNA, 140 bp, Artificial Sequence
  Synthetic
aggccctggctgctgatatggtcaccgtgccacatcccaacatcgaggaggtggctctgtccaacactggagagatccccttctatggcaaagccatccccatcgagaccatcaaggggggaccttttgggacagcggtg

SEQ ID NO: 392484 - DNA, 140 bp, Artificial Sequence
  Synthetic
caccgctgtcccaaaaggtccccccttgatggtctcgatggggatggctttgccatagaaggggatctctccagtgttggacagagccacctcctcgatgttgggatgtggcacggtgaccatatcagcagccagggcct

SEQ ID NO: 392485 - DNA, 140 bp, Artificial Sequence
  Synthetic
atacgccatgctgggtctccgcgtacttttccatggtggcgaactgggcgaaggtcctggtaatactgttgctattcgccggcgtcgacgcggaaacccacgtctccggggggagtgccgcgtacttgggagtcggccat

SEQ ID NO: 392486 - DNA, 140 bp, Artificial Sequence
  Synthetic
atggccgactcccaagtacgcggcactccccccggagacgtgggtttccgcgtcgacgccggcgaatagcaacagtattaccaggaccttcgcccagttcgccaccatggaaaagtacgcggagacccagcatggcgtat

SEQ ID NO: 392487 - DNA, 140 bp, Artificial Sequence
  Synthetic
atacgccatgctgggtctcccggattacatccctccggttgtccatgggtgcgctttgcccccgagcaagccaactcccgttgctcctcctaggaggaaacgggcaattgcgctcactgacgtacttgggagtcggccat

SEQ ID NO: 392488 - DNA, 140 bp, Artificial Sequence
  Synthetic
atggccgactcccaagtacgtcagtgagcgcaattgcccgtttcctcctaggaggagcaacgggagttggcttgctcgggggcaaagcgcacccatggacaaccggagggatgtaatccgggagacccagcatggcgtat

SEQ ID NO: 392489 - DNA, 140 bp, Artificial Sequence
  Synthetic
aggccctggctgctgatatgccaactcccgttgctcctcctaggaggaaacgggcaattgcgctcactgagtcgaacgtctccagcgccctggctgatctggcagcaaaggccttcagccgaccttttgggacagcggtg

SEQ ID NO: 392490 - DNA, 140 bp, Artificial Sequence
  Synthetic
caccgctgtcccaaaaggtcggctgaaggcctttgctgccagatcagccagggcgctggagacgttcgactcagtgagcgcaattgcccgtttcctcctaggaggagcaacgggagttggcatatcagcagccagggcct

SEQ ID NO: 392491 - DNA, 140 bp, Artificial Sequence
  Synthetic
atacgccatgctgggtctcccctgaactgcaatgacagcctcaacaccggctggatagcagggcttttctaccacaacaaattcaactcttcgggctgtcccgagagaatggccagctgtcgtacttgggagtcggccat

SEQ ID NO: 392492 - DNA, 140 bp, Artificial Sequence
  Synthetic
atggccgactcccaagtacgacagctggccattctctcgggacagcccgaagagttgaatttgttgtggtagaaaagccctgctatccagccggtgttgaggctgtcattgcagttcaggggagacccagcatggcgtat

SEQ ID NO: 392493 - DNA, 140 bp, Artificial Sequence
  Synthetic
aggccctggctgctgatatgaggccctccgagctttcacggaagccatgacgaggtactcagctcccccaggcgacgccccacagccagcgtacgacctggaattgataacatcttgctcgaccttttgggacagcggtg

SEQ ID NO: 392494 - DNA, 140 bp, Artificial Sequence
  Synthetic
caccgctgtcccaaaaggtcgagcaagatgttatcaattccaggtcgtacgctggctgtggggcgtcgcctgggggagctgagtacctcgtcatggcttccgtgaaagctcggagggcctcatatcagcagccagggcct

SEQ ID NO: 392495 - DNA, 140 bp, Artificial Sequence
  Synthetic
aggccctggctgctgatatggactacgtccctccggtggtacacgggtgcccattaccacctaccaaggcccctccaataccacctccacggagaaagaggacggttgtcctgacagaatgaccttttgggacagcggtg

SEQ ID NO: 392496 - DNA, 140 bp, Artificial Sequence
  Synthetic
caccgctgtcccaaaaggtcattctgtcaggacaaccgtcctctttctccgtggaggtggtattggaggggccttggtaggtggtaatgggcacccgtgtaccaccggagggacgtagtccatatcagcagccagggcct

SEQ ID NO: 392497 - DNA, 140 bp, Artificial Sequence
  Synthetic
atacgccatgctgggtctccccgaccccgctatttactcctgtgcctactcctactttccgtaggggtaggcatctttttactccccgcccggtaggggtaacactccgaccttagggtccgtacttgggagtcggccat

SEQ ID NO: 392498 - DNA, 140 bp, Artificial Sequence
  Synthetic
atggccgactcccaagtacggaccctaaggtcggagtgttacccctaccgggcggggagtaaaaagatgcctacccctacggaaagtaggagtaggcacaggagtaaatagcggggtcggggagacccagcatggcgtat

SEQ ID NO: 392499 - DNA, 140 bp, Artificial Sequence
  Synthetic
aggccctggctgctgatatgtgtgcgagaaaatggctctctacgatgtggtctccaccctccctcaggccgtgatgggctcctcatacggattccagtactctcctggacagcgggtcgagaccttttgggacagcggtg

SEQ ID NO: 392500 - DNA, 140 bp, Artificial Sequence
  Synthetic
caccgctgtcccaaaaggtctcgacccgctgtccaggagagtactggaatccgtatgaggagcccatcacggcctgagggagggtggagaccacatcgtagagagccattttctcgcacacatatcagcagccagggcct

SEQ ID NO: 392501 - DNA, 140 bp, Artificial Sequence
  Synthetic
  misc_feature (101)..(101): n is a, c, g, or t
aggccctggctgctgatatgtctttctctatcttcctcttggcactgctctcgtgcctgactgttcccacttcggcctacaactatcgcaacagctcgggngtctaccacatcactaacggaccttttgggacagcggtg

SEQ ID NO: 392502 - DNA, 140 bp, Artificial Sequence
  Synthetic
  misc_feature (40)..(40): n is a, c, g, or t
caccgctgtcccaaaaggtccgttagtgatgtggtagacncccgagctgttgcgatagttgtaggccgaagtgggaacagtcaggcacgagagcagtgccaagaggaagatagagaaagacatatcagcagccagggcct

SEQ ID NO: 392503 - DNA, 140 bp, Artificial Sequence
  Synthetic
aggccctggctgctgatatggatcggttcggtgtccctacgtatagctggggggagaatgagacagacgtgctgctccttaacaacacgcggccgccgcaaggcaactggttcggctgtagaccttttgggacagcggtg

SEQ ID NO: 392504 - DNA, 140 bp, Artificial Sequence
  Synthetic
caccgctgtcccaaaaggtctacagccgaaccagttgccttgcggcggccgcgtgttgttaaggagcagcacgtctgtctcattctccccccagctatacgtagggacaccgaaccgatccatatcagcagccagggcct

SEQ ID NO: 392505 - DNA, 140 bp, Artificial Sequence
  Synthetic
atacgccatgctgggtctccggtggctctaacccccactgtggctgcgccatatctgaatgctccgcttgagtccttgcgacgtcatgtggatctgatggtaggcagcgccactctttgccgtacttgggagtcggccat

SEQ ID NO: 392506 - DNA, 140 bp, Artificial Sequence
  Synthetic
atggccgactcccaagtacggcaaagagtggcgctgcctaccatcagatccacatgacgtcgcaaggactcaagcggagcattcagatatggcgcagccacagtgggggttagagccaccggagacccagcatggcgtat

SEQ ID NO: 392507 - DNA, 140 bp, Artificial Sequence
  Synthetic
aggccctggctgctgatatgagtccttgcgacgtcatgtggatctgatggtaggcagcgccactctttgctccgccctctacgtcggagacttgtgtgggggtgtgttcttggtcggtcagaccttttgggacagcggtg

SEQ ID NO: 392508 - DNA, 140 bp, Artificial Sequence
  Synthetic
caccgctgtcccaaaaggtctgaccgaccaagaacacacccccacacaagtctccgacgtagagggcggagcaaagagtggcgctgcctaccatcagatccacatgacgtcgcaaggactcatatcagcagccagggcct

SEQ ID NO: 392509 - DNA, 140 bp, Artificial Sequence
  Synthetic
aggccctggctgctgatatggatcccaaccgccatggtcgacctgcttgcaggcggccattggggtatcctggttggcattgcgtacttcagcatgcaggctaactgggccaaggtcatcgaccttttgggacagcggtg

SEQ ID NO: 392510 - DNA, 140 bp, Artificial Sequence
  Synthetic
caccgctgtcccaaaaggtcgatgaccttggcccagttagcctgcatgctgaagtacgcaatgccaaccaggataccccaatggccgcctgcaagcaggtcgaccatggcggttgggatccatatcagcagccagggcct

SEQ ID NO: 392511 - DNA, 140 bp, Artificial Sequence
  Synthetic
atacgccatgctgggtctccgttccaagcaaaacatacagctcatcaacaccaatgggagctggcacatcaacagaactgccctcaactgtaacgacagcctgaacacaggattcttggccgtacttgggagtcggccat

SEQ ID NO: 392512 - DNA, 140 bp, Artificial Sequence
  Synthetic
atggccgactcccaagtacggccaagaatcctgtgttcaggctgtcgttacagttgagggcagttctgttgatgtgccagctcccattggtgttgatgagctgtatgttttgcttggaacggagacccagcatggcgtat

SEQ ID NO: 392513 - DNA, 140 bp, Artificial Sequence
  Synthetic
atacgccatgctgggtctcccagcctgttttacacccacaggttcaacagctccgggtgtccggagaggcttgccggctgcagcagccttgacagcctcccacagggttggggccctcttcgtacttgggagtcggccat

SEQ ID NO: 392514 - DNA, 140 bp, Artificial Sequence
  Synthetic
atggccgactcccaagtacgaagagggccccaaccctgtgggaggctgtcaaggctgctgcagccggcaagcctctccggacacccggagctgttgaacctgtgggtgtaaaacaggctgggagacccagcatggcgtat

SEQ ID NO: 392515 - DNA, 140 bp, Artificial Sequence
  Synthetic
aggccctggctgctgatatgtccccttcccgcgccgaactataagttcgcgctgtggagggtgtctgcagaggaatacgtggagataaggcaggtgggggacttccactacgtgacgggtgaccttttgggacagcggtg

SEQ ID NO: 392516 - DNA, 140 bp, Artificial Sequence
  Synthetic
caccgctgtcccaaaaggtcacccgtcacgtagtggaagtcccccacctgccttatctccacgtattcctctgcagacaccctccacagcgcgaacttatagttcggcgcgggaaggggacatatcagcagccagggcct

SEQ ID NO: 392517 - DNA, 140 bp, Artificial Sequence
  Synthetic
atacgccatgctgggtctcctatattgttttacacccagccctgtggtggtcgggacaaccgaccgccttggggttccaacatacacgtggggcgagaatgagactgatgtattcctgctcgtacttgggagtcggccat

SEQ ID NO: 392518 - DNA, 140 bp, Artificial Sequence
  Synthetic
atggccgactcccaagtacgagcaggaatacatcagtctcattctcgccccacgtgtatgttggaaccccaaggcggtcggttgtcccgaccaccacagggctgggtgtaaaacaatataggagacccagcatggcgtat

SEQ ID NO: 392519 - DNA, 140 bp, Artificial Sequence
  Synthetic
  misc_feature (65)..(65): n is a, c, g, or t
atacgccatgctgggtctccacaaacaacggcacttggggatgtccgactgactgctttaggaancatccagaaaccacctacaccaaatgtggctcagggccttggcttacgccgaggtcgtacttgggagtcggccat

SEQ ID NO: 392520 - DNA, 140 bp, Artificial Sequence
  Synthetic
  misc_feature (76)..(76): n is a, c, g, or t
atggccgactcccaagtacgacctcggcgtaagccaaggccctgagccacatttggtgtaggtggtttctggatgnttcctaaagcagtcagtcggacatccccaagtgccgttgtttgtggagacccagcatggcgtat

SEQ ID NO: 392521 - DNA, 140 bp, Artificial Sequence
  Synthetic
aggccctggctgctgatatgcctggcgggcctcgcctactattccatggtggggaactgggctaaggttttgattgtgatgctactctttgccggcgttgacgggacgacctacacgtcggaccttttgggacagcggtg

SEQ ID NO: 392522 - DNA, 140 bp, Artificial Sequence
  Synthetic
caccgctgtcccaaaaggtccgacgtgtaggtcgtcccgtcaacgccggcaaagagtagcatcacaatcaaaaccttagcccagttccccaccatggaatagtaggcgaggcccgccaggcatatcagcagccagggcct

SEQ ID NO: 392523 - DNA, 140 bp, Artificial Sequence
  Synthetic
aggccctggctgctgatatgtacaccatctttaaggttaggatgtatgtcggtgggatagagcatcggttggacgcggcttgcaactggaccagaggagagccctgcgacctggaacacagaccttttgggacagcggtg

SEQ ID NO: 392524 - DNA, 140 bp, Artificial Sequence
  Synthetic
caccgctgtcccaaaaggtctgtgttccaggtcgcagggctctcctctggtccagttgcaagccgcgtccaaccgatgctctatcccaccgacatacatcctaaccttaaagatggtgtacatatcagcagccagggcct

SEQ ID NO: 392525 - DNA, 140 bp, Artificial Sequence
  Synthetic
aggccctggctgctgatatgctgcagtggtgtcatgggctcttaagtgggagtacattgtgcttgctttcctgctgttggcagacgccaggatctctgcatgcttgtggatgatgctgatgaccttttgggacagcggtg

SEQ ID NO: 392526 - DNA, 140 bp, Artificial Sequence
  Synthetic
caccgctgtcccaaaaggtcatcagcatcatccacaagcatgcagagatcctggcgtctgccaacagcaggaaagcaagcacaatgtactcccacttaagagcccatgacaccactgcagcatatcagcagccagggcct

SEQ ID NO: 392527 - DNA, 140 bp, Artificial Sequence
  Synthetic
aggccctggctgctgatatgattgcttggcatgttaagggcaggattccagctgctgccacctacgccgcatgcgggatgtggcccctgctgctcctggtcttgatgctgcccgagaggggaccttttgggacagcggtg

SEQ ID NO: 392528 - DNA, 140 bp, Artificial Sequence
  Synthetic
caccgctgtcccaaaaggtcccctctcgggcagcatcaagaccaggagcagcaggggccacatcccgcatgcggcgtaggtggcagcagctggaatcctgcccttaacatgccaagcaatcatatcagcagccagggcct

SEQ ID NO: 392529 - DNA, 140 bp, Artificial Sequence
  Synthetic
atacgccatgctgggtctccctggcgacctgcgtcaatggcgcgtgctggactgtcttccatggtgccggctcaaagaccttagctggcccaaaaggtccaatcacccagatgtacactacgtacttgggagtcggccat

SEQ ID NO: 392530 - DNA, 140 bp, Artificial Sequence
  Synthetic
atggccgactcccaagtacgtagtgtacatctgggtgattggaccttttgggccagctaaggtctttgagccggcaccatggaagacagtccagcacgcgccattgacgcaggtcgccagggagacccagcatggcgtat

SEQ ID NO: 392531 - DNA, 140 bp, Artificial Sequence
  Synthetic
atacgccatgctgggtctcctcgaggtatttggtggctgcaatacttcattgccagagccgaggctgtcatccatgtctacgtgccgccgttggacgtgcgcgggcctcgcgactccatccgtacttgggagtcggccat

SEQ ID NO: 392532 - DNA, 140 bp, Artificial Sequence
  Synthetic
atggccgactcccaagtacggatggagtcgcgaggcccgcgcacgtccaacggcggcacgtagacatggatgacagcctcggctctggcaatgaagtattgcagccaccaaatacctcgaggagacccagcatggcgtat

SEQ ID NO: 392533 - DNA, 140 bp, Artificial Sequence
  Synthetic
atacgccatgctgggtctcctgcgcgtcccttacttcgtgagagcgcacgcgctaatcaagatatgcagcctagttcgtggagtggtgtatggcaagtattgccaaatggccctgttgaacgtacttgggagtcggccat

SEQ ID NO: 392534 - DNA, 140 bp, Artificial Sequence
  Synthetic
atggccgactcccaagtacgttcaacagggccatttggcaatacttgccatacaccactccacgaactaggctgcatatcttgattagcgcgtgcgctctcacgaagtaagggacgcgcaggagacccagcatggcgtat

SEQ ID NO: 392535 - DNA, 140 bp, Artificial Sequence
  Synthetic
aggccctggctgctgatatggatgggggcgttgaccggaacatacgtctacaaccacctcactcctttgtcagactgggcggctgagggccttagtgacctagcggtggcacttgagccggaccttttgggacagcggtg

SEQ ID NO: 392536 - DNA, 140 bp, Artificial Sequence
  Synthetic
caccgctgtcccaaaaggtccggctcaagtgccaccgctaggtcactaaggccctcagccgcccagtctgacaaaggagtgaggtggttgtagacgtatgttccggtcaacgcccccatccatatcagcagccagggcct

SEQ ID NO: 392537 - DNA, 140 bp, Artificial Sequence
  Synthetic
atacgccatgctgggtctccgtgaagtccaggtgctgtccacggcgacgcagtcctttctgggcactgcaatcaatggcgtcatgtggacggtttaccatggggcgggcagcaagaccatcgtacttgggagtcggccat

SEQ ID NO: 392538 - DNA, 140 bp, Artificial Sequence
  Synthetic
atggccgactcccaagtacgatggtcttgctgcccgccccatggtaaaccgtccacatgacgccattgattgcagtgcccagaaaggactgcgtcgccgtggacagcacctggacttcacggagacccagcatggcgtat

SEQ ID NO: 392539 - DNA, 140 bp, Artificial Sequence
  Synthetic
atacgccatgctgggtctccggccatgccgccggcatcttccgagccgcggtgtgtacccggggtgtggctaaagcagtggatttcgtgccagttgaatcccttgaaaccaccatgaggtcgtacttgggagtcggccat

SEQ ID NO: 392540 - DNA, 140 bp, Artificial Sequence
  Synthetic
atggccgactcccaagtacgacctcatggtggtttcaagggattcaactggcacgaaatccactgctttagccacaccccgggtacacaccgcggctcggaagatgccggcggcatggccggagacccagcatggcgtat

SEQ ID NO: 392541 - DNA, 140 bp, Artificial Sequence
  Synthetic
atacgccatgctgggtctcccggggccctacgcagaagatccagttgatcaattccaatggcagttggcacatcaatagaacagccctgaactgtaatgacagcctcaacaccggctggacgtacttgggagtcggccat

SEQ ID NO: 392542 - DNA, 140 bp, Artificial Sequence
  Synthetic
atggccgactcccaagtacgtccagccggtgttgaggctgtcattacagttcagggctgttctattgatgtgccaactgccattggaattgatcaactggatcttctgcgtagggccccgggagacccagcatggcgtat

SEQ ID NO: 392543 - DNA, 140 bp, Artificial Sequence
  Synthetic
atacgccatgctgggtctccccccagtattcactgacaactccactcctcctgccgtgccccagacctaccaagtagcccatttgcacgcgccgacgggaagcggcaaaagcacgaaagtcgtacttgggagtcggccat

SEQ ID NO: 392544 - DNA, 140 bp, Artificial Sequence
  Synthetic
atggccgactcccaagtacgactttcgtgcttttgccgcttcccgtcggcgcgtgcaaatgggctacttggtaggtctggggcacggcaggaggagtggagttgtcagtgaatactggggggagacccagcatggcgtat

SEQ ID NO: 392545 - DNA, 140 bp, Artificial Sequence
  Synthetic
aggccctggctgctgatatgattgatcccaatatacgatcaggggtcagaactatcaccacaggcgcgcctattacgtactccacatacgggaagttcctggctgatggaggttgcgcaggaccttttgggacagcggtg

SEQ ID NO: 392546 - DNA, 140 bp, Artificial Sequence
  Synthetic
caccgctgtcccaaaaggtcctgcgcaacctccatcagccaggaacttcccgtatgtggagtacgtaataggcgcgcctgtggtgatagttctgacccctgatcgtatattgggatcaatcatatcagcagccagggcct

SEQ ID NO: 392547 - DNA, 140 bp, Artificial Sequence
  Synthetic
aggccctggctgctgatatgtccttaacaacaccaggccaccgctgggcaattggttcggttgcacctggatgaattcaactggatacaccaaagtgtgcggagcgcccccttgtgtcatgaccttttgggacagcggtg

SEQ ID NO: 392548 - DNA, 140 bp, Artificial Sequence
  Synthetic
caccgctgtcccaaaaggtcatgacacaagggggcgctccgcacactttggtgtatccagttgaattcatccaggtgcaaccgaaccaattgcccagcggtggcctggtgttgttaaggacatatcagcagccagggcct

SEQ ID NO: 392549 - DNA, 140 bp, Artificial Sequence
  Synthetic
aggccctggctgctgatatgtcagtaataccattatctggtgacgtcgtggtttgcgccacggacgccctcatgacaggctttaccggtgactttgacacagtgatagactgcaacacgtgaccttttgggacagcggtg

SEQ ID NO: 392550 - DNA, 140 bp, Artificial Sequence
  Synthetic
caccgctgtcccaaaaggtcacgtgttgcagtctatcactgtgtcaaagtcaccggtaaagcctgtcatgagggcgtccgtggcgcaaaccacgacgtcaccagataatggtattactgacatatcagcagccagggcct

SEQ ID NO: 392551 - DNA, 140 bp, Artificial Sequence
  Synthetic
atacgccatgctgggtctcccactggtagggggaggttaggcatataccggtatgtcaccccaggagaaaggccatccggcatatttgacacctcagtactctgtgagtgctacgatactcgtacttgggagtcggccat

SEQ ID NO: 392552 - DNA, 140 bp, Artificial Sequence
  Synthetic
atggccgactcccaagtacgagtatcgtagcactcacagagtactgaggtgtcaaatatgccggatggcctttctcctggggtgacataccggtatatgcctaacctccccctaccagtgggagacccagcatggcgtat

SEQ ID NO: 392553 - DNA, 140 bp, Artificial Sequence
  Synthetic
aggccctggctgctgatatgggccatccggcatatttgacacctcagtactctgtgagtgctacgatactggatgtgcttggtatgaactgacgccggcagaaacaacaatcaggttaaggaccttttgggacagcggtg

SEQ ID NO: 392554 - DNA, 140 bp, Artificial Sequence
  Synthetic
caccgctgtcccaaaaggtccttaacctgattgttgtttctgccggcgtcagttcataccaagcacatccagtatcgtagcactcacagagtactgaggtgtcaaatatgccggatggcccatatcagcagccagggcct

SEQ ID NO: 392555 - DNA, 140 bp, Artificial Sequence
  Synthetic
atacgccatgctgggtctcctcccagaccaaacaggcgggtgacaacttcccttacctggtcgcctaccaggcaacagtctgtgccaaggcgttggcacccccacccagttgggacaccacgtacttgggagtcggccat

SEQ ID NO: 392556 - DNA, 140 bp, Artificial Sequence
  Synthetic
atggccgactcccaagtacgtggtgtcccaactgggtgggggtgccaacgccttggcacagactgttgcctggtaggcgaccaggtaagggaagttgtcacccgcctgtttggtctgggaggagacccagcatggcgtat

SEQ ID NO: 392557 - DNA, 140 bp, Artificial Sequence
  Synthetic
atacgccatgctgggtctccgatcacaaagtacatcatggcctgcatgtccgccgaccttgaggtcgtgaccagcacgtgggtcatggtaggcggcctcctggcggctcttgctgcctaccgtacttgggagtcggccat

SEQ ID NO: 392558 - DNA, 140 bp, Artificial Sequence
  Synthetic
atggccgactcccaagtacggtaggcagcaagagccgccaggaggccgcctaccatgacccacgtgctggtcacgacctcaaggtcggcggacatgcaggccatgatgtactttgtgatcggagacccagcatggcgtat

SEQ ID NO: 392559 - DNA, 140 bp, Artificial Sequence
  Synthetic
atacgccatgctgggtctcctgcttgtcagtgggcagtgtggtaatcgtcgggagggtcgtcctatcaggccaacctgccgtcattcctgatcgggaggtgctgtacaaacagttcgacgcgtacttgggagtcggccat

SEQ ID NO: 392560 - DNA, 140 bp, Artificial Sequence
  Synthetic
atggccgactcccaagtacgcgtcgaactgtttgtacagcacctcccgatcaggaatgacggcaggttggcctgataggacgaccctcccgacgattaccacactgcccactgacaagcaggagacccagcatggcgtat

SEQ ID NO: 392561 - DNA, 140 bp, Artificial Sequence
  Synthetic
aggccctggctgctgatatgcatcaataggacggccttgaactgcaatgacagccttaacaccggctggatagcagggcttttctatcaccacaaattcaactcttcaggctgtcctgaggaccttttgggacagcggtg

SEQ ID NO: 392562 - DNA, 140 bp, Artificial Sequence
  Synthetic
caccgctgtcccaaaaggtcctcaggacagcctgaagagttgaatttgtggtgatagaaaagccctgctatccagccggtgttaaggctgtcattgcagttcaaggccgtcctattgatgcatatcagcagccagggcct

SEQ ID NO: 392563 - DNA, 140 bp, Artificial Sequence
  Synthetic
aggccctggctgctgatatgttgaacaattttgggcgaagcatatgtggaacttcatcagtggcatccaataccttgccgggctgtctaccttgccgggcaacccaaccattgcttccctgaccttttgggacagcggtg

SEQ ID NO: 392564 - DNA, 140 bp, Artificial Sequence
  Synthetic
caccgctgtcccaaaaggtcagggaagcaatggttgggttgcccggcaaggtagacagcccggcaaggtattggatgccactgatgaagttccacatatgcttcgcccaaaattgttcaacatatcagcagccagggcct

SEQ ID NO: 392565 - DNA, 140 bp, Artificial Sequence
  Synthetic
aggccctggctgctgatatgggagttctgggagagcgtcttcacaggcctcacccacatagatgcccacttcttgtcccagactaagcaggcaggagacaacttcccctacctggtagcagaccttttgggacagcggtg

SEQ ID NO: 392566 - DNA, 140 bp, Artificial Sequence
  Synthetic
caccgctgtcccaaaaggtctgctaccaggtaggggaagttgtctcctgcctgcttagtctgggacaagaagtgggcatctatgtgggtgaggcctgtgaagacgctctcccagaactcccatatcagcagccagggcct

SEQ ID NO: 392567 - DNA, 140 bp, Artificial Sequence
  Synthetic
atacgccatgctgggtctcctcctattcaacatcttgggaggttgggtagcctcacagatcgcgacccctacggcctctacggcttttgtcgtaagcggcatcgcgggggctgcggtcggcgtacttgggagtcggccat

SEQ ID NO: 392568 - DNA, 140 bp, Artificial Sequence
  Synthetic
atggccgactcccaagtacgccgaccgcagcccccgcgatgccgcttacgacaaaagccgtagaggccgtaggggtcgcgatctgtgaggctacccaacctcccaagatgttgaataggaggagacccagcatggcgtat

SEQ ID NO: 392569 - DNA, 140 bp, Artificial Sequence
  Synthetic
aggccctggctgctgatatgtgtctcctttgcaatcaaatgggagtatgtcgtgttgctcttccttctcctggcagacgcgcgcgtctgtgcctgcttgtggatgatgctgctgatagccgaccttttgggacagcggtg

SEQ ID NO: 392570 - DNA, 140 bp, Artificial Sequence
  Synthetic
caccgctgtcccaaaaggtcggctatcagcagcatcatccacaagcaggcacagacgcgcgcgtctgccaggagaaggaagagcaacacgacatactcccatttgattgcaaaggagacacatatcagcagccagggcct

SEQ ID NO: 392571 - DNA, 140 bp, Artificial Sequence
  Synthetic
atacgccatgctgggtctccgagtgttggcctggggaagattctagtggacatccttgctggctacggtgccggcgtggccggcgctgtggtcaccttcaagatcatgagcggcgagacacgtacttgggagtcggccat

SEQ ID NO: 392572 - DNA, 140 bp, Artificial Sequence
  Synthetic
atggccgactcccaagtacgtgtctcgccgctcatgatcttgaaggtgaccacagcgccggccacgccggcaccgtagccagcaaggatgtccactagaatcttccccaggccaacactcggagacccagcatggcgtat

SEQ ID NO: 392573 - DNA, 140 bp, Artificial Sequence
  Synthetic
atacgccatgctgggtctccgaccaggtgagggggcggtccagtggatgaaccgcttgatcgcattcgcgtcaaggggcaaccacgtggctcccacacactacgtccccgagtccgacgccgtacttgggagtcggccat

SEQ ID NO: 392574 - DNA, 140 bp, Artificial Sequence
  Synthetic
atggccgactcccaagtacggcgtcggactcggggacgtagtgtgtgggagccacgtggttgccccttgacgcgaatgcgatcaagcggttcatccactggaccgccccctcacctggtcggagacccagcatggcgtat

SEQ ID NO: 392575 - DNA, 140 bp, Artificial Sequence
  Synthetic
atacgccatgctgggtctcctcagacgcctccacaagtggatcaacgaggactgctccactccttgtgatcgctcttggctatgggagatctgggactgggtctgcaccgtactgagtgacgtacttgggagtcggccat

SEQ ID NO: 392576 - DNA, 140 bp, Artificial Sequence
  Synthetic
atggccgactcccaagtacgtcactcagtacggtgcagacccagtcccagatctcccatagccaagagcgatcacaaggagtggagcagtcctcgttgatccacttgtggaggcgtctgaggagacccagcatggcgtat

SEQ ID NO: 392577 - DNA, 140 bp, Artificial Sequence
  Synthetic
atacgccatgctgggtctccccttcttctcctgtcaaagggggtacagaggagtatggcggggagacggggtaatgcacacaacatgcacatgcggcgcagagctggccggccacgtcaacgtacttgggagtcggccat

SEQ ID NO: 392578 - DNA, 140 bp, Artificial Sequence
  Synthetic
atggccgactcccaagtacgttgacgtggccggccagctctgcgccgcatgtgcatgttgtgtgcattaccccgtctccccgccatactcctctgtaccccctttgacaggagaagaaggggagacccagcatggcgtat

SEQ ID NO: 392579 - DNA, 140 bp, Artificial Sequence
  Synthetic
atacgccatgctgggtctccaaacggctcgatgaggatcgtcgggcccaagacctgtagcaatacctggcacgggactttccccatcaacgcctacaccacgggtcctagcgtgcccatccgtacttgggagtcggccat

SEQ ID NO: 392580 - DNA, 140 bp, Artificial Sequence
  Synthetic
atggccgactcccaagtacggatgggcacgctaggacccgtggtgtaggcgttgatggggaaagtcccgtgccaggtattgctacaggtcttgggcccgacgatcctcatcgagccgtttggagacccagcatggcgtat

SEQ ID NO: 392581 - DNA, 140 bp, Artificial Sequence
  Synthetic
atacgccatgctgggtctcccgtggaggttcgcagagtgggggatttccactacgtcaccggggtcacacaggataacatcaagtgcccctgccaggtacctgcacctgagttcttcacccgtacttgggagtcggccat

SEQ ID NO: 392582 - DNA, 140 bp, Artificial Sequence
  Synthetic
atggccgactcccaagtacgggtgaagaactcaggtgcaggtacctggcaggggcacttgatgttatcctgtgtgaccccggtgacgtagtggaaatcccccactctgcgaacctccacgggagacccagcatggcgtat

SEQ ID NO: 392583 - DNA, 140 bp, Artificial Sequence
  Synthetic
aggccctggctgctgatatgtcaatgtcctacacatggacaggcgccttgatcacgccatgcgccgcggaggaaagcaagttgcccatcaacccgttgagcaactctttgttgcgtcaccgaccttttgggacagcggtg

SEQ ID NO: 392584 - DNA, 140 bp, Artificial Sequence
  Synthetic
caccgctgtcccaaaaggtcggtgacgcaacaaagagttgctcaacgggttgatgggcaacttgctttcctccgcggcgcatggcgtgatcaaggcgcctgtccatgtgtaggacattgacatatcagcagccagggcct

SEQ ID NO: 392585 - DNA, 140 bp, Artificial Sequence
  Synthetic
aggccctggctgctgatatgggtcccagctcccctgcgagcccgagccagacgtcgcagtgttaacatctatgctgacagatccatctcacatcacagcggaggcagcacgccgcaggctgaccttttgggacagcggtg

SEQ ID NO: 392586 - DNA, 140 bp, Artificial Sequence
  Synthetic
caccgctgtcccaaaaggtcagcctgcggcgtgctgcctccgctgtgatgtgagatggatctgtcagcatagatgttaacactgcgacgtctggctcgggctcgcaggggagctgggacccatatcagcagccagggcct

SEQ ID NO: 392587 - DNA, 140 bp, Artificial Sequence
  Synthetic
atacgccatgctgggtctccgtggacctcatcgagtccaatcttctctggggcgccaacgctaccagggttgagtcagaggataaggtgctgatcttggactctttcgagccccttgtggcgtacttgggagtcggccat

SEQ ID NO: 392588 - DNA, 140 bp, Artificial Sequence
  Synthetic
atggccgactcccaagtacgccacaaggggctcgaaagagtccaagatcagcaccttatcctctgactcaaccctggtagcgttggcgccccagagaagattggactcgatgaggtccacggagacccagcatggcgtat

SEQ ID NO: 392589 - DNA, 140 bp, Artificial Sequence
  Synthetic
atacgccatgctgggtctcccaacccacctcttattgagacgtggaaacaaccagactacaaaccaccagttgtccatggctgcgcactgcccccggataaaccaaccccagttcctccccgtacttgggagtcggccat

SEQ ID NO: 392590 - DNA, 140 bp, Artificial Sequence
  Synthetic
atggccgactcccaagtacggggaggaactggggttggtttatccgggggcagtgcgcagccatggacaactggtggtttgtagtctggttgtttccacgtctcaataagaggtgggttgggagacccagcatggcgtat

SEQ ID NO: 392591 - DNA, 140 bp, Artificial Sequence
  Synthetic
atacgccatgctgggtctcccccaggaggaagcgggcagttgtgctctcggagtccaacatctcggctgcattggcaagcttggcagacaagaccttcagccaaccgggtgtcagctccgcgtacttgggagtcggccat

SEQ ID NO: 392592 - DNA, 140 bp, Artificial Sequence
  Synthetic
atggccgactcccaagtacgcggagctgacacccggttggctgaaggtcttgtctgccaagcttgccaatgcagccgagatgttggactccgagagcacaactgcccgcttcctcctgggggagacccagcatggcgtat

SEQ ID NO: 392593 - DNA, 140 bp, Artificial Sequence
  Synthetic
atacgccatgctgggtctccactagaaggggagcctggtgacccagacttgacatcagattcttggtccaccgtcagcggatcggaggatgtagtgtgctgctcaatgtcctactcatggcgtacttgggagtcggccat

SEQ ID NO: 392594 - DNA, 140 bp, Artificial Sequence
  Synthetic
atggccgactcccaagtacgccatgagtaggacattgagcagcacactacatcctccgatccgctgacggtggaccaagaatctgatgtcaagtctgggtcaccaggctccccttctagtggagacccagcatggcgtat

SEQ ID NO: 392595 - DNA, 140 bp, Artificial Sequence
  Synthetic
atacgccatgctgggtctcccgacttctcgttccgccgtcacccggcagaagaaagtcaccttcgaccgtatgcaagtggtggacaaccactacaatgatgtacttaaggagattaaggccgtacttgggagtcggccat

SEQ ID NO: 392596 - DNA, 140 bp, Artificial Sequence
  Synthetic
atggccgactcccaagtacggccttaatctccttaagtacatcattgtagtggttgtccaccacttgcatacggtcgaaggtgactttcttctgccgggtgacggcggaacgagaagtcgggagacccagcatggcgtat

SEQ ID NO: 392597 - DNA, 140 bp, Artificial Sequence
  Synthetic
atacgccatgctgggtctccgaggttcggagccatgcccgtaaggccattaaccacatcaactccgtgtgggaggacttgcgggaagacaccactacccccatccctacaacaatcatggcgtacttgggagtcggccat

SEQ ID NO: 392598 - DNA, 140 bp, Artificial Sequence
  Synthetic
atggccgactcccaagtacgccatgattgttgtagggatgggggtagtggtgtcttcccgcaagtcctcccacacggagttgatgtggttaatggccttacgggcatggctccgaacctcggagacccagcatggcgtat

SEQ ID NO: 392599 - DNA, 140 bp, Artificial Sequence
  Synthetic
aggccctggctgctgatatgctccaataccaccaccacggaggaagaggacggttgtcctgacagaatccaccgtgtcttctgccttggcggagctcgctacaaagaccttcggcagctcgaccttttgggacagcggtg

SEQ ID NO: 392600 - DNA, 140 bp, Artificial Sequence
  Synthetic
caccgctgtcccaaaaggtcgagctgccgaaggtctttgtagcgagctccgccaaggcagaagacacggtggattctgtcaggacaaccgtcctcttcctccgtggtggtggtattggagcatatcagcagccagggcct

SEQ ID NO: 392601 - DNA, 140 bp, Artificial Sequence
  Synthetic
aggccctggctgctgatatgctttgactccactgtaaccgaaaaagacatcagggtcgaggaggaggtttatcagtgttgtgacctagagcccgaagcccgcaaggtcatatccgccctcgaccttttgggacagcggtg

SEQ ID NO: 392602 - DNA, 140 bp, Artificial Sequence
  Synthetic
caccgctgtcccaaaaggtcgagggcggatatgaccttgcgggcttcgggctctaggtcacaacactgataaacctcctcctcgaccctgatgtctttttcggttacagtggagtcaaagcatatcagcagccagggcct

SEQ ID NO: 392603 - DNA, 140 bp, Artificial Sequence
  Synthetic
atacgccatgctgggtctccaagctgcccatcaatgcgttgagcaactctttgctgcgccaccacaacatggtctatgccacaacatcccgcagcgcaagccagcggcagaagaaggtcacgtacttgggagtcggccat

SEQ ID NO: 392604 - DNA, 140 bp, Artificial Sequence
  Synthetic
atggccgactcccaagtacgtgaccttcttctgccgctggcttgcgctgcgggatgttgtggcatagaccatgttgtggtggcgcagcaaagagttgctcaacgcattgatgggcagcttggagacccagcatggcgtat

SEQ ID NO: 392605 - DNA, 140 bp, Artificial Sequence
  Synthetic
aggccctggctgctgatatgggagacatctcatcttctgtcactcaaagaagaagtgtgacgagctcgccgcaaagctggtcgcattgggcatcaacgccgtggcctactaccgcggtctgaccttttgggacagcggtg

SEQ ID NO: 392606 - DNA, 140 bp, Artificial Sequence
  Synthetic
caccgctgtcccaaaaggtcagaccgcggtagtaggccacggcgttgatgcccaatgcgaccagctttgcggcgagctcgtcacacttcttctttgagtgacagaagatgagatgtctcccatatcagcagccagggcct

SEQ ID NO: 392607 - DNA, 140 bp, Artificial Sequence
  Synthetic
aggccctggctgctgatatgtgagcgactttaaaacctggctaaaagccaagctcatgccgcaactgcctgggattccctttgtgtcctgccagcgcgggtataggggggtctggcgagggaccttttgggacagcggtg

SEQ ID NO: 392608 - DNA, 140 bp, Artificial Sequence
  Synthetic
caccgctgtcccaaaaggtccctcgccagacccccctatacccgcgctggcaggacacaaagggaatcccaggcagttgcggcatgagcttggcttttagccaggttttaaagtcgctcacatatcagcagccagggcct

SEQ ID NO: 392609 - DNA, 140 bp, Artificial Sequence
  Synthetic
aggccctggctgctgatatgtgtccgggaagccggcaattatacctgacagggaagtcctctaccgggagttcgatgagatggaagagtgctctcagcacttaccgtacatcgagcaagggaccttttgggacagcggtg

SEQ ID NO: 392610 - DNA, 140 bp, Artificial Sequence
  Synthetic
caccgctgtcccaaaaggtcccttgctcgatgtacggtaagtgctgagagcactcttccatctcatcgaactcccggtagaggacttccctgtcaggtataattgccggcttcccggacacatatcagcagccagggcct

SEQ ID NO: 392611 - DNA, 140 bp, Artificial Sequence
  Synthetic
aggccctggctgctgatatggactatgaaccacctgtggtccatggctgtccacttccgcctccaaagtctcctcctgtacctccgcctcggaagaagcggacggtggtcctcactgaatgaccttttgggacagcggtg

SEQ ID NO: 392612 - DNA, 140 bp, Artificial Sequence
  Synthetic
caccgctgtcccaaaaggtcattcagtgaggaccaccgtccgcttcttccgaggcggaggtacaggaggagactttggaggcggaagtggacagccatggaccacaggtggttcatagtccatatcagcagccagggcct

SEQ ID NO: 392613 - DNA, 140 bp, Artificial Sequence
  Synthetic
atacgccatgctgggtctccgcacatcaacaggacggccctgaactgtaatgactccctccagaccgggttccttgccgcgctgttctacacacgcagcttcaacagctccggatgcccacgtacttgggagtcggccat

SEQ ID NO: 392614 - DNA, 140 bp, Artificial Sequence
  Synthetic
atggccgactcccaagtacgtgggcatccggagctgttgaagctgcgtgtgtagaacagcgcggcaaggaacccggtctggagggagtcattacagttcagggccgtcctgttgatgtgcggagacccagcatggcgtat

SEQ ID NO: 392615 - DNA, 140 bp, Artificial Sequence
  Synthetic
aggccctggctgctgatatgacatcaactccgtgtggaaagaccttctggaagacagtgtaacaccaatagacactaccatcatggccaagaacgaggttttctgcgttcagcctgagaagaccttttgggacagcggtg

SEQ ID NO: 392616 - DNA, 140 bp, Artificial Sequence
  Synthetic
caccgctgtcccaaaaggtcttctcaggctgaacgcagaaaacctcgttcttggccatgatggtagtgtctattggtgttacactgtcttccagaaggtctttccacacggagttgatgtcatatcagcagccagggcct

SEQ ID NO: 392617 - DNA, 140 bp, Artificial Sequence
  Synthetic
atacgccatgctgggtctccccgaattcgagcatagtgtatgagaccgagcatcacatcttgcacctcccgggatgcgttccttgtgtgagggccgggaacaaatctagctgctgggtgtcgtacttgggagtcggccat

SEQ ID NO: 392618 - DNA, 140 bp, Artificial Sequence
  Synthetic
atggccgactcccaagtacgacacccagcagctagatttgttcccggccctcacacaaggaacgcatcccgggaggtgcaagatgtgatgctcggtctcatacactatgctcgaattcggggagacccagcatggcgtat

SEQ ID NO: 392619 - DNA, 140 bp, Artificial Sequence
  Synthetic
aggccctggctgctgatatgtcctggcgggccttgcctactattccatggttgggaactgggctaaggtcttgattgtgatgctactctttgccggcgttgacgggacaactagtgtgtcgaccttttgggacagcggtg

SEQ ID NO: 392620 - DNA, 140 bp, Artificial Sequence
  Synthetic
caccgctgtcccaaaaggtcgacacactagttgtcccgtcaacgccggcaaagagtagcatcacaatcaagaccttagcccagttcccaaccatggaatagtaggcaaggcccgccaggacatatcagcagccagggcct

SEQ ID NO: 392621 - DNA, 140 bp, Artificial Sequence
  Synthetic
aggccctggctgctgatatggaattggagccctactacgacgctggtcctcgcccaacttatgaggatcccaagcgccatggtcgacctgctcgcgggcggccattggggcattctggttgaccttttgggacagcggtg

SEQ ID NO: 392622 - DNA, 140 bp, Artificial Sequence
  Synthetic
caccgctgtcccaaaaggtcaaccagaatgccccaatggccgcccgcgagcaggtcgaccatggcgcttgggatcctcataagttgggcgaggaccagcgtcgtagtagggctccaattccatatcagcagccagggcct

SEQ ID NO: 392623 - DNA, 140 bp, Artificial Sequence
  Synthetic
atacgccatgctgggtctccatcaacaggactgccctgaactgcaacgactccctccacaccgggttcattgctgcgctgttttacgcaaacagtttcaactcatccgcatgcccacatccgtacttgggagtcggccat

SEQ ID NO: 392624 - DNA, 140 bp, Artificial Sequence
  Synthetic
atggccgactcccaagtacggatgtgggcatgcggatgagttgaaactgtttgcgtaaaacagcgcagcaatgaacccggtgtggagggagtcgttgcagttcagggcagtcctgttgatggagacccagcatggcgtat

SEQ ID NO: 392625 - DNA, 140 bp, Artificial Sequence
  Synthetic
atacgccatgctgggtctccaagcggggcgtgacgcgttgacctttgccgggctcttcaccatgggtggccaacagcacatacagctcattaacaccaacgggagctggcacatcaatagcgtacttgggagtcggccat

SEQ ID NO: 392626 - DNA, 140 bp, Artificial Sequence
  Synthetic
atggccgactcccaagtacgctattgatgtgccagctcccgttggtgttaatgagctgtatgtgctgttggccacccatggtgaagagcccggcaaaggtcaacgcgtcacgccccgcttggagacccagcatggcgtat

SEQ ID NO: 392627 - DNA, 140 bp, Artificial Sequence
  Synthetic
atacgccatgctgggtctccagctgcagcagccttgacagcctcccacagggctggggcccccttgggatttatcagcctaatgtgcccgacacaagaccctactgctggaactacacgccgtacttgggagtcggccat

SEQ ID NO: 392628 - DNA, 140 bp, Artificial Sequence
  Synthetic
atggccgactcccaagtacggcgtgtagttccagcagtagggtcttgtgtcgggcacattaggctgataaatcccaagggggccccagccctgtgggaggctgtcaaggctgctgcagctggagacccagcatggcgtat

SEQ ID NO: 392629 - DNA, 140 bp, Artificial Sequence
  Synthetic
aggccctggctgctgatatgttatcagcctaatgtgcccgacacaagaccctactgctggaactacacgcctcgaccctgcgggacggtgtccgcacttaccgtgtgcggccccgtatatgaccttttgggacagcggtg

SEQ ID NO: 392630 - DNA, 140 bp, Artificial Sequence
  Synthetic
caccgctgtcccaaaaggtcatatacggggccgcacacggtaagtgcggacaccgtcccgcagggtcgaggcgtgtagttccagcagtagggtcttgtgtcgggcacattaggctgataacatatcagcagccagggcct

SEQ ID NO: 392631 - DNA, 140 bp, Artificial Sequence
  Synthetic
aggccctggctgctgatatggactacgaaccacctgtggtccatggctgcccgcttccacctccaaagtcccctcctgtgcctccgcctcggaagaagcggacggtggtcctcaccgaatgaccttttgggacagcggtg

SEQ ID NO: 392632 - DNA, 140 bp, Artificial Sequence
  Synthetic
caccgctgtcccaaaaggtcattcggtgaggaccaccgtccgcttcttccgaggcggaggcacaggaggggactttggaggtggaagcgggcagccatggaccacaggtggttcgtagtccatatcagcagccagggcct

SEQ ID NO: 392633 - DNA, 140 bp, Artificial Sequence
  Synthetic
aggccctggctgctgatatggtcgattatccttaccggctgtggcactatccgtgcacagtcaactacaccgtctttaaggtcaggatgtacatcggcgggatagagcatcggctggacggaccttttgggacagcggtg

SEQ ID NO: 392634 - DNA, 140 bp, Artificial Sequence
  Synthetic
caccgctgtcccaaaaggtccgtccagccgatgctctatcccgccgatgtacatcctgaccttaaagacggtgtagttgactgtgcacggatagtgccacagccggtaaggataatcgaccatatcagcagccagggcct

SEQ ID NO: 392635 - DNA, 140 bp, Artificial Sequence
  Synthetic
atacgccatgctgggtctcccaggaggaagcggacggttcagcttacagagtccgttgtttccactgctttggcagagctggccgcaaagaccttcggccaatctgagctgggttcagaccgtacttgggagtcggccat

SEQ ID NO: 392636 - DNA, 140 bp, Artificial Sequence
  Synthetic
atggccgactcccaagtacggtctgaacccagctcagattggccgaaggtctttgcggccagctctgccaaagcagtggaaacaacggactctgtaagctgaaccgtccgcttcctcctgggagacccagcatggcgtat

SEQ ID NO: 392637 - DNA, 140 bp, Artificial Sequence
  Synthetic
atacgccatgctgggtctcccccctgctccttcaccacgctgcccgccctctcgactggcttgattcacctccaccagaacatcgttgacgtccaatacctttacggtgttggctcagcacgtacttgggagtcggccat

SEQ ID NO: 392638 - DNA, 140 bp, Artificial Sequence
  Synthetic
atggccgactcccaagtacgtgctgagccaacaccgtaaaggtattggacgtcaacgatgttctggtggaggtgaatcaagccagtcgagagggcgggcagcgtggtgaaggagcaggggggagacccagcatggcgtat

SEQ ID NO: 392639 - DNA, 140 bp, Artificial Sequence
  Synthetic
atacgccatgctgggtctcccctctctgaaagcgacatgcaccacccaccacgactctcccgacgcggacctcatcgaggccaacctcctgtggaggcaggagatgggcggaaacatcaccgtacttgggagtcggccat

SEQ ID NO: 392640 - DNA, 140 bp, Artificial Sequence
  Synthetic
atggccgactcccaagtacggtgatgtttccgcccatctcctgcctccacaggaggttggcctcgatgaggtccgcgtcgggagagtcgtggtgggtggtgcatgtcgctttcagagaggggagacccagcatggcgtat

SEQ ID NO: 392641 - DNA, 140 bp, Artificial Sequence
  Synthetic
  misc_feature (97)..(97): n is a, c, g, or t
atacgccatgctgggtctcccgcaggtcgaggcagcgctcgccaacttgattactatcaatgcagtctcagtcgccggcattcatggattctggcangctatccttctcatctgcatcgccgtacttgggagtcggccat

SEQ ID NO: 392642 - DNA, 140 bp, Artificial Sequence
  Synthetic
  misc_feature (44)..(44): n is a, c, g, or t
atggccgactcccaagtacggcgatgcagatgagaaggatagcntgccagaatccatgaatgccggcgactgagactgcattgatagtaatcaagttggcgagcgctgcctcgacctgcgggagacccagcatggcgtat

SEQ ID NO: 392643 - DNA, 140 bp, Artificial Sequence
  Synthetic
aggccctggctgctgatatggttttcgcaggcttggtactcttgaccatgtcaccacactacaaagtgttcctcgctaagctcatatggtggttgcagtatttcatcaccagagccgagggaccttttgggacagcggtg

SEQ ID NO: 392644 - DNA, 140 bp, Artificial Sequence
  Synthetic
caccgctgtcccaaaaggtccctcggctctggtgatgaaatactgcaaccaccatatgagcttagcgaggaacactttgtagtgtggtgacatggtcaagagtaccaagcctgcgaaaaccatatcagcagccagggcct

SEQ ID NO: 392645 - DNA, 140 bp, Artificial Sequence
  Synthetic
atacgccatgctgggtctccgccttcgatcgggaaatggcggggtctgccggcagtgctgtcctggtcttgctaactttactgaccttgtctccatattacaaacagtggctagctcgagcgtacttgggagtcggccat

SEQ ID NO: 392646 - DNA, 140 bp, Artificial Sequence
  Synthetic
atggccgactcccaagtacgctcgagctagccactgtttgtaatatggagacaaggtcagtaaagttagcaagaccaggacagcactgccggcagaccccgccatttcccgatcgaaggcggagacccagcatggcgtat

SEQ ID NO: 392647 - DNA, 140 bp, Artificial Sequence
  Synthetic
atacgccatgctgggtctccgtctatgtgccatccctagacgtgcgcgggccccgcgattctatcatcatcctcgctgccttggtgtccccacacgtggcatttgaaaccacaaaacacccgtacttgggagtcggccat

SEQ ID NO: 392648 - DNA, 140 bp, Artificial Sequence
  Synthetic
atggccgactcccaagtacgggtgttttgtggtttcaaatgccacgtgtggggacaccaaggcagcgaggatgatgatagaatcgcggggcccgcgcacgtctagggatggcacatagacggagacccagcatggcgtat

SEQ ID NO: 392649 - DNA, 140 bp, Artificial Sequence
  Synthetic
atacgccatgctgggtctccccgtgggttggtgtgtggtaagtattgtcagatggccctattgaagataggggcgctgaccggaacatacgtctacaaccacctcactcccttatcagaccgtacttgggagtcggccat

SEQ ID NO: 392650 - DNA, 140 bp, Artificial Sequence
  Synthetic
atggccgactcccaagtacggtctgataagggagtgaggtggttgtagacgtatgttccggtcagcgcccctatcttcaatagggccatctgacaatacttaccacacaccaacccacggggagacccagcatggcgtat

SEQ ID NO: 392651 - DNA, 140 bp, Artificial Sequence
  Synthetic
aggccctggctgctgatatggggcgctgaccggaacatacgtctacaaccacctcactcccttatcagactgggctgccgaggggcttagtgacctagcggtggcacttgagccggtcgtgaccttttgggacagcggtg

SEQ ID NO: 392652 - DNA, 140 bp, Artificial Sequence
  Synthetic
caccgctgtcccaaaaggtcacgaccggctcaagtgccaccgctaggtcactaagcccctcggcagcccagtctgataagggagtgaggtggttgtagacgtatgttccggtcagcgccccatatcagcagccagggcct

SEQ ID NO: 392653 - DNA, 140 bp, Artificial Sequence
  Synthetic
atacgccatgctgggtctcctgggtctcaccgcgatcttcaggccgggtcccaagcagaacatccagctcatcaacaccaatggcagttggcacatcaatcgcacggccttgaactgtaacgtacttgggagtcggccat

SEQ ID NO: 392654 - DNA, 140 bp, Artificial Sequence
  Synthetic
atggccgactcccaagtacgttacagttcaaggccgtgcgattgatgtgccaactgccattggtgttgatgagctggatgttctgcttgggacccggcctgaagatcgcggtgagacccaggagacccagcatggcgtat

SEQ ID NO: 392655 - DNA, 140 bp, Artificial Sequence
  Synthetic
aggccctggctgctgatatgtggctcgtcggacttgttcctggttaccaggcacgccgacgtagtgcccgtgcgcagaagaggcgacactcgcggcgccctcataagccccaggccgattgaccttttgggacagcggtg

SEQ ID NO: 392656 - DNA, 140 bp, Artificial Sequence
  Synthetic
caccgctgtcccaaaaggtcaatcggcctggggcttatgagggcgccgcgagtgtcgcctcttctgcgcacgggcactacgtcggcgtgcctggtaaccaggaacaagtccgacgagccacatatcagcagccagggcct

SEQ ID NO: 392657 - DNA, 140 bp, Artificial Sequence
  Synthetic
aggccctggctgctgatatgcagtggatttcgtgccggttgaatctcttgaaaccaccatgagatcaccagtattctctgacaattccactcctcctgccgtgccccagacttatcaagtgaccttttgggacagcggtg

SEQ ID NO: 392658 - DNA, 140 bp, Artificial Sequence
  Synthetic
caccgctgtcccaaaaggtcacttgataagtctggggcacggcaggaggagtggaattgtcagagaatactggtgatctcatggtggtttcaagagattcaaccggcacgaaatccactgcatatcagcagccagggcct

SEQ ID NO: 392659 - DNA, 140 bp, Artificial Sequence
  Synthetic
atacgccatgctgggtctccgctgcgactctgggttttggggcatacatgtccaaggcacatggcattgatcccaatatacgatcaggggtcagaactattaccacaggcgcgcctatcacgtacttgggagtcggccat

SEQ ID NO: 392660 - DNA, 140 bp, Artificial Sequence
  Synthetic
atggccgactcccaagtacgtgataggcgcgcctgtggtaatagttctgacccctgatcgtatattgggatcaatgccatgtgccttggacatgtatgccccaaaacccagagtcgcagcggagacccagcatggcgtat

SEQ ID NO: 392661 - DNA, 140 bp, Artificial Sequence
  Synthetic
atacgccatgctgggtctccgatcatgggtataggcacggtcttagacaaaccgaaaaccccggaaccccgcctggccggccccccaaccccaacccaacccgggccgggaaaaaccccacgtacttgggagtcggccat

SEQ ID NO: 392662 - DNA, 140 bp, Artificial Sequence
  Synthetic
atggccgactcccaagtacgtggggtttttcccggcccgggttgggttggggttggggggccggccaggcggggttccggggttttcggtttgtctaagaccgtgcctatacccatgatcggagacccagcatggcgtat

SEQ ID NO: 392663 - DNA, 140 bp, Artificial Sequence
  Synthetic
  misc_feature (112)..(112): n is a, c, g, or t
aggccctggctgctgatatggcctggccggccccccaaccccaacccaacccgggccgggaaaaaccccacaccacaaaaaaaagcacgccgcacgaccgacaacgacaganatacacctgaccttttgggacagcggtg

SEQ ID NO: 392664 - DNA, 140 bp, Artificial Sequence
  Synthetic
  misc_feature (29)..(29): n is a, c, g, or t
caccgctgtcccaaaaggtcaggtgtatntctgtcgttgtcggtcgtgcggcgtgcttttttttgtggtgtggggtttttcccggcccgggttgggttggggttggggggccggccaggccatatcagcagccagggcct

SEQ ID NO: 392665 - DNA, 140 bp, Artificial Sequence
  Synthetic
aggccctggctgctgatatgtccggcatatttgactcctcagtactctgtgagtgctacgatgctggatgcgcttggtatgaactgacaccggcagagacaacggtcaggttaagggcttgaccttttgggacagcggtg

SEQ ID NO: 392666 - DNA, 140 bp, Artificial Sequence
  Synthetic
caccgctgtcccaaaaggtcaagcccttaacctgaccgttgtctctgccggtgtcagttcataccaagcgcatccagcatcgtagcactcacagagtactgaggagtcaaatatgccggacatatcagcagccagggcct

SEQ ID NO: 392667 - DNA, 140 bp, Artificial Sequence
  Synthetic
aggccctggctgctgatatggaccaaacaggcgggtgacaactacccctacctggtcgcctaccaggctacagtctgtgccaaggctttggcacccccacccagttgggacacaatgtgggaccttttgggacagcggtg

SEQ ID NO: 392668 - DNA, 140 bp, Artificial Sequence
  Synthetic
caccgctgtcccaaaaggtcccacattgtgtcccaactgggtgggggtgccaaagccttggcacagactgtagcctggtaggcgaccaggtaggggtagttgtcacccgcctgtttggtccatatcagcagccagggcct

SEQ ID NO: 392669 - DNA, 140 bp, Artificial Sequence
  Synthetic
aggccctggctgctgatatgagctgggcgtgcctacctacaactggggtgacaatgatacggacgtcctcgtccttaataacaccaggccaccgttgggcaattggttcggttgcacctggaccttttgggacagcggtg

SEQ ID NO: 392670 - DNA, 140 bp, Artificial Sequence
  Synthetic
caccgctgtcccaaaaggtccaggtgcaaccgaaccaattgcccaacggtggcctggtgttattaaggacgaggacgtccgtatcattgtcaccccagttgtaggtaggcacgcccagctcatatcagcagccagggcct

SEQ ID NO: 392671 - DNA, 140 bp, Artificial Sequence
  Synthetic
atacgccatgctgggtctccccaaatacatcgcggcctgcatgtccgccgatcttgaggttgtgaccagcacgtgggtcatggtaggcggccttctggcggccctcgctgcctactgcttcgtacttgggagtcggccat

SEQ ID NO: 392672 - DNA, 140 bp, Artificial Sequence
  Synthetic
atggccgactcccaagtacgaagcagtaggcagcgagggccgccagaaggccgcctaccatgacccacgtgctggtcacaacctcaagatcggcggacatgcaggccgcgatgtatttggggagacccagcatggcgtat

SEQ ID NO: 392673 - DNA, 140 bp, Artificial Sequence
  Synthetic
atacgccatgctgggtctcctttaacatcttggggggttgggtagcctcacagatcgcgacccccacggcctccactgcttttgtcataagcggcatcgcgggggctgcggtcgggagtgcgtacttgggagtcggccat

SEQ ID NO: 392674 - DNA, 140 bp, Artificial Sequence
  Synthetic
atggccgactcccaagtacgcactcccgaccgcagcccccgcgatgccgcttatgacaaaagcagtggaggccgtgggggtcgcgatctgtgaggctacccaaccccccaagatgttaaaggagacccagcatggcgtat

SEQ ID NO: 392675 - DNA, 140 bp, Artificial Sequence
  Synthetic
aggccctggctgctgatatgtgttggcagcataggtcttgggaaggtgcttgtggacatcttggcgggttatggagcaggggtggcaggcgctctcgtggcctttaaggtcatgagcggcgaccttttgggacagcggtg

SEQ ID NO: 392676 - DNA, 140 bp, Artificial Sequence
  Synthetic
caccgctgtcccaaaaggtcgccgctcatgaccttaaaggccacgagagcgcctgccacccctgctccataacccgccaagatgtccacaagcaccttcccaagacctatgctgccaacacatatcagcagccagggcct

SEQ ID NO: 392677 - DNA, 140 bp, Artificial Sequence
  Synthetic
atacgccatgctgggtctccttggcttggggaagatcctagtggacattctcgctggctacggggccggtgtggccggcgctgtggtcgccttcaagatcatgagcggcgagacaccgtccgtacttgggagtcggccat

SEQ ID NO: 392678 - DNA, 140 bp, Artificial Sequence
  Synthetic
atggccgactcccaagtacggacggtgtctcgccgctcatgatcttgaaggcgaccacagcgccggccacaccggccccgtagccagcgagaatgtccactaggatcttccccaagccaaggagacccagcatggcgtat

SEQ ID NO: 392679 - DNA, 140 bp, Artificial Sequence
  Synthetic
aggccctggctgctgatatgtatatcagctggtgcttatggtggcttcagtattttctgaccagagtagaagcgcaactgcacgtgtgggttccccccctcaacgtccgaggggggcgcggaccttttgggacagcggtg

SEQ ID NO: 392680 - DNA, 140 bp, Artificial Sequence
  Synthetic
caccgctgtcccaaaaggtccgcgcccccctcggacgttgagggggggaacccacacgtgcagttgcgcttctactctggtcagaaaatactgaagccaccataagcaccagctgatatacatatcagcagccagggcct

SEQ ID NO: 392681 - DNA, 140 bp, Artificial Sequence
  Synthetic
aggccctggctgctgatatgccggactacgtccctccggtggtgcatgggtgcccattgccgcctaccaaggcccctccaataccacctccacggaggaaaaggacggttgtcctgacaggaccttttgggacagcggtg

SEQ ID NO: 392682 - DNA, 140 bp, Artificial Sequence
  Synthetic
caccgctgtcccaaaaggtcctgtcaggacaaccgtccttttcctccgtggaggtggtattggaggggccttggtaggcggcaatgggcacccatgcaccaccggagggacgtagtccggcatatcagcagccagggcct

SEQ ID NO: 392683 - DNA, 140 bp, Artificial Sequence
  Synthetic
aggccctggctgctgatatgcagtctgctcaaagtgccctacttcgtgcgcgtccaaggcctcctccggatctgcgcgctagcgcgcaagatggccggaggccattacgtgcagatggccgaccttttgggacagcggtg

SEQ ID NO: 392684 - DNA, 140 bp, Artificial Sequence
  Synthetic
caccgctgtcccaaaaggtcggccatctgcacgtaatggcctccggccatcttgcgcgctagcgcgcagatccggaggaggccttggacgcgcacgaagtagggcactttgagcagactgcatatcagcagccagggcct

SEQ ID NO: 392685 - DNA, 140 bp, Artificial Sequence
  Synthetic
atacgccatgctgggtctccaggttcgcagagtaggggatttccattatgtcaccggggtcacacaagataacatcaagtgcccctgccaggtacccgcacctgagttcttcactgaggtcgtacttgggagtcggccat

SEQ ID NO: 392686 - DNA, 140 bp, Artificial Sequence
  Synthetic
atggccgactcccaagtacgacctcagtgaagaactcaggtgcgggtacctggcaggggcacttgatgttatcttgtgtgaccccggtgacataatggaaatcccctactctgcgaacctggagacccagcatggcgtat

SEQ ID NO: 392687 - DNA, 140 bp, Artificial Sequence
  Synthetic
aggccctggctgctgatatgcaactcccctgcgagcccgagccagatgttgcagtgctaacatctatgctgacagatccatctcacatcacggctgaggcagcacgccgtaggctgggaagaccttttgggacagcggtg

SEQ ID NO: 392688 - DNA, 140 bp, Artificial Sequence
  Synthetic
caccgctgtcccaaaaggtcttcccagcctacggcgtgctgcctcagccgtgatgtgagatggatctgtcagcatagatgttagcactgcaacatctggctcgggctcgcaggggagttgcatatcagcagccagggcct

SEQ ID NO: 392689 - DNA, 140 bp, Artificial Sequence
  Synthetic
aggccctggctgctgatatgggtggagggtgaggttcagatcgtgtcaactgctgcccagactttcctggcaacctgcatcaacggggtgtgctggactgtctaccacggggccggaacagaccttttgggacagcggtg

SEQ ID NO: 392690 - DNA, 140 bp, Artificial Sequence
  Synthetic
caccgctgtcccaaaaggtctgttccggccccgtggtagacagtccagcacaccccgttgatgcaggttgccaggaaagtctgggcagcagttgacacgatctgaacctcaccctccacccatatcagcagccagggcct

SEQ ID NO: 392691 - DNA, 140 bp, Artificial Sequence
  Synthetic
  misc_feature (57)..(57): n is a, c, g, or t
atacgccatgctgggtctcccctcatcgaggctaatcttctctggggcgccaacgtnaccagggtcgagtcaggggataaggtgctgatcttggactctttcgagccccttgtggccgagcgtacttgggagtcggccat

SEQ ID NO: 392692 - DNA, 140 bp, Artificial Sequence
  Synthetic
  misc_feature (84)..(84): n is a, c, g, or t
atggccgactcccaagtacgctcggccacaaggggctcgaaagagtccaagatcagcaccttatcccctgactcgaccctggtnacgttggcgccccagagaagattagcctcgatgaggggagacccagcatggcgtat

SEQ ID NO: 392693 - DNA, 140 bp, Artificial Sequence
  Synthetic
  misc_feature (36)..(36): n is a, c, g, or t
atacgccatgctgggtctccccggatgacagggagntctccgtcccagcagagatcctgcggacttcgaggaagttcccaagggccatgccaatttgggctcagccggcttataacccaccgtacttgggagtcggccat

SEQ ID NO: 392694 - DNA, 140 bp, Artificial Sequence
  Synthetic
  misc_feature (105)..(105): n is a, c, g, or t
atggccgactcccaagtacggtgggttataagccggctgagcccaaattggcatggcccttgggaacttcctcgaagtccgcaggatctctgctgggacggaganctccctgtcatccggggagacccagcatggcgtat

SEQ ID NO: 392695 - DNA, 140 bp, Artificial Sequence
  Synthetic
atacgccatgctgggtctccctctcattgagacgtggaaacaaccagactacgaaccaccagttgttcatggctgcgcactgcccccggacaaaccaacccctgttcctcctcccaggagcgtacttgggagtcggccat

SEQ ID NO: 392696 - DNA, 140 bp, Artificial Sequence
  Synthetic
atggccgactcccaagtacgctcctgggaggaggaacaggggttggtttgtccgggggcagtgcgcagccatgaacaactggtggttcgtagtctggttgtttccacgtctcaatgagagggagacccagcatggcgtat

SEQ ID NO: 392697 - DNA, 140 bp, Artificial Sequence
  Synthetic
atacgccatgctgggtctccgaagcggacagtcgcgctctcggagtccaatatctcagaggcactggcgagcttggcagacaagaccttcggccagccagctgccagctccgattccggacgtacttgggagtcggccat

SEQ ID NO: 392698 - DNA, 140 bp, Artificial Sequence
  Synthetic
atggccgactcccaagtacgtccggaatcggagctggcagctggctggccgaaggtcttgtctgccaagctcgccagtgcctctgagatattggactccgagagcgcgactgtccgcttcggagacccagcatggcgtat

SEQ ID NO: 392699 - DNA, 140 bp, Artificial Sequence
  Synthetic
atacgccatgctgggtctccatgacgaggtactcagccccccccggagacgccccgcaaccagcatatgacctggaactcataacatcgtgctcctccaatgtttccgtcgcacacgacgcgtacttgggagtcggccat

SEQ ID NO: 392700 - DNA, 140 bp, Artificial Sequence
  Synthetic
atggccgactcccaagtacgcgtcgtgtgcgacggaaacattggaggagcacgatgttatgagttccaggtcatatgctggttgcggggcgtctccggggggggctgagtacctcgtcatggagacccagcatggcgtat

SEQ ID NO: 392701 - DNA, 140 bp, Artificial Sequence
  Synthetic
atacgccatgctgggtctccctgggctcagcccgggtacccttggcccctctatggcaatgagggcatggggtgggcaggatggctcctgtcaccccgtggctctcggcctagttggggccgtacttgggagtcggccat

SEQ ID NO: 392702 - DNA, 140 bp, Artificial Sequence
  Synthetic
atggccgactcccaagtacggccccaactaggccgagagccacggggtgacaggagccatcctgcccaccccatgccctcattgccatagaggggccaagggtacccgggctgagcccagggagacccagcatggcgtat

SEQ ID NO: 392703 - DNA, 140 bp, Artificial Sequence
  Synthetic
atacgccatgctgggtctcctcgtcgggagggtcgttatatctggccaacctgctgtcatccccgatcgagaggtgctgtaccgacagttcgacgaaatggaagagtgctctaagcacctcgtacttgggagtcggccat

SEQ ID NO: 392704 - DNA, 140 bp, Artificial Sequence
  Synthetic
atggccgactcccaagtacgaggtgcttagagcactcttccatttcgtcgaactgtcggtacagcacctctcgatcggggatgacagcaggttggccagatataacgaccctcccgacgaggagacccagcatggcgtat

SEQ ID NO: 392705 - DNA, 140 bp, Artificial Sequence
  Synthetic
aggccctggctgctgatatgcagaaaatccagctcgtaaacaccaatggcagctggcacatcaacaggactgccctcaactgcaatgactccctccagactgggtttcttgccgcgctgtgaccttttgggacagcggtg

SEQ ID NO: 392706 - DNA, 140 bp, Artificial Sequence
  Synthetic
caccgctgtcccaaaaggtcacagcgcggcaagaaacccagtctggagggagtcattgcagttgagggcagtcctgttgatgtgccagctgccattggtgtttacgagctggattttctgcatatcagcagccagggcct

SEQ ID NO: 392707 - DNA, 140 bp, Artificial Sequence
  Synthetic
aggccctggctgctgatatggggccttgcctactatgccatggtggggaattgggctaaggttttgattgtgatgctactcttcgccggcgttgatggggatacctacgcgtctgggggggaccttttgggacagcggtg

SEQ ID NO: 392708 - DNA, 140 bp, Artificial Sequence
  Synthetic
caccgctgtcccaaaaggtcccccccagacgcgtaggtatccccatcaacgccggcgaagagtagcatcacaatcaaaaccttagcccaattccccaccatggcatagtaggcaaggccccatatcagcagccagggcct

SEQ ID NO: 392709 - DNA, 140 bp, Artificial Sequence
  Synthetic
atacgccatgctgggtctccttacgcaacagggaatcttcccggttgctctttctctatcttcctcttggcactgctctcgtgcctgactgttcccgcttcggcctacaactatcgcaaccgtacttgggagtcggccat

SEQ ID NO: 392710 - DNA, 140 bp, Artificial Sequence
  Synthetic
atggccgactcccaagtacggttgcgatagttgtaggccgaagcgggaacagtcaggcacgagagcagtgccaagaggaagatagagaaagagcaaccgggaagattccctgttgcgtaaggagacccagcatggcgtat

SEQ ID NO: 392711 - DNA, 140 bp, Artificial Sequence
  Synthetic
atacgccatgctgggtctccagctcgggtgtctaccatgtcaccaacgactgcccgaactcgagcatagtctatgaagccgatcaccacatcttgcacctcccggggtgtgtcccttgtgcgtacttgggagtcggccat

SEQ ID NO: 392712 - DNA, 140 bp, Artificial Sequence
  Synthetic
atggccgactcccaagtacgcacaagggacacaccccgggaggtgcaagatgtggtgatcggcttcatagactatgctcgagttcgggcagtcgttggtgacatggtagacacccgagctggagacccagcatggcgtat

SEQ ID NO: 392713 - DNA, 140 bp, Artificial Sequence
  Synthetic
atacgccatgctgggtctcctctgatggtgggcagcgccactctctgctccgctctttacatcggagatgtgtgtgggggtgtgttcttgatcggtcaactgttcacctttcaacctcgccgtacttgggagtcggccat

SEQ ID NO: 392714 - DNA, 140 bp, Artificial Sequence
  Synthetic
atggccgactcccaagtacggcgaggttgaaaggtgaacagttgaccgatcaagaacacacccccacacacatctccgatgtaaagagcggagcagagagtggcgctgcccaccatcagaggagacccagcatggcgtat

SEQ ID NO: 392715 - DNA, 140 bp, Artificial Sequence
  Synthetic
atacgccatgctgggtctcccacaggacacagaatggcttgggacatgatgatgaattggagccccactgcgacgctggtcctcgcccaacttatgaggatcccaggcgccatggttgaccgtacttgggagtcggccat

SEQ ID NO: 392716 - DNA, 140 bp, Artificial Sequence
  Synthetic
atggccgactcccaagtacggtcaaccatggcgcctgggatcctcataagttgggcgaggaccagcgtcgcagtggggctccaattcatcatcatgtcccaagccattctgtgtcctgtgggagacccagcatggcgtat

SEQ ID NO: 392717 - DNA, 140 bp, Artificial Sequence
  Synthetic
aggccctggctgctgatatgcgcccttgctgtataggctaggagccgtccaaaacgaggtcaccctcacacaccccataaccaaatacatcatggcatgcatgtcggctgacctggaggtgaccttttgggacagcggtg

SEQ ID NO: 392718 - DNA, 140 bp, Artificial Sequence
  Synthetic
caccgctgtcccaaaaggtcacctccaggtcagccgacatgcatgccatgatgtatttggttatggggtgtgtgagggtgacctcgttttggacggctcctagcctatacagcaagggcgcatatcagcagccagggcct

SEQ ID NO: 392719 - DNA, 140 bp, Artificial Sequence
  Synthetic
atacgccatgctgggtctccgagtcgacgctaacacccacaccaccgggggccaggcgggacggaccacgtttggcattgcctcactgttcagcccgggttcccaccagaagatacagctcgtacttgggagtcggccat

SEQ ID NO: 392720 - DNA, 140 bp, Artificial Sequence
  Synthetic
atggccgactcccaagtacgagctgtatcttctggtgggaacccgggctgaacagtgaggcaatgccaaacgtggtccgtcccgcctggcccccggtggtgtgggtgttagcgtcgactcggagacccagcatggcgtat

SEQ ID NO: 392721 - DNA, 140 bp, Artificial Sequence
  Synthetic
atacgccatgctgggtctccttcaacagctctgggtgtccagagaggctagccagctgcagcggccttgacagcctcccacaaggctggggccctcttgggacttatcaggctaatgagtcgtacttgggagtcggccat

SEQ ID NO: 392722 - DNA, 140 bp, Artificial Sequence
  Synthetic
atggccgactcccaagtacgactcattagcctgataagtcccaagagggccccagccttgtgggaggctgtcaaggccgctgcagctggctagcctctctggacacccagagctgttgaaggagacccagcatggcgtat

SEQ ID NO: 392723 - DNA, 140 bp, Artificial Sequence
  Synthetic
aggccctggctgctgatatggcgagaatgagaccgatgtgtttctgctgaacacgaccaggcctccccggggtgcttggtttggctgcacgtggatgaacggcacagggtttacaaaatcgaccttttgggacagcggtg

SEQ ID NO: 392724 - DNA, 140 bp, Artificial Sequence
  Synthetic
caccgctgtcccaaaaggtcgattttgtaaaccctgtgccgttcatccacgtgcagccaaaccaagcaccccggggaggcctggtcgtgttcagcagaaacacatcggtctcattctcgccatatcagcagccagggcct

SEQ ID NO: 392725 - DNA, 140 bp, Artificial Sequence
  Synthetic
atacgccatgctgggtctccggctcagggccctggcttacgccaagatgcctagtcgactatccttaccggctgtggcactatccgtgcacagtcaactacaccatctttaaggtcaggacgtacttgggagtcggccat

SEQ ID NO: 392726 - DNA, 140 bp, Artificial Sequence
  Synthetic
atggccgactcccaagtacgtcctgaccttaaagatggtgtagttgactgtgcacggatagtgccacagccggtaaggatagtcgactaggcatcttggcgtaagccagggccctgagccggagacccagcatggcgtat

SEQ ID NO: 392727 - DNA, 140 bp, Artificial Sequence
  Synthetic
atacgccatgctgggtctcctaggtctggtattcctgactttgtcaccatactacaaggtgttcctcgctaggctcatatggtggttgcaatacttcctcaccatagccgaggcgcacctcgtacttgggagtcggccat

SEQ ID NO: 392728 - DNA, 140 bp, Artificial Sequence
  Synthetic
atggccgactcccaagtacgaggtgcgcctcggctatggtgaggaagtattgcaaccaccatatgagcctagcgaggaacaccttgtagtatggtgacaaagtcaggaataccagacctaggagacccagcatggcgtat

SEQ ID NO: 392729 - DNA, 140 bp, Artificial Sequence
  Synthetic
aggccctggctgctgatatgctcctgctcgccacgctcggtccgctcctggtgcttcaggctggcataactagagtgccgtactttgtgcgcgctcatgggctcattcgcgcgtgcatgcgaccttttgggacagcggtg

SEQ ID NO: 392730 - DNA, 140 bp, Artificial Sequence
  Synthetic
caccgctgtcccaaaaggtcgcatgcacgcgcgaatgagcccatgagcgcgcacaaagtacggcactctagttatgccagcctgaagcaccaggagcggaccgagcgtggcgagcaggagcatatcagcagccagggcct

SEQ ID NO: 392731 - DNA, 140 bp, Artificial Sequence
  Synthetic
aggccctggctgctgatatggatgtccaatacctttacggtgttggctcagctgtggtgtcctgggcccttaagtgggagtacattgtgcttgctttcctgctgttggcagacgccaagcgaccttttgggacagcggtg

SEQ ID NO: 392732 - DNA, 140 bp, Artificial Sequence
  Synthetic
caccgctgtcccaaaaggtcgcttggcgtctgccaacagcaggaaagcaagcacaatgtactcccacttaagggcccaggacaccacagctgagccaacaccgtaaaggtattggacatccatatcagcagccagggcct

SEQ ID NO: 392733 - DNA, 140 bp, Artificial Sequence
  Synthetic
atacgccatgctgggtctccgtattggccacgcgcgggtttacgagaactcgcggtggcagtagagcccgtcatcttctctgacatggagaccaagattatcacctggggggcagacactcgtacttgggagtcggccat

SEQ ID NO: 392734 - DNA, 140 bp, Artificial Sequence
  Synthetic
atggccgactcccaagtacgagtgtctgccccccaggtgataatcttggtctccatgtcagagaagatgacgggctctactgccaccgcgagttctcgtaaacccgcgcgtggccaatacggagacccagcatggcgtat

SEQ ID NO: 392735 - DNA, 140 bp, Artificial Sequence
  Synthetic
atacgccatgctgggtctccattctggtacgccatccttgtcatctgcatcgcttggcatgttaagggcaagcttccggctgctgccacctacgccgcatgcgggttgtggcccctgctgcgtacttgggagtcggccat

SEQ ID NO: 392736 - DNA, 140 bp, Artificial Sequence
  Synthetic
atggccgactcccaagtacgcagcaggggccacaacccgcatgcggcgtaggtggcagcagccggaagcttgcccttaacatgccaagcgatgcagatgacaaggatggcgtaccagaatggagacccagcatggcgtat

SEQ ID NO: 392737 - DNA, 140 bp, Artificial Sequence
  Synthetic
atacgccatgctgggtctcctgtctccacgttacaagcagtggctggctctaggcatttggtggctgcaatacttcattgccagagccgaggctatcatccatgtctatgtgccatctctcgtacttgggagtcggccat

SEQ ID NO: 392738 - DNA, 140 bp, Artificial Sequence
  Synthetic
atggccgactcccaagtacgagagatggcacatagacatggatgatagcctcggctctggcaatgaagtattgcagccaccaaatgcctagagccagccactgcttgtaacgtggagacaggagacccagcatggcgtat

SEQ ID NO: 392739 - DNA, 140 bp, Artificial Sequence
  Synthetic
atacgccatgctgggtctccagacgtgcgcgggtctcgcgattccatcattatcctcactgccttggtattcccacacgtggcatttgaaaccacaaaacatctccttgccatccttggtcgtacttgggagtcggccat

SEQ ID NO: 392740 - DNA, 140 bp, Artificial Sequence
  Synthetic
atggccgactcccaagtacgaccaaggatggcaaggagatgttttgtggtttcaaatgccacgtgtgggaataccaaggcagtgaggataatgatggaatcgcgagacccgcgcacgtctggagacccagcatggcgtat

SEQ ID NO: 392741 - DNA, 140 bp, Artificial Sequence
  Synthetic
atacgccatgctgggtctcccagggcctgcctgtctcggcgaggctgggtaatgaaatcttgctcggcccggccgatgcgcacaccataaaggggtggaggctgcttgcccccatcactgcgtacttgggagtcggccat

SEQ ID NO: 392742 - DNA, 140 bp, Artificial Sequence
  Synthetic
atggccgactcccaagtacgcagtgatgggggcaagcagcctccacccctttatggtgtgcgcatcggccgggccgagcaagatttcattacccagcctcgccgagacaggcaggccctgggagacccagcatggcgtat

SEQ ID NO: 392743 - DNA, 140 bp, Artificial Sequence
  Synthetic
atacgccatgctgggtctcccggccccgctggttctggttttgcctactcctgcttgctgcaggggtaggcatatacctcctccccaaccgatgaagatgggtaaacactccggctcttacgtacttgggagtcggccat

SEQ ID NO: 392744 - DNA, 140 bp, Artificial Sequence
  Synthetic
atggccgactcccaagtacgtaagagccggagtgtttacccatcttcatcggttggggaggaggtatatgcctacccctgcagcaagcaggagtaggcaaaaccagaaccagcggggccgggagacccagcatggcgtat

SEQ ID NO: 392745 - DNA, 140 bp, Artificial Sequence
  Synthetic
atacgccatgctgggtctcctccgggagtgaagtccttggccccatgcacctgtggctcgtcggacctgttcctggttaccaggcacgccgacgtggtgcccgtgcgcagaagaggcgaccgtacttgggagtcggccat

SEQ ID NO: 392746 - DNA, 140 bp, Artificial Sequence
  Synthetic
atggccgactcccaagtacggtcgcctcttctgcgcacgggcaccacgtcggcgtgcctggtaaccaggaacaggtccgacgagccacaggtgcatggggccaaggacttcactcccggaggagacccagcatggcgtat

SEQ ID NO: 392747 - DNA, 140 bp, Artificial Sequence
  Synthetic
aggccctggctgctgatatgcggtgtgcgccagggcccaggctccacctccatcgtgggaccaaatgtggaagtgtctcatacggctgaagcctacgctgcacgggccaacacccctgctgaccttttgggacagcggtg

SEQ ID NO: 392748 - DNA, 140 bp, Artificial Sequence
  Synthetic
caccgctgtcccaaaaggtcagcaggggtgttggcccgtgcagcgtaggcttcagccgtatgagacacttccacatttggtcccacgatggaggtggagcctgggccctggcgcacaccgcatatcagcagccagggcct

SEQ ID NO: 392749 - DNA, 140 bp, Artificial Sequence
  Synthetic
atacgccatgctgggtctcccggtcctagaccaggcggaaaccgctggagcgcgtcttgtcgtgctcgcgaccgccacgccacccggatcggtgacaacgccccactccaatatagaggacgtacttgggagtcggccat

SEQ ID NO: 392750 - DNA, 140 bp, Artificial Sequence
  Synthetic
atggccgactcccaagtacgtcctctatattggagtggggcgttgtcaccgatccgggtggcgtggcggtcgcgagcacgacaagacgcgctccagcggtttccgcctggtctaggaccgggagacccagcatggcgtat

SEQ ID NO: 392751 - DNA, 140 bp, Artificial Sequence
  Synthetic
atacgccatgctgggtctccaaaaagtgtgatgagttggccaagcaactatcatctcttggcctcaatgctgtagcctattatagggggctcgacgtctcagtgataccattatctggtgcgtacttgggagtcggccat

SEQ ID NO: 392752 - DNA, 140 bp, Artificial Sequence
  Synthetic
atggccgactcccaagtacgcaccagataatggtatcactgagacgtcgagccccctataataggctacagcattgaggccaagagatgatagttgcttggccaactcatcacactttttggagacccagcatggcgtat

SEQ ID NO: 392753 - DNA, 140 bp, Artificial Sequence
  Synthetic
aggccctggctgctgatatgcagctgatcaacaccaacggcagttggcacatcaataggacggccttgaactgcaatgatagccttcagaccggctttttagcagggcttttctatcaccgaccttttgggacagcggtg

SEQ ID NO: 392754 - DNA, 140 bp, Artificial Sequence
  Synthetic
caccgctgtcccaaaaggtcggtgatagaaaagccctgctaaaaagccggtctgaaggctatcattgcagttcaaggccgtcctattgatgtgccaactgccgttggtgttgatcagctgcatatcagcagccagggcct

SEQ ID NO: 392755 - DNA, 140 bp, Artificial Sequence
  Synthetic
aggccctggctgctgatatgccggtggtgcacgggtgcccattgccacctaccaaggcgcccccaataccacctccacggagaaagaggacggttgtcctgacagaatccaccgtgtcttgaccttttgggacagcggtg

SEQ ID NO: 392756 - DNA, 140 bp, Artificial Sequence
  Synthetic
caccgctgtcccaaaaggtcaagacacggtggattctgtcaggacaaccgtcctctttctccgtggaggtggtattgggggcgccttggtaggtggcaatgggcacccgtgcaccaccggcatatcagcagccagggcct

SEQ ID NO: 392757 - DNA, 140 bp, Artificial Sequence
  Synthetic
aggccctggctgctgatatgcggcgacgcaggatccgacgctgagtcgtactcctccatgcccccccttgagggggagccgggggaccccgatctcagcgacgggtcttggtctaccgtggaccttttgggacagcggtg

SEQ ID NO: 392758 - DNA, 140 bp, Artificial Sequence
  Synthetic
caccgctgtcccaaaaggtccacggtagaccaagacccgtcgctgagatcggggtcccccggctccccctcaagggggggcatggaggagtacgactcagcgtcggatcctgcgtcgccgcatatcagcagccagggcct

SEQ ID NO: 392759 - DNA, 140 bp, Artificial Sequence
  Synthetic
atacgccatgctgggtctccacagtgggcctcaacacttttgtggtggggtcccagctcccctgcgagcccgagccagacgtcgcagtggtaacatctatgctgacagatccatctcacacgtacttgggagtcggccat

SEQ ID NO: 392760 - DNA, 140 bp, Artificial Sequence
  Synthetic
atggccgactcccaagtacgtgtgagatggatctgtcagcatagatgttaccactgcgacgtctggctcgggctcgcaggggagctgggaccccaccacaaaagtgttgaggcccactgtggagacccagcatggcgtat

SEQ ID NO: 392761 - DNA, 140 bp, Artificial Sequence
  Synthetic
  misc_feature (50)..(50): n is a, c, g, or t
aggccctggctgctgatatgaaacaaccagactacgaaccaccagtcgtncatggctgcgcactgcccccggacaaaccaacccctgttcctccccctaggaggaagcgggcagttgcacgaccttttgggacagcggtg

SEQ ID NO: 392762 - DNA, 140 bp, Artificial Sequence
  Synthetic
  misc_feature (91)..(91): n is a, c, g, or t
caccgctgtcccaaaaggtcgtgcaactgcccgcttcctcctagggggaggaacaggggttggtttgtccgggggcagtgcgcagccatgnacgactggtggttcgtagtctggttgtttcatatcagcagccagggcct

SEQ ID NO: 392763 - DNA, 140 bp, Artificial Sequence
  Synthetic
atacgccatgctgggtctccgactgagacttctgaaccagaccccatcattgcggatgacaaatcggatgacgagtcttactcgtcaatgcctccgcttgaaggggagcctggtgacccacgtacttgggagtcggccat

SEQ ID NO: 392764 - DNA, 140 bp, Artificial Sequence
  Synthetic
atggccgactcccaagtacgtgggtcaccaggctccccttcaagcggaggcattgacgagtaagactcgtcatccgatttgtcatccgcaatgatggggtctggttcagaagtctcagtcggagacccagcatggcgtat

SEQ ID NO: 392765 - DNA, 140 bp, Artificial Sequence
  Synthetic
atacgccatgctgggtctccgacctgacatcagactcttggtccaccgtcagcggatcggaggatgtagtgtgctgctcgatgtcctactcgtggacgggggcgcttgtcaccccctgcgcgtacttgggagtcggccat

SEQ ID NO: 392766 - DNA, 140 bp, Artificial Sequence
  Synthetic
atggccgactcccaagtacgcgcagggggtgacaagcgcccccgtccacgagtaggacatcgagcagcacactacatcctccgatccgctgacggtggaccaagagtctgatgtcaggtcggagacccagcatggcgtat

SEQ ID NO: 392767 - DNA, 140 bp, Artificial Sequence
  Synthetic
  misc_feature (120)..(120): n is a, c, g, or t
atacgccatgctgggtctccaccggagaagggcggcagaaaaccggctcgtctaatcgtatacccggacctgggggtgcgggtgtgcgagaagagggccctatatgacgccgtcaaacancgtacttgggagtcggccat

SEQ ID NO: 392768 - DNA, 140 bp, Artificial Sequence
  Synthetic
  misc_feature (21)..(21): n is a, c, g, or t
atggccgactcccaagtacgntgtttgacggcgtcatatagggccctcttctcgcacacccgcacccccaggtccgggtatacgattagacgagccggttttctgccgcccttctccggtggagacccagcatggcgtat

SEQ ID NO: 392769 - DNA, 140 bp, Artificial Sequence
  Synthetic
atacgccatgctgggtctcctggggttttcatatgacacccgctgctttgactccactgtaaccgaaaaggacatcagggtcgaggaggaggtctatcagtgttgtgacctagagcccgacgtacttgggagtcggccat

SEQ ID NO: 392770 - DNA, 140 bp, Artificial Sequence
  Synthetic
atggccgactcccaagtacgtcgggctctaggtcacaacactgatagacctcctcctcgaccctgatgtccttttcggttacagtggagtcaaagcagcgggtgtcatatgaaaaccccaggagacccagcatggcgtat

SEQ ID NO: 392771 - DNA, 140 bp, Artificial Sequence
  Synthetic
atacgccatgctgggtctccctgcgtggtcatagtgggcagggttgtcttgtccgggaagccggcaattatacctgacagggaagttctctaccgggagttcgatgagatggaagagtgccgtacttgggagtcggccat

SEQ ID NO: 392772 - DNA, 140 bp, Artificial Sequence
  Synthetic
atggccgactcccaagtacggcactcttccatctcatcgaactcccggtagagaacttccctgtcaggtataattgccggcttcccggacaagacaaccctgcccactatgaccacgcagggagacccagcatggcgtat

SEQ ID NO: 392773 - DNA, 140 bp, Artificial Sequence
  Synthetic
atacgccatgctgggtctccgacagctcgacacactccagtcaactcttggcttgggaacatcataatctacgcgcccaccatttgggtgcgcatggttttgatgacccacttcttctcacgtacttgggagtcggccat

SEQ ID NO: 392774 - DNA, 140 bp, Artificial Sequence
  Synthetic
atggccgactcccaagtacgtgagaagaagtgggtcatcaaaaccatgcgcacccaaatggtgggcgcgtagattatgatgttcccaagccaagagttgactggagtgtgtcgagctgtcggagacccagcatggcgtat

SEQ ID NO: 392775 - DNA, 140 bp, Artificial Sequence
  Synthetic
aggccctggctgctgatatgttgccgcgctgttctacgcgcacaagttcaactcgtccggatgcccggagcgcatgtccagctgccgctccattgacaagttcgatcaggggtggggtccgaccttttgggacagcggtg

SEQ ID NO: 392776 - DNA, 140 bp, Artificial Sequence
  Synthetic
caccgctgtcccaaaaggtcggaccccacccctgatcgaacttgtcaatggagcggcagctggacatgcgctccgggcatccggacgagttgaacttgtgcgcgtagaacagcgcggcaacatatcagcagccagggcct

SEQ ID NO: 392777 - DNA, 140 bp, Artificial Sequence
  Synthetic
aggccctggctgctgatatgagcaccccgaggccacttacaccaaatgcggttcggggccatggttgacacccaggtgcatagttgactacccatacaggctttggcactacccctgcacgaccttttgggacagcggtg

SEQ ID NO: 392778 - DNA, 140 bp, Artificial Sequence
  Synthetic
caccgctgtcccaaaaggtcgtgcaggggtagtgccaaagcctgtatgggtagtcaactatgcacctgggtgtcaaccatggccccgaaccgcatttggtgtaagtggcctcggggtgctcatatcagcagccagggcct

SEQ ID NO: 392779 - DNA, 140 bp, Artificial Sequence
  Synthetic
aggccctggctgctgatatgtcccaaaacatccagcttataaacaccaacggcagctggcacatcaacaggactgccctgaactgcaatgactccctcaacactgggttccttgccgcgcgaccttttgggacagcggtg

SEQ ID NO: 392780 - DNA, 140 bp, Artificial Sequence
  Synthetic
caccgctgtcccaaaaggtcgcgcggcaaggaacccagtgttgagggagtcattgcagttcagggcagtcctgttgatgtgccagctgccgttggtgtttataagctggatgttttgggacatatcagcagccagggcct

SEQ ID NO: 392781 - DNA, 140 bp, Artificial Sequence
  Synthetic
atacgccatgctgggtctcccgtcgccagggccctggcgcatggcgtcagggctgtggaggacgggattaattatgcaacgggaaaccttcctggttgctctttttctatcttccttctgcgtacttgggagtcggccat

SEQ ID NO: 392782 - DNA, 140 bp, Artificial Sequence
  Synthetic
atggccgactcccaagtacgcagaaggaagatagaaaaagagcaaccaggaaggtttcccgttgcataattaatcccgtcctccacagccctgacgccatgcgccagggccctggcgacgggagacccagcatggcgtat

SEQ ID NO: 392783 - DNA, 140 bp, Artificial Sequence
  Synthetic
  misc_feature (96)..(96): n is a, c, g, or t
atacgccatgctgggtctcccacttcgggcatctatcacatcaccaatgactgccctaactctagcatagtctttgaggcagaacatcacatcttncatcttccaggatgcgtcccctgtcgtacttgggagtcggccat

SEQ ID NO: 392784 - DNA, 140 bp, Artificial Sequence
  Synthetic
  misc_feature (45)..(45): n is a, c, g, or t
atggccgactcccaagtacgacaggggacgcatcctggaagatgnaagatgtgatgttctgcctcaaagactatgctagagttagggcagtcattggtgatgtgatagatgcccgaagtgggagacccagcatggcgtat

SEQ ID NO: 392785 - DNA, 140 bp, Artificial Sequence
  Synthetic
aggccctggctgctgatatgtgcttcaccccaagccctgttgtggtggggacgaccgatcgtttcggcgtccctacgtatagctggggggagaatgagacggacgtgctgcttctcaacagaccttttgggacagcggtg

SEQ ID NO: 392786 - DNA, 140 bp, Artificial Sequence
  Synthetic
caccgctgtcccaaaaggtctgttgagaagcagcacgtccgtctcattctccccccagctatacgtagggacgccgaaacgatcggtcgtccccaccacaacagggcttggggtgaagcacatatcagcagccagggcct

SEQ ID NO: 392787 - DNA, 140 bp, Artificial Sequence
  Synthetic
atacgccatgctgggtctccatttgatggtgggcactgccacactgtgctccgcactctacgttggagatctgtgcgggggcatattcctagtgggccagatgttcacctttcggccccgcgtacttgggagtcggccat

SEQ ID NO: 392788 - DNA, 140 bp, Artificial Sequence
  Synthetic
atggccgactcccaagtacgcggggccgaaaggtgaacatctggcccactaggaatatgcccccgcacagatctccaacgtagagtgcggagcacagtgtggcagtgcccaccatcaaatggagacccagcatggcgtat

SEQ ID NO: 392789 - DNA, 140 bp, Artificial Sequence
  Synthetic
aggccctggctgctgatatgtcacgggtcacagaatggcgtgggacatgatgatgaactggagccctaccaccgctctggtcctagcacaaatcatgagaatacccgccaccctggttgagaccttttgggacagcggtg

SEQ ID NO: 392790 - DNA, 140 bp, Artificial Sequence
  Synthetic
caccgctgtcccaaaaggtctcaaccagggtggcgggtattctcatgatttgtgctaggaccagagcggtggtagggctccagttcatcatcatgtcccacgccattctgtgacccgtgacatatcagcagccagggcct

SEQ ID NO: 392791 - DNA, 140 bp, Artificial Sequence
  Synthetic
atacgccatgctgggtctccggggtcgacgcgcacacgcacgtcaccggcggtaccattgcctctggtgctgccgggcttgctggcctgttcaacgcagggtctcggcagaacctccagccgtacttgggagtcggccat

SEQ ID NO: 392792 - DNA, 140 bp, Artificial Sequence
  Synthetic
atggccgactcccaagtacggctggaggttctgccgagaccctgcgttgaacaggccagcaagcccggcagcaccagaggcaatggtaccgccggtgacgtgcgtgtgcgcgtcgaccccggagacccagcatggcgtat

SEQ ID NO: 392793 - DNA, 140 bp, Artificial Sequence
  Synthetic
atacgccatgctgggtctccatctccatcggaacatcgtggacgtacaatacctgtacggtatagggtcagcggttgtctcctacgcaattaagtgggagtatgtcctgttgctcttcctcgtacttgggagtcggccat

SEQ ID NO: 392794 - DNA, 140 bp, Artificial Sequence
  Synthetic
atggccgactcccaagtacgaggaagagcaacaggacatactcccacttaattgcgtaggagacaaccgctgaccctataccgtacaggtattgtacgtccacgatgttccgatggagatggagacccagcatggcgtat

SEQ ID NO: 392795 - DNA, 140 bp, Artificial Sequence
  Synthetic
atacgccatgctgggtctccattcaacagctccgggtgtccagagaggctttccagctgtgcccgcctcacagatttcaatcaaggttggggcaagcttggggtcgctaacatcacgggccgtacttgggagtcggccat

SEQ ID NO: 392796 - DNA, 140 bp, Artificial Sequence
  Synthetic
atggccgactcccaagtacggcccgtgatgttagcgaccccaagcttgccccaaccttgattgaaatctgtgaggcgggcacagctggaaagcctctctggacacccggagctgttgaatggagacccagcatggcgtat

SEQ ID NO: 392797 - DNA, 140 bp, Artificial Sequence
  Synthetic
aggccctggctgctgatatgatggcgtatggccgctgctcctgctcctgctggcgttgccaccacgagcatacgccatggaccgggagatggctgcatcgtgcggaggcgcggttttcatgaccttttgggacagcggtg

SEQ ID NO: 392798 - DNA, 140 bp, Artificial Sequence
  Synthetic
caccgctgtcccaaaaggtcatgaaaaccgcgcctccgcacgatgcagccatctcccggtccatggcgtatgctcgtggtggcaacgccagcaggagcaggagcagcggccatacgccatcatatcagcagccagggcct

SEQ ID NO: 392799 - DNA, 140 bp, Artificial Sequence
  Synthetic
aggccctggctgctgatatgtacgccatggaccgggagatggctgcatcgtgcggaggcgcggttttcataggtctggcactcttgaccttgtcaccacactataaagtgttcctcgccagaccttttgggacagcggtg

SEQ ID NO: 392800 - DNA, 140 bp, Artificial Sequence
  Synthetic
caccgctgtcccaaaaggtctggcgaggaacactttatagtgtggtgacaaggtcaagagtgccagacctatgaaaaccgcgcctccgcacgatgcagccatctcccggtccatggcgtacatatcagcagccagggcct

SEQ ID NO: 392801 - DNA, 140 bp, Artificial Sequence
  Synthetic
atacgccatgctgggtctccagctggagttgtcccaccgactgcttcaggaaacacccagaaacaacctacaccaagtgtggttcaggtccttggctcacgccgcggtgcttggtccactcgtacttgggagtcggccat

SEQ ID NO: 392802 - DNA, 140 bp, Artificial Sequence
  Synthetic
atggccgactcccaagtacgagtggaccaagcaccgcggcgtgagccaaggacctgaaccacacttggtgtaggttgtttctgggtgtttcctgaagcagtcggtgggacaactccagctggagacccagcatggcgtat

SEQ ID NO: 392803 - DNA, 140 bp, Artificial Sequence
  Synthetic
atacgccatgctgggtctcccaattggaccaggggagaaccttgtggtttggagcacagggatcgctcagaactgtcgcccctgctcttatccaccactcagtggcaggtccttccctgccgtacttgggagtcggccat

SEQ ID NO: 392804 - DNA, 140 bp, Artificial Sequence
  Synthetic
atggccgactcccaagtacggcagggaaggacctgccactgagtggtggataagagcaggggcgacagttctgagcgatccctgtgctccaaaccacaaggttctcccctggtccaattgggagacccagcatggcgtat

SEQ ID NO: 392805 - DNA, 140 bp, Artificial Sequence
  Synthetic
aggccctggctgctgatatggtgcccccatcacgtattccacctatggcaagttccttgctgacggtggttgctctgggggcgcctatgacatcataatatgtgatgagtgccactcaacgaccttttgggacagcggtg

SEQ ID NO: 392806 - DNA, 140 bp, Artificial Sequence
  Synthetic
caccgctgtcccaaaaggtcgttgagtggcactcatcacatattatgatgtcataggcgcccccagagcaaccaccgtcagcaaggaacttgccataggtggaatacgtgatgggggcaccatatcagcagccagggcct

SEQ ID NO: 392807 - DNA, 140 bp, Artificial Sequence
  Synthetic
atacgccatgctgggtctcccttgggctctcaagtgggagtatgttgtgctggctttcctgctgctggcggacgccaggatctgtgcatgtctttggatgatgctgctggtgtcgcaggtcgtacttgggagtcggccat

SEQ ID NO: 392808 - DNA, 140 bp, Artificial Sequence
  Synthetic
atggccgactcccaagtacgacctgcgacaccagcagcatcatccaaagacatgcacagatcctggcgtccgccagcagcaggaaagccagcacaacatactcccacttgagagcccaagggagacccagcatggcgtat

SEQ ID NO: 392809 - DNA, 140 bp, Artificial Sequence
  Synthetic
  misc_feature (119)..(119): n is a, c, g, or t
atacgccatgctgggtctccataaaggggcgagtcccggctgcagccacgtacgcggcctgcggaatgtggcctttgctcctcctgctcctcgcgttgcctgaacgggcttacgcgcanacgtacttgggagtcggccat

SEQ ID NO: 392810 - DNA, 140 bp, Artificial Sequence
  Synthetic
  misc_feature (22)..(22): n is a, c, g, or t
atggccgactcccaagtacgtntgcgcgtaagcccgttcaggcaacgcgaggagcaggaggagcaaaggccacattccgcaggccgcgtacgtggctgcagccgggactcgcccctttatggagacccagcatggcgtat

SEQ ID NO: 392811 - DNA, 140 bp, Artificial Sequence
  Synthetic
atacgccatgctgggtctccgtggctgcaatacttcatagctagggcggaggccttactgcatgtttatgttccatcatttgagccacgtggccctcgggactctgtaatcatccttctgcgtacttgggagtcggccat

SEQ ID NO: 392812 - DNA, 140 bp, Artificial Sequence
  Synthetic
atggccgactcccaagtacgcagaaggatgattacagagtcccgagggccacgtggctcaaatgatggaacataaacatgcagtaaggcctccgccctagctatgaagtattgcagccacggagacccagcatggcgtat

SEQ ID NO: 392813 - DNA, 140 bp, Artificial Sequence
  Synthetic
atacgccatgctgggtctccacagtttcgctaatctcttttcattaggccccagccagaagatcgagctggttaacaccagcggcagctggcacatcaacagtacggccttgaactgcaacgtacttgggagtcggccat

SEQ ID NO: 392814 - DNA, 140 bp, Artificial Sequence
  Synthetic
atggccgactcccaagtacgttgcagttcaaggccgtactgttgatgtgccagctgccgctggtgttaaccagctcgatcttctggctggggcctaatgaaaagagattagcgaaactgtggagacccagcatggcgtat

SEQ ID NO: 392815 - DNA, 140 bp, Artificial Sequence
  Synthetic
aggccctggctgctgatatgggttgcgggcttacctaaatacaccagggttgcccgtctgccaggaccatctggagttctgggagagcgtcttcacaggcctcacccacatagatgcccagaccttttgggacagcggtg

SEQ ID NO: 392816 - DNA, 140 bp, Artificial Sequence
  Synthetic
caccgctgtcccaaaaggtctgggcatctatgtgggtgaggcctgtgaagacgctctcccagaactccagatggtcctggcagacgggcaaccctggtgtatttaggtaagcccgcaacccatatcagcagccagggcct

SEQ ID NO: 392817 - DNA, 140 bp, Artificial Sequence
  Synthetic
atacgccatgctgggtctcctgctcggcccggctgacgatgaggtgtcgggggggtggagactcctcgcccccattaccgcctatgcgcagcaaacccgaggcttgctcggcaccatcgtcgtacttgggagtcggccat

SEQ ID NO: 392818 - DNA, 140 bp, Artificial Sequence
  Synthetic
atggccgactcccaagtacgacgatggtgccgagcaagcctcgggtttgctgcgcataggcggtaatgggggcgaggagtctccacccccccgacacctcatcgtcagccgggccgagcaggagacccagcatggcgtat

SEQ ID NO: 392819 - DNA, 140 bp, Artificial Sequence
  Synthetic
aggccctggctgctgatatgtaccatcttgggcatcggcacagtcctggaccaagcggagacggctggagcgcgactcgtcgtactcgccaccgctacgcctccgggatcggtcaccgtggaccttttgggacagcggtg

SEQ ID NO: 392820 - DNA, 140 bp, Artificial Sequence
  Synthetic
caccgctgtcccaaaaggtccacggtgaccgatcccggaggcgtagcggtggcgagtacgacgagtcgcgctccagccgtctccgcttggtccaggactgtgccgatgcccaagatggtacatatcagcagccagggcct

SEQ ID NO: 392821 - DNA, 140 bp, Artificial Sequence
  Synthetic
aggccctggctgctgatatgatgtggactgtgtaccatggagcgggcagcaaaacccttagcggccccaaaggaccagtcaatcaaatgtacaccaatgttgatcaagacctagtgggatgaccttttgggacagcggtg

SEQ ID NO: 392822 - DNA, 140 bp, Artificial Sequence
  Synthetic
caccgctgtcccaaaaggtcatcccactaggtcttgatcaacattggtgtacatttgattgactggtcctttggggccgctaagggttttgctgcccgctccatggtacacagtccacatcatatcagcagccagggcct

SEQ ID NO: 392823 - DNA, 140 bp, Artificial Sequence
  Synthetic
  misc_feature (38)..(38): n is a, c, g, or t
atacgccatgctgggtctcctcggacttgtacctcgtnacaagacatgcagacgttgtgccagtacgtaggaggggggacacccggggcgcccttctgagccccaggccgatatccaccccgtacttgggagtcggccat

SEQ ID NO: 392824 - DNA, 140 bp, Artificial Sequence
  Synthetic
  misc_feature (103)..(103): n is a, c, g, or t
atggccgactcccaagtacggggtggatatcggcctggggctcagaagggcgccccgggtgtcccccctcctacgtactggcacaacgtctgcatgtcttgtnacgaggtacaagtccgaggagacccagcatggcgtat

SEQ ID NO: 392825 - DNA, 140 bp, Artificial Sequence
  Synthetic
aggccctggctgctgatatgcatcactaatggcattcacagcctctatcaccagcccgctcaccacccaacaaaccctcctgtttaacatcttggggggatggctggccgcccaactcgcgaccttttgggacagcggtg

SEQ ID NO: 392826 - DNA, 140 bp, Artificial Sequence
  Synthetic
caccgctgtcccaaaaggtcgcgagttgggcggccagccatccccccaagatgttaaacaggagggtttgttgggtggtgagcgggctggtgatagaggctgtgaatgccattagtgatgcatatcagcagccagggcct

SEQ ID NO: 392827 - DNA, 140 bp, Artificial Sequence
  Synthetic
aggccctggctgctgatatggtcacccagacagtcgacttcagcttggaccctaccttcaccattgagacgacgaccgtgccccaagacgcggtgtcgcgctcgcagcggcgaggcaggagaccttttgggacagcggtg

SEQ ID NO: 392828 - DNA, 140 bp, Artificial Sequence
  Synthetic
caccgctgtcccaaaaggtctcctgcctcgccgctgcgagcgcgacaccgcgtcttggggcacggtcgtcgtctcaatggtgaaggtagggtccaagctgaagtcgactgtctgggtgaccatatcagcagccagggcct

SEQ ID NO: 392829 - DNA, 140 bp, Artificial Sequence
  Synthetic
aggccctggctgctgatatgcgtgctcgcaaccgccacgccgccagggtctgtgacaactccccatcccaacatagaggaagtcgccctgccgacgacgggagagatacctttctatggcgaccttttgggacagcggtg

SEQ ID NO: 392830 - DNA, 140 bp, Artificial Sequence
  Synthetic
caccgctgtcccaaaaggtcgccatagaaaggtatctctcccgtcgtcggcagggcgacttcctctatgttgggatggggagttgtcacagaccctggcggcgtggcggttgcgagcacgcatatcagcagccagggcct

SEQ ID NO: 392831 - DNA, 140 bp, Artificial Sequence
  Synthetic
aggccctggctgctgatatgagacggcatcatgcagaccacctgcccatgtggagcacagatcaccggacatgtcaaaaacggttccatgaggatcgttgggcctaaaacctgcagcaacgaccttttgggacagcggtg

SEQ ID NO: 392832 - DNA, 140 bp, Artificial Sequence
  Synthetic
caccgctgtcccaaaaggtcgttgctgcaggttttaggcccaacgatcctcatggaaccgtttttgacatgtccggtgatctgtgctccacatgggcaggtggtctgcatgatgccgtctcatatcagcagccagggcct

SEQ ID NO: 392833 - DNA, 140 bp, Artificial Sequence
  Synthetic
atacgccatgctgggtctccgactcaatgcagtggcctattacagggggttagacgtgtcagtaataccgacgtctggagacgtcgtggtatgcgcgaccgacgccctcatgactggctacgtacttgggagtcggccat

SEQ ID NO: 392834 - DNA, 140 bp, Artificial Sequence
  Synthetic
atggccgactcccaagtacgtagccagtcatgagggcgtcggtcgcgcataccacgacgtctccagacgtcggtattactgacacgtctaaccccctgtaataggccactgcattgagtcggagacccagcatggcgtat

SEQ ID NO: 392835 - DNA, 140 bp, Artificial Sequence
  Synthetic
aggccctggctgctgatatgacgtctggagacgtcgtggtatgcgcgaccgacgccctcatgactggctacactggtgattttgactcggtgatagactgcaacacgtctgtcatacagagaccttttgggacagcggtg

SEQ ID NO: 392836 - DNA, 140 bp, Artificial Sequence
  Synthetic
caccgctgtcccaaaaggtctctgtatgacagacgtgttgcagtctatcaccgagtcaaaatcaccagtgtagccagtcatgagggcgtcggtcgcgcataccacgacgtctccagacgtcatatcagcagccagggcct

SEQ ID NO: 392837 - DNA, 140 bp, Artificial Sequence
  Synthetic
aggccctggctgctgatatgctgttgatttcagtttggaccccaccttctcaatagagaccacaaccgtccctcaggacgcggtttcccgctctcagcggagaggccgcaccggtagggggaccttttgggacagcggtg

SEQ ID NO: 392838 - DNA, 140 bp, Artificial Sequence
  Synthetic
caccgctgtcccaaaaggtccccctaccggtgcggcctctccgctgagagcgggaaaccgcgtcctgagggacggttgtggtctctattgagaaggtggggtccaaactgaaatcaacagcatatcagcagccagggcct

SEQ ID NO: 392839 - DNA, 140 bp, Artificial Sequence
  Synthetic
atacgccatgctgggtctcctatgaattaacaccggctgagacgacaaccaggttgagagcctacttcaacacgccaggcctccccgtctgccaagaccatcttgagttctgggaaagtgcgtacttgggagtcggccat

SEQ ID NO: 392840 - DNA, 140 bp, Artificial Sequence
  Synthetic
atggccgactcccaagtacgcactttcccagaactcaagatggtcttggcagacggggaggcctggcgtgttgaagtaggctctcaacctggttgtcgtctcagccggtgttaattcataggagacccagcatggcgtat

SEQ ID NO: 392841 - DNA, 140 bp, Artificial Sequence
  Synthetic
atacgccatgctgggtctcccgcgagagcgctcgcgcccccgcccagctgggacaccatgtggaaatgcctgattcgcctcaagcccacactgcatgggcccacccccctcctttacaggcgtacttgggagtcggccat

SEQ ID NO: 392842 - DNA, 140 bp, Artificial Sequence
  Synthetic
atggccgactcccaagtacgcctgtaaaggaggggggtgggcccatgcagtgtgggcttgaggcgaatcaggcatttccacatggtgtcccagctgggcgggggcgcgagcgctctcgcgggagacccagcatggcgtat

SEQ ID NO: 392843 - DNA, 140 bp, Artificial Sequence
  Synthetic
  misc_feature (48)..(48): n is a, c, g, or t
atacgccatgctgggtctcccatcatggcctgtatgtcagcagacctngaagtggtgaccagcacatgggtcatagtaggtggcgtcctggcagccgtggccgcttactgcttgacagtgcgtacttgggagtcggccat

SEQ ID NO: 392844 - DNA, 140 bp, Artificial Sequence
  Synthetic
  misc_feature (93)..(93): n is a, c, g, or t
atggccgactcccaagtacgcactgtcaagcagtaagcggccacggctgccaggacgccacctactatgacccatgtgctggtcaccacttcnaggtctgctgacatacaggccatgatgggagacccagcatggcgtat

SEQ ID NO: 392845 - DNA, 140 bp, Artificial Sequence
  Synthetic
atacgccatgctgggtctccgggcaaaacacatgtggaacttcattagcggtatccaatatcttgctgggttatccaccttacccggcaaccccgctatagcttccctaatgtccttcaccgtacttgggagtcggccat

SEQ ID NO: 392846 - DNA, 140 bp, Artificial Sequence
  Synthetic
atggccgactcccaagtacggtgaaggacattagggaagctatagcggggttgccgggtaaggtggataacccagcaagatattggataccgctaatgaagttccacatgtgttttgcccggagacccagcatggcgtat

SEQ ID NO: 392847 - DNA, 140 bp, Artificial Sequence
  Synthetic
aggccctggctgctgatatgttatccaccttacccggcaaccccgctatagcttccctaatgtccttcaccgccgctgttaccagcccattaaccacccaacaaacccttcttttcaacagaccttttgggacagcggtg

SEQ ID NO: 392848 - DNA, 140 bp, Artificial Sequence
  Synthetic
caccgctgtcccaaaaggtctgttgaaaagaagggtttgttgggtggttaatgggctggtaacagcggcggtgaaggacattagggaagctatagcggggttgccgggtaaggtggataacatatcagcagccagggcct

SEQ ID NO: 392849 - DNA, 140 bp, Artificial Sequence
  Synthetic
atacgccatgctgggtctccgggaaaggtcctggtcgacattctcgccggctacggcgccggcgtagcgggcgctgtggtcactttcaagatcatgagtggcgagatgccgtcaacagagcgtacttgggagtcggccat

SEQ ID NO: 392850 - DNA, 140 bp, Artificial Sequence
  Synthetic
atggccgactcccaagtacgctctgttgacggcatctcgccactcatgatcttgaaagtgaccacagcgcccgctacgccggcgccgtagccggcgagaatgtcgaccaggacctttcccggagacccagcatggcgtat

SEQ ID NO: 392851 - DNA, 140 bp, Artificial Sequence
  Synthetic
aggccctggctgctgatatggcgctgtggtcactttcaagatcatgagtggcgagatgccgtcaacagaggacttggtaaacctgctcccggccatactatcgccgggcgctctggtggtgaccttttgggacagcggtg

SEQ ID NO: 392852 - DNA, 140 bp, Artificial Sequence
  Synthetic
caccgctgtcccaaaaggtcaccaccagagcgcccggcgatagtatggccgggagcaggtttaccaagtcctctgttgacggcatctcgccactcatgatcttgaaagtgaccacagcgccatatcagcagccagggcct

SEQ ID NO: 392853 - DNA, 140 bp, Artificial Sequence
  Synthetic
  misc_feature (54)..(54): n is a, c, g, or t
aggccctggctgctgatatggggggtagtgtgcgccgcaatcctgcgacgtcangtaggcccgggcgagggggccgtgcagtggatgaaccgtctcattgctttcgcatcgcgaggcaatgaccttttgggacagcggtg

SEQ ID NO: 392854 - DNA, 140 bp, Artificial Sequence
  Synthetic
  misc_feature (87)..(87): n is a, c, g, or t
caccgctgtcccaaaaggtcattgcctcgcgatgcgaaagcaatgagacggttcatccactgcacggccccctcgcccgggcctacntgacgtcgcaggattgcggcgcacactaccccccatatcagcagccagggcct

SEQ ID NO: 392855 - DNA, 140 bp, Artificial Sequence
  Synthetic
  misc_feature (100)..(100): n is a, c, g, or t
  misc_feature (106)..(106): n is a, c, g, or t
atacgccatgctgggtctccataagtggatcaatgaagactgccctactccatgtgactcatcgtggctatgggagatctgggactgggtctgcaccgtnttgtcngactttaagcattgcgtacttgggagtcggccat

SEQ ID NO: 392856 - DNA, 140 bp, Artificial Sequence
  Synthetic
  misc_feature (35)..(35): n is a, c, g, or t
  misc_feature (41)..(41): n is a, c, g, or t
atggccgactcccaagtacgcaatgcttaaagtcngacaanacggtgcagacccagtcccagatctcccatagccacgatgagtcacatggagtagggcagtcttcattgatccacttatggagacccagcatggcgtat

SEQ ID NO: 392857 - DNA, 140 bp, Artificial Sequence
  Synthetic
  misc_feature (34)..(34): n is a, c, g, or t
atacgccatgctgggtctccgtcaaaagggatanaagggggagtggcggggggacggggtaatgcataccatctgcccttgcggtgcggagctcgccggccacatcaaaaacggttcaatcgtacttgggagtcggccat

SEQ ID NO: 392858 - DNA, 140 bp, Artificial Sequence
  Synthetic
  misc_feature (107)..(107): n is a, c, g, or t
atggccgactcccaagtacgattgaaccgtttttgatgtggccggcgagctccgcaccgcaagggcagatggtatgcattaccccgtccccccgccactcccccttntatcccttttgacggagacccagcatggcgtat

SEQ ID NO: 392859 - DNA, 140 bp, Artificial Sequence
  Synthetic
  misc_feature (117)..(117): n is a, c, g, or t
aggccctggctgctgatatgcagagtgggtgatttccattacatcactggcgtgacacaagataacatcaagtgtccatgtcaggttcctgcccccgagttcttcactgaggtgganggtgaccttttgggacagcggtg

SEQ ID NO: 392860 - DNA, 140 bp, Artificial Sequence
  Synthetic
  misc_feature (24)..(24): n is a, c, g, or t
caccgctgtcccaaaaggtcaccntccacctcagtgaagaactcgggggcaggaacctgacatggacacttgatgttatcttgtgtcacgccagtgatgtaatggaaatcacccactctgcatatcagcagccagggcct

SEQ ID NO: 392861 - DNA, 140 bp, Artificial Sequence
  Synthetic
  misc_feature (32)..(32): n is a, c, g, or t
atacgccatgctgggtctccgtcaggcttcancgccatgcgcccgcctgcaagcccttgctgacggaagacgtcacgttctccgtgggcctcaactcgttcgtggtaggatcccaactcccgtacttgggagtcggccat

SEQ ID NO: 392862 - DNA, 140 bp, Artificial Sequence
  Synthetic
  misc_feature (109)..(109): n is a, c, g, or t
atggccgactcccaagtacgggagttgggatcctaccacgaacgagttgaggcccacggagaacgtgacgtcttccgtcagcaagggcttgcaggcgggcgcatggcgntgaagcctgacggagacccagcatggcgtat

SEQ ID NO: 392863 - DNA, 140 bp, Artificial Sequence
  Synthetic
aggccctggctgctgatatgtgaaagccacatgtactgcccaccacagttcccctggccaggacctcatcgaagccaatcttttatggggtgccaatgccaccagggttgagctgggtgagaccttttgggacagcggtg

SEQ ID NO: 392864 - DNA, 140 bp, Artificial Sequence
  Synthetic
caccgctgtcccaaaaggtctcacccagctcaaccctggtggcattggcaccccataaaagattggcttcgatgaggtcctggccaggggaactgtggtgggcagtacatgtggctttcacatatcagcagccagggcct

SEQ ID NO: 392865 - DNA, 140 bp, Artificial Sequence
  Synthetic
atacgccatgctgggtctccaggaggtctccatcgcagcagagatcttgcgccccgtcaaaaggttcccgccggccataccaatctgggcccggccagattacaacccacctctggttgacgtacttgggagtcggccat

SEQ ID NO: 392866 - DNA, 140 bp, Artificial Sequence
  Synthetic
atggccgactcccaagtacgtcaaccagaggtgggttgtaatctggccgggcccagattggtatggccggcgggaaccttttgacggggcgcaagatctctgctgcgatggagacctcctggagacccagcatggcgtat

SEQ ID NO: 392867 - DNA, 140 bp, Artificial Sequence
  Synthetic
atacgccatgctgggtctcctacctcctagtaatcagcctccagttcctccccctagaaggaagaagaagacggtcgtgctctccgagtccaccgtttcagaagccttggcggatctggccgtacttgggagtcggccat

SEQ ID NO: 392868 - DNA, 140 bp, Artificial Sequence
  Synthetic
atggccgactcccaagtacggccagatccgccaaggcttctgaaacggtggactcggagagcacgaccgtcttcttcttccttctagggggaggaactggaggctgattactaggaggtaggagacccagcatggcgtat

SEQ ID NO: 392869 - DNA, 140 bp, Artificial Sequence
  Synthetic
aggccctggctgctgatatgagaactgcggttatcgccggtgccgcgcgagcggcgtgctgacgaccagctgcggtaataccctcacatgttacttgaaggcctctgcagcctgtcgagcgaccttttgggacagcggtg

SEQ ID NO: 392870 - DNA, 140 bp, Artificial Sequence
  Synthetic
caccgctgtcccaaaaggtcgctcgacaggctgcagaggccttcaagtaacatgtgagggtattaccgcagctggtcgtcagcacgccgctcgcgcggcaccggcgataaccgcagttctcatatcagcagccagggcct

SEQ ID NO: 392871 - DNA, 140 bp, Artificial Sequence
  Synthetic
atacgccatgctgggtctccattccgccaaatccaagtttggctatggggcaaaggacgttcgcagccactcccgcaaggccattaaccacatcaactccgtgtgggaggacttgctggacgtacttgggagtcggccat

SEQ ID NO: 392872 - DNA, 140 bp, Artificial Sequence
  Synthetic
atggccgactcccaagtacgtccagcaagtcctcccacacggagttgatgtggttaatggccttgcgggagtggctgcgaacgtcctttgccccatagccaaacttggatttggcggaatggagacccagcatggcgtat

SEQ ID NO: 392873 - DNA, 140 bp, Artificial Sequence
  Synthetic
atacgccatgctgggtctccactccccagcacagcgagtcgagtatctcttgaaagcgtgggcatcaaaaaaggttcccatgggtttctcctatgacactcgctgttttgactccacagtcgtacttgggagtcggccat

SEQ ID NO: 392874 - DNA, 140 bp, Artificial Sequence
  Synthetic
atggccgactcccaagtacgactgtggagtcaaaacagcgagtgtcataggagaaacccatgggaaccttttttgatgcccacgctttcaagagatactcgactcgctgtgctggggagtggagacccagcatggcgtat

SEQ ID NO: 392875 - DNA, 140 bp, Artificial Sequence
  Synthetic
atacgccatgctgggtctccgactgaaagagacatcagggtcgaggaagaggtctaccagtgttgtgacctggagcccgaaacccgcaaggcaatatccgccctcactgagagactctaccgtacttgggagtcggccat

SEQ ID NO: 392876 - DNA, 140 bp, Artificial Sequence
  Synthetic
atggccgactcccaagtacggtagagtctctcagtgagggcggatattgccttgcgggtttcgggctccaggtcacaacactggtagacctcttcctcgaccctgatgtctctttcagtcggagacccagcatggcgtat

SEQ ID NO: 392877 - DNA, 140 bp, Artificial Sequence
  Synthetic
atacgccatgctgggtctccgtgggcggtcccatgtataacagcaggggagacctgtgcgggtaccgtagatgccgcgcgagcggcgtctacactacgagcttcgggaacacactgacgtcgtacttgggagtcggccat

SEQ ID NO: 392878 - DNA, 140 bp, Artificial Sequence
  Synthetic
atggccgactcccaagtacgacgtcagtgtgttcccgaagctcgtagtgtagacgccgctcgcgcggcatctacggtacccgcacaggtctcccctgctgttatacatgggaccgcccacggagacccagcatggcgtat

SEQ ID NO: 392879 - DNA, 140 bp, Artificial Sequence
  Synthetic
aggccctggctgctgatatgtgtcgacgaggaccgccgagccctcggagctttcacggaagctatgacgaggtattcggctccccccggagacctaccgcaaccggcatatgacctagaggaccttttgggacagcggtg

SEQ ID NO: 392880 - DNA, 140 bp, Artificial Sequence
  Synthetic
caccgctgtcccaaaaggtcctctaggtcatatgccggttgcggtaggtctccggggggagccgaatacctcgtcatagcttccgtgaaagctccgagggctcggcggtcctcgtcgacacatatcagcagccagggcct

SEQ ID NO: 392881 - DNA, 140 bp, Artificial Sequence
  Synthetic
aggccctggctgctgatatgaacatccagcttataaataccaacggcagctggcacgtcaacaggactgccctgaactgcaatgactccctccagactgggttcattgccgcgctgttctgaccttttgggacagcggtg

SEQ ID NO: 392882 - DNA, 140 bp, Artificial Sequence
  Synthetic
caccgctgtcccaaaaggtcagaacagcgcggcaatgaacccagtctggagggagtcattgcagttcagggcagtcctgttgacgtgccagctgccgttggtatttataagctggatgttcatatcagcagccagggcct

SEQ ID NO: 392883 - DNA, 140 bp, Artificial Sequence
  Synthetic
aggccctggctgctgatatgcctgaactgcaatgactccctccagactgggttcattgccgcgctgttctactaccacaagttcaactcgtctggatgcgcagagcgtatggccagctgcgaccttttgggacagcggtg

SEQ ID NO: 392884 - DNA, 140 bp, Artificial Sequence
  Synthetic
caccgctgtcccaaaaggtcgcagctggccatacgctctgcgcatccagacgagttgaacttgtggtagtagaacagcgcggcaatgaacccagtctggagggagtcattgcagttcaggcatatcagcagccagggcct

SEQ ID NO: 392885 - DNA, 140 bp, Artificial Sequence
  Synthetic
aggccctggctgctgatatgacaggacgttaagttcccgggtggcggtcagatcgttggtggagtttacttgttgccgcgcaggggccctagattgggtgtgcgcgcgacgaggaagactgaccttttgggacagcggtg

SEQ ID NO: 392886 - DNA, 140 bp, Artificial Sequence
  Synthetic
caccgctgtcccaaaaggtcagtcttcctcgtcgcgcgcacacccaatctagggcccctgcgcggcaacaagtaaactccaccaacgatctgaccgccacccgggaacttaacgtcctgtcatatcagcagccagggcct

SEQ ID NO: 392887 - DNA, 140 bp, Artificial Sequence
  Synthetic
aggccctggctgctgatatggtacatcaagggcaagctggtccccggggcagcatatgctttctatggcgtatggccgctgctcctgctcctgctggcattaccaccacgagcatacgccgaccttttgggacagcggtg

SEQ ID NO: 392888 - DNA, 140 bp, Artificial Sequence
  Synthetic
caccgctgtcccaaaaggtcggcgtatgctcgtggtggtaatgccagcaggagcaggagcagcggccatacgccatagaaagcatatgctgccccggggaccagcttgcccttgatgtaccatatcagcagccagggcct

SEQ ID NO: 392889 - DNA, 140 bp, Artificial Sequence
  Synthetic
atacgccatgctgggtctcctgggcaggatggctcctgtccccccgcggctctcggccgtcttggggcccaaatgatccccggcggaggtcccgcaatttgggtaaggtcatcgataccccgtacttgggagtcggccat

SEQ ID NO: 392890 - DNA, 140 bp, Artificial Sequence
  Synthetic
atggccgactcccaagtacggggtatcgatgaccttacccaaattgcgggacctccgccggggatcatttgggccccaagacggccgagagccgcggggggacaggagccatcctgcccaggagacccagcatggcgtat

SEQ ID NO: 392891 - DNA, 140 bp, Artificial Sequence
  Synthetic
atacgccatgctgggtctccagcgcatggccagctgccgctccatcgaccagttcgatcaggggtggggtcccatcacttacgctgagccgggcagctcggaccagaggccttattgctgcgtacttgggagtcggccat

SEQ ID NO: 392892 - DNA, 140 bp, Artificial Sequence
  Synthetic
atggccgactcccaagtacgcagcaataaggcctctggtccgagctgcccggctcagcgtaagtgatgggaccccacccctgatcgaactggtcgatggagcggcagctggccatgcgctggagacccagcatggcgtat

SEQ ID NO: 392893 - DNA, 140 bp, Artificial Sequence
  Synthetic
aggccctggctgctgatatgtcttccttctggcacttctctcgtgcttgactgttcccgcctcggctgtgcattatcacaacacatcgggcgtctatcacatcaccaacgactgccctaagaccttttgggacagcggtg

SEQ ID NO: 392894 - DNA, 140 bp, Artificial Sequence
  Synthetic
caccgctgtcccaaaaggtcttagggcagtcgttggtgatgtgatagacgcccgatgtgttgtgataatgcacagccgaggcgggaacagtcaagcacgagagaagtgccagaaggaagacatatcagcagccagggcct

SEQ ID NO: 392895 - DNA, 140 bp, Artificial Sequence
  Synthetic
atacgccatgctgggtctccacccccacgttagccgcgccatacgttggcgctccacttgagtccatgcggcgtcatgtggatttgatggtgggcactgccacactgtgctccgcgctttcgtacttgggagtcggccat

SEQ ID NO: 392896 - DNA, 140 bp, Artificial Sequence
  Synthetic
atggccgactcccaagtacgaaagcgcggagcacagtgtggcagtgcccaccatcaaatccacatgacgccgcatggactcaagtggagcgccaacgtatggcgcggctaacgtgggggtggagacccagcatggcgtat

SEQ ID NO: 392897 - DNA, 140 bp, Artificial Sequence
  Synthetic
atacgccatgctgggtctccgcggggatatcatcttgggcctgcccgtctccgcccgcagggggagggagatacttctgggaccggcagatagtcttgaggggcaggggtggcgactcctcgtacttgggagtcggccat

SEQ ID NO: 392898 - DNA, 140 bp, Artificial Sequence
  Synthetic
atggccgactcccaagtacgaggagtcgccacccctgcccctcaagactatctgccggtcccagaagtatctccctccccctgcgggcggagacgggcaggcccaagatgatatccccgcggagacccagcatggcgtat

SEQ ID NO: 392899 - DNA, 140 bp, Artificial Sequence
  Synthetic
atacgccatgctgggtctccctctggccacatcacgggtcatagaatggcgtgggacatgatgatgaactggagccctaccaccgctctggttctggcacaaatcatgagggtgcccacccgtacttgggagtcggccat

SEQ ID NO: 392900 - DNA, 140 bp, Artificial Sequence
  Synthetic
atggccgactcccaagtacgggtgggcaccctcatgatttgtgccagaaccagagcggtggtagggctccagttcatcatcatgtcccacgccattctatgacccgtgatgtggccagagggagacccagcatggcgtat

SEQ ID NO: 392901 - DNA, 140 bp, Artificial Sequence
  Synthetic
atacgccatgctgggtctcctcgtcttcgccggggtcgacgcaagtacgcacatcactggtagtgttgctggctccggtgcctccgggctcgctagtatcttcaacccagggtcccggcacgtacttgggagtcggccat

SEQ ID NO: 392902 - DNA, 140 bp, Artificial Sequence
  Synthetic
atggccgactcccaagtacgtgccgggaccctgggttgaagatactagcgagcccggaggcaccggagccagcaacactaccagtgatgtgcgtacttgcgtcgaccccggcgaagacgaggagacccagcatggcgtat

SEQ ID NO: 392903 - DNA, 140 bp, Artificial Sequence
  Synthetic
atacgccatgctgggtctcctacaggagtaagttcaacagctccgggtgcccggagaggctttccagctgtaaacgcctcgacgcgttccagcaaggttggggcaagcttggggtcgccacgtacttgggagtcggccat

SEQ ID NO: 392904 - DNA, 140 bp, Artificial Sequence
  Synthetic
atggccgactcccaagtacgtggcgaccccaagcttgccccaaccttgctggaacgcgtcgaggcgtttacagctggaaagcctctccgggcacccggagctgttgaacttactcctgtaggagacccagcatggcgtat

SEQ ID NO: 392905 - DNA, 140 bp, Artificial Sequence
  Synthetic
aggccctggctgctgatatgtggactttgtacccgttgagtctatggaaactactatgcggtccccggtcttcacggacaactcgtcccccccggccgtaccgcagacattccaagtggcgaccttttgggacagcggtg

SEQ ID NO: 392906 - DNA, 140 bp, Artificial Sequence
  Synthetic
caccgctgtcccaaaaggtcgccacttggaatgtctgcggtacggccgggggggacgagttgtccgtgaagaccggggaccgcatagtagtttccatagactcaacgggtacaaagtccacatatcagcagccagggcct

SEQ ID NO: 392907 - DNA, 140 bp, Artificial Sequence
  Synthetic
atacgccatgctgggtctcctttcacgccgagccctgtagtggtaggcaccaccgacagacttggcgcccccacgtacacctggggggcgaacgaaacggacgtcatcatccttaactcgcgtacttgggagtcggccat

SEQ ID NO: 392908 - DNA, 140 bp, Artificial Sequence
  Synthetic
atggccgactcccaagtacgcgagttaaggatgatgacgtccgtttcgttcgccccccaggtgtacgtgggggcgccaagtctgtcggtggtgcctaccactacagggctcggcgtgaaaggagacccagcatggcgtat

SEQ ID NO: 392909 - DNA, 140 bp, Artificial Sequence
  Synthetic
aggccctggctgctgatatgaggtctggtactcttgaccttgtcaccatactataaggtgttcctcgctaggctcatatggtggttacaatattttatcaccagagccgaggcgcacttggaccttttgggacagcggtg

SEQ ID NO: 392910 - DNA, 140 bp, Artificial Sequence
  Synthetic
caccgctgtcccaaaaggtccaagtgcgcctcggctctggtgataaaatattgtaaccaccatatgagcctagcgaggaacaccttatagtatggtgacaaggtcaagagtaccagacctcatatcagcagccagggcct

SEQ ID NO: 392911 - DNA, 140 bp, Artificial Sequence
  Synthetic
aggccctggctgctgatatgggatcgcgcagaactgtcacccttgctcttatccaccactcaatggcaggtccttccctgctcctttacaccccttcctgccctgtccactggcctgatcgaccttttgggacagcggtg

SEQ ID NO: 392912 - DNA, 140 bp, Artificial Sequence
  Synthetic
caccgctgtcccaaaaggtcgatcaggccagtggacagggcaggaaggggtgtaaaggagcagggaaggacctgccattgagtggtggataagagcaagggtgacagttctgcgcgatcccatatcagcagccagggcct

SEQ ID NO: 392913 - DNA, 140 bp, Artificial Sequence
  Synthetic
atacgccatgctgggtctccgtcgatgcgaccacctacaccaccggggggggtgctgctcaggccacgtctcaattcaccagattcttccttccgggccccaagcagaacatccagctggcgtacttgggagtcggccat

SEQ ID NO: 392914 - DNA, 140 bp, Artificial Sequence
  Synthetic
atggccgactcccaagtacgccagctggatgttctgcttggggcccggaaggaagaatctggtgaattgagacgtggcctgagcagcaccccccccggtggtgtaggtggtcgcatcgacggagacccagcatggcgtat

SEQ ID NO: 392915 - DNA, 140 bp, Artificial Sequence
  Synthetic
atacgccatgctgggtctcctgctgctggcagacgccagggtttgtgcatgtctttggatgatgttgctagtgtcgcaggtagaagcagccatggctaacttgattaccatcaatgctaccgtacttgggagtcggccat

SEQ ID NO: 392916 - DNA, 140 bp, Artificial Sequence
  Synthetic
atggccgactcccaagtacggtagcattgatggtaatcaagttagccatggctgcttctacctgcgacactagcaacatcatccaaagacatgcacaaaccctggcgtctgccagcagcaggagacccagcatggcgtat

SEQ ID NO: 392917 - DNA, 140 bp, Artificial Sequence
  Synthetic
  misc_feature (57)..(57): n is a, c, g, or t
atacgccatgctgggtctcctgcggaatgtggcccctgctcctcctgctcctcgcgntgcccgaacgggcttacgcgtatgaccaggaagtagcggcggcccttggcggaggcgtagtgccgtacttgggagtcggccat

SEQ ID NO: 392918 - DNA, 140 bp, Artificial Sequence
  Synthetic
  misc_feature (84)..(84): n is a, c, g, or t
atggccgactcccaagtacggcactacgcctccgccaagggccgccgctacttcctggtcatacgcgtaagcccgttcgggcancgcgaggagcaggaggagcaggggccacattccgcaggagacccagcatggcgtat

SEQ ID NO: 392919 - DNA, 140 bp, Artificial Sequence
  Synthetic
aggccctggctgctgatatggtcctcaacgcggcctctgcagctagctgccagggcatactttgggggttggctttcatctgctgcgcatggcacgtacgcgggcgggttgtccccctcggaccttttgggacagcggtg

SEQ ID NO: 392920 - DNA, 140 bp, Artificial Sequence
  Synthetic
caccgctgtcccaaaaggtccgagggggacaacccgcccgcgtacgtgccatgcgcagcagatgaaagccaacccccaaagtatgccctggcagctagctgcagaggccgcgttgaggaccatatcagcagccagggcct

SEQ ID NO: 392921 - DNA, 140 bp, Artificial Sequence
  Synthetic
aggccctggctgctgatatgtgtgcgccagggctcaggctccacctccatcgtgggaccaaatgtggaagtgtctcatacggctaaagcctacgctgcacgggccaacacccctgctgtagaccttttgggacagcggtg

SEQ ID NO: 392922 - DNA, 140 bp, Artificial Sequence
  Synthetic
caccgctgtcccaaaaggtctacagcaggggtgttggcccgtgcagcgtaggctttagccgtatgagacacttccacatttggtcccacgatggaggtggagcctgagccctggcgcacacatatcagcagccagggcct

SEQ ID NO: 392923 - DNA, 140 bp, Artificial Sequence
  Synthetic
aggccctggctgctgatatgaggcggtggacttcatacccgttgagtctatggaaactaccatgcggtctccggtcttcacagacaactcatcccctccggccgtaccgcaaacattccagaccttttgggacagcggtg

SEQ ID NO: 392924 - DNA, 140 bp, Artificial Sequence
  Synthetic
caccgctgtcccaaaaggtctggaatgtttgcggtacggccggaggggatgagttgtctgtgaagaccggagaccgcatggtagtttccatagactcaacgggtatgaagtccaccgcctcatatcagcagccagggcct

SEQ ID NO: 392925 - DNA, 140 bp, Artificial Sequence
  Synthetic
aggccctggctgctgatatgcttgccaaaggcagaagaaagtcacatttgacagactgcaggttctggacaaccactaccaggacgtgctcaaggaggttaaggcagcggcgtcaaaagtgaccttttgggacagcggtg

SEQ ID NO: 392926 - DNA, 140 bp, Artificial Sequence
  Synthetic
caccgctgtcccaaaaggtcacttttgacgccgctgccttaacctccttgagcacgtcctggtagtggttgtccagaacctgcagtctgtcaaatgtgactttcttctgcctttggcaagcatatcagcagccagggcct

SEQ ID NO: 392927 - DNA, 140 bp, Artificial Sequence
  Synthetic
aggccctggctgctgatatgagcggccccaaaggaccagtcaaccaaatgtacaccaatgttgatcaagacctagtgggatggccagcacctcctggggtcaggtctcttgtgccgtgtagaccttttgggacagcggtg

SEQ ID NO: 392928 - DNA, 140 bp, Artificial Sequence
  Synthetic
caccgctgtcccaaaaggtctacacggcacaagagacctgaccccaggaggtgctggccatcccactaggtcttgatcaacattggtgtacatttggttgactggtcctttggggccgctcatatcagcagccagggcct

SEQ ID NO: 392929 - DNA, 140 bp, Artificial Sequence
  Synthetic
atacgccatgctgggtctcccttgcggtgcgtctgacctgtacctcgttacgaggcatgcagacgtcgtgcctgtacgtaggaggggagacaccaggggcgcccttttgagccctagacccgtacttgggagtcggccat

SEQ ID NO: 392930 - DNA, 140 bp, Artificial Sequence
  Synthetic
atggccgactcccaagtacgggtctagggctcaaaagggcgcccctggtgtctcccctcctacgtacaggcacgacgtctgcatgcctcgtaacgaggtacaggtcagacgcaccgcaagggagacccagcatggcgtat

SEQ ID NO: 392931 - DNA, 140 bp, Artificial Sequence
  Synthetic
atacgccatgctgggtctcccacccggccttggtatttgacatcaccaagctgctgctggccgtcttcggacccctttggattcttcaaaccagtctgctcaaagtgccctacttcgtgccgtacttgggagtcggccat

SEQ ID NO: 392932 - DNA, 140 bp, Artificial Sequence
  Synthetic
atggccgactcccaagtacggcacgaagtagggcactttgagcagactggtttgaagaatccaaaggggtccgaagacggccagcagcagcttggtgatgtcaaataccaaggccgggtgggagacccagcatggcgtat

SEQ ID NO: 392933 - DNA, 140 bp, Artificial Sequence
  Synthetic
aggccctggctgctgatatgtcgacccaaacatacggtcgggtgtcagaaccatctcaacaggcgcgcctatcacatactccacctatgggaagttcctagcggatggaggatgctcagggaccttttgggacagcggtg

SEQ ID NO: 392934 - DNA, 140 bp, Artificial Sequence
  Synthetic
caccgctgtcccaaaaggtccctgagcatcctccatccgctaggaacttcccataggtggagtatgtgataggcgcgcctgttgagatggttctgacacccgaccgtatgtttgggtcgacatatcagcagccagggcct

SEQ ID NO: 392935 - DNA, 140 bp, Artificial Sequence
  Synthetic
atacgccatgctgggtctccatcacatactccacctatgggaagttcctagcggatggaggatgctcaggaggagcgtacgacatcatcatttgtgatgagtgccattccactgattccacgtacttgggagtcggccat

SEQ ID NO: 392936 - DNA, 140 bp, Artificial Sequence
  Synthetic
atggccgactcccaagtacgtggaatcagtggaatggcactcatcacaaatgatgatgtcgtacgctcctcctgagcatcctccatccgctaggaacttcccataggtggagtatgtgatggagacccagcatggcgtat

SEQ ID NO: 392937 - DNA, 140 bp, Artificial Sequence
  Synthetic
atacgccatgctgggtctccgtgcgactagtcgtgctcgcaaccgccacaccaccagggtccgtgacaaccccccatcccaacatagaggaagtcgccttgccgacgacgggagagataccgtacttgggagtcggccat

SEQ ID NO: 392938 - DNA, 140 bp, Artificial Sequence
  Synthetic
atggccgactcccaagtacggtatctctcccgtcgtcggcaaggcgacttcctctatgttgggatggggggttgtcacggaccctggtggtgtggcggttgcgagcacgactagtcgcacggagacccagcatggcgtat

SEQ ID NO: 392939 - DNA, 140 bp, Artificial Sequence
  Synthetic
aggccctggctgctgatatggtctaccacggggccggaacaaggaccatcgcgtcacccaagggtcctgttatccagatgtataccaatgtagaccaagacctcgtaggctggcccgctcgaccttttgggacagcggtg

SEQ ID NO: 392940 - DNA, 140 bp, Artificial Sequence
  Synthetic
caccgctgtcccaaaaggtcgagcgggccagcctacgaggtcttggtctacattggtatacatctggataacaggacccttgggtgacgcgatggtccttgttccggccccgtggtagaccatatcagcagccagggcct

SEQ ID NO: 392941 - DNA, 140 bp, Artificial Sequence
  Synthetic
aggccctggctgctgatatgtcctagcgggcatagcgtatttctccatggtggggaattgggcgaaggtcctggtagtgctgttgctgtttgccggcgtcgatgcggaaacccacaccacgaccttttgggacagcggtg

SEQ ID NO: 392942 - DNA, 140 bp, Artificial Sequence
  Synthetic
caccgctgtcccaaaaggtcgtggtgtgggtttccgcatcgacgccggcaaacagcaacagcactaccaggaccttcgcccaattccccaccatggagaaatacgctatgcccgctaggacatatcagcagccagggcct

SEQ ID NO: 392943 - DNA, 140 bp, Artificial Sequence
  Synthetic
aggccctggctgctgatatgatgactggctacactggtgattttgactcggtcatagattgcaacacgtctgtcatacagactgttgacttcagtctagaccctaccttttcaatagagagaccttttgggacagcggtg

SEQ ID NO: 392944 - DNA, 140 bp, Artificial Sequence
  Synthetic
caccgctgtcccaaaaggtctctctattgaaaaggtagggtctagactgaagtcaacagtctgtatgacagacgtgttgcaatctatgaccgagtcaaaatcaccagtgtagccagtcatcatatcagcagccagggcct

SEQ ID NO: 392945 - DNA, 140 bp, Artificial Sequence
  Synthetic
aggccctggctgctgatatggcgtggagtcagagaataaggtagtaattctggactctttcgagccgcttcatgcggaggaagatgagagggaagtatccgtcccggcggagatcctgcggaccttttgggacagcggtg

SEQ ID NO: 392946 - DNA, 140 bp, Artificial Sequence
  Synthetic
caccgctgtcccaaaaggtccgcaggatctccgccgggacggatacttccctctcatcttcctccgcatgaagcggctcgaaagagtccagaattactaccttattctctgactccacgccatatcagcagccagggcct

SEQ ID NO: 392947 - DNA, 140 bp, Artificial Sequence
  Synthetic
atacgccatgctgggtctccgccatccggcatgtttgacacttcagtgctctgtgagtgctatgacgctgggtgcgcttggtatgaactaacaccagctgaaacaacaaccaggttgagacgtacttgggagtcggccat

SEQ ID NO: 392948 - DNA, 140 bp, Artificial Sequence
  Synthetic
atggccgactcccaagtacgtctcaacctggttgttgtttcagctggtgttagttcataccaagcgcacccagcgtcatagcactcacagagcactgaagtgtcaaacatgccggatggcggagacccagcatggcgtat

SEQ ID NO: 392949 - DNA, 140 bp, Artificial Sequence
  Synthetic
aggccctggctgctgatatggtggtacacgggtgcccattgccacctaccaaggcccctccaataccacctccacggagaaagaggacggttgtcctaacagaatccaccgtgtcctctggaccttttgggacagcggtg

SEQ ID NO: 392950 - DNA, 140 bp, Artificial Sequence
  Synthetic
caccgctgtcccaaaaggtccagaggacacggtggattctgttaggacaaccgtcctctttctccgtggaggtggtattggaggggccttggtaggtggcaatgggcacccgtgtaccaccatatcagcagccagggcct

SEQ ID NO: 392951 - DNA, 140 bp, Artificial Sequence
  Synthetic
aggccctggctgctgatatggtcgacagcggcacggcgaccgcccctcctgaccagccctccgacgacggcgacgcaggatccgacgttgagtcgtactcctccatgcccccccttgagggaccttttgggacagcggtg

SEQ ID NO: 392952 - DNA, 140 bp, Artificial Sequence
  Synthetic
caccgctgtcccaaaaggtccctcaagggggggcatggaggagtacgactcaacgtcggatcctgcgtcgccgtcgtcggagggctggtcaggaggggcggtcgccgtgccgctgtcgaccatatcagcagccagggcct

SEQ ID NO: 392953 - DNA, 140 bp, Artificial Sequence
  Synthetic
aggccctggctgctgatatgataaccaaatacatcatggcttgcatgtcagcagaccttgaagtggtgaccagcacgtgggtcttggtaggcggtgtcctggcggccgtagctgcatactgaccttttgggacagcggtg

SEQ ID NO: 392954 - DNA, 140 bp, Artificial Sequence
  Synthetic
caccgctgtcccaaaaggtcagtatgcagctacggccgccaggacaccgcctaccaagacccacgtgctggtcaccacttcaaggtctgctgacatgcaagccatgatgtatttggttatcatatcagcagccagggcct

SEQ ID NO: 392955 - DNA, 140 bp, Artificial Sequence
  Synthetic
aggccctggctgctgatatgaatggaggaatgttccaaacatcttccactagtcgagcacggactgcaattggcagagcagttcaaacagaaggccctcggtgtgctgagcgtcgccagtgaccttttgggacagcggtg

SEQ ID NO: 392956 - DNA, 140 bp, Artificial Sequence
  Synthetic
caccgctgtcccaaaaggtcactggcgacgctcagcacaccgagggccttctgtttgaactgctctgccaattgcagtccgtgctcgactagtggaagatgtttggaacattcctccattcatatcagcagccagggcct

SEQ ID NO: 392957 - DNA, 140 bp, Artificial Sequence
  Synthetic
aggccctggctgctgatatgatcttgctgggttatccaccttacccggcaaccccgctatagcttccctaatgtccttcaccgcagctgttaccagcccattaaccacccaacagactctgaccttttgggacagcggtg

SEQ ID NO: 392958 - DNA, 140 bp, Artificial Sequence
  Synthetic
caccgctgtcccaaaaggtcagagtctgttgggtggttaatgggctggtaacagctgcggtgaaggacattagggaagctatagcggggttgccgggtaaggtggataacccagcaagatcatatcagcagccagggcct

SEQ ID NO: 392959 - DNA, 140 bp, Artificial Sequence
  Synthetic
atacgccatgctgggtctccgctgcccgcgtaacagccatactctcatctctgactgtgacatccctcttgaggagactgcacaagtggatcaatgaagactgccctactccgtgtgactcgtacttgggagtcggccat

SEQ ID NO: 392960 - DNA, 140 bp, Artificial Sequence
  Synthetic
atggccgactcccaagtacgagtcacacggagtagggcagtcttcattgatccacttgtgcagtctcctcaagagggatgtcacagtcagagatgagagtatggctgttacgcgggcagcggagacccagcatggcgtat

SEQ ID NO: 392961 - DNA, 140 bp, Artificial Sequence
  Synthetic
atacgccatgctgggtctccgtcctgtagtggtaggcaccaccgacaggctcggcgtccccacatacaactggggggaaaatgagacagatgtcatcatcctcaactcgaccagacctcccgtacttgggagtcggccat
